United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 90

SEQ ID NO: 4088652 - RNA, 21 nt, Variola virus
aucuauaacaugcuaaaccuu

SEQ ID NO: 4088653 - RNA, 21 nt, Variola virus
aucuauaauguuauuaaccuc

SEQ ID NO: 4088654 - RNA, 21 nt, Variola virus
aucuauacgaccgauaagaga

SEQ ID NO: 4088655 - RNA, 22 nt, Variola virus
aucuauauauguauuuuaauaa

SEQ ID NO: 4088656 - RNA, 20 nt, Variola virus
aucuaucagagaccauguau

SEQ ID NO: 4088657 - RNA, 22 nt, Variola virus
aucuaucuuugcauucugaaac

SEQ ID NO: 4088658 - RNA, 19 nt, Variola virus
aucuaugguuuccauaauu

SEQ ID NO: 4088659 - RNA, 17 nt, Variola virus
aucuaugucuuuaucca

SEQ ID NO: 4088660 - RNA, 21 nt, Variola virus
aucuauuaaacagaaauggug

SEQ ID NO: 4088661 - RNA, 18 nt, Variola virus
aucuauuuucuugucaug

SEQ ID NO: 4088662 - RNA, 20 nt, Variola virus
aucucaccugccauaaauaa

SEQ ID NO: 4088663 - RNA, 15 nt, Variola virus
aucucagugcaaaga

SEQ ID NO: 4088664 - RNA, 19 nt, Variola virus
aucucauuaagcuaauaga

SEQ ID NO: 4088665 - RNA, 19 nt, Variola virus
aucuccacuuuugcuuuac

SEQ ID NO: 4088666 - RNA, 14 nt, Variola virus
aucuccaucaaaug

SEQ ID NO: 4088667 - RNA, 15 nt, Variola virus
aucucgccaaaauau

SEQ ID NO: 4088668 - RNA, 14 nt, Variola virus
aucucgucuaaauu

SEQ ID NO: 4088669 - RNA, 15 nt, Variola virus
aucucguuuagaaaa

SEQ ID NO: 4088670 - RNA, 23 nt, Variola virus
aucucuaaauaccucauaaaaca

SEQ ID NO: 4088671 - RNA, 15 nt, Variola virus
aucucuagacaauuu

SEQ ID NO: 4088672 - RNA, 21 nt, Variola virus
aucucugacaccaaccuguau

SEQ ID NO: 4088673 - RNA, 13 nt, Variola virus
auaguaaaguaac

SEQ ID NO: 4088674 - RNA, 19 nt, Variola virus
auaguaacuauguaaauga

SEQ ID NO: 4088675 - RNA, 18 nt, Variola virus
auaguauuaaugauugcc

SEQ ID NO: 4088676 - RNA, 15 nt, Variola virus
auaguauucuuguau

SEQ ID NO: 4088677 - RNA, 13 nt, Variola virus
auagucauagcau

SEQ ID NO: 4088678 - RNA, 14 nt, Variola virus
auaguccagaaaug

SEQ ID NO: 4088679 - RNA, 14 nt, Variola virus
auaguccauagcaa

SEQ ID NO: 4088680 - RNA, 20 nt, Variola virus
auagugacauaaacauagaa

SEQ ID NO: 4088681 - RNA, 14 nt, Variola virus
auagugauaaguaa

SEQ ID NO: 4088682 - RNA, 19 nt, Variola virus
auaguuacagaauuuguau

SEQ ID NO: 4088683 - RNA, 23 nt, Variola virus
auaguuaucuaucuuaaagacua

SEQ ID NO: 4088684 - RNA, 22 nt, Variola virus
auaguuguaauaaaaagggaaa

SEQ ID NO: 4088685 - RNA, 22 nt, Variola virus
auaguuuucucuauucugaaau

SEQ ID NO: 4088686 - RNA, 14 nt, Variola virus
auauaaaaaaauga

SEQ ID NO: 4088687 - RNA, 20 nt, Variola virus
auauaaauccaguaauauca

SEQ ID NO: 4088688 - RNA, 14 nt, Variola virus
auauaauuguugua

SEQ ID NO: 4088689 - RNA, 16 nt, Variola virus
auauacaaaugcaaua

SEQ ID NO: 4088690 - RNA, 15 nt, Variola virus
auauacauuguauaa

SEQ ID NO: 4088691 - RNA, 22 nt, Variola virus
auauacauuuucaaauaauaaa

SEQ ID NO: 4088692 - RNA, 17 nt, Variola virus
auauacguguacuguau

SEQ ID NO: 4088693 - RNA, 11 nt, Variola virus
auauagacaaa

SEQ ID NO: 4088694 - RNA, 21 nt, Variola virus
auauagagaucgaaaaaagag

SEQ ID NO: 4088695 - RNA, 15 nt, Variola virus
auauagaucaaucau

SEQ ID NO: 4088696 - RNA, 14 nt, Variola virus
auauagaugucaau

SEQ ID NO: 4088697 - RNA, 22 nt, Variola virus
auauagcggaugaaaaauuugu

SEQ ID NO: 4088698 - RNA, 15 nt, Variola virus
auauagguuacuaga

SEQ ID NO: 4088699 - RNA, 14 nt, Variola virus
auauaguaccuaga

SEQ ID NO: 4088700 - RNA, 21 nt, Variola virus
auauagucuguguuacauaau

SEQ ID NO: 4088701 - RNA, 18 nt, Variola virus
auauagugaaacaaaaua

SEQ ID NO: 4088702 - RNA, 14 nt, Variola virus
auauaguuaauagu

SEQ ID NO: 4088703 - RNA, 23 nt, Variola virus
auauaguuuuggaucaaauggau

SEQ ID NO: 4088704 - RNA, 21 nt, Variola virus
auauaguuuuuacacauagau

SEQ ID NO: 4088705 - RNA, 13 nt, Variola virus
auauauagaauga

SEQ ID NO: 4088706 - RNA, 20 nt, Variola virus
auauaucaguuaaugcaucu

SEQ ID NO: 4088707 - RNA, 18 nt, Variola virus
auauaucccuuaaaaauu

SEQ ID NO: 4088708 - RNA, 15 nt, Variola virus
auauaugacauaaua

SEQ ID NO: 4088709 - RNA, 17 nt, Variola virus
auauauucgaauucaaa

SEQ ID NO: 4088710 - RNA, 24 nt, Variola virus
auauauucuuacaguacauaguau

SEQ ID NO: 4088711 - RNA, 12 nt, Variola virus
auauauuguuaa

SEQ ID NO: 4088712 - RNA, 23 nt, Variola virus
auauauuuucacuuuaucucauu

SEQ ID NO: 4088713 - RNA, 12 nt, Variola virus
auauauuuucca

SEQ ID NO: 4088714 - RNA, 15 nt, Variola virus
auaucaaauggauau

SEQ ID NO: 4088715 - RNA, 15 nt, Variola virus
auaucacaaaaauaa

SEQ ID NO: 4088716 - RNA, 17 nt, Variola virus
auaucacauuguauaua

SEQ ID NO: 4088717 - RNA, 17 nt, Variola virus
auaucagacgauccaca

SEQ ID NO: 4088718 - RNA, 14 nt, Variola virus
auaucaggaaaugu

SEQ ID NO: 4088719 - RNA, 11 nt, Variola virus
auaucauauau

SEQ ID NO: 4088720 - RNA, 12 nt, Variola virus
auaucauauucu

SEQ ID NO: 4088721 - RNA, 23 nt, Variola virus
auaucaucacaacuuaaugaaga

SEQ ID NO: 4088722 - RNA, 20 nt, Variola virus
auaucauuaggauuuaacuc

SEQ ID NO: 4088723 - RNA, 22 nt, Variola virus
auauccgguguuaaaaaaauua

SEQ ID NO: 4088724 - RNA, 19 nt, Variola virus
auauccguuaaguuuguau

SEQ ID NO: 4088725 - RNA, 17 nt, Variola virus
auauccguuaugucuuc

SEQ ID NO: 4088726 - RNA, 16 nt, Variola virus
auaucgauguuaauaa

SEQ ID NO: 4088727 - RNA, 17 nt, Variola virus
auaucggaauaaguaga

SEQ ID NO: 4088728 - RNA, 21 nt, Variola virus
auaucgguaccguuaaagaug

SEQ ID NO: 4088729 - RNA, 19 nt, Variola virus
auaucuacaaauuggagau

SEQ ID NO: 4088730 - RNA, 16 nt, Variola virus
auaucuauaugagaug

SEQ ID NO: 4088731 - RNA, 16 nt, Variola virus
auaucuauucagauac

SEQ ID NO: 4088732 - RNA, 12 nt, Variola virus
auaucugaugau

SEQ ID NO: 4088733 - RNA, 22 nt, Variola virus
auaucugauuuuucuucauuua

SEQ ID NO: 4088734 - RNA, 18 nt, Variola virus
auaucuuaaucauauucu

SEQ ID NO: 4088735 - RNA, 17 nt, Variola virus
auaucuuagaauauugu

SEQ ID NO: 4088736 - RNA, 19 nt, Variola virus
auaucuuuagauauaucca

SEQ ID NO: 4088737 - RNA, 15 nt, Variola virus
auaucuuuaugaauu

SEQ ID NO: 4088738 - RNA, 12 nt, Variola virus
auaugacauaau

SEQ ID NO: 4088739 - RNA, 12 nt, Variola virus
auaugacaugau

SEQ ID NO: 4088740 - RNA, 15 nt, Variola virus
auaugacuaacuuau

SEQ ID NO: 4088741 - RNA, 18 nt, Variola virus
auaugauucuaaccuaga

SEQ ID NO: 4088742 - RNA, 17 nt, Variola virus
auaugcuaguuaauagu

SEQ ID NO: 4088743 - RNA, 22 nt, Variola virus
auauggaaaaguucaacaugau

SEQ ID NO: 4088744 - RNA, 18 nt, Variola virus
auauggauauucauagau

SEQ ID NO: 4088745 - RNA, 18 nt, Variola virus
auauguaaauauuaauaa

SEQ ID NO: 4088746 - RNA, 17 nt, Variola virus
auaugucuguacaaaug

SEQ ID NO: 4088747 - RNA, 15 nt, Variola virus
auauguuauaauaga

SEQ ID NO: 4088748 - RNA, 17 nt, Variola virus
auauuaaacacuaguau

SEQ ID NO: 4088749 - RNA, 17 nt, Variola virus
auauuaaagucaaauaa

SEQ ID NO: 4088750 - RNA, 18 nt, Variola virus
auauuaaugacgaauuga

SEQ ID NO: 4088751 - RNA, 21 nt, Variola virus
auauuaggcacagucaaacau

SEQ ID NO: 4088752 - RNA, 12 nt, Variola virus
auauuauacaaa

SEQ ID NO: 4088753 - RNA, 15 nt, Variola virus
auauuauauaaacau

SEQ ID NO: 4088754 - RNA, 18 nt, Variola virus
auauuaucaccuauugcc

SEQ ID NO: 4088755 - RNA, 20 nt, Variola virus
auauucaguaaccaaauaca

SEQ ID NO: 4088756 - RNA, 15 nt, Variola virus
auauucccaaacaua

SEQ ID NO: 4088757 - RNA, 18 nt, Variola virus
auauucgauaacagcauu

SEQ ID NO: 4088758 - RNA, 18 nt, Variola virus
auauucguucaauacaaa

SEQ ID NO: 4088759 - RNA, 23 nt, Variola virus
auauucuauaacuugagacuuga

SEQ ID NO: 4088760 - RNA, 13 nt, Variola virus
auauucuaugaug

SEQ ID NO: 4088761 - RNA, 16 nt, Variola virus
auauucucauggaaau

SEQ ID NO: 4088762 - RNA, 14 nt, Variola virus
auauucuguugugu

SEQ ID NO: 4088763 - RNA, 16 nt, Variola virus
auauucuguuguguca

SEQ ID NO: 4088764 - RNA, 14 nt, Variola virus
auauucuuucuugu

SEQ ID NO: 4088765 - RNA, 20 nt, Variola virus
auauugauaucuuuuugaau

SEQ ID NO: 4088766 - RNA, 19 nt, Variola virus
auauuggagcaaaauccua

SEQ ID NO: 4088767 - RNA, 19 nt, Variola virus
acauugcuaugugaugaau

SEQ ID NO: 4088768 - RNA, 23 nt, Variola virus
acauuggcgccguuuaauuuccu

SEQ ID NO: 4088769 - RNA, 16 nt, Variola virus
acauuguauuaugaug

SEQ ID NO: 4088770 - RNA, 15 nt, Variola virus
acauuuccuacauau

SEQ ID NO: 4088771 - RNA, 16 nt, Variola virus
acauuuuuuguuuugg

SEQ ID NO: 4088772 - RNA, 15 nt, Variola virus
accaaaaaaaauaac

SEQ ID NO: 4088773 - RNA, 18 nt, Variola virus
accaaaaucaauauauca

SEQ ID NO: 4088774 - RNA, 13 nt, Variola virus
accaaacauucuu

SEQ ID NO: 4088775 - RNA, 13 nt, Variola virus
accaaauuuuaca

SEQ ID NO: 4088776 - RNA, 17 nt, Variola virus
accaagaaaucguauau

SEQ ID NO: 4088777 - RNA, 20 nt, Variola virus
accaaguaaugaucaucuau

SEQ ID NO: 4088778 - RNA, 14 nt, Variola virus
accaauaaacuauu

SEQ ID NO: 4088779 - RNA, 23 nt, Variola virus
accaccuauagauuuugaauauu

SEQ ID NO: 4088780 - RNA, 13 nt, Variola virus
accacuagcaaaa

SEQ ID NO: 4088781 - RNA, 18 nt, Variola virus
accacuuauuacuccauu

SEQ ID NO: 4088782 - RNA, 15 nt, Variola virus
accagaugucauuau

SEQ ID NO: 4088783 - RNA, 17 nt, Variola virus
accaggguuuauuucau

SEQ ID NO: 4088784 - RNA, 22 nt, Variola virus
accaguucauucaagauaagca

SEQ ID NO: 4088785 - RNA, 16 nt, Variola virus
accauagaagauguua

SEQ ID NO: 4088786 - RNA, 21 nt, Variola virus
accaucucauaaaauaguucu

SEQ ID NO: 4088787 - RNA, 13 nt, Variola virus
accaugaaauaua

SEQ ID NO: 4088788 - RNA, 19 nt, Variola virus
accaugucguuaacuauaa

SEQ ID NO: 4088789 - RNA, 17 nt, Variola virus
acccaacaauacauuua

SEQ ID NO: 4088790 - RNA, 15 nt, Variola virus
acccaagaacaaugu

SEQ ID NO: 4088791 - RNA, 15 nt, Variola virus
acccaguuaguuuua

SEQ ID NO: 4088792 - RNA, 17 nt, Variola virus
acccguaguuuuaacug

SEQ ID NO: 4088793 - RNA, 15 nt, Variola virus
accgaaauuaucacu

SEQ ID NO: 4088794 - RNA, 14 nt, Variola virus
accuaagggauuuu

SEQ ID NO: 4088795 - RNA, 21 nt, Variola virus
accuagaaucgauaaaaccau

SEQ ID NO: 4088796 - RNA, 14 nt, Variola virus
accucuacaaauau

SEQ ID NO: 4088797 - RNA, 18 nt, Variola virus
accucuccuauaugaaua

SEQ ID NO: 4088798 - RNA, 16 nt, Variola virus
accuguauuauuugcg

SEQ ID NO: 4088799 - RNA, 23 nt, Variola virus
accuucuaaugauauauuuucca

SEQ ID NO: 4088800 - RNA, 15 nt, Variola virus
acgaaccaaaaugaa

SEQ ID NO: 4088801 - RNA, 21 nt, Variola virus
acgaaccagaaagugcaaaug

SEQ ID NO: 4088802 - RNA, 13 nt, Variola virus
acgaauaaaagaa

SEQ ID NO: 4088803 - RNA, 12 nt, Variola virus
acgaauaaagcg

SEQ ID NO: 4088804 - RNA, 23 nt, Variola virus
acgaauauaaaucauauuuagaa

SEQ ID NO: 4088805 - RNA, 15 nt, Variola virus
acgaaugguuucauc

SEQ ID NO: 4088806 - RNA, 16 nt, Variola virus
acgacucacaauagaa

SEQ ID NO: 4088807 - RNA, 19 nt, Variola virus
acgacucauuuaguuuauu

SEQ ID NO: 4088808 - RNA, 16 nt, Variola virus
acgacuuauaauuaau

SEQ ID NO: 4088809 - RNA, 22 nt, Variola virus
acgacuuucucgcgucauauau

SEQ ID NO: 4088810 - RNA, 18 nt, Variola virus
acgagccacuacuccucg

SEQ ID NO: 4088811 - RNA, 16 nt, Variola virus
acgaguauagcaucau

SEQ ID NO: 4088812 - RNA, 21 nt, Variola virus
acgauaaugugguuacucuuc

SEQ ID NO: 4088813 - RNA, 15 nt, Variola virus
acgauacaucuguuu

SEQ ID NO: 4088814 - RNA, 14 nt, Variola virus
acgauauuagaauu

SEQ ID NO: 4088815 - RNA, 21 nt, Variola virus
acgauauuaucgacuaugaau

SEQ ID NO: 4088816 - RNA, 20 nt, Variola virus
acgauccaaacaauguuucu

SEQ ID NO: 4088817 - RNA, 22 nt, Variola virus
acgaucgauacuuugguuuauu

SEQ ID NO: 4088818 - RNA, 21 nt, Variola virus
acgaugauauuaaaauuauuu

SEQ ID NO: 4088819 - RNA, 15 nt, Variola virus
acgaugauuucugaa

SEQ ID NO: 4088820 - RNA, 21 nt, Variola virus
acgaugguuaaaauuaacaag

SEQ ID NO: 4088821 - RNA, 18 nt, Variola virus
acgauuaucuauuaaaga

SEQ ID NO: 4088822 - RNA, 21 nt, Variola virus
acgauuauuucuaaauuauuc

SEQ ID NO: 4088823 - RNA, 15 nt, Variola virus
acgcaauaucucaau

SEQ ID NO: 4088824 - RNA, 14 nt, Variola virus
acgcauccauccaa

SEQ ID NO: 4088825 - RNA, 17 nt, Variola virus
acgcaucuguaaaagaa

SEQ ID NO: 4088826 - RNA, 17 nt, Variola virus
acgccaauacauguuuu

SEQ ID NO: 4088827 - RNA, 14 nt, Variola virus
acgcgaaaaaagau

SEQ ID NO: 4088828 - RNA, 14 nt, Variola virus
acgcguauauguuu

SEQ ID NO: 4088829 - RNA, 15 nt, Variola virus
acggaaguaaacgaa

SEQ ID NO: 4088830 - RNA, 16 nt, Variola virus
acggacaaucuaaaaa

SEQ ID NO: 4088831 - RNA, 13 nt, Variola virus
acggauauggaug

SEQ ID NO: 4088832 - RNA, 16 nt, Variola virus
acggcaaaagauauau

SEQ ID NO: 4088833 - RNA, 14 nt, Variola virus
acggcgucauauag

SEQ ID NO: 4088834 - RNA, 18 nt, Variola virus
acgggcgcuguaauuaau

SEQ ID NO: 4088835 - RNA, 22 nt, Variola virus
acguaaaugugugcgaaaauac

SEQ ID NO: 4088836 - RNA, 18 nt, Variola virus
acguaaugaaguuaauga

SEQ ID NO: 4088837 - RNA, 15 nt, Variola virus
acguagaaaauggau

SEQ ID NO: 4088838 - RNA, 15 nt, Variola virus
acgucaucaaaaaua

SEQ ID NO: 4088839 - RNA, 16 nt, Variola virus
acgucaucaaaaauag

SEQ ID NO: 4088840 - RNA, 13 nt, Variola virus
acguuaaacauua

SEQ ID NO: 4088841 - RNA, 13 nt, Variola virus
acguuaauacaaa

SEQ ID NO: 4088842 - RNA, 18 nt, Variola virus
acguuguacguuaaagca

SEQ ID NO: 4088843 - RNA, 22 nt, Variola virus
acguuugguaauggcaauguau

SEQ ID NO: 4088844 - RNA, 18 nt, Variola virus
acuaaaaaacgaaauaua

SEQ ID NO: 4088845 - RNA, 22 nt, Variola virus
acuaaacuaugcgaugucuugg

SEQ ID NO: 4088846 - RNA, 16 nt, Variola virus
acuaaagaaacgaaua

SEQ ID NO: 4088847 - RNA, 13 nt, Variola virus
acuaaauacauua

SEQ ID NO: 4088848 - RNA, 15 nt, Variola virus
acuaacacauuucaa

SEQ ID NO: 4088849 - RNA, 16 nt, Variola virus
acuaacuaauguuucu

SEQ ID NO: 4088850 - RNA, 17 nt, Variola virus
acuaaguucugcauuca

SEQ ID NO: 4088851 - RNA, 14 nt, Variola virus
acuaauaaacauuc

SEQ ID NO: 4088852 - RNA, 17 nt, Variola virus
acuaauucauuuucaau

SEQ ID NO: 4088853 - RNA, 14 nt, Variola virus
acuacaauauuuca

SEQ ID NO: 4088854 - RNA, 18 nt, Variola virus
acuacaauauuucaucau

SEQ ID NO: 4088855 - RNA, 22 nt, Variola virus
acuacauaguuaucuaucuuaa

SEQ ID NO: 4088856 - RNA, 11 nt, Variola virus
acuacauaucc

SEQ ID NO: 4088857 - RNA, 16 nt, Variola virus
acuaccgaguuuaaaa

SEQ ID NO: 4088858 - RNA, 17 nt, Variola virus
acuacguucauauucca

SEQ ID NO: 4088859 - RNA, 16 nt, Variola virus
acuacugaagaacuaa

SEQ ID NO: 4088860 - RNA, 18 nt, Variola virus
acuacugccauuaauauc

SEQ ID NO: 4088861 - RNA, 20 nt, Variola virus
acuacuuuaucauagucuaa

SEQ ID NO: 4088862 - RNA, 23 nt, Variola virus
acuagauaaacuaucaguaaguu

SEQ ID NO: 4088863 - RNA, 16 nt, Variola virus
acuagauuauacaaug

SEQ ID NO: 4088864 - RNA, 21 nt, Variola virus
acuaguauaaaaucuguaucg

SEQ ID NO: 4088865 - RNA, 20 nt, Variola virus
acuaguggcagacugugcau

SEQ ID NO: 4088866 - RNA, 16 nt, Variola virus
acuauaaaauaaaaga

SEQ ID NO: 4088867 - RNA, 18 nt, Variola virus
acuauaaacuaaaaauua

SEQ ID NO: 4088868 - RNA, 22 nt, Variola virus
acuauaggugucccgucaguau

SEQ ID NO: 4088869 - RNA, 14 nt, Variola virus
acuaugcacauuau

SEQ ID NO: 4088870 - RNA, 16 nt, Variola virus
acuaugucaaaaauug

SEQ ID NO: 4088871 - RNA, 14 nt, Variola virus
acuauguuagcauu

SEQ ID NO: 4088872 - RNA, 19 nt, Variola virus
acuauguuagcauuucuau

SEQ ID NO: 4088873 - RNA, 19 nt, Variola virus
acuauuagaauuaaguaga

SEQ ID NO: 4088874 - RNA, 16 nt, Variola virus
acuauuauuuguuaua

SEQ ID NO: 4088875 - RNA, 22 nt, Variola virus
acuauuccuagcaucagcaaaa

SEQ ID NO: 4088876 - RNA, 20 nt, Variola virus
acuauugaaguacuuaauga

SEQ ID NO: 4088877 - RNA, 22 nt, Variola virus
acuauugaaguacuuaaugaag

SEQ ID NO: 4088878 - RNA, 19 nt, Variola virus
acuauugcaucaaaaggau

SEQ ID NO: 4088879 - RNA, 15 nt, Variola virus
acuauuuuauaccuu

SEQ ID NO: 4088880 - RNA, 16 nt, Variola virus
acucaauuauacucua

SEQ ID NO: 4088881 - RNA, 14 nt, Variola virus
acucacguuaauaa

SEQ ID NO: 4088882 - RNA, 14 nt, Variola virus
acucagaagacuau

SEQ ID NO: 4088883 - RNA, 17 nt, Variola virus
acucauaaauaaaaaug

SEQ ID NO: 4088884 - RNA, 18 nt, Variola virus
acucauaagaaagagaau

SEQ ID NO: 4088885 - RNA, 18 nt, Variola virus
acucauauaguauugaac

SEQ ID NO: 4088886 - RNA, 10 nt, Variola virus
aaaaaacaac

SEQ ID NO: 4088887 - RNA, 12 nt, Variola virus
aaaaaagaauca

SEQ ID NO: 4088888 - RNA, 11 nt, Variola virus
aaaaaaugauc

SEQ ID NO: 4088889 - RNA, 18 nt, Variola virus
aaaaaauuacuccaugga

SEQ ID NO: 4088890 - RNA, 19 nt, Variola virus
aaaaacaucacgaaaucua

SEQ ID NO: 4088891 - RNA, 14 nt, Variola virus
aaaaacgaugauau

SEQ ID NO: 4088892 - RNA, 16 nt, Variola virus
aaaaagaaagaauaua

SEQ ID NO: 4088893 - RNA, 15 nt, Variola virus
aaaaagaauguauca

SEQ ID NO: 4088894 - RNA, 13 nt, Variola virus
aaaaagauguauu

SEQ ID NO: 4088895 - RNA, 19 nt, Variola virus
aaaaagauuucagaaucua

SEQ ID NO: 4088896 - RNA, 19 nt, Variola virus
aaaaagcuccauauuacaa

SEQ ID NO: 4088897 - RNA, 16 nt, Variola virus
aaaaaguuaagaauua

SEQ ID NO: 4088898 - RNA, 13 nt, Variola virus
aaaaauaacaauu

SEQ ID NO: 4088899 - RNA, 15 nt, Variola virus
aaaaaucgauuuuau

SEQ ID NO: 4088900 - RNA, 12 nt, Variola virus
aaaaaucucacc

SEQ ID NO: 4088901 - RNA, 21 nt, Variola virus
aaaaaucugauagaaagaaua

SEQ ID NO: 4088902 - RNA, 17 nt, Variola virus
aaaaaugaaaauaaaua

SEQ ID NO: 4088903 - RNA, 14 nt, Variola virus
aaaaaugaugaauu

SEQ ID NO: 4088904 - RNA, 19 nt, Variola virus
agcgcugaaaauaaagaua

SEQ ID NO: 4088905 - RNA, 19 nt, Variola virus
agcggauaaugauagaauu

SEQ ID NO: 4088906 - RNA, 14 nt, Variola virus
agcgguguuauuau

SEQ ID NO: 4088907 - RNA, 18 nt, Variola virus
agcuaaaauauuuucuag

SEQ ID NO: 4088908 - RNA, 15 nt, Variola virus
agcuaauaccaauuu

SEQ ID NO: 4088909 - RNA, 17 nt, Variola virus
agcuaucaagucuuuau

SEQ ID NO: 4088910 - RNA, 14 nt, Variola virus
agcuaugaacuugu

SEQ ID NO: 4088911 - RNA, 17 nt, Variola virus
agcuauguuuacggcug

SEQ ID NO: 4088912 - RNA, 19 nt, Variola virus
agcuauugcauaauacaag

SEQ ID NO: 4088913 - RNA, 23 nt, Variola virus
agcuccuaauggagauuuucuau

SEQ ID NO: 4088914 - RNA, 16 nt, Variola virus
agcugaaaaacuaugu

SEQ ID NO: 4088915 - RNA, 21 nt, Variola virus
agcugaggguguuaaaaauga

SEQ ID NO: 4088916 - RNA, 19 nt, Variola virus
agcugauagcaauucaugu

SEQ ID NO: 4088917 - RNA, 14 nt, Variola virus
agcugcaucuaaau

SEQ ID NO: 4088918 - RNA, 20 nt, Variola virus
agcuggaaaaaguuguucca

SEQ ID NO: 4088919 - RNA, 18 nt, Variola virus
agcuguacaccauagcac

SEQ ID NO: 4088920 - RNA, 19 nt, Variola virus
agcugugaguauuaaugau

SEQ ID NO: 4088921 - RNA, 15 nt, Variola virus
agcuucguauacucu

SEQ ID NO: 4088922 - RNA, 12 nt, Variola virus
aggaaauacuug

SEQ ID NO: 4088923 - RNA, 14 nt, Variola virus
aggaacauacgaca

SEQ ID NO: 4088924 - RNA, 14 nt, Variola virus
aggaagaaaauauu

SEQ ID NO: 4088925 - RNA, 14 nt, Variola virus
aggaagcauauucu

SEQ ID NO: 4088926 - RNA, 20 nt, Variola virus
aggaauagaaaucuugaaua

SEQ ID NO: 4088927 - RNA, 13 nt, Variola virus
aggaauaugguuu

SEQ ID NO: 4088928 - RNA, 20 nt, Variola virus
aggaauuaaucuaguagaaa

SEQ ID NO: 4088929 - RNA, 19 nt, Variola virus
aggacauguaaacuugaca

SEQ ID NO: 4088930 - RNA, 13 nt, Variola virus
aggacuauuagaa

SEQ ID NO: 4088931 - RNA, 22 nt, Variola virus
aggagaugauagcuauuuaacu

SEQ ID NO: 4088932 - RNA, 13 nt, Variola virus
aggaguauacaga

SEQ ID NO: 4088933 - RNA, 21 nt, Variola virus
aggaguucaguuuuauaugau

SEQ ID NO: 4088934 - RNA, 14 nt, Variola virus
aggauaaauuauuu

SEQ ID NO: 4088935 - RNA, 12 nt, Variola virus
aggauaauacau

SEQ ID NO: 4088936 - RNA, 21 nt, Variola virus
aggauauacucaauagaauuu

SEQ ID NO: 4088937 - RNA, 19 nt, Variola virus
aggauaugauaaaaauaua

SEQ ID NO: 4088938 - RNA, 16 nt, Variola virus
aggauccauuuauagu

SEQ ID NO: 4088939 - RNA, 15 nt, Variola virus
aggaucgacuccaua

SEQ ID NO: 4088940 - RNA, 14 nt, Variola virus
aggaucuccaucaa

SEQ ID NO: 4088941 - RNA, 21 nt, Variola virus
aggaugaauuaucguuauuau

SEQ ID NO: 4088942 - RNA, 18 nt, Variola virus
aggauggaaagauaucag

SEQ ID NO: 4088943 - RNA, 19 nt, Variola virus
aggauggaauuaucaucaa

SEQ ID NO: 4088944 - RNA, 19 nt, Variola virus
aggauguauauaucaugau

SEQ ID NO: 4088945 - RNA, 18 nt, Variola virus
aggauguuauuaugaauc

SEQ ID NO: 4088946 - RNA, 19 nt, Variola virus
aggauuaacggguucucaa

SEQ ID NO: 4088947 - RNA, 19 nt, Variola virus
aggauuauaugauauaauu

SEQ ID NO: 4088948 - RNA, 18 nt, Variola virus
aggauucuccuaaauacg

SEQ ID NO: 4088949 - RNA, 12 nt, Variola virus
aggauucuuaau

SEQ ID NO: 4088950 - RNA, 17 nt, Variola virus
aggauuguauaaauuac

SEQ ID NO: 4088951 - RNA, 20 nt, Variola virus
aggauuuacuaaguaauuac

SEQ ID NO: 4088952 - RNA, 16 nt, Variola virus
aggcuacacaauagua

SEQ ID NO: 4088953 - RNA, 19 nt, Variola virus
aggcuuuaauaucuaaaua

SEQ ID NO: 4088954 - RNA, 14 nt, Variola virus
agggguauacuucu

SEQ ID NO: 4088955 - RNA, 19 nt, Variola virus
aggguauuggauauaucaa

SEQ ID NO: 4088956 - RNA, 20 nt, Variola virus
agguaauguauauuuaucca

SEQ ID NO: 4088957 - RNA, 13 nt, Variola virus
agguagcaaaaaa

SEQ ID NO: 4088958 - RNA, 16 nt, Variola virus
agguaguaaaaaauaa

SEQ ID NO: 4088959 - RNA, 14 nt, Variola virus
aggugaacaagaga

SEQ ID NO: 4088960 - RNA, 16 nt, Variola virus
aggugcaacaauuuuu

SEQ ID NO: 4088961 - RNA, 16 nt, Variola virus
aggugcugauguaaau

SEQ ID NO: 4088962 - RNA, 17 nt, Variola virus
agguguguuuuuuacca

SEQ ID NO: 4088963 - RNA, 21 nt, Variola virus
agguuacguauagucuauaug

SEQ ID NO: 4088964 - RNA, 20 nt, Variola virus
aguaaacauaucauaauauu

SEQ ID NO: 4088965 - RNA, 14 nt, Variola virus
aguaaaugcauaua

SEQ ID NO: 4088966 - RNA, 19 nt, Variola virus
aguaacuauugacuuaaua

SEQ ID NO: 4088967 - RNA, 14 nt, Variola virus
aguaagaacauaau

SEQ ID NO: 4088968 - RNA, 15 nt, Variola virus
aguaaguaugucgaa

SEQ ID NO: 4088969 - RNA, 13 nt, Variola virus
aguaaucaugaaa

SEQ ID NO: 4088970 - RNA, 18 nt, Variola virus
aguaaucauguaaauguu

SEQ ID NO: 4088971 - RNA, 16 nt, Variola virus
aguaaugaucaucuau

SEQ ID NO: 4088972 - RNA, 17 nt, Variola virus
aguaauuuguucaaaau

SEQ ID NO: 4088973 - RNA, 17 nt, Variola virus
aguacccuacuaccaac

SEQ ID NO: 4088974 - RNA, 17 nt, Variola virus
aguaccgauucuagaua

SEQ ID NO: 4088975 - RNA, 21 nt, Variola virus
aguacugcuuuuuucgaaaug

SEQ ID NO: 4088976 - RNA, 22 nt, Variola virus
aguacuucucccauaauacuuu

SEQ ID NO: 4088977 - RNA, 21 nt, Variola virus
aguacuuugaugauuuuucca

SEQ ID NO: 4088978 - RNA, 19 nt, Variola virus
aguagauaauauagaaaau

SEQ ID NO: 4088979 - RNA, 14 nt, Variola virus
aguagguuuaagaa

SEQ ID NO: 4088980 - RNA, 18 nt, Variola virus
aguagguuuaagaaguug

SEQ ID NO: 4088981 - RNA, 18 nt, Variola virus
aguagugauuuugaagau

SEQ ID NO: 4088982 - RNA, 15 nt, Variola virus
aguaguucaacauaa

SEQ ID NO: 4088983 - RNA, 13 nt, Variola virus
aguauaaaaauua

SEQ ID NO: 4088984 - RNA, 17 nt, Variola virus
aguauaaacgacauaau

SEQ ID NO: 4088985 - RNA, 22 nt, Variola virus
aguauaaacgacauaauacuca

SEQ ID NO: 4088986 - RNA, 14 nt, Variola virus
aguauaaacuauaa

SEQ ID NO: 4088987 - RNA, 19 nt, Variola virus
aguauaaaguccaacuauu

SEQ ID NO: 4088988 - RNA, 18 nt, Variola virus
aguauaagaaauuuacca

SEQ ID NO: 4088989 - RNA, 14 nt, Variola virus
aguauaaugauauc

SEQ ID NO: 4088990 - RNA, 16 nt, Variola virus
aguauaccaacuauau

SEQ ID NO: 4088991 - RNA, 22 nt, Variola virus
aguauaccaugaccuucuucau

SEQ ID NO: 4088992 - RNA, 18 nt, Variola virus
aguauacuaucgucauuu

SEQ ID NO: 4088993 - RNA, 12 nt, Variola virus
aguauacucuac

SEQ ID NO: 4088994 - RNA, 19 nt, Variola virus
aguauaucuacacauauau

SEQ ID NO: 4088995 - RNA, 18 nt, Variola virus
aguauauggacaaacgug

SEQ ID NO: 4088996 - RNA, 19 nt, Variola virus
aguauaugggcgauauucu

SEQ ID NO: 4088997 - RNA, 16 nt, Variola virus
aguaucaauaacacaa

SEQ ID NO: 4088998 - RNA, 16 nt, Variola virus
aguauccaucacuucu

SEQ ID NO: 4088999 - RNA, 18 nt, Variola virus
aguaucgcccuaauauua

SEQ ID NO: 4089000 - RNA, 14 nt, Variola virus
aguaucuaauggau

SEQ ID NO: 4089001 - RNA, 17 nt, Variola virus
aguaugaagaaaaaugu

SEQ ID NO: 4089002 - RNA, 19 nt, Variola virus
aguaugacguugaacuaau

SEQ ID NO: 4089003 - RNA, 18 nt, Variola virus
aguaugcagacaaaauga

SEQ ID NO: 4089004 - RNA, 17 nt, Variola virus
aguaugcuaaacuuuau

SEQ ID NO: 4089005 - RNA, 17 nt, Variola virus
aguauguauaucuauau

SEQ ID NO: 4089006 - RNA, 14 nt, Variola virus
aguaugugaauaga

SEQ ID NO: 4089007 - RNA, 12 nt, Variola virus
aguauuaaugau

SEQ ID NO: 4089008 - RNA, 20 nt, Variola virus
aguauugucaucaucaugau

SEQ ID NO: 4089009 - RNA, 15 nt, Variola virus
aguauuguuuaauaa

SEQ ID NO: 4089010 - RNA, 18 nt, Variola virus
aguauuguuuaguauuuu

SEQ ID NO: 4089011 - RNA, 22 nt, Variola virus
aguauuucuguggauuaauaga

SEQ ID NO: 4089012 - RNA, 20 nt, Variola virus
aguauuugagaaauauguau

SEQ ID NO: 4089013 - RNA, 16 nt, Variola virus
aguauuugauaaaaca

SEQ ID NO: 4089014 - RNA, 19 nt, Variola virus
aguauuuuucaaaaaaugu

SEQ ID NO: 4089015 - RNA, 17 nt, Variola virus
aguauuuuuuuucagua

SEQ ID NO: 4089016 - RNA, 15 nt, Variola virus
agucaaacauucaac

SEQ ID NO: 4089017 - RNA, 22 nt, Variola virus
agucaaauaaagcgaaaaauaa

SEQ ID NO: 4089018 - RNA, 16 nt, Variola virus
agucaaccaaauaaua

SEQ ID NO: 4089019 - RNA, 21 nt, Variola virus
agucacgauaucucuuaaaug

SEQ ID NO: 4089020 - RNA, 19 nt, Variola virus
agucagacuuguauucaac

SEQ ID NO: 4089021 - RNA, 20 nt, Variola virus
agucagcaucagcauuugac

SEQ ID NO: 4089022 - RNA, 16 nt, Variola virus
agucauaacaaaugua

SEQ ID NO: 4089023 - RNA, 16 nt, Variola virus
agucauaucuagaaug

SEQ ID NO: 4089024 - RNA, 17 nt, Variola virus
agucauguuaaaaauga

SEQ ID NO: 4089025 - RNA, 23 nt, Variola virus
agucauuugacuagauaaacuau

SEQ ID NO: 4089026 - RNA, 13 nt, Variola virus
agucgucaagcau

SEQ ID NO: 4089027 - RNA, 17 nt, Variola virus
agucuacugcuagaaaa

SEQ ID NO: 4089028 - RNA, 16 nt, Variola virus
agucuagguucacaau

SEQ ID NO: 4089029 - RNA, 22 nt, Variola virus
agucuauugccuuagauacuuu

SEQ ID NO: 4089030 - RNA, 17 nt, Variola virus
aucacauauuaaaauuc

SEQ ID NO: 4089031 - RNA, 18 nt, Variola virus
aucacuaucucccaggag

SEQ ID NO: 4089032 - RNA, 15 nt, Variola virus
aucacucuucgaaaa

SEQ ID NO: 4089033 - RNA, 18 nt, Variola virus
aucagaauaaaucaauau

SEQ ID NO: 4089034 - RNA, 17 nt, Variola virus
aucagaugauaucagua

SEQ ID NO: 4089035 - RNA, 15 nt, Variola virus
aucagauuauuuaac

SEQ ID NO: 4089036 - RNA, 18 nt, Variola virus
aucagauuauuuaacaau

SEQ ID NO: 4089037 - RNA, 20 nt, Variola virus
aucagcaucuugaauagaaa

SEQ ID NO: 4089038 - RNA, 16 nt, Variola virus
aucagcugaaaaacua

SEQ ID NO: 4089039 - RNA, 17 nt, Variola virus
aucaggaauccaaagag

SEQ ID NO: 4089040 - RNA, 15 nt, Variola virus
aucagguaaaacaau

SEQ ID NO: 4089041 - RNA, 19 nt, Variola virus
aucagucaagauacagaaa

SEQ ID NO: 4089042 - RNA, 14 nt, Variola virus
aucauaaagaacag

SEQ ID NO: 4089043 - RNA, 14 nt, Variola virus
aucauaaguuuaua

SEQ ID NO: 4089044 - RNA, 14 nt, Variola virus
aucauaccuccauc

SEQ ID NO: 4089045 - RNA, 14 nt, Variola virus
aucauauaucugaa

SEQ ID NO: 4089046 - RNA, 18 nt, Variola virus
aucauaucuucgaaaguu

SEQ ID NO: 4089047 - RNA, 19 nt, Variola virus
aucauauguagugguguaa

SEQ ID NO: 4089048 - RNA, 19 nt, Variola virus
aucauauuauaaagaugau

SEQ ID NO: 4089049 - RNA, 22 nt, Variola virus
aucauauuccggcguaugaauu

SEQ ID NO: 4089050 - RNA, 17 nt, Variola virus
aucaucaccuaucuugu

SEQ ID NO: 4089051 - RNA, 15 nt, Variola virus
aucaucaucugaaau

SEQ ID NO: 4089052 - RNA, 15 nt, Variola virus
aucauccguaucuuc

SEQ ID NO: 4089053 - RNA, 16 nt, Variola virus
aucauccguaucuucu

SEQ ID NO: 4089054 - RNA, 15 nt, Variola virus
aucaucuacaucacu

SEQ ID NO: 4089055 - RNA, 20 nt, Variola virus
aucaucuauagaucauguaa

SEQ ID NO: 4089056 - RNA, 13 nt, Variola virus
aucaucuuuauca

SEQ ID NO: 4089057 - RNA, 15 nt, Variola virus
aucaucuuuaucauu

SEQ ID NO: 4089058 - RNA, 15 nt, Variola virus
aucaugaauggauuu

SEQ ID NO: 4089059 - RNA, 21 nt, Variola virus
aucaugaauggauuuaucauc

SEQ ID NO: 4089060 - RNA, 13 nt, Variola virus
aucaugaugauuu

SEQ ID NO: 4089061 - RNA, 18 nt, Variola virus
aucaugcagagaaaaguu

SEQ ID NO: 4089062 - RNA, 20 nt, Variola virus
aucauggauuuuacauagau

SEQ ID NO: 4089063 - RNA, 17 nt, Variola virus
aucauguagaaaaauuc

SEQ ID NO: 4089064 - RNA, 15 nt, Variola virus
aucaugucacauagu

SEQ ID NO: 4089065 - RNA, 11 nt, Variola virus
aucaugucuaa

SEQ ID NO: 4089066 - RNA, 18 nt, Variola virus
aucaugucuaaugaugaa

SEQ ID NO: 4089067 - RNA, 21 nt, Variola virus
aucauuaaugauauaguuuuu

SEQ ID NO: 4089068 - RNA, 18 nt, Variola virus
aucauuaauuaauacaau

SEQ ID NO: 4089069 - RNA, 18 nt, Variola virus
aucauucauuccuccaua

SEQ ID NO: 4089070 - RNA, 23 nt, Variola virus
aucauucgauaagauagauucca

SEQ ID NO: 4089071 - RNA, 15 nt, Variola virus
aucauuuaaacauuu

SEQ ID NO: 4089072 - RNA, 19 nt, Variola virus
aucauuuaaacauuuaacu

SEQ ID NO: 4089073 - RNA, 13 nt, Variola virus
aucauuucuauaa

SEQ ID NO: 4089074 - RNA, 13 nt, Variola virus
aucauuucucaau

SEQ ID NO: 4089075 - RNA, 20 nt, Variola virus
aucauuugaugauauguuug

SEQ ID NO: 4089076 - RNA, 18 nt, Variola virus
auccaaauggaucucaua

SEQ ID NO: 4089077 - RNA, 15 nt, Variola virus
auccaagaaaaaguc

SEQ ID NO: 4089078 - RNA, 14 nt, Variola virus
auccaagauacuua

SEQ ID NO: 4089079 - RNA, 17 nt, Variola virus
auccaauauuauugaaa

SEQ ID NO: 4089080 - RNA, 21 nt, Variola virus
auccagauccuuuucuucaga

SEQ ID NO: 4089081 - RNA, 15 nt, Variola virus
auccaucaaaaaaca

SEQ ID NO: 4089082 - RNA, 15 nt, Variola virus
auccauucuaaugau

SEQ ID NO: 4089083 - RNA, 21 nt, Variola virus
aucccaaaaccguuaaaaugu

SEQ ID NO: 4089084 - RNA, 22 nt, Variola virus
aucccguacucccaauauguau

SEQ ID NO: 4089085 - RNA, 11 nt, Variola virus
aucccuuauca

SEQ ID NO: 4089086 - RNA, 19 nt, Variola virus
aucccuuugauaaauagua

SEQ ID NO: 4089087 - RNA, 16 nt, Variola virus
auccgacuagaauuag

SEQ ID NO: 4089088 - RNA, 17 nt, Variola virus
auccggauauucuucua

SEQ ID NO: 4089089 - RNA, 14 nt, Variola virus
auccggauucauga

SEQ ID NO: 4089090 - RNA, 15 nt, Variola virus
auccguucuuaacuu

SEQ ID NO: 4089091 - RNA, 17 nt, Variola virus
auccuaacuuuaaacaa

SEQ ID NO: 4089092 - RNA, 13 nt, Variola virus
auccuaaucagga

SEQ ID NO: 4089093 - RNA, 13 nt, Variola virus
auccuauaacuuc

SEQ ID NO: 4089094 - RNA, 17 nt, Variola virus
auccuauaacuucuaau

SEQ ID NO: 4089095 - RNA, 14 nt, Variola virus
auccuauacucuga

SEQ ID NO: 4089096 - RNA, 15 nt, Variola virus
auccuauucuaaaug

SEQ ID NO: 4089097 - RNA, 16 nt, Variola virus
auccuccaguaaauga

SEQ ID NO: 4089098 - RNA, 13 nt, Variola virus
auccuugacuauc

SEQ ID NO: 4089099 - RNA, 18 nt, Variola virus
auccuuguucagauacua

SEQ ID NO: 4089100 - RNA, 18 nt, Variola virus
auccuuuaagaucaacau

SEQ ID NO: 4089101 - RNA, 19 nt, Variola virus
aucgaauauaaaauaacua

SEQ ID NO: 4089102 - RNA, 18 nt, Variola virus
aucgagucuagauucgag

SEQ ID NO: 4089103 - RNA, 14 nt, Variola virus
aucgauaauuauuu

SEQ ID NO: 4089104 - RNA, 16 nt, Variola virus
aucgcauagaaauaca

SEQ ID NO: 4089105 - RNA, 22 nt, Variola virus
aucgcaucaaauaaaauuauug

SEQ ID NO: 4089106 - RNA, 21 nt, Variola virus
aucgcccgcgagcgagagaag

SEQ ID NO: 4089107 - RNA, 15 nt, Variola virus
aucgcuacaaaacua

SEQ ID NO: 4089108 - RNA, 16 nt, Variola virus
aucggacgcagaaauu

SEQ ID NO: 4089109 - RNA, 17 nt, Variola virus
aucggagcuacauuacc

SEQ ID NO: 4089110 - RNA, 13 nt, Variola virus
aucggcucaaaga

SEQ ID NO: 4089111 - RNA, 15 nt, Variola virus
aucggguucugcuuc

SEQ ID NO: 4089112 - RNA, 16 nt, Variola virus
aucguuuagaauacua

SEQ ID NO: 4089113 - RNA, 17 nt, Variola virus
aucguuucuacaaaauc

SEQ ID NO: 4089114 - RNA, 13 nt, Variola virus
aucuaaaaaacua

SEQ ID NO: 4089115 - RNA, 16 nt, Variola virus
aucuaaacaauaccuc

SEQ ID NO: 4089116 - RNA, 15 nt, Variola virus
aucuaaauuaaauau

SEQ ID NO: 4089117 - RNA, 21 nt, Variola virus
aucuaacaucuugauuaauaa

SEQ ID NO: 4089118 - RNA, 17 nt, Variola virus
aucuaauggauaaacug

SEQ ID NO: 4089119 - RNA, 23 nt, Variola virus
aucuacaaguagucaauaaaaga

SEQ ID NO: 4089120 - RNA, 14 nt, Variola virus
aucuacaauuauug

SEQ ID NO: 4089121 - RNA, 15 nt, Variola virus
aucuacuagaaagau

SEQ ID NO: 4089122 - RNA, 17 nt, Variola virus
aucuaggaguaauuaag

SEQ ID NO: 4089123 - RNA, 16 nt, Variola virus
aucuaguuagcaauuu

SEQ ID NO: 4089124 - RNA, 19 nt, Variola virus
aucuauacugcagaauaga

SEQ ID NO: 4089125 - RNA, 15 nt, Variola virus
aucuauauauguauu

SEQ ID NO: 4089126 - RNA, 19 nt, Variola virus
aucuauauugcuacauaau

SEQ ID NO: 4089127 - RNA, 22 nt, Variola virus
aucuaucuuuagcuucugaaau

SEQ ID NO: 4089128 - RNA, 18 nt, Variola virus
aucuauggaauuaccacu

SEQ ID NO: 4089129 - RNA, 15 nt, Variola virus
aucuauuacaaacau

SEQ ID NO: 4089130 - RNA, 13 nt, Variola virus
aucuauuagaaaa

SEQ ID NO: 4089131 - RNA, 18 nt, Variola virus
aucuauuucugucauuaa

SEQ ID NO: 4089132 - RNA, 21 nt, Variola virus
aucucaaaauagguacucugu

SEQ ID NO: 4089133 - RNA, 20 nt, Variola virus
aucucaugucuaagaauuac

SEQ ID NO: 4089134 - RNA, 17 nt, Variola virus
aucucauucaaauccau

SEQ ID NO: 4089135 - RNA, 16 nt, Variola virus
aucucauuugaaaaua

SEQ ID NO: 4089136 - RNA, 17 nt, Variola virus
aucucccauuaucuugg

SEQ ID NO: 4089137 - RNA, 21 nt, Variola virus
aucuccucuaugcaacuguaa

SEQ ID NO: 4089138 - RNA, 15 nt, Variola virus
aucucgaugaaaaua

SEQ ID NO: 4089139 - RNA, 19 nt, Variola virus
aucucguuuagaaaaaugc

SEQ ID NO: 4089140 - RNA, 17 nt, Variola virus
aucucuacauuguuuac

SEQ ID NO: 4089141 - RNA, 20 nt, Variola virus
aucucuucuaguuucacuag

SEQ ID NO: 4089142 - RNA, 16 nt, Variola virus
aucugaaaauaaauaa

SEQ ID NO: 4089143 - RNA, 14 nt, Variola virus
aucugaagaaagua

SEQ ID NO: 4089144 - RNA, 15 nt, Variola virus
aucugaauaaaacau

SEQ ID NO: 4089145 - RNA, 14 nt, Variola virus
aucugaauuaaaua

SEQ ID NO: 4089146 - RNA, 22 nt, Variola virus
aucugauaaauauacaauagau

SEQ ID NO: 4089147 - RNA, 18 nt, Variola virus
aucugauaauauuaaaaa

SEQ ID NO: 4089148 - RNA, 14 nt, Variola virus
aucugauagaaaga

SEQ ID NO: 4089149 - RNA, 14 nt, Variola virus
aucuggcucucucu

SEQ ID NO: 4089150 - RNA, 16 nt, Variola virus
aucugggaauaaaaua

SEQ ID NO: 4089151 - RNA, 15 nt, Variola virus
aucuguaaaaguugu

SEQ ID NO: 4089152 - RNA, 16 nt, Variola virus
aucuguuuccuauaau

SEQ ID NO: 4089153 - RNA, 14 nt, Variola virus
aucuguuuguugag

SEQ ID NO: 4089154 - RNA, 22 nt, Variola virus
aucuucaacguauaguuguuga

SEQ ID NO: 4089155 - RNA, 17 nt, Variola virus
aucuucauaauaaauaa

SEQ ID NO: 4089156 - RNA, 16 nt, Variola virus
aucuucauuaucugau

SEQ ID NO: 4089157 - RNA, 18 nt, Variola virus
gaauacgaggaugaugau

SEQ ID NO: 4089158 - RNA, 20 nt, Variola virus
gaauagaguaggaaguuuaa

SEQ ID NO: 4089159 - RNA, 14 nt, Variola virus
gaauagauauuaau

SEQ ID NO: 4089160 - RNA, 15 nt, Variola virus
gaauagauuacucau

SEQ ID NO: 4089161 - RNA, 20 nt, Variola virus
gaauauaaaauaacuacagu

SEQ ID NO: 4089162 - RNA, 15 nt, Variola virus
gaauauaaaccauau

SEQ ID NO: 4089163 - RNA, 17 nt, Variola virus
gaauauaaauuauauau

SEQ ID NO: 4089164 - RNA, 21 nt, Variola virus
gaauauaacgugguaucuucu

SEQ ID NO: 4089165 - RNA, 12 nt, Variola virus
gaauauaaugaa

SEQ ID NO: 4089166 - RNA, 17 nt, Variola virus
gaauauacaaguauuau

SEQ ID NO: 4089167 - RNA, 20 nt, Variola virus
gaauauacuucauaaaagaa

SEQ ID NO: 4089168 - RNA, 14 nt, Variola virus
gaauauauaaaaga

SEQ ID NO: 4089169 - RNA, 15 nt, Variola virus
gaauauauaauucuu

SEQ ID NO: 4089170 - RNA, 12 nt, Variola virus
gaauauauuaau

SEQ ID NO: 4089171 - RNA, 14 nt, Variola virus
gaauaucaaaucua

SEQ ID NO: 4089172 - RNA, 18 nt, Variola virus
gaauaucaggaaauguau

SEQ ID NO: 4089173 - RNA, 14 nt, Variola virus
gaauaucuacaaua

SEQ ID NO: 4089174 - RNA, 22 nt, Variola virus
gaauaucuguaggcuucuuguu

SEQ ID NO: 4089175 - RNA, 21 nt, Variola virus
gaauauggggaaaauauucua

SEQ ID NO: 4089176 - RNA, 21 nt, Variola virus
gaauauguuauaauagagaua

SEQ ID NO: 4089177 - RNA, 21 nt, Variola virus
gaauauuccucuaacagauau

SEQ ID NO: 4089178 - RNA, 18 nt, Variola virus
gaauauugauuuacuaaa

SEQ ID NO: 4089179 - RNA, 14 nt, Variola virus
gaauauuucuaguu

SEQ ID NO: 4089180 - RNA, 16 nt, Variola virus
gaauauuuuauguaca

SEQ ID NO: 4089181 - RNA, 18 nt, Variola virus
gaauauuuugauaaugaa

SEQ ID NO: 4089182 - RNA, 18 nt, Variola virus
gaaucaaauauagaucuu

SEQ ID NO: 4089183 - RNA, 13 nt, Variola virus
gaaucaacauaua

SEQ ID NO: 4089184 - RNA, 21 nt, Variola virus
gaaucauaaaaaaaaguuuua

SEQ ID NO: 4089185 - RNA, 19 nt, Variola virus
gaauccgcugcauauuauu

SEQ ID NO: 4089186 - RNA, 13 nt, Variola virus
gaaucuaaacaaa

SEQ ID NO: 4089187 - RNA, 15 nt, Variola virus
gaaucuaaugaugac

SEQ ID NO: 4089188 - RNA, 20 nt, Variola virus
gaaucugaaaauguauaaau

SEQ ID NO: 4089189 - RNA, 20 nt, Variola virus
gaaucugaaccaucaucugu

SEQ ID NO: 4089190 - RNA, 17 nt, Variola virus
gaaucuguucaaaaauu

SEQ ID NO: 4089191 - RNA, 22 nt, Variola virus
gaaucuucauuaucugauauau

SEQ ID NO: 4089192 - RNA, 23 nt, Variola virus
gaaugagauacauaaaacuuuau

SEQ ID NO: 4089193 - RNA, 19 nt, Variola virus
gaaugcagaaaugauuuug

SEQ ID NO: 4089194 - RNA, 19 nt, Variola virus
gaaugccugccuguauuau

SEQ ID NO: 4089195 - RNA, 21 nt, Variola virus
gaaugcucucccggauauuau

SEQ ID NO: 4089196 - RNA, 18 nt, Variola virus
gaauggcguuugauauau

SEQ ID NO: 4089197 - RNA, 19 nt, Variola virus
gaauguucucaagaacuac

SEQ ID NO: 4089198 - RNA, 22 nt, Variola virus
gaauguuuauuggcguuggaaa

SEQ ID NO: 4089199 - RNA, 21 nt, Variola virus
gaauuaacgaaacaauguuuc

SEQ ID NO: 4089200 - RNA, 17 nt, Variola virus
gaauuaacgagauauau

SEQ ID NO: 4089201 - RNA, 13 nt, Variola virus
gaauuaauaauau

SEQ ID NO: 4089202 - RNA, 17 nt, Variola virus
gaauuaauguaaucauu

SEQ ID NO: 4089203 - RNA, 14 nt, Variola virus
gaauuauagacacu

SEQ ID NO: 4089204 - RNA, 20 nt, Variola virus
gaauucauccguccuucaga

SEQ ID NO: 4089205 - RNA, 15 nt, Variola virus
gaauuccucugaaaa

SEQ ID NO: 4089206 - RNA, 21 nt, Variola virus
gaauucuuuuucgacuuuuug

SEQ ID NO: 4089207 - RNA, 20 nt, Variola virus
gaauuguugucgguaaacga

SEQ ID NO: 4089208 - RNA, 15 nt, Variola virus
gaauuuucuaacgaa

SEQ ID NO: 4089209 - RNA, 22 nt, Variola virus
gacaaaagacguaaauauucua

SEQ ID NO: 4089210 - RNA, 18 nt, Variola virus
gacaaaguccuaguugua

SEQ ID NO: 4089211 - RNA, 14 nt, Variola virus
gacacagauaucua

SEQ ID NO: 4089212 - RNA, 18 nt, Variola virus
gacaccuaagaagaaugu

SEQ ID NO: 4089213 - RNA, 17 nt, Variola virus
gacagcuauguuaucau

SEQ ID NO: 4089214 - RNA, 13 nt, Variola virus
gacaguaauacau

SEQ ID NO: 4089215 - RNA, 16 nt, Variola virus
gacauaacuaaucaua

SEQ ID NO: 4089216 - RNA, 13 nt, Variola virus
gacauaagaacag

SEQ ID NO: 4089217 - RNA, 22 nt, Variola virus
gacauaccugaucuacguucua

SEQ ID NO: 4089218 - RNA, 22 nt, Variola virus
gacauaguuucaaaacaaacag

SEQ ID NO: 4089219 - RNA, 15 nt, Variola virus
gacauaucugccaua

SEQ ID NO: 4089220 - RNA, 21 nt, Variola virus
gacauaugccuauuuauauau

SEQ ID NO: 4089221 - RNA, 12 nt, Variola virus
gacaucaugaac

SEQ ID NO: 4089222 - RNA, 13 nt, Variola virus
gacaucucagaau

SEQ ID NO: 4089223 - RNA, 15 nt, Variola virus
gacaugcaaaaaugc

SEQ ID NO: 4089224 - RNA, 19 nt, Variola virus
gacaugguaucaacagaua

SEQ ID NO: 4089225 - RNA, 21 nt, Variola virus
gacauuauaauuuuaccaaua

SEQ ID NO: 4089226 - RNA, 20 nt, Variola virus
gacauuauguuguuaaaaua

SEQ ID NO: 4089227 - RNA, 21 nt, Variola virus
gacauuuuuagagagaacuac

SEQ ID NO: 4089228 - RNA, 14 nt, Variola virus
gaccacauccuuca

SEQ ID NO: 4089229 - RNA, 18 nt, Variola virus
gaccgguuuaucauuaau

SEQ ID NO: 4089230 - RNA, 20 nt, Variola virus
gaccguaccagugacagaua

SEQ ID NO: 4089231 - RNA, 23 nt, Variola virus
gaccguaccagugacagauauac

SEQ ID NO: 4089232 - RNA, 16 nt, Variola virus
gacgaguguaaacacu

SEQ ID NO: 4089233 - RNA, 12 nt, Variola virus
gacguagaaaac

SEQ ID NO: 4089234 - RNA, 22 nt, Variola virus
gacgucuagaguuuauaucaau

SEQ ID NO: 4089235 - RNA, 22 nt, Variola virus
gacuaauaaauuaaauauuaau

SEQ ID NO: 4089236 - RNA, 14 nt, Variola virus
gacuagacauuuac

SEQ ID NO: 4089237 - RNA, 19 nt, Variola virus
gacuagauaaacuaucagu

SEQ ID NO: 4089238 - RNA, 12 nt, Variola virus
gacuagauggac

SEQ ID NO: 4089239 - RNA, 17 nt, Variola virus
gacuauaaaauauucua

SEQ ID NO: 4089240 - RNA, 16 nt, Variola virus
gacuaugggaauauau

SEQ ID NO: 4089241 - RNA, 18 nt, Variola virus
gacucaguauacaaaaau

SEQ ID NO: 4089242 - RNA, 14 nt, Variola virus
gacucauuaaaacu

SEQ ID NO: 4089243 - RNA, 18 nt, Variola virus
gacucauuauuucccaaa

SEQ ID NO: 4089244 - RNA, 18 nt, Variola virus
gacuccgggaccaauuac

SEQ ID NO: 4089245 - RNA, 21 nt, Variola virus
gacucgcaaaaaauacaauau

SEQ ID NO: 4089246 - RNA, 15 nt, Variola virus
gacucugguauuuau

SEQ ID NO: 4089247 - RNA, 20 nt, Variola virus
gacugaugaccauuuaaaaa

SEQ ID NO: 4089248 - RNA, 21 nt, Variola virus
gacugccacguuagaggauga

SEQ ID NO: 4089249 - RNA, 15 nt, Variola virus
gacuggaguauauau

SEQ ID NO: 4089250 - RNA, 20 nt, Variola virus
gacuucauugauaucuuuau

SEQ ID NO: 4089251 - RNA, 15 nt, Variola virus
gagcaagugguggug

SEQ ID NO: 4089252 - RNA, 17 nt, Variola virus
gagcacuauuucuaaau

SEQ ID NO: 4089253 - RNA, 21 nt, Variola virus
gagcuaaccacauuagauauu

SEQ ID NO: 4089254 - RNA, 20 nt, Variola virus
gagcugauuauuuauuucuu

SEQ ID NO: 4089255 - RNA, 19 nt, Variola virus
gaggaaaucguauaaauac

SEQ ID NO: 4089256 - RNA, 14 nt, Variola virus
gaggaagaagaugg

SEQ ID NO: 4089257 - RNA, 20 nt, Variola virus
gaggaaguauaaaaauuaaa

SEQ ID NO: 4089258 - RNA, 17 nt, Variola virus
gagguagguauuacuuu

SEQ ID NO: 4089259 - RNA, 11 nt, Variola virus
gagguauauau

SEQ ID NO: 4089260 - RNA, 21 nt, Variola virus
gaguauaaauuuuagaaauaa

SEQ ID NO: 4089261 - RNA, 21 nt, Variola virus
gaguauugguaauguacaaac

SEQ ID NO: 4089262 - RNA, 11 nt, Variola virus
gaguauuucuc

SEQ ID NO: 4089263 - RNA, 14 nt, Variola virus
gagugcuguggaaa

SEQ ID NO: 4089264 - RNA, 21 nt, Variola virus
gaguuaagccaauagaaauau

SEQ ID NO: 4089265 - RNA, 21 nt, Variola virus
gauaaaaaauuauauacugaa

SEQ ID NO: 4089266 - RNA, 20 nt, Variola virus
gauaaagacgguacuuauga

SEQ ID NO: 4089267 - RNA, 16 nt, Variola virus
gauaaagauauaugau

SEQ ID NO: 4089268 - RNA, 14 nt, Variola virus
gauaaauaguauca

SEQ ID NO: 4089269 - RNA, 19 nt, Variola virus
gauaacaauagucuuguaa

SEQ ID NO: 4089270 - RNA, 18 nt, Variola virus
gauaacacauuuucaucu

SEQ ID NO: 4089271 - RNA, 13 nt, Variola virus
gauaacauaaaaa

SEQ ID NO: 4089272 - RNA, 16 nt, Variola virus
gauaacgcgucuuuaa

SEQ ID NO: 4089273 - RNA, 16 nt, Variola virus
gauaagagacguguua

SEQ ID NO: 4089274 - RNA, 15 nt, Variola virus
gauaaguaauaacua

SEQ ID NO: 4089275 - RNA, 22 nt, Variola virus
gauaaguuucggcacauauuaa

SEQ ID NO: 4089276 - RNA, 13 nt, Variola virus
gauaauaaaucau

SEQ ID NO: 4089277 - RNA, 18 nt, Variola virus
gauaauauccugaacagc

SEQ ID NO: 4089278 - RNA, 18 nt, Variola virus
gauaaucagccauaauua

SEQ ID NO: 4089279 - RNA, 23 nt, Variola virus
gauaauggaagacgcuauaucaa

SEQ ID NO: 4089280 - RNA, 16 nt, Variola virus
gauaaugguacucuag

SEQ ID NO: 4089281 - RNA, 16 nt, Variola virus
gauaauuaauaauaua

SEQ ID NO: 4089282 - RNA, 21 nt, Variola virus
gauaauucgcacaccaacaau

SEQ ID NO: 4089283 - RNA, 18 nt, Variola virus
guuaguacuacugaagaa

SEQ ID NO: 4089284 - RNA, 16 nt, Variola virus
guuauaaacgggugua

SEQ ID NO: 4089285 - RNA, 13 nt, Variola virus
guuauaaauuagg

SEQ ID NO: 4089286 - RNA, 14 nt, Variola virus
guuauaauagagau

SEQ ID NO: 4089287 - RNA, 17 nt, Variola virus
guuauaauuaugaugau

SEQ ID NO: 4089288 - RNA, 23 nt, Variola virus
guuauauguaacauuaaguaaau

SEQ ID NO: 4089289 - RNA, 16 nt, Variola virus
guuaucugaugaaaga

SEQ ID NO: 4089290 - RNA, 15 nt, Variola virus
guuauuauaaacucu

SEQ ID NO: 4089291 - RNA, 20 nt, Variola virus
guuauugguauuucuuacau

SEQ ID NO: 4089292 - RNA, 16 nt, Variola virus
guuauugucaaaaucu

SEQ ID NO: 4089293 - RNA, 20 nt, Variola virus
guuauuuggcaguacucauu

SEQ ID NO: 4089294 - RNA, 14 nt, Variola virus
guuauuuuguuaaa

SEQ ID NO: 4089295 - RNA, 15 nt, Variola virus
guucaaaucuagauu

SEQ ID NO: 4089296 - RNA, 13 nt, Variola virus
guucaacaaacua

SEQ ID NO: 4089297 - RNA, 16 nt, Variola virus
guucaccuucuauaga

SEQ ID NO: 4089298 - RNA, 19 nt, Variola virus
guucagaggaugaaauaga

SEQ ID NO: 4089299 - RNA, 18 nt, Variola virus
guucauaagucuaauaga

SEQ ID NO: 4089300 - RNA, 15 nt, Variola virus
guucaucacauaugc

SEQ ID NO: 4089301 - RNA, 16 nt, Variola virus
guuccggaucuauaga

SEQ ID NO: 4089302 - RNA, 19 nt, Variola virus
guucguacccaucuuaaug

SEQ ID NO: 4089303 - RNA, 13 nt, Variola virus
guucuaaauggau

SEQ ID NO: 4089304 - RNA, 21 nt, Variola virus
guucuaauuccgcauuaaaug

SEQ ID NO: 4089305 - RNA, 23 nt, Variola virus
guucuagucgguauuucaucauu

SEQ ID NO: 4089306 - RNA, 22 nt, Variola virus
guucucgccuaagagauaaaaa

SEQ ID NO: 4089307 - RNA, 12 nt, Variola virus
guucugauuuua

SEQ ID NO: 4089308 - RNA, 20 nt, Variola virus
guugagcuaauuuuuguaaa

SEQ ID NO: 4089309 - RNA, 19 nt, Variola virus
guugaucuucaaauuccac

SEQ ID NO: 4089310 - RNA, 21 nt, Variola virus
guugaucuucaaauuccacca

SEQ ID NO: 4089311 - RNA, 13 nt, Variola virus
guugguagauauu

SEQ ID NO: 4089312 - RNA, 18 nt, Variola virus
guuguaaauuuuaauauu

SEQ ID NO: 4089313 - RNA, 19 nt, Variola virus
guuuaaauucuuuaauauc

SEQ ID NO: 4089314 - RNA, 22 nt, Variola virus
guuuaacaauaaaauuaaucac

SEQ ID NO: 4089315 - RNA, 12 nt, Variola virus
guuuaauaacuu

SEQ ID NO: 4089316 - RNA, 14 nt, Variola virus
guuuaauacauuga

SEQ ID NO: 4089317 - RNA, 12 nt, Variola virus
guuuacauaaau

SEQ ID NO: 4089318 - RNA, 18 nt, Variola virus
guuuacauuuuuggauuu

SEQ ID NO: 4089319 - RNA, 19 nt, Variola virus
guuuaccacaauguauaau

SEQ ID NO: 4089320 - RNA, 22 nt, Variola virus
guuuauaauuacaacauaauaa

SEQ ID NO: 4089321 - RNA, 21 nt, Variola virus
guuuaucuuuuuguuggaaaa

SEQ ID NO: 4089322 - RNA, 17 nt, Variola virus
guuuauguacuaugcca

SEQ ID NO: 4089323 - RNA, 13 nt, Variola virus
guuuauuugaccu

SEQ ID NO: 4089324 - RNA, 22 nt, Variola virus
guuucaagauaaauaaucaaaa

SEQ ID NO: 4089325 - RNA, 17 nt, Variola virus
guuucaucaauagaaga

SEQ ID NO: 4089326 - RNA, 15 nt, Variola virus
guuuccaaaaaaugu

SEQ ID NO: 4089327 - RNA, 18 nt, Variola virus
guuuccaguuauaaaaca

SEQ ID NO: 4089328 - RNA, 23 nt, Variola virus
guuucccuauuaaaauucuuaaa

SEQ ID NO: 4089329 - RNA, 22 nt, Variola virus
guuucucaucuuuuacuugauu

SEQ ID NO: 4089330 - RNA, 15 nt, Variola virus
guuugaaucaucauc

SEQ ID NO: 4089331 - RNA, 19 nt, Variola virus
guuugaugcgauucaaaaa

SEQ ID NO: 4089332 - RNA, 14 nt, Variola virus
guuuggauuaaucu

SEQ ID NO: 4089333 - RNA, 14 nt, Variola virus
guuuuaaauuggua

SEQ ID NO: 4089334 - RNA, 19 nt, Variola virus
guuuuacguuauuaaucau

SEQ ID NO: 4089335 - RNA, 16 nt, Variola virus
guuuuauauacaucuu

SEQ ID NO: 4089336 - RNA, 14 nt, Variola virus
guuuuguaauaucu

SEQ ID NO: 4089337 - RNA, 20 nt, Variola virus
guuuuugaacuguucaaaau

SEQ ID NO: 4089338 - RNA, 13 nt, Variola virus
guuuuuuagaucu

SEQ ID NO: 4089339 - RNA, 15 nt, Variola virus
uaaaaaaaauuauuu

SEQ ID NO: 4089340 - RNA, 23 nt, Variola virus
uaaaaaaauaggugaugaugcaa

SEQ ID NO: 4089341 - RNA, 14 nt, Variola virus
uaaaaaaaugauug

SEQ ID NO: 4089342 - RNA, 18 nt, Variola virus
uaaaaaauauauuguucu

SEQ ID NO: 4089343 - RNA, 17 nt, Variola virus
uaaaaaaucugaugagu

SEQ ID NO: 4089344 - RNA, 15 nt, Variola virus
uaaaaaauucccauu

SEQ ID NO: 4089345 - RNA, 16 nt, Variola virus
uaaaaaccaaaucuug

SEQ ID NO: 4089346 - RNA, 22 nt, Variola virus
uaaaaaccaauuuguauaugug

SEQ ID NO: 4089347 - RNA, 17 nt, Variola virus
uaaaaagauaaacuuua

SEQ ID NO: 4089348 - RNA, 16 nt, Variola virus
uaaaaagguagauguu

SEQ ID NO: 4089349 - RNA, 16 nt, Variola virus
uaaaaauacaucuguu

SEQ ID NO: 4089350 - RNA, 12 nt, Variola virus
uaaaaauauguu

SEQ ID NO: 4089351 - RNA, 14 nt, Variola virus
uaaaaauguuaauu

SEQ ID NO: 4089352 - RNA, 14 nt, Variola virus
uaaaacauuugcau

SEQ ID NO: 4089353 - RNA, 21 nt, Variola virus
uaaaacuuccucauuaagauu

SEQ ID NO: 4089354 - RNA, 17 nt, Variola virus
uaaaacuuuauuaucca

SEQ ID NO: 4089355 - RNA, 16 nt, Variola virus
uaaaauaaaagaguau

SEQ ID NO: 4089356 - RNA, 18 nt, Variola virus
uaaaauaaauauucuuca

SEQ ID NO: 4089357 - RNA, 22 nt, Variola virus
uaaaauagacaauggaauucau

SEQ ID NO: 4089358 - RNA, 23 nt, Variola virus
uaaaauagcguucacauauccuc

SEQ ID NO: 4089359 - RNA, 18 nt, Variola virus
uaaaauaggaaguaaugu

SEQ ID NO: 4089360 - RNA, 19 nt, Variola virus
uaaaauaguuuauaacauu

SEQ ID NO: 4089361 - RNA, 16 nt, Variola virus
uaaaauaucauacgau

SEQ ID NO: 4089362 - RNA, 16 nt, Variola virus
uaaaauggauaauggu

SEQ ID NO: 4089363 - RNA, 20 nt, Variola virus
uaaaaugucuccaauuuuug

SEQ ID NO: 4089364 - RNA, 14 nt, Variola virus
uaaaauuaaacauu

SEQ ID NO: 4089365 - RNA, 18 nt, Variola virus
uaaaauuaaauaguagua

SEQ ID NO: 4089366 - RNA, 16 nt, Variola virus
uaaaauuccuacucau

SEQ ID NO: 4089367 - RNA, 18 nt, Variola virus
uaaaauuucauagacuuu

SEQ ID NO: 4089368 - RNA, 14 nt, Variola virus
uaaacaaaauacuc

SEQ ID NO: 4089369 - RNA, 18 nt, Variola virus
uaaacaagcuaucucuug

SEQ ID NO: 4089370 - RNA, 14 nt, Variola virus
uaaacaccaagaaa

SEQ ID NO: 4089371 - RNA, 18 nt, Variola virus
uaaacacccuuauauuca

SEQ ID NO: 4089372 - RNA, 21 nt, Variola virus
uaaacacuaguauagcagaag

SEQ ID NO: 4089373 - RNA, 17 nt, Variola virus
uaaacagaaauauauga

SEQ ID NO: 4089374 - RNA, 16 nt, Variola virus
uaaacaugaauuuauu

SEQ ID NO: 4089375 - RNA, 15 nt, Variola virus
uaaaccauguuguga

SEQ ID NO: 4089376 - RNA, 14 nt, Variola virus
uaaaccauuuuuca

SEQ ID NO: 4089377 - RNA, 22 nt, Variola virus
uaaacgacuauaaaauuauuga

SEQ ID NO: 4089378 - RNA, 20 nt, Variola virus
uaaacgcgucaaauuuuuca

SEQ ID NO: 4089379 - RNA, 19 nt, Variola virus
uaaacguuccguguguaau

SEQ ID NO: 4089380 - RNA, 22 nt, Variola virus
uaaacguuguuuacucauauag

SEQ ID NO: 4089381 - RNA, 19 nt, Variola virus
uaaagaaaaaugauugucu

SEQ ID NO: 4089382 - RNA, 17 nt, Variola virus
uaaagaaaugucuacau

SEQ ID NO: 4089383 - RNA, 18 nt, Variola virus
uaaagaacgauuguguaa

SEQ ID NO: 4089384 - RNA, 16 nt, Variola virus
uaaagaauaucuuugg

SEQ ID NO: 4089385 - RNA, 15 nt, Variola virus
uaaagacuaugucaa

SEQ ID NO: 4089386 - RNA, 18 nt, Variola virus
uaaagauagaaaugaauu

SEQ ID NO: 4089387 - RNA, 13 nt, Variola virus
uaaagaugcuauu

SEQ ID NO: 4089388 - RNA, 14 nt, Variola virus
uaaagcauuauucu

SEQ ID NO: 4089389 - RNA, 20 nt, Variola virus
uaaagcgugugcguguauag

SEQ ID NO: 4089390 - RNA, 18 nt, Variola virus
uaaaggauauuauauguu

SEQ ID NO: 4089391 - RNA, 15 nt, Variola virus
uaaagguaacaauau

SEQ ID NO: 4089392 - RNA, 22 nt, Variola virus
uaaaguauaugggcgauauucu

SEQ ID NO: 4089393 - RNA, 13 nt, Variola virus
uaaaguuaucaug

SEQ ID NO: 4089394 - RNA, 16 nt, Variola virus
uaaaguuucugaaaua

SEQ ID NO: 4089395 - RNA, 14 nt, Variola virus
uaaauaaagaagau

SEQ ID NO: 4089396 - RNA, 20 nt, Variola virus
uaaauaacaaugagauguau

SEQ ID NO: 4089397 - RNA, 16 nt, Variola virus
uaaauacauuaucaug

SEQ ID NO: 4089398 - RNA, 22 nt, Variola virus
uaaauacuuuuuauuuacggua

SEQ ID NO: 4089399 - RNA, 16 nt, Variola virus
uaaaucaacagaaguu

SEQ ID NO: 4089400 - RNA, 19 nt, Variola virus
uaaauccuuaauauauuca

SEQ ID NO: 4089401 - RNA, 23 nt, Variola virus
uaaauccuuguuugauaaaugua

SEQ ID NO: 4089402 - RNA, 21 nt, Variola virus
uaaaucuacuuagauuauucu

SEQ ID NO: 4089403 - RNA, 18 nt, Variola virus
uaaaucuauuauauuuua

SEQ ID NO: 4089404 - RNA, 18 nt, Variola virus
uaaaugcgugacuauaaa

SEQ ID NO: 4089405 - RNA, 14 nt, Variola virus
uaaauguaaauuca

SEQ ID NO: 4089406 - RNA, 18 nt, Variola virus
uaaauguauaaaaacuaa

SEQ ID NO: 4089407 - RNA, 20 nt, Variola virus
uaaauguuuucucuguaaua

SEQ ID NO: 4089408 - RNA, 11 nt, Variola virus
uaaauuagaag

SEQ ID NO: 4089409 - RNA, 11 nt, Variola virus
aaaaaauggaa

SEQ ID NO: 4089410 - RNA, 12 nt, Variola virus
aaaaaauuucca

SEQ ID NO: 4089411 - RNA, 21 nt, Variola virus
aaaaacaucacgaaaucuaua

SEQ ID NO: 4089412 - RNA, 14 nt, Variola virus
aaaaagaaugagua

SEQ ID NO: 4089413 - RNA, 19 nt, Variola virus
aaaaagaccaguucauuca

SEQ ID NO: 4089414 - RNA, 21 nt, Variola virus
aaaaagauuaccguaugauau

SEQ ID NO: 4089415 - RNA, 22 nt, Variola virus
aaaaagauuaccguaugauaug

SEQ ID NO: 4089416 - RNA, 15 nt, Variola virus
aaaaagcuauuauca

SEQ ID NO: 4089417 - RNA, 21 nt, Variola virus
aaaaauacucaguuugauauu

SEQ ID NO: 4089418 - RNA, 17 nt, Variola virus
aaaaaugauagaaauau

SEQ ID NO: 4089419 - RNA, 22 nt, Variola virus
aaaaauggauuuugaugauauu

SEQ ID NO: 4089420 - RNA, 19 nt, Variola virus
aaaaauuaauacaucauca

SEQ ID NO: 4089421 - RNA, 21 nt, Variola virus
aaaaauuauacuguaacacaa

SEQ ID NO: 4089422 - RNA, 23 nt, Variola virus
aaaacagaauaugagaaugaaua

SEQ ID NO: 4089423 - RNA, 13 nt, Variola virus
aaaacauaaucaa

SEQ ID NO: 4089424 - RNA, 14 nt, Variola virus
aaaacauaaucaag

SEQ ID NO: 4089425 - RNA, 19 nt, Variola virus
aaaacauauauaauaaaua

SEQ ID NO: 4089426 - RNA, 18 nt, Variola virus
aaaacgauauuagaauuu

SEQ ID NO: 4089427 - RNA, 22 nt, Variola virus
aaaacggugcugaccuggaaaa

SEQ ID NO: 4089428 - RNA, 19 nt, Variola virus
aaaacguggaaagaaucua

SEQ ID NO: 4089429 - RNA, 19 nt, Variola virus
aaaacuauaucuauguuga

SEQ ID NO: 4089430 - RNA, 16 nt, Variola virus
aaaacugaaaauauau

SEQ ID NO: 4089431 - RNA, 19 nt, Variola virus
aaaacugguuaaaacagua

SEQ ID NO: 4089432 - RNA, 14 nt, Variola virus
aaaagaauauguau

SEQ ID NO: 4089433 - RNA, 14 nt, Variola virus
aaaagaaucaucau

SEQ ID NO: 4089434 - RNA, 21 nt, Variola virus
aaaagacgcuuguuaauaagu

SEQ ID NO: 4089435 - RNA, 16 nt, Variola virus
aaaagacguaaauauu

SEQ ID NO: 4089436 - RNA, 19 nt, Variola virus
aaaagacuuucguuaauuu

SEQ ID NO: 4089437 - RNA, 15 nt, Variola virus
aaaagccccaauuua

SEQ ID NO: 4089438 - RNA, 22 nt, Variola virus
aaaagcuauuaucaaauacugu

SEQ ID NO: 4089439 - RNA, 14 nt, Variola virus
aaaaguaaauacug

SEQ ID NO: 4089440 - RNA, 17 nt, Variola virus
aaaaguagaaaauauau

SEQ ID NO: 4089441 - RNA, 22 nt, Variola virus
aaaaguauuaauacaugucuua

SEQ ID NO: 4089442 - RNA, 13 nt, Variola virus
aaaauaauaauua

SEQ ID NO: 4089443 - RNA, 15 nt, Variola virus
aaaauacaacaaugu

SEQ ID NO: 4089444 - RNA, 10 nt, Variola virus
aaaauacuua

SEQ ID NO: 4089445 - RNA, 17 nt, Variola virus
aaaauauauaaugaaua

SEQ ID NO: 4089446 - RNA, 22 nt, Variola virus
aaaauauggaauuguauuuucu

SEQ ID NO: 4089447 - RNA, 12 nt, Variola virus
aaaauauguaga

SEQ ID NO: 4089448 - RNA, 16 nt, Variola virus
aaaauauguauaacgu

SEQ ID NO: 4089449 - RNA, 11 nt, Variola virus
aaaauauugug

SEQ ID NO: 4089450 - RNA, 13 nt, Variola virus
aaaaucaaugggu

SEQ ID NO: 4089451 - RNA, 19 nt, Variola virus
aaaaucaggguuaucaaag

SEQ ID NO: 4089452 - RNA, 22 nt, Variola virus
aaaaugacaucguugcccggau

SEQ ID NO: 4089453 - RNA, 15 nt, Variola virus
aaaaugauagaaaua

SEQ ID NO: 4089454 - RNA, 21 nt, Variola virus
aaaaugaugcuauuagaauuu

SEQ ID NO: 4089455 - RNA, 17 nt, Variola virus
aaaaugguaaacuuuug

SEQ ID NO: 4089456 - RNA, 22 nt, Variola virus
aaaaugguguauuggaccuggu

SEQ ID NO: 4089457 - RNA, 21 nt, Variola virus
aaaauuaauauuuaugauuua

SEQ ID NO: 4089458 - RNA, 14 nt, Variola virus
aaaauuauaugacc

SEQ ID NO: 4089459 - RNA, 19 nt, Variola virus
aaaauuguugaucauauag

SEQ ID NO: 4089460 - RNA, 15 nt, Variola virus
aaacaaaauuuuacu

SEQ ID NO: 4089461 - RNA, 18 nt, Variola virus
aaacaacaaaauuauacu

SEQ ID NO: 4089462 - RNA, 15 nt, Variola virus
aaacaauguauacaa

SEQ ID NO: 4089463 - RNA, 12 nt, Variola virus
aaacaauguuuc

SEQ ID NO: 4089464 - RNA, 22 nt, Variola virus
aaacacgucaaagguuaacauc

SEQ ID NO: 4089465 - RNA, 13 nt, Variola virus
aaacacuguuguu

SEQ ID NO: 4089466 - RNA, 22 nt, Variola virus
aaacacuguuguuagagauuuu

SEQ ID NO: 4089467 - RNA, 18 nt, Variola virus
aaacaguuauuuucugaa

SEQ ID NO: 4089468 - RNA, 22 nt, Variola virus
aaacaguuugguauuagaauca

SEQ ID NO: 4089469 - RNA, 21 nt, Variola virus
aaacaguuuuaccguuuguau

SEQ ID NO: 4089470 - RNA, 19 nt, Variola virus
aaacauguaugagaaaaac

SEQ ID NO: 4089471 - RNA, 21 nt, Variola virus
aaacauguucaaugcaauaga

SEQ ID NO: 4089472 - RNA, 18 nt, Variola virus
aaacauuuuauuucuaga

SEQ ID NO: 4089473 - RNA, 14 nt, Variola virus
aaaccaaaucuuga

SEQ ID NO: 4089474 - RNA, 16 nt, Variola virus
aaaccauguugugaaa

SEQ ID NO: 4089475 - RNA, 14 nt, Variola virus
aaaccuaugauauc

SEQ ID NO: 4089476 - RNA, 13 nt, Variola virus
aaacgaaaaauac

SEQ ID NO: 4089477 - RNA, 15 nt, Variola virus
aaacgaaaacuauau

SEQ ID NO: 4089478 - RNA, 13 nt, Variola virus
aaacgaacuauau

SEQ ID NO: 4089479 - RNA, 19 nt, Variola virus
aaacgaguacuuuaaagaa

SEQ ID NO: 4089480 - RNA, 18 nt, Variola virus
aaacgcucuacgaauauc

SEQ ID NO: 4089481 - RNA, 16 nt, Variola virus
aaacuaaacuuauuua

SEQ ID NO: 4089482 - RNA, 20 nt, Variola virus
aaacuaacauuguuaauuga

SEQ ID NO: 4089483 - RNA, 12 nt, Variola virus
aaacuaauacau

SEQ ID NO: 4089484 - RNA, 15 nt, Variola virus
aaacuaauucauuuu

SEQ ID NO: 4089485 - RNA, 14 nt, Variola virus
aaacuaauucuguc

SEQ ID NO: 4089486 - RNA, 15 nt, Variola virus
aaacuacagguguga

SEQ ID NO: 4089487 - RNA, 20 nt, Variola virus
aaacuagaaaaacuuaguac

SEQ ID NO: 4089488 - RNA, 21 nt, Variola virus
aaacuauuacuaggagaauua

SEQ ID NO: 4089489 - RNA, 15 nt, Variola virus
aaacucagaacaaua

SEQ ID NO: 4089490 - RNA, 22 nt, Variola virus
aaacucgucuccccaaacauug

SEQ ID NO: 4089491 - RNA, 22 nt, Variola virus
aaacucuuuuauagagaaaugu

SEQ ID NO: 4089492 - RNA, 18 nt, Variola virus
aaacugaaaauauauuga

SEQ ID NO: 4089493 - RNA, 12 nt, Variola virus
aaacugaaaaug

SEQ ID NO: 4089494 - RNA, 14 nt, Variola virus
aaacugguaaucca

SEQ ID NO: 4089495 - RNA, 16 nt, Variola virus
aaacuguuuaagaaaa

SEQ ID NO: 4089496 - RNA, 17 nt, Variola virus
aaacuucucuaaaugag

SEQ ID NO: 4089497 - RNA, 23 nt, Variola virus
aaggauuugcuuaaaggaagaau

SEQ ID NO: 4089498 - RNA, 23 nt, Variola virus
aagguggauucgguaguauuuau

SEQ ID NO: 4089499 - RNA, 15 nt, Variola virus
aagguuaacaucuua

SEQ ID NO: 4089500 - RNA, 12 nt, Variola virus
aagguucuuaua

SEQ ID NO: 4089501 - RNA, 12 nt, Variola virus
aagguuguaaau

SEQ ID NO: 4089502 - RNA, 11 nt, Variola virus
aaguaaauacu

SEQ ID NO: 4089503 - RNA, 15 nt, Variola virus
aaguacucaauaaau

SEQ ID NO: 4089504 - RNA, 19 nt, Variola virus
aaguauacauguuagagaa

SEQ ID NO: 4089505 - RNA, 17 nt, Variola virus
aaguaucaaaucuucua

SEQ ID NO: 4089506 - RNA, 21 nt, Variola virus
aaguauuuuuagagcucuugg

SEQ ID NO: 4089507 - RNA, 13 nt, Variola virus
aagucaaaugauu

SEQ ID NO: 4089508 - RNA, 16 nt, Variola virus
aagucauaugugguau

SEQ ID NO: 4089509 - RNA, 20 nt, Variola virus
aagucccucauagaaugaua

SEQ ID NO: 4089510 - RNA, 17 nt, Variola virus
aagucgccucaaagaua

SEQ ID NO: 4089511 - RNA, 19 nt, Variola virus
aagucucguucguaaauaa

SEQ ID NO: 4089512 - RNA, 17 nt, Variola virus
aagugucuauaaaugua

SEQ ID NO: 4089513 - RNA, 16 nt, Variola virus
aaguuaaauagaaugc

SEQ ID NO: 4089514 - RNA, 18 nt, Variola virus
aaguuagaaaaaaugauu

SEQ ID NO: 4089515 - RNA, 19 nt, Variola virus
aaguucauuaucugaaaua

SEQ ID NO: 4089516 - RNA, 18 nt, Variola virus
aaguucuggcaauguuuc

SEQ ID NO: 4089517 - RNA, 22 nt, Variola virus
aaguugcgaugaaauaggagau

SEQ ID NO: 4089518 - RNA, 15 nt, Variola virus
aaguuucuuuacugu

SEQ ID NO: 4089519 - RNA, 20 nt, Variola virus
aaguuuggacaguucccauu

SEQ ID NO: 4089520 - RNA, 13 nt, Variola virus
aaguuuuaccauu

SEQ ID NO: 4089521 - RNA, 23 nt, Variola virus
aaguuuuucacccauaaauagua

SEQ ID NO: 4089522 - RNA, 11 nt, Variola virus
aauaaaaauua

SEQ ID NO: 4089523 - RNA, 16 nt, Variola virus
aauaaaacaucaaugu

SEQ ID NO: 4089524 - RNA, 12 nt, Variola virus
aauaaaacauuu

SEQ ID NO: 4089525 - RNA, 13 nt, Variola virus
aauaaaagaacua

SEQ ID NO: 4089526 - RNA, 19 nt, Variola virus
aauaaaaugucacaaccuu

SEQ ID NO: 4089527 - RNA, 19 nt, Variola virus
aauaaacuaaacaaaacug

SEQ ID NO: 4089528 - RNA, 22 nt, Variola virus
aauaaacuccguagagaaauau

SEQ ID NO: 4089529 - RNA, 21 nt, Variola virus
aauaaagaugccauuuagaga

SEQ ID NO: 4089530 - RNA, 20 nt, Variola virus
aauaaaguuaaacaacuauu

SEQ ID NO: 4089531 - RNA, 11 nt, Variola virus
aauaaauggau

SEQ ID NO: 4089532 - RNA, 16 nt, Variola virus
aauaaaugguuucgaa

SEQ ID NO: 4089533 - RNA, 15 nt, Variola virus
aauaaauuuuuccaa

SEQ ID NO: 4089534 - RNA, 15 nt, Variola virus
aauaacauaggauua

SEQ ID NO: 4089535 - RNA, 15 nt, Variola virus
aauaacaucagaaaa

SEQ ID NO: 4089536 - RNA, 18 nt, Variola virus
aauaacuaaaaauguaaa

SEQ ID NO: 4089537 - RNA, 19 nt, Variola virus
aauaacuacaguuugaaaa

SEQ ID NO: 4089538 - RNA, 14 nt, Variola virus
aauaacuagaucau

SEQ ID NO: 4089539 - RNA, 19 nt, Variola virus
aauaacuauguuuuaaaaa

SEQ ID NO: 4089540 - RNA, 23 nt, Variola virus
aauaacucauuuauauauuaaaa

SEQ ID NO: 4089541 - RNA, 21 nt, Variola virus
aauaacugccggauaaaagug

SEQ ID NO: 4089542 - RNA, 17 nt, Variola virus
aauaagacuuugaacau

SEQ ID NO: 4089543 - RNA, 13 nt, Variola virus
aauaaguauauaa

SEQ ID NO: 4089544 - RNA, 15 nt, Variola virus
aauaaguauauaaau

SEQ ID NO: 4089545 - RNA, 18 nt, Variola virus
aauaauacaacaaccauu

SEQ ID NO: 4089546 - RNA, 19 nt, Variola virus
aauaauauaaaauucccaa

SEQ ID NO: 4089547 - RNA, 18 nt, Variola virus
aauaaucuaguaaaacuu

SEQ ID NO: 4089548 - RNA, 14 nt, Variola virus
aauaaucucaauua

SEQ ID NO: 4089549 - RNA, 14 nt, Variola virus
aauaauuaaugccc

SEQ ID NO: 4089550 - RNA, 24 nt, Variola virus
aauaauuacuuuacaaacgaugua

SEQ ID NO: 4089551 - RNA, 12 nt, Variola virus
aauaauuauucu

SEQ ID NO: 4089552 - RNA, 21 nt, Variola virus
aauaauuuugaagcauuggaa

SEQ ID NO: 4089553 - RNA, 14 nt, Variola virus
aauacaaaauaaua

SEQ ID NO: 4089554 - RNA, 14 nt, Variola virus
aauacaaaauguua

SEQ ID NO: 4089555 - RNA, 16 nt, Variola virus
aauacacccaauaaua

SEQ ID NO: 4089556 - RNA, 22 nt, Variola virus
aauacacuuagguuuuuagaaa

SEQ ID NO: 4089557 - RNA, 20 nt, Variola virus
aauacauauuguuuagcaaa

SEQ ID NO: 4089558 - RNA, 14 nt, Variola virus
aauacauguacaaa

SEQ ID NO: 4089559 - RNA, 21 nt, Variola virus
aauacauuucucaaaugaaua

SEQ ID NO: 4089560 - RNA, 18 nt, Variola virus
aauacccugaugaaaaug

SEQ ID NO: 4089561 - RNA, 22 nt, Variola virus
aauaccgacgcgucugaauauc

SEQ ID NO: 4089562 - RNA, 23 nt, Variola virus
aauacguccaucagcauuguuuc

SEQ ID NO: 4089563 - RNA, 23 nt, Variola virus
aauacgucuugcacguaaucuau

SEQ ID NO: 4089564 - RNA, 19 nt, Variola virus
aauacuauuacagaaguuu

SEQ ID NO: 4089565 - RNA, 11 nt, Variola virus
aauacuauuau

SEQ ID NO: 4089566 - RNA, 19 nt, Variola virus
aauacugaugcuuuuucca

SEQ ID NO: 4089567 - RNA, 17 nt, Variola virus
aauacuuaaaaauggau

SEQ ID NO: 4089568 - RNA, 18 nt, Variola virus
aauacuuaccuaaugccu

SEQ ID NO: 4089569 - RNA, 22 nt, Variola virus
aauagaaaccaaaucaaaacaa

SEQ ID NO: 4089570 - RNA, 11 nt, Variola virus
aauagaaucua

SEQ ID NO: 4089571 - RNA, 21 nt, Variola virus
aauagaggagccauuaaaugu

SEQ ID NO: 4089572 - RNA, 15 nt, Variola virus
aauagaguauuccaa

SEQ ID NO: 4089573 - RNA, 18 nt, Variola virus
aauagaugauagaauauc

SEQ ID NO: 4089574 - RNA, 21 nt, Variola virus
aauagauuggaugguugacau

SEQ ID NO: 4089575 - RNA, 15 nt, Variola virus
aauagauuuuucaua

SEQ ID NO: 4089576 - RNA, 23 nt, Variola virus
aauagcaaccaauguuugaucau

SEQ ID NO: 4089577 - RNA, 22 nt, Variola virus
aauaggaggaauugauauguau

SEQ ID NO: 4089578 - RNA, 23 nt, Variola virus
aauagguguaaaucuagaaauua

SEQ ID NO: 4089579 - RNA, 16 nt, Variola virus
aauaguacauuuucca

SEQ ID NO: 4089580 - RNA, 17 nt, Variola virus
aauagugcgaaaucauu

SEQ ID NO: 4089581 - RNA, 14 nt, Variola virus
aauauaaaaugaua

SEQ ID NO: 4089582 - RNA, 12 nt, Variola virus
aauauaacagua

SEQ ID NO: 4089583 - RNA, 16 nt, Variola virus
aauauaccauuaaaaa

SEQ ID NO: 4089584 - RNA, 21 nt, Variola virus
aauauagguauauuuauucca

SEQ ID NO: 4089585 - RNA, 17 nt, Variola virus
aauauaucccuuaaaaa

SEQ ID NO: 4089586 - RNA, 20 nt, Variola virus
aauauaugcaaaauaauauc

SEQ ID NO: 4089587 - RNA, 11 nt, Variola virus
aauauauguau

SEQ ID NO: 4089588 - RNA, 14 nt, Variola virus
aauauauugaucau

SEQ ID NO: 4089589 - RNA, 17 nt, Variola virus
aauauauugaucauaau

SEQ ID NO: 4089590 - RNA, 17 nt, Variola virus
aauaucaaacaauccaa

SEQ ID NO: 4089591 - RNA, 13 nt, Variola virus
aauaucaggaaau

SEQ ID NO: 4089592 - RNA, 20 nt, Variola virus
aauaucaggaaauguauaaa

SEQ ID NO: 4089593 - RNA, 14 nt, Variola virus
aauaucauaaucua

SEQ ID NO: 4089594 - RNA, 14 nt, Variola virus
aauaucauauguag

SEQ ID NO: 4089595 - RNA, 18 nt, Variola virus
aauaucauauuacgaaau

SEQ ID NO: 4089596 - RNA, 13 nt, Variola virus
aauauccucaaua

SEQ ID NO: 4089597 - RNA, 16 nt, Variola virus
aauaucuagauuauaa

SEQ ID NO: 4089598 - RNA, 15 nt, Variola virus
aauaucuaggacaau

SEQ ID NO: 4089599 - RNA, 13 nt, Variola virus
aauaucucaauga

SEQ ID NO: 4089600 - RNA, 20 nt, Variola virus
aauaugaaaucuaucuuaua

SEQ ID NO: 4089601 - RNA, 22 nt, Variola virus
aauaugaggaaaaugauuaaau

SEQ ID NO: 4089602 - RNA, 16 nt, Variola virus
aauaugcucaugaaga

SEQ ID NO: 4089603 - RNA, 17 nt, Variola virus
aauauggucuuuaaaaa

SEQ ID NO: 4089604 - RNA, 13 nt, Variola virus
aauauguauauau

SEQ ID NO: 4089605 - RNA, 21 nt, Variola virus
aauauuauuaccaucuuccgc

SEQ ID NO: 4089606 - RNA, 13 nt, Variola virus
aauauuauuuccc

SEQ ID NO: 4089607 - RNA, 16 nt, Variola virus
aauauucaguauauag

SEQ ID NO: 4089608 - RNA, 20 nt, Variola virus
aauauucuaugacugaaugu

SEQ ID NO: 4089609 - RNA, 13 nt, Variola virus
aauauucuguucu

SEQ ID NO: 4089610 - RNA, 21 nt, Variola virus
aauauuggcuuuucuuuauca

SEQ ID NO: 4089611 - RNA, 18 nt, Variola virus
aauauuguguuagccauu

SEQ ID NO: 4089612 - RNA, 16 nt, Variola virus
aauauuguuuuacugu

SEQ ID NO: 4089613 - RNA, 21 nt, Variola virus
aauauuguuuuacugucucaa

SEQ ID NO: 4089614 - RNA, 23 nt, Variola virus
aauauuguuuuucacuuuuuaua

SEQ ID NO: 4089615 - RNA, 21 nt, Variola virus
aauauuuaguuuauucauaau

SEQ ID NO: 4089616 - RNA, 17 nt, Variola virus
aauauuuguuaucauga

SEQ ID NO: 4089617 - RNA, 13 nt, Variola virus
aauauuuuaccuu

SEQ ID NO: 4089618 - RNA, 20 nt, Variola virus
aauauuuuuuauaaacauga

SEQ ID NO: 4089619 - RNA, 12 nt, Variola virus
aaucaaauacuu

SEQ ID NO: 4089620 - RNA, 21 nt, Variola virus
aaucaaaucucuaucgucaca

SEQ ID NO: 4089621 - RNA, 18 nt, Variola virus
aaucaacagaaguuaaua

SEQ ID NO: 4089622 - RNA, 19 nt, Variola virus
aaucaccauccuuuaaaaa

SEQ ID NO: 4089623 - RNA, 18 nt, Variola virus
acaucgaauauaaaauaa

SEQ ID NO: 4089624 - RNA, 16 nt, Variola virus
acaucgaugccuuaac

SEQ ID NO: 4089625 - RNA, 23 nt, Variola virus
acaucggugagugauaugccuau

SEQ ID NO: 4089626 - RNA, 21 nt, Variola virus
acaucguaaucaaaagaauug

SEQ ID NO: 4089627 - RNA, 23 nt, Variola virus
acaucuaaaaaauccuuaaugau

SEQ ID NO: 4089628 - RNA, 13 nt, Variola virus
acaucuaaaaaug

SEQ ID NO: 4089629 - RNA, 20 nt, Variola virus
acaucuagguuucaaaagac

SEQ ID NO: 4089630 - RNA, 14 nt, Variola virus
acaucucgcaauaa

SEQ ID NO: 4089631 - RNA, 16 nt, Variola virus
acaucucgcaauaauc

SEQ ID NO: 4089632 - RNA, 15 nt, Variola virus
acaugauauucaugu

SEQ ID NO: 4089633 - RNA, 14 nt, Variola virus
acaugauuaauaca

SEQ ID NO: 4089634 - RNA, 15 nt, Variola virus
acaugcaaggcauuu

SEQ ID NO: 4089635 - RNA, 23 nt, Variola virus
acaugcgguaaagauauuucuca

SEQ ID NO: 4089636 - RNA, 18 nt, Variola virus
acauggaauaaauuauua

SEQ ID NO: 4089637 - RNA, 13 nt, Variola virus
acaugguuaaagu

SEQ ID NO: 4089638 - RNA, 23 nt, Variola virus
acaugguuaaaguacauguacaa

SEQ ID NO: 4089639 - RNA, 19 nt, Variola virus
acauguuacuauagcauua

SEQ ID NO: 4089640 - RNA, 15 nt, Variola virus
acauguuuaaauaau

SEQ ID NO: 4089641 - RNA, 21 nt, Variola virus
acauuaaauguauauuuucca

SEQ ID NO: 4089642 - RNA, 20 nt, Variola virus
acauuaacaucuugaaccau

SEQ ID NO: 4089643 - RNA, 17 nt, Variola virus
acauuaacauuuugaaa

SEQ ID NO: 4089644 - RNA, 23 nt, Variola virus
acauuaaguaaauccuuaaguuc

SEQ ID NO: 4089645 - RNA, 13 nt, Variola virus
acauuauaugauu

SEQ ID NO: 4089646 - RNA, 17 nt, Variola virus
acauuauuaaucagaau

SEQ ID NO: 4089647 - RNA, 16 nt, Variola virus
acauucaaagauuuga

SEQ ID NO: 4089648 - RNA, 22 nt, Variola virus
acauucaugauaaacuuaauga

SEQ ID NO: 4089649 - RNA, 14 nt, Variola virus
acauucauuaauaa

SEQ ID NO: 4089650 - RNA, 17 nt, Variola virus
acauucauugucuauua

SEQ ID NO: 4089651 - RNA, 17 nt, Variola virus
acauugacauauuucga

SEQ ID NO: 4089652 - RNA, 14 nt, Variola virus
acauugauuaaaga

SEQ ID NO: 4089653 - RNA, 13 nt, Variola virus
acauuuauaucca

SEQ ID NO: 4089654 - RNA, 14 nt, Variola virus
acauuuaugauaug

SEQ ID NO: 4089655 - RNA, 15 nt, Variola virus
acauuuccuacuacu

SEQ ID NO: 4089656 - RNA, 13 nt, Variola virus
acauuuuaaaaua

SEQ ID NO: 4089657 - RNA, 14 nt, Variola virus
acauuuuauuucua

SEQ ID NO: 4089658 - RNA, 17 nt, Variola virus
acauuuucaucuagaua

SEQ ID NO: 4089659 - RNA, 14 nt, Variola virus
acauuuuccauuua

SEQ ID NO: 4089660 - RNA, 20 nt, Variola virus
acauuuuggcaaauugauua

SEQ ID NO: 4089661 - RNA, 13 nt, Variola virus
acauuuuuaaaga

SEQ ID NO: 4089662 - RNA, 18 nt, Variola virus
acauuuuuauaaauagau

SEQ ID NO: 4089663 - RNA, 18 nt, Variola virus
acauuuuuggauuucaua

SEQ ID NO: 4089664 - RNA, 17 nt, Variola virus
accaaaaacucauauaa

SEQ ID NO: 4089665 - RNA, 16 nt, Variola virus
accaaaucaaaacaaa

SEQ ID NO: 4089666 - RNA, 16 nt, Variola virus
accaaauuaaugaaua

SEQ ID NO: 4089667 - RNA, 16 nt, Variola virus
accaacaacuguaaaa

SEQ ID NO: 4089668 - RNA, 17 nt, Variola virus
accaacacuuaucaauu

SEQ ID NO: 4089669 - RNA, 19 nt, Variola virus
accaacagcagaaaaagac

SEQ ID NO: 4089670 - RNA, 18 nt, Variola virus
accaauaaaaauaaacua

SEQ ID NO: 4089671 - RNA, 21 nt, Variola virus
accaauagaaguuuucccaaa

SEQ ID NO: 4089672 - RNA, 23 nt, Variola virus
accaauauuggaauuauaauaua

SEQ ID NO: 4089673 - RNA, 12 nt, Variola virus
accaaugucucu

SEQ ID NO: 4089674 - RNA, 20 nt, Variola virus
accacuucucuaucaaugau

SEQ ID NO: 4089675 - RNA, 17 nt, Variola virus
accauauagaucaauca

SEQ ID NO: 4089676 - RNA, 22 nt, Variola virus
accauccguuaucgaagaaugg

SEQ ID NO: 4089677 - RNA, 21 nt, Variola virus
accaucguacucuacagcaua

SEQ ID NO: 4089678 - RNA, 19 nt, Variola virus
accaugaaauugagaagau

SEQ ID NO: 4089679 - RNA, 16 nt, Variola virus
accauuaauaggaaaa

SEQ ID NO: 4089680 - RNA, 16 nt, Variola virus
accauuaucuuuguuu

SEQ ID NO: 4089681 - RNA, 17 nt, Variola virus
accauuuuaaaaucauu

SEQ ID NO: 4089682 - RNA, 21 nt, Variola virus
acccaaguuugagauuucaua

SEQ ID NO: 4089683 - RNA, 17 nt, Variola virus
acccaugauaaugaaua

SEQ ID NO: 4089684 - RNA, 16 nt, Variola virus
acccauguuuaagaua

SEQ ID NO: 4089685 - RNA, 19 nt, Variola virus
acccauuagguuaaaugau

SEQ ID NO: 4089686 - RNA, 23 nt, Variola virus
acccuuccuuaaacgugaaugau

SEQ ID NO: 4089687 - RNA, 18 nt, Variola virus
accgauaauagacuauca

SEQ ID NO: 4089688 - RNA, 22 nt, Variola virus
accguauguucugauuuuaucu

SEQ ID NO: 4089689 - RNA, 17 nt, Variola virus
accguguguaaaaugac

SEQ ID NO: 4089690 - RNA, 16 nt, Variola virus
accguuguuaaauacu

SEQ ID NO: 4089691 - RNA, 21 nt, Variola virus
accuaaucccgcauuuauaca

SEQ ID NO: 4089692 - RNA, 21 nt, Variola virus
accuauaacauuaauaucaaa

SEQ ID NO: 4089693 - RNA, 15 nt, Variola virus
accuaugauaaagga

SEQ ID NO: 4089694 - RNA, 22 nt, Variola virus
accuauggauacgguacacgua

SEQ ID NO: 4089695 - RNA, 15 nt, Variola virus
accuauuuacuggug

SEQ ID NO: 4089696 - RNA, 16 nt, Variola virus
acgaaaggagagaaug

SEQ ID NO: 4089697 - RNA, 20 nt, Variola virus
acgaaaguauagcuaaugau

SEQ ID NO: 4089698 - RNA, 20 nt, Variola virus
acgaacauuuauaucauuug

SEQ ID NO: 4089699 - RNA, 19 nt, Variola virus
acgaaguauuuauacuuuu

SEQ ID NO: 4089700 - RNA, 20 nt, Variola virus
acgaauauugggcaaagaua

SEQ ID NO: 4089701 - RNA, 17 nt, Variola virus
acgaauucuaugaugaa

SEQ ID NO: 4089702 - RNA, 14 nt, Variola virus
acgacgagaaucuu

SEQ ID NO: 4089703 - RNA, 17 nt, Variola virus
acgacuauuaaaauaaa

SEQ ID NO: 4089704 - RNA, 21 nt, Variola virus
acgagaauggcguuugauaua

SEQ ID NO: 4089705 - RNA, 21 nt, Variola virus
acgauaaaaauaauauuguuu

SEQ ID NO: 4089706 - RNA, 23 nt, Variola virus
acgauaaaccaaaagcuuucuag

SEQ ID NO: 4089707 - RNA, 18 nt, Variola virus
acgauaaugucucuauaa

SEQ ID NO: 4089708 - RNA, 17 nt, Variola virus
acgauauaaauugauua

SEQ ID NO: 4089709 - RNA, 23 nt, Variola virus
acgauauuuguuggauuucugau

SEQ ID NO: 4089710 - RNA, 19 nt, Variola virus
acgaucuuuuauuucugau

SEQ ID NO: 4089711 - RNA, 12 nt, Variola virus
acgaugaaaaug

SEQ ID NO: 4089712 - RNA, 14 nt, Variola virus
acgaugauauguau

SEQ ID NO: 4089713 - RNA, 18 nt, Variola virus
acgauguaguuagauaga

SEQ ID NO: 4089714 - RNA, 15 nt, Variola virus
acgaugucaauaaug

SEQ ID NO: 4089715 - RNA, 16 nt, Variola virus
acgauuauuucuaaau

SEQ ID NO: 4089716 - RNA, 20 nt, Variola virus
acgauucuucacaagugaaa

SEQ ID NO: 4089717 - RNA, 17 nt, Variola virus
acgauugucaauacuuu

SEQ ID NO: 4089718 - RNA, 23 nt, Variola virus
acgcagaaauugguauaaauguu

SEQ ID NO: 4089719 - RNA, 14 nt, Variola virus
acgcgaacaucuuu

SEQ ID NO: 4089720 - RNA, 19 nt, Variola virus
acguaaauacaaaacagaa

SEQ ID NO: 4089721 - RNA, 14 nt, Variola virus
acguaauaaugaag

SEQ ID NO: 4089722 - RNA, 23 nt, Variola virus
acguaucaccaacggaaauggua

SEQ ID NO: 4089723 - RNA, 17 nt, Variola virus
acguaucucgucuaaau

SEQ ID NO: 4089724 - RNA, 22 nt, Variola virus
acguauuuggcagaguuaucca

SEQ ID NO: 4089725 - RNA, 17 nt, Variola virus
acgucaaagguuaacau

SEQ ID NO: 4089726 - RNA, 15 nt, Variola virus
acgucauucuaaaag

SEQ ID NO: 4089727 - RNA, 13 nt, Variola virus
acgucauuucauc

SEQ ID NO: 4089728 - RNA, 13 nt, Variola virus
acguuaacagaga

SEQ ID NO: 4089729 - RNA, 19 nt, Variola virus
acguuaauugucuauaaau

SEQ ID NO: 4089730 - RNA, 18 nt, Variola virus
acguucacuaauaaauug

SEQ ID NO: 4089731 - RNA, 14 nt, Variola virus
acguucauuaaaaa

SEQ ID NO: 4089732 - RNA, 12 nt, Variola virus
acguugucuuuc

SEQ ID NO: 4089733 - RNA, 16 nt, Variola virus
acguuuaaacauucuu

SEQ ID NO: 4089734 - RNA, 17 nt, Variola virus
acuaaaaauaaacauug

SEQ ID NO: 4089735 - RNA, 15 nt, Variola virus
acuaaaagacauaau

SEQ ID NO: 4089736 - RNA, 14 nt, Variola virus
acuaaaauauuuua

SEQ ID NO: 4089737 - RNA, 17 nt, Variola virus
acuaaacacacauuauu

SEQ ID NO: 4089738 - RNA, 18 nt, Variola virus
acuaaacacauuauuaau

SEQ ID NO: 4089739 - RNA, 18 nt, Variola virus
acuaaacaguuuauugau

SEQ ID NO: 4089740 - RNA, 14 nt, Variola virus
acuaaaucuucaca

SEQ ID NO: 4089741 - RNA, 16 nt, Variola virus
acuaacaauaacuaga

SEQ ID NO: 4089742 - RNA, 19 nt, Variola virus
acuaacgaaauuaauauga

SEQ ID NO: 4089743 - RNA, 17 nt, Variola virus
acuaagcccaaaaccaa

SEQ ID NO: 4089744 - RNA, 15 nt, Variola virus
acuaauacaucugaa

SEQ ID NO: 4089745 - RNA, 16 nt, Variola virus
acuaauacaucugaaa

SEQ ID NO: 4089746 - RNA, 16 nt, Variola virus
acuaauauaacuuauu

SEQ ID NO: 4089747 - RNA, 21 nt, Variola virus
acuaauuaagcauauucuuaa

SEQ ID NO: 4089748 - RNA, 19 nt, Variola virus
acuaauucauuuucaauaa

SEQ ID NO: 4089749 - RNA, 15 nt, Variola virus
auuuuaauauugaaa

SEQ ID NO: 4089750 - RNA, 19 nt, Variola virus
auuuuacaaauaauggcug

SEQ ID NO: 4089751 - RNA, 13 nt, Variola virus
auuuuacauuauu

SEQ ID NO: 4089752 - RNA, 20 nt, Variola virus
auuuuaccuuauuuuuuaua

SEQ ID NO: 4089753 - RNA, 14 nt, Variola virus
auuuuauugcuaau

SEQ ID NO: 4089754 - RNA, 15 nt, Variola virus
auuuuauuuuggaaa

SEQ ID NO: 4089755 - RNA, 16 nt, Variola virus
auuuucacaaauacua

SEQ ID NO: 4089756 - RNA, 16 nt, Variola virus
auuuucauucacuauu

SEQ ID NO: 4089757 - RNA, 18 nt, Variola virus
auuuuccaaauacaucca

SEQ ID NO: 4089758 - RNA, 18 nt, Variola virus
auuuugcauaacauguau

SEQ ID NO: 4089759 - RNA, 22 nt, Variola virus
auuuuguaguuaauuuaucaca

SEQ ID NO: 4089760 - RNA, 17 nt, Variola virus
auuuugugcaaauagau

SEQ ID NO: 4089761 - RNA, 17 nt, Variola virus
auuuuguggugcaacuu

SEQ ID NO: 4089762 - RNA, 16 nt, Variola virus
auuuuuaauagcugcu

SEQ ID NO: 4089763 - RNA, 22 nt, Variola virus
auuuuuagugaaacauuccaca

SEQ ID NO: 4089764 - RNA, 12 nt, Variola virus
auuuuucaauua

SEQ ID NO: 4089765 - RNA, 20 nt, Variola virus
auuuuucuucauuuauuaua

SEQ ID NO: 4089766 - RNA, 22 nt, Variola virus
auuuuuggaagacagccgucgc

SEQ ID NO: 4089767 - RNA, 15 nt, Variola virus
auuuuuguugauaaa

SEQ ID NO: 4089768 - RNA, 13 nt, Variola virus
auuuuuuaucaua

SEQ ID NO: 4089769 - RNA, 21 nt, Variola virus
caaaaaacuuuacgauagacu

SEQ ID NO: 4089770 - RNA, 20 nt, Variola virus
caaaaaauaaaagaugauuu

SEQ ID NO: 4089771 - RNA, 13 nt, Variola virus
caaaaaauacaau

SEQ ID NO: 4089772 - RNA, 13 nt, Variola virus
caaaaaauauauu

SEQ ID NO: 4089773 - RNA, 13 nt, Variola virus
caaaaaauguaua

SEQ ID NO: 4089774 - RNA, 13 nt, Variola virus
caaaaacgauauu

SEQ ID NO: 4089775 - RNA, 12 nt, Variola virus
caaaaagagagu

SEQ ID NO: 4089776 - RNA, 11 nt, Variola virus
caaaaagcaua

SEQ ID NO: 4089777 - RNA, 18 nt, Variola virus
caaaaagggugcgguacu

SEQ ID NO: 4089778 - RNA, 12 nt, Variola virus
caaaaauauauu

SEQ ID NO: 4089779 - RNA, 13 nt, Variola virus
caaaaaucuauca

SEQ ID NO: 4089780 - RNA, 16 nt, Variola virus
caaaaauguucuuaau

SEQ ID NO: 4089781 - RNA, 19 nt, Variola virus
caaaacaacauauacacau

SEQ ID NO: 4089782 - RNA, 15 nt, Variola virus
caaaacugaaaauau

SEQ ID NO: 4089783 - RNA, 18 nt, Variola virus
caaaagacaugauaauau

SEQ ID NO: 4089784 - RNA, 20 nt, Variola virus
caaaagacguaaauauucua

SEQ ID NO: 4089785 - RNA, 17 nt, Variola virus
caaaagauuaaggagau

SEQ ID NO: 4089786 - RNA, 19 nt, Variola virus
caaaaguaagcauuuccuu

SEQ ID NO: 4089787 - RNA, 13 nt, Variola virus
caaaaguauacau

SEQ ID NO: 4089788 - RNA, 15 nt, Variola virus
caaaaguuaauaaca

SEQ ID NO: 4089789 - RNA, 17 nt, Variola virus
caaaauaacaaauacua

SEQ ID NO: 4089790 - RNA, 16 nt, Variola virus
caaaauacaaaauguu

SEQ ID NO: 4089791 - RNA, 14 nt, Variola virus
caaaaucuuaauau

SEQ ID NO: 4089792 - RNA, 16 nt, Variola virus
caaaaugauagauauu

SEQ ID NO: 4089793 - RNA, 12 nt, Variola virus
caaaaugauaua

SEQ ID NO: 4089794 - RNA, 19 nt, Variola virus
caaaaugaugauauacgau

SEQ ID NO: 4089795 - RNA, 23 nt, Variola virus
caaaauuaaccgauaaaaagacu

SEQ ID NO: 4089796 - RNA, 12 nt, Variola virus
caaaauuacaau

SEQ ID NO: 4089797 - RNA, 19 nt, Variola virus
caaaauugucuaugauauc

SEQ ID NO: 4089798 - RNA, 16 nt, Variola virus
caaaauuuauauauca

SEQ ID NO: 4089799 - RNA, 19 nt, Variola virus
caaacaaguuaaugagaua

SEQ ID NO: 4089800 - RNA, 14 nt, Variola virus
caaacaauguuucu

SEQ ID NO: 4089801 - RNA, 15 nt, Variola virus
caaacauacaucuau

SEQ ID NO: 4089802 - RNA, 14 nt, Variola virus
caaacugcugaagu

SEQ ID NO: 4089803 - RNA, 20 nt, Variola virus
caaacuuagaaccaaaugau

SEQ ID NO: 4089804 - RNA, 11 nt, Variola virus
caaagaaagag

SEQ ID NO: 4089805 - RNA, 13 nt, Variola virus
caaagauauggaa

SEQ ID NO: 4089806 - RNA, 18 nt, Variola virus
caaagauucuguguauaa

SEQ ID NO: 4089807 - RNA, 19 nt, Variola virus
caaagauuuaaauccuaau

SEQ ID NO: 4089808 - RNA, 21 nt, Variola virus
caaagcggguuauaaaguaaa

SEQ ID NO: 4089809 - RNA, 19 nt, Variola virus
caaaggauguuuaacauuc

SEQ ID NO: 4089810 - RNA, 18 nt, Variola virus
caaagguacuauuucuac

SEQ ID NO: 4089811 - RNA, 14 nt, Variola virus
caaagugaaacaau

SEQ ID NO: 4089812 - RNA, 14 nt, Variola virus
caaauaaaaaguau

SEQ ID NO: 4089813 - RNA, 21 nt, Variola virus
caaauaaagcgaaaaauaauu

SEQ ID NO: 4089814 - RNA, 23 nt, Variola virus
caaauaaagcgaaaaauaauuau

SEQ ID NO: 4089815 - RNA, 22 nt, Variola virus
caaauaaaucacuaaauaauau

SEQ ID NO: 4089816 - RNA, 18 nt, Variola virus
caaauaagaagguacaau

SEQ ID NO: 4089817 - RNA, 10 nt, Variola virus
caaauacuug

SEQ ID NO: 4089818 - RNA, 19 nt, Variola virus
caaauagagauaaaacaag

SEQ ID NO: 4089819 - RNA, 23 nt, Variola virus
caaauaucggaauaaguagacau

SEQ ID NO: 4089820 - RNA, 22 nt, Variola virus
caaauaucggcauuuauguuuc

SEQ ID NO: 4089821 - RNA, 17 nt, Variola virus
caaauaucuuuaugaau

SEQ ID NO: 4089822 - RNA, 18 nt, Variola virus
caaauaucuuuaugaauu

SEQ ID NO: 4089823 - RNA, 21 nt, Variola virus
caaauauucacaagaugaauu

SEQ ID NO: 4089824 - RNA, 14 nt, Variola virus
caaaucaaaacaaa

SEQ ID NO: 4089825 - RNA, 15 nt, Variola virus
caaaucaaaaguauu

SEQ ID NO: 4089826 - RNA, 22 nt, Variola virus
caaaucuaaauucacaucuuca

SEQ ID NO: 4089827 - RNA, 18 nt, Variola virus
caaaucuauaacaugcua

SEQ ID NO: 4089828 - RNA, 13 nt, Variola virus
caaaucuggaaaa

SEQ ID NO: 4089829 - RNA, 18 nt, Variola virus
caaaucuucuuauaagau

SEQ ID NO: 4089830 - RNA, 20 nt, Variola virus
caaaugauauaagacuaaca

SEQ ID NO: 4089831 - RNA, 14 nt, Variola virus
caaauguuaaacau

SEQ ID NO: 4089832 - RNA, 22 nt, Variola virus
caaauguuaaacauuaauugau

SEQ ID NO: 4089833 - RNA, 14 nt, Variola virus
caaauguugucaaa

SEQ ID NO: 4089834 - RNA, 17 nt, Variola virus
caaauguugucaaauga

SEQ ID NO: 4089835 - RNA, 18 nt, Variola virus
caaauuaaauucuggaau

SEQ ID NO: 4089836 - RNA, 12 nt, Variola virus
caaauuauucua

SEQ ID NO: 4089837 - RNA, 13 nt, Variola virus
caaauuuaucuac

SEQ ID NO: 4089838 - RNA, 20 nt, Variola virus
caaauuuauuccauauuuua

SEQ ID NO: 4089839 - RNA, 23 nt, Variola virus
caaauuuuuucuuuaauauuuua

SEQ ID NO: 4089840 - RNA, 13 nt, Variola virus
caacaaacauauu

SEQ ID NO: 4089841 - RNA, 15 nt, Variola virus
caacaacauauaauu

SEQ ID NO: 4089842 - RNA, 13 nt, Variola virus
caacacuauguua

SEQ ID NO: 4089843 - RNA, 19 nt, Variola virus
caacauaaauaauucuaga

SEQ ID NO: 4089844 - RNA, 13 nt, Variola virus
caacauuguagaa

SEQ ID NO: 4089845 - RNA, 23 nt, Variola virus
caaccauuaacggaugaaaauaa

SEQ ID NO: 4089846 - RNA, 16 nt, Variola virus
caaccuguauacugua

SEQ ID NO: 4089847 - RNA, 21 nt, Variola virus
caacuaucguuggaaaaugau

SEQ ID NO: 4089848 - RNA, 17 nt, Variola virus
caacucucucauuuucu

SEQ ID NO: 4089849 - RNA, 12 nt, Variola virus
caacucucuuuu

SEQ ID NO: 4089850 - RNA, 20 nt, Variola virus
caacuuaaacaaaauacaau

SEQ ID NO: 4089851 - RNA, 13 nt, Variola virus
caacuuaaugaag

SEQ ID NO: 4089852 - RNA, 16 nt, Variola virus
caacuuacuaggcagc

SEQ ID NO: 4089853 - RNA, 16 nt, Variola virus
caagaaguuuaucuac

SEQ ID NO: 4089854 - RNA, 23 nt, Variola virus
caagaauccgaucccacuucugu

SEQ ID NO: 4089855 - RNA, 16 nt, Variola virus
caagacuaacacacaa

SEQ ID NO: 4089856 - RNA, 21 nt, Variola virus
caagagaaugaaauauauaca

SEQ ID NO: 4089857 - RNA, 17 nt, Variola virus
caagagagcagaaauaa

SEQ ID NO: 4089858 - RNA, 15 nt, Variola virus
caagauauauauacu

SEQ ID NO: 4089859 - RNA, 21 nt, Variola virus
caagauccucucuuaaaugaa

SEQ ID NO: 4089860 - RNA, 16 nt, Variola virus
caagauuccuuuucua

SEQ ID NO: 4089861 - RNA, 17 nt, Variola virus
caaggaacuaaauagau

SEQ ID NO: 4089862 - RNA, 20 nt, Variola virus
caagguaaccucuuaggaag

SEQ ID NO: 4089863 - RNA, 12 nt, Variola virus
caaguacauaaa

SEQ ID NO: 4089864 - RNA, 14 nt, Variola virus
caaguauccaucau

SEQ ID NO: 4089865 - RNA, 22 nt, Variola virus
caaguauuauuuuuggaagaca

SEQ ID NO: 4089866 - RNA, 22 nt, Variola virus
caaguuuccuguaaauuuucua

SEQ ID NO: 4089867 - RNA, 19 nt, Variola virus
caauaaaaauaaacuagaa

SEQ ID NO: 4089868 - RNA, 20 nt, Variola virus
caauaaaaauaaacuagaaa

SEQ ID NO: 4089869 - RNA, 14 nt, Variola virus
caauaaauguccaa

SEQ ID NO: 4089870 - RNA, 18 nt, Variola virus
caauaacacaaucaugau

SEQ ID NO: 4089871 - RNA, 15 nt, Variola virus
caauaacauaacucu

SEQ ID NO: 4089872 - RNA, 18 nt, Variola virus
caauaaguuuuagauauu

SEQ ID NO: 4089873 - RNA, 18 nt, Variola virus
caauaauaguaacauauu

SEQ ID NO: 4089874 - RNA, 18 nt, Variola virus
caauacacacaauagaca

SEQ ID NO: 4089875 - RNA, 19 nt, Variola virus
caauacaccaauagaugau

SEQ ID NO: 4089876 - RNA, 15 nt, Variola virus
ccauuaagugacauu

SEQ ID NO: 4089877 - RNA, 21 nt, Variola virus
ccauuauaaaacuuaugauua

SEQ ID NO: 4089878 - RNA, 16 nt, Variola virus
ccauuucaaaauguua

SEQ ID NO: 4089879 - RNA, 17 nt, Variola virus
ccauuuguguaucuaua

SEQ ID NO: 4089880 - RNA, 22 nt, Variola virus
cccaaucuuguuauaaacacac

SEQ ID NO: 4089881 - RNA, 24 nt, Variola virus
cccaugcuauauuccuguuaucau

SEQ ID NO: 4089882 - RNA, 13 nt, Variola virus
ccggcgaaaagau

SEQ ID NO: 4089883 - RNA, 21 nt, Variola virus
ccgguucuuaauauuguauug

SEQ ID NO: 4089884 - RNA, 19 nt, Variola virus
ccgucaagagaguuaucug

SEQ ID NO: 4089885 - RNA, 20 nt, Variola virus
ccguuaguuuaauauccuua

SEQ ID NO: 4089886 - RNA, 18 nt, Variola virus
ccguuuuccccucucugu

SEQ ID NO: 4089887 - RNA, 20 nt, Variola virus
ccuacacuauuauaugauua

SEQ ID NO: 4089888 - RNA, 22 nt, Variola virus
ccuaccaaaaucaauauaucau

SEQ ID NO: 4089889 - RNA, 15 nt, Variola virus
ccuagaacaauguca

SEQ ID NO: 4089890 - RNA, 14 nt, Variola virus
ccuauuuguagaag

SEQ ID NO: 4089891 - RNA, 19 nt, Variola virus
ccucaaucauguacuagcu

SEQ ID NO: 4089892 - RNA, 19 nt, Variola virus
ccucauuuaucauguuguc

SEQ ID NO: 4089893 - RNA, 12 nt, Variola virus
ccuccuccacca

SEQ ID NO: 4089894 - RNA, 20 nt, Variola virus
ccucugccuuuuuauacaua

SEQ ID NO: 4089895 - RNA, 15 nt, Variola virus
ccuggaaaaauacuu

SEQ ID NO: 4089896 - RNA, 19 nt, Variola virus
ccuguauucuuuuuaagau

SEQ ID NO: 4089897 - RNA, 20 nt, Variola virus
ccuuaugcauccaaaguauu

SEQ ID NO: 4089898 - RNA, 18 nt, Variola virus
ccuuguuugauaaaugua

SEQ ID NO: 4089899 - RNA, 16 nt, Variola virus
ccuuuacagugaauaa

SEQ ID NO: 4089900 - RNA, 17 nt, Variola virus
ccuuuauuaauucucuc

SEQ ID NO: 4089901 - RNA, 23 nt, Variola virus
ccuuugauaaauaguaucaucua

SEQ ID NO: 4089902 - RNA, 21 nt, Variola virus
ccuuuggugaauccaucucua

SEQ ID NO: 4089903 - RNA, 20 nt, Variola virus
ccuuugucuaccaucuccuc

SEQ ID NO: 4089904 - RNA, 21 nt, Variola virus
cgaaaaacuuuaauguagaua

SEQ ID NO: 4089905 - RNA, 18 nt, Variola virus
cgaaauauauuuguagua

SEQ ID NO: 4089906 - RNA, 14 nt, Variola virus
cgaaccagaaagug

SEQ ID NO: 4089907 - RNA, 22 nt, Variola virus
cgaacuccauaaauuucuccaa

SEQ ID NO: 4089908 - RNA, 14 nt, Variola virus
cgaacuuuaaacag

SEQ ID NO: 4089909 - RNA, 22 nt, Variola virus
cgaauacgauacuuauaaggcu

SEQ ID NO: 4089910 - RNA, 18 nt, Variola virus
cgaauauaucaaaacuac

SEQ ID NO: 4089911 - RNA, 22 nt, Variola virus
cgaauaucguucucuaaauguc

SEQ ID NO: 4089912 - RNA, 21 nt, Variola virus
cgaauauugggcaaagauauu

SEQ ID NO: 4089913 - RNA, 14 nt, Variola virus
cgaaugaauguuuu

SEQ ID NO: 4089914 - RNA, 13 nt, Variola virus
cgacaagauaucg

SEQ ID NO: 4089915 - RNA, 18 nt, Variola virus
cgacaucuggauuucaga

SEQ ID NO: 4089916 - RNA, 20 nt, Variola virus
cgacuacucuggguaacaaa

SEQ ID NO: 4089917 - RNA, 12 nt, Variola virus
cgagacuauuau

SEQ ID NO: 4089918 - RNA, 18 nt, Variola virus
cgagauacccaauagaau

SEQ ID NO: 4089919 - RNA, 16 nt, Variola virus
cgaguuuaaaacuucu

SEQ ID NO: 4089920 - RNA, 21 nt, Variola virus
cgauaaaauccuccuaucaau

SEQ ID NO: 4089921 - RNA, 17 nt, Variola virus
cgauaacuugauuucaa

SEQ ID NO: 4089922 - RNA, 19 nt, Variola virus
cgauauuaaccuaaaagag

SEQ ID NO: 4089923 - RNA, 15 nt, Variola virus
cgauauuaguacaga

SEQ ID NO: 4089924 - RNA, 15 nt, Variola virus
cgaucuaauaacaau

SEQ ID NO: 4089925 - RNA, 16 nt, Variola virus
cgaugaugcugcuaua

SEQ ID NO: 4089926 - RNA, 16 nt, Variola virus
cgauguggaaauuaca

SEQ ID NO: 4089927 - RNA, 17 nt, Variola virus
cgaugugucuacauaaa

SEQ ID NO: 4089928 - RNA, 17 nt, Variola virus
cgauucaucuauacgau

SEQ ID NO: 4089929 - RNA, 19 nt, Variola virus
cgauucuauauauacucuu

SEQ ID NO: 4089930 - RNA, 22 nt, Variola virus
cgauugagauuuugcauacaau

SEQ ID NO: 4089931 - RNA, 19 nt, Variola virus
cgauugauuuggaauucuu

SEQ ID NO: 4089932 - RNA, 18 nt, Variola virus
cgauuguauaguuaauaa

SEQ ID NO: 4089933 - RNA, 20 nt, Variola virus
cgauuuauaaaaaaauaccg

SEQ ID NO: 4089934 - RNA, 14 nt, Variola virus
cgcagaaaauaucu

SEQ ID NO: 4089935 - RNA, 13 nt, Variola virus
cgcauuaaaugau

SEQ ID NO: 4089936 - RNA, 16 nt, Variola virus
cgcauuaacaaaaucu

SEQ ID NO: 4089937 - RNA, 21 nt, Variola virus
cgcauuaguaagugcuacaaa

SEQ ID NO: 4089938 - RNA, 14 nt, Variola virus
cgcccuuguauguu

SEQ ID NO: 4089939 - RNA, 19 nt, Variola virus
cgcggaaaaaacauaauag

SEQ ID NO: 4089940 - RNA, 20 nt, Variola virus
cgcuacaauuauagaacgaa

SEQ ID NO: 4089941 - RNA, 14 nt, Variola virus
cgcuauagcauugu

SEQ ID NO: 4089942 - RNA, 23 nt, Variola virus
cggaaaaucgucuucauaaagca

SEQ ID NO: 4089943 - RNA, 14 nt, Variola virus
cggaagacaaucaa

SEQ ID NO: 4089944 - RNA, 18 nt, Variola virus
cggagauuuaaucuguaa

SEQ ID NO: 4089945 - RNA, 13 nt, Variola virus
cggauacgacauc

SEQ ID NO: 4089946 - RNA, 18 nt, Variola virus
cggauuaauaucucuauc

SEQ ID NO: 4089947 - RNA, 15 nt, Variola virus
cggcauuagaugaga

SEQ ID NO: 4089948 - RNA, 20 nt, Variola virus
cggcgauucuuuuucuuucg

SEQ ID NO: 4089949 - RNA, 21 nt, Variola virus
cgggucaucugguuuaggaaa

SEQ ID NO: 4089950 - RNA, 15 nt, Variola virus
cgguacaacauucca

SEQ ID NO: 4089951 - RNA, 17 nt, Variola virus
cgguguaauagaauuua

SEQ ID NO: 4089952 - RNA, 23 nt, Variola virus
cguaaaccauuuuucagaaagua

SEQ ID NO: 4089953 - RNA, 18 nt, Variola virus
cguaauacccauguuuaa

SEQ ID NO: 4089954 - RNA, 14 nt, Variola virus
cguaauuuuuuaua

SEQ ID NO: 4089955 - RNA, 16 nt, Variola virus
cguagaaaacuauuac

SEQ ID NO: 4089956 - RNA, 15 nt, Variola virus
cguagacuuucuugc

SEQ ID NO: 4089957 - RNA, 12 nt, Variola virus
cguauacaguau

SEQ ID NO: 4089958 - RNA, 16 nt, Variola virus
cguauaucaucaucug

SEQ ID NO: 4089959 - RNA, 18 nt, Variola virus
cguauauuuuauacauuu

SEQ ID NO: 4089960 - RNA, 14 nt, Variola virus
cguaucuucugaaa

SEQ ID NO: 4089961 - RNA, 23 nt, Variola virus
cguaugugguaugauacaaucaa

SEQ ID NO: 4089962 - RNA, 22 nt, Variola virus
cgucaauguacuuaacaugauu

SEQ ID NO: 4089963 - RNA, 16 nt, Variola virus
cguccaucagcauugu

SEQ ID NO: 4089964 - RNA, 15 nt, Variola virus
cgucuagaugauaua

SEQ ID NO: 4089965 - RNA, 17 nt, Variola virus
cgucuauauaguauuuu

SEQ ID NO: 4089966 - RNA, 12 nt, Variola virus
cgucuauccauu

SEQ ID NO: 4089967 - RNA, 12 nt, Variola virus
cgucucuguauu

SEQ ID NO: 4089968 - RNA, 22 nt, Variola virus
cgucugucaugauaaaaauuua

SEQ ID NO: 4089969 - RNA, 12 nt, Variola virus
cgucuguggaug

SEQ ID NO: 4089970 - RNA, 15 nt, Variola virus
cgucuuuauuuucua

SEQ ID NO: 4089971 - RNA, 21 nt, Variola virus
cgucuuuauuuucuauuuuua

SEQ ID NO: 4089972 - RNA, 18 nt, Variola virus
cguggauaauauuucuag

SEQ ID NO: 4089973 - RNA, 22 nt, Variola virus
cguguauuaaauagaauauuua

SEQ ID NO: 4089974 - RNA, 15 nt, Variola virus
cguguguuucaggau

SEQ ID NO: 4089975 - RNA, 12 nt, Variola virus
cguuacuauuau

SEQ ID NO: 4089976 - RNA, 13 nt, Variola virus
cguuagacauaaa

SEQ ID NO: 4089977 - RNA, 20 nt, Variola virus
cguuaucauuugaugauaug

SEQ ID NO: 4089978 - RNA, 21 nt, Variola virus
cguucaacaacguacauacua

SEQ ID NO: 4089979 - RNA, 13 nt, Variola virus
cguuguuaagaua

SEQ ID NO: 4089980 - RNA, 16 nt, Variola virus
cguuuaaagucauuau

SEQ ID NO: 4089981 - RNA, 14 nt, Variola virus
cguuuauagauguu

SEQ ID NO: 4089982 - RNA, 22 nt, Variola virus
cguuucauaaagagaucaggaa

SEQ ID NO: 4089983 - RNA, 22 nt, Variola virus
cuaaaaguauagcaucuggagu

SEQ ID NO: 4089984 - RNA, 17 nt, Variola virus
cuaaaauuuugaucauc

SEQ ID NO: 4089985 - RNA, 15 nt, Variola virus
cuaaacaagcuaucu

SEQ ID NO: 4089986 - RNA, 12 nt, Variola virus
cuaaacuagugg

SEQ ID NO: 4089987 - RNA, 20 nt, Variola virus
cuaaagacucuaaaugguug

SEQ ID NO: 4089988 - RNA, 20 nt, Variola virus
cuaaaggaucugacccuaau

SEQ ID NO: 4089989 - RNA, 14 nt, Variola virus
cuaaaggaugagua

SEQ ID NO: 4089990 - RNA, 12 nt, Variola virus
cuaaauccucau

SEQ ID NO: 4089991 - RNA, 12 nt, Variola virus
cuaaauuagaac

SEQ ID NO: 4089992 - RNA, 22 nt, Variola virus
cuaaauuuuguugauuacucuu

SEQ ID NO: 4089993 - RNA, 13 nt, Variola virus
cuaacaaaacuau

SEQ ID NO: 4089994 - RNA, 23 nt, Variola virus
cuaacauacgagacauguuagua

SEQ ID NO: 4089995 - RNA, 17 nt, Variola virus
cuaacauuaaaaugucu

SEQ ID NO: 4089996 - RNA, 19 nt, Variola virus
cuaagagaaaucuuuagac

SEQ ID NO: 4089997 - RNA, 16 nt, Variola virus
cuaaggaguaaaauag

SEQ ID NO: 4089998 - RNA, 21 nt, Variola virus
cuaaguucuuugaucucuuuu

SEQ ID NO: 4089999 - RNA, 15 nt, Variola virus
cuaaguuucuuuccu

SEQ ID NO: 4090000 - RNA, 22 nt, Variola virus
cuaauaacguuuuuauuuguaa

SEQ ID NO: 4090001 - RNA, 15 nt, Variola virus
cuaauagacggcauu

SEQ ID NO: 4090002 - RNA, 23 nt, Variola virus
gaaaauaaaucacugacgauauu

SEQ ID NO: 4090003 - RNA, 21 nt, Variola virus
gaaaauaauccugaauauauu

SEQ ID NO: 4090004 - RNA, 22 nt, Variola virus
gaaaauaaugacgcguacgaua

SEQ ID NO: 4090005 - RNA, 16 nt, Variola virus
gaaaauacuaaaucag

SEQ ID NO: 4090006 - RNA, 12 nt, Variola virus
gaaaauacuaua

SEQ ID NO: 4090007 - RNA, 11 nt, Variola virus
gaaaauacuua

SEQ ID NO: 4090008 - RNA, 15 nt, Variola virus
gaaaauauaaauuaa

SEQ ID NO: 4090009 - RNA, 21 nt, Variola virus
gaaaauauuguguuuaaucuu

SEQ ID NO: 4090010 - RNA, 15 nt, Variola virus
gaaaaucuaauaacu

SEQ ID NO: 4090011 - RNA, 21 nt, Variola virus
gaaaaugugcuucuaugagau

SEQ ID NO: 4090012 - RNA, 18 nt, Variola virus
gaaacaauucauaauuau

SEQ ID NO: 4090013 - RNA, 20 nt, Variola virus
gaaacacuuauuaaguucuu

SEQ ID NO: 4090014 - RNA, 18 nt, Variola virus
gaaacaguuccauaugau

SEQ ID NO: 4090015 - RNA, 22 nt, Variola virus
gaaacauccaucgauacauaua

SEQ ID NO: 4090016 - RNA, 18 nt, Variola virus
gaaacaucucuucuaguu

SEQ ID NO: 4090017 - RNA, 23 nt, Variola virus
gaaacguaauauccucaauaacg

SEQ ID NO: 4090018 - RNA, 14 nt, Variola virus
gaaacuaucuuuuu

SEQ ID NO: 4090019 - RNA, 15 nt, Variola virus
gaaagauuaaaucau

SEQ ID NO: 4090020 - RNA, 22 nt, Variola virus
gaaagauuaaaucauuaaauga

SEQ ID NO: 4090021 - RNA, 21 nt, Variola virus
gaaagauucuauaauaaugaa

SEQ ID NO: 4090022 - RNA, 15 nt, Variola virus
gaaagcgagaaauaa

SEQ ID NO: 4090023 - RNA, 21 nt, Variola virus
gaaaguaugauauaauacuua

SEQ ID NO: 4090024 - RNA, 23 nt, Variola virus
gaaaguauuuuuguguuaaaaca

SEQ ID NO: 4090025 - RNA, 15 nt, Variola virus
gaaauaaauaaugaa

SEQ ID NO: 4090026 - RNA, 21 nt, Variola virus
gaaauaaccgcaugauuauuu

SEQ ID NO: 4090027 - RNA, 16 nt, Variola virus
gaaauaauuuuuaguu

SEQ ID NO: 4090028 - RNA, 18 nt, Variola virus
gaaauagaggaagacaca

SEQ ID NO: 4090029 - RNA, 17 nt, Variola virus
gaaauagauagaaucua

SEQ ID NO: 4090030 - RNA, 19 nt, Variola virus
gaaauagcucguuucuauu

SEQ ID NO: 4090031 - RNA, 13 nt, Variola virus
gaaauauauuaag

SEQ ID NO: 4090032 - RNA, 20 nt, Variola virus
gaaauauauuuguaguacaa

SEQ ID NO: 4090033 - RNA, 18 nt, Variola virus
gaaauauguaauaaucau

SEQ ID NO: 4090034 - RNA, 16 nt, Variola virus
gaaaucaacauaaugu

SEQ ID NO: 4090035 - RNA, 23 nt, Variola virus
gaaaucuuuagacgguugagaaa

SEQ ID NO: 4090036 - RNA, 20 nt, Variola virus
gaaauggcguauuuaagagu

SEQ ID NO: 4090037 - RNA, 15 nt, Variola virus
gaaaugguacaauca

SEQ ID NO: 4090038 - RNA, 20 nt, Variola virus
gaaaugucuacauaaaucua

SEQ ID NO: 4090039 - RNA, 14 nt, Variola virus
gaaauuaauaugau

SEQ ID NO: 4090040 - RNA, 17 nt, Variola virus
gaaauuagaaaguaaug

SEQ ID NO: 4090041 - RNA, 17 nt, Variola virus
gaaauuguuauaaugcu

SEQ ID NO: 4090042 - RNA, 17 nt, Variola virus
gaacaaacgcuacuaua

SEQ ID NO: 4090043 - RNA, 14 nt, Variola virus
gaacaauaaaagag

SEQ ID NO: 4090044 - RNA, 18 nt, Variola virus
gaacaauaaacaaaauac

SEQ ID NO: 4090045 - RNA, 19 nt, Variola virus
gaacagcuuuuguauauac

SEQ ID NO: 4090046 - RNA, 15 nt, Variola virus
gaacauaaacaaauu

SEQ ID NO: 4090047 - RNA, 15 nt, Variola virus
gaacauaauaauaua

SEQ ID NO: 4090048 - RNA, 20 nt, Variola virus
gaacauacuuuccuguagua

SEQ ID NO: 4090049 - RNA, 16 nt, Variola virus
gaacauauaaauguag

SEQ ID NO: 4090050 - RNA, 14 nt, Variola virus
gaacaucuuccaua

SEQ ID NO: 4090051 - RNA, 21 nt, Variola virus
gaaccacuauguuaauacuua

SEQ ID NO: 4090052 - RNA, 15 nt, Variola virus
gaacgauaauaacuu

SEQ ID NO: 4090053 - RNA, 14 nt, Variola virus
gaacgauaaugaau

SEQ ID NO: 4090054 - RNA, 13 nt, Variola virus
gaacgccauaaua

SEQ ID NO: 4090055 - RNA, 16 nt, Variola virus
gaacgccgguauauag

SEQ ID NO: 4090056 - RNA, 22 nt, Variola virus
gaacguaguaguaaguauuuau

SEQ ID NO: 4090057 - RNA, 13 nt, Variola virus
gaacuaccaauau

SEQ ID NO: 4090058 - RNA, 24 nt, Variola virus
gaacuauauuaagauuaucuauca

SEQ ID NO: 4090059 - RNA, 19 nt, Variola virus
gaacuaucauagaugagaa

SEQ ID NO: 4090060 - RNA, 22 nt, Variola virus
gaacucuaaucaaaaucuuaau

SEQ ID NO: 4090061 - RNA, 21 nt, Variola virus
gaacucuguuucuguaucuau

SEQ ID NO: 4090062 - RNA, 18 nt, Variola virus
gaacuucugaucauuaau

SEQ ID NO: 4090063 - RNA, 20 nt, Variola virus
gaacuuguuuaaugaugaau

SEQ ID NO: 4090064 - RNA, 22 nt, Variola virus
gaagaacguguauuaaauagaa

SEQ ID NO: 4090065 - RNA, 16 nt, Variola virus
gaagacaauauuauca

SEQ ID NO: 4090066 - RNA, 23 nt, Variola virus
gaagagcuguacaauaguuuuua

SEQ ID NO: 4090067 - RNA, 13 nt, Variola virus
gaagauauuacau

SEQ ID NO: 4090068 - RNA, 20 nt, Variola virus
gaagaucgcguuaaucaugu

SEQ ID NO: 4090069 - RNA, 15 nt, Variola virus
gaagauuauauucua

SEQ ID NO: 4090070 - RNA, 19 nt, Variola virus
gaaggaugacaauaaugac

SEQ ID NO: 4090071 - RNA, 13 nt, Variola virus
gaagguauuucca

SEQ ID NO: 4090072 - RNA, 18 nt, Variola virus
gaaguacuuauuaaaacc

SEQ ID NO: 4090073 - RNA, 23 nt, Variola virus
gaaguauaucugaguaugaugau

SEQ ID NO: 4090074 - RNA, 16 nt, Variola virus
gaagugauauuugaaa

SEQ ID NO: 4090075 - RNA, 16 nt, Variola virus
gaaguggauauacaua

SEQ ID NO: 4090076 - RNA, 21 nt, Variola virus
gaaguuccgguugccauguau

SEQ ID NO: 4090077 - RNA, 20 nt, Variola virus
gaaguuuucccaaaaaauau

SEQ ID NO: 4090078 - RNA, 14 nt, Variola virus
gaauaaauauccuu

SEQ ID NO: 4090079 - RNA, 14 nt, Variola virus
gaauaaauuauuau

SEQ ID NO: 4090080 - RNA, 11 nt, Variola virus
gaauaagaaca

SEQ ID NO: 4090081 - RNA, 22 nt, Variola virus
gaauaauaugacucaugaucua

SEQ ID NO: 4090082 - RNA, 13 nt, Variola virus
gaauaauguuucu

SEQ ID NO: 4090083 - RNA, 15 nt, Variola virus
gaauacauggaagaa

SEQ ID NO: 4090084 - RNA, 22 nt, Variola virus
gaauacucuacagaguugauug

SEQ ID NO: 4090085 - RNA, 23 nt, Variola virus
gaauagccaccggaaacuuucua

SEQ ID NO: 4090086 - RNA, 23 nt, Variola virus
gaauagcggauauagauauuaaa

SEQ ID NO: 4090087 - RNA, 17 nt, Variola virus
gaauagguuuuugaauu

SEQ ID NO: 4090088 - RNA, 19 nt, Variola virus
gaauaguuuguuuuggaaa

SEQ ID NO: 4090089 - RNA, 15 nt, Variola virus
gaauauaauaaucua

SEQ ID NO: 4090090 - RNA, 12 nt, Variola virus
gaauauaaucuu

SEQ ID NO: 4090091 - RNA, 20 nt, Variola virus
gaauauacaaaguuaguaca

SEQ ID NO: 4090092 - RNA, 13 nt, Variola virus
gaauauaguuaua

SEQ ID NO: 4090093 - RNA, 16 nt, Variola virus
gaauauaucuauaauu

SEQ ID NO: 4090094 - RNA, 22 nt, Variola virus
gaauauauguauguaaaaauau

SEQ ID NO: 4090095 - RNA, 18 nt, Variola virus
gaauaucacauaucaugu

SEQ ID NO: 4090096 - RNA, 18 nt, Variola virus
gaauaucccuaaguucuu

SEQ ID NO: 4090097 - RNA, 22 nt, Variola virus
gaauaugauuucagauacuaua

SEQ ID NO: 4090098 - RNA, 17 nt, Variola virus
gaauauguuauaauaga

SEQ ID NO: 4090099 - RNA, 20 nt, Variola virus
gaauauuagcacauucauug

SEQ ID NO: 4090100 - RNA, 18 nt, Variola virus
gaauauuauuaugaugau

SEQ ID NO: 4090101 - RNA, 14 nt, Variola virus
gaaucaauauuaau

SEQ ID NO: 4090102 - RNA, 15 nt, Variola virus
gaaucauaaagaaca

SEQ ID NO: 4090103 - RNA, 18 nt, Variola virus
gaaucccuacauauuuua

SEQ ID NO: 4090104 - RNA, 14 nt, Variola virus
gaauccuauacucu

SEQ ID NO: 4090105 - RNA, 19 nt, Variola virus
gaaucgguuuuauacuguu

SEQ ID NO: 4090106 - RNA, 13 nt, Variola virus
gaaucugugaaau

SEQ ID NO: 4090107 - RNA, 19 nt, Variola virus
gaaugaagauaucauuaau

SEQ ID NO: 4090108 - RNA, 16 nt, Variola virus
gaaugcgauacauuga

SEQ ID NO: 4090109 - RNA, 23 nt, Variola virus
gaauggaaaccuuuaaucuauau

SEQ ID NO: 4090110 - RNA, 21 nt, Variola virus
gaaugucauuuguauuuuaua

SEQ ID NO: 4090111 - RNA, 17 nt, Variola virus
gaauguuuuacucugga

SEQ ID NO: 4090112 - RNA, 17 nt, Variola virus
gaauuacauuucuuguu

SEQ ID NO: 4090113 - RNA, 23 nt, Variola virus
gaauuacuuuacauauaauauca

SEQ ID NO: 4090114 - RNA, 15 nt, Variola virus
gaauuaguuaaucuu

SEQ ID NO: 4090115 - RNA, 19 nt, Variola virus
gaauugauaauauaaauau

SEQ ID NO: 4090116 - RNA, 20 nt, Variola virus
gaauuggaacuaguauuuau

SEQ ID NO: 4090117 - RNA, 12 nt, Variola virus
gaauuucccaaa

SEQ ID NO: 4090118 - RNA, 20 nt, Variola virus
gaauuugaucuauugcccua

SEQ ID NO: 4090119 - RNA, 18 nt, Variola virus
gacaaaauauuagaaaaa

SEQ ID NO: 4090120 - RNA, 19 nt, Variola virus
gacaagauccguuaguuua

SEQ ID NO: 4090121 - RNA, 21 nt, Variola virus
gacaauauuuaguuuauucau

SEQ ID NO: 4090122 - RNA, 15 nt, Variola virus
gacaaugaauugcau

SEQ ID NO: 4090123 - RNA, 16 nt, Variola virus
gacacaccaaaaaaga

SEQ ID NO: 4090124 - RNA, 13 nt, Variola virus
gacagaaaaaugu

SEQ ID NO: 4090125 - RNA, 18 nt, Variola virus
gacagaaccuugugucau

SEQ ID NO: 4090126 - RNA, 23 nt, Variola virus
gacaguaauuucuuuauuaucua

SEQ ID NO: 4090127 - RNA, 16 nt, Variola virus
ucaaaauauuaaacca

SEQ ID NO: 4090128 - RNA, 16 nt, Variola virus
ucaaacacgauauuca

SEQ ID NO: 4090129 - RNA, 23 nt, Variola virus
ucaaacgaauaaacaauuucaca

SEQ ID NO: 4090130 - RNA, 19 nt, Variola virus
ucaaacggugcagacguau

SEQ ID NO: 4090131 - RNA, 12 nt, Variola virus
ucaaagaaauaa

SEQ ID NO: 4090132 - RNA, 19 nt, Variola virus
ucaaaguccggauguauua

SEQ ID NO: 4090133 - RNA, 14 nt, Variola virus
ucaaauacuucaaa

SEQ ID NO: 4090134 - RNA, 16 nt, Variola virus
ucaaauaggagauauu

SEQ ID NO: 4090135 - RNA, 19 nt, Variola virus
ucaaauggauaauuuaaga

SEQ ID NO: 4090136 - RNA, 12 nt, Variola virus
ucaaauguagug

SEQ ID NO: 4090137 - RNA, 20 nt, Variola virus
ucaaauucucauucauguau

SEQ ID NO: 4090138 - RNA, 20 nt, Variola virus
ucaacaaucuaauacaaaau

SEQ ID NO: 4090139 - RNA, 13 nt, Variola virus
ucaacauauuaau

SEQ ID NO: 4090140 - RNA, 14 nt, Variola virus
ucaacaucuuuaau

SEQ ID NO: 4090141 - RNA, 16 nt, Variola virus
ucaacggaaaacauuu

SEQ ID NO: 4090142 - RNA, 18 nt, Variola virus
ucaacuaaagggauuuua

SEQ ID NO: 4090143 - RNA, 14 nt, Variola virus
ucaacucaugugua

SEQ ID NO: 4090144 - RNA, 14 nt, Variola virus
ucaacuuucauagc

SEQ ID NO: 4090145 - RNA, 17 nt, Variola virus
ucaaggaugucauagau

SEQ ID NO: 4090146 - RNA, 14 nt, Variola virus
ucaagucaauuauc

SEQ ID NO: 4090147 - RNA, 17 nt, Variola virus
ucaaguuaugaaaauag

SEQ ID NO: 4090148 - RNA, 12 nt, Variola virus
ucaauaaaugug

SEQ ID NO: 4090149 - RNA, 17 nt, Variola virus
ucaauagauugguaaau

SEQ ID NO: 4090150 - RNA, 16 nt, Variola virus
ucaauaugucaucuau

SEQ ID NO: 4090151 - RNA, 18 nt, Variola virus
ucaaucaaggaacuaaau

SEQ ID NO: 4090152 - RNA, 20 nt, Variola virus
ucaaucauccuaaagaguau

SEQ ID NO: 4090153 - RNA, 19 nt, Variola virus
ucaaucucuucuauuuuca

SEQ ID NO: 4090154 - RNA, 19 nt, Variola virus
ucaaugauuaguuucuuaa

SEQ ID NO: 4090155 - RNA, 19 nt, Variola virus
ucaaugcggguguuauuca

SEQ ID NO: 4090156 - RNA, 21 nt, Variola virus
ucaauggaccccaacaucuuu

SEQ ID NO: 4090157 - RNA, 23 nt, Variola virus
ucaaugugaauguauucacuuaa

SEQ ID NO: 4090158 - RNA, 20 nt, Variola virus
ucaauguguguaacuccaga

SEQ ID NO: 4090159 - RNA, 23 nt, Variola virus
ucaauuaacauucuuauaacauc

SEQ ID NO: 4090160 - RNA, 21 nt, Variola virus
ucaauuggcacgaacaaaaau

SEQ ID NO: 4090161 - RNA, 13 nt, Variola virus
ucaauuuguacau

SEQ ID NO: 4090162 - RNA, 19 nt, Variola virus
ucaauuuugaaaauacuua

SEQ ID NO: 4090163 - RNA, 21 nt, Variola virus
ucacaaaaauaaauccacauu

SEQ ID NO: 4090164 - RNA, 19 nt, Variola virus
ucacaacaucuauaaaagu

SEQ ID NO: 4090165 - RNA, 19 nt, Variola virus
ucacaacuuuacuguuuuu

SEQ ID NO: 4090166 - RNA, 16 nt, Variola virus
ucacaaucacugugag

SEQ ID NO: 4090167 - RNA, 15 nt, Variola virus
ucacacaauguagug

SEQ ID NO: 4090168 - RNA, 19 nt, Variola virus
ucacagaauccgaguaaaa

SEQ ID NO: 4090169 - RNA, 12 nt, Variola virus
ucacauacuuug

SEQ ID NO: 4090170 - RNA, 21 nt, Variola virus
ucacaucaucgaacuucugau

SEQ ID NO: 4090171 - RNA, 23 nt, Variola virus
ucaccgaugaacgucauuucucu

SEQ ID NO: 4090172 - RNA, 24 nt, Variola virus
ucacgcucucuacguagacuuucu

SEQ ID NO: 4090173 - RNA, 14 nt, Variola virus
ucacguuaauaacg

SEQ ID NO: 4090174 - RNA, 21 nt, Variola virus
ucacuaacugauaccaugaaa

SEQ ID NO: 4090175 - RNA, 15 nt, Variola virus
ucacuaauaaauugg

SEQ ID NO: 4090176 - RNA, 19 nt, Variola virus
ucacuauaauauaaucuag

SEQ ID NO: 4090177 - RNA, 22 nt, Variola virus
ucacucucauaauguaaagaua

SEQ ID NO: 4090178 - RNA, 16 nt, Variola virus
ucacucuucgaaaaga

SEQ ID NO: 4090179 - RNA, 17 nt, Variola virus
ucagaaaagucaaauau

SEQ ID NO: 4090180 - RNA, 21 nt, Variola virus
ucagaaacgacaucaugaaca

SEQ ID NO: 4090181 - RNA, 18 nt, Variola virus
ucagaaauauauaacaau

SEQ ID NO: 4090182 - RNA, 16 nt, Variola virus
ucagaaauuacaaaca

SEQ ID NO: 4090183 - RNA, 18 nt, Variola virus
ucagaacacacuuuucuc

SEQ ID NO: 4090184 - RNA, 21 nt, Variola virus
ucagaagugugaauaugaucu

SEQ ID NO: 4090185 - RNA, 14 nt, Variola virus
ucagaauaucucau

SEQ ID NO: 4090186 - RNA, 18 nt, Variola virus
ucagaauaucucauucaa

SEQ ID NO: 4090187 - RNA, 17 nt, Variola virus
ucagacaacaucucaga

SEQ ID NO: 4090188 - RNA, 19 nt, Variola virus
ucagacgaguguaaacacu

SEQ ID NO: 4090189 - RNA, 12 nt, Variola virus
ucagaguucagu

SEQ ID NO: 4090190 - RNA, 12 nt, Variola virus
ucagaucaaagu

SEQ ID NO: 4090191 - RNA, 19 nt, Variola virus
ucagauuauuaaguauaau

SEQ ID NO: 4090192 - RNA, 16 nt, Variola virus
ucagauuauuuaacaa

SEQ ID NO: 4090193 - RNA, 14 nt, Variola virus
ucagcgugauuuuc

SEQ ID NO: 4090194 - RNA, 19 nt, Variola virus
ucaguacauagauuaucca

SEQ ID NO: 4090195 - RNA, 15 nt, Variola virus
ucaguaucuucuuua

SEQ ID NO: 4090196 - RNA, 22 nt, Variola virus
ucagucuccacacuauucuuaa

SEQ ID NO: 4090197 - RNA, 21 nt, Variola virus
ucagugcacucauguaaccaa

SEQ ID NO: 4090198 - RNA, 20 nt, Variola virus
ucaguuccggaucuauagaa

SEQ ID NO: 4090199 - RNA, 13 nt, Variola virus
ucauaaauacaga

SEQ ID NO: 4090200 - RNA, 16 nt, Variola virus
ucauaauagaauguau

SEQ ID NO: 4090201 - RNA, 20 nt, Variola virus
ucauagccgcucuuagaguu

SEQ ID NO: 4090202 - RNA, 16 nt, Variola virus
ucauagcugagaauau

SEQ ID NO: 4090203 - RNA, 20 nt, Variola virus
ucauauaacuucuagaugua

SEQ ID NO: 4090204 - RNA, 21 nt, Variola virus
ucauauacguucgucaccaga

SEQ ID NO: 4090205 - RNA, 17 nt, Variola virus
ucauauacucaauuagu

SEQ ID NO: 4090206 - RNA, 17 nt, Variola virus
ucauauaguuauguaua

SEQ ID NO: 4090207 - RNA, 18 nt, Variola virus
ucauauaucugcucuuaa

SEQ ID NO: 4090208 - RNA, 12 nt, Variola virus
ucauaucuguaa

SEQ ID NO: 4090209 - RNA, 14 nt, Variola virus
ucauaucuguaauu

SEQ ID NO: 4090210 - RNA, 16 nt, Variola virus
ucauauggaagauguu

SEQ ID NO: 4090211 - RNA, 16 nt, Variola virus
ucauauuauaaagaug

SEQ ID NO: 4090212 - RNA, 15 nt, Variola virus
ucauauuauagauuu

SEQ ID NO: 4090213 - RNA, 17 nt, Variola virus
ucauauuccaauucacg

SEQ ID NO: 4090214 - RNA, 14 nt, Variola virus
ucauauuuagauuu

SEQ ID NO: 4090215 - RNA, 16 nt, Variola virus
ucaucaaacaacugaa

SEQ ID NO: 4090216 - RNA, 22 nt, Variola virus
ucaucacugucaucaguuaugu

SEQ ID NO: 4090217 - RNA, 19 nt, Variola virus
ucaucacuuagaacagauu

SEQ ID NO: 4090218 - RNA, 20 nt, Variola virus
ucaucaugauccuauucuaa

SEQ ID NO: 4090219 - RNA, 23 nt, Variola virus
ucaucauuaacaauccaauaaua

SEQ ID NO: 4090220 - RNA, 15 nt, Variola virus
ucauccaugguuuua

SEQ ID NO: 4090221 - RNA, 16 nt, Variola virus
ucauccgaucauuaau

SEQ ID NO: 4090222 - RNA, 18 nt, Variola virus
ucauccguggauauuuga

SEQ ID NO: 4090223 - RNA, 16 nt, Variola virus
ucauccguuguuauau

SEQ ID NO: 4090224 - RNA, 18 nt, Variola virus
ucauccuuaaauguuuuc

SEQ ID NO: 4090225 - RNA, 13 nt, Variola virus
ucaucuacaaaaa

SEQ ID NO: 4090226 - RNA, 15 nt, Variola virus
ucaucuacucuacaa

SEQ ID NO: 4090227 - RNA, 23 nt, Variola virus
ucaucugaaauugucacuacuaa

SEQ ID NO: 4090228 - RNA, 22 nt, Variola virus
ucaucugggaauaaaauacuac

SEQ ID NO: 4090229 - RNA, 19 nt, Variola virus
ucaucuuguucagaaauau

SEQ ID NO: 4090230 - RNA, 15 nt, Variola virus
ucaugaagagauguu

SEQ ID NO: 4090231 - RNA, 17 nt, Variola virus
ucaugacuucauugaua

SEQ ID NO: 4090232 - RNA, 17 nt, Variola virus
ucaugauggaugugugu

SEQ ID NO: 4090233 - RNA, 18 nt, Variola virus
ucauguagauaguuacca

SEQ ID NO: 4090234 - RNA, 17 nt, Variola virus
ucauguguucaaaguau

SEQ ID NO: 4090235 - RNA, 23 nt, Variola virus
ucauguuaaaaaaucuugauaga

SEQ ID NO: 4090236 - RNA, 15 nt, Variola virus
ucauguuaacacucu

SEQ ID NO: 4090237 - RNA, 17 nt, Variola virus
ucauuaaaaaaauuaac

SEQ ID NO: 4090238 - RNA, 20 nt, Variola virus
ucauuaagguucuuauaauc

SEQ ID NO: 4090239 - RNA, 17 nt, Variola virus
ucauuaaguucacuaga

SEQ ID NO: 4090240 - RNA, 13 nt, Variola virus
ucauuaauacagu

SEQ ID NO: 4090241 - RNA, 13 nt, Variola virus
ucauuaucugaaa

SEQ ID NO: 4090242 - RNA, 16 nt, Variola virus
ucauuauuuaaguuuu

SEQ ID NO: 4090243 - RNA, 18 nt, Variola virus
ucauucacggaacuacau

SEQ ID NO: 4090244 - RNA, 16 nt, Variola virus
ucauucucuagaagau

SEQ ID NO: 4090245 - RNA, 19 nt, Variola virus
ucauugaugaugugagaga

SEQ ID NO: 4090246 - RNA, 14 nt, Variola virus
ucauuggaaaauau

SEQ ID NO: 4090247 - RNA, 20 nt, Variola virus
ucauuuacuaaggaguaaaa

SEQ ID NO: 4090248 - RNA, 19 nt, Variola virus
ucauuuauuauauauaaug

SEQ ID NO: 4090249 - RNA, 19 nt, Variola virus
ucauuuauugauaauaacu

SEQ ID NO: 4090250 - RNA, 12 nt, Variola virus
ucauuugaaaau

SEQ ID NO: 4090251 - RNA, 22 nt, Variola virus
ucauuugcucggcaguaaucaa

SEQ ID NO: 4090252 - RNA, 19 nt, Variola virus
uccaaauuuaaauacuuua

SEQ ID NO: 4090253 - RNA, 12 nt, Variola virus
ugacuucaucau

SEQ ID NO: 4090254 - RNA, 16 nt, Variola virus
ugagaagauauucucu

SEQ ID NO: 4090255 - RNA, 20 nt, Variola virus
ugagaauaucuuuauucauu

SEQ ID NO: 4090256 - RNA, 23 nt, Variola virus
ugagaaugaauacgaauucuaug

SEQ ID NO: 4090257 - RNA, 13 nt, Variola virus
ugagauaagaaca

SEQ ID NO: 4090258 - RNA, 22 nt, Variola virus
ugagauacuaacacauuucaac

SEQ ID NO: 4090259 - RNA, 21 nt, Variola virus
ugagauguguuuacacuaacu

SEQ ID NO: 4090260 - RNA, 13 nt, Variola virus
ugagauuuugcau

SEQ ID NO: 4090261 - RNA, 19 nt, Variola virus
ugagcauaaacauaauaaa

SEQ ID NO: 4090262 - RNA, 19 nt, Variola virus
ugaggaaauaaaucauaua

SEQ ID NO: 4090263 - RNA, 21 nt, Variola virus
ugaguaucggagcuacauuac

SEQ ID NO: 4090264 - RNA, 15 nt, Variola virus
ugagugcagaugcug

SEQ ID NO: 4090265 - RNA, 16 nt, Variola virus
ugaguucugugcagau

SEQ ID NO: 4090266 - RNA, 14 nt, Variola virus
ugaguuuaauaacu

SEQ ID NO: 4090267 - RNA, 20 nt, Variola virus
ugauacacuaaguauauaca

SEQ ID NO: 4090268 - RNA, 16 nt, Variola virus
ugauacguauauacac

SEQ ID NO: 4090269 - RNA, 16 nt, Variola virus
ugauagaauuauacca

SEQ ID NO: 4090270 - RNA, 17 nt, Variola virus
ugauaguaauucucgga

SEQ ID NO: 4090271 - RNA, 22 nt, Variola virus
ugauaguauuccaauaucugag

SEQ ID NO: 4090272 - RNA, 14 nt, Variola virus
ugauauaauacuua

SEQ ID NO: 4090273 - RNA, 16 nt, Variola virus
ugauauauucuuuaaa

SEQ ID NO: 4090274 - RNA, 14 nt, Variola virus
ugauauauuuucca

SEQ ID NO: 4090275 - RNA, 19 nt, Variola virus
ugauaucauuaauacagua

SEQ ID NO: 4090276 - RNA, 22 nt, Variola virus
ugauaucuacaucguuuggauu

SEQ ID NO: 4090277 - RNA, 23 nt, Variola virus
ugauaucuauaauaggguaucua

SEQ ID NO: 4090278 - RNA, 14 nt, Variola virus
ugauauuguuacag

SEQ ID NO: 4090279 - RNA, 22 nt, Variola virus
ugaucuaguuacaacuauuaca

SEQ ID NO: 4090280 - RNA, 21 nt, Variola virus
ugaucuaucgaaaauugcuau

SEQ ID NO: 4090281 - RNA, 15 nt, Variola virus
ugaucugguuuugag

SEQ ID NO: 4090282 - RNA, 21 nt, Variola virus
ugaucuuuauuuuuuguguau

SEQ ID NO: 4090283 - RNA, 23 nt, Variola virus
ugaugaaucuucauuaucugaua

SEQ ID NO: 4090284 - RNA, 14 nt, Variola virus
ugaugaauuuacca

SEQ ID NO: 4090285 - RNA, 18 nt, Variola virus
ugaugcgaauagcagaua

SEQ ID NO: 4090286 - RNA, 15 nt, Variola virus
ugaugcgauucaaaa

SEQ ID NO: 4090287 - RNA, 21 nt, Variola virus
ugaugcguuccauuuguguau

SEQ ID NO: 4090288 - RNA, 16 nt, Variola virus
ugaugcugguucugga

SEQ ID NO: 4090289 - RNA, 20 nt, Variola virus
ugauguauaacaacugucaa

SEQ ID NO: 4090290 - RNA, 16 nt, Variola virus
ugauuaggcaugucga

SEQ ID NO: 4090291 - RNA, 15 nt, Variola virus
ugauugauucuucca

SEQ ID NO: 4090292 - RNA, 17 nt, Variola virus
ugauuguuugacaaauc

SEQ ID NO: 4090293 - RNA, 18 nt, Variola virus
ugauuucagauacuauau

SEQ ID NO: 4090294 - RNA, 22 nt, Variola virus
ugauuucucucauaaauacaga

SEQ ID NO: 4090295 - RNA, 17 nt, Variola virus
ugauuucugaauuauug

SEQ ID NO: 4090296 - RNA, 18 nt, Variola virus
ugauuucuggugauacgu

SEQ ID NO: 4090297 - RNA, 18 nt, Variola virus
ugauuuucguaacagaua

SEQ ID NO: 4090298 - RNA, 13 nt, Variola virus
ugauuuugaagau

SEQ ID NO: 4090299 - RNA, 15 nt, Variola virus
ugcaaagaacaaaau

SEQ ID NO: 4090300 - RNA, 15 nt, Variola virus
ugcaacauuaacauc

SEQ ID NO: 4090301 - RNA, 21 nt, Variola virus
ugcaacgaauuauuagucugu

SEQ ID NO: 4090302 - RNA, 17 nt, Variola virus
ugcacguuuacauaucu

SEQ ID NO: 4090303 - RNA, 17 nt, Variola virus
ugcacuugccaugauuc

SEQ ID NO: 4090304 - RNA, 14 nt, Variola virus
ugcagaauauuucu

SEQ ID NO: 4090305 - RNA, 17 nt, Variola virus
ugcagauaucguucuua

SEQ ID NO: 4090306 - RNA, 16 nt, Variola virus
ugcauaaucagauucu

SEQ ID NO: 4090307 - RNA, 20 nt, Variola virus
ugcaucuuauuagaauauua

SEQ ID NO: 4090308 - RNA, 15 nt, Variola virus
ugcauuauccaaaau

SEQ ID NO: 4090309 - RNA, 17 nt, Variola virus
ugcauucguuuaaagau

SEQ ID NO: 4090310 - RNA, 19 nt, Variola virus
ugccaaaucuauaagaaaa

SEQ ID NO: 4090311 - RNA, 20 nt, Variola virus
ugccaaugauguuaggaaau

SEQ ID NO: 4090312 - RNA, 16 nt, Variola virus
ugccaauguuaauuuc

SEQ ID NO: 4090313 - RNA, 18 nt, Variola virus
ugccauaaauaaaugcuu

SEQ ID NO: 4090314 - RNA, 22 nt, Variola virus
ugccaucacucucauaauguaa

SEQ ID NO: 4090315 - RNA, 21 nt, Variola virus
ugcgagagacaaaaugugaua

SEQ ID NO: 4090316 - RNA, 14 nt, Variola virus
ugcgaucaauaaau

SEQ ID NO: 4090317 - RNA, 15 nt, Variola virus
ugcgauguuaauuua

SEQ ID NO: 4090318 - RNA, 18 nt, Variola virus
ugcuaaacuuuauguacu

SEQ ID NO: 4090319 - RNA, 17 nt, Variola virus
ugcuaauacgaauauua

SEQ ID NO: 4090320 - RNA, 18 nt, Variola virus
ugcuauguugauucuauu

SEQ ID NO: 4090321 - RNA, 15 nt, Variola virus
ugcucaaacaaaaug

SEQ ID NO: 4090322 - RNA, 20 nt, Variola virus
ugcucaaacaaaaugugaua

SEQ ID NO: 4090323 - RNA, 18 nt, Variola virus
ugcugaugaugaauacau

SEQ ID NO: 4090324 - RNA, 14 nt, Variola virus
ugcugcguguauaa

SEQ ID NO: 4090325 - RNA, 14 nt, Variola virus
ugcuuugaauaauu

SEQ ID NO: 4090326 - RNA, 16 nt, Variola virus
ugcuuuuuugacauau

SEQ ID NO: 4090327 - RNA, 17 nt, Variola virus
uggaagguuuguauucu

SEQ ID NO: 4090328 - RNA, 19 nt, Variola virus
uggaauagaugaaggaaua

SEQ ID NO: 4090329 - RNA, 20 nt, Variola virus
uggaauccaauuguuugaua

SEQ ID NO: 4090330 - RNA, 11 nt, Variola virus
uggaauuauuu

SEQ ID NO: 4090331 - RNA, 17 nt, Variola virus
uggaauuguauauuaca

SEQ ID NO: 4090332 - RNA, 21 nt, Variola virus
uggacaacggugagaaugacg

SEQ ID NO: 4090333 - RNA, 19 nt, Variola virus
uggaccauuaauaggaaaa

SEQ ID NO: 4090334 - RNA, 18 nt, Variola virus
uggagacauccauugaua

SEQ ID NO: 4090335 - RNA, 13 nt, Variola virus
uggagaugaaugc

SEQ ID NO: 4090336 - RNA, 17 nt, Variola virus
uggaggauuauaugaua

SEQ ID NO: 4090337 - RNA, 14 nt, Variola virus
uggaguacagaauu

SEQ ID NO: 4090338 - RNA, 16 nt, Variola virus
uggauacuaauuguag

SEQ ID NO: 4090339 - RNA, 18 nt, Variola virus
uggaucugugauguaugc

SEQ ID NO: 4090340 - RNA, 17 nt, Variola virus
uggaugaggaagugaua

SEQ ID NO: 4090341 - RNA, 20 nt, Variola virus
uggauggaucauaauugaug

SEQ ID NO: 4090342 - RNA, 16 nt, Variola virus
uggauuaaacauacua

SEQ ID NO: 4090343 - RNA, 14 nt, Variola virus
uggauuucauauag

SEQ ID NO: 4090344 - RNA, 12 nt, Variola virus
uggauuuggauu

SEQ ID NO: 4090345 - RNA, 14 nt, Variola virus
uggcgaaauuauug

SEQ ID NO: 4090346 - RNA, 23 nt, Variola virus
uggcuaagaagucauauguggua

SEQ ID NO: 4090347 - RNA, 21 nt, Variola virus
uggcuucuuccauaguuagaa

SEQ ID NO: 4090348 - RNA, 14 nt, Variola virus
ugguaauauggaua

SEQ ID NO: 4090349 - RNA, 22 nt, Variola virus
ugguaauggguuccgucaaaau

SEQ ID NO: 4090350 - RNA, 19 nt, Variola virus
ugguacagaaaauaucaug

SEQ ID NO: 4090351 - RNA, 18 nt, Variola virus
ugguaguugaaucaacau

SEQ ID NO: 4090352 - RNA, 14 nt, Variola virus
ugguauaucaacau

SEQ ID NO: 4090353 - RNA, 15 nt, Variola virus
ugguaucaacagaua

SEQ ID NO: 4090354 - RNA, 13 nt, Variola virus
ugguauuauucua

SEQ ID NO: 4090355 - RNA, 18 nt, Variola virus
ugguauuucuuacauaaa

SEQ ID NO: 4090356 - RNA, 16 nt, Variola virus
uggucaaaaacugaag

SEQ ID NO: 4090357 - RNA, 21 nt, Variola virus
uggucuagauguaaaaaaugu

SEQ ID NO: 4090358 - RNA, 21 nt, Variola virus
uggucucaacgcaaacuuuuu

SEQ ID NO: 4090359 - RNA, 17 nt, Variola virus
uggucuuguauaucuua

SEQ ID NO: 4090360 - RNA, 15 nt, Variola virus
uggugcauucauagc

SEQ ID NO: 4090361 - RNA, 13 nt, Variola virus
ugguguagcauau

SEQ ID NO: 4090362 - RNA, 14 nt, Variola virus
ugguguuacaguua

SEQ ID NO: 4090363 - RNA, 13 nt, Variola virus
ugguugcaagauc

SEQ ID NO: 4090364 - RNA, 16 nt, Variola virus
ugguuuaaaaauacuc

SEQ ID NO: 4090365 - RNA, 14 nt, Variola virus
ugguuuaauuauuu

SEQ ID NO: 4090366 - RNA, 13 nt, Variola virus
ugguuucaaugag

SEQ ID NO: 4090367 - RNA, 19 nt, Variola virus
uguaaaaagauaaacuuua

SEQ ID NO: 4090368 - RNA, 14 nt, Variola virus
uguaaaaauauguu

SEQ ID NO: 4090369 - RNA, 13 nt, Variola virus
uguaaaaugacuc

SEQ ID NO: 4090370 - RNA, 20 nt, Variola virus
uguaaacaagaauauauguu

SEQ ID NO: 4090371 - RNA, 23 nt, Variola virus
uguaaacagauaugguguagcau

SEQ ID NO: 4090372 - RNA, 22 nt, Variola virus
uguaaacuguugaugauaucua

SEQ ID NO: 4090373 - RNA, 19 nt, Variola virus
uguaaagacgaaacaaaau

SEQ ID NO: 4090374 - RNA, 20 nt, Variola virus
uguaaaggauauuauauguu

SEQ ID NO: 4090375 - RNA, 21 nt, Variola virus
uguaaaggauauuauauguug

SEQ ID NO: 4090376 - RNA, 20 nt, Variola virus
uguaaauauccauugucuua

SEQ ID NO: 4090377 - RNA, 19 nt, Variola virus
uguaaauauuacugguaua

SEQ ID NO: 4090378 - RNA, 15 nt, Variola virus
uguaaaucuagaaau

SEQ ID NO: 4090379 - RNA, 18 nt, Variola virus
uuaagaauugucuguaaa

SEQ ID NO: 4090380 - RNA, 18 nt, Variola virus
uuaagacauauauuauua

SEQ ID NO: 4090381 - RNA, 13 nt, Variola virus
uuaagagauaucu

SEQ ID NO: 4090382 - RNA, 19 nt, Variola virus
uuaaguagaucaucugaaa

SEQ ID NO: 4090383 - RNA, 13 nt, Variola virus
uuaagugaugcau

SEQ ID NO: 4090384 - RNA, 21 nt, Variola virus
uuaaguucaccaaacaacuuu

SEQ ID NO: 4090385 - RNA, 22 nt, Variola virus
uuaauaaaaauaauuuaguguu

SEQ ID NO: 4090386 - RNA, 17 nt, Variola virus
uuaauaaacuuagugua

SEQ ID NO: 4090387 - RNA, 13 nt, Variola virus
uuaauaaauacag

SEQ ID NO: 4090388 - RNA, 21 nt, Variola virus
uuaauaauuguuauuauuuca

SEQ ID NO: 4090389 - RNA, 22 nt, Variola virus
uuaauacagaguuuaauacuaa

SEQ ID NO: 4090390 - RNA, 22 nt, Variola virus
uuaauacccguuuguuuaaauu

SEQ ID NO: 4090391 - RNA, 22 nt, Variola virus
uuaauagaugacguauuauaca

SEQ ID NO: 4090392 - RNA, 17 nt, Variola virus
uuaauauaugauuauca

SEQ ID NO: 4090393 - RNA, 13 nt, Variola virus
uuaauauuucuau

SEQ ID NO: 4090394 - RNA, 17 nt, Variola virus
uuaaucguacucauuau

SEQ ID NO: 4090395 - RNA, 15 nt, Variola virus
uuaaucuauuagaau

SEQ ID NO: 4090396 - RNA, 11 nt, Variola virus
uuaaucucaca

SEQ ID NO: 4090397 - RNA, 15 nt, Variola virus
uuaaucuuuaaaauu

SEQ ID NO: 4090398 - RNA, 16 nt, Variola virus
uuaaugaaacaucguu

SEQ ID NO: 4090399 - RNA, 13 nt, Variola virus
uuaauuaaccauu

SEQ ID NO: 4090400 - RNA, 16 nt, Variola virus
uuaauuacauauuguu

SEQ ID NO: 4090401 - RNA, 17 nt, Variola virus
uuaauucuccuauuaca

SEQ ID NO: 4090402 - RNA, 15 nt, Variola virus
uuaauucucucaggu

SEQ ID NO: 4090403 - RNA, 22 nt, Variola virus
uuaauuuccggaucuacauuuu

SEQ ID NO: 4090404 - RNA, 13 nt, Variola virus
uuaauuuguacau

SEQ ID NO: 4090405 - RNA, 15 nt, Variola virus
uuacaagucaaagag

SEQ ID NO: 4090406 - RNA, 21 nt, Variola virus
uuacaauguagaaauuagaaa

SEQ ID NO: 4090407 - RNA, 23 nt, Variola virus
uuacaccggccaaguaugcauaa

SEQ ID NO: 4090408 - RNA, 19 nt, Variola virus
uuacacuauuugucuuaau

SEQ ID NO: 4090409 - RNA, 17 nt, Variola virus
uuacauaucuacguucu

SEQ ID NO: 4090410 - RNA, 22 nt, Variola virus
uuacaucaccucuaacaucauc

SEQ ID NO: 4090411 - RNA, 13 nt, Variola virus
uuacaucauuaag

SEQ ID NO: 4090412 - RNA, 14 nt, Variola virus
uuacaucuugauau

SEQ ID NO: 4090413 - RNA, 16 nt, Variola virus
uuacauuauaagaaau

SEQ ID NO: 4090414 - RNA, 13 nt, Variola virus
uuacauucucauu

SEQ ID NO: 4090415 - RNA, 21 nt, Variola virus
uuacauuuguauaaucuuuaa

SEQ ID NO: 4090416 - RNA, 23 nt, Variola virus
uuaccacaauguauaauauaaga

SEQ ID NO: 4090417 - RNA, 15 nt, Variola virus
uuaccagaauacuau

SEQ ID NO: 4090418 - RNA, 13 nt, Variola virus
uuaccagauaucu

SEQ ID NO: 4090419 - RNA, 19 nt, Variola virus
uuaccaguuccagauuuca

SEQ ID NO: 4090420 - RNA, 20 nt, Variola virus
uuaccaucaaaagcauuaau

SEQ ID NO: 4090421 - RNA, 22 nt, Variola virus
uuaccaucuuccgccaauauag

SEQ ID NO: 4090422 - RNA, 21 nt, Variola virus
uuaccaucuucuuugauuaau

SEQ ID NO: 4090423 - RNA, 17 nt, Variola virus
uuaccggucauauuaau

SEQ ID NO: 4090424 - RNA, 12 nt, Variola virus
uuacgaaacuau

SEQ ID NO: 4090425 - RNA, 14 nt, Variola virus
uuacgaauaaaaga

SEQ ID NO: 4090426 - RNA, 23 nt, Variola virus
uuacgacgagcauauucauaaau

SEQ ID NO: 4090427 - RNA, 24 nt, Variola virus
uuacuaucuuuaacauauguauca

SEQ ID NO: 4090428 - RNA, 13 nt, Variola virus
uuacuauuacuag

SEQ ID NO: 4090429 - RNA, 20 nt, Variola virus
uuacucauuuuuuauaaaaa

SEQ ID NO: 4090430 - RNA, 14 nt, Variola virus
uuacucuucuaaau

SEQ ID NO: 4090431 - RNA, 20 nt, Variola virus
uuacugaggggaaaaucaau

SEQ ID NO: 4090432 - RNA, 13 nt, Variola virus
uuacuugugguaa

SEQ ID NO: 4090433 - RNA, 18 nt, Variola virus
uuagaaacuucaaagauu

SEQ ID NO: 4090434 - RNA, 14 nt, Variola virus
uuagaauagucucu

SEQ ID NO: 4090435 - RNA, 23 nt, Variola virus
uuagacauaaaaacuaauauuag

SEQ ID NO: 4090436 - RNA, 20 nt, Variola virus
uuagacauaugauaaaacga

SEQ ID NO: 4090437 - RNA, 17 nt, Variola virus
uuagacgcuuauuauua

SEQ ID NO: 4090438 - RNA, 18 nt, Variola virus
uuagacguagaaaacgga

SEQ ID NO: 4090439 - RNA, 22 nt, Variola virus
uuagacuaucucugacacuaca

SEQ ID NO: 4090440 - RNA, 20 nt, Variola virus
uuagacugacagacagaaca

SEQ ID NO: 4090441 - RNA, 14 nt, Variola virus
uuagacuuguauuc

SEQ ID NO: 4090442 - RNA, 22 nt, Variola virus
uuagagaacauacauuuguaaa

SEQ ID NO: 4090443 - RNA, 21 nt, Variola virus
uuagagauaauauccugaaca

SEQ ID NO: 4090444 - RNA, 16 nt, Variola virus
uuagauaauuguggua

SEQ ID NO: 4090445 - RNA, 19 nt, Variola virus
uuagauaguugaucagaau

SEQ ID NO: 4090446 - RNA, 23 nt, Variola virus
uuagauauagaagguaaacauca

SEQ ID NO: 4090447 - RNA, 18 nt, Variola virus
uuagaucucauaugugcu

SEQ ID NO: 4090448 - RNA, 19 nt, Variola virus
uuagaucuuuuacacuguu

SEQ ID NO: 4090449 - RNA, 15 nt, Variola virus
uuagauuauucuuaa

SEQ ID NO: 4090450 - RNA, 17 nt, Variola virus
uuagcaaaguuauuaau

SEQ ID NO: 4090451 - RNA, 17 nt, Variola virus
uuagcagaauauauaag

SEQ ID NO: 4090452 - RNA, 22 nt, Variola virus
uuagcgagguauuuauucauaa

SEQ ID NO: 4090453 - RNA, 21 nt, Variola virus
uuaggacgcgaauaaauagau

SEQ ID NO: 4090454 - RNA, 20 nt, Variola virus
uuaggcacagucaaacauuc

SEQ ID NO: 4090455 - RNA, 19 nt, Variola virus
uuagguagcauuuucuuaa

SEQ ID NO: 4090456 - RNA, 15 nt, Variola virus
uuaguauaacuaaag

SEQ ID NO: 4090457 - RNA, 23 nt, Variola virus
uuaguauauaacauuaauacuau

SEQ ID NO: 4090458 - RNA, 16 nt, Variola virus
uuagucauaaccguaa

SEQ ID NO: 4090459 - RNA, 17 nt, Variola virus
uuagucgucucaaagag

SEQ ID NO: 4090460 - RNA, 23 nt, Variola virus
uuagugaaacauuccacaucguu

SEQ ID NO: 4090461 - RNA, 15 nt, Variola virus
uuagugggcaucuuu

SEQ ID NO: 4090462 - RNA, 19 nt, Variola virus
uuaguuuuuuguuacugac

SEQ ID NO: 4090463 - RNA, 14 nt, Variola virus
uuauaaaaaacuuu

SEQ ID NO: 4090464 - RNA, 21 nt, Variola virus
uuauaacgauaacgucauuaa

SEQ ID NO: 4090465 - RNA, 16 nt, Variola virus
uuauaagaaauauaga

SEQ ID NO: 4090466 - RNA, 20 nt, Variola virus
uuauaagaaugauuguuuga

SEQ ID NO: 4090467 - RNA, 18 nt, Variola virus
uuauaagacuuuacucuu

SEQ ID NO: 4090468 - RNA, 16 nt, Variola virus
uuauacaguguaugua

SEQ ID NO: 4090469 - RNA, 16 nt, Variola virus
uuauacauauuccaga

SEQ ID NO: 4090470 - RNA, 16 nt, Variola virus
uuauagagauagauga

SEQ ID NO: 4090471 - RNA, 20 nt, Variola virus
uuauagaugccaagauaucu

SEQ ID NO: 4090472 - RNA, 15 nt, Variola virus
uuauaguagauauca

SEQ ID NO: 4090473 - RNA, 17 nt, Variola virus
uuauauaaaaacauuuu

SEQ ID NO: 4090474 - RNA, 16 nt, Variola virus
uuauauacaucuuuaa

SEQ ID NO: 4090475 - RNA, 18 nt, Variola virus
uuauauacucuaaucuuu

SEQ ID NO: 4090476 - RNA, 19 nt, Variola virus
uuauaucguguucauuaac

SEQ ID NO: 4090477 - RNA, 23 nt, Variola virus
uuauaucguuaucauuaauaaag

SEQ ID NO: 4090478 - RNA, 21 nt, Variola virus
uuauaugauaucuuuacuaag

SEQ ID NO: 4090479 - RNA, 12 nt, Variola virus
uuauauguaguu

SEQ ID NO: 4090480 - RNA, 17 nt, Variola virus
uuaucaaaauuuggaaa

SEQ ID NO: 4090481 - RNA, 19 nt, Variola virus
uuaucaauauacuauucuu

SEQ ID NO: 4090482 - RNA, 20 nt, Variola virus
uuaucacauaucacauuaau

SEQ ID NO: 4090483 - RNA, 18 nt, Variola virus
uuaucaucauccauuaau

SEQ ID NO: 4090484 - RNA, 18 nt, Variola virus
uuaucaucccauuguaaa

SEQ ID NO: 4090485 - RNA, 12 nt, Variola virus
uuaucaugaauu

SEQ ID NO: 4090486 - RNA, 23 nt, Variola virus
uuauccaaaauauuaauaacauu

SEQ ID NO: 4090487 - RNA, 17 nt, Variola virus
uuauccauuuauacauu

SEQ ID NO: 4090488 - RNA, 17 nt, Variola virus
uuauccgcuaaaaauuu

SEQ ID NO: 4090489 - RNA, 17 nt, Variola virus
uuaucgauucaucuaau

SEQ ID NO: 4090490 - RNA, 22 nt, Variola virus
uuaucguuuaagaauaauacag

SEQ ID NO: 4090491 - RNA, 14 nt, Variola virus
uuaucuaacucuuu

SEQ ID NO: 4090492 - RNA, 14 nt, Variola virus
uuaucuaucuuaaa

SEQ ID NO: 4090493 - RNA, 16 nt, Variola virus
uuaucuauuucaaaaa

SEQ ID NO: 4090494 - RNA, 23 nt, Variola virus
uuaucuccucuaugcaacuguaa

SEQ ID NO: 4090495 - RNA, 21 nt, Variola virus
uuaugagucacguuacacuuu

SEQ ID NO: 4090496 - RNA, 22 nt, Variola virus
uuaugauuaguuacgacugaaa

SEQ ID NO: 4090497 - RNA, 20 nt, Variola virus
uuauggaucuauucaagaug

SEQ ID NO: 4090498 - RNA, 16 nt, Variola virus
uuauguaaauaucuuu

SEQ ID NO: 4090499 - RNA, 19 nt, Variola virus
uuauguauauguuuguaaa

SEQ ID NO: 4090500 - RNA, 12 nt, Variola virus
uuaugugaaaca

SEQ ID NO: 4090501 - RNA, 22 nt, Variola virus
uuauuaaaguacguaaaucuag

SEQ ID NO: 4090502 - RNA, 20 nt, Variola virus
uuauuaacaaauuuuuugaa

SEQ ID NO: 4090503 - RNA, 14 nt, Variola virus
uuauuaaguauaau

SEQ ID NO: 4090504 - RNA, 20 nt, Variola virus
agauaugugauaaaaaucgu

SEQ ID NO: 4090505 - RNA, 17 nt, Variola virus
agauauuaguaaaagau

SEQ ID NO: 4090506 - RNA, 17 nt, Variola virus
agauauuggaugaugau

SEQ ID NO: 4090507 - RNA, 17 nt, Variola virus
agaucaucaaaauaugu

SEQ ID NO: 4090508 - RNA, 17 nt, Variola virus
agaucauguaacaauau

SEQ ID NO: 4090509 - RNA, 21 nt, Variola virus
agauccacugucacuggaaag

SEQ ID NO: 4090510 - RNA, 15 nt, Variola virus
agauccaucuacuuu

SEQ ID NO: 4090511 - RNA, 13 nt, Variola virus
agaucccacauca

SEQ ID NO: 4090512 - RNA, 21 nt, Variola virus
agaucccuuaucacacuuaaa

SEQ ID NO: 4090513 - RNA, 20 nt, Variola virus
agauccugcauagaaauauc

SEQ ID NO: 4090514 - RNA, 18 nt, Variola virus
agaucgucuauauaugaa

SEQ ID NO: 4090515 - RNA, 20 nt, Variola virus
agaucuaaagauaaucuucu

SEQ ID NO: 4090516 - RNA, 18 nt, Variola virus
agaucuaaggaugaugag

SEQ ID NO: 4090517 - RNA, 17 nt, Variola virus
agaucuaauaaauggag

SEQ ID NO: 4090518 - RNA, 18 nt, Variola virus
agaucuaauuuuucauua

SEQ ID NO: 4090519 - RNA, 19 nt, Variola virus
agaucugcguguaaaaagu

SEQ ID NO: 4090520 - RNA, 13 nt, Variola virus
agaugaaaaaugg

SEQ ID NO: 4090521 - RNA, 23 nt, Variola virus
agaugaaaauaauccugaauaua

SEQ ID NO: 4090522 - RNA, 16 nt, Variola virus
agaugaaucaaaugua

SEQ ID NO: 4090523 - RNA, 15 nt, Variola virus
agaugauaucaguau

SEQ ID NO: 4090524 - RNA, 18 nt, Variola virus
agaugauguuaacuaugu

SEQ ID NO: 4090525 - RNA, 16 nt, Variola virus
agauggaaauauuguu

SEQ ID NO: 4090526 - RNA, 19 nt, Variola virus
agauggaagggucaaacuu

SEQ ID NO: 4090527 - RNA, 14 nt, Variola virus
agauguauacuccu

SEQ ID NO: 4090528 - RNA, 17 nt, Variola virus
agauguuaaaugaauua

SEQ ID NO: 4090529 - RNA, 17 nt, Variola virus
agauguuagaaaaauga

SEQ ID NO: 4090530 - RNA, 20 nt, Variola virus
agauguuagaaaaaugaugc

SEQ ID NO: 4090531 - RNA, 18 nt, Variola virus
agauuagcuuugauguuu

SEQ ID NO: 4090532 - RNA, 14 nt, Variola virus
agauuaggaaaugu

SEQ ID NO: 4090533 - RNA, 13 nt, Variola virus
agauuaugauacu

SEQ ID NO: 4090534 - RNA, 19 nt, Variola virus
agauucauguuaacacucu

SEQ ID NO: 4090535 - RNA, 19 nt, Variola virus
agauuccugacuacuaacg

SEQ ID NO: 4090536 - RNA, 16 nt, Variola virus
agauuuauaauacuuu

SEQ ID NO: 4090537 - RNA, 22 nt, Variola virus
agauuuauuugauaaucauguu

SEQ ID NO: 4090538 - RNA, 16 nt, Variola virus
agauuucaaagauguu

SEQ ID NO: 4090539 - RNA, 22 nt, Variola virus
agauuugguaaaaugaaauauc

SEQ ID NO: 4090540 - RNA, 15 nt, Variola virus
agauuuuaaaaaacu

SEQ ID NO: 4090541 - RNA, 14 nt, Variola virus
agauuuuaaaugua

SEQ ID NO: 4090542 - RNA, 12 nt, Variola virus
agcaaaaaaacu

SEQ ID NO: 4090543 - RNA, 13 nt, Variola virus
agcaaaaaaacug

SEQ ID NO: 4090544 - RNA, 14 nt, Variola virus
agcaaaguuauuaa

SEQ ID NO: 4090545 - RNA, 15 nt, Variola virus
agcaaccguaugaau

SEQ ID NO: 4090546 - RNA, 19 nt, Variola virus
agcaauagugauagauuuu

SEQ ID NO: 4090547 - RNA, 19 nt, Variola virus
agcaauuacuaaacauaaa

SEQ ID NO: 4090548 - RNA, 23 nt, Variola virus
agcaauuagugccguauacuuua

SEQ ID NO: 4090549 - RNA, 13 nt, Variola virus
agcagaaaaagac

SEQ ID NO: 4090550 - RNA, 19 nt, Variola virus
agcauauuccauuaaugac

SEQ ID NO: 4090551 - RNA, 19 nt, Variola virus
agcaucagcaaaacaguua

SEQ ID NO: 4090552 - RNA, 18 nt, Variola virus
agcaucuccaauacguua

SEQ ID NO: 4090553 - RNA, 22 nt, Variola virus
agcaucuugaauagaaacgaua

SEQ ID NO: 4090554 - RNA, 19 nt, Variola virus
agcauguauuuuuuucuaa

SEQ ID NO: 4090555 - RNA, 22 nt, Variola virus
agcaugugaauauaauaauaca

SEQ ID NO: 4090556 - RNA, 21 nt, Variola virus
agcauuagcuaaaaaaauagu

SEQ ID NO: 4090557 - RNA, 14 nt, Variola virus
agcauugaaaauac

SEQ ID NO: 4090558 - RNA, 16 nt, Variola virus
agcauuuaaauccgaa

SEQ ID NO: 4090559 - RNA, 18 nt, Variola virus
agcauuuguaauaauccu

SEQ ID NO: 4090560 - RNA, 20 nt, Variola virus
agccacuauagaguuucuaa

SEQ ID NO: 4090561 - RNA, 20 nt, Variola virus
agccaucuguauuaaagaua

SEQ ID NO: 4090562 - RNA, 13 nt, Variola virus
agccauuuucuau

SEQ ID NO: 4090563 - RNA, 18 nt, Variola virus
agccgggaaaaagaagau

SEQ ID NO: 4090564 - RNA, 12 nt, Variola virus
agccuguaacug

SEQ ID NO: 4090565 - RNA, 22 nt, Variola virus
agcgacucuauuggauauggau

SEQ ID NO: 4090566 - RNA, 15 nt, Variola virus
agcgauuguuuaaga

SEQ ID NO: 4090567 - RNA, 20 nt, Variola virus
agcgcauguacauauuugua

SEQ ID NO: 4090568 - RNA, 18 nt, Variola virus
agcgggguugaucuugug

SEQ ID NO: 4090569 - RNA, 16 nt, Variola virus
agcuaagcaacuaaga

SEQ ID NO: 4090570 - RNA, 15 nt, Variola virus
agcuaagucuauuau

SEQ ID NO: 4090571 - RNA, 14 nt, Variola virus
agcuacucuagauu

SEQ ID NO: 4090572 - RNA, 13 nt, Variola virus
agcuauucaagau

SEQ ID NO: 4090573 - RNA, 16 nt, Variola virus
agcuauuuaaaugggu

SEQ ID NO: 4090574 - RNA, 18 nt, Variola virus
agcucaauauaaaugcgu

SEQ ID NO: 4090575 - RNA, 21 nt, Variola virus
agcuccuacaggaauaucuuu

SEQ ID NO: 4090576 - RNA, 13 nt, Variola virus
agcugaaaugaga

SEQ ID NO: 4090577 - RNA, 18 nt, Variola virus
agcuuccagauuuaaaaa

SEQ ID NO: 4090578 - RNA, 14 nt, Variola virus
agcuucugaaauaa

SEQ ID NO: 4090579 - RNA, 17 nt, Variola virus
agcuugauaauuagaua

SEQ ID NO: 4090580 - RNA, 22 nt, Variola virus
agcuuuuguucacaaaaauaca

SEQ ID NO: 4090581 - RNA, 14 nt, Variola virus
aggaaacgaaagac

SEQ ID NO: 4090582 - RNA, 13 nt, Variola virus
aggaacaaauauu

SEQ ID NO: 4090583 - RNA, 14 nt, Variola virus
aggaacauaaacaa

SEQ ID NO: 4090584 - RNA, 12 nt, Variola virus
aggaacuagaau

SEQ ID NO: 4090585 - RNA, 17 nt, Variola virus
aggaagaauaucauauu

SEQ ID NO: 4090586 - RNA, 19 nt, Variola virus
aggaaguuuaauaauacaa

SEQ ID NO: 4090587 - RNA, 12 nt, Variola virus
aggaauccaugu

SEQ ID NO: 4090588 - RNA, 22 nt, Variola virus
aggaauuggaauccaauuguuu

SEQ ID NO: 4090589 - RNA, 17 nt, Variola virus
aggacagaaaaauguua

SEQ ID NO: 4090590 - RNA, 17 nt, Variola virus
aggagucgccaaaugua

SEQ ID NO: 4090591 - RNA, 14 nt, Variola virus
aggaguuuuauuca

SEQ ID NO: 4090592 - RNA, 13 nt, Variola virus
aggauaaagaaaa

SEQ ID NO: 4090593 - RNA, 13 nt, Variola virus
aggauaaaguaaa

SEQ ID NO: 4090594 - RNA, 20 nt, Variola virus
aggauauacucaauagaauu

SEQ ID NO: 4090595 - RNA, 13 nt, Variola virus
aggauaucaaaua

SEQ ID NO: 4090596 - RNA, 23 nt, Variola virus
aggauauuagcgaauauaucaaa

SEQ ID NO: 4090597 - RNA, 22 nt, Variola virus
aggauauucucauggaaauauu

SEQ ID NO: 4090598 - RNA, 17 nt, Variola virus
aggauccagaaggaaga

SEQ ID NO: 4090599 - RNA, 14 nt, Variola virus
aggaucuagcaaag

SEQ ID NO: 4090600 - RNA, 13 nt, Variola virus
aggaugaauuuga

SEQ ID NO: 4090601 - RNA, 16 nt, Variola virus
aggaugacucucaaau

SEQ ID NO: 4090602 - RNA, 21 nt, Variola virus
aggaugacucucaaauuauua

SEQ ID NO: 4090603 - RNA, 20 nt, Variola virus
aggcacagucaaacauucaa

SEQ ID NO: 4090604 - RNA, 16 nt, Variola virus
aggcaucaaaaaaugu

SEQ ID NO: 4090605 - RNA, 17 nt, Variola virus
aggcucaguauguaaac

SEQ ID NO: 4090606 - RNA, 23 nt, Variola virus
agggguuguauuguuauuuuaca

SEQ ID NO: 4090607 - RNA, 21 nt, Variola virus
aggguauauccaucacuaaaa

SEQ ID NO: 4090608 - RNA, 20 nt, Variola virus
aggguccauuuucuguaaau

SEQ ID NO: 4090609 - RNA, 13 nt, Variola virus
agguaaauguaaa

SEQ ID NO: 4090610 - RNA, 14 nt, Variola virus
agguaaauguaaau

SEQ ID NO: 4090611 - RNA, 21 nt, Variola virus
agguaaguauaguacuaaaga

SEQ ID NO: 4090612 - RNA, 22 nt, Variola virus
agguacauggucuagauguaaa

SEQ ID NO: 4090613 - RNA, 19 nt, Variola virus
agguacuauaauauuaaaa

SEQ ID NO: 4090614 - RNA, 16 nt, Variola virus
agguauauuuauucca

SEQ ID NO: 4090615 - RNA, 19 nt, Variola virus
aggucacaucguauacuuu

SEQ ID NO: 4090616 - RNA, 22 nt, Variola virus
agguuuugcaacauguuaaaau

SEQ ID NO: 4090617 - RNA, 14 nt, Variola virus
aguaaaguaaacaa

SEQ ID NO: 4090618 - RNA, 17 nt, Variola virus
aguaaaugaaaaaaaac

SEQ ID NO: 4090619 - RNA, 21 nt, Variola virus
aguaacuauguaaaugauaac

SEQ ID NO: 4090620 - RNA, 14 nt, Variola virus
aguaagcauuuccu

SEQ ID NO: 4090621 - RNA, 16 nt, Variola virus
aguaaguauuuauaca

SEQ ID NO: 4090622 - RNA, 17 nt, Variola virus
aguaagugucauuuaac

SEQ ID NO: 4090623 - RNA, 15 nt, Variola virus
aguaauaaaacuaau

SEQ ID NO: 4090624 - RNA, 23 nt, Variola virus
aguaauaucgaauauuuuaucca

SEQ ID NO: 4090625 - RNA, 13 nt, Variola virus
aguaaucaacaau

SEQ ID NO: 4090626 - RNA, 20 nt, Variola virus
aguaaucauguaaauguuua

SEQ ID NO: 4090627 - RNA, 16 nt, Variola virus
aguaaugguauguauu

SEQ ID NO: 4090628 - RNA, 13 nt, Variola virus
aguacauuucaca

SEQ ID NO: 4090629 - RNA, 22 nt, Variola virus
aguacccacugaugagauguua

SEQ ID NO: 4090630 - RNA, 13 nt, Variola virus
auagauagaacua

SEQ ID NO: 4090631 - RNA, 19 nt, Variola virus
auagauguucaucauauaa

SEQ ID NO: 4090632 - RNA, 23 nt, Variola virus
auagauucauucuuuauagaaug

SEQ ID NO: 4090633 - RNA, 17 nt, Variola virus
auagauuuuccauccac

SEQ ID NO: 4090634 - RNA, 22 nt, Variola virus
auagcuacaguaaaaauaacua

SEQ ID NO: 4090635 - RNA, 15 nt, Variola virus
auaggagauauauau

SEQ ID NO: 4090636 - RNA, 17 nt, Variola virus
auaggagcuagaagaac

SEQ ID NO: 4090637 - RNA, 20 nt, Variola virus
auaggauacuuuaugaaugg

SEQ ID NO: 4090638 - RNA, 16 nt, Variola virus
auaggauacuuuguaa

SEQ ID NO: 4090639 - RNA, 13 nt, Variola virus
auaggaucuauau

SEQ ID NO: 4090640 - RNA, 21 nt, Variola virus
auaggauuaaaaauaaaguua

SEQ ID NO: 4090641 - RNA, 20 nt, Variola virus
auaggucuucgucuacagua

SEQ ID NO: 4090642 - RNA, 22 nt, Variola virus
auagguuacuagauuaaaaaug

SEQ ID NO: 4090643 - RNA, 17 nt, Variola virus
auaguaaauacaauaau

SEQ ID NO: 4090644 - RNA, 13 nt, Variola virus
auaguacauuccc

SEQ ID NO: 4090645 - RNA, 13 nt, Variola virus
auaguagaaucua

SEQ ID NO: 4090646 - RNA, 16 nt, Variola virus
auaguagguauggauc

SEQ ID NO: 4090647 - RNA, 23 nt, Variola virus
auaguagguauggaucuggaaaa

SEQ ID NO: 4090648 - RNA, 18 nt, Variola virus
auagucaaccaaauaaua

SEQ ID NO: 4090649 - RNA, 16 nt, Variola virus
auagucuccagaaauc

SEQ ID NO: 4090650 - RNA, 16 nt, Variola virus
auagugaaacaaaaua

SEQ ID NO: 4090651 - RNA, 17 nt, Variola virus
auagugguacaauacua

SEQ ID NO: 4090652 - RNA, 20 nt, Variola virus
auagugucuacuuaaaugua

SEQ ID NO: 4090653 - RNA, 22 nt, Variola virus
auaguuagcgucaacuuucaua

SEQ ID NO: 4090654 - RNA, 18 nt, Variola virus
auaguuugggaaaagaaa

SEQ ID NO: 4090655 - RNA, 22 nt, Variola virus
auauaaaaacuuauuacauagu

SEQ ID NO: 4090656 - RNA, 22 nt, Variola virus
auauaaaauagaaaauaacaga

SEQ ID NO: 4090657 - RNA, 13 nt, Variola virus
auauaaaauggau

SEQ ID NO: 4090658 - RNA, 13 nt, Variola virus
auauaaauuauuc

SEQ ID NO: 4090659 - RNA, 17 nt, Variola virus
auauaacuucugguaaa

SEQ ID NO: 4090660 - RNA, 21 nt, Variola virus
auauaagacacagaaauacug

SEQ ID NO: 4090661 - RNA, 18 nt, Variola virus
auauaagacuaacaguau

SEQ ID NO: 4090662 - RNA, 13 nt, Variola virus
auauaauacuuaa

SEQ ID NO: 4090663 - RNA, 13 nt, Variola virus
auauaauucuuua

SEQ ID NO: 4090664 - RNA, 18 nt, Variola virus
auauacucugagauaaaa

SEQ ID NO: 4090665 - RNA, 21 nt, Variola virus
auauagacaacguagaauugu

SEQ ID NO: 4090666 - RNA, 20 nt, Variola virus
auauagcggaugaaaaauuu

SEQ ID NO: 4090667 - RNA, 15 nt, Variola virus
auauagcuuauucca

SEQ ID NO: 4090668 - RNA, 23 nt, Variola virus
auauaguauaaauaguuauuaga

SEQ ID NO: 4090669 - RNA, 15 nt, Variola virus
auauaguauuaauga

SEQ ID NO: 4090670 - RNA, 22 nt, Variola virus
auauagucuguguuacauaaua

SEQ ID NO: 4090671 - RNA, 13 nt, Variola virus
auauauacaguag

SEQ ID NO: 4090672 - RNA, 14 nt, Variola virus
auauaucaaaauua

SEQ ID NO: 4090673 - RNA, 11 nt, Variola virus
auauaugggag

SEQ ID NO: 4090674 - RNA, 12 nt, Variola virus
auauauguuuau

SEQ ID NO: 4090675 - RNA, 13 nt, Variola virus
auauauuagaaau

SEQ ID NO: 4090676 - RNA, 18 nt, Variola virus
auauauuccaacgcauuu

SEQ ID NO: 4090677 - RNA, 21 nt, Variola virus
auauauucgcauauauuccca

SEQ ID NO: 4090678 - RNA, 18 nt, Variola virus
auauauuguagauaagaa

SEQ ID NO: 4090679 - RNA, 19 nt, Variola virus
auauauuuucacuuuaucu

SEQ ID NO: 4090680 - RNA, 14 nt, Variola virus
auaucaacaaaauu

SEQ ID NO: 4090681 - RNA, 18 nt, Variola virus
auaucaacucauguguaa

SEQ ID NO: 4090682 - RNA, 14 nt, Variola virus
auaucacaaaaaua

SEQ ID NO: 4090683 - RNA, 19 nt, Variola virus
auaucacaaccuuuguuaa

SEQ ID NO: 4090684 - RNA, 21 nt, Variola virus
auaucauaaauaaaaauagua

SEQ ID NO: 4090685 - RNA, 14 nt, Variola virus
auaucauacaugau

SEQ ID NO: 4090686 - RNA, 19 nt, Variola virus
auaucauacaugauauuca

SEQ ID NO: 4090687 - RNA, 19 nt, Variola virus
auaucaucaaaauacugga

SEQ ID NO: 4090688 - RNA, 17 nt, Variola virus
auaucaucaucugaaau

SEQ ID NO: 4090689 - RNA, 22 nt, Variola virus
auaucaucuuuucacuaaauaa

SEQ ID NO: 4090690 - RNA, 15 nt, Variola virus
auaucaugaaauaua

SEQ ID NO: 4090691 - RNA, 15 nt, Variola virus
auaucauuaauacag

SEQ ID NO: 4090692 - RNA, 16 nt, Variola virus
auauccauuuuacauu

SEQ ID NO: 4090693 - RNA, 17 nt, Variola virus
auaucccuuaaaaauua

SEQ ID NO: 4090694 - RNA, 16 nt, Variola virus
auauccuccuguagau

SEQ ID NO: 4090695 - RNA, 19 nt, Variola virus
auauccuuaagauguuuga

SEQ ID NO: 4090696 - RNA, 20 nt, Variola virus
auaucgucaccgaugucaaa

SEQ ID NO: 4090697 - RNA, 17 nt, Variola virus
auaucguucuuaauaga

SEQ ID NO: 4090698 - RNA, 22 nt, Variola virus
auaucuaacguauucuagcaua

SEQ ID NO: 4090699 - RNA, 23 nt, Variola virus
auaucuaggcgguggauauuucu

SEQ ID NO: 4090700 - RNA, 12 nt, Variola virus
auaucuauaaug

SEQ ID NO: 4090701 - RNA, 21 nt, Variola virus
auaucuaucgacuucagauga

SEQ ID NO: 4090702 - RNA, 14 nt, Variola virus
auaucucaauaaug

SEQ ID NO: 4090703 - RNA, 23 nt, Variola virus
auaucucguuuagaaaaaugcua

SEQ ID NO: 4090704 - RNA, 23 nt, Variola virus
auaucugcgacggagcauuuucu

SEQ ID NO: 4090705 - RNA, 13 nt, Variola virus
auaucuuaaauaa

SEQ ID NO: 4090706 - RNA, 14 nt, Variola virus
auaucuucucaaaa

SEQ ID NO: 4090707 - RNA, 20 nt, Variola virus
auaucuucuuuuuauaucca

SEQ ID NO: 4090708 - RNA, 20 nt, Variola virus
auaucuuguucugguuuaaa

SEQ ID NO: 4090709 - RNA, 15 nt, Variola virus
auaugauagaaauga

SEQ ID NO: 4090710 - RNA, 22 nt, Variola virus
auaugcaaagucuaaauauuuu

SEQ ID NO: 4090711 - RNA, 22 nt, Variola virus
auaugcaucuauauaaucuuuu

SEQ ID NO: 4090712 - RNA, 13 nt, Variola virus
auaugccuauaaa

SEQ ID NO: 4090713 - RNA, 17 nt, Variola virus
auaugccuuagcaucau

SEQ ID NO: 4090714 - RNA, 14 nt, Variola virus
auaugcucauauau

SEQ ID NO: 4090715 - RNA, 11 nt, Variola virus
auauggaugag

SEQ ID NO: 4090716 - RNA, 14 nt, Variola virus
auauggauuuccag

SEQ ID NO: 4090717 - RNA, 21 nt, Variola virus
auauggucucaacgcaaacuu

SEQ ID NO: 4090718 - RNA, 23 nt, Variola virus
auaugguuuuuggccaaaaugau

SEQ ID NO: 4090719 - RNA, 22 nt, Variola virus
auauguaggaggaauaucugau

SEQ ID NO: 4090720 - RNA, 16 nt, Variola virus
auaugucauagaauuu

SEQ ID NO: 4090721 - RNA, 19 nt, Variola virus
auaugucuagaacggcaau

SEQ ID NO: 4090722 - RNA, 13 nt, Variola virus
auaugugcacaua

SEQ ID NO: 4090723 - RNA, 12 nt, Variola virus
auaugugcauua

SEQ ID NO: 4090724 - RNA, 14 nt, Variola virus
auauguuccaguaa

SEQ ID NO: 4090725 - RNA, 13 nt, Variola virus
auauuaaaaaaug

SEQ ID NO: 4090726 - RNA, 19 nt, Variola virus
auauuaaaauucacacauu

SEQ ID NO: 4090727 - RNA, 15 nt, Variola virus
auauuaauaggagau

SEQ ID NO: 4090728 - RNA, 18 nt, Variola virus
auauuacuaauugauaga

SEQ ID NO: 4090729 - RNA, 16 nt, Variola virus
auauuacuguuaauaa

SEQ ID NO: 4090730 - RNA, 14 nt, Variola virus
auauuagaaauaca

SEQ ID NO: 4090731 - RNA, 16 nt, Variola virus
auauuagacaauacua

SEQ ID NO: 4090732 - RNA, 16 nt, Variola virus
auauuauauaaacauu

SEQ ID NO: 4090733 - RNA, 19 nt, Variola virus
auauuaucucaacaaaauu

SEQ ID NO: 4090734 - RNA, 14 nt, Variola virus
auauuauuaugaag

SEQ ID NO: 4090735 - RNA, 17 nt, Variola virus
auauucaagcgaauuac

SEQ ID NO: 4090736 - RNA, 15 nt, Variola virus
auauucacaaauaua

SEQ ID NO: 4090737 - RNA, 13 nt, Variola virus
auauucauagagg

SEQ ID NO: 4090738 - RNA, 15 nt, Variola virus
auauucauagauuga

SEQ ID NO: 4090739 - RNA, 15 nt, Variola virus
auauuccauuaauga

SEQ ID NO: 4090740 - RNA, 15 nt, Variola virus
auauucuaaaauggu

SEQ ID NO: 4090741 - RNA, 17 nt, Variola virus
auauucuguaguuguau

SEQ ID NO: 4090742 - RNA, 14 nt, Variola virus
auauucuguucuau

SEQ ID NO: 4090743 - RNA, 19 nt, Variola virus
auauucuugucauguugau

SEQ ID NO: 4090744 - RNA, 22 nt, Variola virus
auauugauacguauauuaauga

SEQ ID NO: 4090745 - RNA, 15 nt, Variola virus
auauuguagcauuac

SEQ ID NO: 4090746 - RNA, 18 nt, Variola virus
auauugucccaauguuuc

SEQ ID NO: 4090747 - RNA, 19 nt, Variola virus
auauugucccaauguuucg

SEQ ID NO: 4090748 - RNA, 18 nt, Variola virus
auauuguuacagccaaga

SEQ ID NO: 4090749 - RNA, 22 nt, Variola virus
auauuuaagugauauaaaacau

SEQ ID NO: 4090750 - RNA, 18 nt, Variola virus
auauuuacaguuacuaaa

SEQ ID NO: 4090751 - RNA, 16 nt, Variola virus
auauuuaccaaagcaa

SEQ ID NO: 4090752 - RNA, 20 nt, Variola virus
auauuuacggaacuucuaaa

SEQ ID NO: 4090753 - RNA, 19 nt, Variola virus
auauuuccccuauaaucuu

SEQ ID NO: 4090754 - RNA, 16 nt, Variola virus
auauuucuauuucuau

SEQ ID NO: 4090755 - RNA, 19 nt, Variola virus
auauuucuccacuacauau

SEQ ID NO: 4090756 - RNA, 13 nt, Variola virus
auauuugaaaauc

SEQ ID NO: 4090757 - RNA, 19 nt, Variola virus
auauuugagaguauuggua

SEQ ID NO: 4090758 - RNA, 15 nt, Variola virus
auauuuguaugagug

SEQ ID NO: 4090759 - RNA, 18 nt, Variola virus
auauuugugaaaauauua

SEQ ID NO: 4090760 - RNA, 19 nt, Variola virus
auauuuguucauuggauug

SEQ ID NO: 4090761 - RNA, 18 nt, Variola virus
auauuuugggcaaaucua

SEQ ID NO: 4090762 - RNA, 13 nt, Variola virus
aucaaaaaguaag

SEQ ID NO: 4090763 - RNA, 14 nt, Variola virus
aucaaaagaagaau

SEQ ID NO: 4090764 - RNA, 23 nt, Variola virus
aucaaacucuaaugaccacaucu

SEQ ID NO: 4090765 - RNA, 19 nt, Variola virus
aucaaagauuaauacauua

SEQ ID NO: 4090766 - RNA, 17 nt, Variola virus
aucaaaugguucauaau

SEQ ID NO: 4090767 - RNA, 13 nt, Variola virus
aucaaaugucuaa

SEQ ID NO: 4090768 - RNA, 16 nt, Variola virus
aucaaauuauugauac

SEQ ID NO: 4090769 - RNA, 16 nt, Variola virus
aucaacagauagcuug

SEQ ID NO: 4090770 - RNA, 19 nt, Variola virus
aucaacucauguguaaauu

SEQ ID NO: 4090771 - RNA, 20 nt, Variola virus
aucaagagagcagaaauaac

SEQ ID NO: 4090772 - RNA, 19 nt, Variola virus
aucaaggacaguuaaaacu

SEQ ID NO: 4090773 - RNA, 17 nt, Variola virus
aucaagucucucauauu

SEQ ID NO: 4090774 - RNA, 13 nt, Variola virus
aucaauaaauagu

SEQ ID NO: 4090775 - RNA, 14 nt, Variola virus
aucaauaaauggau

SEQ ID NO: 4090776 - RNA, 13 nt, Variola virus
aucaauaagcauu

SEQ ID NO: 4090777 - RNA, 17 nt, Variola virus
aucaauagaauaaacca

SEQ ID NO: 4090778 - RNA, 12 nt, Variola virus
aucaauauuaac

SEQ ID NO: 4090779 - RNA, 23 nt, Variola virus
aucaaucaaaagacuauacauuu

SEQ ID NO: 4090780 - RNA, 19 nt, Variola virus
aucaaucgguguguagaaa

SEQ ID NO: 4090781 - RNA, 20 nt, Variola virus
aucaaugauuaguuucuuaa

SEQ ID NO: 4090782 - RNA, 13 nt, Variola virus
aucaauuaaauaa

SEQ ID NO: 4090783 - RNA, 17 nt, Variola virus
aucaauuaaauaauuaa

SEQ ID NO: 4090784 - RNA, 18 nt, Variola virus
aucaauuaaauaauuaau

SEQ ID NO: 4090785 - RNA, 19 nt, Variola virus
aucaauucuggauuauccc

SEQ ID NO: 4090786 - RNA, 17 nt, Variola virus
aucaauuucaaaaagag

SEQ ID NO: 4090787 - RNA, 21 nt, Variola virus
aucacaacaucuauaaaagua

SEQ ID NO: 4090788 - RNA, 19 nt, Variola virus
aucacaagaaguuagaaag

SEQ ID NO: 4090789 - RNA, 16 nt, Variola virus
aucacacuuaaaauaa

SEQ ID NO: 4090790 - RNA, 13 nt, Variola virus
aucacaugaugau

SEQ ID NO: 4090791 - RNA, 17 nt, Variola virus
aucacuaucuuugaaaa

SEQ ID NO: 4090792 - RNA, 19 nt, Variola virus
aucacucucauaauguaaa

SEQ ID NO: 4090793 - RNA, 20 nt, Variola virus
aucacucuucgaaaagaaac

SEQ ID NO: 4090794 - RNA, 13 nt, Variola virus
aucacuucaauaa

SEQ ID NO: 4090795 - RNA, 18 nt, Variola virus
aucagagucugaggauau

SEQ ID NO: 4090796 - RNA, 14 nt, Variola virus
aucagauaacaugu

SEQ ID NO: 4090797 - RNA, 18 nt, Variola virus
aucagcacaugaagaaaa

SEQ ID NO: 4090798 - RNA, 20 nt, Variola virus
aucagcauugcuuucauuau

SEQ ID NO: 4090799 - RNA, 13 nt, Variola virus
aucaggaaaaaag

SEQ ID NO: 4090800 - RNA, 15 nt, Variola virus
aucaggaaaaaagau

SEQ ID NO: 4090801 - RNA, 20 nt, Variola virus
aucaggauauaaagaaaaau

SEQ ID NO: 4090802 - RNA, 20 nt, Variola virus
aucaguauguauaucuauau

SEQ ID NO: 4090803 - RNA, 23 nt, Variola virus
aucagucuuguauuccaaauuaa

SEQ ID NO: 4090804 - RNA, 23 nt, Variola virus
aucagugauagacuagaagaaag

SEQ ID NO: 4090805 - RNA, 16 nt, Variola virus
aucauaauaugagaug

SEQ ID NO: 4090806 - RNA, 19 nt, Variola virus
aucauaauccugugcauaa

SEQ ID NO: 4090807 - RNA, 15 nt, Variola virus
aucauacuuagaauu

SEQ ID NO: 4090808 - RNA, 19 nt, Variola virus
aucauauaguuauguauau

SEQ ID NO: 4090809 - RNA, 17 nt, Variola virus
aucauauauauacugaa

SEQ ID NO: 4090810 - RNA, 21 nt, Variola virus
aucauauaucugaagauauac

SEQ ID NO: 4090811 - RNA, 21 nt, Variola virus
aucaucaccuaucuuguguau

SEQ ID NO: 4090812 - RNA, 20 nt, Variola virus
aucauccaauauuauugaaa

SEQ ID NO: 4090813 - RNA, 21 nt, Variola virus
aucauccaccuguuuuaacau

SEQ ID NO: 4090814 - RNA, 19 nt, Variola virus
aucaucuagagaauccaca

SEQ ID NO: 4090815 - RNA, 15 nt, Variola virus
aucaucuauaugacu

SEQ ID NO: 4090816 - RNA, 16 nt, Variola virus
aucaucuauaugacug

SEQ ID NO: 4090817 - RNA, 13 nt, Variola virus
aucaugaaauaua

SEQ ID NO: 4090818 - RNA, 21 nt, Variola virus
aucauggcggugccagaaauu

SEQ ID NO: 4090819 - RNA, 12 nt, Variola virus
aucauguagaaa

SEQ ID NO: 4090820 - RNA, 18 nt, Variola virus
aucauguccauggauaaa

SEQ ID NO: 4090821 - RNA, 16 nt, Variola virus
aucauuaaaaaaauua

SEQ ID NO: 4090822 - RNA, 13 nt, Variola virus
aucauuaaaggau

SEQ ID NO: 4090823 - RNA, 11 nt, Variola virus
aucauuaacga

SEQ ID NO: 4090824 - RNA, 15 nt, Variola virus
aucauucgguaacuu

SEQ ID NO: 4090825 - RNA, 22 nt, Variola virus
aucauucuacguccuauggaug

SEQ ID NO: 4090826 - RNA, 16 nt, Variola virus
aucauugacugcuaaa

SEQ ID NO: 4090827 - RNA, 12 nt, Variola virus
aucauuucacaa

SEQ ID NO: 4090828 - RNA, 22 nt, Variola virus
auccaaaaguuccgagauaauu

SEQ ID NO: 4090829 - RNA, 14 nt, Variola virus
auccaagucaauau

SEQ ID NO: 4090830 - RNA, 14 nt, Variola virus
auccaaucauauau

SEQ ID NO: 4090831 - RNA, 17 nt, Variola virus
auccaaucuaagaaauu

SEQ ID NO: 4090832 - RNA, 23 nt, Variola virus
auccaauuguuugauauauaauu

SEQ ID NO: 4090833 - RNA, 19 nt, Variola virus
auccacugcugaacaguua

SEQ ID NO: 4090834 - RNA, 21 nt, Variola virus
auccagcuagugaauauauau

SEQ ID NO: 4090835 - RNA, 15 nt, Variola virus
auccauaucguauau

SEQ ID NO: 4090836 - RNA, 15 nt, Variola virus
auccauauuucuuaa

SEQ ID NO: 4090837 - RNA, 15 nt, Variola virus
auccaugucugaaac

SEQ ID NO: 4090838 - RNA, 16 nt, Variola virus
aucccauauaauacag

SEQ ID NO: 4090839 - RNA, 19 nt, Variola virus
aucccauucuaauacuuua

SEQ ID NO: 4090840 - RNA, 15 nt, Variola virus
aucccuuaaaaauua

SEQ ID NO: 4090841 - RNA, 21 nt, Variola virus
auccgaaacaaucucaaauau

SEQ ID NO: 4090842 - RNA, 17 nt, Variola virus
auccgauacuuguaaga

SEQ ID NO: 4090843 - RNA, 14 nt, Variola virus
auccuaacaaugag

SEQ ID NO: 4090844 - RNA, 15 nt, Variola virus
auccuaucuaagaug

SEQ ID NO: 4090845 - RNA, 17 nt, Variola virus
auccuguuucuacuaac

SEQ ID NO: 4090846 - RNA, 21 nt, Variola virus
auccuuagucaucuugucuag

SEQ ID NO: 4090847 - RNA, 22 nt, Variola virus
auccuuauauuuguuaacuaca

SEQ ID NO: 4090848 - RNA, 13 nt, Variola virus
auccuucagaauc

SEQ ID NO: 4090849 - RNA, 12 nt, Variola virus
aucgaguuuauc

SEQ ID NO: 4090850 - RNA, 17 nt, Variola virus
aucgauacauauaugca

SEQ ID NO: 4090851 - RNA, 18 nt, Variola virus
aucgauaguaaugcauuc

SEQ ID NO: 4090852 - RNA, 15 nt, Variola virus
aucgauauugaaaau

SEQ ID NO: 4090853 - RNA, 18 nt, Variola virus
aucgauuuucaaauccau

SEQ ID NO: 4090854 - RNA, 17 nt, Variola virus
aucgcuuaauagacaaa

SEQ ID NO: 4090855 - RNA, 22 nt, Variola virus
aucggcauuuauguuucuuuaa

SEQ ID NO: 4090856 - RNA, 23 nt, Variola virus
aucgucauuuuuuucucuagauc

SEQ ID NO: 4090857 - RNA, 16 nt, Variola virus
aucguuaaauuuuaca

SEQ ID NO: 4090858 - RNA, 15 nt, Variola virus
aucguuauuauauaa

SEQ ID NO: 4090859 - RNA, 14 nt, Variola virus
aucuaaaaacaaua

SEQ ID NO: 4090860 - RNA, 22 nt, Variola virus
aucuaaaacuacguucgaugaa

SEQ ID NO: 4090861 - RNA, 19 nt, Variola virus
aucuaaacgcguuagauaa

SEQ ID NO: 4090862 - RNA, 20 nt, Variola virus
aucuaaagaugaugcuauuu

SEQ ID NO: 4090863 - RNA, 14 nt, Variola virus
aucuaacauaaaca

SEQ ID NO: 4090864 - RNA, 15 nt, Variola virus
aucuaauaacaaugu

SEQ ID NO: 4090865 - RNA, 24 nt, Variola virus
aucuaauaacaauguagguacuau

SEQ ID NO: 4090866 - RNA, 19 nt, Variola virus
aucuaaucuguucauauac

SEQ ID NO: 4090867 - RNA, 14 nt, Variola virus
aucuacacaaauag

SEQ ID NO: 4090868 - RNA, 21 nt, Variola virus
aucuacugauaaaacuggaag

SEQ ID NO: 4090869 - RNA, 21 nt, Variola virus
aucuagacuuucuguuauuau

SEQ ID NO: 4090870 - RNA, 17 nt, Variola virus
aucuagauaauuaauaa

SEQ ID NO: 4090871 - RNA, 13 nt, Variola virus
aucuagccauuau

SEQ ID NO: 4090872 - RNA, 15 nt, Variola virus
aucuauaucaucuau

SEQ ID NO: 4090873 - RNA, 20 nt, Variola virus
aucuauaucugacacaagau

SEQ ID NO: 4090874 - RNA, 15 nt, Variola virus
aucuauguuuaacuu

SEQ ID NO: 4090875 - RNA, 17 nt, Variola virus
aucuauucauaaaacau

SEQ ID NO: 4090876 - RNA, 18 nt, Variola virus
aucuauugacuauaacuc

SEQ ID NO: 4090877 - RNA, 12 nt, Variola virus
aucucaaaauag

SEQ ID NO: 4090878 - RNA, 19 nt, Variola virus
aucucguccuugguuuaca

SEQ ID NO: 4090879 - RNA, 18 nt, Variola virus
aucucuauaauaucuagu

SEQ ID NO: 4090880 - RNA, 13 nt, Variola virus
aucucuugcuucu

SEQ ID NO: 4090881 - RNA, 18 nt, Variola virus
aucucuuuuccaugccuc

SEQ ID NO: 4090882 - RNA, 16 nt, Variola virus
gacauaccaucuauca

SEQ ID NO: 4090883 - RNA, 19 nt, Variola virus
gacaucuggauuucagaua

SEQ ID NO: 4090884 - RNA, 23 nt, Variola virus
gacauguucgugguguuaugaaa

SEQ ID NO: 4090885 - RNA, 17 nt, Variola virus
gacauuuucacaaauac

SEQ ID NO: 4090886 - RNA, 17 nt, Variola virus
gaccaagacacauaugg

SEQ ID NO: 4090887 - RNA, 15 nt, Variola virus
gaccaauuacugaua

SEQ ID NO: 4090888 - RNA, 15 nt, Variola virus
gaccacauccuucag

SEQ ID NO: 4090889 - RNA, 22 nt, Variola virus
gaccacucuccgucauccuuca

SEQ ID NO: 4090890 - RNA, 15 nt, Variola virus
gaccgaauacauaac

SEQ ID NO: 4090891 - RNA, 12 nt, Variola virus
gaccguguuucu

SEQ ID NO: 4090892 - RNA, 22 nt, Variola virus
gacgauauuagaugauaauuua

SEQ ID NO: 4090893 - RNA, 21 nt, Variola virus
gacguauaagucuauuugaaa

SEQ ID NO: 4090894 - RNA, 14 nt, Variola virus
gacgugcguaauau

SEQ ID NO: 4090895 - RNA, 20 nt, Variola virus
gacguuggcacaugaugaau

SEQ ID NO: 4090896 - RNA, 14 nt, Variola virus
gacuaaauacuaca

SEQ ID NO: 4090897 - RNA, 19 nt, Variola virus
gacuacaaagaauguucua

SEQ ID NO: 4090898 - RNA, 14 nt, Variola virus
gacuacuuauucua

SEQ ID NO: 4090899 - RNA, 14 nt, Variola virus
gacuagcauauuau

SEQ ID NO: 4090900 - RNA, 20 nt, Variola virus
gacuaucaacaauuuuguau

SEQ ID NO: 4090901 - RNA, 19 nt, Variola virus
gacuaucagacucuucuau

SEQ ID NO: 4090902 - RNA, 21 nt, Variola virus
gacuauggacgcaugauaaga

SEQ ID NO: 4090903 - RNA, 17 nt, Variola virus
gacucauuuaguuuauu

SEQ ID NO: 4090904 - RNA, 17 nt, Variola virus
gacuucguaagaaauaa

SEQ ID NO: 4090905 - RNA, 19 nt, Variola virus
gacuuguuaaaucuauaua

SEQ ID NO: 4090906 - RNA, 17 nt, Variola virus
gacuuuauaauuucauc

SEQ ID NO: 4090907 - RNA, 18 nt, Variola virus
gagaaguaauaaaacgaa

SEQ ID NO: 4090908 - RNA, 23 nt, Variola virus
gagaccauguauugcuguauuug

SEQ ID NO: 4090909 - RNA, 14 nt, Variola virus
gagagauagaagaa

SEQ ID NO: 4090910 - RNA, 22 nt, Variola virus
gagagaucauuucuauaauuua

SEQ ID NO: 4090911 - RNA, 11 nt, Variola virus
gagauaaaaga

SEQ ID NO: 4090912 - RNA, 16 nt, Variola virus
gagauaaucuauauca

SEQ ID NO: 4090913 - RNA, 20 nt, Variola virus
gagaucuaaacgaucuaguu

SEQ ID NO: 4090914 - RNA, 23 nt, Variola virus
gagaucuaaagccgguguaacau

SEQ ID NO: 4090915 - RNA, 20 nt, Variola virus
gagauuggguuaauaaauac

SEQ ID NO: 4090916 - RNA, 15 nt, Variola virus
gagcaaguagaaaac

SEQ ID NO: 4090917 - RNA, 18 nt, Variola virus
gaggaaaaaggacacauu

SEQ ID NO: 4090918 - RNA, 13 nt, Variola virus
gaggagaaguaau

SEQ ID NO: 4090919 - RNA, 15 nt, Variola virus
gaggauguuaaacaa

SEQ ID NO: 4090920 - RNA, 14 nt, Variola virus
gagggaaaagucau

SEQ ID NO: 4090921 - RNA, 22 nt, Variola virus
gaguaguaaaugcguacauaac

SEQ ID NO: 4090922 - RNA, 12 nt, Variola virus
gaguaguuuaug

SEQ ID NO: 4090923 - RNA, 13 nt, Variola virus
gaguguagaaaac

SEQ ID NO: 4090924 - RNA, 23 nt, Variola virus
gaguuaucacaugcaaggcauuu

SEQ ID NO: 4090925 - RNA, 17 nt, Variola virus
gaguuauuaagaaauac

SEQ ID NO: 4090926 - RNA, 20 nt, Variola virus
gauaaaaaggaaucuauuaa

SEQ ID NO: 4090927 - RNA, 14 nt, Variola virus
gauaaaauacugaa

SEQ ID NO: 4090928 - RNA, 17 nt, Variola virus
gauaaaauuaaugagau

SEQ ID NO: 4090929 - RNA, 18 nt, Variola virus
gauaaacacucauauuau

SEQ ID NO: 4090930 - RNA, 15 nt, Variola virus
gauaaagauaaaaga

SEQ ID NO: 4090931 - RNA, 14 nt, Variola virus
gauaaaguuaucau

SEQ ID NO: 4090932 - RNA, 14 nt, Variola virus
gauaaauuguacaa

SEQ ID NO: 4090933 - RNA, 16 nt, Variola virus
gauaacaaauuaaaga

SEQ ID NO: 4090934 - RNA, 18 nt, Variola virus
gauaacguauuaaauauu

SEQ ID NO: 4090935 - RNA, 20 nt, Variola virus
gauaagauauguuuauucau

SEQ ID NO: 4090936 - RNA, 13 nt, Variola virus
gauaauaaacaaa

SEQ ID NO: 4090937 - RNA, 13 nt, Variola virus
gauaauaauacac

SEQ ID NO: 4090938 - RNA, 22 nt, Variola virus
gauaauaauguuguuauaucua

SEQ ID NO: 4090939 - RNA, 18 nt, Variola virus
gauaauaauuaauaucua

SEQ ID NO: 4090940 - RNA, 19 nt, Variola virus
gauaauagggagaaaugac

SEQ ID NO: 4090941 - RNA, 13 nt, Variola virus
gauaauagucacg

SEQ ID NO: 4090942 - RNA, 19 nt, Variola virus
gauaauauuagacauauga

SEQ ID NO: 4090943 - RNA, 14 nt, Variola virus
gauaauauuaucua

SEQ ID NO: 4090944 - RNA, 20 nt, Variola virus
gauaaugauauauuaaacaa

SEQ ID NO: 4090945 - RNA, 18 nt, Variola virus
gauaauuuauacguauca

SEQ ID NO: 4090946 - RNA, 17 nt, Variola virus
gauacaauggaugauau

SEQ ID NO: 4090947 - RNA, 18 nt, Variola virus
gauacaguaucguuuuaa

SEQ ID NO: 4090948 - RNA, 18 nt, Variola virus
gauacauuauaugaugau

SEQ ID NO: 4090949 - RNA, 14 nt, Variola virus
gauacauuuugcau

SEQ ID NO: 4090950 - RNA, 17 nt, Variola virus
gauacccugauauuaau

SEQ ID NO: 4090951 - RNA, 19 nt, Variola virus
gauacuaauuguagcuauu

SEQ ID NO: 4090952 - RNA, 15 nt, Variola virus
gauacuauaaugaaa

SEQ ID NO: 4090953 - RNA, 20 nt, Variola virus
gauagaagauuuaucuuucu

SEQ ID NO: 4090954 - RNA, 15 nt, Variola virus
gauagacacauaugc

SEQ ID NO: 4090955 - RNA, 17 nt, Variola virus
gauagacuagaagaaag

SEQ ID NO: 4090956 - RNA, 18 nt, Variola virus
gauagauaugauaaacaa

SEQ ID NO: 4090957 - RNA, 16 nt, Variola virus
gauagcaaagagauga

SEQ ID NO: 4090958 - RNA, 23 nt, Variola virus
gauagcugauacguuauaaaggu

SEQ ID NO: 4090959 - RNA, 19 nt, Variola virus
gauagguauugaugaagga

SEQ ID NO: 4090960 - RNA, 23 nt, Variola virus
gauaguuuuuuucauuacuaucu

SEQ ID NO: 4090961 - RNA, 21 nt, Variola virus
gauauacccgaagauauacac

SEQ ID NO: 4090962 - RNA, 24 nt, Variola virus
gauauaggguucuuuauaaugcau

SEQ ID NO: 4090963 - RNA, 14 nt, Variola virus
gauauauauugcac

SEQ ID NO: 4090964 - RNA, 22 nt, Variola virus
gauauauauugcacgauaaugu

SEQ ID NO: 4090965 - RNA, 17 nt, Variola virus
gauauauccacuucuuc

SEQ ID NO: 4090966 - RNA, 13 nt, Variola virus
gauauaugaugaa

SEQ ID NO: 4090967 - RNA, 18 nt, Variola virus
gauaucauuaauacagua

SEQ ID NO: 4090968 - RNA, 16 nt, Variola virus
gauaucuauacuuacu

SEQ ID NO: 4090969 - RNA, 18 nt, Variola virus
gauaucucauuaaaauau

SEQ ID NO: 4090970 - RNA, 19 nt, Variola virus
gauauuaucgacuaugaau

SEQ ID NO: 4090971 - RNA, 15 nt, Variola virus
gauauucuaugaauu

SEQ ID NO: 4090972 - RNA, 12 nt, Variola virus
gaucaaauggau

SEQ ID NO: 4090973 - RNA, 15 nt, Variola virus
gaucaaccucuggag

SEQ ID NO: 4090974 - RNA, 17 nt, Variola virus
gaucacuguagugcuau

SEQ ID NO: 4090975 - RNA, 17 nt, Variola virus
gaucaggaauccaaaga

SEQ ID NO: 4090976 - RNA, 21 nt, Variola virus
gaucagguaaaacaauaaucg

SEQ ID NO: 4090977 - RNA, 18 nt, Variola virus
gaucaucaauccuucaga

SEQ ID NO: 4090978 - RNA, 13 nt, Variola virus
gaucaucuagaua

SEQ ID NO: 4090979 - RNA, 18 nt, Variola virus
gaucauuaauaaaaauac

SEQ ID NO: 4090980 - RNA, 17 nt, Variola virus
gauccaaacaauguuuc

SEQ ID NO: 4090981 - RNA, 16 nt, Variola virus
gauccaggguauuaua

SEQ ID NO: 4090982 - RNA, 17 nt, Variola virus
gauccuaauuuacaaua

SEQ ID NO: 4090983 - RNA, 19 nt, Variola virus
gauccuagaacuagauaua

SEQ ID NO: 4090984 - RNA, 15 nt, Variola virus
gaucgguucagcauu

SEQ ID NO: 4090985 - RNA, 13 nt, Variola virus
gaucgucuagaug

SEQ ID NO: 4090986 - RNA, 21 nt, Variola virus
gaucuagcaaaggaaauugug

SEQ ID NO: 4090987 - RNA, 20 nt, Variola virus
gaucuauagaaaacuacagg

SEQ ID NO: 4090988 - RNA, 21 nt, Variola virus
gaucuauuagaaaauucucuu

SEQ ID NO: 4090989 - RNA, 14 nt, Variola virus
gaucucgaugaaaa

SEQ ID NO: 4090990 - RNA, 10 nt, Variola virus
gaucugaaga

SEQ ID NO: 4090991 - RNA, 17 nt, Variola virus
gaucuggaaaauaaucu

SEQ ID NO: 4090992 - RNA, 21 nt, Variola virus
gaucuuaacuccucuauuaau

SEQ ID NO: 4090993 - RNA, 21 nt, Variola virus
gaucuuacuguuucuucacuc

SEQ ID NO: 4090994 - RNA, 23 nt, Variola virus
gaucuuuauuuuuuguguauuuu

SEQ ID NO: 4090995 - RNA, 14 nt, Variola virus
gaucuuuuguacau

SEQ ID NO: 4090996 - RNA, 22 nt, Variola virus
gaugaaagauaaacuagauaua

SEQ ID NO: 4090997 - RNA, 12 nt, Variola virus
gaugaaauaugu

SEQ ID NO: 4090998 - RNA, 13 nt, Variola virus
gaugaauauauca

SEQ ID NO: 4090999 - RNA, 21 nt, Variola virus
gaugacaauauuauuaugaag

SEQ ID NO: 4091000 - RNA, 15 nt, Variola virus
gaugagauguuuaua

SEQ ID NO: 4091001 - RNA, 18 nt, Variola virus
gaugagcauaaacauaau

SEQ ID NO: 4091002 - RNA, 21 nt, Variola virus
gaugaucuaguuacaacuauu

SEQ ID NO: 4091003 - RNA, 18 nt, Variola virus
gaugccaucauagauaua

SEQ ID NO: 4091004 - RNA, 15 nt, Variola virus
gaugcuauuagaauu

SEQ ID NO: 4091005 - RNA, 20 nt, Variola virus
gaugcuguaaauuaugaaaa

SEQ ID NO: 4091006 - RNA, 21 nt, Variola virus
gauggaucugugauguaugca

SEQ ID NO: 4091007 - RNA, 16 nt, Variola virus
gauggcugaaauuaga

SEQ ID NO: 4091008 - RNA, 22 nt, Variola virus
gucauaaaaauguuuaaaucaa

SEQ ID NO: 4091009 - RNA, 20 nt, Variola virus
gucauaaacuguaaaugauu

SEQ ID NO: 4091010 - RNA, 14 nt, Variola virus
gucauagaugaaau

SEQ ID NO: 4091011 - RNA, 16 nt, Variola virus
gucauagaugaaauac

SEQ ID NO: 4091012 - RNA, 14 nt, Variola virus
gucaucauuaacaa

SEQ ID NO: 4091013 - RNA, 22 nt, Variola virus
gucauccuucacucguuucaua

SEQ ID NO: 4091014 - RNA, 21 nt, Variola virus
gucaucgaaaugguagauaua

SEQ ID NO: 4091015 - RNA, 20 nt, Variola virus
gucaucuuguucagaaauau

SEQ ID NO: 4091016 - RNA, 20 nt, Variola virus
gucgaauaacuguaauuuua

SEQ ID NO: 4091017 - RNA, 21 nt, Variola virus
gucuauauaguauuuuucuga

SEQ ID NO: 4091018 - RNA, 23 nt, Variola virus
gucuaucaagauccaugauucua

SEQ ID NO: 4091019 - RNA, 15 nt, Variola virus
gucuccaaucuuuug

SEQ ID NO: 4091020 - RNA, 22 nt, Variola virus
gucucccuuuagauuguuguau

SEQ ID NO: 4091021 - RNA, 13 nt, Variola virus
gucucuaucuuua

SEQ ID NO: 4091022 - RNA, 15 nt, Variola virus
gucugaagaauaucu

SEQ ID NO: 4091023 - RNA, 16 nt, Variola virus
gucugcuuucuuuuaa

SEQ ID NO: 4091024 - RNA, 14 nt, Variola virus
gucuguaaaccaca

SEQ ID NO: 4091025 - RNA, 13 nt, Variola virus
gucuguacaaaag

SEQ ID NO: 4091026 - RNA, 22 nt, Variola virus
gucuuaauuaauugucuuucuc

SEQ ID NO: 4091027 - RNA, 17 nt, Variola virus
gucuuccuuauguagag

SEQ ID NO: 4091028 - RNA, 21 nt, Variola virus
gucuugauauuguuacagcca

SEQ ID NO: 4091029 - RNA, 11 nt, Variola virus
gucuuuucuaa

SEQ ID NO: 4091030 - RNA, 17 nt, Variola virus
gugaauaugaucuucau

SEQ ID NO: 4091031 - RNA, 15 nt, Variola virus
gugacgucuguggau

SEQ ID NO: 4091032 - RNA, 23 nt, Variola virus
gugacuauuucguucucugaaaa

SEQ ID NO: 4091033 - RNA, 17 nt, Variola virus
gugaggaaauaaaucau

SEQ ID NO: 4091034 - RNA, 14 nt, Variola virus
gugauaauuuccag

SEQ ID NO: 4091035 - RNA, 12 nt, Variola virus
gugauagauaug

SEQ ID NO: 4091036 - RNA, 19 nt, Variola virus
gugaucacggguuuguaaa

SEQ ID NO: 4091037 - RNA, 17 nt, Variola virus
gugauggauuuaaacau

SEQ ID NO: 4091038 - RNA, 20 nt, Variola virus
gugauucucugaaaauguaa

SEQ ID NO: 4091039 - RNA, 13 nt, Variola virus
gugauuuuccaac

SEQ ID NO: 4091040 - RNA, 12 nt, Variola virus
gugauuuuggua

SEQ ID NO: 4091041 - RNA, 19 nt, Variola virus
gugcaaaugagguagcaaa

SEQ ID NO: 4091042 - RNA, 18 nt, Variola virus
gugcauaaauuaaaauac

SEQ ID NO: 4091043 - RNA, 13 nt, Variola virus
gugcuaccaaagg

SEQ ID NO: 4091044 - RNA, 22 nt, Variola virus
guggaggaguugcugaugauga

SEQ ID NO: 4091045 - RNA, 21 nt, Variola virus
guggauaaucagaauauacac

SEQ ID NO: 4091046 - RNA, 16 nt, Variola virus
guggaugguuaaaaag

SEQ ID NO: 4091047 - RNA, 20 nt, Variola virus
guggcuuuccauuuuccaaa

SEQ ID NO: 4091048 - RNA, 15 nt, Variola virus
gugguagauauauag

SEQ ID NO: 4091049 - RNA, 17 nt, Variola virus
guguaaaucuagaaauu

SEQ ID NO: 4091050 - RNA, 23 nt, Variola virus
guguacauccaaaauacaaaaug

SEQ ID NO: 4091051 - RNA, 22 nt, Variola virus
guguauuacaugcaucuuauua

SEQ ID NO: 4091052 - RNA, 12 nt, Variola virus
guguauuuccau

SEQ ID NO: 4091053 - RNA, 23 nt, Variola virus
gugucagagcacaggauuuccaa

SEQ ID NO: 4091054 - RNA, 15 nt, Variola virus
gugucuagacgaaau

SEQ ID NO: 4091055 - RNA, 16 nt, Variola virus
guguguaacacuuuua

SEQ ID NO: 4091056 - RNA, 13 nt, Variola virus
guguuauuuuuua

SEQ ID NO: 4091057 - RNA, 14 nt, Variola virus
guguugauaauauc

SEQ ID NO: 4091058 - RNA, 15 nt, Variola virus
guguuuuaguuuauc

SEQ ID NO: 4091059 - RNA, 19 nt, Variola virus
guuaaaaaauuaaguguua

SEQ ID NO: 4091060 - RNA, 16 nt, Variola virus
guuaaaaauaaucauc

SEQ ID NO: 4091061 - RNA, 18 nt, Variola virus
guuaaacaauagauggau

SEQ ID NO: 4091062 - RNA, 14 nt, Variola virus
guuaaagaucuuaa

SEQ ID NO: 4091063 - RNA, 19 nt, Variola virus
guuaaaggauauuaugcau

SEQ ID NO: 4091064 - RNA, 15 nt, Variola virus
guuaacccgaugguu

SEQ ID NO: 4091065 - RNA, 17 nt, Variola virus
guuaagagaauaauaga

SEQ ID NO: 4091066 - RNA, 12 nt, Variola virus
guuaauaacauc

SEQ ID NO: 4091067 - RNA, 17 nt, Variola virus
guuaauaaucucaucau

SEQ ID NO: 4091068 - RNA, 13 nt, Variola virus
guuaauacuuauu

SEQ ID NO: 4091069 - RNA, 23 nt, Variola virus
guuaauaggacacauauaauaau

SEQ ID NO: 4091070 - RNA, 18 nt, Variola virus
guuaauaguuuuuaucau

SEQ ID NO: 4091071 - RNA, 19 nt, Variola virus
guuaauuaugcaaauuuga

SEQ ID NO: 4091072 - RNA, 17 nt, Variola virus
guuaauuuuaaaugaug

SEQ ID NO: 4091073 - RNA, 10 nt, Variola virus
guuacaaaag

SEQ ID NO: 4091074 - RNA, 22 nt, Variola virus
guuacacgcauccuuauaaaga

SEQ ID NO: 4091075 - RNA, 12 nt, Variola virus
guuacuauuauu

SEQ ID NO: 4091076 - RNA, 18 nt, Variola virus
guuagaaagcagauuaga

SEQ ID NO: 4091077 - RNA, 19 nt, Variola virus
guuagaguaucuacaucag

SEQ ID NO: 4091078 - RNA, 14 nt, Variola virus
guuagucauauuac

SEQ ID NO: 4091079 - RNA, 20 nt, Variola virus
guuauaaaggacagaaauau

SEQ ID NO: 4091080 - RNA, 17 nt, Variola virus
guuauaagauuacuuau

SEQ ID NO: 4091081 - RNA, 15 nt, Variola virus
guuauaguagauauc

SEQ ID NO: 4091082 - RNA, 20 nt, Variola virus
guuaucaucguauaaauuaa

SEQ ID NO: 4091083 - RNA, 11 nt, Variola virus
guuaucuuuug

SEQ ID NO: 4091084 - RNA, 19 nt, Variola virus
guuauucucggaugcuaaa

SEQ ID NO: 4091085 - RNA, 19 nt, Variola virus
guuauugaaauuaaucaua

SEQ ID NO: 4091086 - RNA, 12 nt, Variola virus
guuauuuacagc

SEQ ID NO: 4091087 - RNA, 15 nt, Variola virus
guucagaauauguua

SEQ ID NO: 4091088 - RNA, 16 nt, Variola virus
guucagaggaugaaau

SEQ ID NO: 4091089 - RNA, 20 nt, Variola virus
guucauacaugaaaugaucu

SEQ ID NO: 4091090 - RNA, 15 nt, Variola virus
guucaucagauguuc

SEQ ID NO: 4091091 - RNA, 21 nt, Variola virus
guuccauaaauuuauaauguu

SEQ ID NO: 4091092 - RNA, 12 nt, Variola virus
guuccauauuau

SEQ ID NO: 4091093 - RNA, 22 nt, Variola virus
guuccugguauauagauaaaga

SEQ ID NO: 4091094 - RNA, 21 nt, Variola virus
guucuauaaucguaaauaauu

SEQ ID NO: 4091095 - RNA, 17 nt, Variola virus
guucugggaauagaaac

SEQ ID NO: 4091096 - RNA, 22 nt, Variola virus
guucugggaauagaaaccaaau

SEQ ID NO: 4091097 - RNA, 16 nt, Variola virus
guucuugaucuuauua

SEQ ID NO: 4091098 - RNA, 14 nt, Variola virus
guucuuuuuccaau

SEQ ID NO: 4091099 - RNA, 21 nt, Variola virus
guugaucagaaugaauguuua

SEQ ID NO: 4091100 - RNA, 21 nt, Variola virus
guugcguacauugcucguaaa

SEQ ID NO: 4091101 - RNA, 22 nt, Variola virus
guuggaagaugcgcauuaacaa

SEQ ID NO: 4091102 - RNA, 22 nt, Variola virus
guugggacugacagauguguuc

SEQ ID NO: 4091103 - RNA, 22 nt, Variola virus
guuguagauaaucguuaauauu

SEQ ID NO: 4091104 - RNA, 15 nt, Variola virus
guugucuauuuccaa

SEQ ID NO: 4091105 - RNA, 15 nt, Variola virus
guuguuccaauaaau

SEQ ID NO: 4091106 - RNA, 16 nt, Variola virus
guuuaacaaaguuauu

SEQ ID NO: 4091107 - RNA, 19 nt, Variola virus
guuuaacaaaguuauucau

SEQ ID NO: 4091108 - RNA, 20 nt, Variola virus
guuuaauauccuuagucauc

SEQ ID NO: 4091109 - RNA, 17 nt, Variola virus
guuuaaugauaaacaaa

SEQ ID NO: 4091110 - RNA, 17 nt, Variola virus
guuuacaacacuuuucu

SEQ ID NO: 4091111 - RNA, 14 nt, Variola virus
guuuacauaaauga

SEQ ID NO: 4091112 - RNA, 17 nt, Variola virus
guuuagacgcuuauuau

SEQ ID NO: 4091113 - RNA, 16 nt, Variola virus
guuuauuccaauaaau

SEQ ID NO: 4091114 - RNA, 17 nt, Variola virus
guuucaaaaauauucau

SEQ ID NO: 4091115 - RNA, 23 nt, Variola virus
guuucaaccgcguuaacauauga

SEQ ID NO: 4091116 - RNA, 23 nt, Variola virus
guuucccaaugaaaugguacaau

SEQ ID NO: 4091117 - RNA, 14 nt, Variola virus
guuucuacuaacuu

SEQ ID NO: 4091118 - RNA, 14 nt, Variola virus
guuugauaaaugua

SEQ ID NO: 4091119 - RNA, 13 nt, Variola virus
guuuggaauaacu

SEQ ID NO: 4091120 - RNA, 21 nt, Variola virus
guuuggagacuaauucuuuuu

SEQ ID NO: 4091121 - RNA, 14 nt, Variola virus
guuuguuuuggaaa

SEQ ID NO: 4091122 - RNA, 15 nt, Variola virus
guuuguuuuggaaau

SEQ ID NO: 4091123 - RNA, 15 nt, Variola virus
guuuuauaacgaagu

SEQ ID NO: 4091124 - RNA, 11 nt, Variola virus
guuuucaucag

SEQ ID NO: 4091125 - RNA, 15 nt, Variola virus
guuuucauuauuauu

SEQ ID NO: 4091126 - RNA, 15 nt, Variola virus
guuuucgauacuuuu

SEQ ID NO: 4091127 - RNA, 14 nt, Variola virus
guuuucuauuuuua

SEQ ID NO: 4091128 - RNA, 16 nt, Variola virus
uaaaaaaugaaaauaa

SEQ ID NO: 4091129 - RNA, 18 nt, Variola virus
uaaaaacauuuuauuucu

SEQ ID NO: 4091130 - RNA, 16 nt, Variola virus
uaaaaagacuaaaucu

SEQ ID NO: 4091131 - RNA, 16 nt, Variola virus
uaaaaaguuuaauuug

SEQ ID NO: 4091132 - RNA, 14 nt, Variola virus
uaaaaauauguaua

SEQ ID NO: 4091133 - RNA, 19 nt, Variola virus
uaaaaauuaaaaaaucacu

SEQ ID NO: 4091134 - RNA, 13 nt, Variola virus
uaaaacaauaaau

SEQ ID NO: 4091135 - RNA, 21 nt, Variola virus
uaaaacagucacgauaucucu

SEQ ID NO: 4091136 - RNA, 12 nt, Variola virus
uaaaacauaaag

SEQ ID NO: 4091137 - RNA, 19 nt, Variola virus
uaaaacauaaucaaggaua

SEQ ID NO: 4091138 - RNA, 20 nt, Variola virus
uaaaacauucucgacuuauu

SEQ ID NO: 4091139 - RNA, 14 nt, Variola virus
uaaaacauuuccua

SEQ ID NO: 4091140 - RNA, 15 nt, Variola virus
uaaaagaugauuuuc

SEQ ID NO: 4091141 - RNA, 14 nt, Variola virus
uaaaaguuaaacuu

SEQ ID NO: 4091142 - RNA, 21 nt, Variola virus
uaaaauacuaaugcaucuauu

SEQ ID NO: 4091143 - RNA, 12 nt, Variola virus
uaaaauaucuua

SEQ ID NO: 4091144 - RNA, 21 nt, Variola virus
uaaaauccaugagaucuaauu

SEQ ID NO: 4091145 - RNA, 15 nt, Variola virus
uaaaaugauaaaugc

SEQ ID NO: 4091146 - RNA, 12 nt, Variola virus
uaaaauggauua

SEQ ID NO: 4091147 - RNA, 15 nt, Variola virus
uaaaaugguaaacuu

SEQ ID NO: 4091148 - RNA, 17 nt, Variola virus
uaaaaugugguaugucu

SEQ ID NO: 4091149 - RNA, 15 nt, Variola virus
uaaaauuagagguau

SEQ ID NO: 4091150 - RNA, 21 nt, Variola virus
uaaaauuagaugugucauacu

SEQ ID NO: 4091151 - RNA, 19 nt, Variola virus
uaaaauuggaucuacuaau

SEQ ID NO: 4091152 - RNA, 17 nt, Variola virus
uaaacaaaaauauaaag

SEQ ID NO: 4091153 - RNA, 21 nt, Variola virus
uaaacaauacuucugaagaaa

SEQ ID NO: 4091154 - RNA, 18 nt, Variola virus
uaaacaauuucacaaaug

SEQ ID NO: 4091155 - RNA, 18 nt, Variola virus
uaaacagaaucccuuucc

SEQ ID NO: 4091156 - RNA, 23 nt, Variola virus
uaaacauauagggaaucauauau

SEQ ID NO: 4091157 - RNA, 15 nt, Variola virus
uaaacauaucauaau

SEQ ID NO: 4091158 - RNA, 21 nt, Variola virus
uaaacaugucuauuguuaauc

SEQ ID NO: 4091159 - RNA, 21 nt, Variola virus
uaaacccucgaucaugaaugg

SEQ ID NO: 4091160 - RNA, 14 nt, Variola virus
uaaacgaacuauau

SEQ ID NO: 4091161 - RNA, 20 nt, Variola virus
uaaacgauuuuccaaaucag

SEQ ID NO: 4091162 - RNA, 23 nt, Variola virus
uaaacggcaaaccaaaaacauuu

SEQ ID NO: 4091163 - RNA, 15 nt, Variola virus
uaaacuaacuacaaa

SEQ ID NO: 4091164 - RNA, 20 nt, Variola virus
uaaacuacgugaacauaugg

SEQ ID NO: 4091165 - RNA, 19 nt, Variola virus
uaaacucuccaccauuucc

SEQ ID NO: 4091166 - RNA, 16 nt, Variola virus
uaaagaaaagauaucc

SEQ ID NO: 4091167 - RNA, 17 nt, Variola virus
uaaagaagaucauacag

SEQ ID NO: 4091168 - RNA, 23 nt, Variola virus
uaaagaaguagcuaauguuguga

SEQ ID NO: 4091169 - RNA, 14 nt, Variola virus
uaaagauacaaaac

SEQ ID NO: 4091170 - RNA, 13 nt, Variola virus
uaaagccauacau

SEQ ID NO: 4091171 - RNA, 21 nt, Variola virus
uaaagcgaaaaauaauuauuc

SEQ ID NO: 4091172 - RNA, 15 nt, Variola virus
uaaaggaugauacau

SEQ ID NO: 4091173 - RNA, 17 nt, Variola virus
uaaaguacguaaaucua

SEQ ID NO: 4091174 - RNA, 18 nt, Variola virus
uaaaguauccguguauag

SEQ ID NO: 4091175 - RNA, 21 nt, Variola virus
uaaaguaugaacaaagaaaug

SEQ ID NO: 4091176 - RNA, 13 nt, Variola virus
uaaagucauuaau

SEQ ID NO: 4091177 - RNA, 22 nt, Variola virus
uaaaguccgcacuacuguuaag

SEQ ID NO: 4091178 - RNA, 14 nt, Variola virus
uaaauaaauucauu

SEQ ID NO: 4091179 - RNA, 15 nt, Variola virus
uaaauaauuauuuca

SEQ ID NO: 4091180 - RNA, 22 nt, Variola virus
uaaauaauucucugaugucauu

SEQ ID NO: 4091181 - RNA, 17 nt, Variola virus
uaaauacaugucuaaug

SEQ ID NO: 4091182 - RNA, 14 nt, Variola virus
uaaauacauuauca

SEQ ID NO: 4091183 - RNA, 16 nt, Variola virus
uaaauagaacgucauc

SEQ ID NO: 4091184 - RNA, 24 nt, Variola virus
uaaauagaauucucuucauaucau

SEQ ID NO: 4091185 - RNA, 17 nt, Variola virus
uaaauagguuucuauaa

SEQ ID NO: 4091186 - RNA, 21 nt, Variola virus
uaaauauaucuacaauuauug

SEQ ID NO: 4091187 - RNA, 20 nt, Variola virus
uaaauauauuuauaaaguau

SEQ ID NO: 4091188 - RNA, 21 nt, Variola virus
uaaauaucaaccgcaaaucaa

SEQ ID NO: 4091189 - RNA, 13 nt, Variola virus
uaaauaucauaau

SEQ ID NO: 4091190 - RNA, 15 nt, Variola virus
uaaauccuuguuuga

SEQ ID NO: 4091191 - RNA, 15 nt, Variola virus
uaaaucguauauguu

SEQ ID NO: 4091192 - RNA, 20 nt, Variola virus
uaaaucuaacauugauuuua

SEQ ID NO: 4091193 - RNA, 14 nt, Variola virus
uaaaugacaaguau

SEQ ID NO: 4091194 - RNA, 18 nt, Variola virus
uaaaugagaugagaagau

SEQ ID NO: 4091195 - RNA, 14 nt, Variola virus
uaaaugaugauguu

SEQ ID NO: 4091196 - RNA, 16 nt, Variola virus
uaaauggaacagacau

SEQ ID NO: 4091197 - RNA, 18 nt, Variola virus
uaaauguccacuauacau

SEQ ID NO: 4091198 - RNA, 22 nt, Variola virus
uaaauguuucgauuucaauuua

SEQ ID NO: 4091199 - RNA, 17 nt, Variola virus
uaaauuaauucauacac

SEQ ID NO: 4091200 - RNA, 15 nt, Variola virus
uaaauuaauuuacca

SEQ ID NO: 4091201 - RNA, 15 nt, Variola virus
uaaauuauuaucuac

SEQ ID NO: 4091202 - RNA, 18 nt, Variola virus
uaaauuuaauaagacuuu

SEQ ID NO: 4091203 - RNA, 18 nt, Variola virus
uaaauuuuaaacauaaag

SEQ ID NO: 4091204 - RNA, 13 nt, Variola virus
uaaauuuuguauu

SEQ ID NO: 4091205 - RNA, 17 nt, Variola virus
uaacaaaaauuaugaaa

SEQ ID NO: 4091206 - RNA, 19 nt, Variola virus
uaacaaaauccaaacauua

SEQ ID NO: 4091207 - RNA, 12 nt, Variola virus
uaacaaacaucu

SEQ ID NO: 4091208 - RNA, 16 nt, Variola virus
uaacaaauuaaagaua

SEQ ID NO: 4091209 - RNA, 16 nt, Variola virus
uaacaacgacuuauaa

SEQ ID NO: 4091210 - RNA, 21 nt, Variola virus
uaacaagaaaauuagaaggau

SEQ ID NO: 4091211 - RNA, 12 nt, Variola virus
uaacaauaugcu

SEQ ID NO: 4091212 - RNA, 18 nt, Variola virus
uaacaauuuauuuuguau

SEQ ID NO: 4091213 - RNA, 17 nt, Variola virus
uaacacauuucaacaau

SEQ ID NO: 4091214 - RNA, 13 nt, Variola virus
uaacacauuuuca

SEQ ID NO: 4091215 - RNA, 20 nt, Variola virus
uaacaccuauaagauuauca

SEQ ID NO: 4091216 - RNA, 17 nt, Variola virus
uaacacuauacuuauau

SEQ ID NO: 4091217 - RNA, 20 nt, Variola virus
uaacacuuucuuugauuuaa

SEQ ID NO: 4091218 - RNA, 16 nt, Variola virus
uaacaggucauauucu

SEQ ID NO: 4091219 - RNA, 16 nt, Variola virus
uaacaguauuauuaau

SEQ ID NO: 4091220 - RNA, 23 nt, Variola virus
uaacagucuguucaaauuuauau

SEQ ID NO: 4091221 - RNA, 18 nt, Variola virus
uaacauaaaaauaucauu

SEQ ID NO: 4091222 - RNA, 22 nt, Variola virus
uaacauaaaaauaucauugaau

SEQ ID NO: 4091223 - RNA, 14 nt, Variola virus
uaacauaccaugga

SEQ ID NO: 4091224 - RNA, 23 nt, Variola virus
uaacaucuggccuguucauaaau

SEQ ID NO: 4091225 - RNA, 20 nt, Variola virus
uaacaugcauuugaaaagau

SEQ ID NO: 4091226 - RNA, 18 nt, Variola virus
uaacauguuauagaauau

SEQ ID NO: 4091227 - RNA, 15 nt, Variola virus
uaacauuacauauua

SEQ ID NO: 4091228 - RNA, 23 nt, Variola virus
uaacccauuauaaaacuuaugau

SEQ ID NO: 4091229 - RNA, 16 nt, Variola virus
uaaccuccugaaaaug

SEQ ID NO: 4091230 - RNA, 14 nt, Variola virus
uaacgcaacuauau

SEQ ID NO: 4091231 - RNA, 21 nt, Variola virus
uaacgccuauucgaaauuaga

SEQ ID NO: 4091232 - RNA, 17 nt, Variola virus
uaacguauuaaauauua

SEQ ID NO: 4091233 - RNA, 18 nt, Variola virus
uaacguucuaacaucauu

SEQ ID NO: 4091234 - RNA, 17 nt, Variola virus
uaacuaucuuucaagau

SEQ ID NO: 4091235 - RNA, 18 nt, Variola virus
uaacucaaagacaucaua

SEQ ID NO: 4091236 - RNA, 20 nt, Variola virus
uaacucauucuauauaugcu

SEQ ID NO: 4091237 - RNA, 16 nt, Variola virus
uaacucauuuuuugaa

SEQ ID NO: 4091238 - RNA, 18 nt, Variola virus
uaacuccagaacaucuuc

SEQ ID NO: 4091239 - RNA, 10 nt, Variola virus
uaacugaaga

SEQ ID NO: 4091240 - RNA, 18 nt, Variola virus
uaacugacuuaauaguag

SEQ ID NO: 4091241 - RNA, 14 nt, Variola virus
uaacuuaauuuauu

SEQ ID NO: 4091242 - RNA, 23 nt, Variola virus
uaacuuuaaauaauuuacaaaaa

SEQ ID NO: 4091243 - RNA, 16 nt, Variola virus
uaacuuuaauguguga

SEQ ID NO: 4091244 - RNA, 23 nt, Variola virus
uaacuuuaguaaaguugucuaua

SEQ ID NO: 4091245 - RNA, 16 nt, Variola virus
uaagaaaaauagagag

SEQ ID NO: 4091246 - RNA, 15 nt, Variola virus
uaagaaacuauaaag

SEQ ID NO: 4091247 - RNA, 14 nt, Variola virus
uaagaaauacauac

SEQ ID NO: 4091248 - RNA, 19 nt, Variola virus
uaagaacuccuaauauguu

SEQ ID NO: 4091249 - RNA, 20 nt, Variola virus
uaagacguaucuccauaaag

SEQ ID NO: 4091250 - RNA, 19 nt, Variola virus
uaagacguauucucuacau

SEQ ID NO: 4091251 - RNA, 19 nt, Variola virus
uaagaguuaugacgcauua

SEQ ID NO: 4091252 - RNA, 23 nt, Variola virus
uaagaucuggguauuucuuuucu

SEQ ID NO: 4091253 - RNA, 22 nt, Variola virus
uaagaucuucuauuuuaucauu

SEQ ID NO: 4091254 - RNA, 14 nt, Variola virus
uaagaugcaaacau

SEQ ID NO: 4091255 - RNA, 16 nt, Variola virus
uaagauuuuaaaugua

SEQ ID NO: 4091256 - RNA, 22 nt, Variola virus
uaagcaucuuggaaacauaaaa

SEQ ID NO: 4091257 - RNA, 16 nt, Variola virus
uaagccugaauuuauu

SEQ ID NO: 4091258 - RNA, 16 nt, Variola virus
uaagcugucuaucaag

SEQ ID NO: 4091259 - RNA, 14 nt, Variola virus
uaaggaguugaaau

SEQ ID NO: 4091260 - RNA, 21 nt, Variola virus
uaggaaauugguuuauaaugu

SEQ ID NO: 4091261 - RNA, 14 nt, Variola virus
uaggagaauuauuu

SEQ ID NO: 4091262 - RNA, 20 nt, Variola virus
uaggagucagacuuguauuc

SEQ ID NO: 4091263 - RNA, 16 nt, Variola virus
uaggaguuagaauaau

SEQ ID NO: 4091264 - RNA, 13 nt, Variola virus
uaggauaucuauu

SEQ ID NO: 4091265 - RNA, 16 nt, Variola virus
uaggauuuuuccaaag

SEQ ID NO: 4091266 - RNA, 20 nt, Variola virus
uagguaugaucguuaagaau

SEQ ID NO: 4091267 - RNA, 15 nt, Variola virus
uagguauguccucua

SEQ ID NO: 4091268 - RNA, 19 nt, Variola virus
uagguauuuuaucucuauu

SEQ ID NO: 4091269 - RNA, 18 nt, Variola virus
uaguaaaaaauaagucag

SEQ ID NO: 4091270 - RNA, 18 nt, Variola virus
uaguaaaaaauauacauc

SEQ ID NO: 4091271 - RNA, 19 nt, Variola virus
uaguaacggacuuaacaug

SEQ ID NO: 4091272 - RNA, 17 nt, Variola virus
uaguacaagaaauacuu

SEQ ID NO: 4091273 - RNA, 18 nt, Variola virus
uaguacaagaaauacuuc

SEQ ID NO: 4091274 - RNA, 17 nt, Variola virus
uaguacuacugaagaac

SEQ ID NO: 4091275 - RNA, 20 nt, Variola virus
uaguacucgaaauaauauua

SEQ ID NO: 4091276 - RNA, 20 nt, Variola virus
uaguagucuaccgaucucuu

SEQ ID NO: 4091277 - RNA, 17 nt, Variola virus
uaguauagaacacaugu

SEQ ID NO: 4091278 - RNA, 16 nt, Variola virus
uaguauagcagaaguu

SEQ ID NO: 4091279 - RNA, 21 nt, Variola virus
uaguauccaguuccuuuucua

SEQ ID NO: 4091280 - RNA, 18 nt, Variola virus
uaguaugacuuacuugua

SEQ ID NO: 4091281 - RNA, 19 nt, Variola virus
uaguauuauucauuuucua

SEQ ID NO: 4091282 - RNA, 18 nt, Variola virus
uaguauuuauacuacuaa

SEQ ID NO: 4091283 - RNA, 13 nt, Variola virus
uagucaagaugau

SEQ ID NO: 4091284 - RNA, 16 nt, Variola virus
uagucaucucauuaac

SEQ ID NO: 4091285 - RNA, 24 nt, Variola virus
uagucgguuaauguuguauuucau

SEQ ID NO: 4091286 - RNA, 19 nt, Variola virus
uagucuaguaucuaaacau

SEQ ID NO: 4091287 - RNA, 15 nt, Variola virus
uagugacauaaacau

SEQ ID NO: 4091288 - RNA, 18 nt, Variola virus
uagugcucaaacaaaaug

SEQ ID NO: 4091289 - RNA, 17 nt, Variola virus
uaguguuggauaucuuc

SEQ ID NO: 4091290 - RNA, 17 nt, Variola virus
uaguguuuacauaaaug

SEQ ID NO: 4091291 - RNA, 13 nt, Variola virus
uaguuaaauauua

SEQ ID NO: 4091292 - RNA, 14 nt, Variola virus
uaguuaguagacau

SEQ ID NO: 4091293 - RNA, 13 nt, Variola virus
uaguuaguauaac

SEQ ID NO: 4091294 - RNA, 21 nt, Variola virus
uaguugauagaacaaaauaca

SEQ ID NO: 4091295 - RNA, 19 nt, Variola virus
uaguugcaauauacauaaa

SEQ ID NO: 4091296 - RNA, 21 nt, Variola virus
uaguugucuuagccuuaucaa

SEQ ID NO: 4091297 - RNA, 14 nt, Variola virus
uaguuuauaucuuu

SEQ ID NO: 4091298 - RNA, 19 nt, Variola virus
uaguuuccuuaacaaaucu

SEQ ID NO: 4091299 - RNA, 22 nt, Variola virus
uaguuuguaucaauaauaguaa

SEQ ID NO: 4091300 - RNA, 17 nt, Variola virus
uaguuuguuucuagaau

SEQ ID NO: 4091301 - RNA, 14 nt, Variola virus
uaguuuguuuucau

SEQ ID NO: 4091302 - RNA, 15 nt, Variola virus
uaguuuuauauacau

SEQ ID NO: 4091303 - RNA, 13 nt, Variola virus
uaguuuuucugga

SEQ ID NO: 4091304 - RNA, 13 nt, Variola virus
uaguuuuuuucau

SEQ ID NO: 4091305 - RNA, 17 nt, Variola virus
uauaaaaacauuauucu

SEQ ID NO: 4091306 - RNA, 21 nt, Variola virus
uauaaaaauacuaaaacugaa

SEQ ID NO: 4091307 - RNA, 23 nt, Variola virus
uauaaaaaugcuaaaugugaugu

SEQ ID NO: 4091308 - RNA, 19 nt, Variola virus
uauaaaacgauuaaacaau

SEQ ID NO: 4091309 - RNA, 19 nt, Variola virus
uauaaaacuacuacaauga

SEQ ID NO: 4091310 - RNA, 20 nt, Variola virus
uauaaacguauacuguagau

SEQ ID NO: 4091311 - RNA, 17 nt, Variola virus
uauaaacucgcuuaaua

SEQ ID NO: 4091312 - RNA, 16 nt, Variola virus
uauaaacucucaacau

SEQ ID NO: 4091313 - RNA, 21 nt, Variola virus
uauaaaguccgcacuacuguu

SEQ ID NO: 4091314 - RNA, 18 nt, Variola virus
uauaaauauauaaugggu

SEQ ID NO: 4091315 - RNA, 15 nt, Variola virus
uauaaauauccuuaa

SEQ ID NO: 4091316 - RNA, 17 nt, Variola virus
uauaaaucaaauacuug

SEQ ID NO: 4091317 - RNA, 17 nt, Variola virus
uauaaaucauauuuaga

SEQ ID NO: 4091318 - RNA, 13 nt, Variola virus
uauaaauuuuaga

SEQ ID NO: 4091319 - RNA, 22 nt, Variola virus
uauaacacguauguauuaacuu

SEQ ID NO: 4091320 - RNA, 21 nt, Variola virus
uauaacagagccaucuguaaa

SEQ ID NO: 4091321 - RNA, 22 nt, Variola virus
uauaacauuaauaucaaacaau

SEQ ID NO: 4091322 - RNA, 17 nt, Variola virus
uauaacauucauuagua

SEQ ID NO: 4091323 - RNA, 20 nt, Variola virus
uauaacuggauauagaacug

SEQ ID NO: 4091324 - RNA, 20 nt, Variola virus
uauaacuucugguaaauauu

SEQ ID NO: 4091325 - RNA, 15 nt, Variola virus
uauaagauuaucaaa

SEQ ID NO: 4091326 - RNA, 20 nt, Variola virus
uauaagauuaucaaaaucuu

SEQ ID NO: 4091327 - RNA, 19 nt, Variola virus
uauaauaacaaguaugaca

SEQ ID NO: 4091328 - RNA, 12 nt, Variola virus
uauaauaucuug

SEQ ID NO: 4091329 - RNA, 17 nt, Variola virus
uauaaucgcuucaucau

SEQ ID NO: 4091330 - RNA, 16 nt, Variola virus
uauaaucguuaaauuu

SEQ ID NO: 4091331 - RNA, 18 nt, Variola virus
uauaaucuagccaacaau

SEQ ID NO: 4091332 - RNA, 16 nt, Variola virus
uauaaucugaugaaca

SEQ ID NO: 4091333 - RNA, 18 nt, Variola virus
uauaaucugaugaacaau

SEQ ID NO: 4091334 - RNA, 22 nt, Variola virus
uauaaucuuuuucaucuuguga

SEQ ID NO: 4091335 - RNA, 20 nt, Variola virus
uauaauguaacguuuauaua

SEQ ID NO: 4091336 - RNA, 15 nt, Variola virus
uauaauguggauaau

SEQ ID NO: 4091337 - RNA, 16 nt, Variola virus
uauaauucuccugaaa

SEQ ID NO: 4091338 - RNA, 15 nt, Variola virus
uauaauucuuuggua

SEQ ID NO: 4091339 - RNA, 22 nt, Variola virus
uauaauuuaccgcuauagcauu

SEQ ID NO: 4091340 - RNA, 14 nt, Variola virus
uauacaaaaaugca

SEQ ID NO: 4091341 - RNA, 16 nt, Variola virus
uauacaccacccaaug

SEQ ID NO: 4091342 - RNA, 14 nt, Variola virus
uauacauuacugaa

SEQ ID NO: 4091343 - RNA, 14 nt, Variola virus
uauaccauuaaaaa

SEQ ID NO: 4091344 - RNA, 13 nt, Variola virus
uauacccaaagag

SEQ ID NO: 4091345 - RNA, 16 nt, Variola virus
uauacccauuauguaa

SEQ ID NO: 4091346 - RNA, 21 nt, Variola virus
uauaccuuugguucuuuaaaa

SEQ ID NO: 4091347 - RNA, 13 nt, Variola virus
uauacgaauauga

SEQ ID NO: 4091348 - RNA, 15 nt, Variola virus
uauacggauuucuau

SEQ ID NO: 4091349 - RNA, 18 nt, Variola virus
uauacuccggucgaugau

SEQ ID NO: 4091350 - RNA, 17 nt, Variola virus
uauacugaaaaguuauu

SEQ ID NO: 4091351 - RNA, 23 nt, Variola virus
uauacugcauggaaucauagaug

SEQ ID NO: 4091352 - RNA, 15 nt, Variola virus
uauacuuuaaagcaa

SEQ ID NO: 4091353 - RNA, 21 nt, Variola virus
uauacuuuguaauauaaugau

SEQ ID NO: 4091354 - RNA, 21 nt, Variola virus
uauagacgguaaugucaucau

SEQ ID NO: 4091355 - RNA, 13 nt, Variola virus
uauagagaaguau

SEQ ID NO: 4091356 - RNA, 17 nt, Variola virus
uauagaucuuagacauu

SEQ ID NO: 4091357 - RNA, 15 nt, Variola virus
uauagcaauaugugu

SEQ ID NO: 4091358 - RNA, 19 nt, Variola virus
uauagcacuuuuaacuauu

SEQ ID NO: 4091359 - RNA, 20 nt, Variola virus
uauagcauuguuauguauuu

SEQ ID NO: 4091360 - RNA, 16 nt, Variola virus
uauaggaaaaaaacaa

SEQ ID NO: 4091361 - RNA, 18 nt, Variola virus
uauaggaccacuagcaaa

SEQ ID NO: 4091362 - RNA, 20 nt, Variola virus
uauaguaauaaaauuucuau

SEQ ID NO: 4091363 - RNA, 14 nt, Variola virus
uauauaaauacuuu

SEQ ID NO: 4091364 - RNA, 13 nt, Variola virus
uauauaacucauu

SEQ ID NO: 4091365 - RNA, 16 nt, Variola virus
uauauagcacaaaugu

SEQ ID NO: 4091366 - RNA, 20 nt, Variola virus
uauauccaccaauagaaguu

SEQ ID NO: 4091367 - RNA, 18 nt, Variola virus
uauauccguucuuaacuu

SEQ ID NO: 4091368 - RNA, 22 nt, Variola virus
uauauccuacaccggaagagau

SEQ ID NO: 4091369 - RNA, 15 nt, Variola virus
uauauccuuuuguau

SEQ ID NO: 4091370 - RNA, 15 nt, Variola virus
uauaucguuaucauc

SEQ ID NO: 4091371 - RNA, 14 nt, Variola virus
uauaugacuguauu

SEQ ID NO: 4091372 - RNA, 18 nt, Variola virus
uauaugucaaccauuacu

SEQ ID NO: 4091373 - RNA, 13 nt, Variola virus
uauauguuuucau

SEQ ID NO: 4091374 - RNA, 17 nt, Variola virus
uauauuaaaaaauguca

SEQ ID NO: 4091375 - RNA, 15 nt, Variola virus
uauauuaauacacau

SEQ ID NO: 4091376 - RNA, 20 nt, Variola virus
uauauuaucaaaauuuggaa

SEQ ID NO: 4091377 - RNA, 23 nt, Variola virus
uauauucaguaaccaaauacaua

SEQ ID NO: 4091378 - RNA, 21 nt, Variola virus
uauauucgauaguuauggaca

SEQ ID NO: 4091379 - RNA, 18 nt, Variola virus
uauauucuuacaguacau

SEQ ID NO: 4091380 - RNA, 14 nt, Variola virus
uauauuuuggaagc

SEQ ID NO: 4091381 - RNA, 18 nt, Variola virus
uaucaaaaucuugucugc

SEQ ID NO: 4091382 - RNA, 17 nt, Variola virus
uaucaaacaauccaaaa

SEQ ID NO: 4091383 - RNA, 18 nt, Variola virus
uaucaaauagcucaauau

SEQ ID NO: 4091384 - RNA, 18 nt, Variola virus
uaucaacggacacaaagu

SEQ ID NO: 4091385 - RNA, 16 nt, Variola virus
uaucaauaccuuuucu

SEQ ID NO: 4091386 - RNA, 16 nt, Variola virus
uugcauauuuaucuuu

SEQ ID NO: 4091387 - RNA, 19 nt, Variola virus
uugccaucacucucauaau

SEQ ID NO: 4091388 - RNA, 16 nt, Variola virus
uugccauucuuuguaa

SEQ ID NO: 4091389 - RNA, 15 nt, Variola virus
uugcggcauauauaa

SEQ ID NO: 4091390 - RNA, 18 nt, Variola virus
uugcucaaauaauacuau

SEQ ID NO: 4091391 - RNA, 13 nt, Variola virus
uugcuuuucuaau

SEQ ID NO: 4091392 - RNA, 18 nt, Variola virus
uuggaaaggcguuaucua

SEQ ID NO: 4091393 - RNA, 16 nt, Variola virus
uuggaagcaauuacag

SEQ ID NO: 4091394 - RNA, 18 nt, Variola virus
uuggaaucacaaacauua

SEQ ID NO: 4091395 - RNA, 18 nt, Variola virus
uuggacaaaucuggaaaa

SEQ ID NO: 4091396 - RNA, 18 nt, Variola virus
uuggcaguacucauuaau

SEQ ID NO: 4091397 - RNA, 18 nt, Variola virus
uuggcgcuagucaucuca

SEQ ID NO: 4091398 - RNA, 15 nt, Variola virus
uuggcgguucuaaug

SEQ ID NO: 4091399 - RNA, 16 nt, Variola virus
uuggcuaauugucuuu

SEQ ID NO: 4091400 - RNA, 16 nt, Variola virus
uuggcuucuuccaacu

SEQ ID NO: 4091401 - RNA, 21 nt, Variola virus
uugguaauauggauacuaauu

SEQ ID NO: 4091402 - RNA, 20 nt, Variola virus
uugguauaaauguuguaauu

SEQ ID NO: 4091403 - RNA, 16 nt, Variola virus
uugguauuucuuacau

SEQ ID NO: 4091404 - RNA, 17 nt, Variola virus
uuggucaccaauucuag

SEQ ID NO: 4091405 - RNA, 13 nt, Variola virus
uugguguaaaucu

SEQ ID NO: 4091406 - RNA, 18 nt, Variola virus
uuguaaagaaauuauuuu

SEQ ID NO: 4091407 - RNA, 16 nt, Variola virus
uuguaacaacaauguu

SEQ ID NO: 4091408 - RNA, 15 nt, Variola virus
uuguaagguuguaaa

SEQ ID NO: 4091409 - RNA, 19 nt, Variola virus
uuguaagucggucgauucu

SEQ ID NO: 4091410 - RNA, 15 nt, Variola virus
uuguaauuaaauuuu

SEQ ID NO: 4091411 - RNA, 13 nt, Variola virus
uuguacauuauua

SEQ ID NO: 4091412 - RNA, 22 nt, Variola virus
uuguagaacuuaacuuuuucuu

SEQ ID NO: 4091413 - RNA, 16 nt, Variola virus
uuguauuauucugaau

SEQ ID NO: 4091414 - RNA, 11 nt, Variola virus
uuguauuuugu

SEQ ID NO: 4091415 - RNA, 21 nt, Variola virus
uuguuacccaugaucuauaaa

SEQ ID NO: 4091416 - RNA, 15 nt, Variola virus
uuguuccuguagaua

SEQ ID NO: 4091417 - RNA, 20 nt, Variola virus
uuguuuauuguauauacuua

SEQ ID NO: 4091418 - RNA, 13 nt, Variola virus
uuguuuuauucaa

SEQ ID NO: 4091419 - RNA, 14 nt, Variola virus
uuguuuuauucaaa

SEQ ID NO: 4091420 - RNA, 17 nt, Variola virus
uuuaaaaaaaaauacuu

SEQ ID NO: 4091421 - RNA, 17 nt, Variola virus
uuuaaaaacgaaucaga

SEQ ID NO: 4091422 - RNA, 19 nt, Variola virus
uuuaaacaagaaaguuauc

SEQ ID NO: 4091423 - RNA, 19 nt, Variola virus
uuuaaacagagaaaucagu

SEQ ID NO: 4091424 - RNA, 15 nt, Variola virus
uuuaaacaguuuauu

SEQ ID NO: 4091425 - RNA, 22 nt, Variola virus
uuuaaacuguccuauaaccucu

SEQ ID NO: 4091426 - RNA, 11 nt, Variola virus
uuuaacagaug

SEQ ID NO: 4091427 - RNA, 21 nt, Variola virus
uuuaacgaggauuuauucaga

SEQ ID NO: 4091428 - RNA, 23 nt, Variola virus
uuuaaggaggcguccuuuucuaa

SEQ ID NO: 4091429 - RNA, 18 nt, Variola virus
uuuaaguauauacgauaa

SEQ ID NO: 4091430 - RNA, 23 nt, Variola virus
uuuaauagcuaacucgguaucua

SEQ ID NO: 4091431 - RNA, 15 nt, Variola virus
uuuaauaucuaaaua

SEQ ID NO: 4091432 - RNA, 16 nt, Variola virus
uuuaauggauauacac

SEQ ID NO: 4091433 - RNA, 19 nt, Variola virus
uuuaaugugugaaaacagu

SEQ ID NO: 4091434 - RNA, 20 nt, Variola virus
uuuaauuucuuguaaucauu

SEQ ID NO: 4091435 - RNA, 18 nt, Variola virus
uuuaauuuggucauucuu

SEQ ID NO: 4091436 - RNA, 23 nt, Variola virus
uuuacaaaaguccggaugcauaa

SEQ ID NO: 4091437 - RNA, 21 nt, Variola virus
uuuacaaauugggaucaucca

SEQ ID NO: 4091438 - RNA, 20 nt, Variola virus
uuuacagauauauucauagu

SEQ ID NO: 4091439 - RNA, 19 nt, Variola virus
uuuacccacuauaaaauaa

SEQ ID NO: 4091440 - RNA, 14 nt, Variola virus
uuuacucuucuaaa

SEQ ID NO: 4091441 - RNA, 21 nt, Variola virus
uuuacucuucuaaauucauaa

SEQ ID NO: 4091442 - RNA, 19 nt, Variola virus
uuuagaauauauguaugua

SEQ ID NO: 4091443 - RNA, 23 nt, Variola virus
uuuagaucauuaacucuagaaau

SEQ ID NO: 4091444 - RNA, 18 nt, Variola virus
uuuagaugaauuauuauu

SEQ ID NO: 4091445 - RNA, 15 nt, Variola virus
uuuagcuaauacuaa

SEQ ID NO: 4091446 - RNA, 19 nt, Variola virus
uuuaggagugaucaucaaa

SEQ ID NO: 4091447 - RNA, 15 nt, Variola virus
uuuaguaugacauaa

SEQ ID NO: 4091448 - RNA, 16 nt, Variola virus
uuuaguccuauuucaa

SEQ ID NO: 4091449 - RNA, 15 nt, Variola virus
uuuauaacgaaguag

SEQ ID NO: 4091450 - RNA, 21 nt, Variola virus
uuuaucaaaaauaaaauacau

SEQ ID NO: 4091451 - RNA, 19 nt, Variola virus
uuuauccucucguuagccu

SEQ ID NO: 4091452 - RNA, 20 nt, Variola virus
uuuaucuaauucgauacaaa

SEQ ID NO: 4091453 - RNA, 15 nt, Variola virus
uuuaugcuucguaaa

SEQ ID NO: 4091454 - RNA, 14 nt, Variola virus
uuuauuaauacagg

SEQ ID NO: 4091455 - RNA, 23 nt, Variola virus
uuuauuauauucaguaaccaaau

SEQ ID NO: 4091456 - RNA, 13 nt, Variola virus
uuuauuaucuaca

SEQ ID NO: 4091457 - RNA, 20 nt, Variola virus
uuuauuaucuugucuuggug

SEQ ID NO: 4091458 - RNA, 22 nt, Variola virus
uuuauucgguaagacgaucauu

SEQ ID NO: 4091459 - RNA, 13 nt, Variola virus
uuuauucuagaau

SEQ ID NO: 4091460 - RNA, 17 nt, Variola virus
uuuauuucuaaaauuuu

SEQ ID NO: 4091461 - RNA, 15 nt, Variola virus
uuucaagauaaauaa

SEQ ID NO: 4091462 - RNA, 17 nt, Variola virus
uuucaauaauauacuaa

SEQ ID NO: 4091463 - RNA, 21 nt, Variola virus
uuucaauaguaucgaaaacag

SEQ ID NO: 4091464 - RNA, 22 nt, Variola virus
uuucaauauauuacgguaucua

SEQ ID NO: 4091465 - RNA, 20 nt, Variola virus
uuucaucuagauacacuaga

SEQ ID NO: 4091466 - RNA, 12 nt, Variola virus
uuuccaaagaua

SEQ ID NO: 4091467 - RNA, 12 nt, Variola virus
uuuccauaauaa

SEQ ID NO: 4091468 - RNA, 14 nt, Variola virus
uuuccccucucugu

SEQ ID NO: 4091469 - RNA, 19 nt, Variola virus
uuucccguaauaaauuuua

SEQ ID NO: 4091470 - RNA, 23 nt, Variola virus
uuuccuauaaucguuaaauuuua

SEQ ID NO: 4091471 - RNA, 13 nt, Variola virus
uuuccuuaucauu

SEQ ID NO: 4091472 - RNA, 14 nt, Variola virus
uuuccuuuaucauu

SEQ ID NO: 4091473 - RNA, 16 nt, Variola virus
uuucgaagaucuucuu

SEQ ID NO: 4091474 - RNA, 17 nt, Variola virus
uuucguaccaacucauu

SEQ ID NO: 4091475 - RNA, 14 nt, Variola virus
uuucgucaacaagu

SEQ ID NO: 4091476 - RNA, 16 nt, Variola virus
uuucuauauagcuauu

SEQ ID NO: 4091477 - RNA, 15 nt, Variola virus
uuucuggcuaagaag

SEQ ID NO: 4091478 - RNA, 19 nt, Variola virus
uuucuucuacauacauaag

SEQ ID NO: 4091479 - RNA, 21 nt, Variola virus
uuucuugagaucccacaucau

SEQ ID NO: 4091480 - RNA, 14 nt, Variola virus
uuucuuuuaacaug

SEQ ID NO: 4091481 - RNA, 20 nt, Variola virus
uuugaaauaucuuaugauga

SEQ ID NO: 4091482 - RNA, 19 nt, Variola virus
uuugaauauacuuuuaauu

SEQ ID NO: 4091483 - RNA, 23 nt, Variola virus
uuugacaggaucagguucuucua

SEQ ID NO: 4091484 - RNA, 15 nt, Variola virus
uuugagaacaucgau

SEQ ID NO: 4091485 - RNA, 16 nt, Variola virus
uuugauuaguagauau

SEQ ID NO: 4091486 - RNA, 13 nt, Variola virus
uuugcaaacauaa

SEQ ID NO: 4091487 - RNA, 14 nt, Variola virus
uuugcaaauacagc

SEQ ID NO: 4091488 - RNA, 13 nt, Variola virus
uuugcauucuauu

SEQ ID NO: 4091489 - RNA, 14 nt, Variola virus
uuugcuauuucuau

SEQ ID NO: 4091490 - RNA, 17 nt, Variola virus
uuuguaaauaacuaucu

SEQ ID NO: 4091491 - RNA, 22 nt, Variola virus
uuuguaaauaacuaucuauaaa

SEQ ID NO: 4091492 - RNA, 18 nt, Variola virus
uuuguaacugacuuuaga

SEQ ID NO: 4091493 - RNA, 14 nt, Variola virus
uuuguaauugacau

SEQ ID NO: 4091494 - RNA, 16 nt, Variola virus
uuuguaauugugacau

SEQ ID NO: 4091495 - RNA, 12 nt, Variola virus
uuuguacauuuu

SEQ ID NO: 4091496 - RNA, 15 nt, Variola virus
uuuguauauacauag

SEQ ID NO: 4091497 - RNA, 17 nt, Variola virus
uuugucaacuuuguaaa

SEQ ID NO: 4091498 - RNA, 14 nt, Variola virus
uuuguuagaguaua

SEQ ID NO: 4091499 - RNA, 23 nt, Variola virus
uuuguuuaaacguuuguaguuua

SEQ ID NO: 4091500 - RNA, 17 nt, Variola virus
uuuuaaaguuaaucaua

SEQ ID NO: 4091501 - RNA, 14 nt, Variola virus
uuuuaaggggaaaa

SEQ ID NO: 4091502 - RNA, 15 nt, Variola virus
uuuuaauuguaugua

SEQ ID NO: 4091503 - RNA, 22 nt, Variola virus
uuuuaccgcaauauguaugcua

SEQ ID NO: 4091504 - RNA, 15 nt, Variola virus
uuuuagaauuuccaa

SEQ ID NO: 4091505 - RNA, 18 nt, Variola virus
uuuuagauguaguaucua

SEQ ID NO: 4091506 - RNA, 14 nt, Variola virus
uuuuaguuuaucaa

SEQ ID NO: 4091507 - RNA, 12 nt, Variola virus
uuuuauaaacag

SEQ ID NO: 4091508 - RNA, 12 nt, Variola virus
uuuuauaaacau

SEQ ID NO: 4091509 - RNA, 20 nt, Variola virus
uuuuaucgauucaucuaauu

SEQ ID NO: 4091510 - RNA, 19 nt, Variola virus
uuuuaugacaaacuuuacu

SEQ ID NO: 4091511 - RNA, 17 nt, Variola virus
uuuuauuuuaucuaauu

SEQ ID NO: 4091512 - RNA, 15 nt, Variola virus
acucuacuaguucca

SEQ ID NO: 4091513 - RNA, 23 nt, Variola virus
acucuauuggauauggauuucca

SEQ ID NO: 4091514 - RNA, 18 nt, Variola virus
acucuggguaacaaacau

SEQ ID NO: 4091515 - RNA, 20 nt, Variola virus
acucugggucauauuauaga

SEQ ID NO: 4091516 - RNA, 20 nt, Variola virus
acugaagaacuaaaagugac

SEQ ID NO: 4091517 - RNA, 12 nt, Variola virus
acugaauuauua

SEQ ID NO: 4091518 - RNA, 16 nt, Variola virus
acugacagauguguuc

SEQ ID NO: 4091519 - RNA, 14 nt, Variola virus
acugacuuaauagu

SEQ ID NO: 4091520 - RNA, 13 nt, Variola virus
acugacuuuagac

SEQ ID NO: 4091521 - RNA, 18 nt, Variola virus
acugagaugacuggaaau

SEQ ID NO: 4091522 - RNA, 15 nt, Variola virus
acugaguuuaucacu

SEQ ID NO: 4091523 - RNA, 16 nt, Variola virus
acugauaauguagaaa

SEQ ID NO: 4091524 - RNA, 13 nt, Variola virus
acugauauucagg

SEQ ID NO: 4091525 - RNA, 12 nt, Variola virus
acugaucuucuu

SEQ ID NO: 4091526 - RNA, 18 nt, Variola virus
acugauuaauaagaucuu

SEQ ID NO: 4091527 - RNA, 18 nt, Variola virus
acugauucagaaauggau

SEQ ID NO: 4091528 - RNA, 13 nt, Variola virus
acugcauauuaag

SEQ ID NO: 4091529 - RNA, 17 nt, Variola virus
acugcauuaaacugaua

SEQ ID NO: 4091530 - RNA, 20 nt, Variola virus
acugcuaaauguaucuucca

SEQ ID NO: 4091531 - RNA, 18 nt, Variola virus
acugcuuuaggugcugaa

SEQ ID NO: 4091532 - RNA, 17 nt, Variola virus
acuggauauauuuuaca

SEQ ID NO: 4091533 - RNA, 21 nt, Variola virus
acuggauauucgauaacagca

SEQ ID NO: 4091534 - RNA, 19 nt, Variola virus
acuggaucguuuagaauac

SEQ ID NO: 4091535 - RNA, 17 nt, Variola virus
acuguacgauacauaau

SEQ ID NO: 4091536 - RNA, 14 nt, Variola virus
acugucuaaaugua

SEQ ID NO: 4091537 - RNA, 16 nt, Variola virus
acuguggauacucugu

SEQ ID NO: 4091538 - RNA, 20 nt, Variola virus
acuguggaugugacagacug

SEQ ID NO: 4091539 - RNA, 13 nt, Variola virus
acuguucaagaau

SEQ ID NO: 4091540 - RNA, 20 nt, Variola virus
acuguuuuccggaaggaaau

SEQ ID NO: 4091541 - RNA, 23 nt, Variola virus
acuguuuucuagauggaaauauu

SEQ ID NO: 4091542 - RNA, 20 nt, Variola virus
acuuaacuaucuuucaagau

SEQ ID NO: 4091543 - RNA, 19 nt, Variola virus
acuuaauaggcaucauuua

SEQ ID NO: 4091544 - RNA, 18 nt, Variola virus
acuuacuaaagucaauaa

SEQ ID NO: 4091545 - RNA, 14 nt, Variola virus
acuuacuuaauaga

SEQ ID NO: 4091546 - RNA, 23 nt, Variola virus
acuuaggaguuagaauuuauaga

SEQ ID NO: 4091547 - RNA, 14 nt, Variola virus
acuuauaaaaauac

SEQ ID NO: 4091548 - RNA, 22 nt, Variola virus
acuuaugcgaagccauguuaaa

SEQ ID NO: 4091549 - RNA, 15 nt, Variola virus
acuuauguaugugca

SEQ ID NO: 4091550 - RNA, 14 nt, Variola virus
acuuauuaaugaau

SEQ ID NO: 4091551 - RNA, 14 nt, Variola virus
acuuauuuuaagau

SEQ ID NO: 4091552 - RNA, 12 nt, Variola virus
acuucagaaauu

SEQ ID NO: 4091553 - RNA, 23 nt, Variola virus
acuuccauacgacgaaaauggua

SEQ ID NO: 4091554 - RNA, 14 nt, Variola virus
acuucgcaauaauu

SEQ ID NO: 4091555 - RNA, 18 nt, Variola virus
acuucuaacaaacaucuc

SEQ ID NO: 4091556 - RNA, 19 nt, Variola virus
acuucuguacuaguggcag

SEQ ID NO: 4091557 - RNA, 19 nt, Variola virus
acuucuguauguacagcau

SEQ ID NO: 4091558 - RNA, 18 nt, Variola virus
acuucuuggaaugauacu

SEQ ID NO: 4091559 - RNA, 20 nt, Variola virus
acuucuuucaguucuggaua

SEQ ID NO: 4091560 - RNA, 14 nt, Variola virus
acuugauaaaaaug

SEQ ID NO: 4091561 - RNA, 23 nt, Variola virus
acuugauauuggauauaucacaa

SEQ ID NO: 4091562 - RNA, 18 nt, Variola virus
acuuggagguagguauua

SEQ ID NO: 4091563 - RNA, 22 nt, Variola virus
acuugguauuuggaaauuagug

SEQ ID NO: 4091564 - RNA, 19 nt, Variola virus
acuuguguucuaaauggau

SEQ ID NO: 4091565 - RNA, 18 nt, Variola virus
acuuguuuaaugaugaau

SEQ ID NO: 4091566 - RNA, 23 nt, Variola virus
acuuuaaaguuguuaaaaaauua

SEQ ID NO: 4091567 - RNA, 22 nt, Variola virus
acuuuaauccuguguuuauaga

SEQ ID NO: 4091568 - RNA, 21 nt, Variola virus
acuuucaaugagauaaauaug

SEQ ID NO: 4091569 - RNA, 23 nt, Variola virus
acuuugauuucuuaucuguaguu

SEQ ID NO: 4091570 - RNA, 16 nt, Variola virus
acuuugguaaauguua

SEQ ID NO: 4091571 - RNA, 12 nt, Variola virus
acuuuuaaauac

SEQ ID NO: 4091572 - RNA, 23 nt, Variola virus
acuuuuauuauggcgucuaagau

SEQ ID NO: 4091573 - RNA, 16 nt, Variola virus
acuuuucauuaauagg

SEQ ID NO: 4091574 - RNA, 14 nt, Variola virus
acuuuucuauuugu

SEQ ID NO: 4091575 - RNA, 14 nt, Variola virus
acuuuucucuaaau

SEQ ID NO: 4091576 - RNA, 21 nt, Variola virus
acuuuuucaucuuuacauacu

SEQ ID NO: 4091577 - RNA, 18 nt, Variola virus
acuuuuuuauccaacaau

SEQ ID NO: 4091578 - RNA, 14 nt, Variola virus
agaaaaaacaaugu

SEQ ID NO: 4091579 - RNA, 13 nt, Variola virus
agaaaaaacuaau

SEQ ID NO: 4091580 - RNA, 22 nt, Variola virus
agaaaaaauuuauuuaucaauu

SEQ ID NO: 4091581 - RNA, 11 nt, Variola virus
agaaaacauuu

SEQ ID NO: 4091582 - RNA, 23 nt, Variola virus
agaaaacucguuauuaacuaugu

SEQ ID NO: 4091583 - RNA, 15 nt, Variola virus
agaaaagauuaagau

SEQ ID NO: 4091584 - RNA, 15 nt, Variola virus
agaaaauaacagaua

SEQ ID NO: 4091585 - RNA, 21 nt, Variola virus
agaaaauaucauaaauauauu

SEQ ID NO: 4091586 - RNA, 15 nt, Variola virus
agaaaauaucauguu

SEQ ID NO: 4091587 - RNA, 22 nt, Variola virus
agaaaaugucccucauaauaaa

SEQ ID NO: 4091588 - RNA, 19 nt, Variola virus
agaaaauuuauaaacuauu

SEQ ID NO: 4091589 - RNA, 13 nt, Variola virus
agaaacagaacua

SEQ ID NO: 4091590 - RNA, 14 nt, Variola virus
agaaaccugauuau

SEQ ID NO: 4091591 - RNA, 18 nt, Variola virus
agaaagauacagguauag

SEQ ID NO: 4091592 - RNA, 20 nt, Variola virus
agaaagauauauuaagaaua

SEQ ID NO: 4091593 - RNA, 23 nt, Variola virus
agaaaguaaguaugucgaaucua

SEQ ID NO: 4091594 - RNA, 13 nt, Variola virus
agaaauaaaaauu

SEQ ID NO: 4091595 - RNA, 13 nt, Variola virus
agaaauaaauguc

SEQ ID NO: 4091596 - RNA, 13 nt, Variola virus
agaaauaauauaa

SEQ ID NO: 4091597 - RNA, 22 nt, Variola virus
agaaauauauacuucaauugau

SEQ ID NO: 4091598 - RNA, 13 nt, Variola virus
agaaauaugugaa

SEQ ID NO: 4091599 - RNA, 13 nt, Variola virus
agaaaucauauau

SEQ ID NO: 4091600 - RNA, 18 nt, Variola virus
agaaaucauauaugauau

SEQ ID NO: 4091601 - RNA, 19 nt, Variola virus
agaaaucauauaugauauu

SEQ ID NO: 4091602 - RNA, 22 nt, Variola virus
agaaaucccaccuuauuauauu

SEQ ID NO: 4091603 - RNA, 17 nt, Variola virus
agaaaugaaauuacucg

SEQ ID NO: 4091604 - RNA, 14 nt, Variola virus
agaaauuaauagaa

SEQ ID NO: 4091605 - RNA, 21 nt, Variola virus
agaaauuacauaaaaaaaaug

SEQ ID NO: 4091606 - RNA, 23 nt, Variola virus
agaaauuuuugguucuucucuaa

SEQ ID NO: 4091607 - RNA, 19 nt, Variola virus
agaacaaaccaaauauauu

SEQ ID NO: 4091608 - RNA, 13 nt, Variola virus
agaacaaaguaau

SEQ ID NO: 4091609 - RNA, 14 nt, Variola virus
agaacauaauaaua

SEQ ID NO: 4091610 - RNA, 17 nt, Variola virus
agaaccacgaaacuaau

SEQ ID NO: 4091611 - RNA, 16 nt, Variola virus
agaaccaguaacauau

SEQ ID NO: 4091612 - RNA, 17 nt, Variola virus
agaacccuuaauaacaa

SEQ ID NO: 4091613 - RNA, 16 nt, Variola virus
agaacgggucauuuau

SEQ ID NO: 4091614 - RNA, 14 nt, Variola virus
agaacucaacaaua

SEQ ID NO: 4091615 - RNA, 15 nt, Variola virus
agaacucaacucauc

SEQ ID NO: 4091616 - RNA, 21 nt, Variola virus
agaacuguuuuagaagucaag

SEQ ID NO: 4091617 - RNA, 23 nt, Variola virus
agaacuuaggcauggacauacua

SEQ ID NO: 4091618 - RNA, 19 nt, Variola virus
agaacuuaugaccguaaua

SEQ ID NO: 4091619 - RNA, 21 nt, Variola virus
agaacuuaugaccguaauaaa

SEQ ID NO: 4091620 - RNA, 21 nt, Variola virus
agaagagucauuaaaauaugc

SEQ ID NO: 4091621 - RNA, 16 nt, Variola virus
agaagcguguuauugu

SEQ ID NO: 4091622 - RNA, 22 nt, Variola virus
agaagguuucgauuaucuguau

SEQ ID NO: 4091623 - RNA, 13 nt, Variola virus
agaaguucaugau

SEQ ID NO: 4091624 - RNA, 21 nt, Variola virus
agaaguuguaaauaacaauga

SEQ ID NO: 4091625 - RNA, 18 nt, Variola virus
agaaguuuucccaaaaaa

SEQ ID NO: 4091626 - RNA, 16 nt, Variola virus
agaauaagaacuauaa

SEQ ID NO: 4091627 - RNA, 16 nt, Variola virus
agaauacgaugauauu

SEQ ID NO: 4091628 - RNA, 17 nt, Variola virus
agaauacuauuugguaa

SEQ ID NO: 4091629 - RNA, 23 nt, Variola virus
agaauaguauuugagaaauaugu

SEQ ID NO: 4091630 - RNA, 15 nt, Variola virus
agaauauaaaaaauu

SEQ ID NO: 4091631 - RNA, 23 nt, Variola virus
agaauauaaauuauauauggauu

SEQ ID NO: 4091632 - RNA, 23 nt, Variola virus
agaauauauguauguaaaaauau

SEQ ID NO: 4091633 - RNA, 17 nt, Variola virus
agaauauccucuagaga

SEQ ID NO: 4091634 - RNA, 19 nt, Variola virus
agaauaucuauacauaccu

SEQ ID NO: 4091635 - RNA, 21 nt, Variola virus
agaauaugauccguaacauau

SEQ ID NO: 4091636 - RNA, 18 nt, Variola virus
agaauauguauaucaauu

SEQ ID NO: 4091637 - RNA, 17 nt, Variola virus
agaauauucuuuucuaa

SEQ ID NO: 4091638 - RNA, 18 nt, Variola virus
agaaucagaaucauacaa

SEQ ID NO: 4091639 - RNA, 19 nt, Variola virus
agaaucauaaagaacagua

SEQ ID NO: 4091640 - RNA, 15 nt, Variola virus
agaaucguaauggau

SEQ ID NO: 4091641 - RNA, 16 nt, Variola virus
agaaucuaaugaugac

SEQ ID NO: 4091642 - RNA, 14 nt, Variola virus
agaaugaauguuua

SEQ ID NO: 4091643 - RNA, 15 nt, Variola virus
agaaugacauaacua

SEQ ID NO: 4091644 - RNA, 17 nt, Variola virus
agaaugacauaacuaau

SEQ ID NO: 4091645 - RNA, 22 nt, Variola virus
agaaugcagaaaugauuuugga

SEQ ID NO: 4091646 - RNA, 22 nt, Variola virus
agaaugcuucggaauuagaaca

SEQ ID NO: 4091647 - RNA, 15 nt, Variola virus
agaauuaacuaguau

SEQ ID NO: 4091648 - RNA, 13 nt, Variola virus
agaauuaagauua

SEQ ID NO: 4091649 - RNA, 17 nt, Variola virus
agaauuaggagaacuua

SEQ ID NO: 4091650 - RNA, 22 nt, Variola virus
agaauucaagucaggaacuauu

SEQ ID NO: 4091651 - RNA, 20 nt, Variola virus
agaauucacaccuagagaca

SEQ ID NO: 4091652 - RNA, 22 nt, Variola virus
agaauugauaauauaaauauga

SEQ ID NO: 4091653 - RNA, 13 nt, Variola virus
agaauuguaacuu

SEQ ID NO: 4091654 - RNA, 17 nt, Variola virus
agaauuuagaaauauau

SEQ ID NO: 4091655 - RNA, 17 nt, Variola virus
agaauuuagauacaucu

SEQ ID NO: 4091656 - RNA, 21 nt, Variola virus
agaauuucuacauaauuauau

SEQ ID NO: 4091657 - RNA, 21 nt, Variola virus
agaauuuguaccaacaaacug

SEQ ID NO: 4091658 - RNA, 15 nt, Variola virus
agaauuuuagacacu

SEQ ID NO: 4091659 - RNA, 12 nt, Variola virus
agaauuuucuag

SEQ ID NO: 4091660 - RNA, 15 nt, Variola virus
agaauuuucuagauc

SEQ ID NO: 4091661 - RNA, 22 nt, Variola virus
agaauuuuuauaaauuuuucca

SEQ ID NO: 4091662 - RNA, 22 nt, Variola virus
agaauuuuuucggguuccaaac

SEQ ID NO: 4091663 - RNA, 21 nt, Variola virus
agacaaaauauuagaaaaagu

SEQ ID NO: 4091664 - RNA, 17 nt, Variola virus
agacaaacgcugauaga

SEQ ID NO: 4091665 - RNA, 21 nt, Variola virus
agacaauuauauaaaacauuu

SEQ ID NO: 4091666 - RNA, 17 nt, Variola virus
agacaauugacaaaauu

SEQ ID NO: 4091667 - RNA, 16 nt, Variola virus
agacacuaacucuguu

SEQ ID NO: 4091668 - RNA, 20 nt, Variola virus
agacacuaacucuguuuuau

SEQ ID NO: 4091669 - RNA, 18 nt, Variola virus
agacauauuaauaagacu

SEQ ID NO: 4091670 - RNA, 12 nt, Variola virus
agaccaaaaauu

SEQ ID NO: 4091671 - RNA, 13 nt, Variola virus
agaccaucuaaca

SEQ ID NO: 4091672 - RNA, 22 nt, Variola virus
agaccuacagugauaugauguc

SEQ ID NO: 4091673 - RNA, 14 nt, Variola virus
agacgcucaaaaua

SEQ ID NO: 4091674 - RNA, 13 nt, Variola virus
agacgcuuauuau

SEQ ID NO: 4091675 - RNA, 19 nt, Variola virus
agacggagucauaacuauu

SEQ ID NO: 4091676 - RNA, 22 nt, Variola virus
agacguaucuccauaaagaaau

SEQ ID NO: 4091677 - RNA, 15 nt, Variola virus
agacguggagaucua

SEQ ID NO: 4091678 - RNA, 18 nt, Variola virus
agacguggagaucuagaa

SEQ ID NO: 4091679 - RNA, 18 nt, Variola virus
agacguggcaaacaaugu

SEQ ID NO: 4091680 - RNA, 14 nt, Variola virus
agacguguuauuac

SEQ ID NO: 4091681 - RNA, 16 nt, Variola virus
agacguuucauaauaa

SEQ ID NO: 4091682 - RNA, 21 nt, Variola virus
agacguuucauaauaauacau

SEQ ID NO: 4091683 - RNA, 14 nt, Variola virus
agacuacaauauau

SEQ ID NO: 4091684 - RNA, 17 nt, Variola virus
agacuacaauauauucu

SEQ ID NO: 4091685 - RNA, 23 nt, Variola virus
agacuccauccguaaaaaugcau

SEQ ID NO: 4091686 - RNA, 19 nt, Variola virus
agacuuugccacaacagaa

SEQ ID NO: 4091687 - RNA, 16 nt, Variola virus
agagaagcaaaugaug

SEQ ID NO: 4091688 - RNA, 13 nt, Variola virus
agagagaaauacu

SEQ ID NO: 4091689 - RNA, 15 nt, Variola virus
agagagcagaaauaa

SEQ ID NO: 4091690 - RNA, 20 nt, Variola virus
agagauacuaaauauagaca

SEQ ID NO: 4091691 - RNA, 15 nt, Variola virus
agagcagucuuucua

SEQ ID NO: 4091692 - RNA, 16 nt, Variola virus
agagccaucuguaaaa

SEQ ID NO: 4091693 - RNA, 18 nt, Variola virus
agagcuuuauuaacuucu

SEQ ID NO: 4091694 - RNA, 12 nt, Variola virus
agaggaaauauc

SEQ ID NO: 4091695 - RNA, 14 nt, Variola virus
agaggauaacuauu

SEQ ID NO: 4091696 - RNA, 21 nt, Variola virus
agaggaugaaauagauagaau

SEQ ID NO: 4091697 - RNA, 17 nt, Variola virus
agaggcagucggauugg

SEQ ID NO: 4091698 - RNA, 21 nt, Variola virus
agagggagccgauaacuuuau

SEQ ID NO: 4091699 - RNA, 17 nt, Variola virus
agagguagcaagaagau

SEQ ID NO: 4091700 - RNA, 17 nt, Variola virus
agaguaggaaguuuaau

SEQ ID NO: 4091701 - RNA, 16 nt, Variola virus
agaguaguauauuguc

SEQ ID NO: 4091702 - RNA, 20 nt, Variola virus
agaguaguaucauuaaaucu

SEQ ID NO: 4091703 - RNA, 13 nt, Variola virus
agaguuauccauu

SEQ ID NO: 4091704 - RNA, 13 nt, Variola virus
agauaaacuagau

SEQ ID NO: 4091705 - RNA, 23 nt, Variola virus
agauaaauuuaucaauaaaugug

SEQ ID NO: 4091706 - RNA, 15 nt, Variola virus
agauaauauuagaca

SEQ ID NO: 4091707 - RNA, 13 nt, Variola virus
agauaaucuauau

SEQ ID NO: 4091708 - RNA, 14 nt, Variola virus
agauacaacaaauu

SEQ ID NO: 4091709 - RNA, 15 nt, Variola virus
agauacauaaaacuu

SEQ ID NO: 4091710 - RNA, 20 nt, Variola virus
agauacauuacaucuugaua

SEQ ID NO: 4091711 - RNA, 20 nt, Variola virus
agauaccacgaguaucaauu

SEQ ID NO: 4091712 - RNA, 17 nt, Variola virus
agauagagauucaaugg

SEQ ID NO: 4091713 - RNA, 19 nt, Variola virus
agauagcggacagcuauau

SEQ ID NO: 4091714 - RNA, 21 nt, Variola virus
agauagguauuuuaucucuau

SEQ ID NO: 4091715 - RNA, 14 nt, Variola virus
agauauaauacuug

SEQ ID NO: 4091716 - RNA, 18 nt, Variola virus
agauauaccagaacuauu

SEQ ID NO: 4091717 - RNA, 16 nt, Variola virus
agauauaugaacgaua

SEQ ID NO: 4091718 - RNA, 13 nt, Variola virus
agauauaugguuu

SEQ ID NO: 4091719 - RNA, 16 nt, Variola virus
agauaucuauauaauu

SEQ ID NO: 4091720 - RNA, 23 nt, Variola virus
agauaucucuggauauaucacaa

SEQ ID NO: 4091721 - RNA, 19 nt, Variola virus
agauaucuucuuuuuucca

SEQ ID NO: 4091722 - RNA, 14 nt, Variola virus
agauaugauaaaca

SEQ ID NO: 4091723 - RNA, 23 nt, Variola virus
agauaugguaaaauuaaauagua

SEQ ID NO: 4091724 - RNA, 15 nt, Variola virus
agauauguuuauuca

SEQ ID NO: 4091725 - RNA, 19 nt, Variola virus
agauauuccgacaaaggau

SEQ ID NO: 4091726 - RNA, 13 nt, Variola virus
agauauuuauccu

SEQ ID NO: 4091727 - RNA, 12 nt, Variola virus
agauauuucauc

SEQ ID NO: 4091728 - RNA, 17 nt, Variola virus
agaucaacagaaauauu

SEQ ID NO: 4091729 - RNA, 15 nt, Variola virus
agaucaagaaacauu

SEQ ID NO: 4091730 - RNA, 22 nt, Variola virus
agaucaauggugugauguugau

SEQ ID NO: 4091731 - RNA, 20 nt, Variola virus
agaucauagagagauucauu

SEQ ID NO: 4091732 - RNA, 16 nt, Variola virus
agauccucucuucaac

SEQ ID NO: 4091733 - RNA, 20 nt, Variola virus
agaucgcguuaaucauguac

SEQ ID NO: 4091734 - RNA, 24 nt, Variola virus
agaucgcuuucugguaacaugaua

SEQ ID NO: 4091735 - RNA, 16 nt, Variola virus
agaucuaauuuuucau

SEQ ID NO: 4091736 - RNA, 22 nt, Variola virus
agaucuacuggugaaaugugac

SEQ ID NO: 4091737 - RNA, 19 nt, Variola virus
agaucuauuccuauuuccu

SEQ ID NO: 4091738 - RNA, 21 nt, Variola virus
agaucuuuucucaaagauguu

SEQ ID NO: 4091739 - RNA, 22 nt, Variola virus
agaugaaaaauuuuccacaucu

SEQ ID NO: 4091740 - RNA, 15 nt, Variola virus
agaugaaauagcguu

SEQ ID NO: 4091741 - RNA, 21 nt, Variola virus
agaugaagucauuaacaauau

SEQ ID NO: 4091742 - RNA, 15 nt, Variola virus
agaugagaacucuau

SEQ ID NO: 4091743 - RNA, 19 nt, Variola virus
agaugagcauaaacauaau

SEQ ID NO: 4091744 - RNA, 17 nt, Variola virus
agaugauaauuuauaca

SEQ ID NO: 4091745 - RNA, 21 nt, Variola virus
agaugauagcuauuuaacuaa

SEQ ID NO: 4091746 - RNA, 15 nt, Variola virus
agaugcaaacauuau

SEQ ID NO: 4091747 - RNA, 20 nt, Variola virus
agaugccaagauaucuauau

SEQ ID NO: 4091748 - RNA, 16 nt, Variola virus
agaugccgguacuuau

SEQ ID NO: 4091749 - RNA, 20 nt, Variola virus
agaugguggccacaauauau

SEQ ID NO: 4091750 - RNA, 21 nt, Variola virus
aguauccguauaaaaaucgau

SEQ ID NO: 4091751 - RNA, 21 nt, Variola virus
aguaucuagccauaucuaaag

SEQ ID NO: 4091752 - RNA, 18 nt, Variola virus
aguaugaagauaaacacu

SEQ ID NO: 4091753 - RNA, 16 nt, Variola virus
aguaugaauaaucuuc

SEQ ID NO: 4091754 - RNA, 21 nt, Variola virus
aguaugcauuauccaaaauau

SEQ ID NO: 4091755 - RNA, 16 nt, Variola virus
aguauguuugacuuua

SEQ ID NO: 4091756 - RNA, 22 nt, Variola virus
aguauuaucgacguaacuauau

SEQ ID NO: 4091757 - RNA, 16 nt, Variola virus
aguauuccaauaucug

SEQ ID NO: 4091758 - RNA, 15 nt, Variola virus
aguauucuuauguau

SEQ ID NO: 4091759 - RNA, 19 nt, Variola virus
aguauugguaauguacaaa

SEQ ID NO: 4091760 - RNA, 13 nt, Variola virus
aguauuuaacaag

SEQ ID NO: 4091761 - RNA, 14 nt, Variola virus
aguauuuaacaaga

SEQ ID NO: 4091762 - RNA, 20 nt, Variola virus
aguauuuacaauguagaaau

SEQ ID NO: 4091763 - RNA, 18 nt, Variola virus
aguauuuauacuacuaau

SEQ ID NO: 4091764 - RNA, 22 nt, Variola virus
aguauuuauacuuuuaggaaau

SEQ ID NO: 4091765 - RNA, 12 nt, Variola virus
aguauuuucuau

SEQ ID NO: 4091766 - RNA, 21 nt, Variola virus
aguauuuuucaaaaaauguau

SEQ ID NO: 4091767 - RNA, 16 nt, Variola virus
agucaaauauauuaaa

SEQ ID NO: 4091768 - RNA, 15 nt, Variola virus
agucaagauacagaa

SEQ ID NO: 4091769 - RNA, 15 nt, Variola virus
agucaagaugaugaa

SEQ ID NO: 4091770 - RNA, 14 nt, Variola virus
agucaauaaaagag

SEQ ID NO: 4091771 - RNA, 21 nt, Variola virus
gaucauagaacaaaccaaaua

SEQ ID NO: 4091772 - RNA, 18 nt, Variola virus
gauccauuuauaguuaua

SEQ ID NO: 4091773 - RNA, 17 nt, Variola virus
gaucuaaagauaaucuu

SEQ ID NO: 4091774 - RNA, 21 nt, Variola virus
gaucuaacgaggaagaaauuu

SEQ ID NO: 4091775 - RNA, 22 nt, Variola virus
gaucuauucaagaugaaaucgu

SEQ ID NO: 4091776 - RNA, 15 nt, Variola virus
gaucuccaacaaauu

SEQ ID NO: 4091777 - RNA, 14 nt, Variola virus
gaucugaguaauau

SEQ ID NO: 4091778 - RNA, 19 nt, Variola virus
gaugaauuaucguuauuau

SEQ ID NO: 4091779 - RNA, 13 nt, Variola virus
gaugaauuauuau

SEQ ID NO: 4091780 - RNA, 18 nt, Variola virus
gaugaguuaauguauauu

SEQ ID NO: 4091781 - RNA, 16 nt, Variola virus
gaugaugcaacucuau

SEQ ID NO: 4091782 - RNA, 22 nt, Variola virus
gaugauguucuaccuauuucau

SEQ ID NO: 4091783 - RNA, 14 nt, Variola virus
gaugcauaaguaca

SEQ ID NO: 4091784 - RNA, 17 nt, Variola virus
gaugccaucauagauau

SEQ ID NO: 4091785 - RNA, 16 nt, Variola virus
gaugcuauaguauauu

SEQ ID NO: 4091786 - RNA, 18 nt, Variola virus
gaugcugguuauuacaca

SEQ ID NO: 4091787 - RNA, 14 nt, Variola virus
gauggaauuaucau

SEQ ID NO: 4091788 - RNA, 16 nt, Variola virus
gaugguuaaaauuaac

SEQ ID NO: 4091789 - RNA, 22 nt, Variola virus
gaugucauuccuuauacaauca

SEQ ID NO: 4091790 - RNA, 18 nt, Variola virus
gaugucguuauucugaaa

SEQ ID NO: 4091791 - RNA, 22 nt, Variola virus
gaugucugaaacguauucucuu

SEQ ID NO: 4091792 - RNA, 20 nt, Variola virus
gaugugacagacugaccagu

SEQ ID NO: 4091793 - RNA, 15 nt, Variola virus
gauguuauuaugaau

SEQ ID NO: 4091794 - RNA, 13 nt, Variola virus
gauguucauauau

SEQ ID NO: 4091795 - RNA, 21 nt, Variola virus
gauuacggauugguuucuaaa

SEQ ID NO: 4091796 - RNA, 21 nt, Variola virus
gauuagaaaauauaaauuaau

SEQ ID NO: 4091797 - RNA, 14 nt, Variola virus
gauuaguaaauuca

SEQ ID NO: 4091798 - RNA, 14 nt, Variola virus
gauuauacagguua

SEQ ID NO: 4091799 - RNA, 14 nt, Variola virus
gauuauaugauaua

SEQ ID NO: 4091800 - RNA, 11 nt, Variola virus
gauuaucauga

SEQ ID NO: 4091801 - RNA, 15 nt, Variola virus
gauuaucguuuucau

SEQ ID NO: 4091802 - RNA, 17 nt, Variola virus
gauuauuagaucuuuuc

SEQ ID NO: 4091803 - RNA, 14 nt, Variola virus
gauuauucuacuau

SEQ ID NO: 4091804 - RNA, 19 nt, Variola virus
gauucaucaagguauauaa

SEQ ID NO: 4091805 - RNA, 17 nt, Variola virus
gauucauugacauaugu

SEQ ID NO: 4091806 - RNA, 18 nt, Variola virus
gauuccagccacuuggga

SEQ ID NO: 4091807 - RNA, 21 nt, Variola virus
gauucgcaaacuauucuaaua

SEQ ID NO: 4091808 - RNA, 21 nt, Variola virus
gauucucgauagagaugagau

SEQ ID NO: 4091809 - RNA, 20 nt, Variola virus
gauugauccuagaacuagau

SEQ ID NO: 4091810 - RNA, 13 nt, Variola virus
gauugauuagaaa

SEQ ID NO: 4091811 - RNA, 15 nt, Variola virus
gauuguauugguaaa

SEQ ID NO: 4091812 - RNA, 17 nt, Variola virus
gauuuaucauauuucuc

SEQ ID NO: 4091813 - RNA, 21 nt, Variola virus
gauuuccgaaguucagcuucu

SEQ ID NO: 4091814 - RNA, 19 nt, Variola virus
gauuugauacggcuauucu

SEQ ID NO: 4091815 - RNA, 18 nt, Variola virus
gauuuguaucucuuuucu

SEQ ID NO: 4091816 - RNA, 22 nt, Variola virus
gcaaaaauaauaugauuagaag

SEQ ID NO: 4091817 - RNA, 18 nt, Variola virus
gcaaaacauuauaauaau

SEQ ID NO: 4091818 - RNA, 18 nt, Variola virus
gcaaaacuauuauuuuaa

SEQ ID NO: 4091819 - RNA, 14 nt, Variola virus
gcaaaauauaaugu

SEQ ID NO: 4091820 - RNA, 14 nt, Variola virus
gcaaauuaaaucaa

SEQ ID NO: 4091821 - RNA, 15 nt, Variola virus
gcaacaaguauacaa

SEQ ID NO: 4091822 - RNA, 21 nt, Variola virus
gcaaccaccgcaugauaauau

SEQ ID NO: 4091823 - RNA, 19 nt, Variola virus
gcaaccaugaauuuacaga

SEQ ID NO: 4091824 - RNA, 23 nt, Variola virus
gcaacggggaugaugauaaugau

SEQ ID NO: 4091825 - RNA, 17 nt, Variola virus
gcaagagcugauuauuu

SEQ ID NO: 4091826 - RNA, 13 nt, Variola virus
gcaauaauacaac

SEQ ID NO: 4091827 - RNA, 12 nt, Variola virus
gcaaucaugaaa

SEQ ID NO: 4091828 - RNA, 14 nt, Variola virus
gcaaugaauaucua

SEQ ID NO: 4091829 - RNA, 17 nt, Variola virus
gcaaugcgcuggacagu

SEQ ID NO: 4091830 - RNA, 17 nt, Variola virus
gcaauucgcuaaacaau

SEQ ID NO: 4091831 - RNA, 13 nt, Variola virus
gcaauuuucagua

SEQ ID NO: 4091832 - RNA, 22 nt, Variola virus
gcaauuuugugguugauaauca

SEQ ID NO: 4091833 - RNA, 16 nt, Variola virus
gcacauguauaauaua

SEQ ID NO: 4091834 - RNA, 20 nt, Variola virus
gcacuacuguuaagaaugau

SEQ ID NO: 4091835 - RNA, 23 nt, Variola virus
gcacuacuguuaagaaugauuac

SEQ ID NO: 4091836 - RNA, 17 nt, Variola virus
gcacuagguacaucauu

SEQ ID NO: 4091837 - RNA, 22 nt, Variola virus
gcacuguguauuauuuaguuca

SEQ ID NO: 4091838 - RNA, 16 nt, Variola virus
gcagggugcauauuau

SEQ ID NO: 4091839 - RNA, 22 nt, Variola virus
gcaguggaguuauaugaauagu

SEQ ID NO: 4091840 - RNA, 14 nt, Variola virus
gcauaacucuauca

SEQ ID NO: 4091841 - RNA, 12 nt, Variola virus
gcauagaaauac

SEQ ID NO: 4091842 - RNA, 20 nt, Variola virus
gcaucaacaguuacaaauga

SEQ ID NO: 4091843 - RNA, 16 nt, Variola virus
gcaucuaguugauauu

SEQ ID NO: 4091844 - RNA, 16 nt, Variola virus
gcaucuuaauccuucu

SEQ ID NO: 4091845 - RNA, 14 nt, Variola virus
gcaugauagaagau

SEQ ID NO: 4091846 - RNA, 20 nt, Variola virus
gcauuagaugaaaaauggaa

SEQ ID NO: 4091847 - RNA, 18 nt, Variola virus
gcauucgguucuaccaac

SEQ ID NO: 4091848 - RNA, 20 nt, Variola virus
gcauucuaucuuuaagggau

SEQ ID NO: 4091849 - RNA, 15 nt, Variola virus
gcauuggaagcaacu

SEQ ID NO: 4091850 - RNA, 13 nt, Variola virus
gcauuuauacaua

SEQ ID NO: 4091851 - RNA, 16 nt, Variola virus
gccacuauuauugaaa

SEQ ID NO: 4091852 - RNA, 13 nt, Variola virus
gccagaaucaugg

SEQ ID NO: 4091853 - RNA, 19 nt, Variola virus
gccaguccuccuacagauu

SEQ ID NO: 4091854 - RNA, 21 nt, Variola virus
gccauagauuuauaauacuuu

SEQ ID NO: 4091855 - RNA, 17 nt, Variola virus
gccauaucauacaugau

SEQ ID NO: 4091856 - RNA, 23 nt, Variola virus
gccauuuucuaugaacaaaucaa

SEQ ID NO: 4091857 - RNA, 22 nt, Variola virus
gcccaauuuugguguaaaucua

SEQ ID NO: 4091858 - RNA, 14 nt, Variola virus
gcccaucuacaccu

SEQ ID NO: 4091859 - RNA, 13 nt, Variola virus
gccgcaugaugaa

SEQ ID NO: 4091860 - RNA, 17 nt, Variola virus
gccgcuauaaugaugau

SEQ ID NO: 4091861 - RNA, 17 nt, Variola virus
gccgucuuuaucucuua

SEQ ID NO: 4091862 - RNA, 22 nt, Variola virus
gccuaaacccgacuuaguuaua

SEQ ID NO: 4091863 - RNA, 13 nt, Variola virus
gccucaaauguag

SEQ ID NO: 4091864 - RNA, 22 nt, Variola virus
gccuucauaaggaaacuuuugu

SEQ ID NO: 4091865 - RNA, 15 nt, Variola virus
gccuuuuuauacaua

SEQ ID NO: 4091866 - RNA, 12 nt, Variola virus
gcgaacaucuuu

SEQ ID NO: 4091867 - RNA, 12 nt, Variola virus
gcgaauauuaaa

SEQ ID NO: 4091868 - RNA, 19 nt, Variola virus
gcgauaauagauagugcua

SEQ ID NO: 4091869 - RNA, 19 nt, Variola virus
gcgauuguagauaaugaaa

SEQ ID NO: 4091870 - RNA, 21 nt, Variola virus
gcgccuuauauagcacuuuua

SEQ ID NO: 4091871 - RNA, 20 nt, Variola virus
gcggagauaauaucagaaag

SEQ ID NO: 4091872 - RNA, 13 nt, Variola virus
gcggauacaaaac

SEQ ID NO: 4091873 - RNA, 23 nt, Variola virus
gcguauauuuuauacauuuuuua

SEQ ID NO: 4091874 - RNA, 15 nt, Variola virus
gcguaucaaauguaa

SEQ ID NO: 4091875 - RNA, 23 nt, Variola virus
gcguguuuuaaauccuuaauaua

SEQ ID NO: 4091876 - RNA, 22 nt, Variola virus
gcguucauuggaaaauauacca

SEQ ID NO: 4091877 - RNA, 19 nt, Variola virus
gcguuuccuacauaacauc

SEQ ID NO: 4091878 - RNA, 16 nt, Variola virus
gcguuuuaguuauuac

SEQ ID NO: 4091879 - RNA, 14 nt, Variola virus
gcuaaaauauccuc

SEQ ID NO: 4091880 - RNA, 18 nt, Variola virus
gcuaaaucguauauguua

SEQ ID NO: 4091881 - RNA, 13 nt, Variola virus
gcuaaauuuucau

SEQ ID NO: 4091882 - RNA, 12 nt, Variola virus
gcuaacaucaua

SEQ ID NO: 4091883 - RNA, 20 nt, Variola virus
gcuaaguauacgaucuuuua

SEQ ID NO: 4091884 - RNA, 21 nt, Variola virus
gcuaauuccuaguuucaucau

SEQ ID NO: 4091885 - RNA, 15 nt, Variola virus
gcuaauugucuuucu

SEQ ID NO: 4091886 - RNA, 16 nt, Variola virus
gcuaauugucuuucuc

SEQ ID NO: 4091887 - RNA, 21 nt, Variola virus
gcuaauuuuuguaaauaacua

SEQ ID NO: 4091888 - RNA, 22 nt, Variola virus
gcuacacccacuagaaaccacg

SEQ ID NO: 4091889 - RNA, 12 nt, Variola virus
gcuacaguaaaa

SEQ ID NO: 4091890 - RNA, 20 nt, Variola virus
gcuaguuaacuaauaaauaa

SEQ ID NO: 4091891 - RNA, 23 nt, Variola virus
gcuauaauccgauauaugaugaa

SEQ ID NO: 4091892 - RNA, 23 nt, Variola virus
gcuauaugauaaccaacuacaga

SEQ ID NO: 4091893 - RNA, 19 nt, Variola virus
gcuauguuucguccaucau

SEQ ID NO: 4091894 - RNA, 19 nt, Variola virus
gcuauugaaacugacggau

SEQ ID NO: 4091895 - RNA, 12 nt, Variola virus
gcucaaacaaaa

SEQ ID NO: 4091896 - RNA, 15 nt, Variola virus
gcuccaaauauacau

SEQ ID NO: 4091897 - RNA, 21 nt, Variola virus
gcuccuacaggaauaucuuua

SEQ ID NO: 4091898 - RNA, 17 nt, Variola virus
gcucguggauacuuaug

SEQ ID NO: 4091899 - RNA, 23 nt, Variola virus
gcucuacaugcgguaaagauauu

SEQ ID NO: 4091900 - RNA, 15 nt, Variola virus
caucuggauuucaga

SEQ ID NO: 4091901 - RNA, 20 nt, Variola virus
caugagaauggaaaggaaac

SEQ ID NO: 4091902 - RNA, 21 nt, Variola virus
caugaguagcauuaaauuccu

SEQ ID NO: 4091903 - RNA, 14 nt, Variola virus
caugaugagauguu

SEQ ID NO: 4091904 - RNA, 15 nt, Variola virus
caugauuaguauuuu

SEQ ID NO: 4091905 - RNA, 21 nt, Variola virus
caugauucuaucucuaagacg

SEQ ID NO: 4091906 - RNA, 14 nt, Variola virus
caugcucuauuuug

SEQ ID NO: 4091907 - RNA, 15 nt, Variola virus
caugguauauggaua

SEQ ID NO: 4091908 - RNA, 22 nt, Variola virus
caugguaucgauuacaccucua

SEQ ID NO: 4091909 - RNA, 19 nt, Variola virus
cauguaacaauauuacaau

SEQ ID NO: 4091910 - RNA, 18 nt, Variola virus
cauguaugagaaaaacug

SEQ ID NO: 4091911 - RNA, 15 nt, Variola virus
caugucuagaaagaa

SEQ ID NO: 4091912 - RNA, 17 nt, Variola virus
cauguguacuuguacac

SEQ ID NO: 4091913 - RNA, 13 nt, Variola virus
cauguguauuaca

SEQ ID NO: 4091914 - RNA, 13 nt, Variola virus
cauguuaaaaaug

SEQ ID NO: 4091915 - RNA, 13 nt, Variola virus
cauguuggaauag

SEQ ID NO: 4091916 - RNA, 16 nt, Variola virus
cauuaaaaugauuauu

SEQ ID NO: 4091917 - RNA, 21 nt, Variola virus
cauuaacagcuuuaacagaug

SEQ ID NO: 4091918 - RNA, 23 nt, Variola virus
cauuaaguucacuagaauaucca

SEQ ID NO: 4091919 - RNA, 14 nt, Variola virus
cauuaauacaguaa

SEQ ID NO: 4091920 - RNA, 15 nt, Variola virus
cauuaauacaguaag

SEQ ID NO: 4091921 - RNA, 16 nt, Variola virus
cauuaaucuauuagaa

SEQ ID NO: 4091922 - RNA, 16 nt, Variola virus
cauuaauuaauacaau

SEQ ID NO: 4091923 - RNA, 14 nt, Variola virus
cauuaauuauaacg

SEQ ID NO: 4091924 - RNA, 21 nt, Variola virus
cauuaauuucugauauggaau

SEQ ID NO: 4091925 - RNA, 15 nt, Variola virus
cauuacgcucucugg

SEQ ID NO: 4091926 - RNA, 19 nt, Variola virus
cauuaggaaucuauccaau

SEQ ID NO: 4091927 - RNA, 15 nt, Variola virus
cauuagguuaaauga

SEQ ID NO: 4091928 - RNA, 16 nt, Variola virus
cauuaguaaggcuuua

SEQ ID NO: 4091929 - RNA, 14 nt, Variola virus
cauuauaaaaagug

SEQ ID NO: 4091930 - RNA, 20 nt, Variola virus
cauuauagauguguauacau

SEQ ID NO: 4091931 - RNA, 15 nt, Variola virus
cauuaucaaaaagaa

SEQ ID NO: 4091932 - RNA, 15 nt, Variola virus
cauuauuaacaaauu

SEQ ID NO: 4091933 - RNA, 19 nt, Variola virus
cauuauuacauagauguau

SEQ ID NO: 4091934 - RNA, 16 nt, Variola virus
cauuauuuuauuguga

SEQ ID NO: 4091935 - RNA, 17 nt, Variola virus
cauucaaccauucauaa

SEQ ID NO: 4091936 - RNA, 11 nt, Variola virus
cauucaugaaa

SEQ ID NO: 4091937 - RNA, 12 nt, Variola virus
cauuccaaagau

SEQ ID NO: 4091938 - RNA, 15 nt, Variola virus
cauuccauuguacaa

SEQ ID NO: 4091939 - RNA, 19 nt, Variola virus
cauuccuaccaaacaaaau

SEQ ID NO: 4091940 - RNA, 23 nt, Variola virus
cauucgacucaguauacaaaaau

SEQ ID NO: 4091941 - RNA, 17 nt, Variola virus
cauucugcaauauuguu

SEQ ID NO: 4091942 - RNA, 21 nt, Variola virus
cauugacggauaaaacaaaaa

SEQ ID NO: 4091943 - RNA, 22 nt, Variola virus
cauugacggauaaaacaaaaau

SEQ ID NO: 4091944 - RNA, 18 nt, Variola virus
cauugagugauaaacuug

SEQ ID NO: 4091945 - RNA, 20 nt, Variola virus
cauuguaugguuuuaaauau

SEQ ID NO: 4091946 - RNA, 21 nt, Variola virus
cauugucuaauagauauuuga

SEQ ID NO: 4091947 - RNA, 15 nt, Variola virus
cauuguuauguauuu

SEQ ID NO: 4091948 - RNA, 21 nt, Variola virus
cauuuagauagucacauuuca

SEQ ID NO: 4091949 - RNA, 13 nt, Variola virus
cauuuauacauau

SEQ ID NO: 4091950 - RNA, 22 nt, Variola virus
cauuuaucgacuaaucaaaaaa

SEQ ID NO: 4091951 - RNA, 21 nt, Variola virus
cauuuccaaaucuaacuucua

SEQ ID NO: 4091952 - RNA, 14 nt, Variola virus
cauuuccaugucaa

SEQ ID NO: 4091953 - RNA, 17 nt, Variola virus
cauuucucaaaugaaua

SEQ ID NO: 4091954 - RNA, 20 nt, Variola virus
cauuuggagaguauccucua

SEQ ID NO: 4091955 - RNA, 13 nt, Variola virus
cauuuuacauuau

SEQ ID NO: 4091956 - RNA, 20 nt, Variola virus
cauuuucccaaauaucuuua

SEQ ID NO: 4091957 - RNA, 12 nt, Variola virus
cauuuuuaggau

SEQ ID NO: 4091958 - RNA, 16 nt, Variola virus
ccaaacaauguuucua

SEQ ID NO: 4091959 - RNA, 21 nt, Variola virus
ccaaacuuagaaccaaaugau

SEQ ID NO: 4091960 - RNA, 15 nt, Variola virus
ccaaaggauguuuaa

SEQ ID NO: 4091961 - RNA, 21 nt, Variola virus
ccaaaucaguaacuauguuca

SEQ ID NO: 4091962 - RNA, 12 nt, Variola virus
ccaaaugaugau

SEQ ID NO: 4091963 - RNA, 14 nt, Variola virus
ccaaauuaaugaau

SEQ ID NO: 4091964 - RNA, 18 nt, Variola virus
ccaacguaguaucaucuu

SEQ ID NO: 4091965 - RNA, 17 nt, Variola virus
ccaacucauuuaaauau

SEQ ID NO: 4091966 - RNA, 15 nt, Variola virus
ccaacugauuaauaa

SEQ ID NO: 4091967 - RNA, 13 nt, Variola virus
ccaacuguagacg

SEQ ID NO: 4091968 - RNA, 18 nt, Variola virus
ccaagaaacagucagcug

SEQ ID NO: 4091969 - RNA, 13 nt, Variola virus
ccaagacacauau

SEQ ID NO: 4091970 - RNA, 15 nt, Variola virus
caagcgauucuuuca

SEQ ID NO: 4091971 - RNA, 22 nt, Variola virus
caaggcuuuaauaucuaaauau

SEQ ID NO: 4091972 - RNA, 16 nt, Variola virus
caaguaacaacaaaaa

SEQ ID NO: 4091973 - RNA, 23 nt, Variola virus
caaguaauacgugagaauauacu

SEQ ID NO: 4091974 - RNA, 16 nt, Variola virus
caagucccaaauggag

SEQ ID NO: 4091975 - RNA, 23 nt, Variola virus
caagucuucaguucuaucuucua

SEQ ID NO: 4091976 - RNA, 19 nt, Variola virus
caagugaaccuauaaugag

SEQ ID NO: 4091977 - RNA, 12 nt, Variola virus
caaguuaaauag

SEQ ID NO: 4091978 - RNA, 19 nt, Variola virus
caauaaaaaaguuaagaau

SEQ ID NO: 4091979 - RNA, 17 nt, Variola virus
caauaaaacauuuccua

SEQ ID NO: 4091980 - RNA, 13 nt, Variola virus
caauaaacaaaau

SEQ ID NO: 4091981 - RNA, 14 nt, Variola virus
caauaaacauagua

SEQ ID NO: 4091982 - RNA, 21 nt, Variola virus
caauaacuaauggcaaaugua

SEQ ID NO: 4091983 - RNA, 15 nt, Variola virus
caauaauaguaacau

SEQ ID NO: 4091984 - RNA, 15 nt, Variola virus
caauaauauacuaau

SEQ ID NO: 4091985 - RNA, 16 nt, Variola virus
caauaauauacuaauu

SEQ ID NO: 4091986 - RNA, 23 nt, Variola virus
caauagagaccgcgucuguuaua

SEQ ID NO: 4091987 - RNA, 20 nt, Variola virus
caauauaaucgcuucaucau

SEQ ID NO: 4091988 - RNA, 15 nt, Variola virus
caauauauauacagu

SEQ ID NO: 4091989 - RNA, 21 nt, Variola virus
caauaugccacaccaucuuca

SEQ ID NO: 4091990 - RNA, 19 nt, Variola virus
caauauguaucguauucua

SEQ ID NO: 4091991 - RNA, 15 nt, Variola virus
caauauuguagaauu

SEQ ID NO: 4091992 - RNA, 19 nt, Variola virus
caaucaaaagacuauacau

SEQ ID NO: 4091993 - RNA, 16 nt, Variola virus
caaucuagcauuucua

SEQ ID NO: 4091994 - RNA, 20 nt, Variola virus
caaucugggcguauaaugaa

SEQ ID NO: 4091995 - RNA, 14 nt, Variola virus
caaucuuauaucuu

SEQ ID NO: 4091996 - RNA, 20 nt, Variola virus
caaugaacaagauuaaucuc

SEQ ID NO: 4091997 - RNA, 17 nt, Variola virus
caaugaacuaauaugau

SEQ ID NO: 4091998 - RNA, 12 nt, Variola virus
caaugaguaaaa

SEQ ID NO: 4091999 - RNA, 20 nt, Variola virus
caaugauuucaaggauguca

SEQ ID NO: 4092000 - RNA, 16 nt, Variola virus
caauguaaaguaucua

SEQ ID NO: 4092001 - RNA, 19 nt, Variola virus
caauguauuuauaucugau

SEQ ID NO: 4092002 - RNA, 12 nt, Variola virus
caauuaaaucaa

SEQ ID NO: 4092003 - RNA, 12 nt, Variola virus
caauuaaaucau

SEQ ID NO: 4092004 - RNA, 23 nt, Variola virus
caauuaguagaguuuuauaacga

SEQ ID NO: 4092005 - RNA, 18 nt, Variola virus
caauuaguuaauaaugau

SEQ ID NO: 4092006 - RNA, 15 nt, Variola virus
caauucaugcucuau

SEQ ID NO: 4092007 - RNA, 20 nt, Variola virus
caauucauguuuaaaaugau

SEQ ID NO: 4092008 - RNA, 17 nt, Variola virus
caauucuaaucacuuua

SEQ ID NO: 4092009 - RNA, 20 nt, Variola virus
caauugcauucccaucauuu

SEQ ID NO: 4092010 - RNA, 21 nt, Variola virus
caauugcauucccaucauuuc

SEQ ID NO: 4092011 - RNA, 19 nt, Variola virus
caauuguuugauauauaau

SEQ ID NO: 4092012 - RNA, 16 nt, Variola virus
caauuuagcugcauua

SEQ ID NO: 4092013 - RNA, 19 nt, Variola virus
caauuuauacggauuucua

SEQ ID NO: 4092014 - RNA, 15 nt, Variola virus
caauuucauaaugag

SEQ ID NO: 4092015 - RNA, 23 nt, Variola virus
caauuugcucccgccgauccugu

SEQ ID NO: 4092016 - RNA, 13 nt, Variola virus
caauuuguuaaua

SEQ ID NO: 4092017 - RNA, 18 nt, Variola virus
caauuuugauguauaaca

SEQ ID NO: 4092018 - RNA, 18 nt, Variola virus
cacaacaauuuauuucua

SEQ ID NO: 4092019 - RNA, 14 nt, Variola virus
cacaaucaugauuu

SEQ ID NO: 4092020 - RNA, 11 nt, Variola virus
cacaaugaaua

SEQ ID NO: 4092021 - RNA, 17 nt, Variola virus
cacaaugauaacaucca

SEQ ID NO: 4092022 - RNA, 14 nt, Variola virus
cacacuaaacaguu

SEQ ID NO: 4092023 - RNA, 19 nt, Variola virus
cacagcgaagaauucuaga

SEQ ID NO: 4092024 - RNA, 21 nt, Variola virus
cacaggauuuccaaucuuuug

SEQ ID NO: 4092025 - RNA, 12 nt, Variola virus
cacauaaaagaa

SEQ ID NO: 4092026 - RNA, 15 nt, Variola virus
cacauaauuauucua

SEQ ID NO: 4092027 - RNA, 21 nt, Variola virus
cacauccuuuauuuuaucuau

SEQ ID NO: 4092028 - RNA, 11 nt, Variola virus
cacaugaugau

SEQ ID NO: 4092029 - RNA, 15 nt, Variola virus
cacauuuaugauaug

SEQ ID NO: 4092030 - RNA, 23 nt, Variola virus
caccgagggaaaaucuaaaguug

SEQ ID NO: 4092031 - RNA, 18 nt, Variola virus
caccucuaccgaauagag

SEQ ID NO: 4092032 - RNA, 17 nt, Variola virus
cacgaauauuacuaauu

SEQ ID NO: 4092033 - RNA, 15 nt, Variola virus
cacgagaacuauuaa

SEQ ID NO: 4092034 - RNA, 13 nt, Variola virus
cacgauauggaug

SEQ ID NO: 4092035 - RNA, 16 nt, Variola virus
cacuaacuguaucaau

SEQ ID NO: 4092036 - RNA, 19 nt, Variola virus
cacuaaucauaauauucua

SEQ ID NO: 4092037 - RNA, 13 nt, Variola virus
cacuagaugauuu

SEQ ID NO: 4092038 - RNA, 13 nt, Variola virus
gcucuacgaauau

SEQ ID NO: 4092039 - RNA, 22 nt, Variola virus
gcucucguacaguagagauauu

SEQ ID NO: 4092040 - RNA, 18 nt, Variola virus
gcucuguaaagcauauuc

SEQ ID NO: 4092041 - RNA, 13 nt, Variola virus
gcucuuaaacgac

SEQ ID NO: 4092042 - RNA, 16 nt, Variola virus
gcugaaugaucuuuuu

SEQ ID NO: 4092043 - RNA, 21 nt, Variola virus
gcugagaauaucuuuauucau

SEQ ID NO: 4092044 - RNA, 22 nt, Variola virus
gcugcuggaucuaaauauuuua

SEQ ID NO: 4092045 - RNA, 16 nt, Variola virus
gcugucacucauaaau

SEQ ID NO: 4092046 - RNA, 15 nt, Variola virus
gcuguggaaauuaaa

SEQ ID NO: 4092047 - RNA, 14 nt, Variola virus
gcuuaauaaauguu

SEQ ID NO: 4092048 - RNA, 17 nt, Variola virus
gcuuacauguauuaaag

SEQ ID NO: 4092049 - RNA, 20 nt, Variola virus
gcuuagcuaauccugauauu

SEQ ID NO: 4092050 - RNA, 23 nt, Variola virus
gcuuuuauuuuuggaauaaucuc

SEQ ID NO: 4092051 - RNA, 14 nt, Variola virus
gcuuuucucuuuua

SEQ ID NO: 4092052 - RNA, 16 nt, Variola virus
ggaaaaauaacaaauc

SEQ ID NO: 4092053 - RNA, 12 nt, Variola virus
ggaaaaugaaaa

SEQ ID NO: 4092054 - RNA, 11 nt, Variola virus
ggaaacuauaa

SEQ ID NO: 4092055 - RNA, 16 nt, Variola virus
ggaaacuuucuagaac

SEQ ID NO: 4092056 - RNA, 17 nt, Variola virus
ggaaacuuuuguuuugu

SEQ ID NO: 4092057 - RNA, 16 nt, Variola virus
ggaaccucgagaaugu

SEQ ID NO: 4092058 - RNA, 20 nt, Variola virus
ggaaguagaaucauaaagaa

SEQ ID NO: 4092059 - RNA, 17 nt, Variola virus
ggaauauauuuggauuu

SEQ ID NO: 4092060 - RNA, 19 nt, Variola virus
ggaaugccacgaauaaaaa

SEQ ID NO: 4092061 - RNA, 11 nt, Variola virus
ggaauugauuu

SEQ ID NO: 4092062 - RNA, 13 nt, Variola virus
ggaauuuuaucga

SEQ ID NO: 4092063 - RNA, 16 nt, Variola virus
ggacaacauguuacua

SEQ ID NO: 4092064 - RNA, 21 nt, Variola virus
ggacagauacuacuauuuguc

SEQ ID NO: 4092065 - RNA, 22 nt, Variola virus
ggaccacauccuucuucaucaa

SEQ ID NO: 4092066 - RNA, 22 nt, Variola virus
ggagaugaugcuaaaaaauaua

SEQ ID NO: 4092067 - RNA, 23 nt, Variola virus
ggaguacccacugaugagauguu

SEQ ID NO: 4092068 - RNA, 13 nt, Variola virus
ggaguuagaaaac

SEQ ID NO: 4092069 - RNA, 16 nt, Variola virus
ggaucuccuauuucuu

SEQ ID NO: 4092070 - RNA, 17 nt, Variola virus
ggaugaguuaauguaua

SEQ ID NO: 4092071 - RNA, 17 nt, Variola virus
ggauuacaagaaauaug

SEQ ID NO: 4092072 - RNA, 10 nt, Variola virus
ggauuacuua

SEQ ID NO: 4092073 - RNA, 21 nt, Variola virus
ggauugguuucuaaauucaug

SEQ ID NO: 4092074 - RNA, 20 nt, Variola virus
ggauuugguaagacuauuac

SEQ ID NO: 4092075 - RNA, 11 nt, Variola virus
ggcaaauuguc

SEQ ID NO: 4092076 - RNA, 22 nt, Variola virus
ggcauacucguccgauuucaua

SEQ ID NO: 4092077 - RNA, 20 nt, Variola virus
ggccuguucauaaauaaaaa

SEQ ID NO: 4092078 - RNA, 20 nt, Variola virus
ggcggaguaaguguugagcu

SEQ ID NO: 4092079 - RNA, 22 nt, Variola virus
ggcuaauugucuuucucuuuua

SEQ ID NO: 4092080 - RNA, 21 nt, Variola virus
ggguauuuaucaauaaacaau

SEQ ID NO: 4092081 - RNA, 18 nt, Variola virus
ggguuguuacgaugauga

SEQ ID NO: 4092082 - RNA, 21 nt, Variola virus
gguaauacgcucaucaaguac

SEQ ID NO: 4092083 - RNA, 20 nt, Variola virus
gguacauacgucuauuucua

SEQ ID NO: 4092084 - RNA, 16 nt, Variola virus
gguagacauagauauu

SEQ ID NO: 4092085 - RNA, 19 nt, Variola virus
gguagaccguuaaugaaga

SEQ ID NO: 4092086 - RNA, 21 nt, Variola virus
gguagauuuguucuauagagc

SEQ ID NO: 4092087 - RNA, 16 nt, Variola virus
gguaugggauaaaaua

SEQ ID NO: 4092088 - RNA, 20 nt, Variola virus
ggucaguuuaugauugauuu

SEQ ID NO: 4092089 - RNA, 16 nt, Variola virus
ggucauaacaaguuuc

SEQ ID NO: 4092090 - RNA, 20 nt, Variola virus
ggucauauuauagauuuaau

SEQ ID NO: 4092091 - RNA, 23 nt, Variola virus
ggucgucgauaacaaauuaaaga

SEQ ID NO: 4092092 - RNA, 15 nt, Variola virus
ggucuaucaauaacu

SEQ ID NO: 4092093 - RNA, 16 nt, Variola virus
ggucuucggaaaaaga

SEQ ID NO: 4092094 - RNA, 16 nt, Variola virus
ggugagaacaugagac

SEQ ID NO: 4092095 - RNA, 11 nt, Variola virus
gguguauauaa

SEQ ID NO: 4092096 - RNA, 16 nt, Variola virus
gguucgauauaaagga

SEQ ID NO: 4092097 - RNA, 15 nt, Variola virus
gguucuuuaaaagaa

SEQ ID NO: 4092098 - RNA, 17 nt, Variola virus
gguugcagaauauagac

SEQ ID NO: 4092099 - RNA, 18 nt, Variola virus
gguuucggaacauauucu

SEQ ID NO: 4092100 - RNA, 15 nt, Variola virus
guaaaacauaaagga

SEQ ID NO: 4092101 - RNA, 16 nt, Variola virus
guaaaacucauuacuu

SEQ ID NO: 4092102 - RNA, 19 nt, Variola virus
guaaaaugaaauaucuuaa

SEQ ID NO: 4092103 - RNA, 22 nt, Variola virus
guaaacauuauaucguuaucau

SEQ ID NO: 4092104 - RNA, 22 nt, Variola virus
guaaaccgauaguguauaaaga

SEQ ID NO: 4092105 - RNA, 21 nt, Variola virus
guaaacuguugaugauaucua

SEQ ID NO: 4092106 - RNA, 12 nt, Variola virus
guaaagaaggag

SEQ ID NO: 4092107 - RNA, 15 nt, Variola virus
guaaagauauuucuc

SEQ ID NO: 4092108 - RNA, 14 nt, Variola virus
guaaauaauaauau

SEQ ID NO: 4092109 - RNA, 14 nt, Variola virus
guaaaugauaacua

SEQ ID NO: 4092110 - RNA, 22 nt, Variola virus
guaacguuuauauauucaauau

SEQ ID NO: 4092111 - RNA, 13 nt, Variola virus
guaaguacaucau

SEQ ID NO: 4092112 - RNA, 14 nt, Variola virus
guaaguacaucauc

SEQ ID NO: 4092113 - RNA, 11 nt, Variola virus
guaaguuuauu

SEQ ID NO: 4092114 - RNA, 19 nt, Variola virus
guaauaaaauuucuauucc

SEQ ID NO: 4092115 - RNA, 19 nt, Variola virus
guaauacgaucuauaaaaa

SEQ ID NO: 4092116 - RNA, 15 nt, Variola virus
guaauacuuuuaguu

SEQ ID NO: 4092117 - RNA, 22 nt, Variola virus
guaauagaauacgaugauauua

SEQ ID NO: 4092118 - RNA, 19 nt, Variola virus
guaaucauguaaauguuua

SEQ ID NO: 4092119 - RNA, 16 nt, Variola virus
guaauuauagaugaau

SEQ ID NO: 4092120 - RNA, 15 nt, Variola virus
guacaauauguguua

SEQ ID NO: 4092121 - RNA, 19 nt, Variola virus
guacagaaaauaucauguu

SEQ ID NO: 4092122 - RNA, 19 nt, Variola virus
guacauacgucuauuucua

SEQ ID NO: 4092123 - RNA, 12 nt, Variola virus
guacauacuaga

SEQ ID NO: 4092124 - RNA, 17 nt, Variola virus
guacauuauuacauaga

SEQ ID NO: 4092125 - RNA, 16 nt, Variola virus
guacauuucacagaaa

SEQ ID NO: 4092126 - RNA, 22 nt, Variola virus
guacuaaauucaauaucuuuuu

SEQ ID NO: 4092127 - RNA, 21 nt, Variola virus
guacuaacuuuugauuuuaac

SEQ ID NO: 4092128 - RNA, 20 nt, Variola virus
guacuucucccauaauacuu

SEQ ID NO: 4092129 - RNA, 19 nt, Variola virus
guagaucaaacuuaaauaa

SEQ ID NO: 4092130 - RNA, 17 nt, Variola virus
guagcaaagaaauuaau

SEQ ID NO: 4092131 - RNA, 20 nt, Variola virus
guagcugaauguuauaaaaa

SEQ ID NO: 4092132 - RNA, 13 nt, Variola virus
guaguauugauuc

SEQ ID NO: 4092133 - RNA, 20 nt, Variola virus
guagucaaugaaacauuuga

SEQ ID NO: 4092134 - RNA, 14 nt, Variola virus
guaguucuauaauc

SEQ ID NO: 4092135 - RNA, 19 nt, Variola virus
guaguucuguucuaucauc

SEQ ID NO: 4092136 - RNA, 12 nt, Variola virus
guauaauagacc

SEQ ID NO: 4092137 - RNA, 20 nt, Variola virus
guauaaucaauucuaaucac

SEQ ID NO: 4092138 - RNA, 16 nt, Variola virus
guauaaucuuuaacaa

SEQ ID NO: 4092139 - RNA, 20 nt, Variola virus
guauacacaaaaagaaagaa

SEQ ID NO: 4092140 - RNA, 21 nt, Variola virus
guauaccuuuccaguauauga

SEQ ID NO: 4092141 - RNA, 13 nt, Variola virus
guauacuuuuuaa

SEQ ID NO: 4092142 - RNA, 19 nt, Variola virus
guauagaacacaugucuua

SEQ ID NO: 4092143 - RNA, 20 nt, Variola virus
guauagauccuccaguaaau

SEQ ID NO: 4092144 - RNA, 15 nt, Variola virus
guauauaaauacuuu

SEQ ID NO: 4092145 - RNA, 21 nt, Variola virus
guauauacuauuauagaucaa

SEQ ID NO: 4092146 - RNA, 17 nt, Variola virus
guauauacuuagauaua

SEQ ID NO: 4092147 - RNA, 13 nt, Variola virus
guauauagauaug

SEQ ID NO: 4092148 - RNA, 18 nt, Variola virus
guauaucgcagaugaaac

SEQ ID NO: 4092149 - RNA, 14 nt, Variola virus
guauaugaguaaau

SEQ ID NO: 4092150 - RNA, 15 nt, Variola virus
guauauucucuaguu

SEQ ID NO: 4092151 - RNA, 20 nt, Variola virus
guauauuuuagguacuuaug

SEQ ID NO: 4092152 - RNA, 16 nt, Variola virus
guaucaagaauaucca

SEQ ID NO: 4092153 - RNA, 22 nt, Variola virus
guaucaaucaagaggauggaau

SEQ ID NO: 4092154 - RNA, 16 nt, Variola virus
guaucauaauauuaau

SEQ ID NO: 4092155 - RNA, 20 nt, Variola virus
guaucaucgucuaguuuauc

SEQ ID NO: 4092156 - RNA, 22 nt, Variola virus
guaucaucucuacauuguuuac

SEQ ID NO: 4092157 - RNA, 19 nt, Variola virus
guaucgcccuaauauuauu

SEQ ID NO: 4092158 - RNA, 24 nt, Variola virus
guaucgcuggaagggacuauauga

SEQ ID NO: 4092159 - RNA, 22 nt, Variola virus
guaucucuaccuaugauuaaau

SEQ ID NO: 4092160 - RNA, 22 nt, Variola virus
guaugccauuuacuuaauauga

SEQ ID NO: 4092161 - RNA, 15 nt, Variola virus
guaugucuuauguau

SEQ ID NO: 4092162 - RNA, 18 nt, Variola virus
guauuaccguuaacuaca

SEQ ID NO: 4092163 - RNA, 21 nt, Variola virus
guauuacgaagaagacaauga

SEQ ID NO: 4092164 - RNA, 13 nt, Variola virus
guauuagauaaau

SEQ ID NO: 4092165 - RNA, 17 nt, Variola virus
guauuauaauauacaua

SEQ ID NO: 4092166 - RNA, 14 nt, Variola virus
guauuaugaugaau

SEQ ID NO: 4092167 - RNA, 14 nt, Variola virus
guauucaauuacua

SEQ ID NO: 4092168 - RNA, 15 nt, Variola virus
guauuccauauggau

SEQ ID NO: 4092169 - RNA, 21 nt, Variola virus
guauucuauaccaauauuauu

SEQ ID NO: 4092170 - RNA, 21 nt, Variola virus
guauuucucuacaauauuaau

SEQ ID NO: 4092171 - RNA, 15 nt, Variola virus
guauuugauaaaaca

SEQ ID NO: 4092172 - RNA, 20 nt, Variola virus
guauuuuugacguaaaugug

SEQ ID NO: 4092173 - RNA, 15 nt, Variola virus
guauuuuuuaugaca

SEQ ID NO: 4092174 - RNA, 18 nt, Variola virus
gucaaacuuaauaaagga

SEQ ID NO: 4092175 - RNA, 13 nt, Variola virus
gucaaagaaauac

SEQ ID NO: 4092176 - RNA, 18 nt, Variola virus
gucaaugauaugauuuuu

SEQ ID NO: 4092177 - RNA, 19 nt, Variola virus
gucaauuacgaauaaagcg

SEQ ID NO: 4092178 - RNA, 20 nt, Variola virus
gucaauucccuccuguagua

SEQ ID NO: 4092179 - RNA, 20 nt, Variola virus
gucacauacuuuguaaucua

SEQ ID NO: 4092180 - RNA, 14 nt, Variola virus
gucacuauuaaaga

SEQ ID NO: 4092181 - RNA, 18 nt, Variola virus
gucagaucguauaaucua

SEQ ID NO: 4092182 - RNA, 15 nt, Variola virus
gucagcaucagcauu

SEQ ID NO: 4092183 - RNA, 23 nt, Variola virus
gucauaacaaauguauacuaucu

SEQ ID NO: 4092184 - RNA, 22 nt, Variola virus
gucauacuccaucaauuucaaa

SEQ ID NO: 4092185 - RNA, 23 nt, Variola virus
gucaucaaguaguagugauuuug

SEQ ID NO: 4092186 - RNA, 14 nt, Variola virus
gucauccuucacuc

SEQ ID NO: 4092187 - RNA, 18 nt, Variola virus
gucaucuccagaggaaau

SEQ ID NO: 4092188 - RNA, 22 nt, Variola virus
gucaucuuauguuuuuaagaga

SEQ ID NO: 4092189 - RNA, 14 nt, Variola virus
gucauuauauacuc

SEQ ID NO: 4092190 - RNA, 18 nt, Variola virus
gucauuccuuauacaauc

SEQ ID NO: 4092191 - RNA, 17 nt, Variola virus
guccaacgcuuggcuga

SEQ ID NO: 4092192 - RNA, 21 nt, Variola virus
guccauuaaaguuaaauugug

SEQ ID NO: 4092193 - RNA, 13 nt, Variola virus
gucccaauguuuc

SEQ ID NO: 4092194 - RNA, 21 nt, Variola virus
guccgauaacguuagccacca

SEQ ID NO: 4092195 - RNA, 13 nt, Variola virus
guccguacuuauu

SEQ ID NO: 4092196 - RNA, 15 nt, Variola virus
guccuuagcuauaau

SEQ ID NO: 4092197 - RNA, 14 nt, Variola virus
gucgauaacaaauu

SEQ ID NO: 4092198 - RNA, 23 nt, Variola virus
gucgcaacgggguaguucguaga

SEQ ID NO: 4092199 - RNA, 19 nt, Variola virus
gucggcauaggugccacca

SEQ ID NO: 4092200 - RNA, 16 nt, Variola virus
gucguccaauauuuua

SEQ ID NO: 4092201 - RNA, 18 nt, Variola virus
gucgucuuuugaucuuua

SEQ ID NO: 4092202 - RNA, 18 nt, Variola virus
gucguguuuuauuaauca

SEQ ID NO: 4092203 - RNA, 21 nt, Variola virus
gucuaaauuccauagcauauu

SEQ ID NO: 4092204 - RNA, 22 nt, Variola virus
gucuacaaauagagauaaaaca

SEQ ID NO: 4092205 - RNA, 12 nt, Variola virus
gucuagaaauaa

SEQ ID NO: 4092206 - RNA, 20 nt, Variola virus
gucuagcaaugaucuaaauu

SEQ ID NO: 4092207 - RNA, 15 nt, Variola virus
gucuagccacagaaa

SEQ ID NO: 4092208 - RNA, 18 nt, Variola virus
gucuaguaaguagaaauu

SEQ ID NO: 4092209 - RNA, 20 nt, Variola virus
gucuaguaaguagaaauuau

SEQ ID NO: 4092210 - RNA, 23 nt, Variola virus
gucuaugucucuuauuagagauu

SEQ ID NO: 4092211 - RNA, 23 nt, Variola virus
gucuauuguuaaucaugccacca

SEQ ID NO: 4092212 - RNA, 22 nt, Variola virus
gucucaugaccguguaugaaau

SEQ ID NO: 4092213 - RNA, 19 nt, Variola virus
gucucauuucuaucuguuu

SEQ ID NO: 4092214 - RNA, 15 nt, Variola virus
gucuccaucggcuuu

SEQ ID NO: 4092215 - RNA, 16 nt, Variola virus
gucucuauaaaaauga

SEQ ID NO: 4092216 - RNA, 19 nt, Variola virus
gucucuuccgcagauaaau

SEQ ID NO: 4092217 - RNA, 16 nt, Variola virus
gucuggcaauaaauga

SEQ ID NO: 4092218 - RNA, 16 nt, Variola virus
gucugucaaaucaucu

SEQ ID NO: 4092219 - RNA, 23 nt, Variola virus
gucuuauucuuaaaaucuauucc

SEQ ID NO: 4092220 - RNA, 14 nt, Variola virus
gucuuggaagcaau

SEQ ID NO: 4092221 - RNA, 18 nt, Variola virus
gucuuuuauaguauauac

SEQ ID NO: 4092222 - RNA, 23 nt, Variola virus
gugaaauacuuuauuacuccauu

SEQ ID NO: 4092223 - RNA, 14 nt, Variola virus
gugaauaauguuuc

SEQ ID NO: 4092224 - RNA, 22 nt, Variola virus
gugaguuugaauuuucuacauc

SEQ ID NO: 4092225 - RNA, 15 nt, Variola virus
gugaguuuuccuuaa

SEQ ID NO: 4092226 - RNA, 19 nt, Variola virus
gugauaucaaauggauauu

SEQ ID NO: 4092227 - RNA, 14 nt, Variola virus
gugaucaucuucau

SEQ ID NO: 4092228 - RNA, 18 nt, Variola virus
gugauguuacggauaucu

SEQ ID NO: 4092229 - RNA, 19 nt, Variola virus
gugcacuuuuuuauaaaga

SEQ ID NO: 4092230 - RNA, 17 nt, Variola virus
gugcagaagcucuggcu

SEQ ID NO: 4092231 - RNA, 21 nt, Variola virus
gugcauaauaaaguauaugua

SEQ ID NO: 4092232 - RNA, 19 nt, Variola virus
gugccaaaaugauauacag

SEQ ID NO: 4092233 - RNA, 18 nt, Variola virus
gugcucaagcuaaacaag

SEQ ID NO: 4092234 - RNA, 17 nt, Variola virus
gugcugaggucuuucaa

SEQ ID NO: 4092235 - RNA, 20 nt, Variola virus
gugcugucaaacaaaaacuu

SEQ ID NO: 4092236 - RNA, 14 nt, Variola virus
gugguguaaucuua

SEQ ID NO: 4092237 - RNA, 14 nt, Variola virus
guguagaagaucaa

SEQ ID NO: 4092238 - RNA, 19 nt, Variola virus
guguagcguuuuaaauauu

SEQ ID NO: 4092239 - RNA, 20 nt, Variola virus
guguaguucuguucuaucau

SEQ ID NO: 4092240 - RNA, 18 nt, Variola virus
guguauaacaaucuuaua

SEQ ID NO: 4092241 - RNA, 17 nt, Variola virus
guguaucgacaucuuua

SEQ ID NO: 4092242 - RNA, 22 nt, Variola virus
guguauuaccccucauaguauu

SEQ ID NO: 4092243 - RNA, 12 nt, Variola virus
guguauuaucau

SEQ ID NO: 4092244 - RNA, 19 nt, Variola virus
guguauuuuugacguaaau

SEQ ID NO: 4092245 - RNA, 22 nt, Variola virus
gugucuuaucucguccuugguu

SEQ ID NO: 4092246 - RNA, 13 nt, Variola virus
guguuuaaucuuc

SEQ ID NO: 4092247 - RNA, 21 nt, Variola virus
guuaaacuuggggauaaugau

SEQ ID NO: 4092248 - RNA, 21 nt, Variola virus
guuaaauaaauccuucaucac

SEQ ID NO: 4092249 - RNA, 16 nt, Variola virus
guuaagagaaauuaga

SEQ ID NO: 4092250 - RNA, 16 nt, Variola virus
guuaagccugaauuua

SEQ ID NO: 4092251 - RNA, 22 nt, Variola virus
guuaauaguuggaauaaauaga

SEQ ID NO: 4092252 - RNA, 23 nt, Variola virus
guuaauauagacaauucuuuugu

SEQ ID NO: 4092253 - RNA, 15 nt, Variola virus
guuaaugaacaaauc

SEQ ID NO: 4092254 - RNA, 16 nt, Variola virus
guuaaugagguaggaa

SEQ ID NO: 4092255 - RNA, 21 nt, Variola virus
guuaauuauuucuaacauuga

SEQ ID NO: 4092256 - RNA, 21 nt, Variola virus
guuaauugucuauaaauuaga

SEQ ID NO: 4092257 - RNA, 15 nt, Variola virus
guuaauuucuauuca

SEQ ID NO: 4092258 - RNA, 16 nt, Variola virus
guuacaauuuuaucau

SEQ ID NO: 4092259 - RNA, 21 nt, Variola virus
guuacuaacgugauuauuauu

SEQ ID NO: 4092260 - RNA, 10 nt, Variola virus
guuacuaucg

SEQ ID NO: 4092261 - RNA, 17 nt, Variola virus
guuagaagucuuaaaaa

SEQ ID NO: 4092262 - RNA, 15 nt, Variola virus
guuagagacaaaaga

SEQ ID NO: 4092263 - RNA, 19 nt, Variola virus
guuagauaacucugcucca

SEQ ID NO: 4092264 - RNA, 22 nt, Variola virus
guuagauauuuagcaauugcau

SEQ ID NO: 4092265 - RNA, 22 nt, Variola virus
guuauaaccuuaauauaauaga

SEQ ID NO: 4092266 - RNA, 17 nt, Variola virus
guuauacagauguauua

SEQ ID NO: 4092267 - RNA, 19 nt, Variola virus
guuauagaggaauaucauc

SEQ ID NO: 4092268 - RNA, 16 nt, Variola virus
guuauagucaaauuaa

SEQ ID NO: 4092269 - RNA, 18 nt, Variola virus
guuaucaaaauauguaga

SEQ ID NO: 4092270 - RNA, 21 nt, Variola virus
guuaucaucguauaaauuaaa

SEQ ID NO: 4092271 - RNA, 15 nt, Variola virus
guuaucuauuucaaa

SEQ ID NO: 4092272 - RNA, 22 nt, Variola virus
guuauguauuucauuguucauc

SEQ ID NO: 4092273 - RNA, 18 nt, Variola virus
guuauuacacauguguuu

SEQ ID NO: 4092274 - RNA, 15 nt, Variola virus
guucaaaaauuuaga

SEQ ID NO: 4092275 - RNA, 23 nt, Variola virus
guucagaaucgcgauucuaaaac

SEQ ID NO: 4092276 - RNA, 21 nt, Variola virus
guucagugacgucuguggaug

SEQ ID NO: 4092277 - RNA, 15 nt, Variola virus
guucauaaauaaaaa

SEQ ID NO: 4092278 - RNA, 13 nt, Variola virus
guucauaaucauc

SEQ ID NO: 4092279 - RNA, 20 nt, Variola virus
guucauccuuguucaucauu

SEQ ID NO: 4092280 - RNA, 18 nt, Variola virus
guuccagcuauuccaccu

SEQ ID NO: 4092281 - RNA, 15 nt, Variola virus
guuccauuacaaaua

SEQ ID NO: 4092282 - RNA, 23 nt, Variola virus
guuccguuggaugguaauaaacu

SEQ ID NO: 4092283 - RNA, 20 nt, Variola virus
guuccucuguaaauaaaucu

SEQ ID NO: 4092284 - RNA, 13 nt, Variola virus
guucgauagaaac

SEQ ID NO: 4092285 - RNA, 16 nt, Variola virus
guucuauaaacugaau

SEQ ID NO: 4092286 - RNA, 21 nt, Variola virus
guucuauaagauguuagaauu

SEQ ID NO: 4092287 - RNA, 20 nt, Variola virus
guucucaagaacuacaaaag

SEQ ID NO: 4092288 - RNA, 16 nt, Variola virus
guucuuugaacaucuu

SEQ ID NO: 4092289 - RNA, 22 nt, Variola virus
guugacacguuuauuucguaua

SEQ ID NO: 4092290 - RNA, 23 nt, Variola virus
guugaucacauuuagauaagaag

SEQ ID NO: 4092291 - RNA, 17 nt, Variola virus
guugcaauaauaaaagu

SEQ ID NO: 4092292 - RNA, 16 nt, Variola virus
guugcaauauacauaa

SEQ ID NO: 4092293 - RNA, 19 nt, Variola virus
guugcugcucguauaaucu

SEQ ID NO: 4092294 - RNA, 17 nt, Variola virus
guuggauuaucuauagu

SEQ ID NO: 4092295 - RNA, 14 nt, Variola virus
guuguauauuucuu

SEQ ID NO: 4092296 - RNA, 21 nt, Variola virus
guuguuacuccauuauauauu

SEQ ID NO: 4092297 - RNA, 22 nt, Variola virus
guuuaacaaaguuauucaucgu

SEQ ID NO: 4092298 - RNA, 18 nt, Variola virus
guuuaacuagucuucucu

SEQ ID NO: 4092299 - RNA, 13 nt, Variola virus
guuuaauauccuu

SEQ ID NO: 4092300 - RNA, 16 nt, Variola virus
guuuaauuuucacaag

SEQ ID NO: 4092301 - RNA, 12 nt, Variola virus
guuuaucuuuuu

SEQ ID NO: 4092302 - RNA, 17 nt, Variola virus
guuuauggaucuauuca

SEQ ID NO: 4092303 - RNA, 20 nt, Variola virus
guuuauuguauuuaugaccu

SEQ ID NO: 4092304 - RNA, 22 nt, Variola virus
guuucaaagcaauuguauuauu

SEQ ID NO: 4092305 - RNA, 20 nt, Variola virus
guuucauaauaauacauaua

SEQ ID NO: 4092306 - RNA, 13 nt, Variola virus
guuuccuguaaau

SEQ ID NO: 4092307 - RNA, 15 nt, Variola virus
guuucuaaauuuuua

SEQ ID NO: 4092308 - RNA, 21 nt, Variola virus
guuucuuagcuugugauuuuu

SEQ ID NO: 4092309 - RNA, 16 nt, Variola virus
guuucuuauguggauc

SEQ ID NO: 4092310 - RNA, 20 nt, Variola virus
guuuuacguuauuaaucauc

SEQ ID NO: 4092311 - RNA, 20 nt, Variola virus
guuuucagaagauaauuauc

SEQ ID NO: 4092312 - RNA, 14 nt, Variola virus
guuuucaucuuuua

SEQ ID NO: 4092313 - RNA, 17 nt, Variola virus
guuuucuagauggaaau

SEQ ID NO: 4092314 - RNA, 14 nt, Variola virus
guuuucucuauucu

SEQ ID NO: 4092315 - RNA, 22 nt, Variola virus
guuuuuaggauugauaaucaac

SEQ ID NO: 4092316 - RNA, 13 nt, Variola virus
guuuuuuauucau

SEQ ID NO: 4092317 - RNA, 15 nt, Variola virus
guuuuuuuagaaaau

SEQ ID NO: 4092318 - RNA, 16 nt, Variola virus
uaaaaaaaaauacuua

SEQ ID NO: 4092319 - RNA, 17 nt, Variola virus
uaaaaaaguuaaaacuu

SEQ ID NO: 4092320 - RNA, 19 nt, Variola virus
uaaaaaaguuuuugauuac

SEQ ID NO: 4092321 - RNA, 15 nt, Variola virus
uaaaaacauuauucu

SEQ ID NO: 4092322 - RNA, 15 nt, Variola virus
uaaaaagauaaacuu

SEQ ID NO: 4092323 - RNA, 13 nt, Variola virus
uaaaaauaaaagu

SEQ ID NO: 4092324 - RNA, 15 nt, Variola virus
uaaaaauaaacauug

SEQ ID NO: 4092325 - RNA, 16 nt, Variola virus
uaaaaauguuaauuua

SEQ ID NO: 4092326 - RNA, 16 nt, Variola virus
uaaaaccaacuaauau

SEQ ID NO: 4092327 - RNA, 20 nt, Variola virus
uaaaacucugauuauugucu

SEQ ID NO: 4092328 - RNA, 14 nt, Variola virus
uaaaacuuaaaauu

SEQ ID NO: 4092329 - RNA, 23 nt, Variola virus
uaaaaguagaggaugugauacau

SEQ ID NO: 4092330 - RNA, 16 nt, Variola virus
uaaaauaaauaucauu

SEQ ID NO: 4092331 - RNA, 18 nt, Variola virus
uaaaauaguucuguaaua

SEQ ID NO: 4092332 - RNA, 15 nt, Variola virus
uaaaauauauuauca

SEQ ID NO: 4092333 - RNA, 23 nt, Variola virus
uaaaauauuguuaaauaauggau

SEQ ID NO: 4092334 - RNA, 17 nt, Variola virus
uaaaaucacugaacauu

SEQ ID NO: 4092335 - RNA, 17 nt, Variola virus
uaaaaugguauuucauu

SEQ ID NO: 4092336 - RNA, 15 nt, Variola virus
uaaaauuaacaagga

SEQ ID NO: 4092337 - RNA, 15 nt, Variola virus
uaaaauuacuuaaag

SEQ ID NO: 4092338 - RNA, 14 nt, Variola virus
uaaaauuagaucuu

SEQ ID NO: 4092339 - RNA, 11 nt, Variola virus
uaaaauuauuc

SEQ ID NO: 4092340 - RNA, 20 nt, Variola virus
uaaaauuauugauauguaua

SEQ ID NO: 4092341 - RNA, 17 nt, Variola virus
uaaacacauagaaauaa

SEQ ID NO: 4092342 - RNA, 19 nt, Variola virus
uaaacagauccuuaaccuu

SEQ ID NO: 4092343 - RNA, 22 nt, Variola virus
uaaacaguuuccacuuugguaa

SEQ ID NO: 4092344 - RNA, 16 nt, Variola virus
uaaacauaaacaacau

SEQ ID NO: 4092345 - RNA, 16 nt, Variola virus
uaaacauaagacguau

SEQ ID NO: 4092346 - RNA, 17 nt, Variola virus
uaaacaucuugauacuu

SEQ ID NO: 4092347 - RNA, 13 nt, Variola virus
uaaacauuauuga

SEQ ID NO: 4092348 - RNA, 16 nt, Variola virus
uaaaccagacaaccac

SEQ ID NO: 4092349 - RNA, 20 nt, Variola virus
uaaaccaucuuacuuaaaau

SEQ ID NO: 4092350 - RNA, 18 nt, Variola virus
uaaaccgauaguguauaa

SEQ ID NO: 4092351 - RNA, 16 nt, Variola virus
uaaaccguuuaauauu

SEQ ID NO: 4092352 - RNA, 23 nt, Variola virus
uaaacgccuuuagaaaaacuuua

SEQ ID NO: 4092353 - RNA, 14 nt, Variola virus
uaaacuaauucauu

SEQ ID NO: 4092354 - RNA, 17 nt, Variola virus
uaaacuauaaacuaaaa

SEQ ID NO: 4092355 - RNA, 15 nt, Variola virus
uaaacuauuguuaug

SEQ ID NO: 4092356 - RNA, 20 nt, Variola virus
uaaacuauuuuaccagcauu

SEQ ID NO: 4092357 - RNA, 17 nt, Variola virus
uaaacucacauuucaaa

SEQ ID NO: 4092358 - RNA, 19 nt, Variola virus
uaaacucagauaauagcaa

SEQ ID NO: 4092359 - RNA, 20 nt, Variola virus
uaaacugcgccaaauugugg

SEQ ID NO: 4092360 - RNA, 21 nt, Variola virus
uaaacuugacaaaaauuguga

SEQ ID NO: 4092361 - RNA, 20 nt, Variola virus
uaaacuugugcuaaucucuu

SEQ ID NO: 4092362 - RNA, 14 nt, Variola virus
uaaacuuuaacaau

SEQ ID NO: 4092363 - RNA, 14 nt, Variola virus
uaaacuuuaaugau

SEQ ID NO: 4092364 - RNA, 14 nt, Variola virus
uaaagaauaucuuu

SEQ ID NO: 4092365 - RNA, 18 nt, Variola virus
uaaagacccaaaugucug

SEQ ID NO: 4092366 - RNA, 15 nt, Variola virus
uaaagaccgaauaca

SEQ ID NO: 4092367 - RNA, 13 nt, Variola virus
uaaagacuuuuau

SEQ ID NO: 4092368 - RNA, 16 nt, Variola virus
uaaagauagaugauga

SEQ ID NO: 4092369 - RNA, 21 nt, Variola virus
uaaagauauucuaaaauggua

SEQ ID NO: 4092370 - RNA, 16 nt, Variola virus
uaaagauauuguuaca

SEQ ID NO: 4092371 - RNA, 13 nt, Variola virus
uaaagauauuucu

SEQ ID NO: 4092372 - RNA, 16 nt, Variola virus
uaaagaugaugcuauu

SEQ ID NO: 4092373 - RNA, 19 nt, Variola virus
uaaagcauauuccauuaau

SEQ ID NO: 4092374 - RNA, 18 nt, Variola virus
uaaaggaccuaauccauu

SEQ ID NO: 4092375 - RNA, 21 nt, Variola virus
uaaaggauauuauauguugug

SEQ ID NO: 4092376 - RNA, 21 nt, Variola virus
uaaagguauaaaauacuuauu

SEQ ID NO: 4092377 - RNA, 15 nt, Variola virus
uaaaguaauaaucuu

SEQ ID NO: 4092378 - RNA, 21 nt, Variola virus
uaaagucauuauauaggguug

SEQ ID NO: 4092379 - RNA, 18 nt, Variola virus
uaaagucuacauugucau

SEQ ID NO: 4092380 - RNA, 14 nt, Variola virus
uaaaguguaugucu

SEQ ID NO: 4092381 - RNA, 12 nt, Variola virus
uaaauagaauau

SEQ ID NO: 4092382 - RNA, 14 nt, Variola virus
uaaauaucauuaau

SEQ ID NO: 4092383 - RNA, 12 nt, Variola virus
uaaauauccauu

SEQ ID NO: 4092384 - RNA, 16 nt, Variola virus
uaaauauccauugucu

SEQ ID NO: 4092385 - RNA, 20 nt, Variola virus
uaaaucauggaguggaugua

SEQ ID NO: 4092386 - RNA, 14 nt, Variola virus
uaaaucuucacauu

SEQ ID NO: 4092387 - RNA, 17 nt, Variola virus
uaaauguauauuuucca

SEQ ID NO: 4092388 - RNA, 18 nt, Variola virus
uaaauucaaccaugaauu

SEQ ID NO: 4092389 - RNA, 12 nt, Variola virus
uaaauucaagau

SEQ ID NO: 4092390 - RNA, 20 nt, Variola virus
uaaauugguacucuaucaua

SEQ ID NO: 4092391 - RNA, 16 nt, Variola virus
uaaauuuuacaaaucu

SEQ ID NO: 4092392 - RNA, 20 nt, Variola virus
uaaauuuuagaaauaacauu

SEQ ID NO: 4092393 - RNA, 19 nt, Variola virus
uaacaaaaauuaugaaaua

SEQ ID NO: 4092394 - RNA, 13 nt, Variola virus
uaacaaagaaaga

SEQ ID NO: 4092395 - RNA, 17 nt, Variola virus
uaacaaccucuuuaaua

SEQ ID NO: 4092396 - RNA, 19 nt, Variola virus
uaacaacgacgaaccaaaa

SEQ ID NO: 4092397 - RNA, 14 nt, Variola virus
uaacaauuaaugau

SEQ ID NO: 4092398 - RNA, 19 nt, Variola virus
uaacaauuauuauaauugu

SEQ ID NO: 4092399 - RNA, 15 nt, Variola virus
uaacaauuucuauaa

SEQ ID NO: 4092400 - RNA, 20 nt, Variola virus
uaacacaaauuauauuauua

SEQ ID NO: 4092401 - RNA, 17 nt, Variola virus
uaacacaccuaaaugug

SEQ ID NO: 4092402 - RNA, 22 nt, Variola virus
uaacacguuuuuuagaucucau

SEQ ID NO: 4092403 - RNA, 19 nt, Variola virus
uaacacuauacgacacuau

SEQ ID NO: 4092404 - RNA, 17 nt, Variola virus
uaacagaaaaaacaaug

SEQ ID NO: 4092405 - RNA, 15 nt, Variola virus
uaacagccaauauga

SEQ ID NO: 4092406 - RNA, 22 nt, Variola virus
uaacaggucauauucucauaau

SEQ ID NO: 4092407 - RNA, 16 nt, Variola virus
uaacaguaacuuguau

SEQ ID NO: 4092408 - RNA, 20 nt, Variola virus
uaacaguuuugcuaauuaau

SEQ ID NO: 4092409 - RNA, 16 nt, Variola virus
uaacauaaacauauca

SEQ ID NO: 4092410 - RNA, 15 nt, Variola virus
uaacaucacuaauau

SEQ ID NO: 4092411 - RNA, 12 nt, Variola virus
uaacaucauuau

SEQ ID NO: 4092412 - RNA, 16 nt, Variola virus
uaacaucuuucaucau

SEQ ID NO: 4092413 - RNA, 23 nt, Variola virus
uaacauuguuaauugaaaaggga

SEQ ID NO: 4092414 - RNA, 19 nt, Variola virus
uaaccguuucaucaucauu

SEQ ID NO: 4092415 - RNA, 18 nt, Variola virus
uaacgaaacaauguuucu

SEQ ID NO: 4092416 - RNA, 16 nt, Variola virus
uaacgaggaagaaauu

SEQ ID NO: 4092417 - RNA, 19 nt, Variola virus
uaacgauaacgucauuaau

SEQ ID NO: 4092418 - RNA, 21 nt, Variola virus
uaacgauauuuugcaaaauag

SEQ ID NO: 4092419 - RNA, 22 nt, Variola virus
uaacgccuauacuauguuauau

SEQ ID NO: 4092420 - RNA, 17 nt, Variola virus
uaacgccuauucgaaau

SEQ ID NO: 4092421 - RNA, 22 nt, Variola virus
uaacguuccuaauucucucauu

SEQ ID NO: 4092422 - RNA, 17 nt, Variola virus
uaacguugguauuauau

SEQ ID NO: 4092423 - RNA, 19 nt, Variola virus
ucgaucggugaaaagucuu

SEQ ID NO: 4092424 - RNA, 19 nt, Variola virus
ucgauuguuuauuguauau

SEQ ID NO: 4092425 - RNA, 23 nt, Variola virus
ucgcaaacuauucuaauacauaa

SEQ ID NO: 4092426 - RNA, 16 nt, Variola virus
ucgcgcuuuacauucu

SEQ ID NO: 4092427 - RNA, 16 nt, Variola virus
ucgcuaaaaucuucau

SEQ ID NO: 4092428 - RNA, 12 nt, Variola virus
ucggauagaguu

SEQ ID NO: 4092429 - RNA, 17 nt, Variola virus
ucguaaaucuuuucacg

SEQ ID NO: 4092430 - RNA, 19 nt, Variola virus
ucguaauuagguucuaaug

SEQ ID NO: 4092431 - RNA, 17 nt, Variola virus
ucguacuuuauaucgug

SEQ ID NO: 4092432 - RNA, 21 nt, Variola virus
ucguauaucaucaucugaaau

SEQ ID NO: 4092433 - RNA, 20 nt, Variola virus
ucguauuucauaaaaguuau

SEQ ID NO: 4092434 - RNA, 19 nt, Variola virus
ucgucaaaauauuuacuaa

SEQ ID NO: 4092435 - RNA, 13 nt, Variola virus
ucgucuaaaguuu

SEQ ID NO: 4092436 - RNA, 11 nt, Variola virus
ucguuaaccaa

SEQ ID NO: 4092437 - RNA, 11 nt, Variola virus
ucguuaaugaa

SEQ ID NO: 4092438 - RNA, 13 nt, Variola virus
ucguucucuaaau

SEQ ID NO: 4092439 - RNA, 15 nt, Variola virus
ucguucucugaaaau

SEQ ID NO: 4092440 - RNA, 20 nt, Variola virus
ucguucugcuaaauuuucau

SEQ ID NO: 4092441 - RNA, 15 nt, Variola virus
ucguucuuaucccaa

SEQ ID NO: 4092442 - RNA, 13 nt, Variola virus
ucguuuacaaaau

SEQ ID NO: 4092443 - RNA, 20 nt, Variola virus
ucuaaaacaauaaaugcauu

SEQ ID NO: 4092444 - RNA, 23 nt, Variola virus
ucuaaaauuuccaucucuaucua

SEQ ID NO: 4092445 - RNA, 16 nt, Variola virus
ucuaaaccuucuuauu

SEQ ID NO: 4092446 - RNA, 23 nt, Variola virus
ucuaaauauuuuagaacacuguu

SEQ ID NO: 4092447 - RNA, 22 nt, Variola virus
ucuaaaugaugauauaccuguu

SEQ ID NO: 4092448 - RNA, 20 nt, Variola virus
ucuaaauuauauuuauuauu

SEQ ID NO: 4092449 - RNA, 16 nt, Variola virus
ucuaacaaacaucuca

SEQ ID NO: 4092450 - RNA, 14 nt, Variola virus
ucuaacaucaucau

SEQ ID NO: 4092451 - RNA, 21 nt, Variola virus
ucuaacuggugaguuaauauu

SEQ ID NO: 4092452 - RNA, 20 nt, Variola virus
ucuaagacgucucauuucua

SEQ ID NO: 4092453 - RNA, 14 nt, Variola virus
ucuaagauguugua

SEQ ID NO: 4092454 - RNA, 21 nt, Variola virus
ucuaauacuuuaacaugugua

SEQ ID NO: 4092455 - RNA, 17 nt, Variola virus
ucuaauucuacauaugg

SEQ ID NO: 4092456 - RNA, 13 nt, Variola virus
ucuacaucuucaa

SEQ ID NO: 4092457 - RNA, 15 nt, Variola virus
ucuacauuuucaguc

SEQ ID NO: 4092458 - RNA, 13 nt, Variola virus
ucuacauuuugcu

SEQ ID NO: 4092459 - RNA, 18 nt, Variola virus
ucuaccguuguuaaauac

SEQ ID NO: 4092460 - RNA, 14 nt, Variola virus
ucuacuauucuauu

SEQ ID NO: 4092461 - RNA, 17 nt, Variola virus
ucuacuauuuguguauu

SEQ ID NO: 4092462 - RNA, 17 nt, Variola virus
ucuagacgugaugugua

SEQ ID NO: 4092463 - RNA, 14 nt, Variola virus
ucuagacuccgcau

SEQ ID NO: 4092464 - RNA, 14 nt, Variola virus
ucuagauacaaaau

SEQ ID NO: 4092465 - RNA, 17 nt, Variola virus
ucuagauccucucuuca

SEQ ID NO: 4092466 - RNA, 18 nt, Variola virus
ucuagauccucucuucaa

SEQ ID NO: 4092467 - RNA, 17 nt, Variola virus
ucuagauguagaagcau

SEQ ID NO: 4092468 - RNA, 13 nt, Variola virus
ucuagcauuucua

SEQ ID NO: 4092469 - RNA, 15 nt, Variola virus
ucuagccauaucuaa

SEQ ID NO: 4092470 - RNA, 21 nt, Variola virus
ucuagccucgguaaucuguac

SEQ ID NO: 4092471 - RNA, 21 nt, Variola virus
ucuagcguugcuucuacauaa

SEQ ID NO: 4092472 - RNA, 21 nt, Variola virus
ucuagguagaccguuaaugaa

SEQ ID NO: 4092473 - RNA, 14 nt, Variola virus
ucuauaaacugaau

SEQ ID NO: 4092474 - RNA, 14 nt, Variola virus
ucuauaaauguaga

SEQ ID NO: 4092475 - RNA, 19 nt, Variola virus
ucuauaaucacuauucaga

SEQ ID NO: 4092476 - RNA, 18 nt, Variola virus
ucuauacccauuauguaa

SEQ ID NO: 4092477 - RNA, 15 nt, Variola virus
ucuauagauggagua

SEQ ID NO: 4092478 - RNA, 12 nt, Variola virus
ucuauaggaaag

SEQ ID NO: 4092479 - RNA, 19 nt, Variola virus
ucuauaucguccuucuuaa

SEQ ID NO: 4092480 - RNA, 14 nt, Variola virus
ucuauaucuaaaau

SEQ ID NO: 4092481 - RNA, 14 nt, Variola virus
ucuaucaaagcuuu

SEQ ID NO: 4092482 - RNA, 22 nt, Variola virus
ucuauccauuugucuuccuuaa

SEQ ID NO: 4092483 - RNA, 21 nt, Variola virus
ucuaucccccguauuuacauu

SEQ ID NO: 4092484 - RNA, 15 nt, Variola virus
ucuaucgacuucaga

SEQ ID NO: 4092485 - RNA, 17 nt, Variola virus
ucuaucgcauguggaug

SEQ ID NO: 4092486 - RNA, 16 nt, Variola virus
ucuaucuuuuauuuua

SEQ ID NO: 4092487 - RNA, 13 nt, Variola virus
ucuaugucucuua

SEQ ID NO: 4092488 - RNA, 19 nt, Variola virus
ucuauuccaaauauucaga

SEQ ID NO: 4092489 - RNA, 17 nt, Variola virus
ucuauuccuagaagugu

SEQ ID NO: 4092490 - RNA, 12 nt, Variola virus
ucuauuuggauu

SEQ ID NO: 4092491 - RNA, 14 nt, Variola virus
ucucaagauuuuaa

SEQ ID NO: 4092492 - RNA, 16 nt, Variola virus
ucucacugaauacgag

SEQ ID NO: 4092493 - RNA, 22 nt, Variola virus
ucucacugaauacgaggaugau

SEQ ID NO: 4092494 - RNA, 20 nt, Variola virus
ucucauaacugcucuagauu

SEQ ID NO: 4092495 - RNA, 22 nt, Variola virus
ucucaugguaucgauuacaccu

SEQ ID NO: 4092496 - RNA, 15 nt, Variola virus
ucucauuuucuucaa

SEQ ID NO: 4092497 - RNA, 14 nt, Variola virus
ucuccccaaacauu

SEQ ID NO: 4092498 - RNA, 20 nt, Variola virus
ucuccgcaauacauuucuca

SEQ ID NO: 4092499 - RNA, 16 nt, Variola virus
ucucuaagagcuacgu

SEQ ID NO: 4092500 - RNA, 19 nt, Variola virus
ucucuaaguuaacacaugu

SEQ ID NO: 4092501 - RNA, 22 nt, Variola virus
ucucuauaaacgaugguuuaau

SEQ ID NO: 4092502 - RNA, 19 nt, Variola virus
ucucuauucugaaauaauu

SEQ ID NO: 4092503 - RNA, 19 nt, Variola virus
ucucucaaucacuacaucu

SEQ ID NO: 4092504 - RNA, 22 nt, Variola virus
ucucuuuuguagaacuuaacuu

SEQ ID NO: 4092505 - RNA, 13 nt, Variola virus
ucugaaauaauca

SEQ ID NO: 4092506 - RNA, 20 nt, Variola virus
ucugaacccguuaauguaua

SEQ ID NO: 4092507 - RNA, 19 nt, Variola virus
ucugaaguaguuucuaaua

SEQ ID NO: 4092508 - RNA, 20 nt, Variola virus
ucugacuggguuguaauguu

SEQ ID NO: 4092509 - RNA, 15 nt, Variola virus
ucugaguauaguguu

SEQ ID NO: 4092510 - RNA, 17 nt, Variola virus
ucugauacaacaauaua

SEQ ID NO: 4092511 - RNA, 18 nt, Variola virus
ucugauggcgacauaauu

SEQ ID NO: 4092512 - RNA, 23 nt, Variola virus
ucugauuuuaucuuuuagagguu

SEQ ID NO: 4092513 - RNA, 15 nt, Variola virus
ucugcuuucuuuuaa

SEQ ID NO: 4092514 - RNA, 21 nt, Variola virus
ucuggaacauuuaacucauug

SEQ ID NO: 4092515 - RNA, 19 nt, Variola virus
ucugguugaagaaauccaa

SEQ ID NO: 4092516 - RNA, 16 nt, Variola virus
ucuguaacuaugaauu

SEQ ID NO: 4092517 - RNA, 15 nt, Variola virus
ucuguacaaaaguuu

SEQ ID NO: 4092518 - RNA, 23 nt, Variola virus
ucuguaguuguauccguuucaga

SEQ ID NO: 4092519 - RNA, 16 nt, Variola virus
ucugucgaaaaaguag

SEQ ID NO: 4092520 - RNA, 16 nt, Variola virus
ucuguuuuauuaaccg

SEQ ID NO: 4092521 - RNA, 21 nt, Variola virus
ucuuaaagccauacauuuaga

SEQ ID NO: 4092522 - RNA, 20 nt, Variola virus
ucuuaaggagaaugaaacag

SEQ ID NO: 4092523 - RNA, 15 nt, Variola virus
ucuuaauagacauau

SEQ ID NO: 4092524 - RNA, 22 nt, Variola virus
ucuuacauauuuuuuucuuauu

SEQ ID NO: 4092525 - RNA, 19 nt, Variola virus
ucuuaccaucuucuuugau

SEQ ID NO: 4092526 - RNA, 14 nt, Variola virus
ucuuagcgaaugau

SEQ ID NO: 4092527 - RNA, 13 nt, Variola virus
ucuuauagaugug

SEQ ID NO: 4092528 - RNA, 16 nt, Variola virus
ucuuauagcaugaauu

SEQ ID NO: 4092529 - RNA, 13 nt, Variola virus
ucuuauguggauc

SEQ ID NO: 4092530 - RNA, 20 nt, Variola virus
ucuuauuggucagaaguuuu

SEQ ID NO: 4092531 - RNA, 13 nt, Variola virus
ucuucaaauucca

SEQ ID NO: 4092532 - RNA, 21 nt, Variola virus
ucuucacuagugggaaucaau

SEQ ID NO: 4092533 - RNA, 19 nt, Variola virus
ucuucauaugauccaaauu

SEQ ID NO: 4092534 - RNA, 21 nt, Variola virus
ucuuccagcauccguuucuaa

SEQ ID NO: 4092535 - RNA, 15 nt, Variola virus
ucuuccuucgauaga

SEQ ID NO: 4092536 - RNA, 15 nt, Variola virus
ucuucugaaacacca

SEQ ID NO: 4092537 - RNA, 21 nt, Variola virus
ucuucugauaucauuaaugau

SEQ ID NO: 4092538 - RNA, 15 nt, Variola virus
ucuucuggaaccuca

SEQ ID NO: 4092539 - RNA, 22 nt, Variola virus
ucuucuuauaagauuguagaau

SEQ ID NO: 4092540 - RNA, 17 nt, Variola virus
ucuugaaacuuuucaga

SEQ ID NO: 4092541 - RNA, 15 nt, Variola virus
ucuugauuacaaaac

SEQ ID NO: 4092542 - RNA, 19 nt, Variola virus
ucuuggauaaaagcaucca

SEQ ID NO: 4092543 - RNA, 15 nt, Variola virus
ucuuguaucauauau

SEQ ID NO: 4092544 - RNA, 18 nt, Variola virus
ucuuuaaaaauuuaaaau

SEQ ID NO: 4092545 - RNA, 14 nt, Variola virus
ucuuuaaugugaaa

SEQ ID NO: 4092546 - RNA, 15 nt, Variola virus
ucuuuaccuuaagaa

SEQ ID NO: 4092547 - RNA, 16 nt, Variola virus
ucuuuuauuuuaucua

SEQ ID NO: 4092548 - RNA, 19 nt, Variola virus
ugaaauaaccgcaugauua

SEQ ID NO: 4092549 - RNA, 17 nt, Variola virus
ugaaauaauuagaacua

SEQ ID NO: 4092550 - RNA, 15 nt, Variola virus
ugaaauauaguaaua

SEQ ID NO: 4092551 - RNA, 19 nt, Variola virus
ugaaaucaguggaguagua

SEQ ID NO: 4092552 - RNA, 16 nt, Variola virus
ugaaaugauaacuguu

SEQ ID NO: 4092553 - RNA, 13 nt, Variola virus
ugaacaauacuac

SEQ ID NO: 4092554 - RNA, 14 nt, Variola virus
ugaacauuauuaau

SEQ ID NO: 4092555 - RNA, 24 nt, Variola virus
ugaacauuuaagagaucaaagcau

SEQ ID NO: 4092556 - RNA, 22 nt, Variola virus
ugaaccaguaccagaucuuaau

SEQ ID NO: 4092557 - RNA, 17 nt, Variola virus
ugaaccgggaucauuau

SEQ ID NO: 4092558 - RNA, 15 nt, Variola virus
ugaagaaaaauguug

SEQ ID NO: 4092559 - RNA, 15 nt, Variola virus
ugaagaaaguaauua

SEQ ID NO: 4092560 - RNA, 11 nt, Variola virus
ugaagaaauga

SEQ ID NO: 4092561 - RNA, 12 nt, Variola virus
ugaagaacacau

SEQ ID NO: 4092562 - RNA, 15 nt, Variola virus
ugaagaagaaaacaa

SEQ ID NO: 4092563 - RNA, 19 nt, Variola virus
ugaagaagaaaacaaacau

SEQ ID NO: 4092564 - RNA, 22 nt, Variola virus
ugaaguauuuguuguauucauu

SEQ ID NO: 4092565 - RNA, 22 nt, Variola virus
ugaaguuaaugauacacacuau

SEQ ID NO: 4092566 - RNA, 19 nt, Variola virus
ugaauaaucagauuuaccc

SEQ ID NO: 4092567 - RNA, 22 nt, Variola virus
ugaauagcaaaauuuuuacuau

SEQ ID NO: 4092568 - RNA, 18 nt, Variola virus
ugaauauagaacaucauu

SEQ ID NO: 4092569 - RNA, 14 nt, Variola virus
ugaaucaaauguaa

SEQ ID NO: 4092570 - RNA, 16 nt, Variola virus
ugaauucucauuuugc

SEQ ID NO: 4092571 - RNA, 22 nt, Variola virus
ugaauuugauuauuuugaagac

SEQ ID NO: 4092572 - RNA, 16 nt, Variola virus
ugacacuaucuucugu

SEQ ID NO: 4092573 - RNA, 18 nt, Variola virus
ugacaucauacuagauaa

SEQ ID NO: 4092574 - RNA, 22 nt, Variola virus
ugacaugauuaagauugcucuu

SEQ ID NO: 4092575 - RNA, 17 nt, Variola virus
ugacauuuauucaucau

SEQ ID NO: 4092576 - RNA, 14 nt, Variola virus
ugacauuuuggauu

SEQ ID NO: 4092577 - RNA, 13 nt, Variola virus
ugacgcuguaaaa

SEQ ID NO: 4092578 - RNA, 19 nt, Variola virus
ugacgucguucuacauaaa

SEQ ID NO: 4092579 - RNA, 19 nt, Variola virus
ugacuagacugauuucucu

SEQ ID NO: 4092580 - RNA, 16 nt, Variola virus
ugacuccuauauuucc

SEQ ID NO: 4092581 - RNA, 17 nt, Variola virus
ugacuccuauauuuccc

SEQ ID NO: 4092582 - RNA, 19 nt, Variola virus
ugacuccuuucuaauauag

SEQ ID NO: 4092583 - RNA, 12 nt, Variola virus
ugacuguauuug

SEQ ID NO: 4092584 - RNA, 19 nt, Variola virus
ugacuucauugauaucuuu

SEQ ID NO: 4092585 - RNA, 22 nt, Variola virus
ugacuuuccugccgaauuuaga

SEQ ID NO: 4092586 - RNA, 18 nt, Variola virus
ugagagaucuacugguga

SEQ ID NO: 4092587 - RNA, 17 nt, Variola virus
ugagagucaauaucauu

SEQ ID NO: 4092588 - RNA, 20 nt, Variola virus
ugagagucuuauauguagca

SEQ ID NO: 4092589 - RNA, 16 nt, Variola virus
ugagauaucucauuaa

SEQ ID NO: 4092590 - RNA, 22 nt, Variola virus
ugagaucccacaucauuucaac

SEQ ID NO: 4092591 - RNA, 23 nt, Variola virus
ugagauguuauuaaauguugaua

SEQ ID NO: 4092592 - RNA, 20 nt, Variola virus
ugagauugauguaauacuuu

SEQ ID NO: 4092593 - RNA, 14 nt, Variola virus
ugaggauaaugcua

SEQ ID NO: 4092594 - RNA, 14 nt, Variola virus
ugaggauauacaaa

SEQ ID NO: 4092595 - RNA, 15 nt, Variola virus
ugagguuuuuggaga

SEQ ID NO: 4092596 - RNA, 17 nt, Variola virus
ugaguauuuuacucauu

SEQ ID NO: 4092597 - RNA, 14 nt, Variola virus
ugaguuaauaugca

SEQ ID NO: 4092598 - RNA, 21 nt, Variola virus
ugauaaucauccuaagaugau

SEQ ID NO: 4092599 - RNA, 15 nt, Variola virus
ugauacguauauaca

SEQ ID NO: 4092600 - RNA, 11 nt, Variola virus
ugauacugaua

SEQ ID NO: 4092601 - RNA, 12 nt, Variola virus
ugauagcauugu

SEQ ID NO: 4092602 - RNA, 16 nt, Variola virus
ugauagcgguagaugu

SEQ ID NO: 4092603 - RNA, 17 nt, Variola virus
ugauaggcaauaaacau

SEQ ID NO: 4092604 - RNA, 17 nt, Variola virus
ugauauauaauuuaccg

SEQ ID NO: 4092605 - RNA, 18 nt, Variola virus
ugauaucuaguauugaua

SEQ ID NO: 4092606 - RNA, 21 nt, Variola virus
ugauaugauuaucguuuucau

SEQ ID NO: 4092607 - RNA, 21 nt, Variola virus
ugauauuggagcaaaauccua

SEQ ID NO: 4092608 - RNA, 13 nt, Variola virus
ugauauuuggauc

SEQ ID NO: 4092609 - RNA, 12 nt, Variola virus
ugauauuuguau

SEQ ID NO: 4092610 - RNA, 17 nt, Variola virus
ugauauuuugauguaca

SEQ ID NO: 4092611 - RNA, 16 nt, Variola virus
ugaucuaacuaagaua

SEQ ID NO: 4092612 - RNA, 17 nt, Variola virus
ugaucuaugacaucaug

SEQ ID NO: 4092613 - RNA, 20 nt, Variola virus
ugaugaaagauaaacuagau

SEQ ID NO: 4092614 - RNA, 19 nt, Variola virus
ugaugaacgacuggauguu

SEQ ID NO: 4092615 - RNA, 16 nt, Variola virus
ugaugaaucagacaau

SEQ ID NO: 4092616 - RNA, 17 nt, Variola virus
ugaugacacuagaugau

SEQ ID NO: 4092617 - RNA, 22 nt, Variola virus
ugaugagauguuauuaaauguu

SEQ ID NO: 4092618 - RNA, 16 nt, Variola virus
ugaugaugaaaugaua

SEQ ID NO: 4092619 - RNA, 17 nt, Variola virus
ugaugcuuaaaaugcuc

SEQ ID NO: 4092620 - RNA, 18 nt, Variola virus
ugaugucguuaaauuuga

SEQ ID NO: 4092621 - RNA, 19 nt, Variola virus
ugaugucguuauucugaaa

SEQ ID NO: 4092622 - RNA, 21 nt, Variola virus
ugauuaaucaauuaguagaga

SEQ ID NO: 4092623 - RNA, 22 nt, Variola virus
ugauuaaugauuuagaaaugaa

SEQ ID NO: 4092624 - RNA, 12 nt, Variola virus
ugauuacuacau

SEQ ID NO: 4092625 - RNA, 14 nt, Variola virus
ugauuagaaaauau

SEQ ID NO: 4092626 - RNA, 16 nt, Variola virus
ugauuauaguuucuau

SEQ ID NO: 4092627 - RNA, 14 nt, Variola virus
ugauuauuagauuu

SEQ ID NO: 4092628 - RNA, 23 nt, Variola virus
ugauucuguagaugccauaucau

SEQ ID NO: 4092629 - RNA, 13 nt, Variola virus
ugauugaacgauu

SEQ ID NO: 4092630 - RNA, 19 nt, Variola virus
ugauugugucucaaaugcc

SEQ ID NO: 4092631 - RNA, 18 nt, Variola virus
ugauuguuugacaaauca

SEQ ID NO: 4092632 - RNA, 15 nt, Variola virus
ugauuucuugaacau

SEQ ID NO: 4092633 - RNA, 19 nt, Variola virus
ugauuuggccaaauguacc

SEQ ID NO: 4092634 - RNA, 21 nt, Variola virus
ugauuuuaacgacgacauauu

SEQ ID NO: 4092635 - RNA, 17 nt, Variola virus
ugcaaugaauaucuaca

SEQ ID NO: 4092636 - RNA, 18 nt, Variola virus
ugcacagcgaagaauucu

SEQ ID NO: 4092637 - RNA, 23 nt, Variola virus
ugcauacaauacuagucuagaaa

SEQ ID NO: 4092638 - RNA, 23 nt, Variola virus
ugcaucuaaaagcgaugcuacgc

SEQ ID NO: 4092639 - RNA, 15 nt, Variola virus
ugcaucuacaucauc

SEQ ID NO: 4092640 - RNA, 23 nt, Variola virus
ugcaucuauauaaucuuuuucau

SEQ ID NO: 4092641 - RNA, 13 nt, Variola virus
ugcauguuuucau

SEQ ID NO: 4092642 - RNA, 14 nt, Variola virus
ugccagauacauac

SEQ ID NO: 4092643 - RNA, 14 nt, Variola virus
ugccauaauaauua

SEQ ID NO: 4092644 - RNA, 15 nt, Variola virus
ugccaucuuacauga

SEQ ID NO: 4092645 - RNA, 23 nt, Variola virus
ugccgaacuaaaaaaaauaacuu

SEQ ID NO: 4092646 - RNA, 14 nt, Variola virus
ugccuaguacugua

SEQ ID NO: 4092647 - RNA, 15 nt, Variola virus
ugcguuuagcaucua

SEQ ID NO: 4092648 - RNA, 14 nt, Variola virus
ugcuaaauuuucau

SEQ ID NO: 4092649 - RNA, 13 nt, Variola virus
ugcuaauauacaa

SEQ ID NO: 4092650 - RNA, 19 nt, Variola virus
ugcuaauauauucuuacag

SEQ ID NO: 4092651 - RNA, 13 nt, Variola virus
ugcuagaacaacu

SEQ ID NO: 4092652 - RNA, 17 nt, Variola virus
ugcuauaccuaauacua

SEQ ID NO: 4092653 - RNA, 17 nt, Variola virus
ugcuaugaaguugucua

SEQ ID NO: 4092654 - RNA, 22 nt, Variola virus
ugcucggcaguaaucaacaaua

SEQ ID NO: 4092655 - RNA, 22 nt, Variola virus
ugcucuacaugcgguaaagaua

SEQ ID NO: 4092656 - RNA, 22 nt, Variola virus
ugcucuagauacugcaaaacuu

SEQ ID NO: 4092657 - RNA, 15 nt, Variola virus
ugcucugcaauaacu

SEQ ID NO: 4092658 - RNA, 13 nt, Variola virus
ugcugucaaacaa

SEQ ID NO: 4092659 - RNA, 15 nt, Variola virus
ugcuguuguacauac

SEQ ID NO: 4092660 - RNA, 22 nt, Variola virus
ugcuuaauacaccguuaacaau

SEQ ID NO: 4092661 - RNA, 16 nt, Variola virus
ugcuuuagugaaauuu

SEQ ID NO: 4092662 - RNA, 22 nt, Variola virus
ugcuuuuaucaggauaaauaca

SEQ ID NO: 4092663 - RNA, 13 nt, Variola virus
uggaaaaaugaug

SEQ ID NO: 4092664 - RNA, 21 nt, Variola virus
uggaaaaaugaugaauuaaug

SEQ ID NO: 4092665 - RNA, 13 nt, Variola virus
uggaaagauauca

SEQ ID NO: 4092666 - RNA, 13 nt, Variola virus
uggaaauguuaua

SEQ ID NO: 4092667 - RNA, 23 nt, Variola virus
uggaaauguuauagaaaauuaaa

SEQ ID NO: 4092668 - RNA, 21 nt, Variola virus
uggaagaaggauggaaagaua

SEQ ID NO: 4092669 - RNA, 14 nt, Variola virus
uggaaguuccaaac

SEQ ID NO: 4092670 - RNA, 15 nt, Variola virus
uggaauaucaaaucu

SEQ ID NO: 4092671 - RNA, 19 nt, Variola virus
uggaauaucauuaacuguu

SEQ ID NO: 4092672 - RNA, 19 nt, Variola virus
uggaaugacgaauccuguu

SEQ ID NO: 4092673 - RNA, 23 nt, Variola virus
uggaaugacgaauccuguuucua

SEQ ID NO: 4092674 - RNA, 23 nt, Variola virus
uggaaugcuguuuaauguuucca

SEQ ID NO: 4092675 - RNA, 21 nt, Variola virus
uggaauucaguuggaauauug

SEQ ID NO: 4092676 - RNA, 22 nt, Variola virus
uggaauugauuucgucaaugua

SEQ ID NO: 4092677 - RNA, 15 nt, Variola virus
uggacaaaucuggaa

SEQ ID NO: 4092678 - RNA, 20 nt, Variola virus
uggacgaucuauuagaaaau

SEQ ID NO: 4092679 - RNA, 13 nt, Variola virus
uggagaagguuuc

SEQ ID NO: 4092680 - RNA, 14 nt, Variola virus
uggagaucuaaaga

SEQ ID NO: 4092681 - RNA, 21 nt, Variola virus
ucaaauucucauucauguaua

SEQ ID NO: 4092682 - RNA, 16 nt, Variola virus
ucaaauuguccuauau

SEQ ID NO: 4092683 - RNA, 18 nt, Variola virus
ucaacaauaugcaaauag

SEQ ID NO: 4092684 - RNA, 23 nt, Variola virus
ucaacaaugucugucauauguau

SEQ ID NO: 4092685 - RNA, 21 nt, Variola virus
ucaacaauuuuguauuauucu

SEQ ID NO: 4092686 - RNA, 13 nt, Variola virus
ucaacacuuauau

SEQ ID NO: 4092687 - RNA, 20 nt, Variola virus
ucaacauaaauaauucuaga

SEQ ID NO: 4092688 - RNA, 21 nt, Variola virus
ucaacggaugaguuaauguau

SEQ ID NO: 4092689 - RNA, 13 nt, Variola virus
ucaacuuauucuc

SEQ ID NO: 4092690 - RNA, 20 nt, Variola virus
ucaagaucuaauauucuaga

SEQ ID NO: 4092691 - RNA, 21 nt, Variola virus
ucaagcuaggcuggaaacuau

SEQ ID NO: 4092692 - RNA, 18 nt, Variola virus
ucaaggaaaaagaugcua

SEQ ID NO: 4092693 - RNA, 20 nt, Variola virus
ucaaggacaguuaaaacuau

SEQ ID NO: 4092694 - RNA, 11 nt, Variola virus
ucaaggauucu

SEQ ID NO: 4092695 - RNA, 19 nt, Variola virus
ucaagucaauuaucuuauu

SEQ ID NO: 4092696 - RNA, 13 nt, Variola virus
ucaagucauaaau

SEQ ID NO: 4092697 - RNA, 18 nt, Variola virus
ucaaguccaauguuuuua

SEQ ID NO: 4092698 - RNA, 16 nt, Variola virus
ucaauagaauaaacca

SEQ ID NO: 4092699 - RNA, 20 nt, Variola virus
ucaauagaauaugucucuua

SEQ ID NO: 4092700 - RNA, 15 nt, Variola virus
ucaauagauuauaca

SEQ ID NO: 4092701 - RNA, 21 nt, Variola virus
ucaauagcaguuuauuaucca

SEQ ID NO: 4092702 - RNA, 18 nt, Variola virus
ucaauauauuaagaaguu

SEQ ID NO: 4092703 - RNA, 15 nt, Variola virus
ucaaucccuaagucu

SEQ ID NO: 4092704 - RNA, 13 nt, Variola virus
ucaaugaauuaug

SEQ ID NO: 4092705 - RNA, 20 nt, Variola virus
ucaauggaccccaacaucuu

SEQ ID NO: 4092706 - RNA, 13 nt, Variola virus
ucaauuaauguac

SEQ ID NO: 4092707 - RNA, 22 nt, Variola virus
ucaauuacacuauuugucuuaa

SEQ ID NO: 4092708 - RNA, 12 nt, Variola virus
ucaauuauacuc

SEQ ID NO: 4092709 - RNA, 13 nt, Variola virus
ucacaacauuucu

SEQ ID NO: 4092710 - RNA, 21 nt, Variola virus
ucacagcuccaucaguuuuau

SEQ ID NO: 4092711 - RNA, 17 nt, Variola virus
ucacauccuuuauuuua

SEQ ID NO: 4092712 - RNA, 14 nt, Variola virus
ucaccaacuacaua

SEQ ID NO: 4092713 - RNA, 22 nt, Variola virus
ucaccguuacgguaauuuuuga

SEQ ID NO: 4092714 - RNA, 21 nt, Variola virus
ucacgauaccggaaaaugcga

SEQ ID NO: 4092715 - RNA, 16 nt, Variola virus
ucacuaacaauaacua

SEQ ID NO: 4092716 - RNA, 20 nt, Variola virus
ucacuaauaucaauauacaa

SEQ ID NO: 4092717 - RNA, 19 nt, Variola virus
ucacuagguaguaauuuga

SEQ ID NO: 4092718 - RNA, 15 nt, Variola virus
ucacucaauaucuag

SEQ ID NO: 4092719 - RNA, 17 nt, Variola virus
ucacugaguuuacagau

SEQ ID NO: 4092720 - RNA, 17 nt, Variola virus
ucacugucacugucacu

SEQ ID NO: 4092721 - RNA, 19 nt, Variola virus
ucacuucuucaacuaccaa

SEQ ID NO: 4092722 - RNA, 16 nt, Variola virus
ucagaaagcuguggau

SEQ ID NO: 4092723 - RNA, 13 nt, Variola virus
ucagaaauuauuc

SEQ ID NO: 4092724 - RNA, 19 nt, Variola virus
ucagacgauccacaaucaa

SEQ ID NO: 4092725 - RNA, 16 nt, Variola virus
ucagauauaaaaaucu

SEQ ID NO: 4092726 - RNA, 16 nt, Variola virus
ucagauuuauacauau

SEQ ID NO: 4092727 - RNA, 21 nt, Variola virus
ucaggacgaauaauucuaaua

SEQ ID NO: 4092728 - RNA, 21 nt, Variola virus
ucaguucaauaacuacacauc

SEQ ID NO: 4092729 - RNA, 22 nt, Variola virus
ucaguugcauuuucaacacucg

SEQ ID NO: 4092730 - RNA, 18 nt, Variola virus
ucaguugcuguugaagag

SEQ ID NO: 4092731 - RNA, 16 nt, Variola virus
ucauaaccauuucuau

SEQ ID NO: 4092732 - RNA, 13 nt, Variola virus
ucauacagacacu

SEQ ID NO: 4092733 - RNA, 18 nt, Variola virus
ucauacuuguuaguaguu

SEQ ID NO: 4092734 - RNA, 15 nt, Variola virus
ucauauaacaacaaa

SEQ ID NO: 4092735 - RNA, 18 nt, Variola virus
ucauauacaacucucuaa

SEQ ID NO: 4092736 - RNA, 19 nt, Variola virus
ucauauauuuauagaagau

SEQ ID NO: 4092737 - RNA, 18 nt, Variola virus
ucauaugacauuucauga

SEQ ID NO: 4092738 - RNA, 14 nt, Variola virus
ucauauguaguguu

SEQ ID NO: 4092739 - RNA, 19 nt, Variola virus
ucaucaaaagacuuaugau

SEQ ID NO: 4092740 - RNA, 23 nt, Variola virus
ucauccguggauauuugauuuuu

SEQ ID NO: 4092741 - RNA, 16 nt, Variola virus
ucaucggaucuguaaa

SEQ ID NO: 4092742 - RNA, 19 nt, Variola virus
ucaucuaccaacgguauau

SEQ ID NO: 4092743 - RNA, 12 nt, Variola virus
ucaucuagaaug

SEQ ID NO: 4092744 - RNA, 19 nt, Variola virus
ucaucuauagaucauguaa

SEQ ID NO: 4092745 - RNA, 14 nt, Variola virus
ucaucuaucauaga

SEQ ID NO: 4092746 - RNA, 16 nt, Variola virus
ucaucucuagauaugu

SEQ ID NO: 4092747 - RNA, 17 nt, Variola virus
ucaucuugucuagaaug

SEQ ID NO: 4092748 - RNA, 13 nt, Variola virus
ucaugaacauaau

SEQ ID NO: 4092749 - RNA, 17 nt, Variola virus
ucaugaaucaauuagua

SEQ ID NO: 4092750 - RNA, 14 nt, Variola virus
ucaugacaaucaau

SEQ ID NO: 4092751 - RNA, 20 nt, Variola virus
ucaugguaaggucuuagaaa

SEQ ID NO: 4092752 - RNA, 16 nt, Variola virus
ucauguuuauuucuag

SEQ ID NO: 4092753 - RNA, 11 nt, Variola virus
ucauuaaacag

SEQ ID NO: 4092754 - RNA, 23 nt, Variola virus
ucauuaaacagcauuucugucaa

SEQ ID NO: 4092755 - RNA, 20 nt, Variola virus
ucauuaacuagacguuuauu

SEQ ID NO: 4092756 - RNA, 18 nt, Variola virus
ucauuacuaauagaguau

SEQ ID NO: 4092757 - RNA, 20 nt, Variola virus
ucauuauuacgucuguaguc

SEQ ID NO: 4092758 - RNA, 15 nt, Variola virus
ucauucaucuagaau

SEQ ID NO: 4092759 - RNA, 12 nt, Variola virus
ucauugauuuua

SEQ ID NO: 4092760 - RNA, 12 nt, Variola virus
ucauugauuuuu

SEQ ID NO: 4092761 - RNA, 15 nt, Variola virus
ucauuuggagaguau

SEQ ID NO: 4092762 - RNA, 14 nt, Variola virus
ucauuuguauacac

SEQ ID NO: 4092763 - RNA, 18 nt, Variola virus
ucauuuucuucaacaaau

SEQ ID NO: 4092764 - RNA, 16 nt, Variola virus
uccaaaaacaauuuga

SEQ ID NO: 4092765 - RNA, 17 nt, Variola virus
uccaaaaagaaugagua

SEQ ID NO: 4092766 - RNA, 20 nt, Variola virus
uccaaacuguugacuucacu

SEQ ID NO: 4092767 - RNA, 15 nt, Variola virus
uccaacuccuuuucg

SEQ ID NO: 4092768 - RNA, 19 nt, Variola virus
uccaauaaacagucuuuaa

SEQ ID NO: 4092769 - RNA, 12 nt, Variola virus
uccaauguuuaa

SEQ ID NO: 4092770 - RNA, 14 nt, Variola virus
uccaauuacaaaaa

SEQ ID NO: 4092771 - RNA, 21 nt, Variola virus
uccacugagaugacuggaaau

SEQ ID NO: 4092772 - RNA, 18 nt, Variola virus
uccacugucacuggaaag

SEQ ID NO: 4092773 - RNA, 17 nt, Variola virus
uccagaauguuucaaag

SEQ ID NO: 4092774 - RNA, 19 nt, Variola virus
uccagaauuguaacaacaa

SEQ ID NO: 4092775 - RNA, 16 nt, Variola virus
uccagauagaaaauau

SEQ ID NO: 4092776 - RNA, 15 nt, Variola virus
uccagaugaaugggu

SEQ ID NO: 4092777 - RNA, 20 nt, Variola virus
uccagcguuacuauacacaa

SEQ ID NO: 4092778 - RNA, 22 nt, Variola virus
uccaggaucguuucuacaaaau

SEQ ID NO: 4092779 - RNA, 17 nt, Variola virus
uccaguccaguguauaa

SEQ ID NO: 4092780 - RNA, 21 nt, Variola virus
uccauaaacaauauuaaggag

SEQ ID NO: 4092781 - RNA, 14 nt, Variola virus
uccauaauccucua

SEQ ID NO: 4092782 - RNA, 19 nt, Variola virus
uccauacauguuauuauca

SEQ ID NO: 4092783 - RNA, 22 nt, Variola virus
uccauaggcaguccagaaauau

SEQ ID NO: 4092784 - RNA, 21 nt, Variola virus
uccauauaccaaacuuucaga

SEQ ID NO: 4092785 - RNA, 17 nt, Variola virus
uccauauauguuuucau

SEQ ID NO: 4092786 - RNA, 20 nt, Variola virus
uccauaugacuaaaaugcug

SEQ ID NO: 4092787 - RNA, 19 nt, Variola virus
uccauauuucuuaauguaa

SEQ ID NO: 4092788 - RNA, 17 nt, Variola virus
uccaucagaauguuucc

SEQ ID NO: 4092789 - RNA, 20 nt, Variola virus
uccaucaugaucugguuuug

SEQ ID NO: 4092790 - RNA, 21 nt, Variola virus
uccaucgguauaaaaaucauu

SEQ ID NO: 4092791 - RNA, 15 nt, Variola virus
uccaugaucaagaag

SEQ ID NO: 4092792 - RNA, 20 nt, Variola virus
uccauuuaaggcuuuaaaau

SEQ ID NO: 4092793 - RNA, 17 nt, Variola virus
ucccaauuccaaagauc

SEQ ID NO: 4092794 - RNA, 18 nt, Variola virus
ucccaccaaauuaaugaa

SEQ ID NO: 4092795 - RNA, 18 nt, Variola virus
ucccgcauuuauacauau

SEQ ID NO: 4092796 - RNA, 18 nt, Variola virus
uccgauuguuguguacau

SEQ ID NO: 4092797 - RNA, 20 nt, Variola virus
uccguauuguauuagaguau

SEQ ID NO: 4092798 - RNA, 21 nt, Variola virus
uccuaauauugguacaugccu

SEQ ID NO: 4092799 - RNA, 14 nt, Variola virus
uccuauuacauaua

SEQ ID NO: 4092800 - RNA, 13 nt, Variola virus
uccuauuaugaaa

SEQ ID NO: 4092801 - RNA, 21 nt, Variola virus
uccuccaguagcaugugguuc

SEQ ID NO: 4092802 - RNA, 17 nt, Variola virus
uccuccuguagauaugu

SEQ ID NO: 4092803 - RNA, 22 nt, Variola virus
uccugacgucuagaguuuauau

SEQ ID NO: 4092804 - RNA, 14 nt, Variola virus
uccuguaauacuuu

SEQ ID NO: 4092805 - RNA, 18 nt, Variola virus
uccuguauaugugaauau

SEQ ID NO: 4092806 - RNA, 20 nt, Variola virus
uccuuaagauguuugagaau

SEQ ID NO: 4092807 - RNA, 20 nt, Variola virus
uccuuaauucuagcaucuuc

SEQ ID NO: 4092808 - RNA, 14 nt, Variola virus
uccuuacacaaaua

SEQ ID NO: 4092809 - RNA, 17 nt, Variola virus
uccuuggaauugauaga

SEQ ID NO: 4092810 - RNA, 14 nt, Variola virus
uccuuuuacuacaa

SEQ ID NO: 4092811 - RNA, 11 nt, Variola virus
ucgaaaacuag

SEQ ID NO: 4092812 - RNA, 19 nt, Variola virus
ucgaaauaauauuauccuu

SEQ ID NO: 4092813 - RNA, 13 nt, Variola virus
ucgaauaaaguau

SEQ ID NO: 4092814 - RNA, 22 nt, Variola virus
ucgaauaaguuugcagacaaac

SEQ ID NO: 4092815 - RNA, 12 nt, Variola virus
ucgaauacuuau

SEQ ID NO: 4092816 - RNA, 18 nt, Variola virus
ucgaaucagaagucauac

SEQ ID NO: 4092817 - RNA, 18 nt, Variola virus
ucgaaugccauagaauaa

SEQ ID NO: 4092818 - RNA, 16 nt, Variola virus
ucgacucaguauacaa

SEQ ID NO: 4092819 - RNA, 17 nt, Variola virus
ucgauaacacauuuuca

SEQ ID NO: 4092820 - RNA, 13 nt, Variola virus
ucgauaauuauuu

SEQ ID NO: 4092821 - RNA, 15 nt, Variola virus
ucgauacauuuugca

SEQ ID NO: 4092822 - RNA, 16 nt, Variola virus
ucgauagaggaaguau

SEQ ID NO: 4092823 - RNA, 13 nt, Variola virus
ccuagcuuuguua

SEQ ID NO: 4092824 - RNA, 17 nt, Variola virus
ccuagucauauguuuaa

SEQ ID NO: 4092825 - RNA, 16 nt, Variola virus
ccuauaaacaugaauu

SEQ ID NO: 4092826 - RNA, 16 nt, Variola virus
ccuauacuauguuaua

SEQ ID NO: 4092827 - RNA, 14 nt, Variola virus
ccuaucauguauuu

SEQ ID NO: 4092828 - RNA, 15 nt, Variola virus
ccuauucccaacaau

SEQ ID NO: 4092829 - RNA, 16 nt, Variola virus
ccuauucuaaauggau

SEQ ID NO: 4092830 - RNA, 17 nt, Variola virus
ccucaaacucuauuuua

SEQ ID NO: 4092831 - RNA, 23 nt, Variola virus
ccucucaccagaagaggagcuac

SEQ ID NO: 4092832 - RNA, 17 nt, Variola virus
ccugccauuuuagagau

SEQ ID NO: 4092833 - RNA, 21 nt, Variola virus
ccugguagacggaauguuuua

SEQ ID NO: 4092834 - RNA, 13 nt, Variola virus
ccuguaacaaaaa

SEQ ID NO: 4092835 - RNA, 12 nt, Variola virus
ccuguguuuaua

SEQ ID NO: 4092836 - RNA, 21 nt, Variola virus
ccuguuucuacuaacuuuuug

SEQ ID NO: 4092837 - RNA, 14 nt, Variola virus
ccuuaauauaauag

SEQ ID NO: 4092838 - RNA, 22 nt, Variola virus
ccuuauagaggauguuaaacaa

SEQ ID NO: 4092839 - RNA, 12 nt, Variola virus
ccuuaucuucua

SEQ ID NO: 4092840 - RNA, 20 nt, Variola virus
ccuuccacauccaugagauu

SEQ ID NO: 4092841 - RNA, 15 nt, Variola virus
ccuuguauguuuuua

SEQ ID NO: 4092842 - RNA, 15 nt, Variola virus
ccuuuaaauccucua

SEQ ID NO: 4092843 - RNA, 22 nt, Variola virus
ccuuuaucauuaauaauuucua

SEQ ID NO: 4092844 - RNA, 15 nt, Variola virus
cgaaaagaaacagau

SEQ ID NO: 4092845 - RNA, 15 nt, Variola virus
cgaaaauacacaaau

SEQ ID NO: 4092846 - RNA, 17 nt, Variola virus
cgaaaauugcuauuuca

SEQ ID NO: 4092847 - RNA, 16 nt, Variola virus
cgaaacuuagaagagu

SEQ ID NO: 4092848 - RNA, 20 nt, Variola virus
cgaaagauuuuauuucacau

SEQ ID NO: 4092849 - RNA, 22 nt, Variola virus
cgaacacuaacgcgcaugauuu

SEQ ID NO: 4092850 - RNA, 19 nt, Variola virus
cgaacuaccugauuuugca

SEQ ID NO: 4092851 - RNA, 19 nt, Variola virus
cgaagauauacacacuaau

SEQ ID NO: 4092852 - RNA, 13 nt, Variola virus
cgaauaaauagau

SEQ ID NO: 4092853 - RNA, 13 nt, Variola virus
cgaauaacaaaaa

SEQ ID NO: 4092854 - RNA, 15 nt, Variola virus
cgaauccuguuucua

SEQ ID NO: 4092855 - RNA, 15 nt, Variola virus
cgaaucuaugauauu

SEQ ID NO: 4092856 - RNA, 17 nt, Variola virus
cgacucauaagaaagag

SEQ ID NO: 4092857 - RNA, 17 nt, Variola virus
cgacucuacuaguucca

SEQ ID NO: 4092858 - RNA, 14 nt, Variola virus
cgagaccuacagug

SEQ ID NO: 4092859 - RNA, 12 nt, Variola virus
cgaggagacugu

SEQ ID NO: 4092860 - RNA, 22 nt, Variola virus
cgagugaguacggauuaaacau

SEQ ID NO: 4092861 - RNA, 17 nt, Variola virus
cgaguuuaaaacuucua

SEQ ID NO: 4092862 - RNA, 17 nt, Variola virus
cgauaacggaauagacu

SEQ ID NO: 4092863 - RNA, 19 nt, Variola virus
cgauaaugugguuacucuu

SEQ ID NO: 4092864 - RNA, 22 nt, Variola virus
cgauaauuguuucauauguuuu

SEQ ID NO: 4092865 - RNA, 17 nt, Variola virus
cgaucauauuauuuuua

SEQ ID NO: 4092866 - RNA, 16 nt, Variola virus
cgaucucaaucaucuu

SEQ ID NO: 4092867 - RNA, 15 nt, Variola virus
cgauuaaacuuuaau

SEQ ID NO: 4092868 - RNA, 17 nt, Variola virus
cgauuuuaaaucaucuu

SEQ ID NO: 4092869 - RNA, 14 nt, Variola virus
cgcauguggaugga

SEQ ID NO: 4092870 - RNA, 12 nt, Variola virus
cgcauuaaugag

SEQ ID NO: 4092871 - RNA, 19 nt, Variola virus
cgccucaguugucauaaac

SEQ ID NO: 4092872 - RNA, 22 nt, Variola virus
cgcgaagcaauauauauacagu

SEQ ID NO: 4092873 - RNA, 13 nt, Variola virus
cgcgggauacauc

SEQ ID NO: 4092874 - RNA, 17 nt, Variola virus
cgcuacaauaacucuau

SEQ ID NO: 4092875 - RNA, 13 nt, Variola virus
cgcuguaucacaa

SEQ ID NO: 4092876 - RNA, 16 nt, Variola virus
cgcuuaacaucuucua

SEQ ID NO: 4092877 - RNA, 13 nt, Variola virus
cggaaaguauuuc

SEQ ID NO: 4092878 - RNA, 13 nt, Variola virus
cggaaaugauaua

SEQ ID NO: 4092879 - RNA, 17 nt, Variola virus
cggaaauguaauucuaa

SEQ ID NO: 4092880 - RNA, 13 nt, Variola virus
cggaacaauaaac

SEQ ID NO: 4092881 - RNA, 15 nt, Variola virus
cggaauaaguagaca

SEQ ID NO: 4092882 - RNA, 22 nt, Variola virus
cggacuuauauagcuuauucca

SEQ ID NO: 4092883 - RNA, 22 nt, Variola virus
cggauacuaguaguuucacaaa

SEQ ID NO: 4092884 - RNA, 17 nt, Variola virus
cggcauaguuucuguaa

SEQ ID NO: 4092885 - RNA, 23 nt, Variola virus
cggcauuucuuuuuaaugauaua

SEQ ID NO: 4092886 - RNA, 16 nt, Variola virus
cgggaauuaauguccu

SEQ ID NO: 4092887 - RNA, 15 nt, Variola virus
cgggaucauuauuua

SEQ ID NO: 4092888 - RNA, 22 nt, Variola virus
cgggucaaacaauuuuaacaga

SEQ ID NO: 4092889 - RNA, 16 nt, Variola virus
cgguguguagaaagug

SEQ ID NO: 4092890 - RNA, 14 nt, Variola virus
cgguuuuaacuuua

SEQ ID NO: 4092891 - RNA, 13 nt, Variola virus
cgguuuuucuugg

SEQ ID NO: 4092892 - RNA, 19 nt, Variola virus
cguacaugagucugaguuc

SEQ ID NO: 4092893 - RNA, 22 nt, Variola virus
cguaccaacucauuuaaauauc

SEQ ID NO: 4092894 - RNA, 22 nt, Variola virus
cguagcgucuagucuuaaaugg

SEQ ID NO: 4092895 - RNA, 13 nt, Variola virus
cguaguaacucua

SEQ ID NO: 4092896 - RNA, 13 nt, Variola virus
cguauaauagaca

SEQ ID NO: 4092897 - RNA, 18 nt, Variola virus
cguauaauagacauaaug

SEQ ID NO: 4092898 - RNA, 21 nt, Variola virus
uggaguauauauuuaucucuu

SEQ ID NO: 4092899 - RNA, 21 nt, Variola virus
uggauaaugguacucuagaau

SEQ ID NO: 4092900 - RNA, 14 nt, Variola virus
uggauaauuuccau

SEQ ID NO: 4092901 - RNA, 17 nt, Variola virus
uggauacaauaaauguu

SEQ ID NO: 4092902 - RNA, 14 nt, Variola virus
uggauauguuuuua

SEQ ID NO: 4092903 - RNA, 22 nt, Variola virus
uggauauucgauaacagcauuu

SEQ ID NO: 4092904 - RNA, 15 nt, Variola virus
uggaucaaauggaua

SEQ ID NO: 4092905 - RNA, 16 nt, Variola virus
uggaucuaguuuucag

SEQ ID NO: 4092906 - RNA, 17 nt, Variola virus
uggaucuaugguuucca

SEQ ID NO: 4092907 - RNA, 18 nt, Variola virus
uggaucuaugguuuccau

SEQ ID NO: 4092908 - RNA, 15 nt, Variola virus
uggaugaauucuaug

SEQ ID NO: 4092909 - RNA, 15 nt, Variola virus
uggauguacauguau

SEQ ID NO: 4092910 - RNA, 18 nt, Variola virus
uggauuaucccuuugaua

SEQ ID NO: 4092911 - RNA, 12 nt, Variola virus
uggcaauguuuc

SEQ ID NO: 4092912 - RNA, 23 nt, Variola virus
uggcugaaauuagagcucaucua

SEQ ID NO: 4092913 - RNA, 20 nt, Variola virus
ugggaaaaacgaaauuaucg

SEQ ID NO: 4092914 - RNA, 21 nt, Variola virus
ugggacuauuggaauguguua

SEQ ID NO: 4092915 - RNA, 16 nt, Variola virus
ugggaggcuugaagug

SEQ ID NO: 4092916 - RNA, 20 nt, Variola virus
ugggugugguuaaacgaaag

SEQ ID NO: 4092917 - RNA, 16 nt, Variola virus
ugguaaaguaaaucau

SEQ ID NO: 4092918 - RNA, 23 nt, Variola virus
ugguacguaaccgaaucuuccca

SEQ ID NO: 4092919 - RNA, 14 nt, Variola virus
ugguaucaacagau

SEQ ID NO: 4092920 - RNA, 20 nt, Variola virus
ugguauccuggcgaauauua

SEQ ID NO: 4092921 - RNA, 19 nt, Variola virus
ugguauuagaaucaaggau

SEQ ID NO: 4092922 - RNA, 15 nt, Variola virus
ugguauuugaaaucg

SEQ ID NO: 4092923 - RNA, 14 nt, Variola virus
uggucaaccuuugu

SEQ ID NO: 4092924 - RNA, 17 nt, Variola virus
uggucauaauagaaugu

SEQ ID NO: 4092925 - RNA, 16 nt, Variola virus
ugguccuauugcuucc

SEQ ID NO: 4092926 - RNA, 13 nt, Variola virus
ugguguaaaucua

SEQ ID NO: 4092927 - RNA, 22 nt, Variola virus
ugguuccacaauucauuuccau

SEQ ID NO: 4092928 - RNA, 13 nt, Variola virus
ugguuuaggaaag

SEQ ID NO: 4092929 - RNA, 17 nt, Variola virus
ugguuucauguuuucaa

SEQ ID NO: 4092930 - RNA, 13 nt, Variola virus
ugguuuucuaaau

SEQ ID NO: 4092931 - RNA, 22 nt, Variola virus
uguaaaaaacaucacgaaaucu

SEQ ID NO: 4092932 - RNA, 16 nt, Variola virus
uguaaaagcauauguu

SEQ ID NO: 4092933 - RNA, 14 nt, Variola virus
uguaaacacagaua

SEQ ID NO: 4092934 - RNA, 23 nt, Variola virus
uguaaacuugacaaaaauuguga

SEQ ID NO: 4092935 - RNA, 20 nt, Variola virus
uguaaagaacaaauguugua

SEQ ID NO: 4092936 - RNA, 19 nt, Variola virus
uguaaauagaacauacuuu

SEQ ID NO: 4092937 - RNA, 21 nt, Variola virus
uguaaauauaucaauaagcau

SEQ ID NO: 4092938 - RNA, 14 nt, Variola virus
uguaaauauaucua

SEQ ID NO: 4092939 - RNA, 15 nt, Variola virus
uguaacaauauuaca

SEQ ID NO: 4092940 - RNA, 15 nt, Variola virus
uguaaccuuaacaau

SEQ ID NO: 4092941 - RNA, 16 nt, Variola virus
uguaacguuagacauu

SEQ ID NO: 4092942 - RNA, 18 nt, Variola virus
uguaagacuugugggaaa

SEQ ID NO: 4092943 - RNA, 21 nt, Variola virus
uguaauaccagcgugaacaac

SEQ ID NO: 4092944 - RNA, 13 nt, Variola virus
uguaauagaauuu

SEQ ID NO: 4092945 - RNA, 14 nt, Variola virus
uguaauaguuucca

SEQ ID NO: 4092946 - RNA, 16 nt, Variola virus
uguaauuacauacuuu

SEQ ID NO: 4092947 - RNA, 15 nt, Variola virus
uguacauacaucacu

SEQ ID NO: 4092948 - RNA, 16 nt, Variola virus
uguacauauuuguaca

SEQ ID NO: 4092949 - RNA, 13 nt, Variola virus
uguacauguaguu

SEQ ID NO: 4092950 - RNA, 13 nt, Variola virus
uguagaacucaug

SEQ ID NO: 4092951 - RNA, 21 nt, Variola virus
uguagagaaucgcuagaugcu

SEQ ID NO: 4092952 - RNA, 23 nt, Variola virus
uguagauaauaacuaaaaaucaa

SEQ ID NO: 4092953 - RNA, 12 nt, Variola virus
uguaguaguaua

SEQ ID NO: 4092954 - RNA, 18 nt, Variola virus
uguauaacagagccaucu

SEQ ID NO: 4092955 - RNA, 12 nt, Variola virus
uguauacuguau

SEQ ID NO: 4092956 - RNA, 18 nt, Variola virus
uguauauaauaguuucua

SEQ ID NO: 4092957 - RNA, 18 nt, Variola virus
uguauccggcaauauuua

SEQ ID NO: 4092958 - RNA, 14 nt, Variola virus
uguaugaaaugcuu

SEQ ID NO: 4092959 - RNA, 18 nt, Variola virus
uguaugauaaaauucuua

SEQ ID NO: 4092960 - RNA, 17 nt, Variola virus
uguaugucuuauguaua

SEQ ID NO: 4092961 - RNA, 22 nt, Variola virus
uguaugugcauucuuuaugaca

SEQ ID NO: 4092962 - RNA, 18 nt, Variola virus
uguauuauccaauacaga

SEQ ID NO: 4092963 - RNA, 18 nt, Variola virus
uguauucacuuaacaauu

SEQ ID NO: 4092964 - RNA, 23 nt, Variola virus
uguauucagaauuaauagauaua

SEQ ID NO: 4092965 - RNA, 15 nt, Variola virus
uguauucucuuacaa

SEQ ID NO: 4092966 - RNA, 17 nt, Variola virus
uguauucuuuuuaagau

SEQ ID NO: 4092967 - RNA, 14 nt, Variola virus
ugucaaaggaugaa

SEQ ID NO: 4092968 - RNA, 23 nt, Variola virus
ugucaauacuuuuguuacuaaua

SEQ ID NO: 4092969 - RNA, 19 nt, Variola virus
ugucaaugguauguaucua

SEQ ID NO: 4092970 - RNA, 21 nt, Variola virus
ugucacucucccuauaucuuc

SEQ ID NO: 4092971 - RNA, 21 nt, Variola virus
ugucaucgaaaugguagauau

SEQ ID NO: 4092972 - RNA, 15 nt, Variola virus
uguccuaaaauacua

SEQ ID NO: 4092973 - RNA, 17 nt, Variola virus
ugucgccaaucuuacac

SEQ ID NO: 4092974 - RNA, 12 nt, Variola virus
ugucgguaaacg

SEQ ID NO: 4092975 - RNA, 21 nt, Variola virus
ugucuacaaccgcuacauaau

SEQ ID NO: 4092976 - RNA, 19 nt, Variola virus
ugucuacauaaauaugcaa

SEQ ID NO: 4092977 - RNA, 22 nt, Variola virus
ugucuagaggcuaaaacauauu

SEQ ID NO: 4092978 - RNA, 13 nt, Variola virus
ugucuauaucuuc

SEQ ID NO: 4092979 - RNA, 16 nt, Variola virus
ugucuaucucuguaaa

SEQ ID NO: 4092980 - RNA, 12 nt, Variola virus
ugucuccauuac

SEQ ID NO: 4092981 - RNA, 15 nt, Variola virus
ugucuuucucuuuua

SEQ ID NO: 4092982 - RNA, 18 nt, Variola virus
ugugacaguuuucucauc

SEQ ID NO: 4092983 - RNA, 19 nt, Variola virus
ugugauaccaauaaguuuu

SEQ ID NO: 4092984 - RNA, 20 nt, Variola virus
ugugaugcuguagcaucaaa

SEQ ID NO: 4092985 - RNA, 12 nt, Variola virus
ugugauggauuu

SEQ ID NO: 4092986 - RNA, 22 nt, Variola virus
ugugauuaaugugugacacauu

SEQ ID NO: 4092987 - RNA, 13 nt, Variola virus
uguggguauacaa

SEQ ID NO: 4092988 - RNA, 14 nt, Variola virus
uguguacuuguaca

SEQ ID NO: 4092989 - RNA, 16 nt, Variola virus
uguguccggaguuaga

SEQ ID NO: 4092990 - RNA, 19 nt, Variola virus
ugugucuccauguacauac

SEQ ID NO: 4092991 - RNA, 14 nt, Variola virus
uguuaaaaaugauu

SEQ ID NO: 4092992 - RNA, 19 nt, Variola virus
uguuaagaaugauuacuaa

SEQ ID NO: 4092993 - RNA, 12 nt, Variola virus
uguuaauaacug

SEQ ID NO: 4092994 - RNA, 18 nt, Variola virus
uguuaauaaguaaaugaa

SEQ ID NO: 4092995 - RNA, 21 nt, Variola virus
uguuaauacaucaauggaaga

SEQ ID NO: 4092996 - RNA, 13 nt, Variola virus
uguuaauguauua

SEQ ID NO: 4092997 - RNA, 19 nt, Variola virus
aaacuuguaagaaguaaau

SEQ ID NO: 4092998 - RNA, 15 nt, Variola virus
aaacuuuauuaucca

SEQ ID NO: 4092999 - RNA, 21 nt, Variola virus
aaacuuucuagaacauacuga

SEQ ID NO: 4093000 - RNA, 15 nt, Variola virus
aaagaaaauauggaa

SEQ ID NO: 4093001 - RNA, 18 nt, Variola virus
aaagaagaucauacaguc

SEQ ID NO: 4093002 - RNA, 15 nt, Variola virus
aaagaaguccauuua

SEQ ID NO: 4093003 - RNA, 15 nt, Variola virus
aaagaaucaucauau

SEQ ID NO: 4093004 - RNA, 23 nt, Variola virus
aaagaauuuguuguuucuauuua

SEQ ID NO: 4093005 - RNA, 18 nt, Variola virus
aaagaccgaauacauaac

SEQ ID NO: 4093006 - RNA, 14 nt, Variola virus
aaagacucagaaga

SEQ ID NO: 4093007 - RNA, 24 nt, Variola virus
aaagagaacguauuuauuguuacu

SEQ ID NO: 4093008 - RNA, 16 nt, Variola virus
aaagagaauuauauau

SEQ ID NO: 4093009 - RNA, 15 nt, Variola virus
aaagauuuuauuuca

SEQ ID NO: 4093010 - RNA, 12 nt, Variola virus
aaagcauauucc

SEQ ID NO: 4093011 - RNA, 17 nt, Variola virus
aaagcgugugcguguau

SEQ ID NO: 4093012 - RNA, 15 nt, Variola virus
aaaggagagaaugua

SEQ ID NO: 4093013 - RNA, 14 nt, Variola virus
aaagguaagaguua

SEQ ID NO: 4093014 - RNA, 15 nt, Variola virus
aaagguauacgaaug

SEQ ID NO: 4093015 - RNA, 17 nt, Variola virus
aaaggugacacauguac

SEQ ID NO: 4093016 - RNA, 16 nt, Variola virus
aaagguuauaguguac

SEQ ID NO: 4093017 - RNA, 14 nt, Variola virus
aaaguaaaaaagaa

SEQ ID NO: 4093018 - RNA, 19 nt, Variola virus
aaaguagaaaauauauucu

SEQ ID NO: 4093019 - RNA, 22 nt, Variola virus
aaaguaguucaacauaauauua

SEQ ID NO: 4093020 - RNA, 22 nt, Variola virus
aaagucuuuacagauuucaucc

SEQ ID NO: 4093021 - RNA, 12 nt, Variola virus
aaagugaaaauc

SEQ ID NO: 4093022 - RNA, 17 nt, Variola virus
aaaguuaauaaucucau

SEQ ID NO: 4093023 - RNA, 17 nt, Variola virus
aaauaaaacuauaguau

SEQ ID NO: 4093024 - RNA, 23 nt, Variola virus
aaauaaaauauaaaauauuggaa

SEQ ID NO: 4093025 - RNA, 18 nt, Variola virus
aaauaaacaaaauaaugu

SEQ ID NO: 4093026 - RNA, 11 nt, Variola virus
aaauaaauguc

SEQ ID NO: 4093027 - RNA, 17 nt, Variola virus
aaauaacaauuaacaau

SEQ ID NO: 4093028 - RNA, 20 nt, Variola virus
aaauaacaccauuacacgaa

SEQ ID NO: 4093029 - RNA, 18 nt, Variola virus
aaauaacaguaucauuua

SEQ ID NO: 4093030 - RNA, 20 nt, Variola virus
aaauaacauauagauuuuau

SEQ ID NO: 4093031 - RNA, 19 nt, Variola virus
aaauaagaucaguaacagu

SEQ ID NO: 4093032 - RNA, 20 nt, Variola virus
aaauaaguaguaauaaugau

SEQ ID NO: 4093033 - RNA, 12 nt, Variola virus
aaauaauaauau

SEQ ID NO: 4093034 - RNA, 19 nt, Variola virus
aaauacauauuuuuuguaa

SEQ ID NO: 4093035 - RNA, 21 nt, Variola virus
aaauacgcaaucgauguguca

SEQ ID NO: 4093036 - RNA, 15 nt, Variola virus
aaauacguccaucag

SEQ ID NO: 4093037 - RNA, 19 nt, Variola virus
aaauacguucuauugugua

SEQ ID NO: 4093038 - RNA, 13 nt, Variola virus
aaauagaacuuau

SEQ ID NO: 4093039 - RNA, 14 nt, Variola virus
aaauagauccugaa

SEQ ID NO: 4093040 - RNA, 15 nt, Variola virus
aaauagcgcugaaaa

SEQ ID NO: 4093041 - RNA, 20 nt, Variola virus
aaauagcguucgucaacaua

SEQ ID NO: 4093042 - RNA, 21 nt, Variola virus
aaauagcucuuaguaugggaa

SEQ ID NO: 4093043 - RNA, 21 nt, Variola virus
aaauaguaaaugagagaucua

SEQ ID NO: 4093044 - RNA, 14 nt, Variola virus
aaauauaaacaguc

SEQ ID NO: 4093045 - RNA, 15 nt, Variola virus
aaauauaauaaugau

SEQ ID NO: 4093046 - RNA, 16 nt, Variola virus
aaauauaaucguguau

SEQ ID NO: 4093047 - RNA, 12 nt, Variola virus
aaauauaaugau

SEQ ID NO: 4093048 - RNA, 16 nt, Variola virus
aaauauaauguuguau

SEQ ID NO: 4093049 - RNA, 14 nt, Variola virus
aaauauaauuuuau

SEQ ID NO: 4093050 - RNA, 22 nt, Variola virus
aaauauagaucuuauuuaguau

SEQ ID NO: 4093051 - RNA, 21 nt, Variola virus
aaauauaucauucgauaagau

SEQ ID NO: 4093052 - RNA, 18 nt, Variola virus
aaauauaugcucauauau

SEQ ID NO: 4093053 - RNA, 17 nt, Variola virus
aaauauauuuucauuua

SEQ ID NO: 4093054 - RNA, 18 nt, Variola virus
aaauaucauuaacgauau

SEQ ID NO: 4093055 - RNA, 22 nt, Variola virus
aaauaucauuuuuugaauauau

SEQ ID NO: 4093056 - RNA, 20 nt, Variola virus
aaauaucgauguuaauaaca

SEQ ID NO: 4093057 - RNA, 13 nt, Variola virus
aaauaucuauuca

SEQ ID NO: 4093058 - RNA, 14 nt, Variola virus
aaauauguaauaau

SEQ ID NO: 4093059 - RNA, 22 nt, Variola virus
aaauauuaauaacauuacauau

SEQ ID NO: 4093060 - RNA, 12 nt, Variola virus
aaauauucauua

SEQ ID NO: 4093061 - RNA, 15 nt, Variola virus
aaauauucuacauau

SEQ ID NO: 4093062 - RNA, 23 nt, Variola virus
aaauauuguauccauacauacau

SEQ ID NO: 4093063 - RNA, 17 nt, Variola virus
aaauauuguuaaauaau

SEQ ID NO: 4093064 - RNA, 22 nt, Variola virus
aaauauuucuacuacuucauua

SEQ ID NO: 4093065 - RNA, 21 nt, Variola virus
aaauauuuuuggacaguguuu

SEQ ID NO: 4093066 - RNA, 14 nt, Variola virus
aaaucaagacuaca

SEQ ID NO: 4093067 - RNA, 17 nt, Variola virus
aaaucacgagaacuauu

SEQ ID NO: 4093068 - RNA, 19 nt, Variola virus
aaaucacuuuuuauacuaa

SEQ ID NO: 4093069 - RNA, 21 nt, Variola virus
aaaucagauaucgauguuaua

SEQ ID NO: 4093070 - RNA, 13 nt, Variola virus
aaauccuguaaua

SEQ ID NO: 4093071 - RNA, 17 nt, Variola virus
aaauccuguaauacuuu

SEQ ID NO: 4093072 - RNA, 21 nt, Variola virus
aaauccuguaauacuuuuagu

SEQ ID NO: 4093073 - RNA, 14 nt, Variola virus
aaaucgcaucuucu

SEQ ID NO: 4093074 - RNA, 19 nt, Variola virus
aaaucggauggauugguaa

SEQ ID NO: 4093075 - RNA, 17 nt, Variola virus
aaaucuaacagauacaa

SEQ ID NO: 4093076 - RNA, 14 nt, Variola virus
aaaucucguaguau

SEQ ID NO: 4093077 - RNA, 23 nt, Variola virus
aaaucuuucauuucuuccuggua

SEQ ID NO: 4093078 - RNA, 14 nt, Variola virus
aaaugaauuauuua

SEQ ID NO: 4093079 - RNA, 15 nt, Variola virus
aaaugauaacuagau

SEQ ID NO: 4093080 - RNA, 13 nt, Variola virus
aaaugauacugau

SEQ ID NO: 4093081 - RNA, 11 nt, Variola virus
aaauggauaau

SEQ ID NO: 4093082 - RNA, 22 nt, Variola virus
aaauggauaauauccauauuga

SEQ ID NO: 4093083 - RNA, 15 nt, Variola virus
aaaugguacaaucag

SEQ ID NO: 4093084 - RNA, 15 nt, Variola virus
aaauguaaauccaau

SEQ ID NO: 4093085 - RNA, 18 nt, Variola virus
aaauguauauuuuccauu

SEQ ID NO: 4093086 - RNA, 21 nt, Variola virus
aaauguauuuuuuaugauaua

SEQ ID NO: 4093087 - RNA, 14 nt, Variola virus
aaauguguaauaau

SEQ ID NO: 4093088 - RNA, 23 nt, Variola virus
aaauuaaccgauaaaaagacuuu

SEQ ID NO: 4093089 - RNA, 13 nt, Variola virus
aaauuagaaagua

SEQ ID NO: 4093090 - RNA, 15 nt, Variola virus
aaauuauaugaccaa

SEQ ID NO: 4093091 - RNA, 12 nt, Variola virus
aaauuauauucu

SEQ ID NO: 4093092 - RNA, 18 nt, Variola virus
aaauuaucaaauacuuca

SEQ ID NO: 4093093 - RNA, 20 nt, Variola virus
aaauuauuaaacaauacucu

SEQ ID NO: 4093094 - RNA, 22 nt, Variola virus
aaauuauucacuauaucaguau

SEQ ID NO: 4093095 - RNA, 21 nt, Variola virus
aaauuauuccaauuauuugaa

SEQ ID NO: 4093096 - RNA, 16 nt, Variola virus
aaauuauugcaaacga

SEQ ID NO: 4093097 - RNA, 21 nt, Variola virus
aaauuauuuaauuuaauacau

SEQ ID NO: 4093098 - RNA, 14 nt, Variola virus
aaauuccaccauuu

SEQ ID NO: 4093099 - RNA, 14 nt, Variola virus
aaauugauaaugag

SEQ ID NO: 4093100 - RNA, 23 nt, Variola virus
aaauuguuuaguuuucucuuuuu

SEQ ID NO: 4093101 - RNA, 15 nt, Variola virus
aaauuuaaauacuuu

SEQ ID NO: 4093102 - RNA, 18 nt, Variola virus
aaauuucuuuuucaaaga

SEQ ID NO: 4093103 - RNA, 17 nt, Variola virus
aaauuuuacuacauagu

SEQ ID NO: 4093104 - RNA, 14 nt, Variola virus
aaauuuuagaaaua

SEQ ID NO: 4093105 - RNA, 23 nt, Variola virus
aaauuuuguugauuacucuuuuu

SEQ ID NO: 4093106 - RNA, 13 nt, Variola virus
aacaaaaauugau

SEQ ID NO: 4093107 - RNA, 18 nt, Variola virus
aacaaagauauuaccagu

SEQ ID NO: 4093108 - RNA, 17 nt, Variola virus
aacaaauagcuacagua

SEQ ID NO: 4093109 - RNA, 22 nt, Variola virus
aacaaaugcaccaaaguuauau

SEQ ID NO: 4093110 - RNA, 19 nt, Variola virus
aacaaccuuggcauauuga

SEQ ID NO: 4093111 - RNA, 14 nt, Variola virus
aacaacuaaaaugu

SEQ ID NO: 4093112 - RNA, 13 nt, Variola virus
aacaacuguaaaa

SEQ ID NO: 4093113 - RNA, 17 nt, Variola virus
aacaaguuggaugauau

SEQ ID NO: 4093114 - RNA, 13 nt, Variola virus
aacaaguuuuuau

SEQ ID NO: 4093115 - RNA, 15 nt, Variola virus
aacaauaguuauuac

SEQ ID NO: 4093116 - RNA, 15 nt, Variola virus
aacaauaugcaaaua

SEQ ID NO: 4093117 - RNA, 12 nt, Variola virus
aacaauauuaag

SEQ ID NO: 4093118 - RNA, 20 nt, Variola virus
aacaauuaauuaauacagua

SEQ ID NO: 4093119 - RNA, 22 nt, Variola virus
aacaauuuuguauuauucugaa

SEQ ID NO: 4093120 - RNA, 14 nt, Variola virus
aacacaaaauauga

SEQ ID NO: 4093121 - RNA, 15 nt, Variola virus
aacaccaaguagaaa

SEQ ID NO: 4093122 - RNA, 16 nt, Variola virus
aacaccuauaagauua

SEQ ID NO: 4093123 - RNA, 15 nt, Variola virus
aacacgauuuaaaau

SEQ ID NO: 4093124 - RNA, 14 nt, Variola virus
aacacuaaaaauau

SEQ ID NO: 4093125 - RNA, 18 nt, Variola virus
aacacucgacugaauauu

SEQ ID NO: 4093126 - RNA, 23 nt, Variola virus
aacacuuauuaaguucuuuuucc

SEQ ID NO: 4093127 - RNA, 17 nt, Variola virus
aacagcuuuaacagaug

SEQ ID NO: 4093128 - RNA, 19 nt, Variola virus
aacaggugguauauuauau

SEQ ID NO: 4093129 - RNA, 16 nt, Variola virus
aacaguauguaaaagu

SEQ ID NO: 4093130 - RNA, 17 nt, Variola virus
aacaguuauuuucugaa

SEQ ID NO: 4093131 - RNA, 21 nt, Variola virus
aacaguuugguauuagaauca

SEQ ID NO: 4093132 - RNA, 13 nt, Variola virus
aacauaaaaauau

SEQ ID NO: 4093133 - RNA, 16 nt, Variola virus
aacauaaacacagaua

SEQ ID NO: 4093134 - RNA, 15 nt, Variola virus
aacauaauuuucuaa

SEQ ID NO: 4093135 - RNA, 17 nt, Variola virus
aacauaguaaaaaauau

SEQ ID NO: 4093136 - RNA, 15 nt, Variola virus
aacauauuuuucuau

SEQ ID NO: 4093137 - RNA, 23 nt, Variola virus
aacaucauacaucaauuaacauu

SEQ ID NO: 4093138 - RNA, 17 nt, Variola virus
aacauccauuucuagaa

SEQ ID NO: 4093139 - RNA, 20 nt, Variola virus
aacaucgaagaugaaucaaa

SEQ ID NO: 4093140 - RNA, 18 nt, Variola virus
aacaucggaaaaaaaucu

SEQ ID NO: 4093141 - RNA, 20 nt, Variola virus
aacaucuuggggaaauaugg

SEQ ID NO: 4093142 - RNA, 16 nt, Variola virus
aacaugcuuuucuaua

SEQ ID NO: 4093143 - RNA, 13 nt, Variola virus
aacauuaaaaugu

SEQ ID NO: 4093144 - RNA, 20 nt, Variola virus
aacauugcagccauuuucua

SEQ ID NO: 4093145 - RNA, 11 nt, Variola virus
aaccaaaucaa

SEQ ID NO: 4093146 - RNA, 20 nt, Variola virus
aaccaaggacagaaaaaugu

SEQ ID NO: 4093147 - RNA, 16 nt, Variola virus
aaccacggaucguaau

SEQ ID NO: 4093148 - RNA, 16 nt, Variola virus
aaccagaauuguaaaa

SEQ ID NO: 4093149 - RNA, 22 nt, Variola virus
aaccaguaucucuuaacgaugu

SEQ ID NO: 4093150 - RNA, 20 nt, Variola virus
aaccaugcuacaaucauuau

SEQ ID NO: 4093151 - RNA, 15 nt, Variola virus
aacccagauaauaac

SEQ ID NO: 4093152 - RNA, 14 nt, Variola virus
aacccauaaauaca

SEQ ID NO: 4093153 - RNA, 17 nt, Variola virus
aacccguuuauacagug

SEQ ID NO: 4093154 - RNA, 22 nt, Variola virus
aaccgucauucaucuagaaugg

SEQ ID NO: 4093155 - RNA, 12 nt, Variola virus
aaccuaauucca

SEQ ID NO: 4093156 - RNA, 14 nt, Variola virus
aaccuagaaaauau

SEQ ID NO: 4093157 - RNA, 20 nt, Variola virus
aaccucacuguuaaaaauau

SEQ ID NO: 4093158 - RNA, 19 nt, Variola virus
aaccugaucuggaaaauaa

SEQ ID NO: 4093159 - RNA, 12 nt, Variola virus
aaccuucuuauu

SEQ ID NO: 4093160 - RNA, 11 nt, Variola virus
aaccuuuguug

SEQ ID NO: 4093161 - RNA, 17 nt, Variola virus
aacgacuuauaauuaau

SEQ ID NO: 4093162 - RNA, 22 nt, Variola virus
aacgagccaguaaucuuaccau

SEQ ID NO: 4093163 - RNA, 21 nt, Variola virus
aacgaguacuuuaaagaagua

SEQ ID NO: 4093164 - RNA, 21 nt, Variola virus
aacgagugcaaguagaacuua

SEQ ID NO: 4093165 - RNA, 20 nt, Variola virus
aacgaguucaaauaugaaau

SEQ ID NO: 4093166 - RNA, 12 nt, Variola virus
aacgauauuaac

SEQ ID NO: 4093167 - RNA, 19 nt, Variola virus
aacgaucuaauaacaaugu

SEQ ID NO: 4093168 - RNA, 20 nt, Variola virus
aacgauuuuccaaaucagua

SEQ ID NO: 4093169 - RNA, 22 nt, Variola virus
aacgauuuuccaaaucaguaac

SEQ ID NO: 4093170 - RNA, 14 nt, Variola virus
aacgcaucuagacu

SEQ ID NO: 4093171 - RNA, 13 nt, Variola virus
aacgccuuagaaa

SEQ ID NO: 4093172 - RNA, 18 nt, Variola virus
aacgcuacuauauauuau

SEQ ID NO: 4093173 - RNA, 21 nt, Variola virus
aacggaagaugcaauaguaau

SEQ ID NO: 4093174 - RNA, 14 nt, Variola virus
aacggaugaaaaua

SEQ ID NO: 4093175 - RNA, 13 nt, Variola virus
aacggcuaucacu

SEQ ID NO: 4093176 - RNA, 16 nt, Variola virus
aacgggauauaugaau

SEQ ID NO: 4093177 - RNA, 14 nt, Variola virus
aacgguaucuucuu

SEQ ID NO: 4093178 - RNA, 18 nt, Variola virus
aacguacaaauggauaaa

SEQ ID NO: 4093179 - RNA, 13 nt, Variola virus
aacuaauaaacau

SEQ ID NO: 4093180 - RNA, 14 nt, Variola virus
aacuacaauauuuc

SEQ ID NO: 4093181 - RNA, 23 nt, Variola virus
aacuaccaauaugucuguacaaa

SEQ ID NO: 4093182 - RNA, 15 nt, Variola virus
aacuacgucaagacu

SEQ ID NO: 4093183 - RNA, 17 nt, Variola virus
aacuacucgaacagaua

SEQ ID NO: 4093184 - RNA, 15 nt, Variola virus
aacuacuugaaauuc

SEQ ID NO: 4093185 - RNA, 15 nt, Variola virus
aacuagaauuguaua

SEQ ID NO: 4093186 - RNA, 21 nt, Variola virus
aacuagaucauccaacaaucu

SEQ ID NO: 4093187 - RNA, 15 nt, Variola virus
aacuaguauaaaauc

SEQ ID NO: 4093188 - RNA, 17 nt, Variola virus
aacuauauauuuguaua

SEQ ID NO: 4093189 - RNA, 21 nt, Variola virus
aacuauauauuuguauagaua

SEQ ID NO: 4093190 - RNA, 18 nt, Variola virus
aacuauaucuauguugau

SEQ ID NO: 4093191 - RNA, 20 nt, Variola virus
aacuaucuaugcuguagaua

SEQ ID NO: 4093192 - RNA, 15 nt, Variola virus
aacuaugucaaaaau

SEQ ID NO: 4093193 - RNA, 18 nt, Variola virus
aacuaugucaaaaauugu

SEQ ID NO: 4093194 - RNA, 14 nt, Variola virus
aacuauuuagcaaa

SEQ ID NO: 4093195 - RNA, 22 nt, Variola virus
aacuauuuuaguuaacaacuau

SEQ ID NO: 4093196 - RNA, 15 nt, Variola virus
aacuauuuuuaacuu

SEQ ID NO: 4093197 - RNA, 18 nt, Variola virus
aacucauuacuuacgaua

SEQ ID NO: 4093198 - RNA, 15 nt, Variola virus
aacucauucuauaua

SEQ ID NO: 4093199 - RNA, 21 nt, Variola virus
aacucauuuaaauaucauaau

SEQ ID NO: 4093200 - RNA, 16 nt, Variola virus
aacucgguaaaaaauu

SEQ ID NO: 4093201 - RNA, 23 nt, Variola virus
aacucuacauaaucauaaccauu

SEQ ID NO: 4093202 - RNA, 19 nt, Variola virus
aacucuuucgaauacuuau

SEQ ID NO: 4093203 - RNA, 14 nt, Variola virus
aacugcucuagauu

SEQ ID NO: 4093204 - RNA, 16 nt, Variola virus
aacugucaaugaauua

SEQ ID NO: 4093205 - RNA, 14 nt, Variola virus
aacuguuaaauguu

SEQ ID NO: 4093206 - RNA, 15 nt, Variola virus
aacuguucaaaauau

SEQ ID NO: 4093207 - RNA, 13 nt, Variola virus
aacuguuuguaua

SEQ ID NO: 4093208 - RNA, 15 nt, Variola virus
aacuuaaacaaaaua

SEQ ID NO: 4093209 - RNA, 17 nt, Variola virus
aacuuaaacaaaauaca

SEQ ID NO: 4093210 - RNA, 12 nt, Variola virus
aacuuaaugaaa

SEQ ID NO: 4093211 - RNA, 18 nt, Variola virus
aacuuauuagauagagau

SEQ ID NO: 4093212 - RNA, 24 nt, Variola virus
aacuuauucuuagcgucacagaau

SEQ ID NO: 4093213 - RNA, 20 nt, Variola virus
aacuucuggaaguuccaaac

SEQ ID NO: 4093214 - RNA, 22 nt, Variola virus
aacuuuaauucaaauuuccauu

SEQ ID NO: 4093215 - RNA, 21 nt, Variola virus
aacuuuuguuuuguuucugau

SEQ ID NO: 4093216 - RNA, 17 nt, Variola virus
aacuuuuuugacaaauu

SEQ ID NO: 4093217 - RNA, 13 nt, Variola virus
aagaaaaaugauu

SEQ ID NO: 4093218 - RNA, 15 nt, Variola virus
aagaaauuaauaaag

SEQ ID NO: 4093219 - RNA, 18 nt, Variola virus
aagaacauugcagccauu

SEQ ID NO: 4093220 - RNA, 20 nt, Variola virus
aagaacccguuuauacagug

SEQ ID NO: 4093221 - RNA, 14 nt, Variola virus
aagaacuacuaucg

SEQ ID NO: 4093222 - RNA, 15 nt, Variola virus
aagaacucuugaaga

SEQ ID NO: 4093223 - RNA, 19 nt, Variola virus
aagaagugucuauaaaugu

SEQ ID NO: 4093224 - RNA, 22 nt, Variola virus
aagaagugucuauaaauguaga

SEQ ID NO: 4093225 - RNA, 23 nt, Variola virus
aagaaucuucaagagugcauuga

SEQ ID NO: 4093226 - RNA, 12 nt, Variola virus
aagaauggauga

SEQ ID NO: 4093227 - RNA, 14 nt, Variola virus
aagaauucggaaau

SEQ ID NO: 4093228 - RNA, 16 nt, Variola virus
aagaauuuuagacacu

SEQ ID NO: 4093229 - RNA, 12 nt, Variola virus
aagacaauaaug

SEQ ID NO: 4093230 - RNA, 14 nt, Variola virus
aagaccaguucauu

SEQ ID NO: 4093231 - RNA, 19 nt, Variola virus
aagaccgaauacauaacag

SEQ ID NO: 4093232 - RNA, 16 nt, Variola virus
aagacgaucauuuacu

SEQ ID NO: 4093233 - RNA, 13 nt, Variola virus
aagagaauuuucu

SEQ ID NO: 4093234 - RNA, 12 nt, Variola virus
aagauaauccaa

SEQ ID NO: 4093235 - RNA, 18 nt, Variola virus
aagauaccgaagaauuaa

SEQ ID NO: 4093236 - RNA, 21 nt, Variola virus
aagauagaugaacugacauau

SEQ ID NO: 4093237 - RNA, 20 nt, Variola virus
aagauaucuacuagaaagau

SEQ ID NO: 4093238 - RNA, 14 nt, Variola virus
aagauauuccaaga

SEQ ID NO: 4093239 - RNA, 21 nt, Variola virus
aagaucguuggacauuggaua

SEQ ID NO: 4093240 - RNA, 18 nt, Variola virus
aagaucuaauauucuaga

SEQ ID NO: 4093241 - RNA, 16 nt, Variola virus
aagauuacuacacuug

SEQ ID NO: 4093242 - RNA, 17 nt, Variola virus
aagauuccauuaucuaa

SEQ ID NO: 4093243 - RNA, 18 nt, Variola virus
aagauugauggauuagaa

SEQ ID NO: 4093244 - RNA, 12 nt, Variola virus
aagcaaaugaug

SEQ ID NO: 4093245 - RNA, 14 nt, Variola virus
aagcuaacaaaauu

SEQ ID NO: 4093246 - RNA, 16 nt, Variola virus
aagcuaggcuggaaac

SEQ ID NO: 4093247 - RNA, 16 nt, Variola virus
aagcucuaaauccaaa

SEQ ID NO: 4093248 - RNA, 17 nt, Variola virus
aaggacaguuaaaacua

SEQ ID NO: 4093249 - RNA, 11 nt, Variola virus
aaggauaaaga

SEQ ID NO: 4093250 - RNA, 21 nt, Variola virus
aauugaauugcgauuauaaga

SEQ ID NO: 4093251 - RNA, 16 nt, Variola virus
aauugauaauauaaau

SEQ ID NO: 4093252 - RNA, 14 nt, Variola virus
aauugauucuauga

SEQ ID NO: 4093253 - RNA, 17 nt, Variola virus
aauuggcauuuaacaga

SEQ ID NO: 4093254 - RNA, 19 nt, Variola virus
aauugggaggauauacaaa

SEQ ID NO: 4093255 - RNA, 17 nt, Variola virus
aauugggguauuaauaa

SEQ ID NO: 4093256 - RNA, 20 nt, Variola virus
aauugguaacucauucuaua

SEQ ID NO: 4093257 - RNA, 21 nt, Variola virus
aauugguuuauaauguauaau

SEQ ID NO: 4093258 - RNA, 18 nt, Variola virus
aauuguauauuacacauu

SEQ ID NO: 4093259 - RNA, 16 nt, Variola virus
aauuguauuauuuccc

SEQ ID NO: 4093260 - RNA, 18 nt, Variola virus
aauugucuguaaaccaca

SEQ ID NO: 4093261 - RNA, 15 nt, Variola virus
aauuuaaaaugagua

SEQ ID NO: 4093262 - RNA, 14 nt, Variola virus
aauuuaaaauggua

SEQ ID NO: 4093263 - RNA, 21 nt, Variola virus
aauuuaaaauuagaucuuuua

SEQ ID NO: 4093264 - RNA, 18 nt, Variola virus
aauuuacaaauaaaaguc

SEQ ID NO: 4093265 - RNA, 22 nt, Variola virus
aauuuaccagauauaggagaau

SEQ ID NO: 4093266 - RNA, 11 nt, Variola virus
aauuuagaaaa

SEQ ID NO: 4093267 - RNA, 13 nt, Variola virus
aauuuaucaucug

SEQ ID NO: 4093268 - RNA, 12 nt, Variola virus
aauuuauuucua

SEQ ID NO: 4093269 - RNA, 14 nt, Variola virus
aauuuauuucuaaa

SEQ ID NO: 4093270 - RNA, 23 nt, Variola virus
aauuucaaggacaaaaugaccag

SEQ ID NO: 4093271 - RNA, 15 nt, Variola virus
aauuucauccauuua

SEQ ID NO: 4093272 - RNA, 19 nt, Variola virus
aauuucuggacguucacca

SEQ ID NO: 4093273 - RNA, 17 nt, Variola virus
aauuucugguuagauaa

SEQ ID NO: 4093274 - RNA, 13 nt, Variola virus
aauuugacuacau

SEQ ID NO: 4093275 - RNA, 18 nt, Variola virus
aauuugaguaagaauaag

SEQ ID NO: 4093276 - RNA, 13 nt, Variola virus
aauuugauaaaga

SEQ ID NO: 4093277 - RNA, 23 nt, Variola virus
aauuuguaaagacgaaacaaaau

SEQ ID NO: 4093278 - RNA, 16 nt, Variola virus
aauuuguaaucaucuu

SEQ ID NO: 4093279 - RNA, 13 nt, Variola virus
aauuuuaacagau

SEQ ID NO: 4093280 - RNA, 17 nt, Variola virus
aauuuuuuaaauccugu

SEQ ID NO: 4093281 - RNA, 22 nt, Variola virus
acaaaaacuugguuucaaugag

SEQ ID NO: 4093282 - RNA, 20 nt, Variola virus
acaaaacguuuauaugaagu

SEQ ID NO: 4093283 - RNA, 16 nt, Variola virus
acaaaagaguuaaguu

SEQ ID NO: 4093284 - RNA, 16 nt, Variola virus
acaaaagguauuacaa

SEQ ID NO: 4093285 - RNA, 17 nt, Variola virus
acaaaaguuaauaacaa

SEQ ID NO: 4093286 - RNA, 18 nt, Variola virus
acaaaaguuaauaaucuc

SEQ ID NO: 4093287 - RNA, 12 nt, Variola virus
acaaaaugugau

SEQ ID NO: 4093288 - RNA, 16 nt, Variola virus
acaaacaggauaucua

SEQ ID NO: 4093289 - RNA, 14 nt, Variola virus
acaaacauacucua

SEQ ID NO: 4093290 - RNA, 14 nt, Variola virus
acaaacuaucugau

SEQ ID NO: 4093291 - RNA, 23 nt, Variola virus
acaaaggaacuaaucaaugaaug

SEQ ID NO: 4093292 - RNA, 19 nt, Variola virus
acaaaguuuccuuuaacuc

SEQ ID NO: 4093293 - RNA, 23 nt, Variola virus
acaaauaauagguuguaauacau

SEQ ID NO: 4093294 - RNA, 16 nt, Variola virus
acaaauauaaaaugau

SEQ ID NO: 4093295 - RNA, 14 nt, Variola virus
acaaaucaauaauu

SEQ ID NO: 4093296 - RNA, 16 nt, Variola virus
acaaaucacugaaaau

SEQ ID NO: 4093297 - RNA, 15 nt, Variola virus
acaaaucuauuugga

SEQ ID NO: 4093298 - RNA, 21 nt, Variola virus
acaaauucuuggauauaugau

SEQ ID NO: 4093299 - RNA, 18 nt, Variola virus
acaaauuuggauauucua

SEQ ID NO: 4093300 - RNA, 18 nt, Variola virus
acaacaaaugauaaucaa

SEQ ID NO: 4093301 - RNA, 17 nt, Variola virus
acaacaucuaacuauau

SEQ ID NO: 4093302 - RNA, 20 nt, Variola virus
acaacaucuauuccaaauau

SEQ ID NO: 4093303 - RNA, 14 nt, Variola virus
acaacauuaauaca

SEQ ID NO: 4093304 - RNA, 16 nt, Variola virus
acaacauuccaaagau

SEQ ID NO: 4093305 - RNA, 15 nt, Variola virus
acaagcuguuuaucu

SEQ ID NO: 4093306 - RNA, 15 nt, Variola virus
acaaguauaaugaua

SEQ ID NO: 4093307 - RNA, 22 nt, Variola virus
acaaguuauacgucauuucauc

SEQ ID NO: 4093308 - RNA, 16 nt, Variola virus
acaauaaaaaaaauug

SEQ ID NO: 4093309 - RNA, 15 nt, Variola virus
acaauaaacaaaaua

SEQ ID NO: 4093310 - RNA, 13 nt, Variola virus
acaauaaauggau

SEQ ID NO: 4093311 - RNA, 16 nt, Variola virus
acaauaaugagaaugu

SEQ ID NO: 4093312 - RNA, 21 nt, Variola virus
acaauacagaagauagcaaag

SEQ ID NO: 4093313 - RNA, 22 nt, Variola virus
acaauauaauguacuagauaau

SEQ ID NO: 4093314 - RNA, 20 nt, Variola virus
acaauauauucucaugguau

SEQ ID NO: 4093315 - RNA, 22 nt, Variola virus
acaauaucauaaacaaacuaau

SEQ ID NO: 4093316 - RNA, 23 nt, Variola virus
acaauauuuuucguuuacaaaau

SEQ ID NO: 4093317 - RNA, 21 nt, Variola virus
acaaucaaaccuauaacauua

SEQ ID NO: 4093318 - RNA, 14 nt, Variola virus
acaauccaauaaua

SEQ ID NO: 4093319 - RNA, 18 nt, Variola virus
acaaucugucgaaaaagu

SEQ ID NO: 4093320 - RNA, 15 nt, Variola virus
acaaugauaaugaac

SEQ ID NO: 4093321 - RNA, 17 nt, Variola virus
acaaugcuauaccuaau

SEQ ID NO: 4093322 - RNA, 16 nt, Variola virus
acaauuucuauuuccu

SEQ ID NO: 4093323 - RNA, 22 nt, Variola virus
acaauuuuuuuauaauaauucu

SEQ ID NO: 4093324 - RNA, 14 nt, Variola virus
acacaaaaagaaag

SEQ ID NO: 4093325 - RNA, 19 nt, Variola virus
acacaaaaagaaagaauau

SEQ ID NO: 4093326 - RNA, 12 nt, Variola virus
acacacuuuucu

SEQ ID NO: 4093327 - RNA, 20 nt, Variola virus
acacaguaaccaaaaugaaa

SEQ ID NO: 4093328 - RNA, 15 nt, Variola virus
acacaucaaaauaac

SEQ ID NO: 4093329 - RNA, 20 nt, Variola virus
acacaucgacggacaaucua

SEQ ID NO: 4093330 - RNA, 19 nt, Variola virus
acacauucuuuagaacuuc

SEQ ID NO: 4093331 - RNA, 15 nt, Variola virus
acaccaauagaugau

SEQ ID NO: 4093332 - RNA, 22 nt, Variola virus
acaccuguuucauggaacaaua

SEQ ID NO: 4093333 - RNA, 17 nt, Variola virus
acacgagccuuuauuau

SEQ ID NO: 4093334 - RNA, 18 nt, Variola virus
acacuaccaguaucaauu

SEQ ID NO: 4093335 - RNA, 15 nt, Variola virus
acacuauuagaauua

SEQ ID NO: 4093336 - RNA, 16 nt, Variola virus
acacuauuauaugauu

SEQ ID NO: 4093337 - RNA, 17 nt, Variola virus
acacuauucuuaaaugu

SEQ ID NO: 4093338 - RNA, 20 nt, Variola virus
acacuauucuuaaaugucau

SEQ ID NO: 4093339 - RNA, 19 nt, Variola virus
acacugauauuaugaugaa

SEQ ID NO: 4093340 - RNA, 23 nt, Variola virus
acacuuauauucuuuguuauuau

SEQ ID NO: 4093341 - RNA, 15 nt, Variola virus
acacuuuauacuucu

SEQ ID NO: 4093342 - RNA, 19 nt, Variola virus
acagaaaagauauuuguua

SEQ ID NO: 4093343 - RNA, 16 nt, Variola virus
acagaaacuuagauua

SEQ ID NO: 4093344 - RNA, 19 nt, Variola virus
acagaaauauaugagaugu

SEQ ID NO: 4093345 - RNA, 15 nt, Variola virus
acagaaauaugugaa

SEQ ID NO: 4093346 - RNA, 14 nt, Variola virus
acagacauacagua

SEQ ID NO: 4093347 - RNA, 14 nt, Variola virus
acagacugaaagua

SEQ ID NO: 4093348 - RNA, 15 nt, Variola virus
acagacugaaaguau

SEQ ID NO: 4093349 - RNA, 19 nt, Variola virus
acagauagaucauuuugaa

SEQ ID NO: 4093350 - RNA, 15 nt, Variola virus
acagauguauuggau

SEQ ID NO: 4093351 - RNA, 15 nt, Variola virus
acagcauuucuguca

SEQ ID NO: 4093352 - RNA, 18 nt, Variola virus
acagcuuuaacagaugau

SEQ ID NO: 4093353 - RNA, 13 nt, Variola virus
acaggcauauuag

SEQ ID NO: 4093354 - RNA, 22 nt, Variola virus
acaguaaguacaucaucugaaa

SEQ ID NO: 4093355 - RNA, 18 nt, Variola virus
acaguguauguaaaaaug

SEQ ID NO: 4093356 - RNA, 13 nt, Variola virus
acaguuacaaaug

SEQ ID NO: 4093357 - RNA, 13 nt, Variola virus
acaguuucuagug

SEQ ID NO: 4093358 - RNA, 22 nt, Variola virus
acauaaucguagauucauguua

SEQ ID NO: 4093359 - RNA, 20 nt, Variola virus
acauaauuauucuaucaauu

SEQ ID NO: 4093360 - RNA, 14 nt, Variola virus
acauaccauggaaa

SEQ ID NO: 4093361 - RNA, 17 nt, Variola virus
acauacgucuauuucua

SEQ ID NO: 4093362 - RNA, 17 nt, Variola virus
acauacucuaauaggug

SEQ ID NO: 4093363 - RNA, 13 nt, Variola virus
acauacuuuguaa

SEQ ID NO: 4093364 - RNA, 16 nt, Variola virus
acauaguuaucuaucu

SEQ ID NO: 4093365 - RNA, 16 nt, Variola virus
acauauaauaaugaau

SEQ ID NO: 4093366 - RNA, 17 nt, Variola virus
acauaucgguguuucca

SEQ ID NO: 4093367 - RNA, 22 nt, Variola virus
acauauuaguaacuguuuucca

SEQ ID NO: 4093368 - RNA, 14 nt, Variola virus
acauauuuauaauu

SEQ ID NO: 4093369 - RNA, 20 nt, Variola virus
acauauuuguuugauaauua

SEQ ID NO: 4093370 - RNA, 22 nt, Variola virus
acauauuuuagaacagaaauac

SEQ ID NO: 4093371 - RNA, 16 nt, Variola virus
acaucauaaaaugagu

SEQ ID NO: 4093372 - RNA, 15 nt, Variola virus
acaucaucauuuacc

SEQ ID NO: 4093373 - RNA, 16 nt, Variola virus
acauccaaaauacaaa

SEQ ID NO: 4093374 - RNA, 20 nt, Variola virus
acauccaucuucucuagaaa

SEQ ID NO: 4093375 - RNA, 15 nt, Variola virus
acauccauuucuaga

SEQ ID NO: 4093376 - RNA, 16 nt, Variola virus
auucaauuaguuuauu

SEQ ID NO: 4093377 - RNA, 13 nt, Variola virus
auucacaaauaua

SEQ ID NO: 4093378 - RNA, 16 nt, Variola virus
auucacauaaaggaua

SEQ ID NO: 4093379 - RNA, 14 nt, Variola virus
auucacuuaacaau

SEQ ID NO: 4093380 - RNA, 19 nt, Variola virus
auucagaacucaacucauc

SEQ ID NO: 4093381 - RNA, 20 nt, Variola virus
auucagaauuucuacauaau

SEQ ID NO: 4093382 - RNA, 17 nt, Variola virus
auucagcugaaaugaga

SEQ ID NO: 4093383 - RNA, 14 nt, Variola virus
auucaguaaauaga

SEQ ID NO: 4093384 - RNA, 20 nt, Variola virus
auucauaaaacauaaucaag

SEQ ID NO: 4093385 - RNA, 13 nt, Variola virus
auucauaacgaga

SEQ ID NO: 4093386 - RNA, 22 nt, Variola virus
auucauaauaagauaaauccau

SEQ ID NO: 4093387 - RNA, 17 nt, Variola virus
auucaugauaaacuuaa

SEQ ID NO: 4093388 - RNA, 21 nt, Variola virus
auucauuaggauuaucaaauc

SEQ ID NO: 4093389 - RNA, 12 nt, Variola virus
auucauuuccau

SEQ ID NO: 4093390 - RNA, 12 nt, Variola virus
auuccaaaauug

SEQ ID NO: 4093391 - RNA, 12 nt, Variola virus
auuccaaagauc

SEQ ID NO: 4093392 - RNA, 15 nt, Variola virus
auuccaacaaacgaa

SEQ ID NO: 4093393 - RNA, 20 nt, Variola virus
auuccagcuaucagauuaug

SEQ ID NO: 4093394 - RNA, 23 nt, Variola virus
auuccggcguaugaauugacauu

SEQ ID NO: 4093395 - RNA, 19 nt, Variola virus
auuccuaccaaacaaaauu

SEQ ID NO: 4093396 - RNA, 18 nt, Variola virus
auuccugacugauuaaca

SEQ ID NO: 4093397 - RNA, 17 nt, Variola virus
auucgaaauuagaaagu

SEQ ID NO: 4093398 - RNA, 21 nt, Variola virus
auucgaagcaguuacaaugac

SEQ ID NO: 4093399 - RNA, 15 nt, Variola virus
auucguucaaaaaua

SEQ ID NO: 4093400 - RNA, 13 nt, Variola virus
auucuaaaugaug

SEQ ID NO: 4093401 - RNA, 13 nt, Variola virus
auucuaaauggau

SEQ ID NO: 4093402 - RNA, 21 nt, Variola virus
auucuaccuuuuuauuuucua

SEQ ID NO: 4093403 - RNA, 18 nt, Variola virus
auucuagcggcuagaaug

SEQ ID NO: 4093404 - RNA, 21 nt, Variola virus
auucuaggcucaguauguaaa

SEQ ID NO: 4093405 - RNA, 19 nt, Variola virus
auucuaugaauuuauaaaa

SEQ ID NO: 4093406 - RNA, 20 nt, Variola virus
auucuaugaugguauugaag

SEQ ID NO: 4093407 - RNA, 18 nt, Variola virus
auucuauuuuacaaauaa

SEQ ID NO: 4093408 - RNA, 19 nt, Variola virus
auucucuaguuacacuaug

SEQ ID NO: 4093409 - RNA, 19 nt, Variola virus
auucucuuaauuauaacga

SEQ ID NO: 4093410 - RNA, 13 nt, Variola virus
auucugaauagau

SEQ ID NO: 4093411 - RNA, 19 nt, Variola virus
auucugccguguuuaaaaa

SEQ ID NO: 4093412 - RNA, 16 nt, Variola virus
auucuuagucaaugga

SEQ ID NO: 4093413 - RNA, 18 nt, Variola virus
auucuucgcccucaauuu

SEQ ID NO: 4093414 - RNA, 23 nt, Variola virus
auucuucuuuaaacgauuuucca

SEQ ID NO: 4093415 - RNA, 12 nt, Variola virus
auucuuucaaag

SEQ ID NO: 4093416 - RNA, 13 nt, Variola virus
auucuuucaauuc

SEQ ID NO: 4093417 - RNA, 20 nt, Variola virus
auugaagaaggagaagauau

SEQ ID NO: 4093418 - RNA, 12 nt, Variola virus
auugacaaaauu

SEQ ID NO: 4093419 - RNA, 19 nt, Variola virus
auugauaucgcauagaaau

SEQ ID NO: 4093420 - RNA, 23 nt, Variola virus
auugaugugucuguuuauacaau

SEQ ID NO: 4093421 - RNA, 17 nt, Variola virus
auugauuacuauaaaug

SEQ ID NO: 4093422 - RNA, 17 nt, Variola virus
auugauuauuucaaaga

SEQ ID NO: 4093423 - RNA, 20 nt, Variola virus
auugauuauuucaaagacua

SEQ ID NO: 4093424 - RNA, 13 nt, Variola virus
auugcugcauaug

SEQ ID NO: 4093425 - RNA, 15 nt, Variola virus
auuggaaaauuagug

SEQ ID NO: 4093426 - RNA, 19 nt, Variola virus
auuggauaguuuuuuugaa

SEQ ID NO: 4093427 - RNA, 15 nt, Variola virus
auuggcuuuucuuua

SEQ ID NO: 4093428 - RNA, 16 nt, Variola virus
auugguagcugaaugu

SEQ ID NO: 4093429 - RNA, 21 nt, Variola virus
auugguuccgagucacaaaua

SEQ ID NO: 4093430 - RNA, 17 nt, Variola virus
auuguaaaagaaauaua

SEQ ID NO: 4093431 - RNA, 20 nt, Variola virus
auuguacacuucuauaguau

SEQ ID NO: 4093432 - RNA, 20 nt, Variola virus
auuguacuauacauuuugaa

SEQ ID NO: 4093433 - RNA, 18 nt, Variola virus
auuguauccauacauaca

SEQ ID NO: 4093434 - RNA, 22 nt, Variola virus
auugucugacauaagaugucua

SEQ ID NO: 4093435 - RNA, 16 nt, Variola virus
auugucuuaacuauaa

SEQ ID NO: 4093436 - RNA, 19 nt, Variola virus
auuguugccguaaauccug

SEQ ID NO: 4093437 - RNA, 20 nt, Variola virus
auuguuuugaagaaaugaua

SEQ ID NO: 4093438 - RNA, 16 nt, Variola virus
auuuaaaaaguauuua

SEQ ID NO: 4093439 - RNA, 12 nt, Variola virus
auuuaaauccua

SEQ ID NO: 4093440 - RNA, 13 nt, Variola virus
auuuaacacuaua

SEQ ID NO: 4093441 - RNA, 20 nt, Variola virus
auuuaacuagauuauacaau

SEQ ID NO: 4093442 - RNA, 20 nt, Variola virus
auuuaaggcuuuaaaauuga

SEQ ID NO: 4093443 - RNA, 15 nt, Variola virus
auuuaagugaugcau

SEQ ID NO: 4093444 - RNA, 13 nt, Variola virus
auuuaaucuaucu

SEQ ID NO: 4093445 - RNA, 17 nt, Variola virus
auuuaauuguauaccuu

SEQ ID NO: 4093446 - RNA, 21 nt, Variola virus
auuuaauuuuguaguuaauuu

SEQ ID NO: 4093447 - RNA, 14 nt, Variola virus
auuuacacacauaa

SEQ ID NO: 4093448 - RNA, 14 nt, Variola virus
auuuacauuaaaug

SEQ ID NO: 4093449 - RNA, 16 nt, Variola virus
auuuacauuaaaugua

SEQ ID NO: 4093450 - RNA, 22 nt, Variola virus
auuuaccaucccauauauucca

SEQ ID NO: 4093451 - RNA, 11 nt, Variola virus
auuuacuaaca

SEQ ID NO: 4093452 - RNA, 18 nt, Variola virus
auuuagauacaucuauau

SEQ ID NO: 4093453 - RNA, 15 nt, Variola virus
auuuagauacuaaca

SEQ ID NO: 4093454 - RNA, 14 nt, Variola virus
auuuagcaaaauua

SEQ ID NO: 4093455 - RNA, 14 nt, Variola virus
auuuagcaaaauuc

SEQ ID NO: 4093456 - RNA, 23 nt, Variola virus
auuuaguuucuucgauauuggau

SEQ ID NO: 4093457 - RNA, 15 nt, Variola virus
auuuauaaugucuac

SEQ ID NO: 4093458 - RNA, 15 nt, Variola virus
auuuauacuacuaau

SEQ ID NO: 4093459 - RNA, 23 nt, Variola virus
auuuauauccuauauacgaaaaa

SEQ ID NO: 4093460 - RNA, 21 nt, Variola virus
auuuaucuaaccauucaauua

SEQ ID NO: 4093461 - RNA, 19 nt, Variola virus
auuuaucuguuuuggugaa

SEQ ID NO: 4093462 - RNA, 23 nt, Variola virus
auuuaugucauaaacuguaaaug

SEQ ID NO: 4093463 - RNA, 16 nt, Variola virus
auuuauguuuuaaaua

SEQ ID NO: 4093464 - RNA, 19 nt, Variola virus
auuuauucaucaucaaaag

SEQ ID NO: 4093465 - RNA, 23 nt, Variola virus
auuuauuggucguccuaugcaua

SEQ ID NO: 4093466 - RNA, 14 nt, Variola virus
auuuauuugaugaa

SEQ ID NO: 4093467 - RNA, 15 nt, Variola virus
auuucaaaauuauuu

SEQ ID NO: 4093468 - RNA, 16 nt, Variola virus
auuucaaauauauuua

SEQ ID NO: 4093469 - RNA, 22 nt, Variola virus
auuucaacaauaaugagaaugu

SEQ ID NO: 4093470 - RNA, 22 nt, Variola virus
auuucaucuguaguauucuugu

SEQ ID NO: 4093471 - RNA, 19 nt, Variola virus
auuuccaaacuguugacuu

SEQ ID NO: 4093472 - RNA, 21 nt, Variola virus
auuuccaaagauacacacauu

SEQ ID NO: 4093473 - RNA, 23 nt, Variola virus
auuuccaucucuaucuaauacag

SEQ ID NO: 4093474 - RNA, 17 nt, Variola virus
auuucuagaaaaaauua

SEQ ID NO: 4093475 - RNA, 15 nt, Variola virus
auuucuauucaugaa

SEQ ID NO: 4093476 - RNA, 12 nt, Variola virus
auuucuauuuuu

SEQ ID NO: 4093477 - RNA, 23 nt, Variola virus
auuucuggauauguuuuuaauaa

SEQ ID NO: 4093478 - RNA, 19 nt, Variola virus
auuucuuuuucaaagaaaa

SEQ ID NO: 4093479 - RNA, 14 nt, Variola virus
auuugaacuuaacu

SEQ ID NO: 4093480 - RNA, 14 nt, Variola virus
auuugaaguauuug

SEQ ID NO: 4093481 - RNA, 12 nt, Variola virus
auuugacuagau

SEQ ID NO: 4093482 - RNA, 17 nt, Variola virus
auuugauaaagauagau

SEQ ID NO: 4093483 - RNA, 20 nt, Variola virus
auuugauacggacaugguau

SEQ ID NO: 4093484 - RNA, 14 nt, Variola virus
auuugauuaguaga

SEQ ID NO: 4093485 - RNA, 19 nt, Variola virus
auuugauuauuuugaagac

SEQ ID NO: 4093486 - RNA, 20 nt, Variola virus
auuuggaauuuauuaauaca

SEQ ID NO: 4093487 - RNA, 18 nt, Variola virus
auuuggagcuuuaauagu

SEQ ID NO: 4093488 - RNA, 17 nt, Variola virus
auuuggcgcuuuucucu

SEQ ID NO: 4093489 - RNA, 19 nt, Variola virus
auuugggccauuauaccuc

SEQ ID NO: 4093490 - RNA, 22 nt, Variola virus
auuuggucauaauagaauguau

SEQ ID NO: 4093491 - RNA, 21 nt, Variola virus
auuuguaauaauccuaucuaa

SEQ ID NO: 4093492 - RNA, 16 nt, Variola virus
auuuguacacaucuau

SEQ ID NO: 4093493 - RNA, 14 nt, Variola virus
auuuguacauuauu

SEQ ID NO: 4093494 - RNA, 16 nt, Variola virus
auuugucgcauuccuu

SEQ ID NO: 4093495 - RNA, 19 nt, Variola virus
auuuguugacgacauauau

SEQ ID NO: 4093496 - RNA, 14 nt, Variola virus
auuuuaaaaaacug

SEQ ID NO: 4093497 - RNA, 20 nt, Variola virus
auuuuaaaaucaaaaaggag

SEQ ID NO: 4093498 - RNA, 20 nt, Variola virus
auuuuaaaauuauuaaacaa

SEQ ID NO: 4093499 - RNA, 21 nt, Variola virus
auuuuaagaaaugguguaacu

SEQ ID NO: 4093500 - RNA, 17 nt, Variola virus
auuuuaaguuuauugac

SEQ ID NO: 4093501 - RNA, 15 nt, Variola virus
auuuuaauauagcug

SEQ ID NO: 4093502 - RNA, 14 nt, Variola virus
caucaaaaaacaac

SEQ ID NO: 4093503 - RNA, 19 nt, Variola virus
caucaaacgaauaaacaau

SEQ ID NO: 4093504 - RNA, 14 nt, Variola virus
caucaaauggaugc

SEQ ID NO: 4093505 - RNA, 20 nt, Variola virus
caucaacucucucauuuucu

SEQ ID NO: 4093506 - RNA, 13 nt, Variola virus
caucaauuuugaa

SEQ ID NO: 4093507 - RNA, 21 nt, Variola virus
caucagauguuccggaaagag

SEQ ID NO: 4093508 - RNA, 15 nt, Variola virus
caucauuaucauuuu

SEQ ID NO: 4093509 - RNA, 14 nt, Variola virus
cauccauauguuug

SEQ ID NO: 4093510 - RNA, 23 nt, Variola virus
caucgauugugauuguauuuccu

SEQ ID NO: 4093511 - RNA, 16 nt, Variola virus
caucgcauacaaaaac

SEQ ID NO: 4093512 - RNA, 16 nt, Variola virus
caucggcaacauacua

SEQ ID NO: 4093513 - RNA, 16 nt, Variola virus
caucgucucaucuguu

SEQ ID NO: 4093514 - RNA, 19 nt, Variola virus
caucuaacuauaugauauc

SEQ ID NO: 4093515 - RNA, 17 nt, Variola virus
caucuaauaauuuggau

SEQ ID NO: 4093516 - RNA, 14 nt, Variola virus
caucuacaaaaaca

SEQ ID NO: 4093517 - RNA, 18 nt, Variola virus
caucuaguugauauucca

SEQ ID NO: 4093518 - RNA, 18 nt, Variola virus
caucuauaggugaugcug

SEQ ID NO: 4093519 - RNA, 20 nt, Variola virus
caucuauauugcuacauaau

SEQ ID NO: 4093520 - RNA, 12 nt, Variola virus
caucuaucaucu

SEQ ID NO: 4093521 - RNA, 23 nt, Variola virus
caucuaucaucuccacacaguca

SEQ ID NO: 4093522 - RNA, 14 nt, Variola virus
caucugcucaacaa

SEQ ID NO: 4093523 - RNA, 20 nt, Variola virus
caucugggaauaaaauacua

SEQ ID NO: 4093524 - RNA, 15 nt, Variola virus
caucuguuguaucau

SEQ ID NO: 4093525 - RNA, 20 nt, Variola virus
caucuucuuugauuaaugau

SEQ ID NO: 4093526 - RNA, 21 nt, Variola virus
caucuuggggaaauauggaag

SEQ ID NO: 4093527 - RNA, 14 nt, Variola virus
caugaccuucuuca

SEQ ID NO: 4093528 - RNA, 18 nt, Variola virus
caugauacuaaguauaau

SEQ ID NO: 4093529 - RNA, 20 nt, Variola virus
caugcaaagcucuaaaucca

SEQ ID NO: 4093530 - RNA, 19 nt, Variola virus
caugccucagguucaucga

SEQ ID NO: 4093531 - RNA, 13 nt, Variola virus
caugcuaccuaau

SEQ ID NO: 4093532 - RNA, 17 nt, Variola virus
cauggaaauuuaacagc

SEQ ID NO: 4093533 - RNA, 14 nt, Variola virus
cauggaagaacuac

SEQ ID NO: 4093534 - RNA, 21 nt, Variola virus
cauggcucguaccaacaguaa

SEQ ID NO: 4093535 - RNA, 20 nt, Variola virus
cauggucuagauguaaaaaa

SEQ ID NO: 4093536 - RNA, 19 nt, Variola virus
cauguacauauuuguacau

SEQ ID NO: 4093537 - RNA, 22 nt, Variola virus
cauguauugcuguauuuguaau

SEQ ID NO: 4093538 - RNA, 14 nt, Variola virus
caugucaacaaaaa

SEQ ID NO: 4093539 - RNA, 19 nt, Variola virus
caugucuauuguuaaucau

SEQ ID NO: 4093540 - RNA, 12 nt, Variola virus
caugucuucaau

SEQ ID NO: 4093541 - RNA, 20 nt, Variola virus
cauguguauuacaugcaucu

SEQ ID NO: 4093542 - RNA, 18 nt, Variola virus
cauguuccuauuaugaaa

SEQ ID NO: 4093543 - RNA, 16 nt, Variola virus
cauguucgaaaaagug

SEQ ID NO: 4093544 - RNA, 14 nt, Variola virus
cauuaaggagauuc

SEQ ID NO: 4093545 - RNA, 21 nt, Variola virus
cauuaaggcguugaugcaauu

SEQ ID NO: 4093546 - RNA, 15 nt, Variola virus
cauuaauaacauccu

SEQ ID NO: 4093547 - RNA, 20 nt, Variola virus
cauuaauaauuguuuugaau

SEQ ID NO: 4093548 - RNA, 20 nt, Variola virus
cauuaauauaugcucuagau

SEQ ID NO: 4093549 - RNA, 15 nt, Variola virus
cauuaauccugucaa

SEQ ID NO: 4093550 - RNA, 15 nt, Variola virus
cauuaauuauaacgg

SEQ ID NO: 4093551 - RNA, 16 nt, Variola virus
cauuaauuucugauau

SEQ ID NO: 4093552 - RNA, 19 nt, Variola virus
cauuacauauuauaucaau

SEQ ID NO: 4093553 - RNA, 22 nt, Variola virus
cauuaccuccacgauacauuug

SEQ ID NO: 4093554 - RNA, 20 nt, Variola virus
cauuacuaguugauaacaau

SEQ ID NO: 4093555 - RNA, 16 nt, Variola virus
cauuagcaaucuuuua

SEQ ID NO: 4093556 - RNA, 22 nt, Variola virus
cauuagccacguucacuguaaa

SEQ ID NO: 4093557 - RNA, 20 nt, Variola virus
cauuagcgcauguacauauu

SEQ ID NO: 4093558 - RNA, 22 nt, Variola virus
cauuagcgcauguacauauuug

SEQ ID NO: 4093559 - RNA, 19 nt, Variola virus
cauuaguaaggcuuuagaa

SEQ ID NO: 4093560 - RNA, 23 nt, Variola virus
cauuaguuaaugaaaauaacucu

SEQ ID NO: 4093561 - RNA, 17 nt, Variola virus
cauuaucgauacuaauu

SEQ ID NO: 4093562 - RNA, 23 nt, Variola virus
cauuaucuggauuaaacauacua

SEQ ID NO: 4093563 - RNA, 17 nt, Variola virus
cauuauuuuuuuggaau

SEQ ID NO: 4093564 - RNA, 15 nt, Variola virus
cauucauaaaaacca

SEQ ID NO: 4093565 - RNA, 19 nt, Variola virus
cauucuaauauauguauuu

SEQ ID NO: 4093566 - RNA, 19 nt, Variola virus
cauucuaauguucauaauu

SEQ ID NO: 4093567 - RNA, 17 nt, Variola virus
cauugaucuauuauuua

SEQ ID NO: 4093568 - RNA, 18 nt, Variola virus
cauugcgcuauacaguau

SEQ ID NO: 4093569 - RNA, 22 nt, Variola virus
cauuggauuggauaauaauaca

SEQ ID NO: 4093570 - RNA, 19 nt, Variola virus
cauuggcuagguauaugca

SEQ ID NO: 4093571 - RNA, 23 nt, Variola virus
cauuguuuacggugauguuuauc

SEQ ID NO: 4093572 - RNA, 11 nt, Variola virus
cauuuaaacau

SEQ ID NO: 4093573 - RNA, 12 nt, Variola virus
cauuuaaacauu

SEQ ID NO: 4093574 - RNA, 21 nt, Variola virus
cauuuaguuuauuacuauuac

SEQ ID NO: 4093575 - RNA, 19 nt, Variola virus
cauuuauaacggucaauau

SEQ ID NO: 4093576 - RNA, 18 nt, Variola virus
cauuuauaacguacaaau

SEQ ID NO: 4093577 - RNA, 14 nt, Variola virus
cauuuauacacaau

SEQ ID NO: 4093578 - RNA, 21 nt, Variola virus
cauuuaucacaaaaaaaacuu

SEQ ID NO: 4093579 - RNA, 22 nt, Variola virus
cauuuaucgcuaacaugcauuu

SEQ ID NO: 4093580 - RNA, 19 nt, Variola virus
cauuuauggcguauacaac

SEQ ID NO: 4093581 - RNA, 17 nt, Variola virus
cauuuauuauauauaau

SEQ ID NO: 4093582 - RNA, 20 nt, Variola virus
cauuucugcauuacaaagaa

SEQ ID NO: 4093583 - RNA, 17 nt, Variola virus
cauuuuacuuuaacaau

SEQ ID NO: 4093584 - RNA, 21 nt, Variola virus
cauuuuauggaaacuauaauu

SEQ ID NO: 4093585 - RNA, 13 nt, Variola virus
cauuuuauuucua

SEQ ID NO: 4093586 - RNA, 21 nt, Variola virus
cauuuucaauaauauacuaau

SEQ ID NO: 4093587 - RNA, 19 nt, Variola virus
cauuuuccagaugauaugu

SEQ ID NO: 4093588 - RNA, 15 nt, Variola virus
cauuuuuuuaaaacu

SEQ ID NO: 4093589 - RNA, 23 nt, Variola virus
ccaaaaauuuuuaaaguauaucu

SEQ ID NO: 4093590 - RNA, 14 nt, Variola virus
ccaaaaugaugaua

SEQ ID NO: 4093591 - RNA, 14 nt, Variola virus
ccaaacaauaccau

SEQ ID NO: 4093592 - RNA, 13 nt, Variola virus
ccaaauucuggaa

SEQ ID NO: 4093593 - RNA, 14 nt, Variola virus
ccaacaaaacaauu

SEQ ID NO: 4093594 - RNA, 22 nt, Variola virus
ccaaccaaacggaguaaaauaa

SEQ ID NO: 4093595 - RNA, 16 nt, Variola virus
ccaacuuaaacaaaau

SEQ ID NO: 4093596 - RNA, 21 nt, Variola virus
ccaagagaugcaauacaaaag

SEQ ID NO: 4093597 - RNA, 22 nt, Variola virus
ccaagauccucucuuaaaugaa

SEQ ID NO: 4093598 - RNA, 21 nt, Variola virus
ccaagucauaucuagaaugaa

SEQ ID NO: 4093599 - RNA, 15 nt, Variola virus
ccaaguuaaauuuua

SEQ ID NO: 4093600 - RNA, 14 nt, Variola virus
ccaauaaaauuacu

SEQ ID NO: 4093601 - RNA, 14 nt, Variola virus
ccaaugaaauggua

SEQ ID NO: 4093602 - RNA, 17 nt, Variola virus
ccaauucguauaaauau

SEQ ID NO: 4093603 - RNA, 17 nt, Variola virus
ccacggauauacaaaac

SEQ ID NO: 4093604 - RNA, 16 nt, Variola virus
ccacguuuaaacauuc

SEQ ID NO: 4093605 - RNA, 17 nt, Variola virus
ccacugaugagauguua

SEQ ID NO: 4093606 - RNA, 17 nt, Variola virus
ccacugucacuggaaag

SEQ ID NO: 4093607 - RNA, 19 nt, Variola virus
ccacuuuaauaauaucaua

SEQ ID NO: 4093608 - RNA, 15 nt, Variola virus
ccagaaguauuuuua

SEQ ID NO: 4093609 - RNA, 22 nt, Variola virus
ccagauuuaaaaagguucacau

SEQ ID NO: 4093610 - RNA, 15 nt, Variola virus
ccaguacaucuauca

SEQ ID NO: 4093611 - RNA, 12 nt, Variola virus
ccagucaugaau

SEQ ID NO: 4093612 - RNA, 14 nt, Variola virus
ccagugcuauaucu

SEQ ID NO: 4093613 - RNA, 15 nt, Variola virus
ccauaagcaaacuga

SEQ ID NO: 4093614 - RNA, 13 nt, Variola virus
ccauagaggaugu

SEQ ID NO: 4093615 - RNA, 17 nt, Variola virus
ccauaguuuguaucaau

SEQ ID NO: 4093616 - RNA, 21 nt, Variola virus
ccauauauguuuucaucauuu

SEQ ID NO: 4093617 - RNA, 21 nt, Variola virus
ccauaucuaaagcuauguuua

SEQ ID NO: 4093618 - RNA, 21 nt, Variola virus
ccauccaagucaauaucuuua

SEQ ID NO: 4093619 - RNA, 21 nt, Variola virus
ccaucuccuuauuuuuaaaaa

SEQ ID NO: 4093620 - RNA, 14 nt, Variola virus
ccaucuuacaugau

SEQ ID NO: 4093621 - RNA, 18 nt, Variola virus
ccaugauggucauguuua

SEQ ID NO: 4093622 - RNA, 19 nt, Variola virus
ccauggacucauaaucucu

SEQ ID NO: 4093623 - RNA, 15 nt, Variola virus
ccauggauaaaguua

SEQ ID NO: 4093624 - RNA, 17 nt, Variola virus
ccauguuucaucuauca

SEQ ID NO: 4093625 - RNA, 16 nt, Variola virus
ccauuaaaaauuguua

SEQ ID NO: 4093626 - RNA, 13 nt, Variola virus
ccauuaaagaauu

SEQ ID NO: 4093627 - RNA, 15 nt, Variola virus
cuaauaucauuagua

SEQ ID NO: 4093628 - RNA, 22 nt, Variola virus
cuaaucuaaacgcguuagauaa

SEQ ID NO: 4093629 - RNA, 13 nt, Variola virus
cuaaucuauuuua

SEQ ID NO: 4093630 - RNA, 23 nt, Variola virus
cuaaugacaauaauuauguagua

SEQ ID NO: 4093631 - RNA, 23 nt, Variola virus
cuaaugaguuauuaagaaauaca

SEQ ID NO: 4093632 - RNA, 11 nt, Variola virus
cuaaugauaua

SEQ ID NO: 4093633 - RNA, 18 nt, Variola virus
cuaauuaaucuaaaaucu

SEQ ID NO: 4093634 - RNA, 12 nt, Variola virus
cuaauuaauuuu

SEQ ID NO: 4093635 - RNA, 23 nt, Variola virus
cuaauuauacuuugguaaauguu

SEQ ID NO: 4093636 - RNA, 20 nt, Variola virus
cuaauugucuuucucuuuua

SEQ ID NO: 4093637 - RNA, 20 nt, Variola virus
cuaauuuuguagcauuagua

SEQ ID NO: 4093638 - RNA, 19 nt, Variola virus
cuacaaaaaggacauguaa

SEQ ID NO: 4093639 - RNA, 22 nt, Variola virus
cuacaauauauauucauagagg

SEQ ID NO: 4093640 - RNA, 15 nt, Variola virus
cuacauaaaacauca

SEQ ID NO: 4093641 - RNA, 17 nt, Variola virus
cuaccauaucagcucuc

SEQ ID NO: 4093642 - RNA, 23 nt, Variola virus
cuaccgucgucgaaauaucuuuc

SEQ ID NO: 4093643 - RNA, 17 nt, Variola virus
cuaccguuguuaaauac

SEQ ID NO: 4093644 - RNA, 15 nt, Variola virus
cuacguuuggagaca

SEQ ID NO: 4093645 - RNA, 20 nt, Variola virus
cuacuacacuucuagauauc

SEQ ID NO: 4093646 - RNA, 19 nt, Variola virus
cuacuauggaauuaauuuu

SEQ ID NO: 4093647 - RNA, 16 nt, Variola virus
cuacucauagaaaggu

SEQ ID NO: 4093648 - RNA, 19 nt, Variola virus
cuacugcguccgcuuuagu

SEQ ID NO: 4093649 - RNA, 21 nt, Variola virus
cuagauaaaauacugaaucaa

SEQ ID NO: 4093650 - RNA, 11 nt, Variola virus
cuagauacauu

SEQ ID NO: 4093651 - RNA, 22 nt, Variola virus
cuagauauguauuuaauaucaa

SEQ ID NO: 4093652 - RNA, 23 nt, Variola virus
cuagauauguauuuaauaucaaa

SEQ ID NO: 4093653 - RNA, 17 nt, Variola virus
cuagaucaagaaacauu

SEQ ID NO: 4093654 - RNA, 21 nt, Variola virus
cuagauuaucuagucagaacu

SEQ ID NO: 4093655 - RNA, 13 nt, Variola virus
cuagcaaaacuau

SEQ ID NO: 4093656 - RNA, 19 nt, Variola virus
cuagguacaucauuuagau

SEQ ID NO: 4093657 - RNA, 14 nt, Variola virus
cuaggucuacagaa

SEQ ID NO: 4093658 - RNA, 16 nt, Variola virus
cuaguacugaggauuu

SEQ ID NO: 4093659 - RNA, 14 nt, Variola virus
cuaguagaaaagau

SEQ ID NO: 4093660 - RNA, 17 nt, Variola virus
cuaguagcgaaaacuau

SEQ ID NO: 4093661 - RNA, 21 nt, Variola virus
cuaguauagcagaaguuuaua

SEQ ID NO: 4093662 - RNA, 16 nt, Variola virus
cuaguuaaaauuuuaa

SEQ ID NO: 4093663 - RNA, 13 nt, Variola virus
cuaguucucucuc

SEQ ID NO: 4093664 - RNA, 19 nt, Variola virus
cuaguuucagaauuuucua

SEQ ID NO: 4093665 - RNA, 18 nt, Variola virus
cuaguuuucuaaguucua

SEQ ID NO: 4093666 - RNA, 23 nt, Variola virus
cuauaaagucugucaaaucaucu

SEQ ID NO: 4093667 - RNA, 19 nt, Variola virus
cuauaacauuaauaucaaa

SEQ ID NO: 4093668 - RNA, 17 nt, Variola virus
cuauaaugacaauaaaa

SEQ ID NO: 4093669 - RNA, 22 nt, Variola virus
cuauacauugcgccaucguguu

SEQ ID NO: 4093670 - RNA, 18 nt, Variola virus
cuauagaaauuauuuuua

SEQ ID NO: 4093671 - RNA, 17 nt, Variola virus
cuauagaccaaacugua

SEQ ID NO: 4093672 - RNA, 22 nt, Variola virus
cuauaguacacggaauaaugau

SEQ ID NO: 4093673 - RNA, 11 nt, Variola virus
cuauaguucuc

SEQ ID NO: 4093674 - RNA, 18 nt, Variola virus
cuauaguuuccacauuaa

SEQ ID NO: 4093675 - RNA, 13 nt, Variola virus
cuauauagauauu

SEQ ID NO: 4093676 - RNA, 15 nt, Variola virus
cuauaucuaacaucu

SEQ ID NO: 4093677 - RNA, 13 nt, Variola virus
cuauauuaauagg

SEQ ID NO: 4093678 - RNA, 24 nt, Variola virus
cuaucaauagcaguuuauuaucca

SEQ ID NO: 4093679 - RNA, 15 nt, Variola virus
cuaucacuguagaaa

SEQ ID NO: 4093680 - RNA, 14 nt, Variola virus
cuaucauguauuug

SEQ ID NO: 4093681 - RNA, 18 nt, Variola virus
cuaucaugucuauucucc

SEQ ID NO: 4093682 - RNA, 21 nt, Variola virus
cuaucgaaaauugcuauuuca

SEQ ID NO: 4093683 - RNA, 16 nt, Variola virus
cuaucgcauguggaug

SEQ ID NO: 4093684 - RNA, 15 nt, Variola virus
cuaucuaucuguauu

SEQ ID NO: 4093685 - RNA, 20 nt, Variola virus
cuaucuuuagcuucugaaau

SEQ ID NO: 4093686 - RNA, 17 nt, Variola virus
cuaugaauuuauaaaau

SEQ ID NO: 4093687 - RNA, 16 nt, Variola virus
cuaugauuaaaucguu

SEQ ID NO: 4093688 - RNA, 16 nt, Variola virus
cuaugccaacacaaac

SEQ ID NO: 4093689 - RNA, 14 nt, Variola virus
cuauggaacaaaau

SEQ ID NO: 4093690 - RNA, 13 nt, Variola virus
cuauguaaaugau

SEQ ID NO: 4093691 - RNA, 18 nt, Variola virus
cuaugucaaaaauuguag

SEQ ID NO: 4093692 - RNA, 15 nt, Variola virus
cuauguuaauaugua

SEQ ID NO: 4093693 - RNA, 17 nt, Variola virus
cuauguuccucguuucc

SEQ ID NO: 4093694 - RNA, 15 nt, Variola virus
cuauuaaagauggag

SEQ ID NO: 4093695 - RNA, 20 nt, Variola virus
cuauuacaccgccuccuaua

SEQ ID NO: 4093696 - RNA, 15 nt, Variola virus
cuauuauaucuuuuu

SEQ ID NO: 4093697 - RNA, 19 nt, Variola virus
cuauuauuauuaauuuuag

SEQ ID NO: 4093698 - RNA, 17 nt, Variola virus
cuauucaguaguguuua

SEQ ID NO: 4093699 - RNA, 12 nt, Variola virus
cuauucauguaa

SEQ ID NO: 4093700 - RNA, 16 nt, Variola virus
cuauugacugaacaau

SEQ ID NO: 4093701 - RNA, 20 nt, Variola virus
cuauugaucaaguauacaau

SEQ ID NO: 4093702 - RNA, 19 nt, Variola virus
cuauugcuuccaugcuacc

SEQ ID NO: 4093703 - RNA, 20 nt, Variola virus
cuauugugucuguuaauaga

SEQ ID NO: 4093704 - RNA, 21 nt, Variola virus
cuauuuagaucauuaacucua

SEQ ID NO: 4093705 - RNA, 20 nt, Variola virus
cuauuucauacuauuuugug

SEQ ID NO: 4093706 - RNA, 13 nt, Variola virus
cuauuuuaauagg

SEQ ID NO: 4093707 - RNA, 17 nt, Variola virus
cuauuuuaccagcauua

SEQ ID NO: 4093708 - RNA, 18 nt, Variola virus
cuauuuugguaucuucca

SEQ ID NO: 4093709 - RNA, 22 nt, Variola virus
cucaaagagaauuauauauuua

SEQ ID NO: 4093710 - RNA, 17 nt, Variola virus
cucaaauaaauacucua

SEQ ID NO: 4093711 - RNA, 10 nt, Variola virus
cucaaaugua

SEQ ID NO: 4093712 - RNA, 16 nt, Variola virus
cucaacauaaauaauu

SEQ ID NO: 4093713 - RNA, 23 nt, Variola virus
cucaauauuuaucuagagugagu

SEQ ID NO: 4093714 - RNA, 15 nt, Variola virus
cucaccaauaauuuu

SEQ ID NO: 4093715 - RNA, 19 nt, Variola virus
cucacuucucuucauuacu

SEQ ID NO: 4093716 - RNA, 13 nt, Variola virus
cucagaaagauau

SEQ ID NO: 4093717 - RNA, 16 nt, Variola virus
cucagugcaaagauua

SEQ ID NO: 4093718 - RNA, 19 nt, Variola virus
cucaguuugauauuacuaa

SEQ ID NO: 4093719 - RNA, 19 nt, Variola virus
cucauaaguguauauaucu

SEQ ID NO: 4093720 - RNA, 16 nt, Variola virus
cucauuaaacagcauu

SEQ ID NO: 4093721 - RNA, 19 nt, Variola virus
cucauugauuauauucuca

SEQ ID NO: 4093722 - RNA, 19 nt, Variola virus
cuccacaguuuuuaauuuc

SEQ ID NO: 4093723 - RNA, 19 nt, Variola virus
cuccagauacauauggauc

SEQ ID NO: 4093724 - RNA, 18 nt, Variola virus
cuccagauuucauaauau

SEQ ID NO: 4093725 - RNA, 16 nt, Variola virus
cuccaguagcaugugg

SEQ ID NO: 4093726 - RNA, 17 nt, Variola virus
cuccguauuccaaacua

SEQ ID NO: 4093727 - RNA, 21 nt, Variola virus
cuccgucaucaucuccuggag

SEQ ID NO: 4093728 - RNA, 14 nt, Variola virus
cuccuauauuuccc

SEQ ID NO: 4093729 - RNA, 14 nt, Variola virus
cucgaauacaaauu

SEQ ID NO: 4093730 - RNA, 12 nt, Variola virus
cucguccuuggu

SEQ ID NO: 4093731 - RNA, 13 nt, Variola virus
cucguccuugguu

SEQ ID NO: 4093732 - RNA, 22 nt, Variola virus
cucuaagaacuuauuaaugaau

SEQ ID NO: 4093733 - RNA, 18 nt, Variola virus
cucuacucauuucauuau

SEQ ID NO: 4093734 - RNA, 13 nt, Variola virus
cucuacucuagau

SEQ ID NO: 4093735 - RNA, 11 nt, Variola virus
cucuagaaaaa

SEQ ID NO: 4093736 - RNA, 12 nt, Variola virus
cucuauaauauu

SEQ ID NO: 4093737 - RNA, 18 nt, Variola virus
cucuauucgaaaacucua

SEQ ID NO: 4093738 - RNA, 18 nt, Variola virus
cucuauucugaaauaauu

SEQ ID NO: 4093739 - RNA, 23 nt, Variola virus
cucuauuggauauggauuuccag

SEQ ID NO: 4093740 - RNA, 19 nt, Variola virus
cucucauaauccauuucca

SEQ ID NO: 4093741 - RNA, 22 nt, Variola virus
cucucauuuucuucaacaaauu

SEQ ID NO: 4093742 - RNA, 18 nt, Variola virus
cucucuucaacaucuuua

SEQ ID NO: 4093743 - RNA, 16 nt, Variola virus
cucuguaauaguuucc

SEQ ID NO: 4093744 - RNA, 21 nt, Variola virus
cucuguagacgauacuugacu

SEQ ID NO: 4093745 - RNA, 15 nt, Variola virus
cucuucucugcauuu

SEQ ID NO: 4093746 - RNA, 12 nt, Variola virus
cucuuuaauagc

SEQ ID NO: 4093747 - RNA, 16 nt, Variola virus
cucuuucggacuuaua

SEQ ID NO: 4093748 - RNA, 16 nt, Variola virus
cugaaaagaaaguauc

SEQ ID NO: 4093749 - RNA, 13 nt, Variola virus
cugaaaauauauu

SEQ ID NO: 4093750 - RNA, 22 nt, Variola virus
cugaaaauauauugauaauauu

SEQ ID NO: 4093751 - RNA, 16 nt, Variola virus
cugaaaaugaaauugu

SEQ ID NO: 4093752 - RNA, 21 nt, Variola virus
cugaaauggugguaaaacuaa

SEQ ID NO: 4093753 - RNA, 13 nt, Variola virus
uaucaauagcagu

SEQ ID NO: 4093754 - RNA, 21 nt, Variola virus
uaucaccuguuugcaugguga

SEQ ID NO: 4093755 - RNA, 16 nt, Variola virus
uaucacgcuuuccauu

SEQ ID NO: 4093756 - RNA, 21 nt, Variola virus
uaucauaaauaaaaauaguag

SEQ ID NO: 4093757 - RNA, 14 nt, Variola virus
uaucauaauuaaau

SEQ ID NO: 4093758 - RNA, 12 nt, Variola virus
uaucauagaugc

SEQ ID NO: 4093759 - RNA, 14 nt, Variola virus
uaucaucuaucaga

SEQ ID NO: 4093760 - RNA, 17 nt, Variola virus
uaucaugcuuuaacauu

SEQ ID NO: 4093761 - RNA, 15 nt, Variola virus
uaucauuaacuguug

SEQ ID NO: 4093762 - RNA, 22 nt, Variola virus
uauccaaggacaaggaugaaaa

SEQ ID NO: 4093763 - RNA, 13 nt, Variola virus
uauccauacauac

SEQ ID NO: 4093764 - RNA, 15 nt, Variola virus
uauccaugaugguca

SEQ ID NO: 4093765 - RNA, 14 nt, Variola virus
uauccauuggaaaa

SEQ ID NO: 4093766 - RNA, 21 nt, Variola virus
uauccgacaacguuacucaaa

SEQ ID NO: 4093767 - RNA, 22 nt, Variola virus
uauccucaauaacguuaucauu

SEQ ID NO: 4093768 - RNA, 18 nt, Variola virus
uaucgcagaugaaacgga

SEQ ID NO: 4093769 - RNA, 16 nt, Variola virus
uaucgcauauuuauau

SEQ ID NO: 4093770 - RNA, 21 nt, Variola virus
uaucgcauuuucuaacgugau

SEQ ID NO: 4093771 - RNA, 18 nt, Variola virus
uaucguaccuaucuuaaa

SEQ ID NO: 4093772 - RNA, 20 nt, Variola virus
uaucguauuggauucugaaa

SEQ ID NO: 4093773 - RNA, 12 nt, Variola virus
uaucuaaagcuu

SEQ ID NO: 4093774 - RNA, 18 nt, Variola virus
uaucuacgauccaucaaa

SEQ ID NO: 4093775 - RNA, 20 nt, Variola virus
uaucuacgauuuuuacaaaa

SEQ ID NO: 4093776 - RNA, 20 nt, Variola virus
uaucuagauaacaacgacuu

SEQ ID NO: 4093777 - RNA, 12 nt, Variola virus
uaucuauacaua

SEQ ID NO: 4093778 - RNA, 16 nt, Variola virus
uaucuauacuauuaaa

SEQ ID NO: 4093779 - RNA, 16 nt, Variola virus
uaucuauguuaucauc

SEQ ID NO: 4093780 - RNA, 23 nt, Variola virus
uaucucaauaaaaaauuaauauu

SEQ ID NO: 4093781 - RNA, 21 nt, Variola virus
uaucucguuuagaaaaaugcu

SEQ ID NO: 4093782 - RNA, 14 nt, Variola virus
uaucucucuuggua

SEQ ID NO: 4093783 - RNA, 15 nt, Variola virus
uaucucuuaaaugcu

SEQ ID NO: 4093784 - RNA, 10 nt, Variola virus
uaucucuuuc

SEQ ID NO: 4093785 - RNA, 11 nt, Variola virus
uaucuguaaaa

SEQ ID NO: 4093786 - RNA, 14 nt, Variola virus
uaugaaaaacaugu

SEQ ID NO: 4093787 - RNA, 18 nt, Variola virus
uaugaacgauaauaacuu

SEQ ID NO: 4093788 - RNA, 15 nt, Variola virus
uaugaagauaaacac

SEQ ID NO: 4093789 - RNA, 12 nt, Variola virus
uaugacaaaauu

SEQ ID NO: 4093790 - RNA, 17 nt, Variola virus
uaugacaaaguuuacau

SEQ ID NO: 4093791 - RNA, 18 nt, Variola virus
uaugacuguauuuggauc

SEQ ID NO: 4093792 - RNA, 19 nt, Variola virus
uaugauaaaaugaaguuuu

SEQ ID NO: 4093793 - RNA, 15 nt, Variola virus
uaugauaucucuauu

SEQ ID NO: 4093794 - RNA, 18 nt, Variola virus
uaugauccguaacauaua

SEQ ID NO: 4093795 - RNA, 17 nt, Variola virus
uaugcauguuugcccuu

SEQ ID NO: 4093796 - RNA, 19 nt, Variola virus
uaugccugagaguaaacau

SEQ ID NO: 4093797 - RNA, 16 nt, Variola virus
uaugcgggaauuaaug

SEQ ID NO: 4093798 - RNA, 13 nt, Variola virus
uaugcuguuuauc

SEQ ID NO: 4093799 - RNA, 13 nt, Variola virus
uaugcuuucauaa

SEQ ID NO: 4093800 - RNA, 13 nt, Variola virus
uauggaaaacuaa

SEQ ID NO: 4093801 - RNA, 19 nt, Variola virus
uauggaaacuauaauuuug

SEQ ID NO: 4093802 - RNA, 18 nt, Variola virus
uauggaucuauucaagau

SEQ ID NO: 4093803 - RNA, 22 nt, Variola virus
uauggauuuggucauaauagaa

SEQ ID NO: 4093804 - RNA, 21 nt, Variola virus
uauggcgccauuggcaucuug

SEQ ID NO: 4093805 - RNA, 13 nt, Variola virus
uauguaugugcau

SEQ ID NO: 4093806 - RNA, 22 nt, Variola virus
uaugucuagcaaugaucuaaau

SEQ ID NO: 4093807 - RNA, 18 nt, Variola virus
uaugucuguacaaauguu

SEQ ID NO: 4093808 - RNA, 12 nt, Variola virus
uaugugauuuug

SEQ ID NO: 4093809 - RNA, 14 nt, Variola virus
uaugugcauuacca

SEQ ID NO: 4093810 - RNA, 22 nt, Variola virus
uauguuuauuuagauacagaug

SEQ ID NO: 4093811 - RNA, 17 nt, Variola virus
uauguuuuauguuuauu

SEQ ID NO: 4093812 - RNA, 14 nt, Variola virus
uauuaaaauuauuu

SEQ ID NO: 4093813 - RNA, 16 nt, Variola virus
uauuaaaauucuuaaa

SEQ ID NO: 4093814 - RNA, 19 nt, Variola virus
uauuaaaguacguaaaucu

SEQ ID NO: 4093815 - RNA, 15 nt, Variola virus
uauuaaaucaugaag

SEQ ID NO: 4093816 - RNA, 13 nt, Variola virus
uauuaaauuuaga

SEQ ID NO: 4093817 - RNA, 14 nt, Variola virus
uauuaaccacauau

SEQ ID NO: 4093818 - RNA, 17 nt, Variola virus
uauuaacccaagcagca

SEQ ID NO: 4093819 - RNA, 21 nt, Variola virus
uauuaacgugaaacguaguau

SEQ ID NO: 4093820 - RNA, 15 nt, Variola virus
uauuaauccuuugau

SEQ ID NO: 4093821 - RNA, 21 nt, Variola virus
uauuaaugagugcacaacugu

SEQ ID NO: 4093822 - RNA, 15 nt, Variola virus
uauuaauucuguaaa

SEQ ID NO: 4093823 - RNA, 21 nt, Variola virus
uauuacaaacauguucaaugc

SEQ ID NO: 4093824 - RNA, 21 nt, Variola virus
uauuacagauuuuauuaaacu

SEQ ID NO: 4093825 - RNA, 22 nt, Variola virus
uauuacauugugauuaaacauu

SEQ ID NO: 4093826 - RNA, 19 nt, Variola virus
uauuacgcuuaccaucaaa

SEQ ID NO: 4093827 - RNA, 18 nt, Variola virus
uauuacguacauaacauu

SEQ ID NO: 4093828 - RNA, 15 nt, Variola virus
uauuaguguuuagau

SEQ ID NO: 4093829 - RNA, 14 nt, Variola virus
uauuauaaacucuc

SEQ ID NO: 4093830 - RNA, 14 nt, Variola virus
uauuauacuuguau

SEQ ID NO: 4093831 - RNA, 17 nt, Variola virus
uauuauacuuguauaua

SEQ ID NO: 4093832 - RNA, 22 nt, Variola virus
uauuaucaaagucacaaagcaa

SEQ ID NO: 4093833 - RNA, 18 nt, Variola virus
uauuauccaauuauuaua

SEQ ID NO: 4093834 - RNA, 18 nt, Variola virus
uauuauggaaaucaacau

SEQ ID NO: 4093835 - RNA, 23 nt, Variola virus
uauuauggaaaucaacauaaugu

SEQ ID NO: 4093836 - RNA, 16 nt, Variola virus
uauuauugauagcauu

SEQ ID NO: 4093837 - RNA, 20 nt, Variola virus
uauucaguaguguuuacaua

SEQ ID NO: 4093838 - RNA, 20 nt, Variola virus
uauucauuaggauuaucaaa

SEQ ID NO: 4093839 - RNA, 14 nt, Variola virus
uauucauugggaag

SEQ ID NO: 4093840 - RNA, 16 nt, Variola virus
uauucccaaacauaca

SEQ ID NO: 4093841 - RNA, 13 nt, Variola virus
uauuccuagcauc

SEQ ID NO: 4093842 - RNA, 17 nt, Variola virus
uauucgauaacagcauu

SEQ ID NO: 4093843 - RNA, 15 nt, Variola virus
uauucuuaaauguca

SEQ ID NO: 4093844 - RNA, 13 nt, Variola virus
uauucuuaauauu

SEQ ID NO: 4093845 - RNA, 23 nt, Variola virus
uauugagguuucugacaauuacu

SEQ ID NO: 4093846 - RNA, 13 nt, Variola virus
uauugaguggaaa

SEQ ID NO: 4093847 - RNA, 13 nt, Variola virus
uauugaugauguc

SEQ ID NO: 4093848 - RNA, 17 nt, Variola virus
uauugcauguuuucaua

SEQ ID NO: 4093849 - RNA, 16 nt, Variola virus
uauuggauauaucaaa

SEQ ID NO: 4093850 - RNA, 19 nt, Variola virus
uauuggauauggauuucca

SEQ ID NO: 4093851 - RNA, 22 nt, Variola virus
uauuggcuuuucuuuaucacua

SEQ ID NO: 4093852 - RNA, 17 nt, Variola virus
uauuggugcauuaauaa

SEQ ID NO: 4093853 - RNA, 23 nt, Variola virus
uauuguagaaauuguuuuucaua

SEQ ID NO: 4093854 - RNA, 14 nt, Variola virus
uauuuaaaugacuu

SEQ ID NO: 4093855 - RNA, 14 nt, Variola virus
uauuuaauaucaaa

SEQ ID NO: 4093856 - RNA, 22 nt, Variola virus
uauuuaaugauucauuaucaua

SEQ ID NO: 4093857 - RNA, 21 nt, Variola virus
uauuuacgaaacuaucaaaau

SEQ ID NO: 4093858 - RNA, 17 nt, Variola virus
uauuuauaccaugucaa

SEQ ID NO: 4093859 - RNA, 19 nt, Variola virus
uauuuauccguaaaaaugu

SEQ ID NO: 4093860 - RNA, 19 nt, Variola virus
uauuucauugacggaugau

SEQ ID NO: 4093861 - RNA, 21 nt, Variola virus
uauuuccuguuccguuaacau

SEQ ID NO: 4093862 - RNA, 23 nt, Variola virus
uauuucuauggacuuaucuacau

SEQ ID NO: 4093863 - RNA, 12 nt, Variola virus
uauuucuuacau

SEQ ID NO: 4093864 - RNA, 13 nt, Variola virus
uauuucuuacaua

SEQ ID NO: 4093865 - RNA, 23 nt, Variola virus
uauuugagaaauauguauacaua

SEQ ID NO: 4093866 - RNA, 23 nt, Variola virus
uauuugcgugguuguuuaucaca

SEQ ID NO: 4093867 - RNA, 19 nt, Variola virus
uauuuggcauuucuaaaau

SEQ ID NO: 4093868 - RNA, 18 nt, Variola virus
uauuuguguauucuucua

SEQ ID NO: 4093869 - RNA, 20 nt, Variola virus
uauuuuaacgucuaaaugua

SEQ ID NO: 4093870 - RNA, 16 nt, Variola virus
uauuuuacauggauuu

SEQ ID NO: 4093871 - RNA, 12 nt, Variola virus
uauuuuaucauc

SEQ ID NO: 4093872 - RNA, 15 nt, Variola virus
uauuuuauuucaaaa

SEQ ID NO: 4093873 - RNA, 18 nt, Variola virus
uauuuucggguuuaaauu

SEQ ID NO: 4093874 - RNA, 20 nt, Variola virus
uauuuugggcaaaucuaaau

SEQ ID NO: 4093875 - RNA, 21 nt, Variola virus
uauuuuuucuggcauuaucua

SEQ ID NO: 4093876 - RNA, 18 nt, Variola virus
ucaaaagacguuguacaa

SEQ ID NO: 4093877 - RNA, 18 nt, Variola virus
ucaaaauaacaaauacua

SEQ ID NO: 4093878 - RNA, 14 nt, Variola virus
ucaaaauauguaga

SEQ ID NO: 4093879 - RNA, 16 nt, Variola virus
ucuaucguuauaacuc

SEQ ID NO: 4093880 - RNA, 22 nt, Variola virus
ucuaucguuauaacucgagaau

SEQ ID NO: 4093881 - RNA, 13 nt, Variola virus
ucuaucucaaaau

SEQ ID NO: 4093882 - RNA, 21 nt, Variola virus
ucuaugaauauaauagaugua

SEQ ID NO: 4093883 - RNA, 12 nt, Variola virus
ucuauguaucua

SEQ ID NO: 4093884 - RNA, 16 nt, Variola virus
ucuauguuauuuguau

SEQ ID NO: 4093885 - RNA, 18 nt, Variola virus
ucuauguugauagaaguu

SEQ ID NO: 4093886 - RNA, 13 nt, Variola virus
ucuauuacuacaa

SEQ ID NO: 4093887 - RNA, 20 nt, Variola virus
ucuauuagaguauugcauuu

SEQ ID NO: 4093888 - RNA, 21 nt, Variola virus
ucuauucgaaaacucuaagaa

SEQ ID NO: 4093889 - RNA, 23 nt, Variola virus
ucuauuggauauggauuuccaga

SEQ ID NO: 4093890 - RNA, 17 nt, Variola virus
ucuauugugucuguuaa

SEQ ID NO: 4093891 - RNA, 23 nt, Variola virus
ucuauuuguucugacaauauuua

SEQ ID NO: 4093892 - RNA, 17 nt, Variola virus
ucuauuuugucauuaac

SEQ ID NO: 4093893 - RNA, 12 nt, Variola virus
ucucaauacaga

SEQ ID NO: 4093894 - RNA, 16 nt, Variola virus
ucucaauauuuggauu

SEQ ID NO: 4093895 - RNA, 14 nt, Variola virus
ucucauaaaauagu

SEQ ID NO: 4093896 - RNA, 22 nt, Variola virus
ucucaugucuaagaauuacaaa

SEQ ID NO: 4093897 - RNA, 22 nt, Variola virus
ucuccaugauuaaauauuuuaa

SEQ ID NO: 4093898 - RNA, 22 nt, Variola virus
ucuccuuuucagaaauuaguuu

SEQ ID NO: 4093899 - RNA, 16 nt, Variola virus
ucuccuuuuguagaua

SEQ ID NO: 4093900 - RNA, 16 nt, Variola virus
ucucggacauuucagc

SEQ ID NO: 4093901 - RNA, 18 nt, Variola virus
ucucguaggcacacaauc

SEQ ID NO: 4093902 - RNA, 15 nt, Variola virus
ucucgucguccaaua

SEQ ID NO: 4093903 - RNA, 18 nt, Variola virus
ucucuaagacgucucauu

SEQ ID NO: 4093904 - RNA, 18 nt, Variola virus
ucucuaucuguuuccauu

SEQ ID NO: 4093905 - RNA, 22 nt, Variola virus
ucucucaaucacuacaucuuua

SEQ ID NO: 4093906 - RNA, 17 nt, Variola virus
ucucucauuuaucaaaa

SEQ ID NO: 4093907 - RNA, 21 nt, Variola virus
ucucugauguuuguuuucgau

SEQ ID NO: 4093908 - RNA, 12 nt, Variola virus
ucugaagaagag

SEQ ID NO: 4093909 - RNA, 17 nt, Variola virus
ucugaauuuagauaguu

SEQ ID NO: 4093910 - RNA, 16 nt, Variola virus
ucugacauaagaacag

SEQ ID NO: 4093911 - RNA, 15 nt, Variola virus
ucugacgacaaacag

SEQ ID NO: 4093912 - RNA, 15 nt, Variola virus
ucugauaaucucuaa

SEQ ID NO: 4093913 - RNA, 23 nt, Variola virus
ucugaucuuaacuccucuauuaa

SEQ ID NO: 4093914 - RNA, 17 nt, Variola virus
ucugaugaaucugaacc

SEQ ID NO: 4093915 - RNA, 13 nt, Variola virus
ucugcauucaauu

SEQ ID NO: 4093916 - RNA, 14 nt, Variola virus
ucugguugaagaaa

SEQ ID NO: 4093917 - RNA, 16 nt, Variola virus
ucuguaaaagaaucau

SEQ ID NO: 4093918 - RNA, 15 nt, Variola virus
ucuguagucacuuaa

SEQ ID NO: 4093919 - RNA, 14 nt, Variola virus
ucuguuauuucagu

SEQ ID NO: 4093920 - RNA, 18 nt, Variola virus
ucuguucaaaaauuuaga

SEQ ID NO: 4093921 - RNA, 15 nt, Variola virus
ucuuaaaacaguuuu

SEQ ID NO: 4093922 - RNA, 13 nt, Variola virus
ucuuaaauaacuc

SEQ ID NO: 4093923 - RNA, 13 nt, Variola virus
ucuuaauaucaga

SEQ ID NO: 4093924 - RNA, 15 nt, Variola virus
ucuuauauacacagu

SEQ ID NO: 4093925 - RNA, 16 nt, Variola virus
ucuuaucaauuucuga

SEQ ID NO: 4093926 - RNA, 16 nt, Variola virus
ucuuauccauuuauaa

SEQ ID NO: 4093927 - RNA, 16 nt, Variola virus
ucuuauccauuucgaa

SEQ ID NO: 4093928 - RNA, 18 nt, Variola virus
ucuuauuggucagaaguu

SEQ ID NO: 4093929 - RNA, 15 nt, Variola virus
ucuuccuucaaacag

SEQ ID NO: 4093930 - RNA, 20 nt, Variola virus
ucuucgaaaagaaacagaua

SEQ ID NO: 4093931 - RNA, 14 nt, Variola virus
ucuucgcagaugau

SEQ ID NO: 4093932 - RNA, 15 nt, Variola virus
ucuucuacaugaaga

SEQ ID NO: 4093933 - RNA, 12 nt, Variola virus
ucuucuaucaaa

SEQ ID NO: 4093934 - RNA, 22 nt, Variola virus
ucuugacugucuaucucuguaa

SEQ ID NO: 4093935 - RNA, 14 nt, Variola virus
ucuugcucaaauaa

SEQ ID NO: 4093936 - RNA, 22 nt, Variola virus
ucuuggaaacauaaaauaacuc

SEQ ID NO: 4093937 - RNA, 15 nt, Variola virus
ucuugguuaaacuca

SEQ ID NO: 4093938 - RNA, 14 nt, Variola virus
ucuuguucaauaga

SEQ ID NO: 4093939 - RNA, 18 nt, Variola virus
ucuuuaaaguuucugaaa

SEQ ID NO: 4093940 - RNA, 19 nt, Variola virus
ucuuuaaaguuucugaaau

SEQ ID NO: 4093941 - RNA, 20 nt, Variola virus
ucuuuaguaaacauaucaua

SEQ ID NO: 4093942 - RNA, 14 nt, Variola virus
ucuuuauacaauga

SEQ ID NO: 4093943 - RNA, 14 nt, Variola virus
ucuuuaucucuuag

SEQ ID NO: 4093944 - RNA, 15 nt, Variola virus
ucuuucguuaaauau

SEQ ID NO: 4093945 - RNA, 21 nt, Variola virus
ucuuugauuaaugauuuagaa

SEQ ID NO: 4093946 - RNA, 16 nt, Variola virus
ucuuuggauauucuaa

SEQ ID NO: 4093947 - RNA, 18 nt, Variola virus
ucuuuuagcacauguaua

SEQ ID NO: 4093948 - RNA, 21 nt, Variola virus
ucuuuuauacaagaacaauua

SEQ ID NO: 4093949 - RNA, 21 nt, Variola virus
ucuuuuccauuuuuaucagua

SEQ ID NO: 4093950 - RNA, 22 nt, Variola virus
ucuuuuuauccucauuaaacag

SEQ ID NO: 4093951 - RNA, 17 nt, Variola virus
ucuuuuucauuaacuag

SEQ ID NO: 4093952 - RNA, 18 nt, Variola virus
ugaaaaauggauuuugau

SEQ ID NO: 4093953 - RNA, 21 nt, Variola virus
ugaaaacuaaaugguauacac

SEQ ID NO: 4093954 - RNA, 12 nt, Variola virus
ugaaaauuauuu

SEQ ID NO: 4093955 - RNA, 14 nt, Variola virus
ugaaacgaacacua

SEQ ID NO: 4093956 - RNA, 13 nt, Variola virus
ugaaacuaucuuu

SEQ ID NO: 4093957 - RNA, 21 nt, Variola virus
ugaaauagcguucgucaacau

SEQ ID NO: 4093958 - RNA, 15 nt, Variola virus
ugaaauugagaagau

SEQ ID NO: 4093959 - RNA, 19 nt, Variola virus
ugaacacacgaugaaaaug

SEQ ID NO: 4093960 - RNA, 24 nt, Variola virus
ugaacauauaguucgucauuuaau

SEQ ID NO: 4093961 - RNA, 16 nt, Variola virus
ugaacauauucaucgu

SEQ ID NO: 4093962 - RNA, 19 nt, Variola virus
ugaaccguaauauaucuag

SEQ ID NO: 4093963 - RNA, 15 nt, Variola virus
ugaacgauaauaacu

SEQ ID NO: 4093964 - RNA, 14 nt, Variola virus
ugaacuauuucuug

SEQ ID NO: 4093965 - RNA, 20 nt, Variola virus
ugaacuccgccguaguuucc

SEQ ID NO: 4093966 - RNA, 21 nt, Variola virus
ugaacuccgccguaguuucca

SEQ ID NO: 4093967 - RNA, 22 nt, Variola virus
ugaagaaauuguuauaaugcua

SEQ ID NO: 4093968 - RNA, 14 nt, Variola virus
ugaaguagguuucu

SEQ ID NO: 4093969 - RNA, 17 nt, Variola virus
ugaaguuaugacauuca

SEQ ID NO: 4093970 - RNA, 20 nt, Variola virus
ugaaguuggcgcauaucuuu

SEQ ID NO: 4093971 - RNA, 21 nt, Variola virus
ugaauaagcaguguuaucuau

SEQ ID NO: 4093972 - RNA, 20 nt, Variola virus
ugaauaauacauuuaaauuu

SEQ ID NO: 4093973 - RNA, 19 nt, Variola virus
ugaauacaacuaaggagaa

SEQ ID NO: 4093974 - RNA, 15 nt, Variola virus
ugaauauauaugaca

SEQ ID NO: 4093975 - RNA, 23 nt, Variola virus
ugaauauauuaaaguuauuuaug

SEQ ID NO: 4093976 - RNA, 11 nt, Variola virus
ugaauaugaca

SEQ ID NO: 4093977 - RNA, 19 nt, Variola virus
ugaaucauauauguauuca

SEQ ID NO: 4093978 - RNA, 21 nt, Variola virus
ugaauccaucucuauguuuca

SEQ ID NO: 4093979 - RNA, 16 nt, Variola virus
ugaauggauacuaguu

SEQ ID NO: 4093980 - RNA, 17 nt, Variola virus
ugaauguuugaaaacau

SEQ ID NO: 4093981 - RNA, 13 nt, Variola virus
ugaauguuuucaa

SEQ ID NO: 4093982 - RNA, 22 nt, Variola virus
ugaauuacuaaaauauacaaac

SEQ ID NO: 4093983 - RNA, 13 nt, Variola virus
ugaauuagauaua

SEQ ID NO: 4093984 - RNA, 17 nt, Variola virus
ugaauucucauuuugca

SEQ ID NO: 4093985 - RNA, 18 nt, Variola virus
ugaauucucauuuugcau

SEQ ID NO: 4093986 - RNA, 22 nt, Variola virus
ugaauugcauacacuacaugac

SEQ ID NO: 4093987 - RNA, 13 nt, Variola virus
ugaauuguuucuu

SEQ ID NO: 4093988 - RNA, 24 nt, Variola virus
ugaauuguuucuuuuagaagugau

SEQ ID NO: 4093989 - RNA, 16 nt, Variola virus
ugaauuuauaaaaugc

SEQ ID NO: 4093990 - RNA, 21 nt, Variola virus
ugacaauauuauuaugaagac

SEQ ID NO: 4093991 - RNA, 17 nt, Variola virus
ugacauaauuacauaua

SEQ ID NO: 4093992 - RNA, 17 nt, Variola virus
ugacauauguaaauauu

SEQ ID NO: 4093993 - RNA, 15 nt, Variola virus
ugacaucaacuacaa

SEQ ID NO: 4093994 - RNA, 12 nt, Variola virus
ugacauggaaau

SEQ ID NO: 4093995 - RNA, 13 nt, Variola virus
ugaccaauuuauu

SEQ ID NO: 4093996 - RNA, 12 nt, Variola virus
ugacgaagagau

SEQ ID NO: 4093997 - RNA, 21 nt, Variola virus
ugacggagcccaauuuuggug

SEQ ID NO: 4093998 - RNA, 19 nt, Variola virus
ugacuaguccaaagacuua

SEQ ID NO: 4093999 - RNA, 15 nt, Variola virus
ugacuccaucuuuua

SEQ ID NO: 4094000 - RNA, 19 nt, Variola virus
ugacucgcaacaauuguaa

SEQ ID NO: 4094001 - RNA, 17 nt, Variola virus
ugacugacuuaaaacuu

SEQ ID NO: 4094002 - RNA, 18 nt, Variola virus
ugacuguuuguacuuuga

SEQ ID NO: 4094003 - RNA, 14 nt, Variola virus
ugacuuacauaaau

SEQ ID NO: 4094004 - RNA, 14 nt, Variola virus
ugacuuaguucuua

SEQ ID NO: 4094005 - RNA, 20 nt, Variola virus
uguaacauuaaguaaauccu

SEQ ID NO: 4094006 - RNA, 15 nt, Variola virus
uguaaggaaauguuu

SEQ ID NO: 4094007 - RNA, 22 nt, Variola virus
uguaagugaugauguaagucau

SEQ ID NO: 4094008 - RNA, 22 nt, Variola virus
uguaauaucuuaaauaacucau

SEQ ID NO: 4094009 - RNA, 17 nt, Variola virus
uguaauuccaguaauug

SEQ ID NO: 4094010 - RNA, 16 nt, Variola virus
uguacaauacauguac

SEQ ID NO: 4094011 - RNA, 20 nt, Variola virus
uguacuacaaacaggcgaug

SEQ ID NO: 4094012 - RNA, 23 nt, Variola virus
uguacucuuccaaaguugggaua

SEQ ID NO: 4094013 - RNA, 16 nt, Variola virus
uguacuuaacaugauu

SEQ ID NO: 4094014 - RNA, 23 nt, Variola virus
uguacuucuuucaguucuggaua

SEQ ID NO: 4094015 - RNA, 17 nt, Variola virus
uguagaugguucuuuaa

SEQ ID NO: 4094016 - RNA, 16 nt, Variola virus
uguagccgauaaacaa

SEQ ID NO: 4094017 - RNA, 13 nt, Variola virus
uguagucuugguc

SEQ ID NO: 4094018 - RNA, 21 nt, Variola virus
uguaguuguugguaacgucug

SEQ ID NO: 4094019 - RNA, 18 nt, Variola virus
uguauagaaauuuuggua

SEQ ID NO: 4094020 - RNA, 22 nt, Variola virus
uguauauaggucagauacuggu

SEQ ID NO: 4094021 - RNA, 19 nt, Variola virus
uguauaucuaacguauucu

SEQ ID NO: 4094022 - RNA, 19 nt, Variola virus
uguauaugugaauaugaca

SEQ ID NO: 4094023 - RNA, 13 nt, Variola virus
uguauaugugauc

SEQ ID NO: 4094024 - RNA, 20 nt, Variola virus
uguauaugugaucuaugaca

SEQ ID NO: 4094025 - RNA, 17 nt, Variola virus
uguauauuacacauuau

SEQ ID NO: 4094026 - RNA, 14 nt, Variola virus
uguaucaaaugcua

SEQ ID NO: 4094027 - RNA, 20 nt, Variola virus
uguaucauaauauuaaucau

SEQ ID NO: 4094028 - RNA, 22 nt, Variola virus
uguauccgucaaucuaauauua

SEQ ID NO: 4094029 - RNA, 17 nt, Variola virus
uguaucgaaaaacuuua

SEQ ID NO: 4094030 - RNA, 14 nt, Variola virus
uguaucuagugaua

SEQ ID NO: 4094031 - RNA, 15 nt, Variola virus
uguauguuugggaga

SEQ ID NO: 4094032 - RNA, 16 nt, Variola virus
uguauuaagaacagaa

SEQ ID NO: 4094033 - RNA, 17 nt, Variola virus
uguauuaguuaaauauu

SEQ ID NO: 4094034 - RNA, 22 nt, Variola virus
uguauucaacaugcuuuucuau

SEQ ID NO: 4094035 - RNA, 11 nt, Variola virus
uguauuuccau

SEQ ID NO: 4094036 - RNA, 19 nt, Variola virus
ugucaacaaaaaugugaua

SEQ ID NO: 4094037 - RNA, 17 nt, Variola virus
ugucaagaucuuuugua

SEQ ID NO: 4094038 - RNA, 16 nt, Variola virus
ugucaauugauucuua

SEQ ID NO: 4094039 - RNA, 21 nt, Variola virus
ugucaucaucaugauacacaa

SEQ ID NO: 4094040 - RNA, 14 nt, Variola virus
ugucauuaaaucuu

SEQ ID NO: 4094041 - RNA, 14 nt, Variola virus
ugucauuuguauuu

SEQ ID NO: 4094042 - RNA, 14 nt, Variola virus
uguccacuauacau

SEQ ID NO: 4094043 - RNA, 14 nt, Variola virus
uguccuaaaauacu

SEQ ID NO: 4094044 - RNA, 15 nt, Variola virus
uguccuucacaucau

SEQ ID NO: 4094045 - RNA, 23 nt, Variola virus
ugucuaaugaugaacacaaaugg

SEQ ID NO: 4094046 - RNA, 16 nt, Variola virus
ugucuacauaaaucua

SEQ ID NO: 4094047 - RNA, 22 nt, Variola virus
ugucuaucaagauccaugauuc

SEQ ID NO: 4094048 - RNA, 13 nt, Variola virus
ugucuccuuuuca

SEQ ID NO: 4094049 - RNA, 15 nt, Variola virus
ugucucgaaaucauu

SEQ ID NO: 4094050 - RNA, 23 nt, Variola virus
ugucuuaauaagaaguguaagag

SEQ ID NO: 4094051 - RNA, 12 nt, Variola virus
ugucuuggaagc

SEQ ID NO: 4094052 - RNA, 17 nt, Variola virus
ugucuuugaacaacauu

SEQ ID NO: 4094053 - RNA, 23 nt, Variola virus
ugugaaugguaaagaaugcuguu

SEQ ID NO: 4094054 - RNA, 20 nt, Variola virus
ugugaauuuagcauauagua

SEQ ID NO: 4094055 - RNA, 14 nt, Variola virus
ugugacaguuuucu

SEQ ID NO: 4094056 - RNA, 23 nt, Variola virus
uguggaauaaaauaaaacaagga

SEQ ID NO: 4094057 - RNA, 14 nt, Variola virus
uguguaaaaaguuu

SEQ ID NO: 4094058 - RNA, 16 nt, Variola virus
uguguaacaaaguauu

SEQ ID NO: 4094059 - RNA, 16 nt, Variola virus
uguguaugaaaugcuu

SEQ ID NO: 4094060 - RNA, 23 nt, Variola virus
ugugucaaagguuaaaccuuuau

SEQ ID NO: 4094061 - RNA, 23 nt, Variola virus
ugugucuacaaccgcuacauaau

SEQ ID NO: 4094062 - RNA, 22 nt, Variola virus
uguguggaugcuacuucaucua

SEQ ID NO: 4094063 - RNA, 22 nt, Variola virus
uguguuaucagccgcuacagaa

SEQ ID NO: 4094064 - RNA, 16 nt, Variola virus
uguguugaacaucagu

SEQ ID NO: 4094065 - RNA, 20 nt, Variola virus
uguuaaauguacuguauaua

SEQ ID NO: 4094066 - RNA, 19 nt, Variola virus
uguuaccauaauaccuuuu

SEQ ID NO: 4094067 - RNA, 18 nt, Variola virus
uguuagaagucuuaaaaa

SEQ ID NO: 4094068 - RNA, 20 nt, Variola virus
uguuaguacuacugaagaac

SEQ ID NO: 4094069 - RNA, 17 nt, Variola virus
uguuauccaacauauca

SEQ ID NO: 4094070 - RNA, 13 nt, Variola virus
uguucaaaugccu

SEQ ID NO: 4094071 - RNA, 20 nt, Variola virus
uguucaaugcaauagaugcc

SEQ ID NO: 4094072 - RNA, 21 nt, Variola virus
uguucauaauugcuuuucuaa

SEQ ID NO: 4094073 - RNA, 16 nt, Variola virus
uguucuuaaucaaugu

SEQ ID NO: 4094074 - RNA, 16 nt, Variola virus
uguucuuggauuucau

SEQ ID NO: 4094075 - RNA, 15 nt, Variola virus
uguugacgacauaua

SEQ ID NO: 4094076 - RNA, 13 nt, Variola virus
uguugugggaaac

SEQ ID NO: 4094077 - RNA, 16 nt, Variola virus
uguuguguacauguag

SEQ ID NO: 4094078 - RNA, 19 nt, Variola virus
uguuuaaauaauucucuga

SEQ ID NO: 4094079 - RNA, 16 nt, Variola virus
uguuuaaauuuuucua

SEQ ID NO: 4094080 - RNA, 19 nt, Variola virus
uguuuaacaaaguuauuca

SEQ ID NO: 4094081 - RNA, 11 nt, Variola virus
uguuuaagaua

SEQ ID NO: 4094082 - RNA, 17 nt, Variola virus
uguuuaccucuacaaau

SEQ ID NO: 4094083 - RNA, 19 nt, Variola virus
uguuuagaugaaguauuga

SEQ ID NO: 4094084 - RNA, 19 nt, Variola virus
uguuucacauugacauauu

SEQ ID NO: 4094085 - RNA, 15 nt, Variola virus
uguuuccauagauuu

SEQ ID NO: 4094086 - RNA, 19 nt, Variola virus
uguuucgaaacuuuaucaa

SEQ ID NO: 4094087 - RNA, 14 nt, Variola virus
uguuucgauuucaa

SEQ ID NO: 4094088 - RNA, 14 nt, Variola virus
uguuugagaauuaa

SEQ ID NO: 4094089 - RNA, 19 nt, Variola virus
uguuugugaugcuuaaaau

SEQ ID NO: 4094090 - RNA, 13 nt, Variola virus
uguuuucauacau

SEQ ID NO: 4094091 - RNA, 19 nt, Variola virus
uuaaaaaaauaaaaaugaa

SEQ ID NO: 4094092 - RNA, 15 nt, Variola virus
uuaaaaauaugugcu

SEQ ID NO: 4094093 - RNA, 16 nt, Variola virus
uuaaaacacaaauaug

SEQ ID NO: 4094094 - RNA, 17 nt, Variola virus
uuaaaauaaauauucuu

SEQ ID NO: 4094095 - RNA, 19 nt, Variola virus
uuaaaauaaauauucuuca

SEQ ID NO: 4094096 - RNA, 16 nt, Variola virus
uuaaaauacaacaaug

SEQ ID NO: 4094097 - RNA, 23 nt, Variola virus
uuaaaauaguuuauaacauuaau

SEQ ID NO: 4094098 - RNA, 21 nt, Variola virus
uuaaacagauauaguuuuucu

SEQ ID NO: 4094099 - RNA, 15 nt, Variola virus
uuaaacguauaaaaa

SEQ ID NO: 4094100 - RNA, 19 nt, Variola virus
uuaaacuaauucauuuuca

SEQ ID NO: 4094101 - RNA, 23 nt, Variola virus
uuaaagagacuacaauauauucu

SEQ ID NO: 4094102 - RNA, 22 nt, Variola virus
uuaaagauggaguauaaucuuu

SEQ ID NO: 4094103 - RNA, 17 nt, Variola virus
uuaaaggauauuaugca

SEQ ID NO: 4094104 - RNA, 22 nt, Variola virus
uuaaaggauggcgaaauuauug

SEQ ID NO: 4094105 - RNA, 14 nt, Variola virus
uuaaaguguaaaua

SEQ ID NO: 4094106 - RNA, 20 nt, Variola virus
uuaaaguuucugaaauaaga

SEQ ID NO: 4094107 - RNA, 20 nt, Variola virus
uuaaauaguaguacacaaca

SEQ ID NO: 4094108 - RNA, 12 nt, Variola virus
uuaaauauuaau

SEQ ID NO: 4094109 - RNA, 13 nt, Variola virus
uuaaaucauuaaa

SEQ ID NO: 4094110 - RNA, 18 nt, Variola virus
uuaaauuauugauauuca

SEQ ID NO: 4094111 - RNA, 14 nt, Variola virus
uuaaauucuuuaau

SEQ ID NO: 4094112 - RNA, 23 nt, Variola virus
uuaaauuuagagauaauauccug

SEQ ID NO: 4094113 - RNA, 17 nt, Variola virus
uuaacaaaaucuuuaau

SEQ ID NO: 4094114 - RNA, 16 nt, Variola virus
uuaacacguugucuuu

SEQ ID NO: 4094115 - RNA, 15 nt, Variola virus
uuaacagauguagua

SEQ ID NO: 4094116 - RNA, 14 nt, Variola virus
uuaacaucacuaau

SEQ ID NO: 4094117 - RNA, 16 nt, Variola virus
uuaacaucacuaauau

SEQ ID NO: 4094118 - RNA, 19 nt, Variola virus
uuaacaucucuucauuaau

SEQ ID NO: 4094119 - RNA, 14 nt, Variola virus
uuaaccgauaaaaa

SEQ ID NO: 4094120 - RNA, 18 nt, Variola virus
uuaacggcguuuuggaaa

SEQ ID NO: 4094121 - RNA, 23 nt, Variola virus
uuaacgucuaccgaaacaucguu

SEQ ID NO: 4094122 - RNA, 15 nt, Variola virus
uuaacuacauuauca

SEQ ID NO: 4094123 - RNA, 23 nt, Variola virus
uuaacuacgguauucauaaaaua

SEQ ID NO: 4094124 - RNA, 23 nt, Variola virus
uuaacuaucgugucucuguuuuu

SEQ ID NO: 4094125 - RNA, 16 nt, Variola virus
uuaacuaucuuucaag

SEQ ID NO: 4094126 - RNA, 22 nt, Variola virus
uuaacucggucgguuuaucuac

SEQ ID NO: 4094127 - RNA, 14 nt, Variola virus
uuaacuuacuuauu

SEQ ID NO: 4094128 - RNA, 15 nt, Variola virus
uuaacuuuauacuuu

SEQ ID NO: 4094129 - RNA, 16 nt, Variola virus
uuaacuuuucauuaau

SEQ ID NO: 4094130 - RNA, 19 nt, Variola virus
uuauuaaguguauuaguca

SEQ ID NO: 4094131 - RNA, 13 nt, Variola virus
uuauuaauucucu

SEQ ID NO: 4094132 - RNA, 22 nt, Variola virus
uuauuacuaaacuacgugaaca

SEQ ID NO: 4094133 - RNA, 19 nt, Variola virus
uuauuacuuaaguuguaaa

SEQ ID NO: 4094134 - RNA, 23 nt, Variola virus
uuauuagucgccgucucuauaaa

SEQ ID NO: 4094135 - RNA, 19 nt, Variola virus
uuauuagucugucuguaga

SEQ ID NO: 4094136 - RNA, 14 nt, Variola virus
uuauucauaauaag

SEQ ID NO: 4094137 - RNA, 22 nt, Variola virus
uuauugcauguuuucauauuca

SEQ ID NO: 4094138 - RNA, 13 nt, Variola virus
uuauuuaacaauu

SEQ ID NO: 4094139 - RNA, 18 nt, Variola virus
uuauuuaaguuuuugaua

SEQ ID NO: 4094140 - RNA, 19 nt, Variola virus
uuauuucagaaauuauucg

SEQ ID NO: 4094141 - RNA, 12 nt, Variola virus
uuauuucuaaau

SEQ ID NO: 4094142 - RNA, 15 nt, Variola virus
uucaaaaauuuagaa

SEQ ID NO: 4094143 - RNA, 23 nt, Variola virus
uucaaaacaaacagacuauucuu

SEQ ID NO: 4094144 - RNA, 14 nt, Variola virus
uucaacaguuucua

SEQ ID NO: 4094145 - RNA, 17 nt, Variola virus
uucaacaugauuauucu

SEQ ID NO: 4094146 - RNA, 22 nt, Variola virus
uucaaccacucucgauacauca

SEQ ID NO: 4094147 - RNA, 17 nt, Variola virus
uucaacuuugaaauugu

SEQ ID NO: 4094148 - RNA, 23 nt, Variola virus
uucaacuuugaaauuguuuuuua

SEQ ID NO: 4094149 - RNA, 23 nt, Variola virus
uucaagauaaauaaucaaaauug

SEQ ID NO: 4094150 - RNA, 14 nt, Variola virus
uucaagauuaucuu

SEQ ID NO: 4094151 - RNA, 18 nt, Variola virus
uucaauaggguagugaua

SEQ ID NO: 4094152 - RNA, 19 nt, Variola virus
uucaauaucuauacuaguu

SEQ ID NO: 4094153 - RNA, 16 nt, Variola virus
uucaaucauagaacug

SEQ ID NO: 4094154 - RNA, 18 nt, Variola virus
uucaaugugcucuuuaca

SEQ ID NO: 4094155 - RNA, 20 nt, Variola virus
uucaauuucccguuuguauu

SEQ ID NO: 4094156 - RNA, 18 nt, Variola virus
uucaccaaacaacuuuua

SEQ ID NO: 4094157 - RNA, 14 nt, Variola virus
uucaccaauaaaaa

SEQ ID NO: 4094158 - RNA, 13 nt, Variola virus
uucacguuccaga

SEQ ID NO: 4094159 - RNA, 19 nt, Variola virus
uucacuauaucuaagaaac

SEQ ID NO: 4094160 - RNA, 21 nt, Variola virus
uucacucgguggauacaauaa

SEQ ID NO: 4094161 - RNA, 14 nt, Variola virus
uucagaauauucuu

SEQ ID NO: 4094162 - RNA, 15 nt, Variola virus
uucagaauauucuuu

SEQ ID NO: 4094163 - RNA, 20 nt, Variola virus
uucagaauuaauagauauau

SEQ ID NO: 4094164 - RNA, 18 nt, Variola virus
uucagaauuucuacauaa

SEQ ID NO: 4094165 - RNA, 17 nt, Variola virus
uucagaggaauacagac

SEQ ID NO: 4094166 - RNA, 17 nt, Variola virus
uucaggaacauaaacaa

SEQ ID NO: 4094167 - RNA, 20 nt, Variola virus
uucaguaaccaaauacauau

SEQ ID NO: 4094168 - RNA, 22 nt, Variola virus
uucaguauuuuuggaaucauaa

SEQ ID NO: 4094169 - RNA, 19 nt, Variola virus
uucagugaagaagugucua

SEQ ID NO: 4094170 - RNA, 19 nt, Variola virus
uucagugguaaagauaucu

SEQ ID NO: 4094171 - RNA, 19 nt, Variola virus
uucauaaauaaaaacuugg

SEQ ID NO: 4094172 - RNA, 23 nt, Variola virus
uucauccccauacauuuuacauu

SEQ ID NO: 4094173 - RNA, 18 nt, Variola virus
uucaucggcauauuauua

SEQ ID NO: 4094174 - RNA, 23 nt, Variola virus
uucaucguuuagaauaaaaugau

SEQ ID NO: 4094175 - RNA, 14 nt, Variola virus
uucauuaaggagau

SEQ ID NO: 4094176 - RNA, 17 nt, Variola virus
uucauuaauuucugaua

SEQ ID NO: 4094177 - RNA, 11 nt, Variola virus
uucauuagaau

SEQ ID NO: 4094178 - RNA, 15 nt, Variola virus
uucauucguaaaucu

SEQ ID NO: 4094179 - RNA, 14 nt, Variola virus
uuccaagaaacuaa

SEQ ID NO: 4094180 - RNA, 18 nt, Variola virus
uuccacagauaauauuag

SEQ ID NO: 4094181 - RNA, 16 nt, Variola virus
uuccacuauugccauc

SEQ ID NO: 4094182 - RNA, 22 nt, Variola virus
uuccaggaucuagauaauuaau

SEQ ID NO: 4094183 - RNA, 14 nt, Variola virus
uuccauaacagugu

SEQ ID NO: 4094184 - RNA, 13 nt, Variola virus
uuccaucauuaac

SEQ ID NO: 4094185 - RNA, 15 nt, Variola virus
uuccaucuagacuau

SEQ ID NO: 4094186 - RNA, 19 nt, Variola virus
uuccauuggccucauuaac

SEQ ID NO: 4094187 - RNA, 23 nt, Variola virus
uucccaaugguuucaucaauaga

SEQ ID NO: 4094188 - RNA, 21 nt, Variola virus
uucccugauuaguauuuucua

SEQ ID NO: 4094189 - RNA, 16 nt, Variola virus
uucccuugucauuaaa

SEQ ID NO: 4094190 - RNA, 21 nt, Variola virus
uuccgccguauccauaaacaa

SEQ ID NO: 4094191 - RNA, 16 nt, Variola virus
uuccuaauuaagaaaa

SEQ ID NO: 4094192 - RNA, 12 nt, Variola virus
uuccuaccaaac

SEQ ID NO: 4094193 - RNA, 12 nt, Variola virus
uuccucauuaag

SEQ ID NO: 4094194 - RNA, 16 nt, Variola virus
uuccuucuauugaucu

SEQ ID NO: 4094195 - RNA, 16 nt, Variola virus
uuccuuuaucauuaau

SEQ ID NO: 4094196 - RNA, 13 nt, Variola virus
uucgaaaauacua

SEQ ID NO: 4094197 - RNA, 22 nt, Variola virus
uucgaagcaguuacaaugacuc

SEQ ID NO: 4094198 - RNA, 21 nt, Variola virus
uucggguuccaaacauuaaca

SEQ ID NO: 4094199 - RNA, 20 nt, Variola virus
uucgucaacaaguuggauga

SEQ ID NO: 4094200 - RNA, 18 nt, Variola virus
uucuaaaaaaauauuaac

SEQ ID NO: 4094201 - RNA, 19 nt, Variola virus
uucuaaaaugguaaacuuu

SEQ ID NO: 4094202 - RNA, 13 nt, Variola virus
uucuaaauuauuc

SEQ ID NO: 4094203 - RNA, 18 nt, Variola virus
uucuaacaucauuauuuu

SEQ ID NO: 4094204 - RNA, 21 nt, Variola virus
uucuaagaaaucuauaauauc

SEQ ID NO: 4094205 - RNA, 15 nt, Variola virus
uucuaaguucuaaug

SEQ ID NO: 4094206 - RNA, 20 nt, Variola virus
uucuaccgcauacgaaauaa

SEQ ID NO: 4094207 - RNA, 21 nt, Variola virus
uucuaccuuacccauaaacaa

SEQ ID NO: 4094208 - RNA, 22 nt, Variola virus
uucuacuaugcacauuauucua

SEQ ID NO: 4094209 - RNA, 16 nt, Variola virus
uucuagaaaaaauuac

SEQ ID NO: 4094210 - RNA, 13 nt, Variola virus
uucuagaccaaaa

SEQ ID NO: 4094211 - RNA, 16 nt, Variola virus
uucuagaguacugauu

SEQ ID NO: 4094212 - RNA, 21 nt, Variola virus
uucuauaccaauauuauucuu

SEQ ID NO: 4094213 - RNA, 18 nt, Variola virus
uucuauauagcuauucuu

SEQ ID NO: 4094214 - RNA, 21 nt, Variola virus
uucuaucuuuaguaguguuuc

SEQ ID NO: 4094215 - RNA, 17 nt, Variola virus
uucuauggcguacaaag

SEQ ID NO: 4094216 - RNA, 18 nt, Variola virus
uucucaucuaucaucucc

SEQ ID NO: 4094217 - RNA, 18 nt, Variola virus
uucucuaguuacacuaug

SEQ ID NO: 4094218 - RNA, 23 nt, Variola virus
uucucuccgguuaauaauucuag

SEQ ID NO: 4094219 - RNA, 17 nt, Variola virus
uucugaaauaacguauu

SEQ ID NO: 4094220 - RNA, 14 nt, Variola virus
uucugauaauagau

SEQ ID NO: 4094221 - RNA, 20 nt, Variola virus
uucugcaauaucuucguaaa

SEQ ID NO: 4094222 - RNA, 20 nt, Variola virus
uucugcuaguucuugagaca

SEQ ID NO: 4094223 - RNA, 17 nt, Variola virus
uucuguacaaauuauug

SEQ ID NO: 4094224 - RNA, 12 nt, Variola virus
uucuuaagaaau

SEQ ID NO: 4094225 - RNA, 20 nt, Variola virus
uucuuacauaaaugaaaaga

SEQ ID NO: 4094226 - RNA, 23 nt, Variola virus
uucuuagcuugugauuuuuucuu

SEQ ID NO: 4094227 - RNA, 15 nt, Variola virus
uucuuggauuucaua

SEQ ID NO: 4094228 - RNA, 21 nt, Variola virus
uucuuggcaaaagaauaccaa

SEQ ID NO: 4094229 - RNA, 12 nt, Variola virus
uucuuguuaaug

SEQ ID NO: 4094230 - RNA, 21 nt, Variola virus
uucuuuaauuauauggcacug

SEQ ID NO: 4094231 - RNA, 13 nt, Variola virus
uugaaaauuauuu

SEQ ID NO: 4094232 - RNA, 14 nt, Variola virus
uugaaaauuauuuu

SEQ ID NO: 4094233 - RNA, 19 nt, Variola virus
uugaaacuaggauacauaa

SEQ ID NO: 4094234 - RNA, 12 nt, Variola virus
uugaaacuuuuc

SEQ ID NO: 4094235 - RNA, 22 nt, Variola virus
uugaaagcgagaaauaaucaua

SEQ ID NO: 4094236 - RNA, 13 nt, Variola virus
uugaaauguguaa

SEQ ID NO: 4094237 - RNA, 14 nt, Variola virus
uugaaccaaacauu

SEQ ID NO: 4094238 - RNA, 22 nt, Variola virus
uugaaccaguccauggaaaaga

SEQ ID NO: 4094239 - RNA, 18 nt, Variola virus
uugaccacggcuuccauu

SEQ ID NO: 4094240 - RNA, 14 nt, Variola virus
uugacguaaaugug

SEQ ID NO: 4094241 - RNA, 19 nt, Variola virus
uugacguaugcaguuacau

SEQ ID NO: 4094242 - RNA, 23 nt, Variola virus
uugacguaugcaguuacaucguu

SEQ ID NO: 4094243 - RNA, 17 nt, Variola virus
uugacuauuguguguaa

SEQ ID NO: 4094244 - RNA, 14 nt, Variola virus
uugagaaaacauuu

SEQ ID NO: 4094245 - RNA, 18 nt, Variola virus
uugagacgggucaaacaa

SEQ ID NO: 4094246 - RNA, 17 nt, Variola virus
uugauaaaucuaucuuu

SEQ ID NO: 4094247 - RNA, 21 nt, Variola virus
uugauaguuguuccuagauau

SEQ ID NO: 4094248 - RNA, 17 nt, Variola virus
uugauaucuuuagauau

SEQ ID NO: 4094249 - RNA, 12 nt, Variola virus
uugaucuucaaa

SEQ ID NO: 4094250 - RNA, 19 nt, Variola virus
uugaugccggacaauagca

SEQ ID NO: 4094251 - RNA, 13 nt, Variola virus
uugauuacucuuu

SEQ ID NO: 4094252 - RNA, 13 nt, Variola virus
uugauucuaguau

SEQ ID NO: 4094253 - RNA, 19 nt, Variola virus
uugauucuuauucacuaua

SEQ ID NO: 4094254 - RNA, 16 nt, Variola virus
uugcaaguuacuaauu

SEQ ID NO: 4094255 - RNA, 12 nt, Variola virus
acuguuuaagag

SEQ ID NO: 4094256 - RNA, 14 nt, Variola virus
acuuaaaaauggau

SEQ ID NO: 4094257 - RNA, 18 nt, Variola virus
acuuaacuuuuucuuucu

SEQ ID NO: 4094258 - RNA, 16 nt, Variola virus
acuuaaugaaaaaugu

SEQ ID NO: 4094259 - RNA, 18 nt, Variola virus
acuuacauggacacauuc

SEQ ID NO: 4094260 - RNA, 16 nt, Variola virus
acuuacugacaaaguu

SEQ ID NO: 4094261 - RNA, 14 nt, Variola virus
acuuacuuaauagg

SEQ ID NO: 4094262 - RNA, 21 nt, Variola virus
acuuacuuuccagauagaaaa

SEQ ID NO: 4094263 - RNA, 21 nt, Variola virus
acuuauuaaguucuuuuucca

SEQ ID NO: 4094264 - RNA, 18 nt, Variola virus
acuucagaugauggugca

SEQ ID NO: 4094265 - RNA, 19 nt, Variola virus
acuucauaaaagaaaauac

SEQ ID NO: 4094266 - RNA, 15 nt, Variola virus
acuuccguuuaaaaa

SEQ ID NO: 4094267 - RNA, 23 nt, Variola virus
acuuccucauuaagauugucaug

SEQ ID NO: 4094268 - RNA, 22 nt, Variola virus
acuucgacagccaucuuaaaau

SEQ ID NO: 4094269 - RNA, 23 nt, Variola virus
acuucuagcgcugauuuaacuaa

SEQ ID NO: 4094270 - RNA, 13 nt, Variola virus
acuucuaucuugu

SEQ ID NO: 4094271 - RNA, 17 nt, Variola virus
acuucucaguucaauaa

SEQ ID NO: 4094272 - RNA, 23 nt, Variola virus
acuucugcagaauaauuagaaau

SEQ ID NO: 4094273 - RNA, 23 nt, Variola virus
acuucuucaacuaccaaaaauug

SEQ ID NO: 4094274 - RNA, 18 nt, Variola virus
acuucuugcgugucuuuc

SEQ ID NO: 4094275 - RNA, 15 nt, Variola virus
acuugacaaaaauug

SEQ ID NO: 4094276 - RNA, 17 nt, Variola virus
acuugagacuugauaga

SEQ ID NO: 4094277 - RNA, 14 nt, Variola virus
acuugauaauuaau

SEQ ID NO: 4094278 - RNA, 22 nt, Variola virus
acuugaucuuuauuuuuugugu

SEQ ID NO: 4094279 - RNA, 20 nt, Variola virus
acuugccaugauucguuaua

SEQ ID NO: 4094280 - RNA, 16 nt, Variola virus
acuuggcgauucuaua

SEQ ID NO: 4094281 - RNA, 13 nt, Variola virus
acuuguuuaauga

SEQ ID NO: 4094282 - RNA, 16 nt, Variola virus
acuuuaaacagaaaua

SEQ ID NO: 4094283 - RNA, 14 nt, Variola virus
acuuuaacaaucuc

SEQ ID NO: 4094284 - RNA, 21 nt, Variola virus
acuuuaacacguugucuuuca

SEQ ID NO: 4094285 - RNA, 11 nt, Variola virus
acuuuaaugau

SEQ ID NO: 4094286 - RNA, 21 nt, Variola virus
acuuuacgcuauuaaucuuua

SEQ ID NO: 4094287 - RNA, 18 nt, Variola virus
acuuuacuggguauucca

SEQ ID NO: 4094288 - RNA, 15 nt, Variola virus
acuuuagaagaauau

SEQ ID NO: 4094289 - RNA, 19 nt, Variola virus
acuuuagcauugaaaauac

SEQ ID NO: 4094290 - RNA, 20 nt, Variola virus
acuuuaucaucuuauauaga

SEQ ID NO: 4094291 - RNA, 18 nt, Variola virus
acuuuccaacuuaucauu

SEQ ID NO: 4094292 - RNA, 21 nt, Variola virus
acuuucuucuauaaaauggau

SEQ ID NO: 4094293 - RNA, 21 nt, Variola virus
acuuucuugcaaguuacuaau

SEQ ID NO: 4094294 - RNA, 18 nt, Variola virus
acuuugcccuuuaauaca

SEQ ID NO: 4094295 - RNA, 13 nt, Variola virus
acuuuguuaauga

SEQ ID NO: 4094296 - RNA, 19 nt, Variola virus
acuuuuauuuuuagaaagu

SEQ ID NO: 4094297 - RNA, 17 nt, Variola virus
agaaaaaaaauugaauu

SEQ ID NO: 4094298 - RNA, 19 nt, Variola virus
agaaaaaaauaucgauauu

SEQ ID NO: 4094299 - RNA, 13 nt, Variola virus
agaaaaaauaucu

SEQ ID NO: 4094300 - RNA, 12 nt, Variola virus
agaaaaaugauu

SEQ ID NO: 4094301 - RNA, 11 nt, Variola virus
agaaaacauua

SEQ ID NO: 4094302 - RNA, 16 nt, Variola virus
agaaaacuagauacaa

SEQ ID NO: 4094303 - RNA, 21 nt, Variola virus
agaaaauaacagauauuacaa

SEQ ID NO: 4094304 - RNA, 17 nt, Variola virus
agaaaauacuauauauu

SEQ ID NO: 4094305 - RNA, 15 nt, Variola virus
agaaaauauaaauua

SEQ ID NO: 4094306 - RNA, 23 nt, Variola virus
agaaaaucagaucugauaauauu

SEQ ID NO: 4094307 - RNA, 11 nt, Variola virus
agaaaauggau

SEQ ID NO: 4094308 - RNA, 19 nt, Variola virus
agaaacauaacaaugagua

SEQ ID NO: 4094309 - RNA, 22 nt, Variola virus
agaaacgauuauuucuaaauua

SEQ ID NO: 4094310 - RNA, 18 nt, Variola virus
agaaagcguguaauacga

SEQ ID NO: 4094311 - RNA, 23 nt, Variola virus
agaaaguaugauauaauacuuac

SEQ ID NO: 4094312 - RNA, 16 nt, Variola virus
agaaagucagaaucua

SEQ ID NO: 4094313 - RNA, 16 nt, Variola virus
agaaagugcaaaugag

SEQ ID NO: 4094314 - RNA, 17 nt, Variola virus
agaaagugcaaaugagg

SEQ ID NO: 4094315 - RNA, 23 nt, Variola virus
agaaauaaaggcagaaauacaau

SEQ ID NO: 4094316 - RNA, 21 nt, Variola virus
agaaauaacaggcuaaaaugu

SEQ ID NO: 4094317 - RNA, 17 nt, Variola virus
agaaauaagagacuuaa

SEQ ID NO: 4094318 - RNA, 17 nt, Variola virus
agaaauaauauaaauga

SEQ ID NO: 4094319 - RNA, 12 nt, Variola virus
agaaauacuucu

SEQ ID NO: 4094320 - RNA, 13 nt, Variola virus
agaaauauauacu

SEQ ID NO: 4094321 - RNA, 21 nt, Variola virus
agaaaucaacaaucuaauaca

SEQ ID NO: 4094322 - RNA, 21 nt, Variola virus
agaaauccaaauaaaauggau

SEQ ID NO: 4094323 - RNA, 13 nt, Variola virus
agaaaucugaaga

SEQ ID NO: 4094324 - RNA, 22 nt, Variola virus
agaaauggaaaucguaauacca

SEQ ID NO: 4094325 - RNA, 21 nt, Variola virus
agaaauggagagagacuguuu

SEQ ID NO: 4094326 - RNA, 13 nt, Variola virus
agaaauuaauaaa

SEQ ID NO: 4094327 - RNA, 19 nt, Variola virus
agaaauugguauaaauguu

SEQ ID NO: 4094328 - RNA, 17 nt, Variola virus
agaacacacuuuucuca

SEQ ID NO: 4094329 - RNA, 18 nt, Variola virus
agaacaucauuuccaaau

SEQ ID NO: 4094330 - RNA, 13 nt, Variola virus
agaacaugaugau

SEQ ID NO: 4094331 - RNA, 20 nt, Variola virus
agaacaugugugaaaauauu

SEQ ID NO: 4094332 - RNA, 21 nt, Variola virus
agaaccgucauucaucuagaa

SEQ ID NO: 4094333 - RNA, 23 nt, Variola virus
agaacuaagauuccauuaucuaa

SEQ ID NO: 4094334 - RNA, 16 nt, Variola virus
agaacuaccaauaugu

SEQ ID NO: 4094335 - RNA, 20 nt, Variola virus
agaacuaucauagaugagaa

SEQ ID NO: 4094336 - RNA, 18 nt, Variola virus
agaacucuguuucuguau

SEQ ID NO: 4094337 - RNA, 12 nt, Variola virus
agaagaaauuga

SEQ ID NO: 4094338 - RNA, 17 nt, Variola virus
agaagauuuaacuagau

SEQ ID NO: 4094339 - RNA, 21 nt, Variola virus
agaaguaccuggaauguaaag

SEQ ID NO: 4094340 - RNA, 17 nt, Variola virus
agaagugugaauaugau

SEQ ID NO: 4094341 - RNA, 14 nt, Variola virus
agaauaaauuauau

SEQ ID NO: 4094342 - RNA, 12 nt, Variola virus
agaauaauacag

SEQ ID NO: 4094343 - RNA, 15 nt, Variola virus
agaauacaacuacau

SEQ ID NO: 4094344 - RNA, 16 nt, Variola virus
agaauacuauagacca

SEQ ID NO: 4094345 - RNA, 19 nt, Variola virus
agaauagcgguaaguauau

SEQ ID NO: 4094346 - RNA, 21 nt, Variola virus
agaauagugggcuuacaugua

SEQ ID NO: 4094347 - RNA, 14 nt, Variola virus
agaauauacuacaa

SEQ ID NO: 4094348 - RNA, 13 nt, Variola virus
agaauauagacaa

SEQ ID NO: 4094349 - RNA, 19 nt, Variola virus
agaauauagacaaaaauau

SEQ ID NO: 4094350 - RNA, 20 nt, Variola virus
agaauauauagguaauacau

SEQ ID NO: 4094351 - RNA, 14 nt, Variola virus
agaauaucucuaac

SEQ ID NO: 4094352 - RNA, 13 nt, Variola virus
agaauaugugcau

SEQ ID NO: 4094353 - RNA, 19 nt, Variola virus
agaauauuccucuaacaga

SEQ ID NO: 4094354 - RNA, 17 nt, Variola virus
agaaucaucuguuguau

SEQ ID NO: 4094355 - RNA, 19 nt, Variola virus
agaauccaucgguuguuaa

SEQ ID NO: 4094356 - RNA, 14 nt, Variola virus
agaaucucaugaau

SEQ ID NO: 4094357 - RNA, 14 nt, Variola virus
agaaugaaacagua

SEQ ID NO: 4094358 - RNA, 17 nt, Variola virus
agaaugugauaagaucg

SEQ ID NO: 4094359 - RNA, 13 nt, Variola virus
agaauuaaaagag

SEQ ID NO: 4094360 - RNA, 22 nt, Variola virus
agaauuaauaauaucucuaaua

SEQ ID NO: 4094361 - RNA, 14 nt, Variola virus
agaauuagaauuac

SEQ ID NO: 4094362 - RNA, 13 nt, Variola virus
agaauucuagauc

SEQ ID NO: 4094363 - RNA, 16 nt, Variola virus
agaauugucuguaaac

SEQ ID NO: 4094364 - RNA, 21 nt, Variola virus
agaauuuaccagauaucuucu

SEQ ID NO: 4094365 - RNA, 16 nt, Variola virus
agaauuuauauaaauu

SEQ ID NO: 4094366 - RNA, 20 nt, Variola virus
agaauuuauauaaauuauuc

SEQ ID NO: 4094367 - RNA, 20 nt, Variola virus
agaauuuucauggauguaga

SEQ ID NO: 4094368 - RNA, 12 nt, Variola virus
agaauuuucuaa

SEQ ID NO: 4094369 - RNA, 17 nt, Variola virus
agaauuuuuuaaaaagu

SEQ ID NO: 4094370 - RNA, 14 nt, Variola virus
agacaaaaauaugg

SEQ ID NO: 4094371 - RNA, 19 nt, Variola virus
agacaaauggucaaugaua

SEQ ID NO: 4094372 - RNA, 18 nt, Variola virus
agacaaugcuaauauauu

SEQ ID NO: 4094373 - RNA, 15 nt, Variola virus
agacaccgaauacaa

SEQ ID NO: 4094374 - RNA, 15 nt, Variola virus
agacauaagaaauuu

SEQ ID NO: 4094375 - RNA, 21 nt, Variola virus
agacauaucgguaaaaugcau

SEQ ID NO: 4094376 - RNA, 15 nt, Variola virus
agaccaucuaacaga

SEQ ID NO: 4094377 - RNA, 17 nt, Variola virus
agaccgucuacaagaaa

SEQ ID NO: 4094378 - RNA, 22 nt, Variola virus
agacgacggugaauacacucag

SEQ ID NO: 4094379 - RNA, 18 nt, Variola virus
agacgauuaguaauauau

SEQ ID NO: 4094380 - RNA, 15 nt, Variola virus
agacgcucaaaauag

SEQ ID NO: 4094381 - RNA, 20 nt, Variola virus
agucuuaaccaagaaaucgu

SEQ ID NO: 4094382 - RNA, 21 nt, Variola virus
agucuuauauguagcaaacau

SEQ ID NO: 4094383 - RNA, 20 nt, Variola virus
agucuuuaaugaauuaacga

SEQ ID NO: 4094384 - RNA, 15 nt, Variola virus
agugaaauaagcuuu

SEQ ID NO: 4094385 - RNA, 15 nt, Variola virus
agugauuuugaagau

SEQ ID NO: 4094386 - RNA, 14 nt, Variola virus
agugcaaugaauau

SEQ ID NO: 4094387 - RNA, 17 nt, Variola virus
agugcuacaaaacagaa

SEQ ID NO: 4094388 - RNA, 13 nt, Variola virus
agugcuucuucuu

SEQ ID NO: 4094389 - RNA, 20 nt, Variola virus
agugguauauaauccaucaa

SEQ ID NO: 4094390 - RNA, 17 nt, Variola virus
aguggugugaauacaac

SEQ ID NO: 4094391 - RNA, 20 nt, Variola virus
aguguaaagaacaaauguug

SEQ ID NO: 4094392 - RNA, 22 nt, Variola virus
aguguauuagacgacucauguu

SEQ ID NO: 4094393 - RNA, 16 nt, Variola virus
agugucguaugaugaa

SEQ ID NO: 4094394 - RNA, 20 nt, Variola virus
aguguuaauuuuaaaugaug

SEQ ID NO: 4094395 - RNA, 13 nt, Variola virus
aguuaaaaugaua

SEQ ID NO: 4094396 - RNA, 13 nt, Variola virus
aguuaaauauuaa

SEQ ID NO: 4094397 - RNA, 13 nt, Variola virus
aguuaauagcuuc

SEQ ID NO: 4094398 - RNA, 13 nt, Variola virus
aguuaauuuauca

SEQ ID NO: 4094399 - RNA, 17 nt, Variola virus
aguuagaaaaaaugauu

SEQ ID NO: 4094400 - RNA, 20 nt, Variola virus
aguuagcaauuucaaaauag

SEQ ID NO: 4094401 - RNA, 16 nt, Variola virus
aguuaucaaaauaugu

SEQ ID NO: 4094402 - RNA, 20 nt, Variola virus
aguuaugacauucaucaaug

SEQ ID NO: 4094403 - RNA, 18 nt, Variola virus
aguucccgcauuaaauaa

SEQ ID NO: 4094404 - RNA, 17 nt, Variola virus
aguucuuugaucucuuu

SEQ ID NO: 4094405 - RNA, 16 nt, Variola virus
aguugcugaugaugaa

SEQ ID NO: 4094406 - RNA, 20 nt, Variola virus
aguuguaaaguuaaaauugu

SEQ ID NO: 4094407 - RNA, 19 nt, Variola virus
aguuuaagacugcuaaaug

SEQ ID NO: 4094408 - RNA, 15 nt, Variola virus
aguuuauaaaaauuu

SEQ ID NO: 4094409 - RNA, 16 nt, Variola virus
aguuuauuauauaccg

SEQ ID NO: 4094410 - RNA, 20 nt, Variola virus
aguuucaucaauaaaggaua

SEQ ID NO: 4094411 - RNA, 23 nt, Variola virus
aguuuccuuaacaaaucuaacug

SEQ ID NO: 4094412 - RNA, 17 nt, Variola virus
aguuucuagauacuaga

SEQ ID NO: 4094413 - RNA, 23 nt, Variola virus
aguuugacgaccucgacauuauu

SEQ ID NO: 4094414 - RNA, 16 nt, Variola virus
aguuugagauuucaua

SEQ ID NO: 4094415 - RNA, 15 nt, Variola virus
aguuuguuuuggaaa

SEQ ID NO: 4094416 - RNA, 15 nt, Variola virus
aguuuuauaaacucg

SEQ ID NO: 4094417 - RNA, 17 nt, Variola virus
aguuuuccguuagaaaa

SEQ ID NO: 4094418 - RNA, 16 nt, Variola virus
aguuuucuuucaaaau

SEQ ID NO: 4094419 - RNA, 17 nt, Variola virus
aguuuuuaggaaauauu

SEQ ID NO: 4094420 - RNA, 20 nt, Variola virus
auaaaaaauacuuaaaaugu

SEQ ID NO: 4094421 - RNA, 11 nt, Variola virus
auaaaaacaag

SEQ ID NO: 4094422 - RNA, 21 nt, Variola virus
auaaaaacgagaaugacauaa

SEQ ID NO: 4094423 - RNA, 19 nt, Variola virus
auaaaaaguauagguguau

SEQ ID NO: 4094424 - RNA, 12 nt, Variola virus
auaaaacuauau

SEQ ID NO: 4094425 - RNA, 20 nt, Variola virus
auaaaauagcguucacauau

SEQ ID NO: 4094426 - RNA, 12 nt, Variola virus
auaaaauaugaa

SEQ ID NO: 4094427 - RNA, 12 nt, Variola virus
auaaaaucucca

SEQ ID NO: 4094428 - RNA, 13 nt, Variola virus
auaaaaugucaca

SEQ ID NO: 4094429 - RNA, 14 nt, Variola virus
auaaaauuacuuaa

SEQ ID NO: 4094430 - RNA, 19 nt, Variola virus
auaaaauuauucacuauau

SEQ ID NO: 4094431 - RNA, 14 nt, Variola virus
auaaaauuuaagaa

SEQ ID NO: 4094432 - RNA, 17 nt, Variola virus
auaaacaaacuaauaaa

SEQ ID NO: 4094433 - RNA, 18 nt, Variola virus
auaaacaccaagaaagcu

SEQ ID NO: 4094434 - RNA, 23 nt, Variola virus
auaaacaugaauuuauuucuaau

SEQ ID NO: 4094435 - RNA, 20 nt, Variola virus
auaaaccauuagauaaaguu

SEQ ID NO: 4094436 - RNA, 17 nt, Variola virus
auaaacuagaaaaacuu

SEQ ID NO: 4094437 - RNA, 15 nt, Variola virus
auaaacuagauauau

SEQ ID NO: 4094438 - RNA, 16 nt, Variola virus
auaaacuauuguuaug

SEQ ID NO: 4094439 - RNA, 21 nt, Variola virus
auaaacucacauuucaaauau

SEQ ID NO: 4094440 - RNA, 15 nt, Variola virus
auaaacuuaguguaa

SEQ ID NO: 4094441 - RNA, 19 nt, Variola virus
auaaagaccgaauacauaa

SEQ ID NO: 4094442 - RNA, 22 nt, Variola virus
auaaagacguggcaaacaaugu

SEQ ID NO: 4094443 - RNA, 16 nt, Variola virus
auaaagaguccuauau

SEQ ID NO: 4094444 - RNA, 16 nt, Variola virus
auaaagauauaaauga

SEQ ID NO: 4094445 - RNA, 13 nt, Variola virus
auaaagauauaca

SEQ ID NO: 4094446 - RNA, 15 nt, Variola virus
auaaagcgagacuau

SEQ ID NO: 4094447 - RNA, 14 nt, Variola virus
auaaaguauaugua

SEQ ID NO: 4094448 - RNA, 18 nt, Variola virus
auaaaguccaacuauugu

SEQ ID NO: 4094449 - RNA, 23 nt, Variola virus
auaaagucccaaaccagaauugc

SEQ ID NO: 4094450 - RNA, 19 nt, Variola virus
auaaagucugucaaaucau

SEQ ID NO: 4094451 - RNA, 16 nt, Variola virus
auaaaguuuauacaag

SEQ ID NO: 4094452 - RNA, 14 nt, Variola virus
auaaauaaggaagu

SEQ ID NO: 4094453 - RNA, 13 nt, Variola virus
auaaauaaugaau

SEQ ID NO: 4094454 - RNA, 15 nt, Variola virus
auaaauaucauauau

SEQ ID NO: 4094455 - RNA, 15 nt, Variola virus
auaaaucaaauacuu

SEQ ID NO: 4094456 - RNA, 21 nt, Variola virus
auaaaucacuuuuuauacuaa

SEQ ID NO: 4094457 - RNA, 12 nt, Variola virus
auaaaucauauu

SEQ ID NO: 4094458 - RNA, 19 nt, Variola virus
auaaaucuuuaucaagcac

SEQ ID NO: 4094459 - RNA, 15 nt, Variola virus
auaaaugacaaguau

SEQ ID NO: 4094460 - RNA, 16 nt, Variola virus
auaaauguucaaugaa

SEQ ID NO: 4094461 - RNA, 13 nt, Variola virus
auaaauguuguaa

SEQ ID NO: 4094462 - RNA, 16 nt, Variola virus
auaaauuaaauauuaa

SEQ ID NO: 4094463 - RNA, 13 nt, Variola virus
auaaauuauacuc

SEQ ID NO: 4094464 - RNA, 18 nt, Variola virus
auaaauuaucaaauacuu

SEQ ID NO: 4094465 - RNA, 23 nt, Variola virus
auaaauuuauuauuuaugauauu

SEQ ID NO: 4094466 - RNA, 13 nt, Variola virus
auaacaaagaaag

SEQ ID NO: 4094467 - RNA, 13 nt, Variola virus
auaacaaauacua

SEQ ID NO: 4094468 - RNA, 15 nt, Variola virus
auaacaaguaugaca

SEQ ID NO: 4094469 - RNA, 21 nt, Variola virus
auaacaaguuuccuguaaauu

SEQ ID NO: 4094470 - RNA, 13 nt, Variola virus
auaacaaugacuu

SEQ ID NO: 4094471 - RNA, 21 nt, Variola virus
auaacagagccaucuguaaaa

SEQ ID NO: 4094472 - RNA, 20 nt, Variola virus
auaacaugaacgauaaacaa

SEQ ID NO: 4094473 - RNA, 15 nt, Variola virus
auaacauuguuuaug

SEQ ID NO: 4094474 - RNA, 17 nt, Variola virus
auaacgagaauaucaca

SEQ ID NO: 4094475 - RNA, 16 nt, Variola virus
auaacguaauuccaaa

SEQ ID NO: 4094476 - RNA, 15 nt, Variola virus
auaacgucucuguau

SEQ ID NO: 4094477 - RNA, 20 nt, Variola virus
auaacguuagccaccacuuc

SEQ ID NO: 4094478 - RNA, 14 nt, Variola virus
auaacguuaucauu

SEQ ID NO: 4094479 - RNA, 18 nt, Variola virus
auaacguuggcaauacua

SEQ ID NO: 4094480 - RNA, 23 nt, Variola virus
auaacucaauuaguuauugccaa

SEQ ID NO: 4094481 - RNA, 18 nt, Variola virus
auaacuucuagauguaga

SEQ ID NO: 4094482 - RNA, 20 nt, Variola virus
auaagaacauaauaauauau

SEQ ID NO: 4094483 - RNA, 19 nt, Variola virus
auaagaaugacuccuauau

SEQ ID NO: 4094484 - RNA, 22 nt, Variola virus
auaagacuuuacucuucuaaau

SEQ ID NO: 4094485 - RNA, 19 nt, Variola virus
auaagagaucuaguaacua

SEQ ID NO: 4094486 - RNA, 23 nt, Variola virus
auaagaugacuguagaacucaug

SEQ ID NO: 4094487 - RNA, 14 nt, Variola virus
auaagcucuauugu

SEQ ID NO: 4094488 - RNA, 18 nt, Variola virus
auaaggaacuagaauugu

SEQ ID NO: 4094489 - RNA, 17 nt, Variola virus
auaaggcuucucaauau

SEQ ID NO: 4094490 - RNA, 19 nt, Variola virus
auaaguaguaauaaugauu

SEQ ID NO: 4094491 - RNA, 22 nt, Variola virus
auaaguauaguuuuaaacuaau

SEQ ID NO: 4094492 - RNA, 15 nt, Variola virus
auaaguguguuguaa

SEQ ID NO: 4094493 - RNA, 23 nt, Variola virus
auaauaaaucauggggcaaacau

SEQ ID NO: 4094494 - RNA, 21 nt, Variola virus
auaauacauuuaaauuuauca

SEQ ID NO: 4094495 - RNA, 23 nt, Variola virus
auaauaccuucuacuaugcaauu

SEQ ID NO: 4094496 - RNA, 14 nt, Variola virus
auaauacuuaaaaa

SEQ ID NO: 4094497 - RNA, 14 nt, Variola virus
auaauagaaaauga

SEQ ID NO: 4094498 - RNA, 17 nt, Variola virus
auaauaggaggaauuga

SEQ ID NO: 4094499 - RNA, 16 nt, Variola virus
auaauaggauaugauu

SEQ ID NO: 4094500 - RNA, 17 nt, Variola virus
auaauagggagaaauga

SEQ ID NO: 4094501 - RNA, 20 nt, Variola virus
auaauagguggaacguauau

SEQ ID NO: 4094502 - RNA, 22 nt, Variola virus
auaauagguuguaauacauaua

SEQ ID NO: 4094503 - RNA, 22 nt, Variola virus
auaauauacuaauuaguaacga

SEQ ID NO: 4094504 - RNA, 15 nt, Variola virus
auaauaucagaaugc

SEQ ID NO: 4094505 - RNA, 13 nt, Variola virus
auaauaucuauau

SEQ ID NO: 4094506 - RNA, 15 nt, Variola virus
auaauauuagauuua

SEQ ID NO: 4094507 - RNA, 13 nt, Variola virus
cgaggauuuugau

SEQ ID NO: 4094508 - RNA, 18 nt, Variola virus
cgauaauaacuuaguuua

SEQ ID NO: 4094509 - RNA, 22 nt, Variola virus
cgauacauuuugcauuagauuu

SEQ ID NO: 4094510 - RNA, 16 nt, Variola virus
cgauacuaauuacaaa

SEQ ID NO: 4094511 - RNA, 11 nt, Variola virus
cgauagaaaaa

SEQ ID NO: 4094512 - RNA, 16 nt, Variola virus
cgauagugauuuugag

SEQ ID NO: 4094513 - RNA, 19 nt, Variola virus
cgauaugccuccagaaguu

SEQ ID NO: 4094514 - RNA, 10 nt, Variola virus
cgauauuaau

SEQ ID NO: 4094515 - RNA, 14 nt, Variola virus
cgauauuauuguaa

SEQ ID NO: 4094516 - RNA, 16 nt, Variola virus
cgauggucuauacaau

SEQ ID NO: 4094517 - RNA, 21 nt, Variola virus
cgaugugucugcguuaagauc

SEQ ID NO: 4094518 - RNA, 15 nt, Variola virus
cgauuauuauaaaau

SEQ ID NO: 4094519 - RNA, 21 nt, Variola virus
cgauuauuauaaaauaacaau

SEQ ID NO: 4094520 - RNA, 18 nt, Variola virus
cgauucuggcuauuucaa

SEQ ID NO: 4094521 - RNA, 14 nt, Variola virus
cgauugaauucucu

SEQ ID NO: 4094522 - RNA, 14 nt, Variola virus
cgauuuuaaaucau

SEQ ID NO: 4094523 - RNA, 12 nt, Variola virus
cgcauuaaauga

SEQ ID NO: 4094524 - RNA, 12 nt, Variola virus
cgcauuaacaaa

SEQ ID NO: 4094525 - RNA, 12 nt, Variola virus
cgccucaaaugu

SEQ ID NO: 4094526 - RNA, 14 nt, Variola virus
cgcgaacaucuuuc

SEQ ID NO: 4094527 - RNA, 14 nt, Variola virus
cgcgaguauucucu

SEQ ID NO: 4094528 - RNA, 12 nt, Variola virus
cgcuauacagua

SEQ ID NO: 4094529 - RNA, 14 nt, Variola virus
cgcuguauauggaa

SEQ ID NO: 4094530 - RNA, 16 nt, Variola virus
cgcuuaauaucuucug

SEQ ID NO: 4094531 - RNA, 20 nt, Variola virus
cggaauugccaacucucaaa

SEQ ID NO: 4094532 - RNA, 23 nt, Variola virus
cggauaguauucaagucaaagaa

SEQ ID NO: 4094533 - RNA, 14 nt, Variola virus
cggcacauauuaau

SEQ ID NO: 4094534 - RNA, 18 nt, Variola virus
cggcuaucgacuuaauau

SEQ ID NO: 4094535 - RNA, 21 nt, Variola virus
cgguuaauguuguauuucauu

SEQ ID NO: 4094536 - RNA, 14 nt, Variola virus
cguaaaaagauucu

SEQ ID NO: 4094537 - RNA, 13 nt, Variola virus
cguaccagcauuu

SEQ ID NO: 4094538 - RNA, 19 nt, Variola virus
cguauaaaguuauauaauu

SEQ ID NO: 4094539 - RNA, 12 nt, Variola virus
cguauacucuau

SEQ ID NO: 4094540 - RNA, 17 nt, Variola virus
cguauauagaugucaau

SEQ ID NO: 4094541 - RNA, 12 nt, Variola virus
cguauauguuuc

SEQ ID NO: 4094542 - RNA, 14 nt, Variola virus
cguauauguuucua

SEQ ID NO: 4094543 - RNA, 17 nt, Variola virus
cguaucuauaaucaucu

SEQ ID NO: 4094544 - RNA, 12 nt, Variola virus
cgucaaacauua

SEQ ID NO: 4094545 - RNA, 12 nt, Variola virus
cgucaguauuua

SEQ ID NO: 4094546 - RNA, 20 nt, Variola virus
cguccaacgaauaacauccg

SEQ ID NO: 4094547 - RNA, 20 nt, Variola virus
cgucucauuucuaucuguuu

SEQ ID NO: 4094548 - RNA, 15 nt, Variola virus
cgucuggagauaucc

SEQ ID NO: 4094549 - RNA, 18 nt, Variola virus
cgucuucccaaaauguua

SEQ ID NO: 4094550 - RNA, 13 nt, Variola virus
cgugagauaaagu

SEQ ID NO: 4094551 - RNA, 17 nt, Variola virus
cguuaaauauaacuggu

SEQ ID NO: 4094552 - RNA, 21 nt, Variola virus
cguuaaugaagaacacauauu

SEQ ID NO: 4094553 - RNA, 16 nt, Variola virus
cguuagaucuauuuua

SEQ ID NO: 4094554 - RNA, 20 nt, Variola virus
cguuauuugagagaucauuu

SEQ ID NO: 4094555 - RNA, 13 nt, Variola virus
cguucuacauaaa

SEQ ID NO: 4094556 - RNA, 18 nt, Variola virus
cguuuaaaguaaacuucg

SEQ ID NO: 4094557 - RNA, 23 nt, Variola virus
cguuuauacaucgaauauaaaau

SEQ ID NO: 4094558 - RNA, 21 nt, Variola virus
cguuuccguuauauccaggga

SEQ ID NO: 4094559 - RNA, 22 nt, Variola virus
cuaaaacuacguucgaugaauu

SEQ ID NO: 4094560 - RNA, 16 nt, Variola virus
cuaaaagcuguuaaag

SEQ ID NO: 4094561 - RNA, 20 nt, Variola virus
cuaaaauauuuuuauucuca

SEQ ID NO: 4094562 - RNA, 16 nt, Variola virus
cuaaacacgauguuua

SEQ ID NO: 4094563 - RNA, 15 nt, Variola virus
cuaaacauaaacaac

SEQ ID NO: 4094564 - RNA, 15 nt, Variola virus
cuaaacauauaacaa

SEQ ID NO: 4094565 - RNA, 18 nt, Variola virus
cuaaacgaucaaccaaaa

SEQ ID NO: 4094566 - RNA, 22 nt, Variola virus
cuaaacuaacuccuugguuuca

SEQ ID NO: 4094567 - RNA, 15 nt, Variola virus
cuaaacuuauuuaga

SEQ ID NO: 4094568 - RNA, 24 nt, Variola virus
cuaaagcaaauugcgccacagaau

SEQ ID NO: 4094569 - RNA, 20 nt, Variola virus
cuaaagccgguguaacauuc

SEQ ID NO: 4094570 - RNA, 23 nt, Variola virus
cuaaagggauuuuauaugauauc

SEQ ID NO: 4094571 - RNA, 12 nt, Variola virus
cuaaauggauua

SEQ ID NO: 4094572 - RNA, 20 nt, Variola virus
cuaacaauaacuagaucauc

SEQ ID NO: 4094573 - RNA, 16 nt, Variola virus
cuaacgaguacauucu

SEQ ID NO: 4094574 - RNA, 14 nt, Variola virus
cuaacuccuugguu

SEQ ID NO: 4094575 - RNA, 16 nt, Variola virus
cuaacucuuauauacc

SEQ ID NO: 4094576 - RNA, 14 nt, Variola virus
cuaacuuuaaacaa

SEQ ID NO: 4094577 - RNA, 15 nt, Variola virus
cuaaggguaaaauag

SEQ ID NO: 4094578 - RNA, 22 nt, Variola virus
cuaagguagaaucucuauuugu

SEQ ID NO: 4094579 - RNA, 16 nt, Variola virus
cuaaguccuauucucg

SEQ ID NO: 4094580 - RNA, 13 nt, Variola virus
cuaauaaacauuc

SEQ ID NO: 4094581 - RNA, 19 nt, Variola virus
cuaauacuacuacuuguaa

SEQ ID NO: 4094582 - RNA, 12 nt, Variola virus
cuaauauuagua

SEQ ID NO: 4094583 - RNA, 23 nt, Variola virus
cuaauauucccaaacauacaucu

SEQ ID NO: 4094584 - RNA, 14 nt, Variola virus
cuaaucuguucaua

SEQ ID NO: 4094585 - RNA, 18 nt, Variola virus
cuaaugaugcagauaucg

SEQ ID NO: 4094586 - RNA, 22 nt, Variola virus
cuaaugauguaucuacacaaac

SEQ ID NO: 4094587 - RNA, 16 nt, Variola virus
cuaauggaugucaaug

SEQ ID NO: 4094588 - RNA, 12 nt, Variola virus
cuaauucucaga

SEQ ID NO: 4094589 - RNA, 16 nt, Variola virus
cuaauuguuuaaauaa

SEQ ID NO: 4094590 - RNA, 15 nt, Variola virus
cuaauuuuuguaaau

SEQ ID NO: 4094591 - RNA, 14 nt, Variola virus
cuacaaaaaugcgu

SEQ ID NO: 4094592 - RNA, 13 nt, Variola virus
cuacaacuaguga

SEQ ID NO: 4094593 - RNA, 23 nt, Variola virus
cuacacuaaaaugauuaaacaau

SEQ ID NO: 4094594 - RNA, 18 nt, Variola virus
cuacagauguaagauacu

SEQ ID NO: 4094595 - RNA, 15 nt, Variola virus
cuacaguaaugucca

SEQ ID NO: 4094596 - RNA, 17 nt, Variola virus
cuacaguaauguccaaa

SEQ ID NO: 4094597 - RNA, 14 nt, Variola virus
cuacauuuggauuu

SEQ ID NO: 4094598 - RNA, 19 nt, Variola virus
cuaccagucuacauuuugc

SEQ ID NO: 4094599 - RNA, 22 nt, Variola virus
cuaccauggacggagacaaauu

SEQ ID NO: 4094600 - RNA, 20 nt, Variola virus
cuaccuuacccauaaacaau

SEQ ID NO: 4094601 - RNA, 20 nt, Variola virus
cuacgaaaacgaaaucugua

SEQ ID NO: 4094602 - RNA, 23 nt, Variola virus
cuacgaaacugauacaaucucuu

SEQ ID NO: 4094603 - RNA, 23 nt, Variola virus
cuacguagacuagacuguuuaua

SEQ ID NO: 4094604 - RNA, 18 nt, Variola virus
cuacuaccgaugauguaa

SEQ ID NO: 4094605 - RNA, 16 nt, Variola virus
cuacugccucacugac

SEQ ID NO: 4094606 - RNA, 19 nt, Variola virus
cuagaaaacgaaaacaucc

SEQ ID NO: 4094607 - RNA, 17 nt, Variola virus
cuagaauuagaauuaca

SEQ ID NO: 4094608 - RNA, 19 nt, Variola virus
cuagagauacaggaauaca

SEQ ID NO: 4094609 - RNA, 21 nt, Variola virus
cuagauagaaagauguagcua

SEQ ID NO: 4094610 - RNA, 22 nt, Variola virus
cuagauauagcuuuuauuucca

SEQ ID NO: 4094611 - RNA, 19 nt, Variola virus
cuagaucggcaaucuuucu

SEQ ID NO: 4094612 - RNA, 12 nt, Variola virus
cuagauuuugac

SEQ ID NO: 4094613 - RNA, 21 nt, Variola virus
cuaggacggcgauucuuuuuc

SEQ ID NO: 4094614 - RNA, 23 nt, Variola virus
cuaguagaggcgguauuacugag

SEQ ID NO: 4094615 - RNA, 22 nt, Variola virus
cuagugccgaacauuaacauuu

SEQ ID NO: 4094616 - RNA, 19 nt, Variola virus
cuaguggcagacugugcau

SEQ ID NO: 4094617 - RNA, 17 nt, Variola virus
cuaguucucucucauaa

SEQ ID NO: 4094618 - RNA, 13 nt, Variola virus
cuaguucucuuuu

SEQ ID NO: 4094619 - RNA, 17 nt, Variola virus
cuaguuuuacuaucaua

SEQ ID NO: 4094620 - RNA, 19 nt, Variola virus
cuauaaaaagaguuucaaa

SEQ ID NO: 4094621 - RNA, 19 nt, Variola virus
cuauaaaacgauuaaacaa

SEQ ID NO: 4094622 - RNA, 21 nt, Variola virus
cuauaaaauuguauauucaga

SEQ ID NO: 4094623 - RNA, 15 nt, Variola virus
cuauaaacaugaauu

SEQ ID NO: 4094624 - RNA, 17 nt, Variola virus
cuauaagccuuuguuua

SEQ ID NO: 4094625 - RNA, 14 nt, Variola virus
cuauaauaaugaau

SEQ ID NO: 4094626 - RNA, 23 nt, Variola virus
cuauaccauauccuccuguagau

SEQ ID NO: 4094627 - RNA, 13 nt, Variola virus
cuauacuauguua

SEQ ID NO: 4094628 - RNA, 12 nt, Variola virus
cuauagauggag

SEQ ID NO: 4094629 - RNA, 14 nt, Variola virus
cuauagauuuugaa

SEQ ID NO: 4094630 - RNA, 21 nt, Variola virus
cuauauaaagguccuauucca

SEQ ID NO: 4094631 - RNA, 13 nt, Variola virus
cuauauaugaaua

SEQ ID NO: 4094632 - RNA, 16 nt, Variola virus
cuauaucuaacaucuu

SEQ ID NO: 4094633 - RNA, 15 nt, Variola virus
cuauauuaacaucua

SEQ ID NO: 4094634 - RNA, 18 nt, Variola virus
gauaauuucguuaaaaca

SEQ ID NO: 4094635 - RNA, 22 nt, Variola virus
gauacacgaaagaaucaaaaga

SEQ ID NO: 4094636 - RNA, 17 nt, Variola virus
gauacauggaaauguau

SEQ ID NO: 4094637 - RNA, 20 nt, Variola virus
gauaccauuauuaacaaauu

SEQ ID NO: 4094638 - RNA, 17 nt, Variola virus
gauaccguuacauuuga

SEQ ID NO: 4094639 - RNA, 22 nt, Variola virus
gauacguacugucuauaaugac

SEQ ID NO: 4094640 - RNA, 15 nt, Variola virus
gauacguauauuaau

SEQ ID NO: 4094641 - RNA, 16 nt, Variola virus
gauacuaucaaaauau

SEQ ID NO: 4094642 - RNA, 23 nt, Variola virus
gauacuauccaucagaauguuuc

SEQ ID NO: 4094643 - RNA, 17 nt, Variola virus
gauagacgcaaauuaga

SEQ ID NO: 4094644 - RNA, 18 nt, Variola virus
gauaguaaaacaaaauua

SEQ ID NO: 4094645 - RNA, 19 nt, Variola virus
gauaguacagcguaguaca

SEQ ID NO: 4094646 - RNA, 22 nt, Variola virus
gauaguauaccaacuauauuac

SEQ ID NO: 4094647 - RNA, 11 nt, Variola virus
gauauaaugaa

SEQ ID NO: 4094648 - RNA, 21 nt, Variola virus
gauauaauucguggauaauca

SEQ ID NO: 4094649 - RNA, 23 nt, Variola virus
gauauaauucguggauaaucauu

SEQ ID NO: 4094650 - RNA, 19 nt, Variola virus
gauauacgaagaauaaugu

SEQ ID NO: 4094651 - RNA, 23 nt, Variola virus
gauauauauggucuuaugaaaga

SEQ ID NO: 4094652 - RNA, 14 nt, Variola virus
gauauauuaaacaa

SEQ ID NO: 4094653 - RNA, 22 nt, Variola virus
gauaucaaauggauauugccac

SEQ ID NO: 4094654 - RNA, 17 nt, Variola virus
gauaugaacauauucau

SEQ ID NO: 4094655 - RNA, 12 nt, Variola virus
gauauuauuaca

SEQ ID NO: 4094656 - RNA, 23 nt, Variola virus
gauauuuagcaauuucugauucu

SEQ ID NO: 4094657 - RNA, 12 nt, Variola virus
gaucaaguaaag

SEQ ID NO: 4094658 - RNA, 21 nt, Variola virus
gaucagaaauacgguuuuucu

SEQ ID NO: 4094659 - RNA, 15 nt, Variola virus
gaucauguagaaaac

SEQ ID NO: 4094660 - RNA, 12 nt, Variola virus
gauccaaucaaa

SEQ ID NO: 4094661 - RNA, 17 nt, Variola virus
gauccaaucaaaaaaua

SEQ ID NO: 4094662 - RNA, 21 nt, Variola virus
gaucccauacuugauaagaua

SEQ ID NO: 4094663 - RNA, 18 nt, Variola virus
gauccuaggauccuucag

SEQ ID NO: 4094664 - RNA, 18 nt, Variola virus
gauccugcauagaaauau

SEQ ID NO: 4094665 - RNA, 20 nt, Variola virus
gauccugcauagaaauaucu

SEQ ID NO: 4094666 - RNA, 14 nt, Variola virus
gauccuuuaagaga

SEQ ID NO: 4094667 - RNA, 15 nt, Variola virus
gaucuaaaaauuaaa

SEQ ID NO: 4094668 - RNA, 15 nt, Variola virus
gaucuaauuuuucau

SEQ ID NO: 4094669 - RNA, 20 nt, Variola virus
gaucuagcaaaggaaauugu

SEQ ID NO: 4094670 - RNA, 22 nt, Variola virus
gaucugcuauauggauauucau

SEQ ID NO: 4094671 - RNA, 22 nt, Variola virus
gaucugcucccgguacacauau

SEQ ID NO: 4094672 - RNA, 20 nt, Variola virus
gaugaaaaauuuguagauuu

SEQ ID NO: 4094673 - RNA, 13 nt, Variola virus
gaugaacagguua

SEQ ID NO: 4094674 - RNA, 19 nt, Variola virus
gaugacuuuaguaaaucau

SEQ ID NO: 4094675 - RNA, 17 nt, Variola virus
gaugagguaaaaaauaa

SEQ ID NO: 4094676 - RNA, 15 nt, Variola virus
gaugaguuagauauu

SEQ ID NO: 4094677 - RNA, 12 nt, Variola virus
gaugauauuaac

SEQ ID NO: 4094678 - RNA, 18 nt, Variola virus
gaugauauucaaacuaau

SEQ ID NO: 4094679 - RNA, 18 nt, Variola virus
gaugccuuaacaucauca

SEQ ID NO: 4094680 - RNA, 17 nt, Variola virus
gauggauaaagauauau

SEQ ID NO: 4094681 - RNA, 15 nt, Variola virus
gauggauauauuaaa

SEQ ID NO: 4094682 - RNA, 23 nt, Variola virus
gauggugccaccguaguguauau

SEQ ID NO: 4094683 - RNA, 13 nt, Variola virus
gauguacauguau

SEQ ID NO: 4094684 - RNA, 13 nt, Variola virus
gauguagaagaag

SEQ ID NO: 4094685 - RNA, 15 nt, Variola virus
gauguaguaguauau

SEQ ID NO: 4094686 - RNA, 19 nt, Variola virus
gauguauauaggucagaua

SEQ ID NO: 4094687 - RNA, 11 nt, Variola virus
gauguauauau

SEQ ID NO: 4094688 - RNA, 23 nt, Variola virus
gauguaugcaaaucaguauauaa

SEQ ID NO: 4094689 - RNA, 19 nt, Variola virus
gaugucaaaggaugaaaga

SEQ ID NO: 4094690 - RNA, 13 nt, Variola virus
gauguguauacau

SEQ ID NO: 4094691 - RNA, 17 nt, Variola virus
gaugugucuacauaaau

SEQ ID NO: 4094692 - RNA, 16 nt, Variola virus
gauguuaaacaaauaa

SEQ ID NO: 4094693 - RNA, 22 nt, Variola virus
gauuaauuguuauuuuauucau

SEQ ID NO: 4094694 - RNA, 20 nt, Variola virus
gauucauccuuaaauguuuu

SEQ ID NO: 4094695 - RNA, 14 nt, Variola virus
gauucgauuuugau

SEQ ID NO: 4094696 - RNA, 13 nt, Variola virus
gauucuaucuuua

SEQ ID NO: 4094697 - RNA, 22 nt, Variola virus
gauucuguguauaaaaacagaa

SEQ ID NO: 4094698 - RNA, 13 nt, Variola virus
gauuguaaugaac

SEQ ID NO: 4094699 - RNA, 16 nt, Variola virus
gauuuaucuguuuugg

SEQ ID NO: 4094700 - RNA, 18 nt, Variola virus
gauuucuuaucuguaguu

SEQ ID NO: 4094701 - RNA, 13 nt, Variola virus
gcaaaaauaauau

SEQ ID NO: 4094702 - RNA, 16 nt, Variola virus
gcaaaauaguaaugau

SEQ ID NO: 4094703 - RNA, 12 nt, Variola virus
gcaaaauuuaua

SEQ ID NO: 4094704 - RNA, 13 nt, Variola virus
gcaaagagaugau

SEQ ID NO: 4094705 - RNA, 19 nt, Variola virus
gcaaaucacucaauaucua

SEQ ID NO: 4094706 - RNA, 18 nt, Variola virus
gcaaauugucuauaucua

SEQ ID NO: 4094707 - RNA, 17 nt, Variola virus
gcaacuguaaauuucuc

SEQ ID NO: 4094708 - RNA, 16 nt, Variola virus
gcaauaagucuuucuc

SEQ ID NO: 4094709 - RNA, 17 nt, Variola virus
gcaauagguaauaacua

SEQ ID NO: 4094710 - RNA, 15 nt, Variola virus
gcaauauauauacag

SEQ ID NO: 4094711 - RNA, 19 nt, Variola virus
gcaaucacuacaauaauua

SEQ ID NO: 4094712 - RNA, 20 nt, Variola virus
gcaaucuuuuagaugaugau

SEQ ID NO: 4094713 - RNA, 20 nt, Variola virus
gcacaaaugugcuuaaacga

SEQ ID NO: 4094714 - RNA, 16 nt, Variola virus
gcacaaugauaaugaa

SEQ ID NO: 4094715 - RNA, 14 nt, Variola virus
gcacacaauacaga

SEQ ID NO: 4094716 - RNA, 13 nt, Variola virus
gcacauuauucua

SEQ ID NO: 4094717 - RNA, 14 nt, Variola virus
gcaccaaaguuaua

SEQ ID NO: 4094718 - RNA, 21 nt, Variola virus
gcacguaucuaaaguauuucu

SEQ ID NO: 4094719 - RNA, 16 nt, Variola virus
gcacugguuuaguuca

SEQ ID NO: 4094720 - RNA, 19 nt, Variola virus
gcagacuagaaauaacagg

SEQ ID NO: 4094721 - RNA, 13 nt, Variola virus
gcagacugugcau

SEQ ID NO: 4094722 - RNA, 17 nt, Variola virus
gcagauagcuauaugau

SEQ ID NO: 4094723 - RNA, 17 nt, Variola virus
gcagcgaacuugauauu

SEQ ID NO: 4094724 - RNA, 20 nt, Variola virus
gcagguacuauaauauuaaa

SEQ ID NO: 4094725 - RNA, 18 nt, Variola virus
gcaguaacauagauuauu

SEQ ID NO: 4094726 - RNA, 12 nt, Variola virus
gcauaaaaaugc

SEQ ID NO: 4094727 - RNA, 11 nt, Variola virus
gcauaauacaa

SEQ ID NO: 4094728 - RNA, 19 nt, Variola virus
gcauaauccuuguaaugau

SEQ ID NO: 4094729 - RNA, 20 nt, Variola virus
gcauacgaaauaaauaauga

SEQ ID NO: 4094730 - RNA, 11 nt, Variola virus
gcauagauaua

SEQ ID NO: 4094731 - RNA, 14 nt, Variola virus
gcauauauuagaaa

SEQ ID NO: 4094732 - RNA, 16 nt, Variola virus
gcauauuaguauauaa

SEQ ID NO: 4094733 - RNA, 16 nt, Variola virus
gcaucaaaaaauguaa

SEQ ID NO: 4094734 - RNA, 21 nt, Variola virus
gcaucaacaguuacaaaugag

SEQ ID NO: 4094735 - RNA, 16 nt, Variola virus
gcaucaugaauacagu

SEQ ID NO: 4094736 - RNA, 14 nt, Variola virus
gcauccaaauggau

SEQ ID NO: 4094737 - RNA, 15 nt, Variola virus
gcaucgauugcaugg

SEQ ID NO: 4094738 - RNA, 22 nt, Variola virus
gcaucuaaaacaauaaaugcau

SEQ ID NO: 4094739 - RNA, 16 nt, Variola virus
gcaucucuuaauccaa

SEQ ID NO: 4094740 - RNA, 19 nt, Variola virus
gcaucugauacaacaauau

SEQ ID NO: 4094741 - RNA, 21 nt, Variola virus
gcaugugauuuacucauuuau

SEQ ID NO: 4094742 - RNA, 14 nt, Variola virus
gcauuauuaagaca

SEQ ID NO: 4094743 - RNA, 13 nt, Variola virus
gcauuugaugcac

SEQ ID NO: 4094744 - RNA, 17 nt, Variola virus
gcauuuuuauauacauu

SEQ ID NO: 4094745 - RNA, 20 nt, Variola virus
gccaaaacuucacagaugau

SEQ ID NO: 4094746 - RNA, 12 nt, Variola virus
gccaaaaugaua

SEQ ID NO: 4094747 - RNA, 18 nt, Variola virus
gccaaaaugauagauauu

SEQ ID NO: 4094748 - RNA, 12 nt, Variola virus
gccaacaaauau

SEQ ID NO: 4094749 - RNA, 23 nt, Variola virus
gccaauugauaguaaauaaugag

SEQ ID NO: 4094750 - RNA, 23 nt, Variola virus
gccacaauauauucuaugauggu

SEQ ID NO: 4094751 - RNA, 15 nt, Variola virus
gccaccacuucucua

SEQ ID NO: 4094752 - RNA, 21 nt, Variola virus
gccacgaauaaaaaauacuua

SEQ ID NO: 4094753 - RNA, 22 nt, Variola virus
gccaucguguuaaauuuucuaa

SEQ ID NO: 4094754 - RNA, 14 nt, Variola virus
gccauuacaagaua

SEQ ID NO: 4094755 - RNA, 18 nt, Variola virus
gccgcaaccauuagauuu

SEQ ID NO: 4094756 - RNA, 20 nt, Variola virus
gccuaauguaucgauaauua

SEQ ID NO: 4094757 - RNA, 17 nt, Variola virus
gcgaaccgauuaaacau

SEQ ID NO: 4094758 - RNA, 15 nt, Variola virus
gcgaacuuuaaacag

SEQ ID NO: 4094759 - RNA, 17 nt, Variola virus
gcgaauaaauagauaua

SEQ ID NO: 4094760 - RNA, 19 nt, Variola virus
uaacuaaaaauguaaaaua

SEQ ID NO: 4094761 - RNA, 19 nt, Variola virus
uaacuaaaguuaauacuac

SEQ ID NO: 4094762 - RNA, 22 nt, Variola virus
uaacuaugauaucucuauuaau

SEQ ID NO: 4094763 - RNA, 16 nt, Variola virus
uaacuauuuagcaaaa

SEQ ID NO: 4094764 - RNA, 12 nt, Variola virus
uaacuauuugca

SEQ ID NO: 4094765 - RNA, 21 nt, Variola virus
uaacucauugcuuucuagaau

SEQ ID NO: 4094766 - RNA, 13 nt, Variola virus
uacauacuaauau

SEQ ID NO: 4094767 - RNA, 17 nt, Variola virus
uacauauuuguacauua

SEQ ID NO: 4094768 - RNA, 13 nt, Variola virus
uacaucaaucuua

SEQ ID NO: 4094769 - RNA, 18 nt, Variola virus
uacaucuaguucuuugaa

SEQ ID NO: 4094770 - RNA, 19 nt, Variola virus
uacaucuauauugcuacau

SEQ ID NO: 4094771 - RNA, 16 nt, Variola virus
uacaucuguuuccuau

SEQ ID NO: 4094772 - RNA, 16 nt, Variola virus
uacaucuucaauagau

SEQ ID NO: 4094773 - RNA, 14 nt, Variola virus
uacaugaaggacuu

SEQ ID NO: 4094774 - RNA, 17 nt, Variola virus
uacauucuuuuugcugu

SEQ ID NO: 4094775 - RNA, 20 nt, Variola virus
uaccaaaaagugugauuaau

SEQ ID NO: 4094776 - RNA, 23 nt, Variola virus
uaccaaacuuucagaagaaaugg

SEQ ID NO: 4094777 - RNA, 13 nt, Variola virus
uaccaaauauuag

SEQ ID NO: 4094778 - RNA, 22 nt, Variola virus
uaccaacaugucugauauuuug

SEQ ID NO: 4094779 - RNA, 22 nt, Variola virus
uaccaauaugucuguacaaaug

SEQ ID NO: 4094780 - RNA, 21 nt, Variola virus
uaccacaauaaaaaaaauuga

SEQ ID NO: 4094781 - RNA, 23 nt, Variola virus
uaccauggaaaaauauuacagau

SEQ ID NO: 4094782 - RNA, 21 nt, Variola virus
uaccauggacggagacaaauu

SEQ ID NO: 4094783 - RNA, 13 nt, Variola virus
uaccauucaauau

SEQ ID NO: 4094784 - RNA, 17 nt, Variola virus
uaccauuuuaaaaucau

SEQ ID NO: 4094785 - RNA, 16 nt, Variola virus
uacccaaaucugaaaa

SEQ ID NO: 4094786 - RNA, 18 nt, Variola virus
uacccaaucucucucaaa

SEQ ID NO: 4094787 - RNA, 21 nt, Variola virus
uaccccucauaguauuaauau

SEQ ID NO: 4094788 - RNA, 16 nt, Variola virus
uaccgaagaauuaaau

SEQ ID NO: 4094789 - RNA, 23 nt, Variola virus
uaccuaauauaaaucaaauacuu

SEQ ID NO: 4094790 - RNA, 20 nt, Variola virus
uaccugcaguggaguuauau

SEQ ID NO: 4094791 - RNA, 14 nt, Variola virus
uaccuuguauacau

SEQ ID NO: 4094792 - RNA, 21 nt, Variola virus
uacgaaaacgaaaucuguaau

SEQ ID NO: 4094793 - RNA, 17 nt, Variola virus
uacgaagacagacauac

SEQ ID NO: 4094794 - RNA, 18 nt, Variola virus
uacgacuaaguucaaguc

SEQ ID NO: 4094795 - RNA, 14 nt, Variola virus
uacgauaugauuca

SEQ ID NO: 4094796 - RNA, 14 nt, Variola virus
uacgauuaucuauu

SEQ ID NO: 4094797 - RNA, 17 nt, Variola virus
uacgcauuacaguuuuu

SEQ ID NO: 4094798 - RNA, 22 nt, Variola virus
uacgccaaauaucucaaagaug

SEQ ID NO: 4094799 - RNA, 16 nt, Variola virus
uacgccccuguaucuc

SEQ ID NO: 4094800 - RNA, 19 nt, Variola virus
uacgccuuuaaauccucua

SEQ ID NO: 4094801 - RNA, 16 nt, Variola virus
uacgcuuauuaucauc

SEQ ID NO: 4094802 - RNA, 15 nt, Variola virus
uacgucaucaaaaau

SEQ ID NO: 4094803 - RNA, 15 nt, Variola virus
uacuaaaacugaaga

SEQ ID NO: 4094804 - RNA, 17 nt, Variola virus
uacuaauacuaauacua

SEQ ID NO: 4094805 - RNA, 18 nt, Variola virus
uacuaauacuaauacuac

SEQ ID NO: 4094806 - RNA, 18 nt, Variola virus
uacuaauaggucuaaaaa

SEQ ID NO: 4094807 - RNA, 19 nt, Variola virus
uacuaauuacuaaaucugu

SEQ ID NO: 4094808 - RNA, 22 nt, Variola virus
uacuagacugacuucuaacaaa

SEQ ID NO: 4094809 - RNA, 11 nt, Variola virus
uacuaggaaaa

SEQ ID NO: 4094810 - RNA, 20 nt, Variola virus
uacuaguggauguacaugua

SEQ ID NO: 4094811 - RNA, 21 nt, Variola virus
uacuauauaguaauaccaaug

SEQ ID NO: 4094812 - RNA, 18 nt, Variola virus
uacuauuauauuugguau

SEQ ID NO: 4094813 - RNA, 18 nt, Variola virus
uacucauuuaacagaugu

SEQ ID NO: 4094814 - RNA, 24 nt, Variola virus
uacuccaaaaaacaaaauaacuag

SEQ ID NO: 4094815 - RNA, 18 nt, Variola virus
uacucggccgacauaaug

SEQ ID NO: 4094816 - RNA, 20 nt, Variola virus
uacucuaaucuuuaauagau

SEQ ID NO: 4094817 - RNA, 22 nt, Variola virus
uacucuccgaguguaaauauua

SEQ ID NO: 4094818 - RNA, 13 nt, Variola virus
uacucuucuaaau

SEQ ID NO: 4094819 - RNA, 16 nt, Variola virus
uacugaagaacuaaaa

SEQ ID NO: 4094820 - RNA, 13 nt, Variola virus
uacugaauuauua

SEQ ID NO: 4094821 - RNA, 16 nt, Variola virus
uacuggauucauacau

SEQ ID NO: 4094822 - RNA, 16 nt, Variola virus
uacuguaacacaauga

SEQ ID NO: 4094823 - RNA, 21 nt, Variola virus
uacuguauugauuacagugua

SEQ ID NO: 4094824 - RNA, 20 nt, Variola virus
uacuuagucuguacaaaagu

SEQ ID NO: 4094825 - RNA, 13 nt, Variola virus
uacuucuauacaa

SEQ ID NO: 4094826 - RNA, 20 nt, Variola virus
uacuucucccauaauacuuu

SEQ ID NO: 4094827 - RNA, 18 nt, Variola virus
uacuugauaagauaaaau

SEQ ID NO: 4094828 - RNA, 22 nt, Variola virus
uacuugcacguaaagucuacau

SEQ ID NO: 4094829 - RNA, 16 nt, Variola virus
uacuuuaaagaaguag

SEQ ID NO: 4094830 - RNA, 13 nt, Variola virus
uacuuuguaagau

SEQ ID NO: 4094831 - RNA, 23 nt, Variola virus
uacuuuguggaugaugaugaaau

SEQ ID NO: 4094832 - RNA, 15 nt, Variola virus
uacuuuguguuucau

SEQ ID NO: 4094833 - RNA, 14 nt, Variola virus
uacuuuuaggaaau

SEQ ID NO: 4094834 - RNA, 18 nt, Variola virus
uagaaaaaacauguggua

SEQ ID NO: 4094835 - RNA, 20 nt, Variola virus
uagaaaaaauagaacuuauc

SEQ ID NO: 4094836 - RNA, 15 nt, Variola virus
uagaaaaaauuuauu

SEQ ID NO: 4094837 - RNA, 13 nt, Variola virus
uagaaaaacuuua

SEQ ID NO: 4094838 - RNA, 15 nt, Variola virus
uagaaaauauauucu

SEQ ID NO: 4094839 - RNA, 15 nt, Variola virus
uagaaacauauucua

SEQ ID NO: 4094840 - RNA, 23 nt, Variola virus
uagaaagaaacgauuauuucuaa

SEQ ID NO: 4094841 - RNA, 17 nt, Variola virus
uagaaaguaauggauua

SEQ ID NO: 4094842 - RNA, 19 nt, Variola virus
uagaaauuaucaaauguug

SEQ ID NO: 4094843 - RNA, 17 nt, Variola virus
uagaacagauuuaacaa

SEQ ID NO: 4094844 - RNA, 19 nt, Variola virus
uagaaccacuauguuaaua

SEQ ID NO: 4094845 - RNA, 17 nt, Variola virus
uagaacuuuuaauuuug

SEQ ID NO: 4094846 - RNA, 21 nt, Variola virus
uagaagagcaaauaucucauc

SEQ ID NO: 4094847 - RNA, 21 nt, Variola virus
uagaagaucaaccucuggagu

SEQ ID NO: 4094848 - RNA, 16 nt, Variola virus
uagaagccaauaucug

SEQ ID NO: 4094849 - RNA, 14 nt, Variola virus
uagaauauauguca

SEQ ID NO: 4094850 - RNA, 21 nt, Variola virus
uagaauccauaaaacaaaauc

SEQ ID NO: 4094851 - RNA, 18 nt, Variola virus
uagaaugcucuuaaauaa

SEQ ID NO: 4094852 - RNA, 22 nt, Variola virus
uagaauguugagcuaauuuuug

SEQ ID NO: 4094853 - RNA, 21 nt, Variola virus
uagacaaugcuaauauauucu

SEQ ID NO: 4094854 - RNA, 15 nt, Variola virus
uagacacgcguaaua

SEQ ID NO: 4094855 - RNA, 16 nt, Variola virus
uagacagaauaucgug

SEQ ID NO: 4094856 - RNA, 14 nt, Variola virus
uagacauaauacua

SEQ ID NO: 4094857 - RNA, 21 nt, Variola virus
uagacauaauagucaauagau

SEQ ID NO: 4094858 - RNA, 11 nt, Variola virus
uagacauagau

SEQ ID NO: 4094859 - RNA, 21 nt, Variola virus
uagacauuguacaauaugugu

SEQ ID NO: 4094860 - RNA, 19 nt, Variola virus
uagagaaucgcuagaugcu

SEQ ID NO: 4094861 - RNA, 20 nt, Variola virus
uagagcccacguuuaaacau

SEQ ID NO: 4094862 - RNA, 21 nt, Variola virus
uagagcccacguuuaaacauu

SEQ ID NO: 4094863 - RNA, 22 nt, Variola virus
uagagugaguuuaggauucauu

SEQ ID NO: 4094864 - RNA, 13 nt, Variola virus
uagauaaacuauc

SEQ ID NO: 4094865 - RNA, 14 nt, Variola virus
uagauaaauuuauc

SEQ ID NO: 4094866 - RNA, 12 nt, Variola virus
uagauacaaaau

SEQ ID NO: 4094867 - RNA, 14 nt, Variola virus
uagauaucaaaaua

SEQ ID NO: 4094868 - RNA, 15 nt, Variola virus
uagaucaacgucauc

SEQ ID NO: 4094869 - RNA, 22 nt, Variola virus
uagauccuucaauaacuuauag

SEQ ID NO: 4094870 - RNA, 21 nt, Variola virus
uagaucugauacaccuguaau

SEQ ID NO: 4094871 - RNA, 14 nt, Variola virus
uagauuaaugcuua

SEQ ID NO: 4094872 - RNA, 13 nt, Variola virus
uagauuaucuauu

SEQ ID NO: 4094873 - RNA, 19 nt, Variola virus
uagauuggagucuacuaau

SEQ ID NO: 4094874 - RNA, 19 nt, Variola virus
uagauugguacgaaauaua

SEQ ID NO: 4094875 - RNA, 17 nt, Variola virus
uagauuuauaauacuuu

SEQ ID NO: 4094876 - RNA, 16 nt, Variola virus
uagauuuccaaagaua

SEQ ID NO: 4094877 - RNA, 16 nt, Variola virus
uagauuuuaucuaauu

SEQ ID NO: 4094878 - RNA, 18 nt, Variola virus
uagauuuuuaguuacaga

SEQ ID NO: 4094879 - RNA, 16 nt, Variola virus
uagcaauuucaaaaua

SEQ ID NO: 4094880 - RNA, 19 nt, Variola virus
uagcaucuuuuuauaucug

SEQ ID NO: 4094881 - RNA, 17 nt, Variola virus
uagccaucguuaauuau

SEQ ID NO: 4094882 - RNA, 22 nt, Variola virus
uagccaugggaacaguaaugau

SEQ ID NO: 4094883 - RNA, 18 nt, Variola virus
uagcguuauaacaaaauc

SEQ ID NO: 4094884 - RNA, 21 nt, Variola virus
uagcuauuuguagcaaaacua

SEQ ID NO: 4094885 - RNA, 15 nt, Variola virus
uagcuguucaagaau

SEQ ID NO: 4094886 - RNA, 23 nt, Variola virus
uagcuuuguuagacuaaauacua

SEQ ID NO: 4094887 - RNA, 17 nt, Variola virus
uaggagaugauagcuau

SEQ ID NO: 4094888 - RNA, 14 nt, Variola virus
uaggaguaucuauu

SEQ ID NO: 4094889 - RNA, 19 nt, Variola virus
uaggauuuuggacuuauau

SEQ ID NO: 4094890 - RNA, 17 nt, Variola virus
uaggcacagucaaacau

SEQ ID NO: 4094891 - RNA, 13 nt, Variola virus
cucuauuaaauac

SEQ ID NO: 4094892 - RNA, 17 nt, Variola virus
cucuauuuugucauuaa

SEQ ID NO: 4094893 - RNA, 22 nt, Variola virus
cucuauuuugucauuaacuuua

SEQ ID NO: 4094894 - RNA, 21 nt, Variola virus
cucugaauauagaacaucauu

SEQ ID NO: 4094895 - RNA, 16 nt, Variola virus
cucugaccuaaaggug

SEQ ID NO: 4094896 - RNA, 20 nt, Variola virus
cucuggguaacaaacauacu

SEQ ID NO: 4094897 - RNA, 13 nt, Variola virus
cucuuaaaaauug

SEQ ID NO: 4094898 - RNA, 18 nt, Variola virus
cucuucaacaucuuuaau

SEQ ID NO: 4094899 - RNA, 15 nt, Variola virus
cucuuccaguuccaa

SEQ ID NO: 4094900 - RNA, 17 nt, Variola virus
cucuuccaucaccaaaa

SEQ ID NO: 4094901 - RNA, 14 nt, Variola virus
cucuuggaauuaau

SEQ ID NO: 4094902 - RNA, 15 nt, Variola virus
cugaaaaagauauca

SEQ ID NO: 4094903 - RNA, 16 nt, Variola virus
cugaaaagaagugagu

SEQ ID NO: 4094904 - RNA, 14 nt, Variola virus
cugaaaauaaagau

SEQ ID NO: 4094905 - RNA, 12 nt, Variola virus
cugaaaauuaaa

SEQ ID NO: 4094906 - RNA, 22 nt, Variola virus
cugaaaauuggaguuagguauu

SEQ ID NO: 4094907 - RNA, 15 nt, Variola virus
cugaacccguuaaug

SEQ ID NO: 4094908 - RNA, 13 nt, Variola virus
cugaaguuucaua

SEQ ID NO: 4094909 - RNA, 14 nt, Variola virus
cugaauaaaacauc

SEQ ID NO: 4094910 - RNA, 23 nt, Variola virus
cugaauacuaucgauugaugagu

SEQ ID NO: 4094911 - RNA, 16 nt, Variola virus
cugaauauauugauuu

SEQ ID NO: 4094912 - RNA, 14 nt, Variola virus
cugauaagauaucu

SEQ ID NO: 4094913 - RNA, 14 nt, Variola virus
cugaucauuaauau

SEQ ID NO: 4094914 - RNA, 20 nt, Variola virus
cugauuuauguuuuaaauau

SEQ ID NO: 4094915 - RNA, 16 nt, Variola virus
cugauuucucucauaa

SEQ ID NO: 4094916 - RNA, 21 nt, Variola virus
cugauuuuuuaugauuuugug

SEQ ID NO: 4094917 - RNA, 20 nt, Variola virus
cugcagaauaauuagaaauu

SEQ ID NO: 4094918 - RNA, 17 nt, Variola virus
cugcauuaucaauaaau

SEQ ID NO: 4094919 - RNA, 18 nt, Variola virus
cugcgaacuuuaaacaga

SEQ ID NO: 4094920 - RNA, 19 nt, Variola virus
cugcuccagaauuaauaau

SEQ ID NO: 4094921 - RNA, 17 nt, Variola virus
cugguagccguuucaau

SEQ ID NO: 4094922 - RNA, 22 nt, Variola virus
cuggucuaaaauuuccaucucu

SEQ ID NO: 4094923 - RNA, 20 nt, Variola virus
cuguacuaucuagagauugu

SEQ ID NO: 4094924 - RNA, 18 nt, Variola virus
cuguaucauccaguuugc

SEQ ID NO: 4094925 - RNA, 18 nt, Variola virus
cuguauccucaaacaucc

SEQ ID NO: 4094926 - RNA, 18 nt, Variola virus
cuguauuuggaucuuuug

SEQ ID NO: 4094927 - RNA, 18 nt, Variola virus
cugucaugauaaaaauuu

SEQ ID NO: 4094928 - RNA, 21 nt, Variola virus
cugucaugauaaaaauuuaaa

SEQ ID NO: 4094929 - RNA, 23 nt, Variola virus
cugucgaaaaaguaggaauuaau

SEQ ID NO: 4094930 - RNA, 21 nt, Variola virus
cugugcauaaauuaaaauaca

SEQ ID NO: 4094931 - RNA, 13 nt, Variola virus
cuguuauuuugaa

SEQ ID NO: 4094932 - RNA, 15 nt, Variola virus
cuguucuaucaucua

SEQ ID NO: 4094933 - RNA, 16 nt, Variola virus
cuguucuccguguggu

SEQ ID NO: 4094934 - RNA, 17 nt, Variola virus
cuguugugaauauuuua

SEQ ID NO: 4094935 - RNA, 15 nt, Variola virus
cuuaaauauuucuac

SEQ ID NO: 4094936 - RNA, 21 nt, Variola virus
cuuaacuuuuucuuucucagc

SEQ ID NO: 4094937 - RNA, 13 nt, Variola virus
cuuaauaaauguu

SEQ ID NO: 4094938 - RNA, 16 nt, Variola virus
cuuaguaaacagucca

SEQ ID NO: 4094939 - RNA, 13 nt, Variola virus
cuuaguaacucua

SEQ ID NO: 4094940 - RNA, 22 nt, Variola virus
cuuauacgauccgcgucuuuuu

SEQ ID NO: 4094941 - RNA, 22 nt, Variola virus
cuuaugaaacuuggaaacaucu

SEQ ID NO: 4094942 - RNA, 21 nt, Variola virus
cuucagaaaagucaaauauug

SEQ ID NO: 4094943 - RNA, 20 nt, Variola virus
cuucagaauauucuuuucua

SEQ ID NO: 4094944 - RNA, 21 nt, Variola virus
cuucagaauauucuuuucuaa

SEQ ID NO: 4094945 - RNA, 23 nt, Variola virus
cuucagauaaucugaaaaugaaa

SEQ ID NO: 4094946 - RNA, 23 nt, Variola virus
cuucaucaaccgaguuguuaauc

SEQ ID NO: 4094947 - RNA, 23 nt, Variola virus
cuuccagaauuguaacaacaaug

SEQ ID NO: 4094948 - RNA, 14 nt, Variola virus
cuucuaaucuugua

SEQ ID NO: 4094949 - RNA, 12 nt, Variola virus
cuucuacauaaa

SEQ ID NO: 4094950 - RNA, 20 nt, Variola virus
cuucuaucuuguuuagauuu

SEQ ID NO: 4094951 - RNA, 22 nt, Variola virus
cuucuaugagauugaucaugua

SEQ ID NO: 4094952 - RNA, 17 nt, Variola virus
cuucuuuuuauauccaa

SEQ ID NO: 4094953 - RNA, 14 nt, Variola virus
cuugaagaugauuu

SEQ ID NO: 4094954 - RNA, 21 nt, Variola virus
cuugagagcauccaguaugaa

SEQ ID NO: 4094955 - RNA, 18 nt, Variola virus
cuugaucucaucauucca

SEQ ID NO: 4094956 - RNA, 13 nt, Variola virus
cuugcaaguuaaa

SEQ ID NO: 4094957 - RNA, 19 nt, Variola virus
cuugguuuacauggaucag

SEQ ID NO: 4094958 - RNA, 22 nt, Variola virus
cuuguaauugugggaacauaau

SEQ ID NO: 4094959 - RNA, 13 nt, Variola virus
cuugugguaauga

SEQ ID NO: 4094960 - RNA, 19 nt, Variola virus
cuuguuaauaaguaaauga

SEQ ID NO: 4094961 - RNA, 15 nt, Variola virus
cuuguuauaaacaca

SEQ ID NO: 4094962 - RNA, 16 nt, Variola virus
cuuuaacaucacuaau

SEQ ID NO: 4094963 - RNA, 15 nt, Variola virus
cuuuaaccuauacau

SEQ ID NO: 4094964 - RNA, 14 nt, Variola virus
cuuuaagcagaucu

SEQ ID NO: 4094965 - RNA, 22 nt, Variola virus
cuuuaaguuuuucguuguuaag

SEQ ID NO: 4094966 - RNA, 15 nt, Variola virus
cuuuaauccauguuu

SEQ ID NO: 4094967 - RNA, 14 nt, Variola virus
cuuuagaaaaacuu

SEQ ID NO: 4094968 - RNA, 14 nt, Variola virus
cuuuauaaugcauu

SEQ ID NO: 4094969 - RNA, 12 nt, Variola virus
cuuuaucacuau

SEQ ID NO: 4094970 - RNA, 14 nt, Variola virus
cuuuauuaaaucau

SEQ ID NO: 4094971 - RNA, 13 nt, Variola virus
cuuuauuaucuau

SEQ ID NO: 4094972 - RNA, 11 nt, Variola virus
cuuucucucuu

SEQ ID NO: 4094973 - RNA, 18 nt, Variola virus
cuuugaacuguuuaagag

SEQ ID NO: 4094974 - RNA, 12 nt, Variola virus
cuuugacaaaug

SEQ ID NO: 4094975 - RNA, 16 nt, Variola virus
cuuugauuucuuaucu

SEQ ID NO: 4094976 - RNA, 12 nt, Variola virus
cuuugcuauuuc

SEQ ID NO: 4094977 - RNA, 20 nt, Variola virus
cuuugguaauaaaauuauuc

SEQ ID NO: 4094978 - RNA, 15 nt, Variola virus
cuuuguaauauugua

SEQ ID NO: 4094979 - RNA, 18 nt, Variola virus
cuuuguauucaguauuuu

SEQ ID NO: 4094980 - RNA, 21 nt, Variola virus
cuuuuaucguuuaagaauaau

SEQ ID NO: 4094981 - RNA, 20 nt, Variola virus
cuuuuauuuccacauuagau

SEQ ID NO: 4094982 - RNA, 16 nt, Variola virus
cuuuuauuuuaucuaa

SEQ ID NO: 4094983 - RNA, 16 nt, Variola virus
cuuuugcuauuaccaa

SEQ ID NO: 4094984 - RNA, 22 nt, Variola virus
cuuuugucguaaauacaugucu

SEQ ID NO: 4094985 - RNA, 18 nt, Variola virus
cuuuuguggaauuuccca

SEQ ID NO: 4094986 - RNA, 18 nt, Variola virus
cuuuuguggacauuuucu

SEQ ID NO: 4094987 - RNA, 17 nt, Variola virus
cuuuuuauccucauuaa

SEQ ID NO: 4094988 - RNA, 16 nt, Variola virus
cuuuuuuccaaacugc

SEQ ID NO: 4094989 - RNA, 22 nt, Variola virus
gaaaaaaaucuuuuuuuauucu

SEQ ID NO: 4094990 - RNA, 17 nt, Variola virus
gaaaaauaacaaaucua

SEQ ID NO: 4094991 - RNA, 12 nt, Variola virus
gaaaaauaauua

SEQ ID NO: 4094992 - RNA, 19 nt, Variola virus
gaaaaauguuagaauuaga

SEQ ID NO: 4094993 - RNA, 17 nt, Variola virus
gaaaacuauauacuaua

SEQ ID NO: 4094994 - RNA, 17 nt, Variola virus
gaaaacugguuaaaaca

SEQ ID NO: 4094995 - RNA, 13 nt, Variola virus
gaaaagauucuuu

SEQ ID NO: 4094996 - RNA, 22 nt, Variola virus
gaaaaguuauuaucuguagacg

SEQ ID NO: 4094997 - RNA, 17 nt, Variola virus
gaaaauaaucuaguaaa

SEQ ID NO: 4094998 - RNA, 21 nt, Variola virus
gaaaaucagaucugauaauau

SEQ ID NO: 4094999 - RNA, 18 nt, Variola virus
gaaaauccagcuacuaua

SEQ ID NO: 4095000 - RNA, 22 nt, Variola virus
gaaaaugaaaaaguacuagaua

SEQ ID NO: 4095001 - RNA, 24 nt, Variola virus
gaaaaugaacaucggaaauauaga

SEQ ID NO: 4095002 - RNA, 14 nt, Variola virus
gaaaauguaauaaa

SEQ ID NO: 4095003 - RNA, 15 nt, Variola virus
gaaaauuauaaugaa

SEQ ID NO: 4095004 - RNA, 15 nt, Variola virus
gaaaauucaaauaga

SEQ ID NO: 4095005 - RNA, 22 nt, Variola virus
gaaacaauguuucuuacauauu

SEQ ID NO: 4095006 - RNA, 15 nt, Variola virus
gaaacauaacaauga

SEQ ID NO: 4095007 - RNA, 23 nt, Variola virus
gaaacauauucuaugaauuuaua

SEQ ID NO: 4095008 - RNA, 20 nt, Variola virus
gaaaccacugucuaaaugua

SEQ ID NO: 4095009 - RNA, 22 nt, Variola virus
gaaaccagaaugaaaaacucug

SEQ ID NO: 4095010 - RNA, 20 nt, Variola virus
gaaacuuuucagaauaucua

SEQ ID NO: 4095011 - RNA, 17 nt, Variola virus
gaaagauauauuaagaa

SEQ ID NO: 4095012 - RNA, 19 nt, Variola virus
gaaauaaccgcaugauuau

SEQ ID NO: 4095013 - RNA, 14 nt, Variola virus
gaaauaagagacuu

SEQ ID NO: 4095014 - RNA, 20 nt, Variola virus
gaaauaauauaaaugauuau

SEQ ID NO: 4095015 - RNA, 14 nt, Variola virus
gaaauaauauuaaa

SEQ ID NO: 4095016 - RNA, 21 nt, Variola virus
gaaauauaugagauguaguua

SEQ ID NO: 4095017 - RNA, 18 nt, Variola virus
gaaauauauuaagaaauc

SEQ ID NO: 4095018 - RNA, 15 nt, Variola virus
gaaaucaacaaucua

SEQ ID NO: 4095019 - RNA, 14 nt, Variola virus
gaaauccuauuuua

SEQ ID NO: 4095020 - RNA, 18 nt, Variola virus
cguuacuaacgugauuau

SEQ ID NO: 4095021 - RNA, 18 nt, Variola virus
cguuaguaacgccauuau

SEQ ID NO: 4095022 - RNA, 12 nt, Variola virus
cguuagucauau

SEQ ID NO: 4095023 - RNA, 19 nt, Variola virus
cguucaacauuuuauggaa

SEQ ID NO: 4095024 - RNA, 18 nt, Variola virus
cguuggaccauuaauagg

SEQ ID NO: 4095025 - RNA, 12 nt, Variola virus
cguuuuucugau

SEQ ID NO: 4095026 - RNA, 21 nt, Variola virus
cuaaaacugaagagacugauu

SEQ ID NO: 4095027 - RNA, 23 nt, Variola virus
cuaaaauaguucuguaauauguc

SEQ ID NO: 4095028 - RNA, 14 nt, Variola virus
cuaaauaaguagua

SEQ ID NO: 4095029 - RNA, 23 nt, Variola virus
cuaaauaccucauaaaacaaaaa

SEQ ID NO: 4095030 - RNA, 17 nt, Variola virus
cuaaaucgucaguagua

SEQ ID NO: 4095031 - RNA, 12 nt, Variola virus
cuaaaugaugau

SEQ ID NO: 4095032 - RNA, 13 nt, Variola virus
cuaacacauuuca

SEQ ID NO: 4095033 - RNA, 15 nt, Variola virus
cuaacacauuucaac

SEQ ID NO: 4095034 - RNA, 16 nt, Variola virus
cuaacgugauggauau

SEQ ID NO: 4095035 - RNA, 14 nt, Variola virus
cuaacucuguuuua

SEQ ID NO: 4095036 - RNA, 13 nt, Variola virus
cuaacuuaucuag

SEQ ID NO: 4095037 - RNA, 17 nt, Variola virus
cuaagacgucucauuuc

SEQ ID NO: 4095038 - RNA, 22 nt, Variola virus
cuaagacguuguaucucuuuuu

SEQ ID NO: 4095039 - RNA, 20 nt, Variola virus
cuaagcaauagguaauaacu

SEQ ID NO: 4095040 - RNA, 13 nt, Variola virus
cuaagccaacaaa

SEQ ID NO: 4095041 - RNA, 16 nt, Variola virus
cuaagcgguaaauaau

SEQ ID NO: 4095042 - RNA, 14 nt, Variola virus
cuaaguuucuuucc

SEQ ID NO: 4095043 - RNA, 22 nt, Variola virus
cuaauagcgaucauucgcuuaa

SEQ ID NO: 4095044 - RNA, 14 nt, Variola virus
cuaauauauucuua

SEQ ID NO: 4095045 - RNA, 19 nt, Variola virus
cuaauaugaggaaaaugau

SEQ ID NO: 4095046 - RNA, 19 nt, Variola virus
cuaauauuauuaccaucuu

SEQ ID NO: 4095047 - RNA, 22 nt, Variola virus
cuaauauucccaaacauacauc

SEQ ID NO: 4095048 - RNA, 19 nt, Variola virus
cuaaucuauuuuaucauuu

SEQ ID NO: 4095049 - RNA, 16 nt, Variola virus
cuaaucucuucuuuaa

SEQ ID NO: 4095050 - RNA, 12 nt, Variola virus
cuaaugaugcag

SEQ ID NO: 4095051 - RNA, 13 nt, Variola virus
cuaauggauguca

SEQ ID NO: 4095052 - RNA, 23 nt, Variola virus
cuaauguuuccggagauagauuu

SEQ ID NO: 4095053 - RNA, 15 nt, Variola virus
cuaauuaaaaguuuu

SEQ ID NO: 4095054 - RNA, 20 nt, Variola virus
cuaauuccgcauuaaaugau

SEQ ID NO: 4095055 - RNA, 17 nt, Variola virus
cuaauucgacuaucgaa

SEQ ID NO: 4095056 - RNA, 13 nt, Variola virus
cuaauucuuuaau

SEQ ID NO: 4095057 - RNA, 22 nt, Variola virus
cuaauugaucaagaguaacuau

SEQ ID NO: 4095058 - RNA, 17 nt, Variola virus
cuaauuuacuaucugua

SEQ ID NO: 4095059 - RNA, 22 nt, Variola virus
cuacaaaacagaaauaugugaa

SEQ ID NO: 4095060 - RNA, 20 nt, Variola virus
cuacaaauuuggauauucua

SEQ ID NO: 4095061 - RNA, 15 nt, Variola virus
cuacaauacacacaa

SEQ ID NO: 4095062 - RNA, 16 nt, Variola virus
cuacaauauauucuca

SEQ ID NO: 4095063 - RNA, 15 nt, Variola virus
cuacacuaaaaugau

SEQ ID NO: 4095064 - RNA, 24 nt, Variola virus
cuacagucguucaacugucuuuca

SEQ ID NO: 4095065 - RNA, 21 nt, Variola virus
cuacauaguuaucuaucuuaa

SEQ ID NO: 4095066 - RNA, 22 nt, Variola virus
cuacauaguuaucuaucuuaaa

SEQ ID NO: 4095067 - RNA, 15 nt, Variola virus
cuacaucaucaucuu

SEQ ID NO: 4095068 - RNA, 13 nt, Variola virus
cuaccaucauguc

SEQ ID NO: 4095069 - RNA, 12 nt, Variola virus
cuaccuauuuca

SEQ ID NO: 4095070 - RNA, 15 nt, Variola virus
cuacucguuuggaau

SEQ ID NO: 4095071 - RNA, 13 nt, Variola virus
cuacuuaaaugua

SEQ ID NO: 4095072 - RNA, 15 nt, Variola virus
cuacuuuagcauuga

SEQ ID NO: 4095073 - RNA, 14 nt, Variola virus
cuagaauaucccaa

SEQ ID NO: 4095074 - RNA, 18 nt, Variola virus
cuagacuugauuauucua

SEQ ID NO: 4095075 - RNA, 18 nt, Variola virus
cuagagcaucaauguccu

SEQ ID NO: 4095076 - RNA, 20 nt, Variola virus
cuagaugauauagugaaaca

SEQ ID NO: 4095077 - RNA, 16 nt, Variola virus
cuagaugguuauuuac

SEQ ID NO: 4095078 - RNA, 17 nt, Variola virus
cuagauucgaaaaucaa

SEQ ID NO: 4095079 - RNA, 23 nt, Variola virus
cuagcuuuauacacaucucuuca

SEQ ID NO: 4095080 - RNA, 12 nt, Variola virus
cuaggauacaua

SEQ ID NO: 4095081 - RNA, 15 nt, Variola virus
cuaggauuuaaacaa

SEQ ID NO: 4095082 - RNA, 16 nt, Variola virus
cuaggugcuauggaug

SEQ ID NO: 4095083 - RNA, 16 nt, Variola virus
cuagguuucucuauaa

SEQ ID NO: 4095084 - RNA, 10 nt, Variola virus
cuaguauaaa

SEQ ID NO: 4095085 - RNA, 17 nt, Variola virus
cuagucucgauauccaa

SEQ ID NO: 4095086 - RNA, 18 nt, Variola virus
cuagugcucaaacaaaau

SEQ ID NO: 4095087 - RNA, 18 nt, Variola virus
cuaguggaauugaaaauu

SEQ ID NO: 4095088 - RNA, 20 nt, Variola virus
cuaguguuccuaauaucaua

SEQ ID NO: 4095089 - RNA, 20 nt, Variola virus
cuaguuuuagaauaacauua

SEQ ID NO: 4095090 - RNA, 20 nt, Variola virus
cuauaaaaagauuauacaaa

SEQ ID NO: 4095091 - RNA, 14 nt, Variola virus
cuauaaaauggauu

SEQ ID NO: 4095092 - RNA, 12 nt, Variola virus
cuauaacuucua

SEQ ID NO: 4095093 - RNA, 14 nt, Variola virus
cuauaaguauaaau

SEQ ID NO: 4095094 - RNA, 16 nt, Variola virus
cuauaauaucuuugaa

SEQ ID NO: 4095095 - RNA, 20 nt, Variola virus
cuauaauggaguuguaaaug

SEQ ID NO: 4095096 - RNA, 22 nt, Variola virus
cuauacaaaaucguucugcuaa

SEQ ID NO: 4095097 - RNA, 15 nt, Variola virus
cuauacaagucgucu

SEQ ID NO: 4095098 - RNA, 11 nt, Variola virus
cuauagaaaau

SEQ ID NO: 4095099 - RNA, 16 nt, Variola virus
cuauauaauaaaugua

SEQ ID NO: 4095100 - RNA, 17 nt, Variola virus
cuauauaauuauacuau

SEQ ID NO: 4095101 - RNA, 17 nt, Variola virus
cuauauauucugcuaua

SEQ ID NO: 4095102 - RNA, 16 nt, Variola virus
cuauaucaaugccuuu

SEQ ID NO: 4095103 - RNA, 14 nt, Variola virus
cuauauuauguuuu

SEQ ID NO: 4095104 - RNA, 19 nt, Variola virus
cuauauucuugauguagua

SEQ ID NO: 4095105 - RNA, 17 nt, Variola virus
cuauauuguaccaaauu

SEQ ID NO: 4095106 - RNA, 14 nt, Variola virus
cuaucauaaguuua

SEQ ID NO: 4095107 - RNA, 13 nt, Variola virus
cuauccaauaaac

SEQ ID NO: 4095108 - RNA, 18 nt, Variola virus
cuaucccccguauuuaca

SEQ ID NO: 4095109 - RNA, 23 nt, Variola virus
cuaucgaaaauugcuauuucaga

SEQ ID NO: 4095110 - RNA, 15 nt, Variola virus
cuaucgauaauuguu

SEQ ID NO: 4095111 - RNA, 13 nt, Variola virus
cuaucuacaucuu

SEQ ID NO: 4095112 - RNA, 18 nt, Variola virus
cuaucuccucuauucaua

SEQ ID NO: 4095113 - RNA, 12 nt, Variola virus
cuaucuuuagag

SEQ ID NO: 4095114 - RNA, 17 nt, Variola virus
cuauuacugacuuuaau

SEQ ID NO: 4095115 - RNA, 17 nt, Variola virus
cuauuagaauuuacaaa

SEQ ID NO: 4095116 - RNA, 23 nt, Variola virus
cuauuagaguauugcauuuugau

SEQ ID NO: 4095117 - RNA, 19 nt, Variola virus
cuauuagaucauuaacaga

SEQ ID NO: 4095118 - RNA, 19 nt, Variola virus
cuauuaucuccguuauaga

SEQ ID NO: 4095119 - RNA, 14 nt, Variola virus
cuauuauuaccaua

SEQ ID NO: 4095120 - RNA, 22 nt, Variola virus
cuauucuaacucacguuaauaa

SEQ ID NO: 4095121 - RNA, 19 nt, Variola virus
cuauugaugacacuaguua

SEQ ID NO: 4095122 - RNA, 14 nt, Variola virus
cuauugccuuagau

SEQ ID NO: 4095123 - RNA, 15 nt, Variola virus
cuauuggaauguguu

SEQ ID NO: 4095124 - RNA, 15 nt, Variola virus
cuauuguauuuugug

SEQ ID NO: 4095125 - RNA, 22 nt, Variola virus
cuauuguuacaaaaguuaauaa

SEQ ID NO: 4095126 - RNA, 21 nt, Variola virus
cuauuuauugacauuaaucua

SEQ ID NO: 4095127 - RNA, 9 nt, Variola virus
cuauuugga

SEQ ID NO: 4095128 - RNA, 13 nt, Variola virus
cuauuuucaguaa

SEQ ID NO: 4095129 - RNA, 19 nt, Variola virus
cuauuuuuuuauacuucua

SEQ ID NO: 4095130 - RNA, 15 nt, Variola virus
cucaacgcgauaucu

SEQ ID NO: 4095131 - RNA, 15 nt, Variola virus
cucaauuaguuuauu

SEQ ID NO: 4095132 - RNA, 13 nt, Variola virus
cucagaaacagaa

SEQ ID NO: 4095133 - RNA, 20 nt, Variola virus
cucauagucuauuaaguggu

SEQ ID NO: 4095134 - RNA, 19 nt, Variola virus
cucauguaaccuacuagaa

SEQ ID NO: 4095135 - RNA, 15 nt, Variola virus
cucauuaaaacuucu

SEQ ID NO: 4095136 - RNA, 19 nt, Variola virus
cucauuuuuugaauauacu

SEQ ID NO: 4095137 - RNA, 14 nt, Variola virus
cuccaaucaugugu

SEQ ID NO: 4095138 - RNA, 15 nt, Variola virus
cuccauuacacaaau

SEQ ID NO: 4095139 - RNA, 14 nt, Variola virus
cuccgauauucaau

SEQ ID NO: 4095140 - RNA, 16 nt, Variola virus
cuccgucauccuucac

SEQ ID NO: 4095141 - RNA, 11 nt, Variola virus
cuccuccacca

SEQ ID NO: 4095142 - RNA, 21 nt, Variola virus
cuccuccguuguuuuuucccu

SEQ ID NO: 4095143 - RNA, 19 nt, Variola virus
cuccugauugugucucaaa

SEQ ID NO: 4095144 - RNA, 22 nt, Variola virus
cuccuguaucuguuaaaacuac

SEQ ID NO: 4095145 - RNA, 19 nt, Variola virus
cucgagaauauuuaauuug

SEQ ID NO: 4095146 - RNA, 21 nt, Variola virus
cucguaugaaagauuaauuug

SEQ ID NO: 4095147 - RNA, 13 nt, Variola virus
cucuaauagauuu

SEQ ID NO: 4095148 - RNA, 20 nt, Variola virus
cucuagauuaucuuagugaa

SEQ ID NO: 4095149 - RNA, 15 nt, Variola virus
cucuauaaaaaugaa

SEQ ID NO: 4095150 - RNA, 17 nt, Variola virus
ccaaucuauaauaucuu

SEQ ID NO: 4095151 - RNA, 22 nt, Variola virus
ccaaucugggcguauaaugaau

SEQ ID NO: 4095152 - RNA, 18 nt, Variola virus
ccaaucuuguuauaaaca

SEQ ID NO: 4095153 - RNA, 22 nt, Variola virus
ccaaucuuuuguuuagaaugau

SEQ ID NO: 4095154 - RNA, 22 nt, Variola virus
ccaauuguuuuuguacauaaua

SEQ ID NO: 4095155 - RNA, 17 nt, Variola virus
ccaauuuggauauagca

SEQ ID NO: 4095156 - RNA, 13 nt, Variola virus
ccaauuuuucaga

SEQ ID NO: 4095157 - RNA, 11 nt, Variola virus
ccacaauucau

SEQ ID NO: 4095158 - RNA, 16 nt, Variola virus
ccacuaguuuccuuua

SEQ ID NO: 4095159 - RNA, 14 nt, Variola virus
ccacuauaaaauaa

SEQ ID NO: 4095160 - RNA, 16 nt, Variola virus
ccacugucuaaaugua

SEQ ID NO: 4095161 - RNA, 17 nt, Variola virus
ccacuuuaacaucucuu

SEQ ID NO: 4095162 - RNA, 20 nt, Variola virus
ccagauaguuuauauccgua

SEQ ID NO: 4095163 - RNA, 23 nt, Variola virus
ccagaucuauugacuauaacucc

SEQ ID NO: 4095164 - RNA, 13 nt, Variola virus
ccagauugaacau

SEQ ID NO: 4095165 - RNA, 14 nt, Variola virus
ccagcagcuagaga

SEQ ID NO: 4095166 - RNA, 17 nt, Variola virus
ccaguaugaauaaucuu

SEQ ID NO: 4095167 - RNA, 12 nt, Variola virus
ccauaauucuca

SEQ ID NO: 4095168 - RNA, 19 nt, Variola virus
ccauacucgucauccucau

SEQ ID NO: 4095169 - RNA, 20 nt, Variola virus
ccauagaguauuauugucga

SEQ ID NO: 4095170 - RNA, 14 nt, Variola virus
ccauauguuggaaa

SEQ ID NO: 4095171 - RNA, 21 nt, Variola virus
ccauauuaugggaucagguaa

SEQ ID NO: 4095172 - RNA, 14 nt, Variola virus
ccaucaaaagcauu

SEQ ID NO: 4095173 - RNA, 21 nt, Variola virus
ccaucacuucuaucuuguuua

SEQ ID NO: 4095174 - RNA, 15 nt, Variola virus
ccaucauccaagaaa

SEQ ID NO: 4095175 - RNA, 20 nt, Variola virus
ccauccuugggaguaguuua

SEQ ID NO: 4095176 - RNA, 14 nt, Variola virus
ccaucgauuguuua

SEQ ID NO: 4095177 - RNA, 16 nt, Variola virus
ccaucgauuguuuauu

SEQ ID NO: 4095178 - RNA, 14 nt, Variola virus
ccaucguuaauuau

SEQ ID NO: 4095179 - RNA, 15 nt, Variola virus
ccaucucuauguuuc

SEQ ID NO: 4095180 - RNA, 18 nt, Variola virus
ccaucuugaauauuuuua

SEQ ID NO: 4095181 - RNA, 14 nt, Variola virus
ccaugauaaugaau

SEQ ID NO: 4095182 - RNA, 18 nt, Variola virus
ccaugauuaaauauuuua

SEQ ID NO: 4095183 - RNA, 16 nt, Variola virus
ccauggaaaaauauua

SEQ ID NO: 4095184 - RNA, 18 nt, Variola virus
ccauguagaauaaauuau

SEQ ID NO: 4095185 - RNA, 19 nt, Variola virus
ccauuaagaaacuaguuua

SEQ ID NO: 4095186 - RNA, 17 nt, Variola virus
ccauuagguuaaaugau

SEQ ID NO: 4095187 - RNA, 15 nt, Variola virus
ccauucagacuacca

SEQ ID NO: 4095188 - RNA, 17 nt, Variola virus
ccauucuaaucacauua

SEQ ID NO: 4095189 - RNA, 16 nt, Variola virus
ccauugaugaauuccu

SEQ ID NO: 4095190 - RNA, 17 nt, Variola virus
ccauugcguugaaugau

SEQ ID NO: 4095191 - RNA, 22 nt, Variola virus
ccauuuaucauggaaaagaauu

SEQ ID NO: 4095192 - RNA, 16 nt, Variola virus
ccauuuuaaaaucauu

SEQ ID NO: 4095193 - RNA, 17 nt, Variola virus
ccauuuuguggugcaac

SEQ ID NO: 4095194 - RNA, 20 nt, Variola virus
cccaaaauguauguguugaa

SEQ ID NO: 4095195 - RNA, 14 nt, Variola virus
cccaaauaucuuua

SEQ ID NO: 4095196 - RNA, 15 nt, Variola virus
cccacguuuaaacau

SEQ ID NO: 4095197 - RNA, 21 nt, Variola virus
cccagaauaauauacuucugu

SEQ ID NO: 4095198 - RNA, 19 nt, Variola virus
ccccaggaucuccaacaaa

SEQ ID NO: 4095199 - RNA, 21 nt, Variola virus
cccuaccugaugaaucagaca

SEQ ID NO: 4095200 - RNA, 23 nt, Variola virus
cccuaucaagcgauucuuucaau

SEQ ID NO: 4095201 - RNA, 12 nt, Variola virus
ccggaacaaaaa

SEQ ID NO: 4095202 - RNA, 16 nt, Variola virus
ccggaguuagaaagca

SEQ ID NO: 4095203 - RNA, 14 nt, Variola virus
ccgucuaucaucua

SEQ ID NO: 4095204 - RNA, 13 nt, Variola virus
ccgucuguaucau

SEQ ID NO: 4095205 - RNA, 18 nt, Variola virus
ccguguucguucaaaugc

SEQ ID NO: 4095206 - RNA, 16 nt, Variola virus
ccguuaacaucucuuc

SEQ ID NO: 4095207 - RNA, 15 nt, Variola virus
ccguuuaauuuccua

SEQ ID NO: 4095208 - RNA, 19 nt, Variola virus
ccuaauacaucucuggaaa

SEQ ID NO: 4095209 - RNA, 18 nt, Variola virus
ccuacaggaauaucuuua

SEQ ID NO: 4095210 - RNA, 22 nt, Variola virus
ccuacguaucuauaaucaucug

SEQ ID NO: 4095211 - RNA, 21 nt, Variola virus
ccuaguacugaggauuuacua

SEQ ID NO: 4095212 - RNA, 16 nt, Variola virus
ccucuaacaucaucau

SEQ ID NO: 4095213 - RNA, 19 nt, Variola virus
ccugccauaaauaaaugcu

SEQ ID NO: 4095214 - RNA, 17 nt, Variola virus
ccuggaguauggaauac

SEQ ID NO: 4095215 - RNA, 19 nt, Variola virus
ccuugaaaauaaauacagu

SEQ ID NO: 4095216 - RNA, 16 nt, Variola virus
ccuuugcaaauacagc

SEQ ID NO: 4095217 - RNA, 17 nt, Variola virus
ccuuuuccuuaucuuca

SEQ ID NO: 4095218 - RNA, 18 nt, Variola virus
cgaaauaaauaaugaauu

SEQ ID NO: 4095219 - RNA, 21 nt, Variola virus
cgaaauagauuauuuaacagc

SEQ ID NO: 4095220 - RNA, 15 nt, Variola virus
cgaaauaucuuucca

SEQ ID NO: 4095221 - RNA, 14 nt, Variola virus
cgaagaauaauguu

SEQ ID NO: 4095222 - RNA, 18 nt, Variola virus
cgaagagacgauagauuu

SEQ ID NO: 4095223 - RNA, 12 nt, Variola virus
cgaauaaaagaa

SEQ ID NO: 4095224 - RNA, 20 nt, Variola virus
cgaauaauguauagcauugc

SEQ ID NO: 4095225 - RNA, 17 nt, Variola virus
cgaauauaaaucauauu

SEQ ID NO: 4095226 - RNA, 21 nt, Variola virus
cgaaugccauagaauaaauau

SEQ ID NO: 4095227 - RNA, 21 nt, Variola virus
cgaauuaugucuuuauucucu

SEQ ID NO: 4095228 - RNA, 21 nt, Variola virus
cgaauuauuucuuuguuuaua

SEQ ID NO: 4095229 - RNA, 13 nt, Variola virus
cgacaauauucua

SEQ ID NO: 4095230 - RNA, 23 nt, Variola virus
cgacuaguucccgcauuaaauaa

SEQ ID NO: 4095231 - RNA, 22 nt, Variola virus
cgagugaaaaaauaauuucuac

SEQ ID NO: 4095232 - RNA, 14 nt, Variola virus
cgauaauagauagu

SEQ ID NO: 4095233 - RNA, 14 nt, Variola virus
cgauaauauauuua

SEQ ID NO: 4095234 - RNA, 14 nt, Variola virus
cgauacauaauguu

SEQ ID NO: 4095235 - RNA, 20 nt, Variola virus
cgauacauccuucuauguua

SEQ ID NO: 4095236 - RNA, 21 nt, Variola virus
cgaucuuguuguuuauuuuca

SEQ ID NO: 4095237 - RNA, 18 nt, Variola virus
cgaugauuaaugacgaua

SEQ ID NO: 4095238 - RNA, 19 nt, Variola virus
cgaugccuuuuguaaauau

SEQ ID NO: 4095239 - RNA, 17 nt, Variola virus
cgaugucuuggaagcaa

SEQ ID NO: 4095240 - RNA, 12 nt, Variola virus
cgauguuagaac

SEQ ID NO: 4095241 - RNA, 13 nt, Variola virus
cgauuuaugugac

SEQ ID NO: 4095242 - RNA, 15 nt, Variola virus
cgcacaccaacaauu

SEQ ID NO: 4095243 - RNA, 13 nt, Variola virus
cgcauaucaugaa

SEQ ID NO: 4095244 - RNA, 13 nt, Variola virus
cgcgagucaauuc

SEQ ID NO: 4095245 - RNA, 18 nt, Variola virus
cgcuacacccacuagaaa

SEQ ID NO: 4095246 - RNA, 16 nt, Variola virus
cgcuauuguagaaauu

SEQ ID NO: 4095247 - RNA, 15 nt, Variola virus
cgcucaaaauagacg

SEQ ID NO: 4095248 - RNA, 14 nt, Variola virus
cgcugauuuaacua

SEQ ID NO: 4095249 - RNA, 15 nt, Variola virus
cgcuugguuggauuu

SEQ ID NO: 4095250 - RNA, 21 nt, Variola virus
cggaauaaguguuuucucaau

SEQ ID NO: 4095251 - RNA, 17 nt, Variola virus
cggagaagaauugguaa

SEQ ID NO: 4095252 - RNA, 22 nt, Variola virus
cggaguaaguguugagcucccu

SEQ ID NO: 4095253 - RNA, 21 nt, Variola virus
cggauaaugauagacaagaua

SEQ ID NO: 4095254 - RNA, 13 nt, Variola virus
cggauaguuuaag

SEQ ID NO: 4095255 - RNA, 15 nt, Variola virus
cggauggaugauaua

SEQ ID NO: 4095256 - RNA, 19 nt, Variola virus
cggauguugugaucaucuu

SEQ ID NO: 4095257 - RNA, 16 nt, Variola virus
cggcugcguuaaacau

SEQ ID NO: 4095258 - RNA, 15 nt, Variola virus
cggucgauucuuucg

SEQ ID NO: 4095259 - RNA, 15 nt, Variola virus
cgguguauuguauuu

SEQ ID NO: 4095260 - RNA, 13 nt, Variola virus
cguaccaguuuca

SEQ ID NO: 4095261 - RNA, 14 nt, Variola virus
cguacccaacaaua

SEQ ID NO: 4095262 - RNA, 22 nt, Variola virus
cguagaaaguaucuuauauaca

SEQ ID NO: 4095263 - RNA, 20 nt, Variola virus
cguagugacaauacuauuag

SEQ ID NO: 4095264 - RNA, 19 nt, Variola virus
cguauaaaaaauauaacau

SEQ ID NO: 4095265 - RNA, 18 nt, Variola virus
cguauaacaguaaaagaa

SEQ ID NO: 4095266 - RNA, 22 nt, Variola virus
cguauacuuuuuaauucucuau

SEQ ID NO: 4095267 - RNA, 17 nt, Variola virus
cguauucugaugauauu

SEQ ID NO: 4095268 - RNA, 19 nt, Variola virus
cguauuuacauuaaaugua

SEQ ID NO: 4095269 - RNA, 13 nt, Variola virus
cguauuuaucuaa

SEQ ID NO: 4095270 - RNA, 16 nt, Variola virus
cgucauucuaaaagac

SEQ ID NO: 4095271 - RNA, 23 nt, Variola virus
cgucuaagauauucuuccaucaa

SEQ ID NO: 4095272 - RNA, 14 nt, Variola virus
cgugauagcucccg

SEQ ID NO: 4095273 - RNA, 16 nt, Variola virus
cgugauauuaucuuca

SEQ ID NO: 4095274 - RNA, 14 nt, Variola virus
cguguacaaaaaug

SEQ ID NO: 4095275 - RNA, 19 nt, Variola virus
cguuaaagaauuuaacaau

SEQ ID NO: 4095276 - RNA, 16 nt, Variola virus
cguuaaagguaacaau

SEQ ID NO: 4095277 - RNA, 14 nt, Variola virus
cguuaaaucaucua

SEQ ID NO: 4095278 - RNA, 24 nt, Variola virus
cguuaacuaucaaacaaacugcug

SEQ ID NO: 4095279 - RNA, 20 nt, Variola virus
auuuuaucaagacauaugca

SEQ ID NO: 4095280 - RNA, 18 nt, Variola virus
auuuuauucuagaauuga

SEQ ID NO: 4095281 - RNA, 17 nt, Variola virus
auuuuauuucaaaauua

SEQ ID NO: 4095282 - RNA, 20 nt, Variola virus
auuuucaaaagauaguuuuc

SEQ ID NO: 4095283 - RNA, 23 nt, Variola virus
auuuucagcauggauuucucaua

SEQ ID NO: 4095284 - RNA, 13 nt, Variola virus
auuuuccauuuau

SEQ ID NO: 4095285 - RNA, 23 nt, Variola virus
auuuucgaaacucguaaaaagau

SEQ ID NO: 4095286 - RNA, 22 nt, Variola virus
auuuucggguuuaaauucuuua

SEQ ID NO: 4095287 - RNA, 14 nt, Variola virus
auuuucuaacguga

SEQ ID NO: 4095288 - RNA, 16 nt, Variola virus
auuuugaggaaauuga

SEQ ID NO: 4095289 - RNA, 19 nt, Variola virus
auuuugcaauuucuucaua

SEQ ID NO: 4095290 - RNA, 17 nt, Variola virus
auuuuggcguuaucauu

SEQ ID NO: 4095291 - RNA, 18 nt, Variola virus
auuuuggugccuauuuua

SEQ ID NO: 4095292 - RNA, 17 nt, Variola virus
auuuuuaaacuguuugu

SEQ ID NO: 4095293 - RNA, 16 nt, Variola virus
auuuuuagugaaacau

SEQ ID NO: 4095294 - RNA, 16 nt, Variola virus
auuuuuaguuacagaa

SEQ ID NO: 4095295 - RNA, 12 nt, Variola virus
auuuuuaucaug

SEQ ID NO: 4095296 - RNA, 16 nt, Variola virus
auuuuucauuaacuaa

SEQ ID NO: 4095297 - RNA, 19 nt, Variola virus
auuuuucuauguuaggaau

SEQ ID NO: 4095298 - RNA, 18 nt, Variola virus
auuuuugcaucauuuacg

SEQ ID NO: 4095299 - RNA, 23 nt, Variola virus
auuuuuuuauucaucaucuucug

SEQ ID NO: 4095300 - RNA, 15 nt, Variola virus
caaaaaauaaaagau

SEQ ID NO: 4095301 - RNA, 14 nt, Variola virus
caaaaaauaauaau

SEQ ID NO: 4095302 - RNA, 22 nt, Variola virus
caaaaacacaacaaaugauaau

SEQ ID NO: 4095303 - RNA, 16 nt, Variola virus
caaaaaguaagauauu

SEQ ID NO: 4095304 - RNA, 19 nt, Variola virus
caaaaauauuguacaguac

SEQ ID NO: 4095305 - RNA, 16 nt, Variola virus
caaaaauuacgauauu

SEQ ID NO: 4095306 - RNA, 20 nt, Variola virus
caaaaccaacacuuaucaau

SEQ ID NO: 4095307 - RNA, 19 nt, Variola virus
caaaaccaauuccuuuuug

SEQ ID NO: 4095308 - RNA, 22 nt, Variola virus
caaaaccccaugguguaacaac

SEQ ID NO: 4095309 - RNA, 19 nt, Variola virus
caaaaccguuaaaauguau

SEQ ID NO: 4095310 - RNA, 22 nt, Variola virus
caaaacguaauuauagaugaau

SEQ ID NO: 4095311 - RNA, 12 nt, Variola virus
caaaacuauuau

SEQ ID NO: 4095312 - RNA, 15 nt, Variola virus
caaaacuauuucaga

SEQ ID NO: 4095313 - RNA, 21 nt, Variola virus
caaaacuucacagaugauaau

SEQ ID NO: 4095314 - RNA, 22 nt, Variola virus
caaaagacuaugggaauauauu

SEQ ID NO: 4095315 - RNA, 18 nt, Variola virus
caaaaggacguagacaau

SEQ ID NO: 4095316 - RNA, 17 nt, Variola virus
caaaauagguacucugu

SEQ ID NO: 4095317 - RNA, 19 nt, Variola virus
caaaauauguuucaaucau

SEQ ID NO: 4095318 - RNA, 19 nt, Variola virus
caaaaucuaaacaaauauu

SEQ ID NO: 4095319 - RNA, 22 nt, Variola virus
caaaauuaucguuccugguaua

SEQ ID NO: 4095320 - RNA, 18 nt, Variola virus
caaaauugucuaugauau

SEQ ID NO: 4095321 - RNA, 14 nt, Variola virus
caaacaauaaugac

SEQ ID NO: 4095322 - RNA, 21 nt, Variola virus
caaacaauccaaaaaaugaaa

SEQ ID NO: 4095323 - RNA, 23 nt, Variola virus
caaacaauuaauuaauacaguaa

SEQ ID NO: 4095324 - RNA, 15 nt, Variola virus
caaacauguucaaug

SEQ ID NO: 4095325 - RNA, 18 nt, Variola virus
caaacgccauaaucugug

SEQ ID NO: 4095326 - RNA, 20 nt, Variola virus
caaacggaguaaaauaaaua

SEQ ID NO: 4095327 - RNA, 14 nt, Variola virus
caaacuguaaaugu

SEQ ID NO: 4095328 - RNA, 22 nt, Variola virus
caaagagaugaucgauuauauu

SEQ ID NO: 4095329 - RNA, 17 nt, Variola virus
caaagaguuacacuaag

SEQ ID NO: 4095330 - RNA, 16 nt, Variola virus
caaagauggcugaaau

SEQ ID NO: 4095331 - RNA, 21 nt, Variola virus
caaaguaaugccuguaaaaau

SEQ ID NO: 4095332 - RNA, 15 nt, Variola virus
caaaguuaguacaga

SEQ ID NO: 4095333 - RNA, 16 nt, Variola virus
caaauaaaauucugau

SEQ ID NO: 4095334 - RNA, 16 nt, Variola virus
caaauaaauacucuau

SEQ ID NO: 4095335 - RNA, 15 nt, Variola virus
caaauaacaaaaucc

SEQ ID NO: 4095336 - RNA, 15 nt, Variola virus
caaauaauacuauau

SEQ ID NO: 4095337 - RNA, 20 nt, Variola virus
caaauaauacuauauacaau

SEQ ID NO: 4095338 - RNA, 15 nt, Variola virus
caaauaauauucucu

SEQ ID NO: 4095339 - RNA, 17 nt, Variola virus
caaauagagcaauuacu

SEQ ID NO: 4095340 - RNA, 15 nt, Variola virus
caaauaggagauauu

SEQ ID NO: 4095341 - RNA, 18 nt, Variola virus
caaauauauuacuagaca

SEQ ID NO: 4095342 - RNA, 20 nt, Variola virus
caaauauauuacuagacaau

SEQ ID NO: 4095343 - RNA, 12 nt, Variola virus
caaauauauuua

SEQ ID NO: 4095344 - RNA, 14 nt, Variola virus
caaaucaaaaguau

SEQ ID NO: 4095345 - RNA, 15 nt, Variola virus
caaaucaguaacuau

SEQ ID NO: 4095346 - RNA, 15 nt, Variola virus
caaaucuaacuucua

SEQ ID NO: 4095347 - RNA, 21 nt, Variola virus
caaaucugaaaauaaauaaug

SEQ ID NO: 4095348 - RNA, 15 nt, Variola virus
caaauggauaauuua

SEQ ID NO: 4095349 - RNA, 20 nt, Variola virus
caaauggucaaugauaugau

SEQ ID NO: 4095350 - RNA, 12 nt, Variola virus
caaauuaaacau

SEQ ID NO: 4095351 - RNA, 15 nt, Variola virus
caaauuaaauucugg

SEQ ID NO: 4095352 - RNA, 14 nt, Variola virus
caaauuuuacuaca

SEQ ID NO: 4095353 - RNA, 19 nt, Variola virus
caaauuuuuuuuacaaaca

SEQ ID NO: 4095354 - RNA, 15 nt, Variola virus
caacaaauauaaaau

SEQ ID NO: 4095355 - RNA, 17 nt, Variola virus
caacaaauucugcaaua

SEQ ID NO: 4095356 - RNA, 20 nt, Variola virus
caacaaauucugcaauaucu

SEQ ID NO: 4095357 - RNA, 23 nt, Variola virus
caacaagucauuacuaauagagu

SEQ ID NO: 4095358 - RNA, 18 nt, Variola virus
caacaaucuaauacaaaa

SEQ ID NO: 4095359 - RNA, 19 nt, Variola virus
caaccgcauacuacuauua

SEQ ID NO: 4095360 - RNA, 14 nt, Variola virus
caaccggauuuaaa

SEQ ID NO: 4095361 - RNA, 16 nt, Variola virus
caaccuacacuauuau

SEQ ID NO: 4095362 - RNA, 19 nt, Variola virus
caacgaaucccuacauauu

SEQ ID NO: 4095363 - RNA, 19 nt, Variola virus
caacguguuagaucgucua

SEQ ID NO: 4095364 - RNA, 22 nt, Variola virus
caacguguuagaucgucuauau

SEQ ID NO: 4095365 - RNA, 17 nt, Variola virus
caacuuaacaaaucuua

SEQ ID NO: 4095366 - RNA, 16 nt, Variola virus
caacuuuauuagauaa

SEQ ID NO: 4095367 - RNA, 17 nt, Variola virus
caagaacuacaaaaguu

SEQ ID NO: 4095368 - RNA, 22 nt, Variola virus
caagaacucuugaagaugauuu

SEQ ID NO: 4095369 - RNA, 18 nt, Variola virus
uauaacaugcuaaaccuu

SEQ ID NO: 4095370 - RNA, 17 nt, Variola virus
uauaacauuaauaucaa

SEQ ID NO: 4095371 - RNA, 20 nt, Variola virus
uguauuaaauagaauauuua

SEQ ID NO: 4095372 - RNA, 21 nt, Variola virus
uguauucaucgccuaauguau

SEQ ID NO: 4095373 - RNA, 19 nt, Variola virus
uguauugauuacaguguau

SEQ ID NO: 4095374 - RNA, 15 nt, Variola virus
uguauuuugaggaaa

SEQ ID NO: 4095375 - RNA, 14 nt, Variola virus
uguauuuuggcaua

SEQ ID NO: 4095376 - RNA, 14 nt, Variola virus
ugucaaaaauugua

SEQ ID NO: 4095377 - RNA, 21 nt, Variola virus
ugucaaagauuguguagaaau

SEQ ID NO: 4095378 - RNA, 20 nt, Variola virus
ugucaaaugaucggaucuaa

SEQ ID NO: 4095379 - RNA, 17 nt, Variola virus
ugucaucauuucuaaug

SEQ ID NO: 4095380 - RNA, 22 nt, Variola virus
ugucaucuuguucagaaauaua

SEQ ID NO: 4095381 - RNA, 13 nt, Variola virus
ugucauucucaug

SEQ ID NO: 4095382 - RNA, 19 nt, Variola virus
ugucccuauuauaaucauu

SEQ ID NO: 4095383 - RNA, 21 nt, Variola virus
uguccuugcguuuuucugaua

SEQ ID NO: 4095384 - RNA, 20 nt, Variola virus
ugucgaaucuaaacuagugg

SEQ ID NO: 4095385 - RNA, 12 nt, Variola virus
ugucuacauaaa

SEQ ID NO: 4095386 - RNA, 19 nt, Variola virus
ugucuacgauaaaccaaaa

SEQ ID NO: 4095387 - RNA, 20 nt, Variola virus
ugucuagcauuuuagagcau

SEQ ID NO: 4095388 - RNA, 15 nt, Variola virus
ugucuauuauguaua

SEQ ID NO: 4095389 - RNA, 19 nt, Variola virus
ugucucuuaacuauuuccg

SEQ ID NO: 4095390 - RNA, 22 nt, Variola virus
ugugaaacagacuuguaauucu

SEQ ID NO: 4095391 - RNA, 23 nt, Variola virus
ugugaauguauucacuuaacaau

SEQ ID NO: 4095392 - RNA, 15 nt, Variola virus
ugugaguauuuuacu

SEQ ID NO: 4095393 - RNA, 16 nt, Variola virus
ugugauguuacggaua

SEQ ID NO: 4095394 - RNA, 18 nt, Variola virus
uguguacccaauaaaaug

SEQ ID NO: 4095395 - RNA, 21 nt, Variola virus
ugugucuacauaaauaugcaa

SEQ ID NO: 4095396 - RNA, 13 nt, Variola virus
uguguuacauaau

SEQ ID NO: 4095397 - RNA, 16 nt, Variola virus
uguguucuuguguaau

SEQ ID NO: 4095398 - RNA, 18 nt, Variola virus
uguuaaaaacaguuauuu

SEQ ID NO: 4095399 - RNA, 12 nt, Variola virus
uuacuaagaaag

SEQ ID NO: 4095400 - RNA, 14 nt, Variola virus
uuacuacauuauua

SEQ ID NO: 4095401 - RNA, 22 nt, Variola virus
uuacuacguucauauuccaauu

SEQ ID NO: 4095402 - RNA, 14 nt, Variola virus
uuacuauagcauua

SEQ ID NO: 4095403 - RNA, 23 nt, Variola virus
uuacuauuggcaauuguagauau

SEQ ID NO: 4095404 - RNA, 16 nt, Variola virus
uuacucaaaauacuau

SEQ ID NO: 4095405 - RNA, 17 nt, Variola virus
uuacucuauaaaauacu

SEQ ID NO: 4095406 - RNA, 18 nt, Variola virus
uuacugaauuaauaauau

SEQ ID NO: 4095407 - RNA, 21 nt, Variola virus
uuacugggauaagauuucuaa

SEQ ID NO: 4095408 - RNA, 16 nt, Variola virus
uuacuuagucuguaca

SEQ ID NO: 4095409 - RNA, 16 nt, Variola virus
uuacuuguauaauaag

SEQ ID NO: 4095410 - RNA, 20 nt, Variola virus
uuacuuugacaaauguagua

SEQ ID NO: 4095411 - RNA, 16 nt, Variola virus
uuacuuuguggaugau

SEQ ID NO: 4095412 - RNA, 15 nt, Variola virus
uuagaaaaaacauca

SEQ ID NO: 4095413 - RNA, 22 nt, Variola virus
uuagaaaacucucuaucucuua

SEQ ID NO: 4095414 - RNA, 16 nt, Variola virus
uuagaaggaguguuuu

SEQ ID NO: 4095415 - RNA, 20 nt, Variola virus
uuagaaggauuggucuuaaa

SEQ ID NO: 4095416 - RNA, 19 nt, Variola virus
uuagaauaagaguguagua

SEQ ID NO: 4095417 - RNA, 17 nt, Variola virus
uuagacuauaugugucu

SEQ ID NO: 4095418 - RNA, 14 nt, Variola virus
uuagauacauagau

SEQ ID NO: 4095419 - RNA, 13 nt, Variola virus
uuagaucauuaac

SEQ ID NO: 4095420 - RNA, 18 nt, Variola virus
uuagaugagaaauuauuc

SEQ ID NO: 4095421 - RNA, 15 nt, Variola virus
uuagcacuaucauaa

SEQ ID NO: 4095422 - RNA, 16 nt, Variola virus
uuagcacuaucauaau

SEQ ID NO: 4095423 - RNA, 22 nt, Variola virus
uuagcaugaauccauucuaaug

SEQ ID NO: 4095424 - RNA, 16 nt, Variola virus
uuagcguacacauuuu

SEQ ID NO: 4095425 - RNA, 13 nt, Variola virus
uuagcuauuucgg

SEQ ID NO: 4095426 - RNA, 22 nt, Variola virus
uuagcuccguauuccaaacuag

SEQ ID NO: 4095427 - RNA, 16 nt, Variola virus
uuaggauugacauagu

SEQ ID NO: 4095428 - RNA, 20 nt, Variola virus
uuaguaucuagcucuguaaa

SEQ ID NO: 4095429 - RNA, 18 nt, Variola virus
uuagucacacaauacuac

SEQ ID NO: 4095430 - RNA, 19 nt, Variola virus
uuagucauacguaaugaag

SEQ ID NO: 4095431 - RNA, 18 nt, Variola virus
uuagucgugguaagaaag

SEQ ID NO: 4095432 - RNA, 21 nt, Variola virus
uuagucuuaaugauacacuaa

SEQ ID NO: 4095433 - RNA, 15 nt, Variola virus
uuaguuccaacaauu

SEQ ID NO: 4095434 - RNA, 17 nt, Variola virus
uuaguuuauuacuauua

SEQ ID NO: 4095435 - RNA, 22 nt, Variola virus
uuaguuucugguuuucuauaaa

SEQ ID NO: 4095436 - RNA, 16 nt, Variola virus
uuaguuuuuggauaga

SEQ ID NO: 4095437 - RNA, 12 nt, Variola virus
uuauaaaaauua

SEQ ID NO: 4095438 - RNA, 19 nt, Variola virus
uuauaaacggguguaaaca

SEQ ID NO: 4095439 - RNA, 18 nt, Variola virus
uuauaaaguuuagucucu

SEQ ID NO: 4095440 - RNA, 13 nt, Variola virus
uuauaaauagaug

SEQ ID NO: 4095441 - RNA, 13 nt, Variola virus
uuauaacuaaaca

SEQ ID NO: 4095442 - RNA, 16 nt, Variola virus
uuauaacuuauugucu

SEQ ID NO: 4095443 - RNA, 21 nt, Variola virus
uuauaauagguguaaaucuag

SEQ ID NO: 4095444 - RNA, 17 nt, Variola virus
uuauacaagauugaaau

SEQ ID NO: 4095445 - RNA, 18 nt, Variola virus
uuauacaguguauguaaa

SEQ ID NO: 4095446 - RNA, 21 nt, Variola virus
uuauacgaaaaaaaucauuaa

SEQ ID NO: 4095447 - RNA, 23 nt, Variola virus
uuauacgaauaucguucucuaaa

SEQ ID NO: 4095448 - RNA, 16 nt, Variola virus
uuauacuaauaugaca

SEQ ID NO: 4095449 - RNA, 19 nt, Variola virus
uuauagaauugucuaucua

SEQ ID NO: 4095450 - RNA, 21 nt, Variola virus
uuauauacacauaauuauucu

SEQ ID NO: 4095451 - RNA, 14 nt, Variola virus
uuauauacaucuuc

SEQ ID NO: 4095452 - RNA, 12 nt, Variola virus
uuauauauguaa

SEQ ID NO: 4095453 - RNA, 18 nt, Variola virus
uuauaucacaacaucuau

SEQ ID NO: 4095454 - RNA, 14 nt, Variola virus
uuauaucacaugau

SEQ ID NO: 4095455 - RNA, 22 nt, Variola virus
uuauaucauccaauauuauuga

SEQ ID NO: 4095456 - RNA, 19 nt, Variola virus
uuauaucguuaucauuaau

SEQ ID NO: 4095457 - RNA, 19 nt, Variola virus
uuaucagugucguaaauua

SEQ ID NO: 4095458 - RNA, 12 nt, Variola virus
uuaucauuauua

SEQ ID NO: 4095459 - RNA, 23 nt, Variola virus
uuauccacaauaaauauaaacaa

SEQ ID NO: 4095460 - RNA, 20 nt, Variola virus
uuauccguauuuccauaaua

SEQ ID NO: 4095461 - RNA, 22 nt, Variola virus
uuauccuuuagaugaauuauua

SEQ ID NO: 4095462 - RNA, 22 nt, Variola virus
uuaucgguaacaucuuuguaaa

SEQ ID NO: 4095463 - RNA, 15 nt, Variola virus
uuaucguuauuauua

SEQ ID NO: 4095464 - RNA, 14 nt, Variola virus
uuaucuauacuauu

SEQ ID NO: 4095465 - RNA, 16 nt, Variola virus
uuaucucaguacauag

SEQ ID NO: 4095466 - RNA, 13 nt, Variola virus
uuaucuguagacg

SEQ ID NO: 4095467 - RNA, 22 nt, Variola virus
uuaugaauaucacauaucaugu

SEQ ID NO: 4095468 - RNA, 21 nt, Variola virus
uuaugacaaaguuuacauucu

SEQ ID NO: 4095469 - RNA, 17 nt, Variola virus
uuaugaugauacauuuu

SEQ ID NO: 4095470 - RNA, 16 nt, Variola virus
uuaugccgaacuaaaa

SEQ ID NO: 4095471 - RNA, 19 nt, Variola virus
uuauguaguaaagaugcua

SEQ ID NO: 4095472 - RNA, 19 nt, Variola virus
uuaugucauaaacuguaaa

SEQ ID NO: 4095473 - RNA, 20 nt, Variola virus
uuauuaaauauuuuuggaca

SEQ ID NO: 4095474 - RNA, 17 nt, Variola virus
uuauuacuaaacauuuu

SEQ ID NO: 4095475 - RNA, 14 nt, Variola virus
uuauuaucuguaga

SEQ ID NO: 4095476 - RNA, 13 nt, Variola virus
uuauuauuucagg

SEQ ID NO: 4095477 - RNA, 18 nt, Variola virus
uuauuccaauuauuugaa

SEQ ID NO: 4095478 - RNA, 23 nt, Variola virus
uuauuccgguacugguuuagaua

SEQ ID NO: 4095479 - RNA, 21 nt, Variola virus
uuauuggcguuggaaaaauua

SEQ ID NO: 4095480 - RNA, 21 nt, Variola virus
uuauugggccaguauacuguu

SEQ ID NO: 4095481 - RNA, 22 nt, Variola virus
uuauugguauuucuuacauaaa

SEQ ID NO: 4095482 - RNA, 16 nt, Variola virus
uuauugucuucuuaaa

SEQ ID NO: 4095483 - RNA, 19 nt, Variola virus
uuauuuagauacagaugua

SEQ ID NO: 4095484 - RNA, 12 nt, Variola virus
uuauuuagugua

SEQ ID NO: 4095485 - RNA, 18 nt, Variola virus
uuauuucaaaauuauuua

SEQ ID NO: 4095486 - RNA, 20 nt, Variola virus
uuauuuuaggaucauauuua

SEQ ID NO: 4095487 - RNA, 14 nt, Variola virus
uuauuuuuggaaga

SEQ ID NO: 4095488 - RNA, 16 nt, Variola virus
uucaaaagauaguuuu

SEQ ID NO: 4095489 - RNA, 22 nt, Variola virus
uucaacauuuuauggaaacuau

SEQ ID NO: 4095490 - RNA, 23 nt, Variola virus
uucaaccaugagugugaaacuaa

SEQ ID NO: 4095491 - RNA, 14 nt, Variola virus
uucaacuaccaaaa

SEQ ID NO: 4095492 - RNA, 21 nt, Variola virus
uucaacuuugaaauuguuuuu

SEQ ID NO: 4095493 - RNA, 17 nt, Variola virus
uucaaggacaaaaugac

SEQ ID NO: 4095494 - RNA, 14 nt, Variola virus
uucaauucuagaaa

SEQ ID NO: 4095495 - RNA, 20 nt, Variola virus
uucaauucucggauagucuu

SEQ ID NO: 4095496 - RNA, 14 nt, Variola virus
uucacaauucauuc

SEQ ID NO: 4095497 - RNA, 23 nt, Variola virus
uucacagauagaucauuuugaac

SEQ ID NO: 4095498 - RNA, 18 nt, Variola virus
uucacagaugauaauaga

SEQ ID NO: 4095499 - RNA, 21 nt, Variola virus
uucacauucaccggaaacuag

SEQ ID NO: 4095500 - RNA, 18 nt, Variola virus
uucacauuguaacuauuc

SEQ ID NO: 4095501 - RNA, 14 nt, Variola virus
uucacuuaacaauu

SEQ ID NO: 4095502 - RNA, 13 nt, Variola virus
uucaggaacauaa

SEQ ID NO: 4095503 - RNA, 19 nt, Variola virus
uucauaaaagaaaauacua

SEQ ID NO: 4095504 - RNA, 16 nt, Variola virus
uucaucagauuauuua

SEQ ID NO: 4095505 - RNA, 14 nt, Variola virus
uucaucaucugaua

SEQ ID NO: 4095506 - RNA, 19 nt, Variola virus
uucauguuuaaaaugaucu

SEQ ID NO: 4095507 - RNA, 13 nt, Variola virus
uucauuaacuaga

SEQ ID NO: 4095508 - RNA, 13 nt, Variola virus
uucauuaaucuuu

SEQ ID NO: 4095509 - RNA, 12 nt, Variola virus
uucauuaauuuc

SEQ ID NO: 4095510 - RNA, 23 nt, Variola virus
uucauuaggauuaucaaaucuuu

SEQ ID NO: 4095511 - RNA, 13 nt, Variola virus
uucauucguaaau

SEQ ID NO: 4095512 - RNA, 14 nt, Variola virus
uucauugucauuaa

SEQ ID NO: 4095513 - RNA, 11 nt, Variola virus
uuccaaacauu

SEQ ID NO: 4095514 - RNA, 15 nt, Variola virus
uuccaaauuauucuu

SEQ ID NO: 4095515 - RNA, 17 nt, Variola virus
uuccaacuuaucauuau

SEQ ID NO: 4095516 - RNA, 14 nt, Variola virus
uuccaaucauugau

SEQ ID NO: 4095517 - RNA, 18 nt, Variola virus
uuccaaucuauugcuacu

SEQ ID NO: 4095518 - RNA, 12 nt, Variola virus
uuccaauguuua

SEQ ID NO: 4095519 - RNA, 21 nt, Variola virus
uuccaauuccguagguaaacg

SEQ ID NO: 4095520 - RNA, 20 nt, Variola virus
uuccaccuagagauagucaa

SEQ ID NO: 4095521 - RNA, 18 nt, Variola virus
uuccacguagucaaugaa

SEQ ID NO: 4095522 - RNA, 15 nt, Variola virus
uuccaguauuuucca

SEQ ID NO: 4095523 - RNA, 20 nt, Variola virus
uuccauacguuuauauucuu

SEQ ID NO: 4095524 - RNA, 18 nt, Variola virus
uuccauaugaugaacuaa

SEQ ID NO: 4095525 - RNA, 21 nt, Variola virus
uuccaucaacgauucuagaac

SEQ ID NO: 4095526 - RNA, 18 nt, Variola virus
uuccaucuagacuauauu

SEQ ID NO: 4095527 - RNA, 17 nt, Variola virus
uuccaugauauccaaaa

SEQ ID NO: 4095528 - RNA, 21 nt, Variola virus
uguuaaaacuacgauuaucua

SEQ ID NO: 4095529 - RNA, 15 nt, Variola virus
uguuaagaauuuaga

SEQ ID NO: 4095530 - RNA, 15 nt, Variola virus
uguuaauacaucaau

SEQ ID NO: 4095531 - RNA, 22 nt, Variola virus
uguuaccauaucguauaacuug

SEQ ID NO: 4095532 - RNA, 16 nt, Variola virus
uguuagaguaucuaca

SEQ ID NO: 4095533 - RNA, 15 nt, Variola virus
uguuagcauuucuau

SEQ ID NO: 4095534 - RNA, 16 nt, Variola virus
uguuauauauugucua

SEQ ID NO: 4095535 - RNA, 17 nt, Variola virus
uguuauuaugaaucauu

SEQ ID NO: 4095536 - RNA, 17 nt, Variola virus
uguuauuguauacuguc

SEQ ID NO: 4095537 - RNA, 15 nt, Variola virus
uguucaacaaacuaa

SEQ ID NO: 4095538 - RNA, 20 nt, Variola virus
uguucacguccaccaaugau

SEQ ID NO: 4095539 - RNA, 12 nt, Variola virus
uguucagaaaua

SEQ ID NO: 4095540 - RNA, 13 nt, Variola virus
uguucccaucauu

SEQ ID NO: 4095541 - RNA, 15 nt, Variola virus
uguucccuugucauu

SEQ ID NO: 4095542 - RNA, 17 nt, Variola virus
uguuccgaucuuaguaa

SEQ ID NO: 4095543 - RNA, 16 nt, Variola virus
uguucuauaaacugaa

SEQ ID NO: 4095544 - RNA, 14 nt, Variola virus
uguugaacaucagu

SEQ ID NO: 4095545 - RNA, 16 nt, Variola virus
uguugacgacauauau

SEQ ID NO: 4095546 - RNA, 13 nt, Variola virus
uguugaucauaua

SEQ ID NO: 4095547 - RNA, 17 nt, Variola virus
uguugaugauaucuaca

SEQ ID NO: 4095548 - RNA, 22 nt, Variola virus
uguugaugauaucuacaucguu

SEQ ID NO: 4095549 - RNA, 18 nt, Variola virus
uguuguacaaauuccucg

SEQ ID NO: 4095550 - RNA, 18 nt, Variola virus
uguugugcuguuguacau

SEQ ID NO: 4095551 - RNA, 20 nt, Variola virus
uguugugucaguuuauaaua

SEQ ID NO: 4095552 - RNA, 15 nt, Variola virus
uguuuaaaucaaaau

SEQ ID NO: 4095553 - RNA, 21 nt, Variola virus
uguuuaaugaauuacuaaaau

SEQ ID NO: 4095554 - RNA, 16 nt, Variola virus
uguuuaccacaaugua

SEQ ID NO: 4095555 - RNA, 16 nt, Variola virus
uguuuaucuucuucca

SEQ ID NO: 4095556 - RNA, 23 nt, Variola virus
uguuuccuauaaucguuaaauuu

SEQ ID NO: 4095557 - RNA, 22 nt, Variola virus
uguuucuacuaacuuuuuggua

SEQ ID NO: 4095558 - RNA, 17 nt, Variola virus
uguuucuauguuuucua

SEQ ID NO: 4095559 - RNA, 16 nt, Variola virus
uguuucuuacauauuu

SEQ ID NO: 4095560 - RNA, 16 nt, Variola virus
uguuugauaauuacgc

SEQ ID NO: 4095561 - RNA, 20 nt, Variola virus
uguuuuauuaaucaaucauu

SEQ ID NO: 4095562 - RNA, 12 nt, Variola virus
uguuuucucaau

SEQ ID NO: 4095563 - RNA, 22 nt, Variola virus
uguuuugaggcagcaaauacug

SEQ ID NO: 4095564 - RNA, 23 nt, Variola virus
uuaaaaaaauuauccuaucaugu

SEQ ID NO: 4095565 - RNA, 19 nt, Variola virus
uuaaaaacaguuauuuucu

SEQ ID NO: 4095566 - RNA, 14 nt, Variola virus
uuaaaaaguuaucu

SEQ ID NO: 4095567 - RNA, 23 nt, Variola virus
uuaaaaaguugacagaaccuugu

SEQ ID NO: 4095568 - RNA, 14 nt, Variola virus
uuaaaaauacgguu

SEQ ID NO: 4095569 - RNA, 14 nt, Variola virus
uuaaaaauaguuuu

SEQ ID NO: 4095570 - RNA, 11 nt, Variola virus
uuaaaaaugau

SEQ ID NO: 4095571 - RNA, 17 nt, Variola virus
uuaaaaauguuacugaa

SEQ ID NO: 4095572 - RNA, 13 nt, Variola virus
uuaaaaauuauua

SEQ ID NO: 4095573 - RNA, 17 nt, Variola virus
uuaaaacuguuuaagaa

SEQ ID NO: 4095574 - RNA, 19 nt, Variola virus
uuaaaacuugauaauuaau

SEQ ID NO: 4095575 - RNA, 22 nt, Variola virus
uuaaaagaauuacuuagucugu

SEQ ID NO: 4095576 - RNA, 22 nt, Variola virus
uuaaaaguaaucaugaaauuaa

SEQ ID NO: 4095577 - RNA, 16 nt, Variola virus
uuaaaauauauuauca

SEQ ID NO: 4095578 - RNA, 16 nt, Variola virus
uuaaaauaucuauuca

SEQ ID NO: 4095579 - RNA, 12 nt, Variola virus
uuaaaauuauua

SEQ ID NO: 4095580 - RNA, 18 nt, Variola virus
uuaaaauucacacauuuu

SEQ ID NO: 4095581 - RNA, 23 nt, Variola virus
uuaaacaauaucacgaaaguaga

SEQ ID NO: 4095582 - RNA, 23 nt, Variola virus
uuaaacagaaauauaugagaugu

SEQ ID NO: 4095583 - RNA, 17 nt, Variola virus
uuaaacauggcauuaau

SEQ ID NO: 4095584 - RNA, 22 nt, Variola virus
uuaaacgaauuaaaauuauuua

SEQ ID NO: 4095585 - RNA, 19 nt, Variola virus
uuaaacgauggauuuucca

SEQ ID NO: 4095586 - RNA, 17 nt, Variola virus
uuaaacuacuacguucu

SEQ ID NO: 4095587 - RNA, 22 nt, Variola virus
uuaaacuguuuguauaauaucu

SEQ ID NO: 4095588 - RNA, 17 nt, Variola virus
uuaaauaacucauuuau

SEQ ID NO: 4095589 - RNA, 13 nt, Variola virus
uuaaauauguucu

SEQ ID NO: 4095590 - RNA, 12 nt, Variola virus
uuaaauauuucu

SEQ ID NO: 4095591 - RNA, 17 nt, Variola virus
uuaaaucccaauucaga

SEQ ID NO: 4095592 - RNA, 17 nt, Variola virus
uuaaauccuuguuugau

SEQ ID NO: 4095593 - RNA, 16 nt, Variola virus
uuaaaucguuguucua

SEQ ID NO: 4095594 - RNA, 13 nt, Variola virus
uuaaauguaucua

SEQ ID NO: 4095595 - RNA, 18 nt, Variola virus
uuaaauuuuuuuauuaau

SEQ ID NO: 4095596 - RNA, 15 nt, Variola virus
uuaacagcuauucaa

SEQ ID NO: 4095597 - RNA, 12 nt, Variola virus
uuaacagcuuua

SEQ ID NO: 4095598 - RNA, 17 nt, Variola virus
uuaacauaugauauuca

SEQ ID NO: 4095599 - RNA, 12 nt, Variola virus
uuaacauuauua

SEQ ID NO: 4095600 - RNA, 17 nt, Variola virus
uuaaccuaacuaaaaga

SEQ ID NO: 4095601 - RNA, 14 nt, Variola virus
uuaacgauauuuug

SEQ ID NO: 4095602 - RNA, 22 nt, Variola virus
uuaacgauuggaaaucauuaac

SEQ ID NO: 4095603 - RNA, 15 nt, Variola virus
uuaacuaucuguaaa

SEQ ID NO: 4095604 - RNA, 16 nt, Variola virus
uuaacuuauuagcguu

SEQ ID NO: 4095605 - RNA, 13 nt, Variola virus
uuaagaauaaucc

SEQ ID NO: 4095606 - RNA, 19 nt, Variola virus
uuaagauuuuaaauguaua

SEQ ID NO: 4095607 - RNA, 17 nt, Variola virus
uuaagcaacaugucuuu

SEQ ID NO: 4095608 - RNA, 20 nt, Variola virus
uuaagcaacaugucuuuaaa

SEQ ID NO: 4095609 - RNA, 20 nt, Variola virus
uuaaggaauacaauacauac

SEQ ID NO: 4095610 - RNA, 15 nt, Variola virus
uuaaggggaaaaagc

SEQ ID NO: 4095611 - RNA, 20 nt, Variola virus
uuaagugauauaaaacauuc

SEQ ID NO: 4095612 - RNA, 21 nt, Variola virus
uuaaguucuggaauauuauca

SEQ ID NO: 4095613 - RNA, 16 nt, Variola virus
uuaauaaacuaacauu

SEQ ID NO: 4095614 - RNA, 17 nt, Variola virus
uuaauaaauaucauuaa

SEQ ID NO: 4095615 - RNA, 24 nt, Variola virus
uuaauaacauuacauauuauauca

SEQ ID NO: 4095616 - RNA, 16 nt, Variola virus
uuaauaauucauggaa

SEQ ID NO: 4095617 - RNA, 19 nt, Variola virus
uuaauacaccguuaacaau

SEQ ID NO: 4095618 - RNA, 17 nt, Variola virus
uuaauacaguaaguaca

SEQ ID NO: 4095619 - RNA, 13 nt, Variola virus
uuaauacaucauc

SEQ ID NO: 4095620 - RNA, 16 nt, Variola virus
uuaauacggaauauag

SEQ ID NO: 4095621 - RNA, 17 nt, Variola virus
uuaauacguucauuaaa

SEQ ID NO: 4095622 - RNA, 18 nt, Variola virus
uuaauauauuuaaacuag

SEQ ID NO: 4095623 - RNA, 18 nt, Variola virus
uuaauaucgcacaaagaa

SEQ ID NO: 4095624 - RNA, 12 nt, Variola virus
uuaauauguaua

SEQ ID NO: 4095625 - RNA, 16 nt, Variola virus
uuaauauuacauauuu

SEQ ID NO: 4095626 - RNA, 20 nt, Variola virus
uuaauauuacauauuuuuca

SEQ ID NO: 4095627 - RNA, 14 nt, Variola virus
uuaauauuacuguu

SEQ ID NO: 4095628 - RNA, 19 nt, Variola virus
uuaauauugaaaauacuaa

SEQ ID NO: 4095629 - RNA, 21 nt, Variola virus
uuaaucaaaugguaaauacug

SEQ ID NO: 4095630 - RNA, 14 nt, Variola virus
uuaaucauuaacuu

SEQ ID NO: 4095631 - RNA, 15 nt, Variola virus
uuaaucauugauuca

SEQ ID NO: 4095632 - RNA, 17 nt, Variola virus
uuaaugauucauuauca

SEQ ID NO: 4095633 - RNA, 19 nt, Variola virus
uuaaugcccaauuuggaua

SEQ ID NO: 4095634 - RNA, 21 nt, Variola virus
uuaaugcuacagauauuauca

SEQ ID NO: 4095635 - RNA, 18 nt, Variola virus
uuaauuccagauguugua

SEQ ID NO: 4095636 - RNA, 22 nt, Variola virus
uuaauucuagacuauuuggaca

SEQ ID NO: 4095637 - RNA, 17 nt, Variola virus
uuaauuuauuauacugu

SEQ ID NO: 4095638 - RNA, 21 nt, Variola virus
uuaauuuuuccuuacacaauc

SEQ ID NO: 4095639 - RNA, 23 nt, Variola virus
uuacaacggcgccagauuuaaga

SEQ ID NO: 4095640 - RNA, 17 nt, Variola virus
uuacaagaauauaaaaa

SEQ ID NO: 4095641 - RNA, 12 nt, Variola virus
uuacaaugacuc

SEQ ID NO: 4095642 - RNA, 17 nt, Variola virus
uuacaaugcucauuaaa

SEQ ID NO: 4095643 - RNA, 20 nt, Variola virus
uuacaauuaauaaguauaaa

SEQ ID NO: 4095644 - RNA, 20 nt, Variola virus
uuacacaacgcgauauauaa

SEQ ID NO: 4095645 - RNA, 12 nt, Variola virus
uuacagagacuu

SEQ ID NO: 4095646 - RNA, 18 nt, Variola virus
uuacagaucuaguauaau

SEQ ID NO: 4095647 - RNA, 16 nt, Variola virus
uuacauguauuaaaga

SEQ ID NO: 4095648 - RNA, 22 nt, Variola virus
uuacauuaaauguauauuuucc

SEQ ID NO: 4095649 - RNA, 20 nt, Variola virus
uuaccaacgacgauaguucu

SEQ ID NO: 4095650 - RNA, 15 nt, Variola virus
uuaccagauaucuuc

SEQ ID NO: 4095651 - RNA, 20 nt, Variola virus
uuaccccucauaguauuaau

SEQ ID NO: 4095652 - RNA, 21 nt, Variola virus
uuaccuugaaaauaaauacag

SEQ ID NO: 4095653 - RNA, 18 nt, Variola virus
uuacgaauauauaaaaga

SEQ ID NO: 4095654 - RNA, 17 nt, Variola virus
uuacgaauuacauuucu

SEQ ID NO: 4095655 - RNA, 22 nt, Variola virus
uuacgacacgcauuugaugcac

SEQ ID NO: 4095656 - RNA, 18 nt, Variola virus
uuacgacgagcauauuca

SEQ ID NO: 4095657 - RNA, 19 nt, Variola virus
acaaaauaaaaaacauaau

SEQ ID NO: 4095658 - RNA, 15 nt, Variola virus
acaaaaucuaaacaa

SEQ ID NO: 4095659 - RNA, 17 nt, Variola virus
acaaaauucagauucua

SEQ ID NO: 4095660 - RNA, 18 nt, Variola virus
acaaacaauuaauuaaua

SEQ ID NO: 4095661 - RNA, 20 nt, Variola virus
acaaacaauuaauuaauaca

SEQ ID NO: 4095662 - RNA, 22 nt, Variola virus
acaaacauuuuuguugguguaa

SEQ ID NO: 4095663 - RNA, 17 nt, Variola virus
acaaacgccauaaucug

SEQ ID NO: 4095664 - RNA, 15 nt, Variola virus
acaaacuccauauau

SEQ ID NO: 4095665 - RNA, 21 nt, Variola virus
acaaacuguucucuuaugaau

SEQ ID NO: 4095666 - RNA, 21 nt, Variola virus
acaaacuguuguuaaggaaua

SEQ ID NO: 4095667 - RNA, 22 nt, Variola virus
acaaacuguuguuaaggaauau

SEQ ID NO: 4095668 - RNA, 20 nt, Variola virus
acaaagauaccgaagaauua

SEQ ID NO: 4095669 - RNA, 17 nt, Variola virus
acaaaguaauuggauuc

SEQ ID NO: 4095670 - RNA, 14 nt, Variola virus
acaaaguacucaau

SEQ ID NO: 4095671 - RNA, 13 nt, Variola virus
acaaauaauaggu

SEQ ID NO: 4095672 - RNA, 19 nt, Variola virus
acaaauagagauaaaacaa

SEQ ID NO: 4095673 - RNA, 14 nt, Variola virus
acaaaucuggaaaa

SEQ ID NO: 4095674 - RNA, 15 nt, Variola virus
acaaauucuuggaua

SEQ ID NO: 4095675 - RNA, 13 nt, Variola virus
acaacaaucuaua

SEQ ID NO: 4095676 - RNA, 17 nt, Variola virus
acaacauguuauaacua

SEQ ID NO: 4095677 - RNA, 17 nt, Variola virus
acaaccgcuacauaauc

SEQ ID NO: 4095678 - RNA, 18 nt, Variola virus
acaaccgcuuagaaauaa

SEQ ID NO: 4095679 - RNA, 19 nt, Variola virus
acaacgagagauauuuuca

SEQ ID NO: 4095680 - RNA, 15 nt, Variola virus
acaacgugaaauacu

SEQ ID NO: 4095681 - RNA, 14 nt, Variola virus
acaacuaaacagua

SEQ ID NO: 4095682 - RNA, 20 nt, Variola virus
acaacuuaaucugaugaaua

SEQ ID NO: 4095683 - RNA, 13 nt, Variola virus
acaagauauauau

SEQ ID NO: 4095684 - RNA, 15 nt, Variola virus
acaagaucuuuguuu

SEQ ID NO: 4095685 - RNA, 17 nt, Variola virus
acaagauuccuuuucua

SEQ ID NO: 4095686 - RNA, 20 nt, Variola virus
acaagcaagcaucaugaaua

SEQ ID NO: 4095687 - RNA, 14 nt, Variola virus
acaagucauuuaaa

SEQ ID NO: 4095688 - RNA, 13 nt, Variola virus
acaagucuaauaa

SEQ ID NO: 4095689 - RNA, 19 nt, Variola virus
acaauaacuacauauucua

SEQ ID NO: 4095690 - RNA, 12 nt, Variola virus
acaauauaacau

SEQ ID NO: 4095691 - RNA, 13 nt, Variola virus
acaauauauucua

SEQ ID NO: 4095692 - RNA, 12 nt, Variola virus
acaauauuuccg

SEQ ID NO: 4095693 - RNA, 14 nt, Variola virus
acaaucguuaauaa

SEQ ID NO: 4095694 - RNA, 17 nt, Variola virus
acaaucuaauacaaaau

SEQ ID NO: 4095695 - RNA, 13 nt, Variola virus
acaaugaacuaau

SEQ ID NO: 4095696 - RNA, 15 nt, Variola virus
acaaugacuuuauca

SEQ ID NO: 4095697 - RNA, 22 nt, Variola virus
acaaugcuaauauauucuuaca

SEQ ID NO: 4095698 - RNA, 19 nt, Variola virus
acaaugcucaguaaaugua

SEQ ID NO: 4095699 - RNA, 16 nt, Variola virus
acaauggaauacuuca

SEQ ID NO: 4095700 - RNA, 15 nt, Variola virus
acaauguauaauaua

SEQ ID NO: 4095701 - RNA, 19 nt, Variola virus
acaaugucaaaauaugagu

SEQ ID NO: 4095702 - RNA, 21 nt, Variola virus
acaauguuugacugaauauau

SEQ ID NO: 4095703 - RNA, 21 nt, Variola virus
acaauuagaacagggaauuac

SEQ ID NO: 4095704 - RNA, 16 nt, Variola virus
acaauuauuauauaau

SEQ ID NO: 4095705 - RNA, 14 nt, Variola virus
acaauuuauuucua

SEQ ID NO: 4095706 - RNA, 22 nt, Variola virus
acaauuuugcaccauucauaau

SEQ ID NO: 4095707 - RNA, 14 nt, Variola virus
acaauuuuguauua

SEQ ID NO: 4095708 - RNA, 23 nt, Variola virus
acacaaguugauaaaauguugau

SEQ ID NO: 4095709 - RNA, 18 nt, Variola virus
acacaggauaaauuauuu

SEQ ID NO: 4095710 - RNA, 14 nt, Variola virus
acacauaacugaag

SEQ ID NO: 4095711 - RNA, 13 nt, Variola virus
acacauuaacauc

SEQ ID NO: 4095712 - RNA, 17 nt, Variola virus
acacauuaggauacaga

SEQ ID NO: 4095713 - RNA, 21 nt, Variola virus
acaccaucuucauaauaaaua

SEQ ID NO: 4095714 - RNA, 15 nt, Variola virus
acaccauuuacuuua

SEQ ID NO: 4095715 - RNA, 14 nt, Variola virus
acaccgaauacaaa

SEQ ID NO: 4095716 - RNA, 16 nt, Variola virus
acaccuaauacucugg

SEQ ID NO: 4095717 - RNA, 17 nt, Variola virus
acaccucaaugucuuua

SEQ ID NO: 4095718 - RNA, 21 nt, Variola virus
acacgaaagaaucaaaagaau

SEQ ID NO: 4095719 - RNA, 16 nt, Variola virus
acacgagccuuuauua

SEQ ID NO: 4095720 - RNA, 20 nt, Variola virus
acacguuagguuucuuuauu

SEQ ID NO: 4095721 - RNA, 17 nt, Variola virus
acacuaauuaagauaua

SEQ ID NO: 4095722 - RNA, 14 nt, Variola virus
acacucaccaauaa

SEQ ID NO: 4095723 - RNA, 17 nt, Variola virus
acacucgacacaauauu

SEQ ID NO: 4095724 - RNA, 17 nt, Variola virus
acacucuauaucuagaa

SEQ ID NO: 4095725 - RNA, 14 nt, Variola virus
acacugauucagaa

SEQ ID NO: 4095726 - RNA, 18 nt, Variola virus
acacuggaucuaugguuu

SEQ ID NO: 4095727 - RNA, 15 nt, Variola virus
acacuguuaaaguua

SEQ ID NO: 4095728 - RNA, 13 nt, Variola virus
acacuucuagaua

SEQ ID NO: 4095729 - RNA, 19 nt, Variola virus
acacuuugauuucuuaucu

SEQ ID NO: 4095730 - RNA, 19 nt, Variola virus
acacuuuuguaaaauauua

SEQ ID NO: 4095731 - RNA, 14 nt, Variola virus
acagaaaagagaau

SEQ ID NO: 4095732 - RNA, 16 nt, Variola virus
acagaacuaauguaua

SEQ ID NO: 4095733 - RNA, 21 nt, Variola virus
acagacgacagccuguaacug

SEQ ID NO: 4095734 - RNA, 13 nt, Variola virus
acagacucauuau

SEQ ID NO: 4095735 - RNA, 21 nt, Variola virus
acagaguuagaaauagauaau

SEQ ID NO: 4095736 - RNA, 14 nt, Variola virus
acagauuuaacaau

SEQ ID NO: 4095737 - RNA, 15 nt, Variola virus
acaggaaagaaguau

SEQ ID NO: 4095738 - RNA, 20 nt, Variola virus
acaggcgaugguaaaaagac

SEQ ID NO: 4095739 - RNA, 13 nt, Variola virus
acaguaguuuaac

SEQ ID NO: 4095740 - RNA, 18 nt, Variola virus
acaguaucagauaaucua

SEQ ID NO: 4095741 - RNA, 17 nt, Variola virus
acaguaucauuuaaaca

SEQ ID NO: 4095742 - RNA, 21 nt, Variola virus
acagucugcgaacuuuaaaca

SEQ ID NO: 4095743 - RNA, 13 nt, Variola virus
acaguuaaaacua

SEQ ID NO: 4095744 - RNA, 14 nt, Variola virus
acaguuauauaucu

SEQ ID NO: 4095745 - RNA, 13 nt, Variola virus
acaguuugaaaaa

SEQ ID NO: 4095746 - RNA, 20 nt, Variola virus
acauaaaggcgcccauuuca

SEQ ID NO: 4095747 - RNA, 17 nt, Variola virus
acauaacagauaguuua

SEQ ID NO: 4095748 - RNA, 17 nt, Variola virus
acauaacagguagaauu

SEQ ID NO: 4095749 - RNA, 16 nt, Variola virus
acauaacucuuuucca

SEQ ID NO: 4095750 - RNA, 17 nt, Variola virus
acauaagcaucuccaau

SEQ ID NO: 4095751 - RNA, 20 nt, Variola virus
acauaagccauuaacagcuu

SEQ ID NO: 4095752 - RNA, 15 nt, Variola virus
acauaauauauacag

SEQ ID NO: 4095753 - RNA, 19 nt, Variola virus
acauaauuuucuauaacug

SEQ ID NO: 4095754 - RNA, 16 nt, Variola virus
acauaccugauuagaa

SEQ ID NO: 4095755 - RNA, 18 nt, Variola virus
acauacuuuccuguagua

SEQ ID NO: 4095756 - RNA, 18 nt, Variola virus
acauauaacuuuccauca

SEQ ID NO: 4095757 - RNA, 17 nt, Variola virus
acauauaauaaugaaua

SEQ ID NO: 4095758 - RNA, 15 nt, Variola virus
acauauaguggauua

SEQ ID NO: 4095759 - RNA, 22 nt, Variola virus
acauaugcaucuauauaaucuu

SEQ ID NO: 4095760 - RNA, 15 nt, Variola virus
acauaugguauuauu

SEQ ID NO: 4095761 - RNA, 16 nt, Variola virus
acauauuuauaauuua

SEQ ID NO: 4095762 - RNA, 13 nt, Variola virus
acaucaaacggau

SEQ ID NO: 4095763 - RNA, 15 nt, Variola virus
acaucauaaaaugag

SEQ ID NO: 4095764 - RNA, 10 nt, Variola virus
acaucaucua

SEQ ID NO: 4095765 - RNA, 22 nt, Variola virus
acauccaggguccauuuucugu

SEQ ID NO: 4095766 - RNA, 14 nt, Variola virus
acauccgaaaaagu

SEQ ID NO: 4095767 - RNA, 17 nt, Variola virus
acauccggcaaaaauaa

SEQ ID NO: 4095768 - RNA, 14 nt, Variola virus
acaucggaaauaua

SEQ ID NO: 4095769 - RNA, 19 nt, Variola virus
acaucguuuaauauuacau

SEQ ID NO: 4095770 - RNA, 14 nt, Variola virus
acaucuaaaaaugu

SEQ ID NO: 4095771 - RNA, 19 nt, Variola virus
acaucuaaagaaaaaugau

SEQ ID NO: 4095772 - RNA, 23 nt, Variola virus
acaucuggccuguucauaaauaa

SEQ ID NO: 4095773 - RNA, 14 nt, Variola virus
acaugcauuugaaa

SEQ ID NO: 4095774 - RNA, 18 nt, Variola virus
acaugcgguucaaaauag

SEQ ID NO: 4095775 - RNA, 15 nt, Variola virus
acauguauuaccguu

SEQ ID NO: 4095776 - RNA, 18 nt, Variola virus
acaugucaucgaaauggu

SEQ ID NO: 4095777 - RNA, 16 nt, Variola virus
acaugucuaauguguu

SEQ ID NO: 4095778 - RNA, 18 nt, Variola virus
acauguguacuuguacac

SEQ ID NO: 4095779 - RNA, 11 nt, Variola virus
acauuaaacag

SEQ ID NO: 4095780 - RNA, 17 nt, Variola virus
acauuaaugguacaaau

SEQ ID NO: 4095781 - RNA, 20 nt, Variola virus
acauuaucaaaaagaacgau

SEQ ID NO: 4095782 - RNA, 19 nt, Variola virus
acauuauuaaaucaugaag

SEQ ID NO: 4095783 - RNA, 19 nt, Variola virus
acauucauuaauaauacag

SEQ ID NO: 4095784 - RNA, 14 nt, Variola virus
acauuccuaugaug

SEQ ID NO: 4095785 - RNA, 22 nt, Variola virus
acauugaucuauuauuuaauga

SEQ ID NO: 4095786 - RNA, 22 nt, Variola virus
acauugauuaaauuuuaauaua

SEQ ID NO: 4095787 - RNA, 20 nt, Variola virus
aaucuagccauugucuuaua

SEQ ID NO: 4095788 - RNA, 22 nt, Variola virus
aaucuaguuaccuugaaaauaa

SEQ ID NO: 4095789 - RNA, 13 nt, Variola virus
aaucuauaauauc

SEQ ID NO: 4095790 - RNA, 20 nt, Variola virus
aaucuauaucauguagaaaa

SEQ ID NO: 4095791 - RNA, 15 nt, Variola virus
aaucugauaaauaua

SEQ ID NO: 4095792 - RNA, 11 nt, Variola virus
aaucuggaaaa

SEQ ID NO: 4095793 - RNA, 23 nt, Variola virus
aaucuguacuauguguuaaaaga

SEQ ID NO: 4095794 - RNA, 15 nt, Variola virus
aaucuguaucgaaug

SEQ ID NO: 4095795 - RNA, 13 nt, Variola virus
aaugacaaacauu

SEQ ID NO: 4095796 - RNA, 22 nt, Variola virus
aaugacuuauuaaaaaacauau

SEQ ID NO: 4095797 - RNA, 18 nt, Variola virus
aaugagauguuaaaugaa

SEQ ID NO: 4095798 - RNA, 23 nt, Variola virus
aaugagguguacagcacaugaua

SEQ ID NO: 4095799 - RNA, 18 nt, Variola virus
aaugaguuauuaagaaau

SEQ ID NO: 4095800 - RNA, 16 nt, Variola virus
aaugaguucugugcag

SEQ ID NO: 4095801 - RNA, 15 nt, Variola virus
aaugauaaacaaaaa

SEQ ID NO: 4095802 - RNA, 19 nt, Variola virus
aaugauacacuaaguauau

SEQ ID NO: 4095803 - RNA, 18 nt, Variola virus
aaugauacugauaaagua

SEQ ID NO: 4095804 - RNA, 21 nt, Variola virus
aaugauaucuaugauuuuacc

SEQ ID NO: 4095805 - RNA, 17 nt, Variola virus
aaugauaucuuagaaua

SEQ ID NO: 4095806 - RNA, 21 nt, Variola virus
aaugaugacuugauagaauau

SEQ ID NO: 4095807 - RNA, 19 nt, Variola virus
aaugaugguguauacagua

SEQ ID NO: 4095808 - RNA, 22 nt, Variola virus
aaugauuauguuguuaugagug

SEQ ID NO: 4095809 - RNA, 14 nt, Variola virus
aaugauuuagaaau

SEQ ID NO: 4095810 - RNA, 17 nt, Variola virus
aaugauuuagaaaugaa

SEQ ID NO: 4095811 - RNA, 18 nt, Variola virus
aaugauuucauuagaaua

SEQ ID NO: 4095812 - RNA, 15 nt, Variola virus
aaugauuuuggaaaa

SEQ ID NO: 4095813 - RNA, 14 nt, Variola virus
aaugcagaaaugau

SEQ ID NO: 4095814 - RNA, 15 nt, Variola virus
aaugcagaaaugauu

SEQ ID NO: 4095815 - RNA, 16 nt, Variola virus
aaugcagggugcauau

SEQ ID NO: 4095816 - RNA, 13 nt, Variola virus
aaugcauuuuaua

SEQ ID NO: 4095817 - RNA, 23 nt, Variola virus
aaugccacgaauaaaaaauacuu

SEQ ID NO: 4095818 - RNA, 23 nt, Variola virus
aaugccuuacucgguguauauaa

SEQ ID NO: 4095819 - RNA, 15 nt, Variola virus
aaugcuaauauuaaa

SEQ ID NO: 4095820 - RNA, 18 nt, Variola virus
aaugcucaguaaauguau

SEQ ID NO: 4095821 - RNA, 23 nt, Variola virus
aaugcuucucuguuuaaugaauu

SEQ ID NO: 4095822 - RNA, 20 nt, Variola virus
aauggacuccaauacgaaau

SEQ ID NO: 4095823 - RNA, 16 nt, Variola virus
aauggauaauuuccau

SEQ ID NO: 4095824 - RNA, 19 nt, Variola virus
aauggaugaggaagugaua

SEQ ID NO: 4095825 - RNA, 16 nt, Variola virus
aauggcauacauagaa

SEQ ID NO: 4095826 - RNA, 16 nt, Variola virus
aauggugguaaaacua

SEQ ID NO: 4095827 - RNA, 15 nt, Variola virus
aauguaaagucuaua

SEQ ID NO: 4095828 - RNA, 16 nt, Variola virus
aauguacuguauauaa

SEQ ID NO: 4095829 - RNA, 16 nt, Variola virus
aauguagaaaaucaua

SEQ ID NO: 4095830 - RNA, 18 nt, Variola virus
aauguagaaauuagaaag

SEQ ID NO: 4095831 - RNA, 14 nt, Variola virus
aauguaguaaauau

SEQ ID NO: 4095832 - RNA, 21 nt, Variola virus
aauguagugauagauaugaua

SEQ ID NO: 4095833 - RNA, 15 nt, Variola virus
aaugucuuucauguu

SEQ ID NO: 4095834 - RNA, 14 nt, Variola virus
aaugugagaaguuu

SEQ ID NO: 4095835 - RNA, 17 nt, Variola virus
aaugugauaauuuccag

SEQ ID NO: 4095836 - RNA, 22 nt, Variola virus
aaugugauucucugaaaaugua

SEQ ID NO: 4095837 - RNA, 14 nt, Variola virus
aauguuaaaacuac

SEQ ID NO: 4095838 - RNA, 14 nt, Variola virus
aauguuaaacauua

SEQ ID NO: 4095839 - RNA, 21 nt, Variola virus
aauguuaagcauauccugaau

SEQ ID NO: 4095840 - RNA, 12 nt, Variola virus
aauguuagaauu

SEQ ID NO: 4095841 - RNA, 19 nt, Variola virus
aauguuagagacggaaaua

SEQ ID NO: 4095842 - RNA, 23 nt, Variola virus
aauguuauaguuuucuaaaaugu

SEQ ID NO: 4095843 - RNA, 22 nt, Variola virus
aauguuugauaaaaauauguau

SEQ ID NO: 4095844 - RNA, 13 nt, Variola virus
aauuaaacaaaac

SEQ ID NO: 4095845 - RNA, 10 nt, Variola virus
aauuaaauau

SEQ ID NO: 4095846 - RNA, 17 nt, Variola virus
aauuaaucauauacaac

SEQ ID NO: 4095847 - RNA, 14 nt, Variola virus
aauuacaaacacua

SEQ ID NO: 4095848 - RNA, 15 nt, Variola virus
aauuacacuauuugu

SEQ ID NO: 4095849 - RNA, 21 nt, Variola virus
aauuacagaguuuucagaaga

SEQ ID NO: 4095850 - RNA, 20 nt, Variola virus
aauuacauaaaaaaaaugua

SEQ ID NO: 4095851 - RNA, 15 nt, Variola virus
aauuacauuucuugu

SEQ ID NO: 4095852 - RNA, 18 nt, Variola virus
aauuaccaacuaaaaguc

SEQ ID NO: 4095853 - RNA, 19 nt, Variola virus
aauuacuaaaauauacaaa

SEQ ID NO: 4095854 - RNA, 20 nt, Variola virus
aauuacuuaaagauagaaau

SEQ ID NO: 4095855 - RNA, 13 nt, Variola virus
aauuagaaauugg

SEQ ID NO: 4095856 - RNA, 16 nt, Variola virus
aauuagaauuacaaaa

SEQ ID NO: 4095857 - RNA, 15 nt, Variola virus
aauuauauaaaacau

SEQ ID NO: 4095858 - RNA, 22 nt, Variola virus
aauuaucguuccugguauauag

SEQ ID NO: 4095859 - RNA, 21 nt, Variola virus
aauuaugagaaugugauucaa

SEQ ID NO: 4095860 - RNA, 12 nt, Variola virus
aauuaugaugau

SEQ ID NO: 4095861 - RNA, 22 nt, Variola virus
aauuauuauauaauucuucgcc

SEQ ID NO: 4095862 - RNA, 14 nt, Variola virus
aauuauuauccaau

SEQ ID NO: 4095863 - RNA, 14 nt, Variola virus
aauuauuucuaaua

SEQ ID NO: 4095864 - RNA, 19 nt, Variola virus
aauuauuuuuucuuaguaa

SEQ ID NO: 4095865 - RNA, 21 nt, Variola virus
aauucauacaccauuaauaga

SEQ ID NO: 4095866 - RNA, 16 nt, Variola virus
aauucaucucuagaua

SEQ ID NO: 4095867 - RNA, 14 nt, Variola virus
aauucauuagaaua

SEQ ID NO: 4095868 - RNA, 22 nt, Variola virus
aauucauuauuaaacaguuuaa

SEQ ID NO: 4095869 - RNA, 19 nt, Variola virus
aauuccagauguuguaaaa

SEQ ID NO: 4095870 - RNA, 19 nt, Variola virus
aauuccgcauuaaaugaug

SEQ ID NO: 4095871 - RNA, 18 nt, Variola virus
aauuccggcggcgguacc

SEQ ID NO: 4095872 - RNA, 19 nt, Variola virus
aauucggaucguaaaucug

SEQ ID NO: 4095873 - RNA, 14 nt, Variola virus
aauucguuuaaaaa

SEQ ID NO: 4095874 - RNA, 21 nt, Variola virus
aauucuagucuuaaccaagaa

SEQ ID NO: 4095875 - RNA, 15 nt, Variola virus
aauucuuaucaauaa

SEQ ID NO: 4095876 - RNA, 17 nt, Variola virus
aauucuuuuaugaauau

SEQ ID NO: 4095877 - RNA, 14 nt, Variola virus
aauugauucuuauu

SEQ ID NO: 4095878 - RNA, 15 nt, Variola virus
aauugcgguaucuau

SEQ ID NO: 4095879 - RNA, 22 nt, Variola virus
aauugcuguuuauuuuagaaga

SEQ ID NO: 4095880 - RNA, 14 nt, Variola virus
aauugcuuuucuaa

SEQ ID NO: 4095881 - RNA, 22 nt, Variola virus
aauugguauauguauuagaaua

SEQ ID NO: 4095882 - RNA, 14 nt, Variola virus
aauuguauauuaca

SEQ ID NO: 4095883 - RNA, 13 nt, Variola virus
aauugucuaauga

SEQ ID NO: 4095884 - RNA, 16 nt, Variola virus
aauugugauuuaguau

SEQ ID NO: 4095885 - RNA, 15 nt, Variola virus
aauuguucaaaacug

SEQ ID NO: 4095886 - RNA, 14 nt, Variola virus
aauuguuucuuuua

SEQ ID NO: 4095887 - RNA, 24 nt, Variola virus
aauuguuuugaauuucuuagucau

SEQ ID NO: 4095888 - RNA, 22 nt, Variola virus
aauuguuuuuguacauaauaga

SEQ ID NO: 4095889 - RNA, 15 nt, Variola virus
aauuuaauaagaaau

SEQ ID NO: 4095890 - RNA, 19 nt, Variola virus
aauuuaccagauaucuucu

SEQ ID NO: 4095891 - RNA, 21 nt, Variola virus
aauuuacuacugaguauaaau

SEQ ID NO: 4095892 - RNA, 14 nt, Variola virus
aauuuagaaauaua

SEQ ID NO: 4095893 - RNA, 15 nt, Variola virus
aauuuagcauuucua

SEQ ID NO: 4095894 - RNA, 13 nt, Variola virus
aauuuauacucau

SEQ ID NO: 4095895 - RNA, 13 nt, Variola virus
aauuuauauaaau

SEQ ID NO: 4095896 - RNA, 22 nt, Variola virus
aauuuaucaaaugguucauaau

SEQ ID NO: 4095897 - RNA, 17 nt, Variola virus
aauuuauuucagaaauu

SEQ ID NO: 4095898 - RNA, 12 nt, Variola virus
aauuucaaaaua

SEQ ID NO: 4095899 - RNA, 14 nt, Variola virus
aauuuccaucucua

SEQ ID NO: 4095900 - RNA, 23 nt, Variola virus
aauuucuaaaggagcaaauguua

SEQ ID NO: 4095901 - RNA, 20 nt, Variola virus
aauuucuagaauaucaucuc

SEQ ID NO: 4095902 - RNA, 16 nt, Variola virus
aauuucuauuagauaa

SEQ ID NO: 4095903 - RNA, 23 nt, Variola virus
aauuucucucaucuguaggauau

SEQ ID NO: 4095904 - RNA, 19 nt, Variola virus
aauuugauccauguucaua

SEQ ID NO: 4095905 - RNA, 17 nt, Variola virus
aauuuuaauauugaaaa

SEQ ID NO: 4095906 - RNA, 18 nt, Variola virus
aauuuucuauacauagau

SEQ ID NO: 4095907 - RNA, 14 nt, Variola virus
aauuuugaagcauu

SEQ ID NO: 4095908 - RNA, 12 nt, Variola virus
aauuuuuagagg

SEQ ID NO: 4095909 - RNA, 13 nt, Variola virus
aauuuuuuaaaaa

SEQ ID NO: 4095910 - RNA, 17 nt, Variola virus
aauuuuuuuucuagaua

SEQ ID NO: 4095911 - RNA, 16 nt, Variola virus
acaaaaagaaagaaua

SEQ ID NO: 4095912 - RNA, 14 nt, Variola virus
acaaaaauacauaa

SEQ ID NO: 4095913 - RNA, 20 nt, Variola virus
acaaaacagaaauaugugaa

SEQ ID NO: 4095914 - RNA, 12 nt, Variola virus
acaaaagguauu

SEQ ID NO: 4095915 - RNA, 21 nt, Variola virus
acaaaagguauuacaagaaua

SEQ ID NO: 4095916 - RNA, 14 nt, Variola virus
cuugaaugucucaa

SEQ ID NO: 4095917 - RNA, 14 nt, Variola virus
cuugacaucuaaaa

SEQ ID NO: 4095918 - RNA, 21 nt, Variola virus
cuugagagacaugauucagaa

SEQ ID NO: 4095919 - RNA, 24 nt, Variola virus
cuugagauaccaaagucugauauu

SEQ ID NO: 4095920 - RNA, 20 nt, Variola virus
cuugauacagccaaguaucu

SEQ ID NO: 4095921 - RNA, 17 nt, Variola virus
cuugauacgaucauuaa

SEQ ID NO: 4095922 - RNA, 20 nt, Variola virus
cuugauuacauucucauuaa

SEQ ID NO: 4095923 - RNA, 23 nt, Variola virus
cuugcacguaaagucuacauugu

SEQ ID NO: 4095924 - RNA, 21 nt, Variola virus
cuugcuagacaccuuuucaau

SEQ ID NO: 4095925 - RNA, 17 nt, Variola virus
cuuggauaaccuucaua

SEQ ID NO: 4095926 - RNA, 19 nt, Variola virus
cuuggauuugacgaaauca

SEQ ID NO: 4095927 - RNA, 19 nt, Variola virus
cuuguauucaacaugcuuu

SEQ ID NO: 4095928 - RNA, 14 nt, Variola virus
cuugucaucuuguu

SEQ ID NO: 4095929 - RNA, 15 nt, Variola virus
cuuguucguugacau

SEQ ID NO: 4095930 - RNA, 19 nt, Variola virus
cuuuaacauauguaucaau

SEQ ID NO: 4095931 - RNA, 12 nt, Variola virus
cuuuaacuucug

SEQ ID NO: 4095932 - RNA, 15 nt, Variola virus
cuuuacuaagaaagu

SEQ ID NO: 4095933 - RNA, 17 nt, Variola virus
cuuuagaugaauuauua

SEQ ID NO: 4095934 - RNA, 21 nt, Variola virus
cuuuauaauuucaucuacaau

SEQ ID NO: 4095935 - RNA, 15 nt, Variola virus
cuuucaguucuggau

SEQ ID NO: 4095936 - RNA, 18 nt, Variola virus
cuuucaucaucugauacc

SEQ ID NO: 4095937 - RNA, 22 nt, Variola virus
cuuucauuauuacgucuguagu

SEQ ID NO: 4095938 - RNA, 23 nt, Variola virus
cuuucggcgguugccauagaaua

SEQ ID NO: 4095939 - RNA, 16 nt, Variola virus
cuuugaucucuuuugu

SEQ ID NO: 4095940 - RNA, 17 nt, Variola virus
cuuuuaacaugauguaa

SEQ ID NO: 4095941 - RNA, 17 nt, Variola virus
cuuuuauuuccacauua

SEQ ID NO: 4095942 - RNA, 17 nt, Variola virus
cuuuucuaguucugaac

SEQ ID NO: 4095943 - RNA, 15 nt, Variola virus
cuuuucuuauccauu

SEQ ID NO: 4095944 - RNA, 22 nt, Variola virus
cuuuugauuugcuuugaauaau

SEQ ID NO: 4095945 - RNA, 15 nt, Variola virus
cuuuugucguaaaua

SEQ ID NO: 4095946 - RNA, 15 nt, Variola virus
cuuuugugaaaagau

SEQ ID NO: 4095947 - RNA, 14 nt, Variola virus
cuuuuguuuagaau

SEQ ID NO: 4095948 - RNA, 23 nt, Variola virus
cuuuuuauaucuggcucucucug

SEQ ID NO: 4095949 - RNA, 18 nt, Variola virus
cuuuuuauuuauccucuc

SEQ ID NO: 4095950 - RNA, 22 nt, Variola virus
gaaaaagaauuuuuauaaauuu

SEQ ID NO: 4095951 - RNA, 12 nt, Variola virus
gaaaaaguaaau

SEQ ID NO: 4095952 - RNA, 18 nt, Variola virus
gaaaaaguaaaugaugaa

SEQ ID NO: 4095953 - RNA, 17 nt, Variola virus
gaaaacauuauauccuc

SEQ ID NO: 4095954 - RNA, 17 nt, Variola virus
gaaaacauuuuuaucau

SEQ ID NO: 4095955 - RNA, 15 nt, Variola virus
cuauuuuaucauuuu

SEQ ID NO: 4095956 - RNA, 15 nt, Variola virus
cucaaacuaaauguc

SEQ ID NO: 4095957 - RNA, 16 nt, Variola virus
cucaaauaauacuaua

SEQ ID NO: 4095958 - RNA, 18 nt, Variola virus
cucaaaugaauaaguuua

SEQ ID NO: 4095959 - RNA, 13 nt, Variola virus
cucaacaauaaau

SEQ ID NO: 4095960 - RNA, 22 nt, Variola virus
cucaauuucccaaauaacacca

SEQ ID NO: 4095961 - RNA, 11 nt, Variola virus
cucacauuuca

SEQ ID NO: 4095962 - RNA, 14 nt, Variola virus
cucaccucuauauu

SEQ ID NO: 4095963 - RNA, 14 nt, Variola virus
cucagaauaucuca

SEQ ID NO: 4095964 - RNA, 21 nt, Variola virus
cucaguacauagauuauccaa

SEQ ID NO: 4095965 - RNA, 17 nt, Variola virus
cucauaaaauaguucuc

SEQ ID NO: 4095966 - RNA, 20 nt, Variola virus
cucauagacccguaguuuua

SEQ ID NO: 4095967 - RNA, 16 nt, Variola virus
cucaucggaucuguaa

SEQ ID NO: 4095968 - RNA, 23 nt, Variola virus
cucaucguuccauaguuuuucua

SEQ ID NO: 4095969 - RNA, 20 nt, Variola virus
cucaucuacaaaaacauacu

SEQ ID NO: 4095970 - RNA, 15 nt, Variola virus
cucauuuaucauguu

SEQ ID NO: 4095971 - RNA, 22 nt, Variola virus
cuccagacuuuauaauuucauc

SEQ ID NO: 4095972 - RNA, 23 nt, Variola virus
cuccaucaauuucaaaaagagcu

SEQ ID NO: 4095973 - RNA, 16 nt, Variola virus
cucccaccaaauuaau

SEQ ID NO: 4095974 - RNA, 16 nt, Variola virus
cucccauaauacuuua

SEQ ID NO: 4095975 - RNA, 17 nt, Variola virus
cucccuuguguaacguu

SEQ ID NO: 4095976 - RNA, 15 nt, Variola virus
cuccgcucucaaugc

SEQ ID NO: 4095977 - RNA, 21 nt, Variola virus
cuccuagguuucucuauaaac

SEQ ID NO: 4095978 - RNA, 16 nt, Variola virus
cuccuuuaaaauuaau

SEQ ID NO: 4095979 - RNA, 14 nt, Variola virus
cucgauaauuauua

SEQ ID NO: 4095980 - RNA, 20 nt, Variola virus
cucgauacaucaacucucuc

SEQ ID NO: 4095981 - RNA, 19 nt, Variola virus
cucgaucaugaauggauuu

SEQ ID NO: 4095982 - RNA, 17 nt, Variola virus
cucgcuuuguguaucau

SEQ ID NO: 4095983 - RNA, 23 nt, Variola virus
cucgguuguguauuaucaucugc

SEQ ID NO: 4095984 - RNA, 23 nt, Variola virus
cucguaaauugggauaaaaauua

SEQ ID NO: 4095985 - RNA, 18 nt, Variola virus
cucguuuuucuuaagaaa

SEQ ID NO: 4095986 - RNA, 21 nt, Variola virus
cucuaaacaauuggacaaauu

SEQ ID NO: 4095987 - RNA, 14 nt, Variola virus
cucuaaaugaugau

SEQ ID NO: 4095988 - RNA, 22 nt, Variola virus
cucuaacaacgacgaaccaaaa

SEQ ID NO: 4095989 - RNA, 13 nt, Variola virus
cucuaguuucaga

SEQ ID NO: 4095990 - RNA, 17 nt, Variola virus
cucucaucuacaaaaac

SEQ ID NO: 4095991 - RNA, 15 nt, Variola virus
cucucuuuuagagau

SEQ ID NO: 4095992 - RNA, 19 nt, Variola virus
cucugacauucagaaagag

SEQ ID NO: 4095993 - RNA, 11 nt, Variola virus
cucuuaggaag

SEQ ID NO: 4095994 - RNA, 14 nt, Variola virus
cucuuucuuuugau

SEQ ID NO: 4095995 - RNA, 19 nt, Variola virus
cucuuugacauauuuugag

SEQ ID NO: 4095996 - RNA, 22 nt, Variola virus
cucuuugauuuugugucacaug

SEQ ID NO: 4095997 - RNA, 21 nt, Variola virus
cucuuuuauagagaaauguaa

SEQ ID NO: 4095998 - RNA, 14 nt, Variola virus
cucuuuuguagaac

SEQ ID NO: 4095999 - RNA, 15 nt, Variola virus
cguaucuaaaguauu

SEQ ID NO: 4096000 - RNA, 18 nt, Variola virus
cguaucuauaaucaucug

SEQ ID NO: 4096001 - RNA, 22 nt, Variola virus
cguauguauuuguguacaguga

SEQ ID NO: 4096002 - RNA, 16 nt, Variola virus
cguauuuuuuaugaau

SEQ ID NO: 4096003 - RNA, 20 nt, Variola virus
cguccaauguuagaguaucu

SEQ ID NO: 4096004 - RNA, 14 nt, Variola virus
cguccgauuucaua

SEQ ID NO: 4096005 - RNA, 20 nt, Variola virus
cgucgucaaaauauuuacua

SEQ ID NO: 4096006 - RNA, 19 nt, Variola virus
cgucuaaaucaaugcaugu

SEQ ID NO: 4096007 - RNA, 14 nt, Variola virus
cgucucaaucuuua

SEQ ID NO: 4096008 - RNA, 16 nt, Variola virus
cgucuuuugaucuuua

SEQ ID NO: 4096009 - RNA, 21 nt, Variola virus
cgugagaauauacuacaauug

SEQ ID NO: 4096010 - RNA, 17 nt, Variola virus
cgugauauuaucuucau

SEQ ID NO: 4096011 - RNA, 18 nt, Variola virus
cgugauuauucuccacca

SEQ ID NO: 4096012 - RNA, 21 nt, Variola virus
cgugcacuuuuuuauaaagau

SEQ ID NO: 4096013 - RNA, 16 nt, Variola virus
cgugcguaauauuguu

SEQ ID NO: 4096014 - RNA, 21 nt, Variola virus
cgugguguuaugaaacaugua

SEQ ID NO: 4096015 - RNA, 18 nt, Variola virus
cguguuaauaaaaacaug

SEQ ID NO: 4096016 - RNA, 16 nt, Variola virus
cguuaauaacaaaaau

SEQ ID NO: 4096017 - RNA, 20 nt, Variola virus
cguuagauuuucuacagaua

SEQ ID NO: 4096018 - RNA, 19 nt, Variola virus
cguuaucauuuucuacaau

SEQ ID NO: 4096019 - RNA, 19 nt, Variola virus
cguucuacauaaaacauca

SEQ ID NO: 4096020 - RNA, 20 nt, Variola virus
cguugaugaggcacauaaua

SEQ ID NO: 4096021 - RNA, 20 nt, Variola virus
cguuuaaaguaaacuucgua

SEQ ID NO: 4096022 - RNA, 12 nt, Variola virus
cguuuauggauc

SEQ ID NO: 4096023 - RNA, 16 nt, Variola virus
cguuuggauuaaucug

SEQ ID NO: 4096024 - RNA, 15 nt, Variola virus
cuaaaaaaaauaacu

SEQ ID NO: 4096025 - RNA, 12 nt, Variola virus
cuaaaaaacuaa

SEQ ID NO: 4096026 - RNA, 15 nt, Variola virus
cuaaaacauauuucu

SEQ ID NO: 4096027 - RNA, 21 nt, Variola virus
cuaaaauauuaucuaauguug

SEQ ID NO: 4096028 - RNA, 21 nt, Variola virus
cuaaacccgacuuaguuauau

SEQ ID NO: 4096029 - RNA, 17 nt, Variola virus
cuaaagaaaaaugauug

SEQ ID NO: 4096030 - RNA, 20 nt, Variola virus
cuaaagaacggagaauaucu

SEQ ID NO: 4096031 - RNA, 22 nt, Variola virus
cuaaagcacaacgagagauauu

SEQ ID NO: 4096032 - RNA, 16 nt, Variola virus
cuaaauaauuauacuu

SEQ ID NO: 4096033 - RNA, 21 nt, Variola virus
cuaaaucuguauaucuuucca

SEQ ID NO: 4096034 - RNA, 10 nt, Variola virus
cuaaauuaau

SEQ ID NO: 4096035 - RNA, 21 nt, Variola virus
cuaacaaaaauuaugaaauaa

SEQ ID NO: 4096036 - RNA, 15 nt, Variola virus
cuaacacacaaugua

SEQ ID NO: 4096037 - RNA, 21 nt, Variola virus
cuaacagaauuuauuguaaca

SEQ ID NO: 4096038 - RNA, 17 nt, Variola virus
cuaacaugcauuugaaa

SEQ ID NO: 4096039 - RNA, 15 nt, Variola virus
cuaacuuuaaacaag

SEQ ID NO: 4096040 - RNA, 18 nt, Variola virus
cuaagacgucucauuucu

SEQ ID NO: 4096041 - RNA, 21 nt, Variola virus
cuaagacguuguaucucuuuu

SEQ ID NO: 4096042 - RNA, 23 nt, Variola virus
cuaagauauacuaccgauauaca

SEQ ID NO: 4096043 - RNA, 20 nt, Variola virus
cuaauaaacauuccacauuc

SEQ ID NO: 4096044 - RNA, 16 nt, Variola virus
cuaauaaauuaaauau

SEQ ID NO: 4096045 - RNA, 17 nt, Variola virus
cuaauacaaaaucaucu

SEQ ID NO: 4096046 - RNA, 19 nt, Variola virus
cuaauacaucucuggaaau

SEQ ID NO: 4096047 - RNA, 15 nt, Variola virus
cuaauacuaaauaca

SEQ ID NO: 4096048 - RNA, 13 nt, Variola virus
aucucuuaaugag

SEQ ID NO: 4096049 - RNA, 21 nt, Variola virus
aucucuuaaugagcguuuaaa

SEQ ID NO: 4096050 - RNA, 19 nt, Variola virus
aucucuucaucuguaaguu

SEQ ID NO: 4096051 - RNA, 21 nt, Variola virus
aucugauagaaagaauaagaa

SEQ ID NO: 4096052 - RNA, 19 nt, Variola virus
aucugauguaggacaucaa

SEQ ID NO: 4096053 - RNA, 22 nt, Variola virus
aucugauguaggacaucaauau

SEQ ID NO: 4096054 - RNA, 17 nt, Variola virus
aucuggaaaaucuauau

SEQ ID NO: 4096055 - RNA, 17 nt, Variola virus
aucuggauuucagauau

SEQ ID NO: 4096056 - RNA, 21 nt, Variola virus
aucuguaguauucuugucauu

SEQ ID NO: 4096057 - RNA, 21 nt, Variola virus
aucugucccauuuugaauauc

SEQ ID NO: 4096058 - RNA, 21 nt, Variola virus
aucugugacagauaucaucuu

SEQ ID NO: 4096059 - RNA, 22 nt, Variola virus
aucuguggaaaauaauacucug

SEQ ID NO: 4096060 - RNA, 20 nt, Variola virus
aucuuauguuuuuaagagau

SEQ ID NO: 4096061 - RNA, 21 nt, Variola virus
aucuucaagagugcauugacu

SEQ ID NO: 4096062 - RNA, 18 nt, Variola virus
aucuucuuauaagauugu

SEQ ID NO: 4096063 - RNA, 21 nt, Variola virus
aucuucuuauuuagaucuugu

SEQ ID NO: 4096064 - RNA, 19 nt, Variola virus
aucuuguuauaaacacaca

SEQ ID NO: 4096065 - RNA, 18 nt, Variola virus
aucuuguucagaaauaua

SEQ ID NO: 4096066 - RNA, 20 nt, Variola virus
aucuuguucugguuuaaaaa

SEQ ID NO: 4096067 - RNA, 16 nt, Variola virus
aucuuuaaagaacuaa

SEQ ID NO: 4096068 - RNA, 18 nt, Variola virus
aucuuuaauaucuagauu

SEQ ID NO: 4096069 - RNA, 22 nt, Variola virus
augaaacaguaggguuauuaac

SEQ ID NO: 4096070 - RNA, 23 nt, Variola virus
augaaagauacaacaaauuaaau

SEQ ID NO: 4096071 - RNA, 13 nt, Variola virus
augaacaaagaaa

SEQ ID NO: 4096072 - RNA, 19 nt, Variola virus
augaacauaguaagaaauu

SEQ ID NO: 4096073 - RNA, 21 nt, Variola virus
augaaccaauacaauguaaag

SEQ ID NO: 4096074 - RNA, 15 nt, Variola virus
augaacuaagagaaa

SEQ ID NO: 4096075 - RNA, 17 nt, Variola virus
augaacuagacaauaau

SEQ ID NO: 4096076 - RNA, 21 nt, Variola virus
augaauaccggaaucauagau

SEQ ID NO: 4096077 - RNA, 13 nt, Variola virus
augaauaucacau

SEQ ID NO: 4096078 - RNA, 17 nt, Variola virus
augaauaucaggaaaug

SEQ ID NO: 4096079 - RNA, 15 nt, Variola virus
augaaucuaaaagaa

SEQ ID NO: 4096080 - RNA, 20 nt, Variola virus
augaauuacuaaaauauaca

SEQ ID NO: 4096081 - RNA, 14 nt, Variola virus
augacaauauaaca

SEQ ID NO: 4096082 - RNA, 16 nt, Variola virus
augacauggaaauauc

SEQ ID NO: 4096083 - RNA, 17 nt, Variola virus
augacauucucugacau

SEQ ID NO: 4096084 - RNA, 14 nt, Variola virus
augacauuguaaaa

SEQ ID NO: 4096085 - RNA, 18 nt, Variola virus
augacauuguaaaagaaa

SEQ ID NO: 4096086 - RNA, 22 nt, Variola virus
augacauuguaaaagaaauaua

SEQ ID NO: 4096087 - RNA, 16 nt, Variola virus
augacgaauugaaaau

SEQ ID NO: 4096088 - RNA, 18 nt, Variola virus
aauaauugcgaauguuuu

SEQ ID NO: 4096089 - RNA, 19 nt, Variola virus
aauaauuguuauuauuuca

SEQ ID NO: 4096090 - RNA, 14 nt, Variola virus
aauaauuuacaaaa

SEQ ID NO: 4096091 - RNA, 22 nt, Variola virus
aauaauuuaggacuuuguaaua

SEQ ID NO: 4096092 - RNA, 15 nt, Variola virus
aauacaacaaccauu

SEQ ID NO: 4096093 - RNA, 20 nt, Variola virus
aauacaaggcacuaugucca

SEQ ID NO: 4096094 - RNA, 14 nt, Variola virus
aauacaauuaaaaa

SEQ ID NO: 4096095 - RNA, 15 nt, Variola virus
aauacacacaaagua

SEQ ID NO: 4096096 - RNA, 15 nt, Variola virus
aauacaccaaauaua

SEQ ID NO: 4096097 - RNA, 19 nt, Variola virus
aauacaccaauagaugaua

SEQ ID NO: 4096098 - RNA, 18 nt, Variola virus
aauacauuaucaugcuug

SEQ ID NO: 4096099 - RNA, 15 nt, Variola virus
aauaccaaaaugaug

SEQ ID NO: 4096100 - RNA, 23 nt, Variola virus
aauaccaaucauuuauugauaau

SEQ ID NO: 4096101 - RNA, 22 nt, Variola virus
aauaccacugaauguuugaaaa

SEQ ID NO: 4096102 - RNA, 23 nt, Variola virus
aauaccgaugugucuacauaaau

SEQ ID NO: 4096103 - RNA, 22 nt, Variola virus
aauacgauccaagguuagagaa

SEQ ID NO: 4096104 - RNA, 14 nt, Variola virus
aauacggauaugac

SEQ ID NO: 4096105 - RNA, 14 nt, Variola virus
aauacguaaaacuc

SEQ ID NO: 4096106 - RNA, 14 nt, Variola virus
aauacguuagagaa

SEQ ID NO: 4096107 - RNA, 17 nt, Variola virus
aauacuagauucgaaaa

SEQ ID NO: 4096108 - RNA, 18 nt, Variola virus
aauacucuuuaaaguuuc

SEQ ID NO: 4096109 - RNA, 13 nt, Variola virus
aauacuggauaaa

SEQ ID NO: 4096110 - RNA, 12 nt, Variola virus
aauacuuaaaaa

SEQ ID NO: 4096111 - RNA, 19 nt, Variola virus
aauacuuauuaauggcucu

SEQ ID NO: 4096112 - RNA, 21 nt, Variola virus
aauacuuugguaguauacaag

SEQ ID NO: 4096113 - RNA, 14 nt, Variola virus
aauagaaacauaua

SEQ ID NO: 4096114 - RNA, 22 nt, Variola virus
aauagacggcauuaauuuccau

SEQ ID NO: 4096115 - RNA, 17 nt, Variola virus
aauagcaaccaauguuu

SEQ ID NO: 4096116 - RNA, 16 nt, Variola virus
aauagcauaaaugcua

SEQ ID NO: 4096117 - RNA, 16 nt, Variola virus
aauagcgcugaaaaua

SEQ ID NO: 4096118 - RNA, 17 nt, Variola virus
aauagcugaugauagaa

SEQ ID NO: 4096119 - RNA, 20 nt, Variola virus
aauaggguaucuaauuuccu

SEQ ID NO: 4096120 - RNA, 13 nt, Variola virus
aauagguauauaa

SEQ ID NO: 4096121 - RNA, 17 nt, Variola virus
aauaggugaugaugcaa

SEQ ID NO: 4096122 - RNA, 12 nt, Variola virus
aauaguaaauga

SEQ ID NO: 4096123 - RNA, 20 nt, Variola virus
aauaguagaaucaaaggaua

SEQ ID NO: 4096124 - RNA, 23 nt, Variola virus
aauaguaucgaaaacagaauauc

SEQ ID NO: 4096125 - RNA, 22 nt, Variola virus
aauaguucaacaucuacuuuug

SEQ ID NO: 4096126 - RNA, 14 nt, Variola virus
aauaguucuguaau

SEQ ID NO: 4096127 - RNA, 15 nt, Variola virus
aauaguuuauaacau

SEQ ID NO: 4096128 - RNA, 22 nt, Variola virus
aauaguuuccaccaaaagacua

SEQ ID NO: 4096129 - RNA, 23 nt, Variola virus
aauaguuuguacugcaaaaauaa

SEQ ID NO: 4096130 - RNA, 16 nt, Variola virus
aauaguuuuuaucaua

SEQ ID NO: 4096131 - RNA, 21 nt, Variola virus
aauauaaauuaauuuaccauc

SEQ ID NO: 4096132 - RNA, 14 nt, Variola virus
aauauaauauugaa

SEQ ID NO: 4096133 - RNA, 16 nt, Variola virus
aauauacauucgaaaa

SEQ ID NO: 4096134 - RNA, 21 nt, Variola virus
aauauacuuuuaauugaacaa

SEQ ID NO: 4096135 - RNA, 20 nt, Variola virus
aauauagaacaucauuucca

SEQ ID NO: 4096136 - RNA, 20 nt, Variola virus
aauauagcauagauccguga

SEQ ID NO: 4096137 - RNA, 22 nt, Variola virus
aauauaguauauaauaaagaua

SEQ ID NO: 4096138 - RNA, 20 nt, Variola virus
aauauauacuucaauugaua

SEQ ID NO: 4096139 - RNA, 19 nt, Variola virus
aauauaucaauaagcauua

SEQ ID NO: 4096140 - RNA, 20 nt, Variola virus
aauauaucaugcucaguaau

SEQ ID NO: 4096141 - RNA, 23 nt, Variola virus
aauauaucuauaauuugauccau

SEQ ID NO: 4096142 - RNA, 14 nt, Variola virus
aauauaucuuauau

SEQ ID NO: 4096143 - RNA, 14 nt, Variola virus
aauauauuaccaug

SEQ ID NO: 4096144 - RNA, 23 nt, Variola virus
aauaucaaagagaugguuuccuu

SEQ ID NO: 4096145 - RNA, 16 nt, Variola virus
aauaucagaaaggaua

SEQ ID NO: 4096146 - RNA, 15 nt, Variola virus
aauaucauaaauaua

SEQ ID NO: 4096147 - RNA, 22 nt, Variola virus
aauaucauuauguauaaucauu

SEQ ID NO: 4096148 - RNA, 23 nt, Variola virus
aauauccacuauugcaacuauaa

SEQ ID NO: 4096149 - RNA, 15 nt, Variola virus
aauauccagaauguu

SEQ ID NO: 4096150 - RNA, 15 nt, Variola virus
aauaucuaaauaugc

SEQ ID NO: 4096151 - RNA, 21 nt, Variola virus
aauaucuauguuuaacuuuug

SEQ ID NO: 4096152 - RNA, 22 nt, Variola virus
aauaucuccacgauucaggaau

SEQ ID NO: 4096153 - RNA, 23 nt, Variola virus
aauaucuuuaaagagguaauggc

SEQ ID NO: 4096154 - RNA, 17 nt, Variola virus
aauaucuuuaauccaau

SEQ ID NO: 4096155 - RNA, 14 nt, Variola virus
aauaugauagaaau

SEQ ID NO: 4096156 - RNA, 17 nt, Variola virus
aauaugauuagaaguua

SEQ ID NO: 4096157 - RNA, 21 nt, Variola virus
aauaugcggaaccucgagaau

SEQ ID NO: 4096158 - RNA, 22 nt, Variola virus
aauaugcuaguuaauaguaaau

SEQ ID NO: 4096159 - RNA, 13 nt, Variola virus
aauauguagaaaa

SEQ ID NO: 4096160 - RNA, 16 nt, Variola virus
aauaugugcucugcag

SEQ ID NO: 4096161 - RNA, 13 nt, Variola virus
aauauuaaaacua

SEQ ID NO: 4096162 - RNA, 12 nt, Variola virus
aauauuaaacac

SEQ ID NO: 4096163 - RNA, 20 nt, Variola virus
aauauuaauaaaguauauau

SEQ ID NO: 4096164 - RNA, 16 nt, Variola virus
aauauuaauaacauua

SEQ ID NO: 4096165 - RNA, 19 nt, Variola virus
aauauuaauauuagaguua

SEQ ID NO: 4096166 - RNA, 11 nt, Variola virus
aauauucaugu

SEQ ID NO: 4096167 - RNA, 17 nt, Variola virus
aauauuguauuguuaua

SEQ ID NO: 4096168 - RNA, 16 nt, Variola virus
aauauugugaauggua

SEQ ID NO: 4096169 - RNA, 20 nt, Variola virus
aauauuguuaauuauuucua

SEQ ID NO: 4096170 - RNA, 13 nt, Variola virus
aauauuuaauccu

SEQ ID NO: 4096171 - RNA, 16 nt, Variola virus
aauauuucuauuucua

SEQ ID NO: 4096172 - RNA, 12 nt, Variola virus
aauauuuucuau

SEQ ID NO: 4096173 - RNA, 13 nt, Variola virus
aauauuuuucuau

SEQ ID NO: 4096174 - RNA, 16 nt, Variola virus
aauauuuuuuauaaaa

SEQ ID NO: 4096175 - RNA, 12 nt, Variola virus
aaucaaaacaaa

SEQ ID NO: 4096176 - RNA, 15 nt, Variola virus
aaucaaaacaaaauu

SEQ ID NO: 4096177 - RNA, 20 nt, Variola virus
aaucaauagaauaaaccauu

SEQ ID NO: 4096178 - RNA, 12 nt, Variola virus
aaucacaaacau

SEQ ID NO: 4096179 - RNA, 15 nt, Variola virus
aaucacuauagaaaa

SEQ ID NO: 4096180 - RNA, 18 nt, Variola virus
aaucagaagaugauucca

SEQ ID NO: 4096181 - RNA, 23 nt, Variola virus
aaucagacugggaggaucacugu

SEQ ID NO: 4096182 - RNA, 19 nt, Variola virus
aaucaguacuaauuuccaa

SEQ ID NO: 4096183 - RNA, 19 nt, Variola virus
aaucaguggaguaguaaau

SEQ ID NO: 4096184 - RNA, 18 nt, Variola virus
aaucauggggcaaacauu

SEQ ID NO: 4096185 - RNA, 17 nt, Variola virus
aaucauguaaauguuua

SEQ ID NO: 4096186 - RNA, 15 nt, Variola virus
aaucauuaaaugauu

SEQ ID NO: 4096187 - RNA, 23 nt, Variola virus
aaucauuaucgauacuaauuaca

SEQ ID NO: 4096188 - RNA, 15 nt, Variola virus
aauccaaaaaaugaa

SEQ ID NO: 4096189 - RNA, 15 nt, Variola virus
aauccaaacaucacu

SEQ ID NO: 4096190 - RNA, 13 nt, Variola virus
aauccaaauauga

SEQ ID NO: 4096191 - RNA, 15 nt, Variola virus
aauccacauaugaua

SEQ ID NO: 4096192 - RNA, 16 nt, Variola virus
aauccaugaauaaagu

SEQ ID NO: 4096193 - RNA, 17 nt, Variola virus
aaucccgucucagaaag

SEQ ID NO: 4096194 - RNA, 16 nt, Variola virus
aauccgguaaauggaa

SEQ ID NO: 4096195 - RNA, 13 nt, Variola virus
aauccugaauaua

SEQ ID NO: 4096196 - RNA, 23 nt, Variola virus
aauccuucuagaauuagaauuac

SEQ ID NO: 4096197 - RNA, 22 nt, Variola virus
aaucguaucggaguacggagau

SEQ ID NO: 4096198 - RNA, 16 nt, Variola virus
aaucuaaaagaauugg

SEQ ID NO: 4096199 - RNA, 15 nt, Variola virus
aaucuaauacaaaau

SEQ ID NO: 4096200 - RNA, 15 nt, Variola virus
aaucuacucacauau

SEQ ID NO: 4096201 - RNA, 18 nt, Variola virus
aaucuagaaauuacauaa

SEQ ID NO: 4096202 - RNA, 18 nt, Variola virus
aaucuagauuccaaucau

SEQ ID NO: 4096203 - RNA, 19 nt, Variola virus
aaucuagccauuauaaagu

SEQ ID NO: 4096204 - RNA, 20 nt, Variola virus
auauuguaccaaauuaauga

SEQ ID NO: 4096205 - RNA, 14 nt, Variola virus
auauuguagcauua

SEQ ID NO: 4096206 - RNA, 12 nt, Variola virus
auauugugaaug

SEQ ID NO: 4096207 - RNA, 14 nt, Variola virus
auauuguuaaauaa

SEQ ID NO: 4096208 - RNA, 23 nt, Variola virus
auauuuaagugauauaaaacauu

SEQ ID NO: 4096209 - RNA, 15 nt, Variola virus
auauuuacaguuacu

SEQ ID NO: 4096210 - RNA, 19 nt, Variola virus
auauuuagcaauuucugau

SEQ ID NO: 4096211 - RNA, 20 nt, Variola virus
auauuucuaaacccaaaaug

SEQ ID NO: 4096212 - RNA, 13 nt, Variola virus
auauuuguaacuu

SEQ ID NO: 4096213 - RNA, 16 nt, Variola virus
auauuuguuaaugccu

SEQ ID NO: 4096214 - RNA, 13 nt, Variola virus
auauuuuaauagu

SEQ ID NO: 4096215 - RNA, 20 nt, Variola virus
auauuuuccauuauuaauaa

SEQ ID NO: 4096216 - RNA, 22 nt, Variola virus
auauuuuuuaucuaaaaaacua

SEQ ID NO: 4096217 - RNA, 17 nt, Variola virus
auauuuuuuuuuaaaga

SEQ ID NO: 4096218 - RNA, 20 nt, Variola virus
aucaaaaaggagaauacuau

SEQ ID NO: 4096219 - RNA, 14 nt, Variola virus
aucaaaagaaaucu

SEQ ID NO: 4096220 - RNA, 17 nt, Variola virus
aucaaaauaguaaagua

SEQ ID NO: 4096221 - RNA, 12 nt, Variola virus
aucaaacaaacu

SEQ ID NO: 4096222 - RNA, 19 nt, Variola virus
aucaaagucacaaagcaag

SEQ ID NO: 4096223 - RNA, 17 nt, Variola virus
aucaaauagcucaauau

SEQ ID NO: 4096224 - RNA, 12 nt, Variola virus
aucaaauuauug

SEQ ID NO: 4096225 - RNA, 23 nt, Variola virus
aucaacagaggaacgccauauau

SEQ ID NO: 4096226 - RNA, 20 nt, Variola virus
aucaacagauagcuugaaug

SEQ ID NO: 4096227 - RNA, 15 nt, Variola virus
aucaaccacauaaua

SEQ ID NO: 4096228 - RNA, 14 nt, Variola virus
aucaacuacauaau

SEQ ID NO: 4096229 - RNA, 15 nt, Variola virus
aucaauaaaacagga

SEQ ID NO: 4096230 - RNA, 20 nt, Variola virus
aucaauaaaugugagaaguu

SEQ ID NO: 4096231 - RNA, 16 nt, Variola virus
aucaauaacuggcaca

SEQ ID NO: 4096232 - RNA, 20 nt, Variola virus
aucaaucuagcauuucuagc

SEQ ID NO: 4096233 - RNA, 21 nt, Variola virus
aucaauguccugcuauacuuc

SEQ ID NO: 4096234 - RNA, 21 nt, Variola virus
aucaauucuauccaagauacu

SEQ ID NO: 4096235 - RNA, 17 nt, Variola virus
aucaauuuaucauauau

SEQ ID NO: 4096236 - RNA, 14 nt, Variola virus
aucacaagaaguua

SEQ ID NO: 4096237 - RNA, 13 nt, Variola virus
aucacuaaaauaa

SEQ ID NO: 4096238 - RNA, 13 nt, Variola virus
aucacuaacaaua

SEQ ID NO: 4096239 - RNA, 19 nt, Variola virus
aucacuaucuucaucauau

SEQ ID NO: 4096240 - RNA, 17 nt, Variola virus
aacagacuguuuaugaa

SEQ ID NO: 4096241 - RNA, 19 nt, Variola virus
aacagagccaucuguaaaa

SEQ ID NO: 4096242 - RNA, 23 nt, Variola virus
aacagauauuacaaccaguguua

SEQ ID NO: 4096243 - RNA, 17 nt, Variola virus
aacagcauuucugucaa

SEQ ID NO: 4096244 - RNA, 15 nt, Variola virus
aacaggcuaaaaugu

SEQ ID NO: 4096245 - RNA, 19 nt, Variola virus
aacaggguuuguugauucg

SEQ ID NO: 4096246 - RNA, 13 nt, Variola virus
aacaguaaaagaa

SEQ ID NO: 4096247 - RNA, 13 nt, Variola virus
aacagucuguuca

SEQ ID NO: 4096248 - RNA, 12 nt, Variola virus
aacaguguguaa

SEQ ID NO: 4096249 - RNA, 13 nt, Variola virus
aacaguuacuauu

SEQ ID NO: 4096250 - RNA, 11 nt, Variola virus
aacaguuuauu

SEQ ID NO: 4096251 - RNA, 15 nt, Variola virus
aacaguuuuaccguu

SEQ ID NO: 4096252 - RNA, 19 nt, Variola virus
aacauaagcuuuucaaaau

SEQ ID NO: 4096253 - RNA, 20 nt, Variola virus
aacauaccauggaaaaauau

SEQ ID NO: 4096254 - RNA, 21 nt, Variola virus
aacauauagaacauaaccauu

SEQ ID NO: 4096255 - RNA, 13 nt, Variola virus
aacauaugauauu

SEQ ID NO: 4096256 - RNA, 18 nt, Variola virus
aacaucaacugaaaaagu

SEQ ID NO: 4096257 - RNA, 11 nt, Variola virus
aacauccacug

SEQ ID NO: 4096258 - RNA, 13 nt, Variola virus
aacauguuccauu

SEQ ID NO: 4096259 - RNA, 22 nt, Variola virus
aacauuaaaaugucuacagaua

SEQ ID NO: 4096260 - RNA, 14 nt, Variola virus
aacauuaacauuuu

SEQ ID NO: 4096261 - RNA, 13 nt, Variola virus
aacauuagaauua

SEQ ID NO: 4096262 - RNA, 20 nt, Variola virus
aacauuuuauauacuuuucu

SEQ ID NO: 4096263 - RNA, 13 nt, Variola virus
aaccaaauacaua

SEQ ID NO: 4096264 - RNA, 18 nt, Variola virus
aaccaaguacuacaaauu

SEQ ID NO: 4096265 - RNA, 14 nt, Variola virus
aaccaauacaaugu

SEQ ID NO: 4096266 - RNA, 14 nt, Variola virus
aaccagucaugaau

SEQ ID NO: 4096267 - RNA, 15 nt, Variola virus
aaccgaaucuuccca

SEQ ID NO: 4096268 - RNA, 16 nt, Variola virus
aaccgccaaugaugcg

SEQ ID NO: 4096269 - RNA, 23 nt, Variola virus
aaccuaacuaaaagacauaauau

SEQ ID NO: 4096270 - RNA, 19 nt, Variola virus
aaccuuuguuguacaaauu

SEQ ID NO: 4096271 - RNA, 22 nt, Variola virus
aacgaacgcggugugaauguac

SEQ ID NO: 4096272 - RNA, 19 nt, Variola virus
aacgaagaucuuuucucaa

SEQ ID NO: 4096273 - RNA, 15 nt, Variola virus
aacgacuuaauuaca

SEQ ID NO: 4096274 - RNA, 18 nt, Variola virus
aacgauaacgucauuaau

SEQ ID NO: 4096275 - RNA, 15 nt, Variola virus
aacgaugauauguau

SEQ ID NO: 4096276 - RNA, 20 nt, Variola virus
aacgucuccaauauaugaua

SEQ ID NO: 4096277 - RNA, 20 nt, Variola virus
aacgucuuccaauaaauguc

SEQ ID NO: 4096278 - RNA, 16 nt, Variola virus
aacguuacucaaacac

SEQ ID NO: 4096279 - RNA, 17 nt, Variola virus
aacguuaucauuuucua

SEQ ID NO: 4096280 - RNA, 12 nt, Variola virus
aacuaaaaaugu

SEQ ID NO: 4096281 - RNA, 17 nt, Variola virus
aacuaaacagucuauca

SEQ ID NO: 4096282 - RNA, 14 nt, Variola virus
aacuaacuauugaa

SEQ ID NO: 4096283 - RNA, 15 nt, Variola virus
aacuaauauuaggaa

SEQ ID NO: 4096284 - RNA, 14 nt, Variola virus
aacuacaaaaaugc

SEQ ID NO: 4096285 - RNA, 21 nt, Variola virus
aacuacaucgguaucuagauc

SEQ ID NO: 4096286 - RNA, 23 nt, Variola virus
aacuacuccauuuuauuguggaa

SEQ ID NO: 4096287 - RNA, 18 nt, Variola virus
aacuagaaucagaaucua

SEQ ID NO: 4096288 - RNA, 15 nt, Variola virus
aacuauagacaaaau

SEQ ID NO: 4096289 - RNA, 15 nt, Variola virus
aacuaucuuucaaga

SEQ ID NO: 4096290 - RNA, 21 nt, Variola virus
aacuauugaagccauugaaaa

SEQ ID NO: 4096291 - RNA, 22 nt, Variola virus
aacuauuuggauagacacauau

SEQ ID NO: 4096292 - RNA, 18 nt, Variola virus
aacucacauuucaaauau

SEQ ID NO: 4096293 - RNA, 15 nt, Variola virus
aacucaguuaacaua

SEQ ID NO: 4096294 - RNA, 19 nt, Variola virus
aacucauugcuuucuagaa

SEQ ID NO: 4096295 - RNA, 17 nt, Variola virus
aacuccacccauuacau

SEQ ID NO: 4096296 - RNA, 21 nt, Variola virus
aacuccacccauuacauauau

SEQ ID NO: 4096297 - RNA, 14 nt, Variola virus
aacuccuggauaac

SEQ ID NO: 4096298 - RNA, 21 nt, Variola virus
aacucuaucauguaguagaaa

SEQ ID NO: 4096299 - RNA, 20 nt, Variola virus
aacucucguauagucauaga

SEQ ID NO: 4096300 - RNA, 21 nt, Variola virus
aacucugauuauugucuaaua

SEQ ID NO: 4096301 - RNA, 18 nt, Variola virus
aacucuuucgaauacuua

SEQ ID NO: 4096302 - RNA, 15 nt, Variola virus
aacucuuugacauau

SEQ ID NO: 4096303 - RNA, 21 nt, Variola virus
aacucuuuuauagagaaaugu

SEQ ID NO: 4096304 - RNA, 14 nt, Variola virus
aacucuuuuccauu

SEQ ID NO: 4096305 - RNA, 21 nt, Variola virus
aacugcauccuucuaagauua

SEQ ID NO: 4096306 - RNA, 18 nt, Variola virus
aacugccggauaaaagug

SEQ ID NO: 4096307 - RNA, 13 nt, Variola virus
aacuguagaauuc

SEQ ID NO: 4096308 - RNA, 20 nt, Variola virus
aacuguagagggucaacaau

SEQ ID NO: 4096309 - RNA, 18 nt, Variola virus
aacuguggauacucugua

SEQ ID NO: 4096310 - RNA, 13 nt, Variola virus
aacuguucaaaau

SEQ ID NO: 4096311 - RNA, 12 nt, Variola virus
aacuuaaaauau

SEQ ID NO: 4096312 - RNA, 17 nt, Variola virus
aacuuaguguaaaacua

SEQ ID NO: 4096313 - RNA, 22 nt, Variola virus
aacuuauaauccuuuuuauuua

SEQ ID NO: 4096314 - RNA, 20 nt, Variola virus
aaugcuaguuuuagaauaac

SEQ ID NO: 4096315 - RNA, 16 nt, Variola virus
aaugcuuuagugaaau

SEQ ID NO: 4096316 - RNA, 21 nt, Variola virus
aauggauaagaauaaauuaua

SEQ ID NO: 4096317 - RNA, 15 nt, Variola virus
aauguaacguuuaua

SEQ ID NO: 4096318 - RNA, 23 nt, Variola virus
aauguaacguuuauauauucaau

SEQ ID NO: 4096319 - RNA, 19 nt, Variola virus
aauguaauggauagacaau

SEQ ID NO: 4096320 - RNA, 15 nt, Variola virus
aauguaguaaauaua

SEQ ID NO: 4096321 - RNA, 21 nt, Variola virus
aauguauccggccaauugaua

SEQ ID NO: 4096322 - RNA, 15 nt, Variola virus
aauguauuaagauua

SEQ ID NO: 4096323 - RNA, 23 nt, Variola virus
aauguccaaaucuaguuguggaa

SEQ ID NO: 4096324 - RNA, 15 nt, Variola virus
aaugucuaaauucca

SEQ ID NO: 4096325 - RNA, 22 nt, Variola virus
aaugucuauaguucucaucuuu

SEQ ID NO: 4096326 - RNA, 16 nt, Variola virus
aaugugaaugaaaaua

SEQ ID NO: 4096327 - RNA, 20 nt, Variola virus
aaugugauucucugaaaaug

SEQ ID NO: 4096328 - RNA, 15 nt, Variola virus
aaugugcuacuaaga

SEQ ID NO: 4096329 - RNA, 18 nt, Variola virus
aauguuacaacugacaau

SEQ ID NO: 4096330 - RNA, 15 nt, Variola virus
aauguuauuacuugu

SEQ ID NO: 4096331 - RNA, 16 nt, Variola virus
aauguugggauccaga

SEQ ID NO: 4096332 - RNA, 17 nt, Variola virus
aauguuugacugaauau

SEQ ID NO: 4096333 - RNA, 18 nt, Variola virus
aauguuugacugaauaua

SEQ ID NO: 4096334 - RNA, 22 nt, Variola virus
aauuaaaacguccucuauacau

SEQ ID NO: 4096335 - RNA, 12 nt, Variola virus
aauuaaauggau

SEQ ID NO: 4096336 - RNA, 19 nt, Variola virus
aauuaacgaugguuaaaau

SEQ ID NO: 4096337 - RNA, 15 nt, Variola virus
aauuaagaacuauag

SEQ ID NO: 4096338 - RNA, 21 nt, Variola virus
aauuaagcauauucuuaauau

SEQ ID NO: 4096339 - RNA, 18 nt, Variola virus
aauuaaguagaucaucug

SEQ ID NO: 4096340 - RNA, 18 nt, Variola virus
aauuaauaguuuugauau

SEQ ID NO: 4096341 - RNA, 16 nt, Variola virus
aauuaaucaaauggua

SEQ ID NO: 4096342 - RNA, 18 nt, Variola virus
aauuaaucuaguagaaaa

SEQ ID NO: 4096343 - RNA, 11 nt, Variola virus
aauuaaugaaa

SEQ ID NO: 4096344 - RNA, 14 nt, Variola virus
aauuacagaaguac

SEQ ID NO: 4096345 - RNA, 19 nt, Variola virus
aauuagaauuacaaaagaa

SEQ ID NO: 4096346 - RNA, 18 nt, Variola virus
aauuaguagaguuuuaua

SEQ ID NO: 4096347 - RNA, 15 nt, Variola virus
aauuaguuuuaccuu

SEQ ID NO: 4096348 - RNA, 16 nt, Variola virus
aauuauaagaaauaua

SEQ ID NO: 4096349 - RNA, 22 nt, Variola virus
aauuauacuuugguaaauguua

SEQ ID NO: 4096350 - RNA, 12 nt, Variola virus
aauuaucaaaug

SEQ ID NO: 4096351 - RNA, 20 nt, Variola virus
aauuaucaacguuuuacugg

SEQ ID NO: 4096352 - RNA, 23 nt, Variola virus
aauuaucgacauagguauagaau

SEQ ID NO: 4096353 - RNA, 22 nt, Variola virus
aauuaugaaaaaguaaaugaug

SEQ ID NO: 4096354 - RNA, 19 nt, Variola virus
aauuauuagcaaaaauaua

SEQ ID NO: 4096355 - RNA, 16 nt, Variola virus
aauuauuauuaaauau

SEQ ID NO: 4096356 - RNA, 13 nt, Variola virus
aauuauuuaccau

SEQ ID NO: 4096357 - RNA, 13 nt, Variola virus
aauucaaauagau

SEQ ID NO: 4096358 - RNA, 19 nt, Variola virus
aauucacaccuagagacaa

SEQ ID NO: 4096359 - RNA, 14 nt, Variola virus
aauucauuagcaaa

SEQ ID NO: 4096360 - RNA, 14 nt, Variola virus
aauuccauuauucu

SEQ ID NO: 4096361 - RNA, 15 nt, Variola virus
aauucccaaucuugu

SEQ ID NO: 4096362 - RNA, 14 nt, Variola virus
aauucgaaggaagu

SEQ ID NO: 4096363 - RNA, 23 nt, Variola virus
aauucuauaauaaacuuuaauga

SEQ ID NO: 4096364 - RNA, 20 nt, Variola virus
aauucuccagacaauacucu

SEQ ID NO: 4096365 - RNA, 19 nt, Variola virus
aauucuuggauauaugaua

SEQ ID NO: 4096366 - RNA, 18 nt, Variola virus
aauucuuuuaugaauauc

SEQ ID NO: 4096367 - RNA, 22 nt, Variola virus
aauucuuuugauuugcuuugaa

SEQ ID NO: 4096368 - RNA, 16 nt, Variola virus
aauugauuaauguuuu

SEQ ID NO: 4096369 - RNA, 15 nt, Variola virus
aauugcgaauguuuu

SEQ ID NO: 4096370 - RNA, 19 nt, Variola virus
aauugcgauuauaagauua

SEQ ID NO: 4096371 - RNA, 22 nt, Variola virus
aauuggagaaucguauaccauu

SEQ ID NO: 4096372 - RNA, 21 nt, Variola virus
aauugucuagauaaaauacug

SEQ ID NO: 4096373 - RNA, 17 nt, Variola virus
aauuguuaaauuaauaa

SEQ ID NO: 4096374 - RNA, 15 nt, Variola virus
aauuguuugagauau

SEQ ID NO: 4096375 - RNA, 13 nt, Variola virus
aauuuaaauacuu

SEQ ID NO: 4096376 - RNA, 15 nt, Variola virus
aauuuagaaaugauu

SEQ ID NO: 4096377 - RNA, 23 nt, Variola virus
aauuuaguuacugcuauacagau

SEQ ID NO: 4096378 - RNA, 21 nt, Variola virus
aauuuauagacgacucauuua

SEQ ID NO: 4096379 - RNA, 18 nt, Variola virus
aauuuauuaauacaggau

SEQ ID NO: 4096380 - RNA, 16 nt, Variola virus
aauuuauuauuuauga

SEQ ID NO: 4096381 - RNA, 15 nt, Variola virus
aauuuauuuaucaau

SEQ ID NO: 4096382 - RNA, 14 nt, Variola virus
aauuuauuucuaau

SEQ ID NO: 4096383 - RNA, 22 nt, Variola virus
aauuuauuucuucucuucguau

SEQ ID NO: 4096384 - RNA, 20 nt, Variola virus
aauuucuuagucauagacaa

SEQ ID NO: 4096385 - RNA, 19 nt, Variola virus
aauuugaccugauuacauu

SEQ ID NO: 4096386 - RNA, 21 nt, Variola virus
aauuugguaauguuucuuaug

SEQ ID NO: 4096387 - RNA, 17 nt, Variola virus
aauuuggucauucuuaa

SEQ ID NO: 4096388 - RNA, 11 nt, Variola virus
aauuuguacau

SEQ ID NO: 4096389 - RNA, 13 nt, Variola virus
aauuuuaaaugau

SEQ ID NO: 4096390 - RNA, 13 nt, Variola virus
aauuuuaagaaau

SEQ ID NO: 4096391 - RNA, 21 nt, Variola virus
aauuuuaagauuuuaaaugua

SEQ ID NO: 4096392 - RNA, 15 nt, Variola virus
aauuuuaccagaaua

SEQ ID NO: 4096393 - RNA, 14 nt, Variola virus
aauuuuagugaaau

SEQ ID NO: 4096394 - RNA, 20 nt, Variola virus
aauuuuuaacgauuuacugu

SEQ ID NO: 4096395 - RNA, 16 nt, Variola virus
aauuuuuuaaauccug

SEQ ID NO: 4096396 - RNA, 17 nt, Variola virus
acaaaaaagcucaauaa

SEQ ID NO: 4096397 - RNA, 21 nt, Variola virus
acaaaaauugugacuuuguua

SEQ ID NO: 4096398 - RNA, 21 nt, Variola virus
acaaaacaauuagagcagcag

SEQ ID NO: 4096399 - RNA, 22 nt, Variola virus
acaaaagguauuacaagaauau

SEQ ID NO: 4096400 - RNA, 23 nt, Variola virus
acaaaaguaguauagcaauacaa

SEQ ID NO: 4096401 - RNA, 16 nt, Variola virus
acaaaauacuauauau

SEQ ID NO: 4096402 - RNA, 19 nt, Variola virus
acaaaaucaacuacauaau

SEQ ID NO: 4096403 - RNA, 20 nt, Variola virus
acaaaauccaucaaaaaugu

SEQ ID NO: 4096404 - RNA, 19 nt, Variola virus
acaaacaggauaucuauga

SEQ ID NO: 4096405 - RNA, 15 nt, Variola virus
acaaacauacucuaa

SEQ ID NO: 4096406 - RNA, 13 nt, Variola virus
acaaaccaaauau

SEQ ID NO: 4096407 - RNA, 15 nt, Variola virus
acaaaccuaagacaa

SEQ ID NO: 4096408 - RNA, 15 nt, Variola virus
acaaacguaaugaca

SEQ ID NO: 4096409 - RNA, 17 nt, Variola virus
acaaagauggcugaaau

SEQ ID NO: 4096410 - RNA, 14 nt, Variola virus
acaaaggagaugau

SEQ ID NO: 4096411 - RNA, 15 nt, Variola virus
acaaaguacucaaua

SEQ ID NO: 4096412 - RNA, 21 nt, Variola virus
acaaauaauuacaaaaccgau

SEQ ID NO: 4096413 - RNA, 13 nt, Variola virus
acaaauacugaca

SEQ ID NO: 4096414 - RNA, 17 nt, Variola virus
acaaauaguaaaugaga

SEQ ID NO: 4096415 - RNA, 18 nt, Variola virus
acaaaucaaaaguauuaa

SEQ ID NO: 4096416 - RNA, 23 nt, Variola virus
acaaaucuauuuggauuuuuugc

SEQ ID NO: 4096417 - RNA, 16 nt, Variola virus
acaaauggucaaugau

SEQ ID NO: 4096418 - RNA, 15 nt, Variola virus
acaaauuacaauaau

SEQ ID NO: 4096419 - RNA, 18 nt, Variola virus
acaaauuuauuuauuaac

SEQ ID NO: 4096420 - RNA, 22 nt, Variola virus
acaacaaggcuuuaauaucuaa

SEQ ID NO: 4096421 - RNA, 13 nt, Variola virus
acaacauauaauu

SEQ ID NO: 4096422 - RNA, 14 nt, Variola virus
acaaccaucuuuga

SEQ ID NO: 4096423 - RNA, 22 nt, Variola virus
acaacgucaucgcuucaucuau

SEQ ID NO: 4096424 - RNA, 16 nt, Variola virus
acaacgucucauauaa

SEQ ID NO: 4096425 - RNA, 21 nt, Variola virus
acaacuaauuaagcauauucu

SEQ ID NO: 4096426 - RNA, 17 nt, Variola virus
acaacugucaaugaauu

SEQ ID NO: 4096427 - RNA, 19 nt, Variola virus
acaagacuacaaagaaugu

SEQ ID NO: 4096428 - RNA, 16 nt, Variola virus
acaagaugaaaaauuu

SEQ ID NO: 4096429 - RNA, 16 nt, Variola virus
acaagauuccuuuucu

SEQ ID NO: 4096430 - RNA, 14 nt, Variola virus
acaagucuaauaau

SEQ ID NO: 4096431 - RNA, 22 nt, Variola virus
acaagugaaauguugucauuau

SEQ ID NO: 4096432 - RNA, 21 nt, Variola virus
acaaguuuaacaauaaaauua

SEQ ID NO: 4096433 - RNA, 15 nt, Variola virus
acaauaacuacauau

SEQ ID NO: 4096434 - RNA, 15 nt, Variola virus
acaauaauuauaauu

SEQ ID NO: 4096435 - RNA, 18 nt, Variola virus
acaauacgauaaacauug

SEQ ID NO: 4096436 - RNA, 14 nt, Variola virus
acaauacuaccaac

SEQ ID NO: 4096437 - RNA, 18 nt, Variola virus
acaauagucuguuaauaa

SEQ ID NO: 4096438 - RNA, 22 nt, Variola virus
acaauagugucuacuuaaaugu

SEQ ID NO: 4096439 - RNA, 20 nt, Variola virus
acaauaguucagauaaugua

SEQ ID NO: 4096440 - RNA, 20 nt, West Nile virus
aagggaaggacuagagguua

SEQ ID NO: 4096441 - RNA, 13 nt, West Nile virus
acaaccagccaca

SEQ ID NO: 4096442 - RNA, 13 nt, West Nile virus
acauagguggcug

SEQ ID NO: 4096443 - RNA, 13 nt, West Nile virus
accccgugccaaa

SEQ ID NO: 4096444 - RNA, 14 nt, West Nile virus
agacggugcugccu

SEQ ID NO: 4096445 - RNA, 22 nt, West Nile virus
agcuguaagccaagggaaggac

SEQ ID NO: 4096446 - RNA, 14 nt, West Nile virus
agggagaagggacu

SEQ ID NO: 4096447 - RNA, 22 nt, West Nile virus
agucaggccagauuaaugcugc

SEQ ID NO: 4096448 - RNA, 20 nt, West Nile virus
agucugcgauagugccccag

SEQ ID NO: 4096449 - RNA, 15 nt, West Nile virus
agugccccaggugga

SEQ ID NO: 4096450 - RNA, 22 nt, West Nile virus
agugccccagguggacuggguu

SEQ ID NO: 4096451 - RNA, 17 nt, West Nile virus
aguguaaauaggauuua

SEQ ID NO: 4096452 - RNA, 16 nt, West Nile virus
auagugccccaggugg

SEQ ID NO: 4096453 - RNA, 21 nt, West Nile virus
augugccacucugcggagagu

SEQ ID NO: 4096454 - RNA, 15 nt, West Nile virus
auugacaccugggau

SEQ ID NO: 4096455 - RNA, 13 nt, West Nile virus
caaccccaggagg

SEQ ID NO: 4096456 - RNA, 15 nt, West Nile virus
cacacggcacagugc

SEQ ID NO: 4096457 - RNA, 16 nt, West Nile virus
cacuuuaaugugccac

SEQ ID NO: 4096458 - RNA, 16 nt, West Nile virus
cagauuaaugcugcca

SEQ ID NO: 4096459 - RNA, 14 nt, West Nile virus
cauagguggcuggu

SEQ ID NO: 4096460 - RNA, 17 nt, West Nile virus
cauagguggcugguggu

SEQ ID NO: 4096461 - RNA, 20 nt, West Nile virus
ccacacuuuaaugugccacu

SEQ ID NO: 4096462 - RNA, 16 nt, West Nile virus
ccacguaagcccucag

SEQ ID NO: 4096463 - RNA, 19 nt, West Nile virus
ccacgugcuuuagccucaa

SEQ ID NO: 4096464 - RNA, 14 nt, West Nile virus
ccacucugcggaga

SEQ ID NO: 4096465 - RNA, 19 nt, West Nile virus
ccagauuaaugcugccacc

SEQ ID NO: 4096466 - RNA, 16 nt, West Nile virus
cggcucaaccccagga

SEQ ID NO: 4096467 - RNA, 13 nt, West Nile virus
cuagaacacagga

SEQ ID NO: 4096468 - RNA, 22 nt, West Nile virus
cucaaagcccagugucagacca

SEQ ID NO: 4096469 - RNA, 12 nt, West Nile virus
cucaaccccagg

SEQ ID NO: 4096470 - RNA, 22 nt, West Nile virus
cuguaagccaagggaaggacua

SEQ ID NO: 4096471 - RNA, 23 nt, West Nile virus
cuuggcugaagcuguaagccaag

SEQ ID NO: 4096472 - RNA, 14 nt, West Nile virus
gauuaaugcugcca

SEQ ID NO: 4096473 - RNA, 20 nt, West Nile virus
gccagauuaaugcugccacc

SEQ ID NO: 4096474 - RNA, 21 nt, West Nile virus
gccagauuaaugcugccaccg

SEQ ID NO: 4096475 - RNA, 22 nt, West Nile virus
gcggcucaaccccaggaggacu

SEQ ID NO: 4096476 - RNA, 13 nt, West Nile virus
gcugccaccggaa

SEQ ID NO: 4096477 - RNA, 16 nt, West Nile virus
ggcccaacuuggcuga

SEQ ID NO: 4096478 - RNA, 20 nt, West Nile virus
ggcugguggugcuagaacac

SEQ ID NO: 4096479 - RNA, 18 nt, West Nile virus
guaagccaagggaaggac

SEQ ID NO: 4096480 - RNA, 20 nt, West Nile virus
gucugcgauagugccccagg

SEQ ID NO: 4096481 - RNA, 15 nt, West Nile virus
guguuaaccagggag

SEQ ID NO: 4096482 - RNA, 14 nt, West Nile virus
uaagccaagggaag

SEQ ID NO: 4096483 - RNA, 16 nt, West Nile virus
uagagguuagaggaga

SEQ ID NO: 4096484 - RNA, 19 nt, West Nile virus
ugauccacguaagcccuca

SEQ ID NO: 4096485 - RNA, 22 nt, West Nile virus
ugcggcucaaccccaggaggac

SEQ ID NO: 4096486 - RNA, 11 nt, West Nile virus
accaaagcugc

SEQ ID NO: 4096487 - RNA, 23 nt, West Nile virus
acggcccaacuuggcugaagcug

SEQ ID NO: 4096488 - RNA, 18 nt, West Nile virus
acuagagguuagaggaga

SEQ ID NO: 4096489 - RNA, 19 nt, West Nile virus
acuuggcugaagcuguaag

SEQ ID NO: 4096490 - RNA, 21 nt, West Nile virus
agaaccgucucggaaggagga

SEQ ID NO: 4096491 - RNA, 21 nt, West Nile virus
agaccacacuuuaaugugcca

SEQ ID NO: 4096492 - RNA, 16 nt, West Nile virus
agccucaaagcccagu

SEQ ID NO: 4096493 - RNA, 18 nt, West Nile virus
aggagaccccgugccaaa

SEQ ID NO: 4096494 - RNA, 18 nt, West Nile virus
aggccagauuaaugcugc

SEQ ID NO: 4096495 - RNA, 15 nt, West Nile virus
agggacuagagguua

SEQ ID NO: 4096496 - RNA, 18 nt, West Nile virus
agugccccagguggacug

SEQ ID NO: 4096497 - RNA, 17 nt, West Nile virus
augcugccaccggaagu

SEQ ID NO: 4096498 - RNA, 17 nt, West Nile virus
cacaaccagccacacgg

SEQ ID NO: 4096499 - RNA, 19 nt, West Nile virus
cacggcccaacuuggcuga

SEQ ID NO: 4096500 - RNA, 20 nt, West Nile virus
cacucugcggagagugcagu

SEQ ID NO: 4096501 - RNA, 14 nt, West Nile virus
caggaggacugggu

SEQ ID NO: 4096502 - RNA, 18 nt, West Nile virus
ccaagggaaggacuagag

SEQ ID NO: 4096503 - RNA, 21 nt, West Nile virus
ccagauuaaugcugccaccgg

SEQ ID NO: 4096504 - RNA, 15 nt, West Nile virus
ccagugucagaccac

SEQ ID NO: 4096505 - RNA, 13 nt, West Nile virus
cccagguggacug

SEQ ID NO: 4096506 - RNA, 15 nt, West Nile virus
ccuggcuaugguguu

SEQ ID NO: 4096507 - RNA, 19 nt, West Nile virus
cgacauagguggcuggugg

SEQ ID NO: 4096508 - RNA, 18 nt, West Nile virus
cgauagugccccaggugg

SEQ ID NO: 4096509 - RNA, 17 nt, West Nile virus
cggaaggaggaccccac

SEQ ID NO: 4096510 - RNA, 20 nt, West Nile virus
cggcucaaccccaggaggac

SEQ ID NO: 4096511 - RNA, 15 nt, West Nile virus
cgugcuuuagccuca

SEQ ID NO: 4096512 - RNA, 18 nt, West Nile virus
cuagagguuagaggagac

SEQ ID NO: 4096513 - RNA, 21 nt, West Nile virus
cuagagguuagaggagacccc

SEQ ID NO: 4096514 - RNA, 15 nt, West Nile virus
cucaaccccaggagg

SEQ ID NO: 4096515 - RNA, 16 nt, West Nile virus
cugaagcuguaagcca

SEQ ID NO: 4096516 - RNA, 21 nt, West Nile virus
cugcacaaccagccacacggc

SEQ ID NO: 4096517 - RNA, 15 nt, West Nile virus
cugcgauagugcccc

SEQ ID NO: 4096518 - RNA, 13 nt, West Nile virus
gacggugcugccu

SEQ ID NO: 4096519 - RNA, 19 nt, West Nile virus
gagguuagaggagaccccg

SEQ ID NO: 4096520 - RNA, 19 nt, West Nile virus
gcauauugacaccugggau

SEQ ID NO: 4096521 - RNA, 22 nt, West Nile virus
gcccaacuuggcugaagcugua

SEQ ID NO: 4096522 - RNA, 21 nt, West Nile virus
gccugcggcucaaccccagga

SEQ ID NO: 4096523 - RNA, 14 nt, West Nile virus
gcgauagugcccca

SEQ ID NO: 4096524 - RNA, 14 nt, West Nile virus
gcuguaagccaagg

SEQ ID NO: 4096525 - RNA, 22 nt, West Nile virus
ggacuagagguuagaggagacc

SEQ ID NO: 4096526 - RNA, 13 nt, West Nile virus
gucucggaaggag

SEQ ID NO: 4096527 - RNA, 15 nt, West Nile virus
ucaaccccaggagga

SEQ ID NO: 4096528 - RNA, 13 nt, West Nile virus
ucgccccacgcgg

SEQ ID NO: 4096529 - RNA, 15 nt, West Nile virus
ucucggaaggaggac

SEQ ID NO: 4096530 - RNA, 15 nt, West Nile virus
ugaccaaagcugcga

SEQ ID NO: 4096531 - RNA, 16 nt, West Nile virus
ugauccacguaagccc

SEQ ID NO: 4096532 - RNA, 20 nt, West Nile virus
ugcucugcacaaccagccac

SEQ ID NO: 4096533 - RNA, 23 nt, West Nile virus
uggcuaugguguuaaccagggag

SEQ ID NO: 4096534 - RNA, 19 nt, West Nile virus
uuaaccagggagaagggac

SEQ ID NO: 4096535 - RNA, 17 nt, West Nile virus
uuagccucaaagcccag

SEQ ID NO: 4096536 - RNA, 20 nt, West Nile virus
uugaguagacggugcugccu

SEQ ID NO: 4096537 - RNA, 17 nt, West Nile virus
aaccagggagaagggac

SEQ ID NO: 4096538 - RNA, 17 nt, West Nile virus
aaccccaggaggacugg

SEQ ID NO: 4096539 - RNA, 15 nt, West Nile virus
aaggacuagagguua

SEQ ID NO: 4096540 - RNA, 13 nt, West Nile virus
aagggaaggacua

SEQ ID NO: 4096541 - RNA, 16 nt, West Nile virus
aagggacuagagguua

SEQ ID NO: 4096542 - RNA, 16 nt, West Nile virus
acacuuuaaugugcca

SEQ ID NO: 4096543 - RNA, 18 nt, West Nile virus
accccaggaggacugggu

SEQ ID NO: 4096544 - RNA, 22 nt, West Nile virus
accccgcguaaaaaagugcacg

SEQ ID NO: 4096545 - RNA, 17 nt, West Nile virus
acugggugaccaaagcu

SEQ ID NO: 4096546 - RNA, 13 nt, West Nile virus
agaccccgugcca

SEQ ID NO: 4096547 - RNA, 13 nt, West Nile virus
agagguuagagga

SEQ ID NO: 4096548 - RNA, 13 nt, West Nile virus
agguggacugggu

SEQ ID NO: 4096549 - RNA, 21 nt, West Nile virus
auuaaugcugccaccggaagu

SEQ ID NO: 4096550 - RNA, 18 nt, West Nile virus
caagggaaggacuagagg

SEQ ID NO: 4096551 - RNA, 21 nt, West Nile virus
cacggcccaacuuggcugaag

SEQ ID NO: 4096552 - RNA, 22 nt, West Nile virus
cagcauauugacaccugggaua

SEQ ID NO: 4096553 - RNA, 15 nt, West Nile virus
caggaggacugggug

SEQ ID NO: 4096554 - RNA, 15 nt, West Nile virus
cagguggacuggguu

SEQ ID NO: 4096555 - RNA, 22 nt, West Nile virus
cagucugcgauagugccccagg

SEQ ID NO: 4096556 - RNA, 21 nt, West Nile virus
ccagccacacggcacagugcg

SEQ ID NO: 4096557 - RNA, 13 nt, West Nile virus
ccagguggacugg

SEQ ID NO: 4096558 - RNA, 20 nt, West Nile virus
ccccgcguaaaaaagugcac

SEQ ID NO: 4096559 - RNA, 16 nt, West Nile virus
ccucaaagcccagugu

SEQ ID NO: 4096560 - RNA, 17 nt, West Nile virus
cgucucggaaggaggac

SEQ ID NO: 4096561 - RNA, 15 nt, West Nile virus
cucaaagcccagugu

SEQ ID NO: 4096562 - RNA, 19 nt, West Nile virus
cugaagcuguaagccaagg

SEQ ID NO: 4096563 - RNA, 23 nt, West Nile virus
cugccugcggcucaaccccagga

SEQ ID NO: 4096564 - RNA, 18 nt, West Nile virus
cugcgauagugccccagg

SEQ ID NO: 4096565 - RNA, 19 nt, West Nile virus
cugcgauagugccccaggu

SEQ ID NO: 4096566 - RNA, 16 nt, West Nile virus
cuguaagccaagggaa

SEQ ID NO: 4096567 - RNA, 23 nt, West Nile virus
gaccccgcguaaaaaagugcacg

SEQ ID NO: 4096568 - RNA, 22 nt, West Nile virus
gccauaacccuggcuauggugu

SEQ ID NO: 4096569 - RNA, 17 nt, West Nile virus
gccccacgcggccauaa

SEQ ID NO: 4096570 - RNA, 19 nt, West Nile virus
gccgacauagguggcuggu

SEQ ID NO: 4096571 - RNA, 13 nt, West Nile virus
gcggcucaacccc

SEQ ID NO: 4096572 - RNA, 19 nt, West Nile virus
gcuaugguguuaaccaggg

SEQ ID NO: 4096573 - RNA, 22 nt, West Nile virus
gcuguaagccaagggaaggacu

SEQ ID NO: 4096574 - RNA, 23 nt, West Nile virus
ggggaucuucugcucugcacaac

SEQ ID NO: 4096575 - RNA, 21 nt, West Nile virus
gucugcgauagugccccaggu

SEQ ID NO: 4096576 - RNA, 22 nt, West Nile virus
gugcagucugcgauagugcccc

SEQ ID NO: 4096577 - RNA, 17 nt, West Nile virus
uaaccagggagaaggga

SEQ ID NO: 4096578 - RNA, 13 nt, West Nile virus
uagagguuagagg

SEQ ID NO: 4096579 - RNA, 18 nt, West Nile virus
ucugcgauagugccccag

SEQ ID NO: 4096580 - RNA, 12 nt, West Nile virus
ugcagucugcga

SEQ ID NO: 4096581 - RNA, 21 nt, West Nile virus
ugcggcucaaccccaggagga

SEQ ID NO: 4096582 - RNA, 15 nt, West Nile virus
uguaagccaagggaa

SEQ ID NO: 4096583 - RNA, 21 nt, West Nile virus
uugagaauggaagucaggcca

SEQ ID NO: 4096584 - RNA, 13 nt, West Nile virus
aaccccaggagga

SEQ ID NO: 4096585 - RNA, 15 nt, West Nile virus
agaagggacuagagg

SEQ ID NO: 4096586 - RNA, 23 nt, West Nile virus
agaccacacuuuaaugugccacu

SEQ ID NO: 4096587 - RNA, 19 nt, West Nile virus
agaggagaccccgcguaaa

SEQ ID NO: 4096588 - RNA, 16 nt, West Nile virus
agagguuagaggagac

SEQ ID NO: 4096589 - RNA, 22 nt, West Nile virus
aggacuagagguuagaggagac

SEQ ID NO: 4096590 - RNA, 20 nt, West Nile virus
aggccagauuaaugcugcca

SEQ ID NO: 4096591 - RNA, 16 nt, West Nile virus
agggaaggacuagagg

SEQ ID NO: 4096592 - RNA, 23 nt, West Nile virus
agggacuagagguuagaggagac

SEQ ID NO: 4096593 - RNA, 19 nt, West Nile virus
agucugcgauagugcccca

SEQ ID NO: 4096594 - RNA, 20 nt, West Nile virus
aguugaguagacggugcugc

SEQ ID NO: 4096595 - RNA, 15 nt, West Nile virus
auuaaugcugccacc

SEQ ID NO: 4096596 - RNA, 19 nt, West Nile virus
auuuauugagaauggaagu

SEQ ID NO: 4096597 - RNA, 23 nt, West Nile virus
caaagcccagugucagaccacac

SEQ ID NO: 4096598 - RNA, 13 nt, West Nile virus
caaccagccacac

SEQ ID NO: 4096599 - RNA, 17 nt, West Nile virus
cacacggcacagugcgc

SEQ ID NO: 4096600 - RNA, 19 nt, West Nile virus
cacacuuuaaugugccacu

SEQ ID NO: 4096601 - RNA, 15 nt, West Nile virus
cacguaagcccucag

SEQ ID NO: 4096602 - RNA, 18 nt, West Nile virus
cagcauauugacaccugg

SEQ ID NO: 4096603 - RNA, 19 nt, West Nile virus
cagccacacggcacagugc

SEQ ID NO: 4096604 - RNA, 14 nt, West Nile virus
cagguggacugggu

SEQ ID NO: 4096605 - RNA, 23 nt, West Nile virus
cagucugcgauagugccccaggu

SEQ ID NO: 4096606 - RNA, 15 nt, West Nile virus
cauauugacaccugg

SEQ ID NO: 4096607 - RNA, 16 nt, West Nile virus
ccacacggcacagugc

SEQ ID NO: 4096608 - RNA, 20 nt, West Nile virus
ccacgcggccauaacccugg

SEQ ID NO: 4096609 - RNA, 13 nt, West Nile virus
ccaggaggacugg

SEQ ID NO: 4096610 - RNA, 20 nt, West Nile virus
ccagggagaagggacuagag

SEQ ID NO: 4096611 - RNA, 10 nt, West Nile virus
ccgugccaaa

SEQ ID NO: 4096612 - RNA, 20 nt, West Nile virus
ccugcggcucaaccccagga

SEQ ID NO: 4096613 - RNA, 16 nt, West Nile virus
cgauagugccccaggu

SEQ ID NO: 4096614 - RNA, 20 nt, West Nile virus
cgcguaaaaaagugcacggc

SEQ ID NO: 4096615 - RNA, 15 nt, West Nile virus
cggcucaaccccagg

SEQ ID NO: 4096616 - RNA, 11 nt, West Nile virus
cggugcugccu

SEQ ID NO: 4096617 - RNA, 17 nt, West Nile virus
cuagagguuagaggaga

SEQ ID NO: 4096618 - RNA, 16 nt, West Nile virus
cucaaccccaggagga

SEQ ID NO: 4096619 - RNA, 13 nt, West Nile virus
cucggaaggagga

SEQ ID NO: 4096620 - RNA, 18 nt, West Nile virus
cugcggcucaaccccagg

SEQ ID NO: 4096621 - RNA, 15 nt, West Nile virus
cugggauagacuagg

SEQ ID NO: 4096622 - RNA, 22 nt, West Nile virus
gacauagguggcugguggugcu

SEQ ID NO: 4096623 - RNA, 19 nt, West Nile virus
gagaagggacuagagguua

SEQ ID NO: 4096624 - RNA, 16 nt, West Nile virus
gauagugccccaggug

SEQ ID NO: 4096625 - RNA, 19 nt, West Nile virus
gauccacguaagcccucag

SEQ ID NO: 4096626 - RNA, 14 nt, West Nile virus
gcggccauaacccu

SEQ ID NO: 4096627 - RNA, 20 nt, West Nile virus
ggacuagagguuagaggaga

SEQ ID NO: 4096628 - RNA, 14 nt, West Nile virus
ggcucaaccccagg

SEQ ID NO: 4096629 - RNA, 17 nt, West Nile virus
ggugcuagaacacagga

SEQ ID NO: 4096630 - RNA, 21 nt, West Nile virus
gugaccaaagcugcgagguga

SEQ ID NO: 4096631 - RNA, 14 nt, West Nile virus
gugucagaccacac

SEQ ID NO: 4096632 - RNA, 14 nt, West Nile virus
guguuaaccaggga

SEQ ID NO: 4096633 - RNA, 22 nt, West Nile virus
ucaggccagauuaaugcugcca

SEQ ID NO: 4096634 - RNA, 14 nt, West Nile virus
ucucggaaggagga

SEQ ID NO: 4096635 - RNA, 21 nt, West Nile virus
ugccugcggcucaaccccagg

SEQ ID NO: 4096636 - RNA, 14 nt, West Nile virus
ugcggcucaacccc

SEQ ID NO: 4096637 - RNA, 14 nt, West Nile virus
ugcuagaacacagg

SEQ ID NO: 4096638 - RNA, 20 nt, West Nile virus
uggcuaugguguuaaccagg

SEQ ID NO: 4096639 - RNA, 23 nt, Western equine encephalomyelitis virus
aaaacucgauguauuuccgagga

SEQ ID NO: 4096640 - RNA, 17 nt, Western equine encephalomyelitis virus
aaaguucacacagcugc

SEQ ID NO: 4096641 - RNA, 15 nt, Western equine encephalomyelitis virus
aaccuggagaucacg

SEQ ID NO: 4096642 - RNA, 14 nt, Western equine encephalomyelitis virus
aagagacugccuga

SEQ ID NO: 4096643 - RNA, 12 nt, Western equine encephalomyelitis virus
aagcacagugca

SEQ ID NO: 4096644 - RNA, 13 nt, Western equine encephalomyelitis virus
aaguccaccugca

SEQ ID NO: 4096645 - RNA, 22 nt, Western equine encephalomyelitis virus
aaguguggcgacuacagcacag

SEQ ID NO: 4096646 - RNA, 17 nt, Western equine encephalomyelitis virus
acacgcugcuggagaac

SEQ ID NO: 4096647 - RNA, 22 nt, Western equine encephalomyelitis virus
acacugaccagucccuaccugg

SEQ ID NO: 4096648 - RNA, 18 nt, Western equine encephalomyelitis virus
acagucauuccuucacca

SEQ ID NO: 4096649 - RNA, 15 nt, Western equine encephalomyelitis virus
acauuuuagcacauc

SEQ ID NO: 4096650 - RNA, 20 nt, Western equine encephalomyelitis virus
accaaccguuucucugggca

SEQ ID NO: 4096651 - RNA, 14 nt, Western equine encephalomyelitis virus
accacucagugcaa

SEQ ID NO: 4096652 - RNA, 21 nt, Western equine encephalomyelitis virus
accaugaaccagucagagucu

SEQ ID NO: 4096653 - RNA, 24 nt, Western equine encephalomyelitis virus
acgaucacuugaaggagacgucug

SEQ ID NO: 4096654 - RNA, 20 nt, Western equine encephalomyelitis virus
acuaaagcaaaacagugcau

SEQ ID NO: 4096655 - RNA, 16 nt, Western equine encephalomyelitis virus
acuacauauuaacaac

SEQ ID NO: 4096656 - RNA, 11 nt, Western equine encephalomyelitis virus
acucagugcaa

SEQ ID NO: 4096657 - RNA, 20 nt, Western equine encephalomyelitis virus
acugagcgcggacacugaca

SEQ ID NO: 4096658 - RNA, 15 nt, Western equine encephalomyelitis virus
acuuccgaggaagcg

SEQ ID NO: 4096659 - RNA, 16 nt, Western equine encephalomyelitis virus
agacaguauggagaaa

SEQ ID NO: 4096660 - RNA, 21 nt, Western equine encephalomyelitis virus
agccuaaaccagggaaacgac

SEQ ID NO: 4096661 - RNA, 22 nt, Western equine encephalomyelitis virus
agcugcacaguagcagacugca

SEQ ID NO: 4096662 - RNA, 18 nt, Western equine encephalomyelitis virus
agcuguuuugaaggaagc

SEQ ID NO: 4096663 - RNA, 15 nt, Western equine encephalomyelitis virus
agguccaccgccaaa

SEQ ID NO: 4096664 - RNA, 20 nt, Western equine encephalomyelitis virus
agguucugaaccguggucac

SEQ ID NO: 4096665 - RNA, 17 nt, Western equine encephalomyelitis virus
agugcuccuaagccaaa

SEQ ID NO: 4096666 - RNA, 12 nt, Western equine encephalomyelitis virus
aguucacacagc

SEQ ID NO: 4096667 - RNA, 15 nt, Western equine encephalomyelitis virus
auagcgguaaaacuc

SEQ ID NO: 4096668 - RNA, 16 nt, Western equine encephalomyelitis virus
aucagacacgcugcag

SEQ ID NO: 4096669 - RNA, 19 nt, Western equine encephalomyelitis virus
auggagcuaugaaaccagg

SEQ ID NO: 4096670 - RNA, 18 nt, Western equine encephalomyelitis virus
auuacaguacaaagcuga

SEQ ID NO: 4096671 - RNA, 14 nt, Western equine encephalomyelitis virus
auuaggcacacaga

SEQ ID NO: 4096672 - RNA, 16 nt, Western equine encephalomyelitis virus
auuccauuccgcuuga

SEQ ID NO: 4096673 - RNA, 15 nt, Western equine encephalomyelitis virus
caaaggcggauuaca

SEQ ID NO: 4096674 - RNA, 14 nt, Western equine encephalomyelitis virus
cacagucauuccuu

SEQ ID NO: 4096675 - RNA, 15 nt, Western equine encephalomyelitis virus
cacaguugugcauuc

SEQ ID NO: 4096676 - RNA, 16 nt, Western equine encephalomyelitis virus
caccagcgacaaacca

SEQ ID NO: 4096677 - RNA, 17 nt, Western equine encephalomyelitis virus
caccgccaaagaagaag

SEQ ID NO: 4096678 - RNA, 13 nt, Western equine encephalomyelitis virus
cacgccggcccaa

SEQ ID NO: 4096679 - RNA, 18 nt, Western equine encephalomyelitis virus
cagccuaaaaagaagaag

SEQ ID NO: 4096680 - RNA, 18 nt, Western equine encephalomyelitis virus
cagcuguuuugaaggaag

SEQ ID NO: 4096681 - RNA, 18 nt, Western equine encephalomyelitis virus
caggcgucugccugggga

SEQ ID NO: 4096682 - RNA, 19 nt, Western equine encephalomyelitis virus
cagguccaccgccaaagaa

SEQ ID NO: 4096683 - RNA, 19 nt, Western equine encephalomyelitis virus
caguggucacuuggaacca

SEQ ID NO: 4096684 - RNA, 21 nt, Western equine encephalomyelitis virus
cauuaccgaugacuucacacu

SEQ ID NO: 4096685 - RNA, 12 nt, Western equine encephalomyelitis virus
ccaagaauucca

SEQ ID NO: 4096686 - RNA, 20 nt, Western equine encephalomyelitis virus
ccaccaguuuacccuacaaa

SEQ ID NO: 4096687 - RNA, 17 nt, Western equine encephalomyelitis virus
cccuccuaggcgccgcu

SEQ ID NO: 4096688 - RNA, 21 nt, Western equine encephalomyelitis virus
ccgaggaagcguggugcauaa

SEQ ID NO: 4096689 - RNA, 12 nt, Western equine encephalomyelitis virus
ccgaucaugcug

SEQ ID NO: 4096690 - RNA, 14 nt, Western equine encephalomyelitis virus
ccugacugcaaugc

SEQ ID NO: 4096691 - RNA, 13 nt, Western equine encephalomyelitis virus
ccugcaaauucca

SEQ ID NO: 4096692 - RNA, 17 nt, Western equine encephalomyelitis virus
ccugcaagaaacagcac

SEQ ID NO: 4096693 - RNA, 23 nt, Western equine encephalomyelitis virus
ccugcguugucggaggaaggcug

SEQ ID NO: 4096694 - RNA, 21 nt, Western equine encephalomyelitis virus
ccuggauacguuugucaaugg

SEQ ID NO: 4096695 - RNA, 19 nt, Western equine encephalomyelitis virus
ccuguuagcucaauguccu

SEQ ID NO: 4096696 - RNA, 15 nt, Western equine encephalomyelitis virus
cgauguacuuccgag

SEQ ID NO: 4096697 - RNA, 15 nt, Western equine encephalomyelitis virus
cgauguauuuccgag

SEQ ID NO: 4096698 - RNA, 14 nt, Western equine encephalomyelitis virus
cgccaaagaagaag

SEQ ID NO: 4096699 - RNA, 13 nt, Western equine encephalomyelitis virus
cgcgcuugcaccg

SEQ ID NO: 4096700 - RNA, 17 nt, Western equine encephalomyelitis virus
cggcaagaaguccaccu

SEQ ID NO: 4096701 - RNA, 23 nt, Western equine encephalomyelitis virus
cguacggcgcuuucaguggucac

SEQ ID NO: 4096702 - RNA, 21 nt, Western equine encephalomyelitis virus
cguucggcgauauucaagcau

SEQ ID NO: 4096703 - RNA, 17 nt, Western equine encephalomyelitis virus
cuaggaggugcaaauga

SEQ ID NO: 4096704 - RNA, 20 nt, Western equine encephalomyelitis virus
cucuaauauacacuacacau

SEQ ID NO: 4096705 - RNA, 21 nt, Western equine encephalomyelitis virus
cugaaacauuuggagaaacuu

SEQ ID NO: 4096706 - RNA, 14 nt, Western equine encephalomyelitis virus
cugaaccgugguca

SEQ ID NO: 4096707 - RNA, 16 nt, Western equine encephalomyelitis virus
cuggcugcuugcacug

SEQ ID NO: 4096708 - RNA, 18 nt, Western equine encephalomyelitis virus
gaaacagcaccauuugga

SEQ ID NO: 4096709 - RNA, 17 nt, Western equine encephalomyelitis virus
gaaauguggaagaacaa

SEQ ID NO: 4096710 - RNA, 15 nt, Western equine encephalomyelitis virus
gaagagacugccuga

SEQ ID NO: 4096711 - RNA, 19 nt, Western equine encephalomyelitis virus
gacagcuguuuugaaggaa

SEQ ID NO: 4096712 - RNA, 15 nt, Western equine encephalomyelitis virus
gacauacggcugcug

SEQ ID NO: 4096713 - RNA, 17 nt, Western equine encephalomyelitis virus
gacauagcgguaaaacu

SEQ ID NO: 4096714 - RNA, 16 nt, Western equine encephalomyelitis virus
gaccacacaugugacu

SEQ ID NO: 4096715 - RNA, 18 nt, Western equine encephalomyelitis virus
gaggaagcguggugcaua

SEQ ID NO: 4096716 - RNA, 22 nt, Western equine encephalomyelitis virus
gaugcagcuuuugugagaucau

SEQ ID NO: 4096717 - RNA, 15 nt, Western equine encephalomyelitis virus
gcaacgguacccaca

SEQ ID NO: 4096718 - RNA, 20 nt, Western equine encephalomyelitis virus
gcaagaagagacugccugac

SEQ ID NO: 4096719 - RNA, 17 nt, Western equine encephalomyelitis virus
gcaccaggcgacccaca

SEQ ID NO: 4096720 - RNA, 17 nt, Western equine encephalomyelitis virus
gcacugcggaugucacc

SEQ ID NO: 4096721 - RNA, 16 nt, Western equine encephalomyelitis virus
gcagacgcaacagcag

SEQ ID NO: 4096722 - RNA, 20 nt, Western equine encephalomyelitis virus
gcagacgcaacagcagaaug

SEQ ID NO: 4096723 - RNA, 16 nt, Western equine encephalomyelitis virus
gcaggcgucugccugg

SEQ ID NO: 4096724 - RNA, 18 nt, Western equine encephalomyelitis virus
gccgucgucuuggccaca

SEQ ID NO: 4096725 - RNA, 21 nt, Western equine encephalomyelitis virus
gcguauaguauacggcaacac

SEQ ID NO: 4096726 - RNA, 14 nt, Western equine encephalomyelitis virus
gcuccuaagccaaa

SEQ ID NO: 4096727 - RNA, 20 nt, Western equine encephalomyelitis virus
gcucuaugcuuauaaacaca

SEQ ID NO: 4096728 - RNA, 17 nt, Western equine encephalomyelitis virus
gcugaauguaaaccacc

SEQ ID NO: 4096729 - RNA, 13 nt, Western equine encephalomyelitis virus
gcugcaugccuuu

SEQ ID NO: 4096730 - RNA, 15 nt, Western equine encephalomyelitis virus
gcugcugaagccuuc

SEQ ID NO: 4096731 - RNA, 18 nt, Western equine encephalomyelitis virus
gcuucuacaacuggcacc

SEQ ID NO: 4096732 - RNA, 14 nt, Western equine encephalomyelitis virus
ggaacuggcugcuu

SEQ ID NO: 4096733 - RNA, 16 nt, Western equine encephalomyelitis virus
ggaagcguggugcaua

SEQ ID NO: 4096734 - RNA, 18 nt, Western equine encephalomyelitis virus
ggcaccaggcgacccaca

SEQ ID NO: 4096735 - RNA, 17 nt, Western equine encephalomyelitis virus
ggcugcucaaaucgaag

SEQ ID NO: 4096736 - RNA, 17 nt, Western equine encephalomyelitis virus
ggguaaccaugaaccag

SEQ ID NO: 4096737 - RNA, 17 nt, Western equine encephalomyelitis virus
guccaccgccaaagaag

SEQ ID NO: 4096738 - RNA, 22 nt, Western equine encephalomyelitis virus
guccaguucacucccacuccac

SEQ ID NO: 4096739 - RNA, 16 nt, Western equine encephalomyelitis virus
guccauggaaagcugg

SEQ ID NO: 4096740 - RNA, 23 nt, Western equine encephalomyelitis virus
gugaccugcaaauuccacacagu

SEQ ID NO: 4096741 - RNA, 23 nt, Western equine encephalomyelitis virus
uaaaccaccggccgaccacauaa

SEQ ID NO: 4096742 - RNA, 16 nt, Western equine encephalomyelitis virus
uacauauuaacaacac

SEQ ID NO: 4096743 - RNA, 22 nt, Western equine encephalomyelitis virus
uacgugaccugcaaauuccaca

SEQ ID NO: 4096744 - RNA, 15 nt, Western equine encephalomyelitis virus
uauacggcaacacca

SEQ ID NO: 4096745 - RNA, 23 nt, Western equine encephalomyelitis virus
uaugcggcaagaaguccaccugc

SEQ ID NO: 4096746 - RNA, 18 nt, Western equine encephalomyelitis virus
uauggagcuaugaaacca

SEQ ID NO: 4096747 - RNA, 15 nt, Western equine encephalomyelitis virus
ucacccuccaccuga

SEQ ID NO: 4096748 - RNA, 17 nt, Western equine encephalomyelitis virus
ucccaugcgacaaacca

SEQ ID NO: 4096749 - RNA, 22 nt, Western equine encephalomyelitis virus
ucugcccguauugcagacacuc

SEQ ID NO: 4096750 - RNA, 12 nt, Western equine encephalomyelitis virus
ugaagaaggcua

SEQ ID NO: 4096751 - RNA, 17 nt, Western equine encephalomyelitis virus
ugaugaaaccacuccac

SEQ ID NO: 4096752 - RNA, 22 nt, Western equine encephalomyelitis virus
ugcaaugcgaccaacauugcug

SEQ ID NO: 4096753 - RNA, 14 nt, Western equine encephalomyelitis virus
ugcaucaucagcag

SEQ ID NO: 4096754 - RNA, 16 nt, Western equine encephalomyelitis virus
ugcaucgccaaagcaa

SEQ ID NO: 4096755 - RNA, 14 nt, Western equine encephalomyelitis virus
ugccguaggcagca

SEQ ID NO: 4096756 - RNA, 17 nt, Western equine encephalomyelitis virus
ugcucgaagagaacguc

SEQ ID NO: 4096757 - RNA, 21 nt, Western equine encephalomyelitis virus
uggauggccgcaugagaucau

SEQ ID NO: 4096758 - RNA, 14 nt, Western equine encephalomyelitis virus
uuaacaacacuaua

SEQ ID NO: 4096759 - RNA, 23 nt, Western equine encephalomyelitis virus
uuagcgguuuugugcugcauucg

SEQ ID NO: 4096760 - RNA, 16 nt, Western equine encephalomyelitis virus
uucacacagcugcucu

SEQ ID NO: 4096761 - RNA, 17 nt, Western equine encephalomyelitis virus
uuggaacuggcugcuug

SEQ ID NO: 4096762 - RNA, 19 nt, Western equine encephalomyelitis virus
uuuacuuaaaaacacuaua

SEQ ID NO: 4096763 - RNA, 23 nt, Western equine encephalomyelitis virus
aaaacucgauguacuuccgagga

SEQ ID NO: 4096764 - RNA, 21 nt, Western equine encephalomyelitis virus
aaacaucuuggaacuggcugc

SEQ ID NO: 4096765 - RNA, 15 nt, Western equine encephalomyelitis virus
aaacauuuggagaaa

SEQ ID NO: 4096766 - RNA, 16 nt, Western equine encephalomyelitis virus
aaacauuuggagaaac

SEQ ID NO: 4096767 - RNA, 12 nt, Western equine encephalomyelitis virus
aacgaacacucg

SEQ ID NO: 4096768 - RNA, 15 nt, Western equine encephalomyelitis virus
aagaagagacugccu

SEQ ID NO: 4096769 - RNA, 16 nt, Western equine encephalomyelitis virus
aagaugaacggcugca

SEQ ID NO: 4096770 - RNA, 20 nt, Western equine encephalomyelitis virus
aagccuucugucaagaacau

SEQ ID NO: 4096771 - RNA, 17 nt, Western equine encephalomyelitis virus
aaguucacacagcugcu

SEQ ID NO: 4096772 - RNA, 18 nt, Western equine encephalomyelitis virus
acaacagaggcagaguug

SEQ ID NO: 4096773 - RNA, 18 nt, Western equine encephalomyelitis virus
acaacguauguguaugaa

SEQ ID NO: 4096774 - RNA, 12 nt, Western equine encephalomyelitis virus
acacuaaaacuc

SEQ ID NO: 4096775 - RNA, 11 nt, Western equine encephalomyelitis virus
acagcaccauu

SEQ ID NO: 4096776 - RNA, 20 nt, Western equine encephalomyelitis virus
accugcaaauuccacacagu

SEQ ID NO: 4096777 - RNA, 18 nt, Western equine encephalomyelitis virus
acgcaagccuaaaccagg

SEQ ID NO: 4096778 - RNA, 18 nt, Western equine encephalomyelitis virus
acgcugcuggagaacguc

SEQ ID NO: 4096779 - RNA, 21 nt, Western equine encephalomyelitis virus
acucagccuaaaaagaagaag

SEQ ID NO: 4096780 - RNA, 23 nt, Western equine encephalomyelitis virus
acuccacguugaaggaaaaauug

SEQ ID NO: 4096781 - RNA, 22 nt, Western equine encephalomyelitis virus
acucgauguauuuccgaggaag

SEQ ID NO: 4096782 - RNA, 20 nt, Western equine encephalomyelitis virus
agcaagaagagacugccuga

SEQ ID NO: 4096783 - RNA, 16 nt, Western equine encephalomyelitis virus
agcgguaaaacucgau

SEQ ID NO: 4096784 - RNA, 16 nt, Western equine encephalomyelitis virus
agcuaucagcacaucu

SEQ ID NO: 4096785 - RNA, 16 nt, Western equine encephalomyelitis virus
agcuugcaucgccaaa

SEQ ID NO: 4096786 - RNA, 15 nt, Western equine encephalomyelitis virus
aggacgaaacgcaag

SEQ ID NO: 4096787 - RNA, 16 nt, Western equine encephalomyelitis virus
aggcacacagaccacu

SEQ ID NO: 4096788 - RNA, 19 nt, Western equine encephalomyelitis virus
agguccaccgccaaagaag

SEQ ID NO: 4096789 - RNA, 16 nt, Western equine encephalomyelitis virus
aguacgugaccugcaa

SEQ ID NO: 4096790 - RNA, 20 nt, Western equine encephalomyelitis virus
aguccuaucuggaggaagcg

SEQ ID NO: 4096791 - RNA, 17 nt, Western equine encephalomyelitis virus
agucugggcccaggagu

SEQ ID NO: 4096792 - RNA, 15 nt, Western equine encephalomyelitis virus
aucagcagcuugcau

SEQ ID NO: 4096793 - RNA, 17 nt, Western equine encephalomyelitis virus
aucugugguuuaacaac

SEQ ID NO: 4096794 - RNA, 23 nt, Western equine encephalomyelitis virus
auuuccgaggaagcacagugcau

SEQ ID NO: 4096795 - RNA, 17 nt, Western equine encephalomyelitis virus
caaauuccacacaguca

SEQ ID NO: 4096796 - RNA, 14 nt, Western equine encephalomyelitis virus
caagaggacgaaac

SEQ ID NO: 4096797 - RNA, 21 nt, Western equine encephalomyelitis virus
caccagcgacaaaccaccggg

SEQ ID NO: 4096798 - RNA, 19 nt, Western equine encephalomyelitis virus
caccaggcgacccacaugg

SEQ ID NO: 4096799 - RNA, 20 nt, Western equine encephalomyelitis virus
cacgagcggagcaucugaga

SEQ ID NO: 4096800 - RNA, 21 nt, Western equine encephalomyelitis virus
cacgcgccgcuugacacuaaa

SEQ ID NO: 4096801 - RNA, 23 nt, Western equine encephalomyelitis virus
cacguuuacgaucacuugaagga

SEQ ID NO: 4096802 - RNA, 15 nt, Western equine encephalomyelitis virus
caugaaccagucaga

SEQ ID NO: 4096803 - RNA, 18 nt, Western equine encephalomyelitis virus
caugcaccguggagaaaa

SEQ ID NO: 4096804 - RNA, 16 nt, Western equine encephalomyelitis virus
caugcgacaaaccacc

SEQ ID NO: 4096805 - RNA, 24 nt, Western equine encephalomyelitis virus
cauuaaucguauaucacacuacau

SEQ ID NO: 4096806 - RNA, 13 nt, Western equine encephalomyelitis virus
cauuccuucacca

SEQ ID NO: 4096807 - RNA, 14 nt, Western equine encephalomyelitis virus
ccaacauugcugac

SEQ ID NO: 4096808 - RNA, 11 nt, Western equine encephalomyelitis virus
ccagaaagggg

SEQ ID NO: 4096809 - RNA, 21 nt, Western equine encephalomyelitis virus
cccgugugcuauucacugacg

SEQ ID NO: 4096810 - RNA, 15 nt, Western equine encephalomyelitis virus
cccucgagugcaagg

SEQ ID NO: 4096811 - RNA, 11 nt, Western equine encephalomyelitis virus
ccgagaggagu

SEQ ID NO: 4096812 - RNA, 19 nt, Western equine encephalomyelitis virus
ccgaggaagcacagugcau

SEQ ID NO: 4096813 - RNA, 20 nt, Western equine encephalomyelitis virus
ccgaggaagcacagugcaua

SEQ ID NO: 4096814 - RNA, 20 nt, Western equine encephalomyelitis virus
ccgaggaagcguggugcaua

SEQ ID NO: 4096815 - RNA, 20 nt, Western equine encephalomyelitis virus
ccgaugacuucacacugacc

SEQ ID NO: 4096816 - RNA, 22 nt, Western equine encephalomyelitis virus
ccgcuugacacuaaaacucgau

SEQ ID NO: 4096817 - RNA, 15 nt, Western equine encephalomyelitis virus
ccuacucagccuaaa

SEQ ID NO: 4096818 - RNA, 19 nt, Western equine encephalomyelitis virus
cgaccaugacaucaaggaa

SEQ ID NO: 4096819 - RNA, 12 nt, Western equine encephalomyelitis virus
cgaggaagcgug

SEQ ID NO: 4096820 - RNA, 18 nt, Western equine encephalomyelitis virus
cgauguacuuccgaggaa

SEQ ID NO: 4096821 - RNA, 18 nt, Western equine encephalomyelitis virus
cgauguauuuccgaggaa

SEQ ID NO: 4096822 - RNA, 22 nt, Western equine encephalomyelitis virus
cggaggaaggcugaugaaacca

SEQ ID NO: 4096823 - RNA, 12 nt, Western equine encephalomyelitis virus
cggcaacaccac

SEQ ID NO: 4096824 - RNA, 20 nt, Western equine encephalomyelitis virus
cguaggcagcauaacacuac

SEQ ID NO: 4096825 - RNA, 20 nt, Western equine encephalomyelitis virus
cgucugccuggggaagguag

SEQ ID NO: 4096826 - RNA, 12 nt, Western equine encephalomyelitis virus
cguugaaggaaa

SEQ ID NO: 4096827 - RNA, 21 nt, Western equine encephalomyelitis virus
cucgauguauuuccgaggaag

SEQ ID NO: 4096828 - RNA, 20 nt, Western equine encephalomyelitis virus
cugacauagcgguaaaacuc

SEQ ID NO: 4096829 - RNA, 18 nt, Western equine encephalomyelitis virus
cugcguugucggaggaag

SEQ ID NO: 4096830 - RNA, 22 nt, Western equine encephalomyelitis virus
cugcguugucggaggaaggcug

SEQ ID NO: 4096831 - RNA, 18 nt, Western equine encephalomyelitis virus
gaagaugaacggcugcac

SEQ ID NO: 4096832 - RNA, 18 nt, Western equine encephalomyelitis virus
gaaggagacgucugccgg

SEQ ID NO: 4096833 - RNA, 23 nt, Western equine encephalomyelitis virus
gaccacauaauuggagaaccaca

SEQ ID NO: 4096834 - RNA, 15 nt, Western equine encephalomyelitis virus
gagaacgucuugaaa

SEQ ID NO: 4096835 - RNA, 19 nt, Western equine encephalomyelitis virus
gauguacuuccgaggaagc

SEQ ID NO: 4096836 - RNA, 16 nt, Western equine encephalomyelitis virus
gcacaucgagcccaca

SEQ ID NO: 4096837 - RNA, 23 nt, Western equine encephalomyelitis virus
gccaagugaauggauaugccugc

SEQ ID NO: 4096838 - RNA, 16 nt, Western equine encephalomyelitis virus
gccacgcgccgcuuga

SEQ ID NO: 4096839 - RNA, 14 nt, Western equine encephalomyelitis virus
gccguaggcagcau

SEQ ID NO: 4096840 - RNA, 15 nt, Western equine encephalomyelitis virus
gcucugaaagucggc

SEQ ID NO: 4096841 - RNA, 21 nt, Western equine encephalomyelitis virus
gcuucuacaacuggcaccacg

SEQ ID NO: 4096842 - RNA, 20 nt, Western equine encephalomyelitis virus
gcuugacaccgacagucugc

SEQ ID NO: 4096843 - RNA, 16 nt, Western equine encephalomyelitis virus
ggaagcacagugcaua

SEQ ID NO: 4096844 - RNA, 14 nt, Western equine encephalomyelitis virus
ggcagcauaacacu

SEQ ID NO: 4096845 - RNA, 13 nt, Western equine encephalomyelitis virus
ggccaggcccaca

SEQ ID NO: 4096846 - RNA, 22 nt, Western equine encephalomyelitis virus
gggcccaggagucggcaccagg

SEQ ID NO: 4096847 - RNA, 14 nt, Western equine encephalomyelitis virus
uaaaaauugagaac

SEQ ID NO: 4096848 - RNA, 17 nt, Western equine encephalomyelitis virus
uacccaccggcagaaug

SEQ ID NO: 4096849 - RNA, 20 nt, Western equine encephalomyelitis virus
uaugaaauguggaagaacaa

SEQ ID NO: 4096850 - RNA, 16 nt, Western equine encephalomyelitis virus
ucacacagcugcucug

SEQ ID NO: 4096851 - RNA, 14 nt, Western equine encephalomyelitis virus
uccgcuugacaccg

SEQ ID NO: 4096852 - RNA, 21 nt, Western equine encephalomyelitis virus
uccucaaaggcggauuacaca

SEQ ID NO: 4096853 - RNA, 12 nt, Western equine encephalomyelitis virus
ucgaaugucacg

SEQ ID NO: 4096854 - RNA, 22 nt, Western equine encephalomyelitis virus
ucugugacagugagaacacaca

SEQ ID NO: 4096855 - RNA, 16 nt, Western equine encephalomyelitis virus
ugaaauguggaagaac

SEQ ID NO: 4096856 - RNA, 22 nt, Western equine encephalomyelitis virus
ugaagccuucugucaagaacau

SEQ ID NO: 4096857 - RNA, 18 nt, Western equine encephalomyelitis virus
ugaccagucccuaccugg

SEQ ID NO: 4096858 - RNA, 15 nt, Western equine encephalomyelitis virus
ugcaaggcauccuca

SEQ ID NO: 4096859 - RNA, 23 nt, Western equine encephalomyelitis virus
uggagaaaaagaucaggaggaag

SEQ ID NO: 4096860 - RNA, 18 nt, Western equine encephalomyelitis virus
ugguucaaaggcaucacc

SEQ ID NO: 4096861 - RNA, 12 nt, Western equine encephalomyelitis virus
ugugcugcauuc

SEQ ID NO: 4096862 - RNA, 15 nt, Western equine encephalomyelitis virus
uugacacuaaaacuc

SEQ ID NO: 4096863 - RNA, 18 nt, Western equine encephalomyelitis virus
cacuacauuuuagcacau

SEQ ID NO: 4096864 - RNA, 14 nt, Western equine encephalomyelitis virus
cacuauacacacuu

SEQ ID NO: 4096865 - RNA, 12 nt, Western equine encephalomyelitis virus
cacuauaucacu

SEQ ID NO: 4096866 - RNA, 13 nt, Western equine encephalomyelitis virus
cacuugaaggaga

SEQ ID NO: 4096867 - RNA, 15 nt, Western equine encephalomyelitis virus
cagcgacaaaccacc

SEQ ID NO: 4096868 - RNA, 18 nt, Western equine encephalomyelitis virus
caggagucggcaccaggc

SEQ ID NO: 4096869 - RNA, 19 nt, Western equine encephalomyelitis virus
cagucuacacugucauugu

SEQ ID NO: 4096870 - RNA, 23 nt, Western equine encephalomyelitis virus
cauaaugcugugcagugucacau

SEQ ID NO: 4096871 - RNA, 13 nt, Western equine encephalomyelitis virus
caucagaaagggg

SEQ ID NO: 4096872 - RNA, 18 nt, Western equine encephalomyelitis virus
caucccugaugcagcuuu

SEQ ID NO: 4096873 - RNA, 16 nt, Western equine encephalomyelitis virus
caugcacaggccaggc

SEQ ID NO: 4096874 - RNA, 13 nt, Western equine encephalomyelitis virus
ccacguugaagga

SEQ ID NO: 4096875 - RNA, 12 nt, Western equine encephalomyelitis virus
cccgcacugaca

SEQ ID NO: 4096876 - RNA, 13 nt, Western equine encephalomyelitis virus
cccugaguaugga

SEQ ID NO: 4096877 - RNA, 11 nt, Western equine encephalomyelitis virus
ccgaggaagca

SEQ ID NO: 4096878 - RNA, 11 nt, Western equine encephalomyelitis virus
ccgcuggcugc

SEQ ID NO: 4096879 - RNA, 21 nt, Western equine encephalomyelitis virus
ccgugaaauugaagaaggcua

SEQ ID NO: 4096880 - RNA, 19 nt, Western equine encephalomyelitis virus
cgauguacuuccgaggaag

SEQ ID NO: 4096881 - RNA, 11 nt, Western equine encephalomyelitis virus
cgccgccaggu

SEQ ID NO: 4096882 - RNA, 22 nt, Western equine encephalomyelitis virus
cgccuucgaacaugcgaccacu

SEQ ID NO: 4096883 - RNA, 18 nt, Western equine encephalomyelitis virus
cggcccccgcuggcugcu

SEQ ID NO: 4096884 - RNA, 13 nt, Western equine encephalomyelitis virus
cgucacgccaggu

SEQ ID NO: 4096885 - RNA, 15 nt, Western equine encephalomyelitis virus
cguugucggaggaag

SEQ ID NO: 4096886 - RNA, 17 nt, Western equine encephalomyelitis virus
cuccacgacagcuguuu

SEQ ID NO: 4096887 - RNA, 23 nt, Western equine encephalomyelitis virus
cugacagggagggacauugucca

SEQ ID NO: 4096888 - RNA, 23 nt, Western equine encephalomyelitis virus
cugcacaguagcagacugcauuu

SEQ ID NO: 4096889 - RNA, 15 nt, Western equine encephalomyelitis virus
cugcuuuucaugcug

SEQ ID NO: 4096890 - RNA, 13 nt, Western equine encephalomyelitis virus
cuugaaaugucca

SEQ ID NO: 4096891 - RNA, 14 nt, Western equine encephalomyelitis virus
cuugacacuaaaac

SEQ ID NO: 4096892 - RNA, 16 nt, Western equine encephalomyelitis virus
cuuggaacuggcugcu

SEQ ID NO: 4096893 - RNA, 18 nt, Western equine encephalomyelitis virus
cuuggaacuggcugcuug

SEQ ID NO: 4096894 - RNA, 12 nt, Western equine encephalomyelitis virus
gaaacauuugga

SEQ ID NO: 4096895 - RNA, 16 nt, Western equine encephalomyelitis virus
gaagcguggugcauaa

SEQ ID NO: 4096896 - RNA, 14 nt, Western equine encephalomyelitis virus
gaucacgcagucgc

SEQ ID NO: 4096897 - RNA, 19 nt, Western equine encephalomyelitis virus
gaucuuauuaggcacacag

SEQ ID NO: 4096898 - RNA, 21 nt, Western equine encephalomyelitis virus
gauguauuuccgaggaagcac

SEQ ID NO: 4096899 - RNA, 19 nt, Western equine encephalomyelitis virus
gcacaguugugcauuccuc

SEQ ID NO: 4096900 - RNA, 13 nt, Western equine encephalomyelitis virus
gcacugcaucauc

SEQ ID NO: 4096901 - RNA, 23 nt, Western equine encephalomyelitis virus
gcacuguuugggggagcaucauc

SEQ ID NO: 4096902 - RNA, 22 nt, Western equine encephalomyelitis virus
gcaucacccuccaccugacugc

SEQ ID NO: 4096903 - RNA, 11 nt, Western equine encephalomyelitis virus
gccaaagcaag

SEQ ID NO: 4096904 - RNA, 14 nt, Western equine encephalomyelitis virus
gcccaggagucggc

SEQ ID NO: 4096905 - RNA, 21 nt, Western equine encephalomyelitis virus
gccggaucuuauuaggcacac

SEQ ID NO: 4096906 - RNA, 23 nt, Western equine encephalomyelitis virus
gccuggggaagguagacgccuuc

SEQ ID NO: 4096907 - RNA, 13 nt, Western equine encephalomyelitis virus
gcgacaaaccacc

SEQ ID NO: 4096908 - RNA, 23 nt, Western equine encephalomyelitis virus
gcgcagguuacgcgccacuuaac

SEQ ID NO: 4096909 - RNA, 13 nt, Western equine encephalomyelitis virus
gcuccagacugca

SEQ ID NO: 4096910 - RNA, 11 nt, Western equine encephalomyelitis virus
gcuggcugcuc

SEQ ID NO: 4096911 - RNA, 17 nt, Western equine encephalomyelitis virus
ggaggugcaaaugaggg

SEQ ID NO: 4096912 - RNA, 13 nt, Western equine encephalomyelitis virus
ggcccaaacgaag

SEQ ID NO: 4096913 - RNA, 16 nt, Western equine encephalomyelitis virus
ggccgugaaauugaag

SEQ ID NO: 4096914 - RNA, 17 nt, Western equine encephalomyelitis virus
ggcugcacuaaagcaaa

SEQ ID NO: 4096915 - RNA, 13 nt, Western equine encephalomyelitis virus
gguaaaacucgau

SEQ ID NO: 4096916 - RNA, 16 nt, Western equine encephalomyelitis virus
ggucacuuggaaccag

SEQ ID NO: 4096917 - RNA, 23 nt, Western equine encephalomyelitis virus
ggucauagcagggccgauaucag

SEQ ID NO: 4096918 - RNA, 17 nt, Western equine encephalomyelitis virus
guaaaacucgauguacu

SEQ ID NO: 4096919 - RNA, 15 nt, Western equine encephalomyelitis virus
guacauuaaaccacc

SEQ ID NO: 4096920 - RNA, 13 nt, Western equine encephalomyelitis virus
guagaugacugag

SEQ ID NO: 4096921 - RNA, 15 nt, Western equine encephalomyelitis virus
guggucacuuggaac

SEQ ID NO: 4096922 - RNA, 22 nt, Western equine encephalomyelitis virus
guucacucccacuccacgacag

SEQ ID NO: 4096923 - RNA, 21 nt, Western equine encephalomyelitis virus
guucccaugcgacaaaccacc

SEQ ID NO: 4096924 - RNA, 14 nt, Western equine encephalomyelitis virus
uaaaaguucacaca

SEQ ID NO: 4096925 - RNA, 23 nt, Western equine encephalomyelitis virus
uagcggccgugaaauugaagaag

SEQ ID NO: 4096926 - RNA, 22 nt, Western equine encephalomyelitis virus
uagucaacuugacuuucaaaca

SEQ ID NO: 4096927 - RNA, 23 nt, Western equine encephalomyelitis virus
uccaaacccuccuaggcgccgcu

SEQ ID NO: 4096928 - RNA, 21 nt, Western equine encephalomyelitis virus
ucggcuacaaucaggcaggca

SEQ ID NO: 4096929 - RNA, 14 nt, Western equine encephalomyelitis virus
ugaaauugaagaag

SEQ ID NO: 4096930 - RNA, 20 nt, Western equine encephalomyelitis virus
ugaagccuucugucaagaac

SEQ ID NO: 4096931 - RNA, 13 nt, Western equine encephalomyelitis virus
ugagaucaucaga

SEQ ID NO: 4096932 - RNA, 14 nt, Western equine encephalomyelitis virus
ugcaagaaacagca

SEQ ID NO: 4096933 - RNA, 14 nt, Western equine encephalomyelitis virus
ugcaccgaacgcaa

SEQ ID NO: 4096934 - RNA, 14 nt, Western equine encephalomyelitis virus
ugccacgcgccgcu

SEQ ID NO: 4096935 - RNA, 17 nt, Western equine encephalomyelitis virus
ugcccguauugcagaca

SEQ ID NO: 4096936 - RNA, 13 nt, Western equine encephalomyelitis virus
uggaagaacaacu

SEQ ID NO: 4096937 - RNA, 10 nt, Western equine encephalomyelitis virus
uggagaucac

SEQ ID NO: 4096938 - RNA, 13 nt, Western equine encephalomyelitis virus
uguuuugaaggaa

SEQ ID NO: 4096939 - RNA, 19 nt, Western equine encephalomyelitis virus
uucagcccaauaaaaauug

SEQ ID NO: 4096940 - RNA, 16 nt, Western equine encephalomyelitis virus
uucuggcaagaacguc

SEQ ID NO: 4096941 - RNA, 15 nt, Western equine encephalomyelitis virus
uucugucaagaacau

SEQ ID NO: 4096942 - RNA, 19 nt, Western equine encephalomyelitis virus
aaaauagcuaucagcacau

SEQ ID NO: 4096943 - RNA, 14 nt, Western equine encephalomyelitis virus
aaacaucuuggaac

SEQ ID NO: 4096944 - RNA, 17 nt, Western equine encephalomyelitis virus
aaacauuuggagaaacu

SEQ ID NO: 4096945 - RNA, 14 nt, Western equine encephalomyelitis virus
aacgcaagccuaaa

SEQ ID NO: 4096946 - RNA, 19 nt, Western equine encephalomyelitis virus
aacggcugcacuaaagcaa

SEQ ID NO: 4096947 - RNA, 13 nt, Western equine encephalomyelitis virus
aacuggcugcuug

SEQ ID NO: 4096948 - RNA, 14 nt, Western equine encephalomyelitis virus
aacuuugaaccauc

SEQ ID NO: 4096949 - RNA, 15 nt, Western equine encephalomyelitis virus
aagaagaagagugcu

SEQ ID NO: 4096950 - RNA, 18 nt, Western equine encephalomyelitis virus
aagacaguauggagaaaa

SEQ ID NO: 4096951 - RNA, 22 nt, Western equine encephalomyelitis virus
aagaugaacggcugcacuaaag

SEQ ID NO: 4096952 - RNA, 18 nt, Western equine encephalomyelitis virus
aaggcugaugaaaccacu

SEQ ID NO: 4096953 - RNA, 19 nt, Western equine encephalomyelitis virus
aaguguacauuaaaccacc

SEQ ID NO: 4096954 - RNA, 13 nt, Western equine encephalomyelitis virus
aaguucacacagc

SEQ ID NO: 4096955 - RNA, 18 nt, Western equine encephalomyelitis virus
aauuacgacacgcugcug

SEQ ID NO: 4096956 - RNA, 14 nt, Western equine encephalomyelitis virus
acaacagaggcaga

SEQ ID NO: 4096957 - RNA, 20 nt, Western equine encephalomyelitis virus
acagcuguuuugaaggaagc

SEQ ID NO: 4096958 - RNA, 18 nt, Western equine encephalomyelitis virus
acauauuaacaacacuau

SEQ ID NO: 4096959 - RNA, 20 nt, Western equine encephalomyelitis virus
acauggauggccgcaugaga

SEQ ID NO: 4096960 - RNA, 22 nt, Western equine encephalomyelitis virus
accaccuucuggcaagaacguc

SEQ ID NO: 4096961 - RNA, 22 nt, Western equine encephalomyelitis virus
accaugaaccagucagagucug

SEQ ID NO: 4096962 - RNA, 17 nt, Western equine encephalomyelitis virus
accgacagucugcccgg

SEQ ID NO: 4096963 - RNA, 16 nt, Western equine encephalomyelitis virus
accuucaacuaacaag

SEQ ID NO: 4096964 - RNA, 20 nt, Western equine encephalomyelitis virus
acgacacgcugcuggagaac

SEQ ID NO: 4096965 - RNA, 17 nt, Western equine encephalomyelitis virus
acgccagaacgaacacu

SEQ ID NO: 4096966 - RNA, 18 nt, Western equine encephalomyelitis virus
acugacauacggcugcug

SEQ ID NO: 4096967 - RNA, 20 nt, Western equine encephalomyelitis virus
agacugcacuauagaucacg

SEQ ID NO: 4096968 - RNA, 18 nt, Western equine encephalomyelitis virus
agaugaacggcugcacua

SEQ ID NO: 4096969 - RNA, 15 nt, Western equine encephalomyelitis virus
agcaaaacagugcau

SEQ ID NO: 4096970 - RNA, 17 nt, Western equine encephalomyelitis virus
agcaagaagagacugcc

SEQ ID NO: 4096971 - RNA, 20 nt, Western equine encephalomyelitis virus
agcagacgcaacagcagaau

SEQ ID NO: 4096972 - RNA, 17 nt, Western equine encephalomyelitis virus
agccuaaaaagaagaag

SEQ ID NO: 4096973 - RNA, 15 nt, Western equine encephalomyelitis virus
agccuaaaccaggga

SEQ ID NO: 4096974 - RNA, 14 nt, Western equine encephalomyelitis virus
agcgucuaacugug

SEQ ID NO: 4096975 - RNA, 18 nt, Western equine encephalomyelitis virus
agcuaugaaaccaggagc

SEQ ID NO: 4096976 - RNA, 21 nt, Western equine encephalomyelitis virus
agcucaauguccuccagguga

SEQ ID NO: 4096977 - RNA, 14 nt, Western equine encephalomyelitis virus
aggaagcgucaggc

SEQ ID NO: 4096978 - RNA, 16 nt, Western equine encephalomyelitis virus
aguagcagacugcauu

SEQ ID NO: 4096979 - RNA, 16 nt, Western equine encephalomyelitis virus
agucggcaccaggcga

SEQ ID NO: 4096980 - RNA, 16 nt, Western equine encephalomyelitis virus
agugcaagguaaauug

SEQ ID NO: 4096981 - RNA, 21 nt, Western equine encephalomyelitis virus
aguucgcuccagacugcacua

SEQ ID NO: 4096982 - RNA, 22 nt, Western equine encephalomyelitis virus
auaaguccuaucuggaggaagc

SEQ ID NO: 4096983 - RNA, 13 nt, Western equine encephalomyelitis virus
auaauuggagaac

SEQ ID NO: 4096984 - RNA, 23 nt, Western equine encephalomyelitis virus
auacguuugucaauggcgucacg

SEQ ID NO: 4096985 - RNA, 17 nt, Western equine encephalomyelitis virus
auauuaacaacacuaua

SEQ ID NO: 4096986 - RNA, 16 nt, Western equine encephalomyelitis virus
augcaccguggagaaa

SEQ ID NO: 4096987 - RNA, 18 nt, Western equine encephalomyelitis virus
auguauuuccgaggaagc

SEQ ID NO: 4096988 - RNA, 19 nt, Western equine encephalomyelitis virus
auuuuacuuaaaaacacua

SEQ ID NO: 4096989 - RNA, 15 nt, Western equine encephalomyelitis virus
caaauguuccgggga

SEQ ID NO: 4096990 - RNA, 15 nt, Western equine encephalomyelitis virus
cacagaccacucagu

SEQ ID NO: 4096991 - RNA, 21 nt, Western equine encephalomyelitis virus
cacagaccacucagugcaagg

SEQ ID NO: 4096992 - RNA, 19 nt, Western equine encephalomyelitis virus
cacagugcauaaugcugug

SEQ ID NO: 4096993 - RNA, 20 nt, Western equine encephalomyelitis virus
caccagcgacaaaccaccgg

SEQ ID NO: 4096994 - RNA, 12 nt, Western equine encephalomyelitis virus
cacuacacauau

SEQ ID NO: 4096995 - RNA, 16 nt, Western equine encephalomyelitis virus
cagaacgaacacucga

SEQ ID NO: 4096996 - RNA, 16 nt, Western equine encephalomyelitis virus
cagagucugggcccag

SEQ ID NO: 4096997 - RNA, 20 nt, Western equine encephalomyelitis virus
cagcuguuuugaaggaagcg

SEQ ID NO: 4096998 - RNA, 15 nt, Western equine encephalomyelitis virus
caggcgucugccugg

SEQ ID NO: 4096999 - RNA, 16 nt, Western equine encephalomyelitis virus
cauauuaacaacacua

SEQ ID NO: 4097000 - RNA, 20 nt, Western equine encephalomyelitis virus
caugcacaggccaggcccac

SEQ ID NO: 4097001 - RNA, 19 nt, Western equine encephalomyelitis virus
cauuaaucguauaucacac

SEQ ID NO: 4097002 - RNA, 22 nt, Western equine encephalomyelitis virus
cauuaaucguauaucacacuac

SEQ ID NO: 4097003 - RNA, 16 nt, Western equine encephalomyelitis virus
ccacacaugugacugc

SEQ ID NO: 4097004 - RNA, 22 nt, Western equine encephalomyelitis virus
ccacgacagcuguuuugaagga

SEQ ID NO: 4097005 - RNA, 18 nt, Western equine encephalomyelitis virus
ccacugugccaaauguuc

SEQ ID NO: 4097006 - RNA, 21 nt, Western equine encephalomyelitis virus
ccgaggaagcacagugcauaa

SEQ ID NO: 4097007 - RNA, 11 nt, Western equine encephalomyelitis virus
ccgaggaagcg

SEQ ID NO: 4097008 - RNA, 11 nt, Western equine encephalomyelitis virus
ccuaaaccagg

SEQ ID NO: 4097009 - RNA, 14 nt, Western equine encephalomyelitis virus
ccuucugucaagaa

SEQ ID NO: 4097010 - RNA, 19 nt, Western equine encephalomyelitis virus
cgauguauuuccgaggaag

SEQ ID NO: 4097011 - RNA, 19 nt, Western equine encephalomyelitis virus
cgcacuaaaaguucacaca

SEQ ID NO: 4097012 - RNA, 13 nt, Western equine encephalomyelitis virus
cggcauccagucu

SEQ ID NO: 4097013 - RNA, 13 nt, Western equine encephalomyelitis virus
cggccgaccacau

SEQ ID NO: 4097014 - RNA, 14 nt, Western equine encephalomyelitis virus
cgguagagaggagu

SEQ ID NO: 4097015 - RNA, 15 nt, Western equine encephalomyelitis virus
cguaccgagaggagu

SEQ ID NO: 4097016 - RNA, 20 nt, Western equine encephalomyelitis virus
cgugaccugcaaauuccaca

SEQ ID NO: 4097017 - RNA, 14 nt, Western equine encephalomyelitis virus
cuaucuggaggaag

SEQ ID NO: 4097018 - RNA, 21 nt, Western equine encephalomyelitis virus
cucgauguacuuccgaggaag

SEQ ID NO: 4097019 - RNA, 17 nt, Western equine encephalomyelitis virus
cugucaagaacauccac

SEQ ID NO: 4097020 - RNA, 17 nt, Western equine encephalomyelitis virus
cugugacagugagaaca

SEQ ID NO: 4097021 - RNA, 22 nt, Western equine encephalomyelitis virus
cuucaccacaaguuaaaugcug

SEQ ID NO: 4097022 - RNA, 21 nt, Western equine encephalomyelitis virus
gaagccuucugucaagaacau

SEQ ID NO: 4097023 - RNA, 15 nt, Western equine encephalomyelitis virus
gacagugagaacaca

SEQ ID NO: 4097024 - RNA, 13 nt, Western equine encephalomyelitis virus
gacuacagcacag

SEQ ID NO: 4097025 - RNA, 19 nt, Western equine encephalomyelitis virus
gaggaagcacagugcauaa

SEQ ID NO: 4097026 - RNA, 22 nt, Western equine encephalomyelitis virus
gccggaucuuauuaggcacaca

SEQ ID NO: 4097027 - RNA, 15 nt, Western equine encephalomyelitis virus
gcugaugaaaccacu

SEQ ID NO: 4097028 - RNA, 16 nt, Western equine encephalomyelitis virus
gcuguuuugaaggaag

SEQ ID NO: 4097029 - RNA, 16 nt, Western equine encephalomyelitis virus
gcuuucaguggucacu

SEQ ID NO: 4097030 - RNA, 19 nt, Western equine encephalomyelitis virus
ggaucgauuagaauccagg

SEQ ID NO: 4097031 - RNA, 15 nt, Western equine encephalomyelitis virus
ggcacacagaccacu

SEQ ID NO: 4097032 - RNA, 16 nt, Western equine encephalomyelitis virus
guauaucacacuacau

SEQ ID NO: 4097033 - RNA, 16 nt, Western equine encephalomyelitis virus
gucucuaauauacacu

SEQ ID NO: 4097034 - RNA, 22 nt, Western equine encephalomyelitis virus
gucucuaauauacacuacacau

SEQ ID NO: 4097035 - RNA, 15 nt, Western equine encephalomyelitis virus
gugagaacacacaac

SEQ ID NO: 4097036 - RNA, 17 nt, Western equine encephalomyelitis virus
guggagaaaaagaucag

SEQ ID NO: 4097037 - RNA, 14 nt, Western equine encephalomyelitis virus
uaacaacacuauau

SEQ ID NO: 4097038 - RNA, 18 nt, Western equine encephalomyelitis virus
uaacaacacuauaucacu

SEQ ID NO: 4097039 - RNA, 12 nt, Western equine encephalomyelitis virus
uacacacuuuau

SEQ ID NO: 4097040 - RNA, 18 nt, Western equine encephalomyelitis virus
uaccgaugacuucacacu

SEQ ID NO: 4097041 - RNA, 11 nt, Western equine encephalomyelitis virus
uagagaggagu

SEQ ID NO: 4097042 - RNA, 12 nt, Western equine encephalomyelitis virus
uaggcacacaga

SEQ ID NO: 4097043 - RNA, 20 nt, Western equine encephalomyelitis virus
uauggagcuaugaaaccagg

SEQ ID NO: 4097044 - RNA, 15 nt, Western equine encephalomyelitis virus
uauugcagacacuca

SEQ ID NO: 4097045 - RNA, 13 nt, Western equine encephalomyelitis virus
ucacuugaaggag

SEQ ID NO: 4097046 - RNA, 18 nt, Western equine encephalomyelitis virus
ucagcacaucuggacccu

SEQ ID NO: 4097047 - RNA, 15 nt, Western equine encephalomyelitis virus
uccacguugaaggaa

SEQ ID NO: 4097048 - RNA, 22 nt, Western equine encephalomyelitis virus
ugaaauguggaagaacaacuca

SEQ ID NO: 4097049 - RNA, 13 nt, Western equine encephalomyelitis virus
ugacagugagaac

SEQ ID NO: 4097050 - RNA, 17 nt, Western equine encephalomyelitis virus
ugcaaugcgaccaacau

SEQ ID NO: 4097051 - RNA, 15 nt, Western equine encephalomyelitis virus
ugcacauuccauucc

SEQ ID NO: 4097052 - RNA, 13 nt, Western equine encephalomyelitis virus
ugcacuaaagcaa

SEQ ID NO: 4097053 - RNA, 14 nt, Western equine encephalomyelitis virus
ugcagacacucaac

SEQ ID NO: 4097054 - RNA, 14 nt, Western equine encephalomyelitis virus
ugcuggagaacguc

SEQ ID NO: 4097055 - RNA, 18 nt, Western equine encephalomyelitis virus
ugggcgggaaaggcgaca

SEQ ID NO: 4097056 - RNA, 15 nt, Western equine encephalomyelitis virus
uucaugcugcaugcc

SEQ ID NO: 4097057 - RNA, 12 nt, Western equine encephalomyelitis virus
uuccgcugcuuu

SEQ ID NO: 4097058 - RNA, 16 nt, Western equine encephalomyelitis virus
uucugucaagaacauc

SEQ ID NO: 4097059 - RNA, 11 nt, Western equine encephalomyelitis virus
uuggagaacca

SEQ ID NO: 4097060 - RNA, 18 nt, Western equine encephalomyelitis virus
aaaagaagaagcagcaag

SEQ ID NO: 4097061 - RNA, 23 nt, Western equine encephalomyelitis virus
aacgagaaaauuggggcugcgag

SEQ ID NO: 4097062 - RNA, 16 nt, Western equine encephalomyelitis virus
aaucagacacgcugca

SEQ ID NO: 4097063 - RNA, 15 nt, Western equine encephalomyelitis virus
acacuaaaacucgau

SEQ ID NO: 4097064 - RNA, 22 nt, Western equine encephalomyelitis virus
acacuauaucacuuuuaugaga

SEQ ID NO: 4097065 - RNA, 14 nt, Western equine encephalomyelitis virus
accaccuucuggca

SEQ ID NO: 4097066 - RNA, 15 nt, Western equine encephalomyelitis virus
acgacacgcugcugg

SEQ ID NO: 4097067 - RNA, 18 nt, Western equine encephalomyelitis virus
acgaucacuugaaggaga

SEQ ID NO: 4097068 - RNA, 13 nt, Western equine encephalomyelitis virus
acgccagaacgaa

SEQ ID NO: 4097069 - RNA, 21 nt, Western equine encephalomyelitis virus
acggcgcaguccaguaugaga

SEQ ID NO: 4097070 - RNA, 16 nt, Western equine encephalomyelitis virus
acggcugcugaagccu

SEQ ID NO: 4097071 - RNA, 22 nt, Western equine encephalomyelitis virus
acucgauguacuuccgaggaag

SEQ ID NO: 4097072 - RNA, 16 nt, Western equine encephalomyelitis virus
acugccugacgccaua

SEQ ID NO: 4097073 - RNA, 12 nt, Western equine encephalomyelitis virus
agaaccacauaa

SEQ ID NO: 4097074 - RNA, 14 nt, Western equine encephalomyelitis virus
agcagcaagccaag

SEQ ID NO: 4097075 - RNA, 14 nt, Western equine encephalomyelitis virus
agccuaaaaagaag

SEQ ID NO: 4097076 - RNA, 20 nt, Western equine encephalomyelitis virus
aggaggugcaaaugagggca

SEQ ID NO: 4097077 - RNA, 18 nt, Western equine encephalomyelitis virus
agggucuacauccaggaa

SEQ ID NO: 4097078 - RNA, 21 nt, Western equine encephalomyelitis virus
aguaucaggguaugaaaugug

SEQ ID NO: 4097079 - RNA, 13 nt, Western equine encephalomyelitis virus
aguccaccugcaa

SEQ ID NO: 4097080 - RNA, 15 nt, Western equine encephalomyelitis virus
agugagaacacacaa

SEQ ID NO: 4097081 - RNA, 15 nt, Western equine encephalomyelitis virus
aguucacacagcugc

SEQ ID NO: 4097082 - RNA, 23 nt, Western equine encephalomyelitis virus
auaaguccuaucuggaggaagcg

SEQ ID NO: 4097083 - RNA, 14 nt, Western equine encephalomyelitis virus
auacgcgcuugcac

SEQ ID NO: 4097084 - RNA, 23 nt, Western equine encephalomyelitis virus
aucuuggaacuggcugcuugcac

SEQ ID NO: 4097085 - RNA, 17 nt, Western equine encephalomyelitis virus
augaaauguggaagaac

SEQ ID NO: 4097086 - RNA, 16 nt, Western equine encephalomyelitis virus
augacaucaaggaaga

SEQ ID NO: 4097087 - RNA, 15 nt, Western equine encephalomyelitis virus
auuccuucaccacaa

SEQ ID NO: 4097088 - RNA, 20 nt, Western equine encephalomyelitis virus
auuuuacuuaaaaacacuau

SEQ ID NO: 4097089 - RNA, 15 nt, Western equine encephalomyelitis virus
caaagcaagaagaga

SEQ ID NO: 4097090 - RNA, 21 nt, Western equine encephalomyelitis virus
caagaaguccaccugcaaugc

SEQ ID NO: 4097091 - RNA, 21 nt, Western equine encephalomyelitis virus
caaugcugaauguaaaccacc

SEQ ID NO: 4097092 - RNA, 17 nt, Western equine encephalomyelitis virus
caauguccuccagguga

SEQ ID NO: 4097093 - RNA, 17 nt, Western equine encephalomyelitis virus
cacagguaucgugagca

SEQ ID NO: 4097094 - RNA, 12 nt, Western equine encephalomyelitis virus
cacagucauucc

SEQ ID NO: 4097095 - RNA, 20 nt, Western equine encephalomyelitis virus
cacaucgagcccacaagcaa

SEQ ID NO: 4097096 - RNA, 21 nt, Western equine encephalomyelitis virus
cacgaccaugacaucaaggaa

SEQ ID NO: 4097097 - RNA, 14 nt, Western equine encephalomyelitis virus
cagaauggauuaca

SEQ ID NO: 4097098 - RNA, 19 nt, Western equine encephalomyelitis virus
cagcaagccaagaggacga

SEQ ID NO: 4097099 - RNA, 15 nt, Western equine encephalomyelitis virus
cagcagcuugcaucg

SEQ ID NO: 4097100 - RNA, 17 nt, Western equine encephalomyelitis virus
caggacgaccccugcaa

SEQ ID NO: 4097101 - RNA, 15 nt, Western equine encephalomyelitis virus
caggccaggcccaca

SEQ ID NO: 4097102 - RNA, 23 nt, Western equine encephalomyelitis virus
cagguccaccgccaaagaagaag

SEQ ID NO: 4097103 - RNA, 15 nt, Western equine encephalomyelitis virus
cagucgcacuaaaag

SEQ ID NO: 4097104 - RNA, 18 nt, Western equine encephalomyelitis virus
cauaaggucgucaucaga

SEQ ID NO: 4097105 - RNA, 22 nt, Western equine encephalomyelitis virus
cauauuuuacuuaaaaacacua

SEQ ID NO: 4097106 - RNA, 23 nt, Western equine encephalomyelitis virus
cauauuuuacuuaaaaacacuau

SEQ ID NO: 4097107 - RNA, 12 nt, Zaire Ebola virus (ZEBOV)
caacaacacuca

SEQ ID NO: 4097108 - RNA, 18 nt, Zaire Ebola virus (ZEBOV)
caaggaagggaagcugca

SEQ ID NO: 4097109 - RNA, 17 nt, Zaire Ebola virus (ZEBOV)
caauacggugauucaaa

SEQ ID NO: 4097110 - RNA, 17 nt, Zaire Ebola virus (ZEBOV)
cagagaacaccaacacg

SEQ ID NO: 4097111 - RNA, 17 nt, Zaire Ebola virus (ZEBOV)
cauaguauccugauacu

SEQ ID NO: 4097112 - RNA, 14 nt, Zaire Ebola virus (ZEBOV)
caugcuuacaucug

SEQ ID NO: 4097113 - RNA, 17 nt, Zaire Ebola virus (ZEBOV)
ccaaaagcagagaacac

SEQ ID NO: 4097114 - RNA, 14 nt, Zaire Ebola virus (ZEBOV)
ccacgaccgcagcc

SEQ ID NO: 4097115 - RNA, 18 nt, Zaire Ebola virus (ZEBOV)
ccagcagcgggaagcuag

SEQ ID NO: 4097116 - RNA, 21 nt, Zaire Ebola virus (ZEBOV)
cccagggaccaacacaacaac

SEQ ID NO: 4097117 - RNA, 17 nt, Zaire Ebola virus (ZEBOV)
cuuaaaauauaaaugua

SEQ ID NO: 4097118 - RNA, 14 nt, Zaire Ebola virus (ZEBOV)
cuuacaucugagga

SEQ ID NO: 4097119 - RNA, 18 nt, Zaire Ebola virus (ZEBOV)
cuuauuuuugaauuuaaa

SEQ ID NO: 4097120 - RNA, 20 nt, Zaire Ebola virus (ZEBOV)
cuuucucauugcacauacuu

SEQ ID NO: 4097121 - RNA, 13 nt, Zaire Ebola virus (ZEBOV)
gaacuucuuccga

SEQ ID NO: 4097122 - RNA, 18 nt, Zaire Ebola virus (ZEBOV)
gacaauugguggacagga

SEQ ID NO: 4097123 - RNA, 21 nt, Zaire Ebola virus (ZEBOV)
gauugaugaaagaucauaacu

SEQ ID NO: 4097124 - RNA, 12 nt, Zaire Ebola virus (ZEBOV)
ggcaauugauuu

SEQ ID NO: 4097125 - RNA, 16 nt, Zaire Ebola virus (ZEBOV)
uagaaucuucucaggg

SEQ ID NO: 4097126 - RNA, 19 nt, Zaire Ebola virus (ZEBOV)
uauacucguaauuaacauu

SEQ ID NO: 4097127 - RNA, 15 nt, Zaire Ebola virus (ZEBOV)
ucaaggaagggaagc

SEQ ID NO: 4097128 - RNA, 14 nt, Zaire Ebola virus (ZEBOV)
ucaaugaaaccagg

SEQ ID NO: 4097129 - RNA, 12 nt, Zaire Ebola virus (ZEBOV)
ugaauuuaaagc

SEQ ID NO: 4097130 - RNA, 13 nt, Zaire Ebola virus (ZEBOV)
ugagucuuaaugc

SEQ ID NO: 4097131 - RNA, 22 nt, Zaire Ebola virus (ZEBOV)
ugcaaagguugguuauuaacau

SEQ ID NO: 4097132 - RNA, 11 nt, Zaire Ebola virus (ZEBOV)
ugccagcagcg

SEQ ID NO: 4097133 - RNA, 23 nt, Zaire Ebola virus (ZEBOV)
ugcugacucaauaguuaucuuga

SEQ ID NO: 4097134 - RNA, 21 nt, Zaire Ebola virus (ZEBOV)
uucaugacuuacuaaugaucu

SEQ ID NO: 4097135 - RNA, 15 nt, Zaire Ebola virus (ZEBOV)
uucuuguacacaaau

SEQ ID NO: 4097136 - RNA, 19 nt, Zaire Ebola virus (ZEBOV)
uugagaaugauaaacuuga

SEQ ID NO: 4097137 - RNA, 14 nt, Zaire Ebola virus (ZEBOV)
uugucaaugcucaa

SEQ ID NO: 4097138 - RNA, 20 nt, Zaire Ebola virus (ZEBOV)
uuuaaagcuagcuuauuauu

SEQ ID NO: 4097139 - RNA, 21 nt, Zaire Ebola virus (ZEBOV)
aguucaauuugagucuuaaug

SEQ ID NO: 4097140 - RNA, 15 nt, Zaire Ebola virus (ZEBOV)
auaaauacucauauu

SEQ ID NO: 4097141 - RNA, 16 nt, Zaire Ebola virus (ZEBOV)
auaauuuguuuaacca

SEQ ID NO: 4097142 - RNA, 22 nt, Zaire Ebola virus (ZEBOV)
auaguauccugauacuugcaaa

SEQ ID NO: 4097143 - RNA, 20 nt, Zaire Ebola virus (ZEBOV)
auuguaacucaauauucuaa

SEQ ID NO: 4097144 - RNA, 15 nt, Zaire Ebola virus (ZEBOV)
caacaucaccgcaga

SEQ ID NO: 4097145 - RNA, 17 nt, Zaire Ebola virus (ZEBOV)
cacagucaaggaaggga

SEQ ID NO: 4097146 - RNA, 22 nt, Zaire Ebola virus (ZEBOV)
ccaaaccagguccggacaacag

SEQ ID NO: 4097147 - RNA, 16 nt, Zaire Ebola virus (ZEBOV)
cuaauaacauuacaaa

SEQ ID NO: 4097148 - RNA, 14 nt, Zaire Ebola virus (ZEBOV)
cucauauuucuuga

SEQ ID NO: 4097149 - RNA, 19 nt, Zaire Ebola virus (ZEBOV)
cucugccacgaccgcagcc

SEQ ID NO: 4097150 - RNA, 23 nt, Zaire Ebola virus (ZEBOV)
cugacucaauaguuaucuugaca

SEQ ID NO: 4097151 - RNA, 14 nt, Zaire Ebola virus (ZEBOV)
cuucaacugcugaa

SEQ ID NO: 4097152 - RNA, 14 nt, Zaire Ebola virus (ZEBOV)
gaaccacaugauug

SEQ ID NO: 4097153 - RNA, 14 nt, Zaire Ebola virus (ZEBOV)
gagugccagcagcg

SEQ ID NO: 4097154 - RNA, 16 nt, Zaire Ebola virus (ZEBOV)
gauaauauaagucaau

SEQ ID NO: 4097155 - RNA, 23 nt, Zaire Ebola virus (ZEBOV)
gcaaagguugguuauuaacauac

SEQ ID NO: 4097156 - RNA, 23 nt, Zaire Ebola virus (ZEBOV)
gcaauugauuucuugcugcagcg

SEQ ID NO: 4097157 - RNA, 20 nt, Zaire Ebola virus (ZEBOV)
gcacauacuuuuugcccuua

SEQ ID NO: 4097158 - RNA, 22 nt, Zaire Ebola virus (ZEBOV)
gcaccuuuucaauccucaaccg

SEQ ID NO: 4097159 - RNA, 22 nt, Zaire Ebola virus (ZEBOV)
gccggacccccaaaagcagaga

SEQ ID NO: 4097160 - RNA, 19 nt, Zaire Ebola virus (ZEBOV)
ggacccccaaaagcagaga

SEQ ID NO: 4097161 - RNA, 19 nt, Zaire Ebola virus (ZEBOV)
ggagaagaacucgaagaga

SEQ ID NO: 4097162 - RNA, 14 nt, Zaire Ebola virus (ZEBOV)
uaauauaauacacu

SEQ ID NO: 4097163 - RNA, 17 nt, Zaire Ebola virus (ZEBOV)
uacguuacauuaaugau

SEQ ID NO: 4097164 - RNA, 15 nt, Zaire Ebola virus (ZEBOV)
ucaaaaaauaaguau

SEQ ID NO: 4097165 - RNA, 17 nt, Zaire Ebola virus (ZEBOV)
ucaaggaacgaaaacag

SEQ ID NO: 4097166 - RNA, 20 nt, Zaire Ebola virus (ZEBOV)
ucacuguaagccagcuucca

SEQ ID NO: 4097167 - RNA, 15 nt, Zaire Ebola virus (ZEBOV)
uccacgaguccccaa

SEQ ID NO: 4097168 - RNA, 14 nt, Zaire Ebola virus (ZEBOV)
ucgggccagcagcc

SEQ ID NO: 4097169 - RNA, 17 nt, Zaire Ebola virus (ZEBOV)
ugccagcagcgggaagc

SEQ ID NO: 4097170 - RNA, 11 nt, Zaire Ebola virus (ZEBOV)
uuauuaacaua

SEQ ID NO: 4097171 - RNA, 22 nt, Zaire Ebola virus (ZEBOV)
uucaauuugagucuuaaugcaa

SEQ ID NO: 4097172 - RNA, 20 nt, Zaire Ebola virus (ZEBOV)
uucuuguacacaaauaaugu

SEQ ID NO: 4097173 - RNA, 21 nt, Zaire Ebola virus (ZEBOV)
uugacaucaaucuaguuaucu

SEQ ID NO: 4097174 - RNA, 14 nt, Zaire Ebola virus (ZEBOV)
aaaauauaaaugua

SEQ ID NO: 4097175 - RNA, 16 nt, Zaire Ebola virus (ZEBOV)
aaaucaaugaaaccag

SEQ ID NO: 4097176 - RNA, 21 nt, Zaire Ebola virus (ZEBOV)
aacauaacagacaaaauugau

SEQ ID NO: 4097177 - RNA, 22 nt, Zaire Ebola virus (ZEBOV)
aacgacagcacagccuccgaca

SEQ ID NO: 4097178 - RNA, 18 nt, Zaire Ebola virus (ZEBOV)
aaggaagggaagcugcag

SEQ ID NO: 4097179 - RNA, 14 nt, Zaire Ebola virus (ZEBOV)
aagugauucuuauu

SEQ ID NO: 4097180 - RNA, 12 nt, Zaire Ebola virus (ZEBOV)
aaugaaaccagg

SEQ ID NO: 4097181 - RNA, 14 nt, Zaire Ebola virus (ZEBOV)
acaaccaaaccagg

SEQ ID NO: 4097182 - RNA, 22 nt, Zaire Ebola virus (ZEBOV)
acaaucaagaugguuuaaucug

SEQ ID NO: 4097183 - RNA, 20 nt, Zaire Ebola virus (ZEBOV)
acaguuaaucauaaacaagg

SEQ ID NO: 4097184 - RNA, 19 nt, Zaire Ebola virus (ZEBOV)
acuggacuacucaggauga

SEQ ID NO: 4097185 - RNA, 20 nt, Zaire Ebola virus (ZEBOV)
agaacagacaacgacagcac

SEQ ID NO: 4097186 - RNA, 14 nt, Zaire Ebola virus (ZEBOV)
agaacucgaagaga

SEQ ID NO: 4097187 - RNA, 21 nt, Zaire Ebola virus (ZEBOV)
agaauuuuugaugucuaaggu

SEQ ID NO: 4097188 - RNA, 14 nt, Zaire Ebola virus (ZEBOV)
agacagcuggccaa

SEQ ID NO: 4097189 - RNA, 16 nt, Zaire Ebola virus (ZEBOV)
agcacugacuuccugg

SEQ ID NO: 4097190 - RNA, 16 nt, Zaire Ebola virus (ZEBOV)
aggauggagacaaugg

SEQ ID NO: 4097191 - RNA, 10 nt, Zaire Ebola virus (ZEBOV)
auaauacacc

SEQ ID NO: 4097192 - RNA, 18 nt, Zaire Ebola virus (ZEBOV)
aucaaagaaaaucauaau

SEQ ID NO: 4097193 - RNA, 12 nt, Zaire Ebola virus (ZEBOV)
augaauaagcau

SEQ ID NO: 4097194 - RNA, 12 nt, Zaire Ebola virus (ZEBOV)
auugcacauacu

SEQ ID NO: 4097195 - RNA, 13 nt, Zaire Ebola virus (ZEBOV)
auuuaucuaaauu

SEQ ID NO: 4097196 - RNA, 15 nt, Zaire Ebola virus (ZEBOV)
auuuuugaugucuaa

SEQ ID NO: 4097197 - RNA, 18 nt, Zaire Ebola virus (ZEBOV)
caaaccaaaagugaugaa

SEQ ID NO: 4097198 - RNA, 19 nt, Zaire Ebola virus (ZEBOV)
caaagguugguuauuaaca

SEQ ID NO: 4097199 - RNA, 16 nt, Zaire Ebola virus (ZEBOV)
aaauuccucugcaaug

SEQ ID NO: 4097200 - RNA, 18 nt, Zaire Ebola virus (ZEBOV)
aacauuagauaaguagau

SEQ ID NO: 4097201 - RNA, 16 nt, Zaire Ebola virus (ZEBOV)
aagagguaugauacaa

SEQ ID NO: 4097202 - RNA, 20 nt, Zaire Ebola virus (ZEBOV)
aaguccccaaaaccacagcg

SEQ ID NO: 4097203 - RNA, 17 nt, Zaire Ebola virus (ZEBOV)
aagugauucuuguacac

SEQ ID NO: 4097204 - RNA, 21 nt, Zaire Ebola virus (ZEBOV)
acagcgagaccgcuggcaaca

SEQ ID NO: 4097205 - RNA, 20 nt, Zaire Ebola virus (ZEBOV)
acguuacauuaaugauacac

SEQ ID NO: 4097206 - RNA, 15 nt, Zaire Ebola virus (ZEBOV)
agagaacaccaacac

SEQ ID NO: 4097207 - RNA, 18 nt, Zaire Ebola virus (ZEBOV)
agaugguuuaaucugugg

SEQ ID NO: 4097208 - RNA, 18 nt, Zaire Ebola virus (ZEBOV)
agccaaaaacaucagugg

SEQ ID NO: 4097209 - RNA, 21 nt, Zaire Ebola virus (ZEBOV)
agccuccgacacucccucugc

SEQ ID NO: 4097210 - RNA, 22 nt, Zaire Ebola virus (ZEBOV)
agccuccgacacucccucugcc

SEQ ID NO: 4097211 - RNA, 19 nt, Zaire Ebola virus (ZEBOV)
aguauccugauacuugcaa

SEQ ID NO: 4097212 - RNA, 17 nt, Zaire Ebola virus (ZEBOV)
aaagcagagaacaccaa

SEQ ID NO: 4097213 - RNA, 23 nt, Zaire Ebola virus (ZEBOV)
aacagacaacgacagcacagccu

SEQ ID NO: 4097214 - RNA, 12 nt, Zaire Ebola virus (ZEBOV)
aacauacagauu

SEQ ID NO: 4097215 - RNA, 20 nt, Zaire Ebola virus (ZEBOV)
aaccaaaccagguccggaca

SEQ ID NO: 4097216 - RNA, 23 nt, Zaire Ebola virus (ZEBOV)
aagguugguuauuaacauacaga

SEQ ID NO: 4097217 - RNA, 18 nt, Zaire Ebola virus (ZEBOV)
aauugguggacaggaugg

SEQ ID NO: 4097218 - RNA, 16 nt, Zaire Ebola virus (ZEBOV)
accagaaauccuauau

SEQ ID NO: 4097219 - RNA, 17 nt, Zaire Ebola virus (ZEBOV)
agaccacaaaaucaugg

SEQ ID NO: 4097220 - RNA, 14 nt, Zaire Ebola virus (ZEBOV)
agauauauaagcau

SEQ ID NO: 4097221 - RNA, 15 nt, Zaire Ebola virus (ZEBOV)
agcuaacucauauau

SEQ ID NO: 4097222 - RNA, 15 nt, Zaire Ebola virus (ZEBOV)
agcuuccaaguugac

SEQ ID NO: 4097223 - RNA, 12 nt, Zaire Ebola virus (ZEBOV)
aguauccugaua

SEQ ID NO: 4097224 - RNA, 14 nt, Zaire Ebola virus (ZEBOV)
aguuuuauagaauc

SEQ ID NO: 4097225 - RNA, 19 nt, Zaire Ebola virus (ZEBOV)
augaauaagcauuuuauca

SEQ ID NO: 4097226 - RNA, 14 nt, Zaire Ebola virus (ZEBOV)
auuaugcuuuuaua

SEQ ID NO: 4097227 - RNA, 18 nt, Zaire Ebola virus (ZEBOV)
auuuuugaugucuaaggu

SEQ ID NO: 4097228 - RNA, 19 nt, Zaire Ebola virus (ZEBOV)
caagauaccggagaagaga

SEQ ID NO: 4097229 - RNA, 19 nt, Zaire Ebola virus (ZEBOV)
cagcacagccuccgacacu

SEQ ID NO: 4097230 - RNA, 17 nt, Zaire Ebola virus (ZEBOV)
cagcuuccaaguugaca

SEQ ID NO: 4097231 - RNA, 16 nt, Zaire Ebola virus (ZEBOV)
cauaauuguaacucaa

SEQ ID NO: 4097232 - RNA, 16 nt, Zaire Ebola virus (ZEBOV)
cccagggaccaacaca

SEQ ID NO: 4097233 - RNA, 22 nt, Zaire Ebola virus (ZEBOV)
ccucugcaaugguucaagugca

SEQ ID NO: 4097234 - RNA, 18 nt, Zaire Ebola virus (ZEBOV)
cgcagaacagacaacgac

SEQ ID NO: 4097235 - RNA, 11 nt, Zaire Ebola virus (ZEBOV)
gaacagacaac

SEQ ID NO: 4097236 - RNA, 13 nt, Zaire Ebola virus (ZEBOV)
gacaaaugauaau

SEQ ID NO: 4097237 - RNA, 18 nt, Zaire Ebola virus (ZEBOV)
gaccagggggacaaugac

SEQ ID NO: 4097238 - RNA, 12 nt, Zaire Ebola virus (ZEBOV)
gcucuucaacug

SEQ ID NO: 4097239 - RNA, 21 nt, Zaire Ebola virus (ZEBOV)
gcuucagaaaauuccucugca

SEQ ID NO: 4097240 - RNA, 13 nt, Zaire Ebola virus (ZEBOV)
guuguucacaauc

SEQ ID NO: 4097241 - RNA, 20 nt, Zaire Ebola virus (ZEBOV)
uaacauuaaguagucaagga

SEQ ID NO: 4097242 - RNA, 19 nt, Zaire Ebola virus (ZEBOV)
uaccauauuucgggccagc

SEQ ID NO: 4097243 - RNA, 23 nt, Zaire Ebola virus (ZEBOV)
uaccauauuucgggccagcagcc

SEQ ID NO: 4097244 - RNA, 15 nt, Zaire Ebola virus (ZEBOV)
ucaaccgacaaauag

SEQ ID NO: 4097245 - RNA, 17 nt, Zaire Ebola virus (ZEBOV)
ucaaguugaacaacauc

SEQ ID NO: 4097246 - RNA, 16 nt, Zaire Ebola virus (ZEBOV)
ucauggaaaagcucag

SEQ ID NO: 4097247 - RNA, 19 nt, Zaire Ebola virus (ZEBOV)
ucuacuugaucacaauacu

SEQ ID NO: 4097248 - RNA, 20 nt, Zaire Ebola virus (ZEBOV)
ugcaaagguugguuauuaac

SEQ ID NO: 4097249 - RNA, 13 nt, Zaire Ebola virus (ZEBOV)
uguauaaacuuga

SEQ ID NO: 4097250 - RNA, 23 nt, Zaire Ebola virus (ZEBOV)
uuaaacauagccaaugugauucu

SEQ ID NO: 4097251 - RNA, 20 nt, Zaire Ebola virus (ZEBOV)
uucuguauaugcaaauuugu

SEQ ID NO: 4097252 - RNA, 22 nt, Zaire Ebola virus (ZEBOV)
aacacgagcaagagcacugacu

SEQ ID NO: 4097253 - RNA, 13 nt, Zaire Ebola virus (ZEBOV)
aacucaaguugaa

SEQ ID NO: 4097254 - RNA, 13 nt, Zaire Ebola virus (ZEBOV)
acagauucuauau

SEQ ID NO: 4097255 - RNA, 12 nt, Zaire Ebola virus (ZEBOV)
acagcuggccaa

SEQ ID NO: 4097256 - RNA, 11 nt, Zaire Ebola virus (ZEBOV)
acauuaaugau

SEQ ID NO: 4097257 - RNA, 21 nt, Zaire Ebola virus (ZEBOV)
acgacucaagcucuucaacug

SEQ ID NO: 4097258 - RNA, 13 nt, Zaire Ebola virus (ZEBOV)
agauuacuugaca

SEQ ID NO: 4097259 - RNA, 19 nt, Zaire Ebola virus (ZEBOV)
aggaagggaagcugcagug

SEQ ID NO: 4097260 - RNA, 12 nt, Zaire Ebola virus (ZEBOV)
auaaacuugaca

SEQ ID NO: 4097261 - RNA, 13 nt, Zaire Ebola virus (ZEBOV)
auaauauacuugu

SEQ ID NO: 4097262 - RNA, 12 nt, Zaire Ebola virus (ZEBOV)
aucaucauauau

SEQ ID NO: 4097263 - RNA, 17 nt, Zaire Ebola virus (ZEBOV)
augcacaaucaagaugg

SEQ ID NO: 4097264 - RNA, 15 nt, Zaire Ebola virus (ZEBOV)
auugacucagaucca

SEQ ID NO: 4097265 - RNA, 20 nt, Zaire Ebola virus (ZEBOV)
auuuacacgaucguuuuaua

SEQ ID NO: 4097266 - RNA, 13 nt, Zaire Ebola virus (ZEBOV)
caacaacaacacu

SEQ ID NO: 4097267 - RNA, 19 nt, Zaire Ebola virus (ZEBOV)
caaggaagggaagcugcag

SEQ ID NO: 4097268 - RNA, 16 nt, Zaire Ebola virus (ZEBOV)
caaucggacuggccug

SEQ ID NO: 4097269 - RNA, 13 nt, Zaire Ebola virus (ZEBOV)
cacucccucugcc

SEQ ID NO: 4097270 - RNA, 20 nt, Zaire Ebola virus (ZEBOV)
cacuugugaguaucagcccu

SEQ ID NO: 4097271 - RNA, 20 nt, Zaire Ebola virus (ZEBOV)
ccggacccccaaaagcagag

SEQ ID NO: 4097272 - RNA, 18 nt, Zaire Ebola virus (ZEBOV)
cugagagccacaacugag

SEQ ID NO: 4097273 - RNA, 20 nt, Zaire Ebola virus (ZEBOV)
cuucagaaaauuccucugca

SEQ ID NO: 4097274 - RNA, 19 nt, Zaire Ebola virus (ZEBOV)
cuugaugaagauuaagaaa

SEQ ID NO: 4097275 - RNA, 16 nt, Zaire Ebola virus (ZEBOV)
gaacauaacagacaaa

SEQ ID NO: 4097276 - RNA, 23 nt, Zaire Ebola virus (ZEBOV)
gaauuauuaucacaauaaaagug

SEQ ID NO: 4097277 - RNA, 17 nt, Zaire Ebola virus (ZEBOV)
gacaacgacagcacagc

SEQ ID NO: 4097278 - RNA, 13 nt, Zaire Ebola virus (ZEBOV)
gacauugcccuuc

SEQ ID NO: 4097279 - RNA, 18 nt, Zaire Ebola virus (ZEBOV)
gauaaacuugaugaagau

SEQ ID NO: 4097280 - RNA, 13 nt, Zaire Ebola virus (ZEBOV)
gauacuugcaaag

SEQ ID NO: 4097281 - RNA, 23 nt, Zaire Ebola virus (ZEBOV)
gccacaguuauagccauaauugu

SEQ ID NO: 4097282 - RNA, 21 nt, Zaire Ebola virus (ZEBOV)
gccaccacaacaaguccccaa

SEQ ID NO: 4097283 - RNA, 12 nt, Zaire Ebola virus (ZEBOV)
guucacaaucca

SEQ ID NO: 4097284 - RNA, 17 nt, Zaire Ebola virus (ZEBOV)
uaacaacccuugccaca

SEQ ID NO: 4097285 - RNA, 18 nt, Zaire Ebola virus (ZEBOV)
uaauauaugaagagguau

SEQ ID NO: 4097286 - RNA, 21 nt, Zaire Ebola virus (ZEBOV)
uacacgaucguuuuauaauua

SEQ ID NO: 4097287 - RNA, 17 nt, Zaire Ebola virus (ZEBOV)
uagccagugugacuugg

SEQ ID NO: 4097288 - RNA, 22 nt, Zaire Ebola virus (ZEBOV)
ucaaacggagccaaaaacauca

SEQ ID NO: 4097289 - RNA, 14 nt, Zaire Ebola virus (ZEBOV)
ucaacuguuccuga

SEQ ID NO: 4097290 - RNA, 18 nt, Zaire Ebola virus (ZEBOV)
ucaaguugaacaacauca

SEQ ID NO: 4097291 - RNA, 21 nt, Zaire Ebola virus (ZEBOV)
ucacauguguuagguuucaca

SEQ ID NO: 4097292 - RNA, 15 nt, Zaire Ebola virus (ZEBOV)
ucugaggcaacucaa

SEQ ID NO: 4097293 - RNA, 13 nt, Zaire Ebola virus (ZEBOV)
ugauacuugcaaa

SEQ ID NO: 4097294 - RNA, 18 nt, Zaire Ebola virus (ZEBOV)
uuaaauuacauuaugcuu

SEQ ID NO: 4097295 - RNA, 16 nt, Zaire Ebola virus (ZEBOV)
uuacaccauugucuuu

SEQ ID NO: 4097296 - RNA, 19 nt, Zaire Ebola virus (ZEBOV)
uuacuagccguuuuucaaa

SEQ ID NO: 4097297 - RNA, 17 nt, Zaire Ebola virus (ZEBOV)
uucaaauguuaaucuuu

SEQ ID NO: 4097298 - RNA, 13 nt, Zaire Ebola virus (ZEBOV)
uugagacagcugg

SEQ ID NO: 4097299 - RNA, 22 nt, Zaire Ebola virus [ZEBOV]
aaaaaccaggacucagaauccc

SEQ ID NO: 4097300 - RNA, 14 nt, Zaire Ebola virus [ZEBOV]
aaaaucauggcuuc

SEQ ID NO: 4097301 - RNA, 16 nt, Zaire Ebola virus [ZEBOV]
aaaauugaucagauua

SEQ ID NO: 4097302 - RNA, 22 nt, Zaire Ebola virus [ZEBOV]
aaaugcaacccuaauuuacauu

SEQ ID NO: 4097303 - RNA, 14 nt, Zaire Ebola virus [ZEBOV]
aaauguagaacuua

SEQ ID NO: 4097304 - RNA, 22 nt, Zaire Ebola virus [ZEBOV]
aacuuaacaaaagacucauaau

SEQ ID NO: 4097305 - RNA, 16 nt, Zaire Ebola virus [ZEBOV]
aagaacauaacagaca

SEQ ID NO: 4097306 - RNA, 17 nt, Zaire Ebola virus [ZEBOV]
aagagagugccagcagc

SEQ ID NO: 4097307 - RNA, 13 nt, Zaire Ebola virus [ZEBOV]
aaggauugauuga

SEQ ID NO: 4097308 - RNA, 16 nt, Zaire Ebola virus [ZEBOV]
aagugauucuuguaca

SEQ ID NO: 4097309 - RNA, 12 nt, Zaire Ebola virus [ZEBOV]
aauagcagaggc

SEQ ID NO: 4097310 - RNA, 20 nt, Zaire Ebola virus [ZEBOV]
aaucucguaucgcucguaau

SEQ ID NO: 4097311 - RNA, 18 nt, Zaire Ebola virus [ZEBOV]
aaugauaaacuugaugaa

SEQ ID NO: 4097312 - RNA, 15 nt, Zaire Ebola virus [ZEBOV]
aaugguuaauuguaa

SEQ ID NO: 4097313 - RNA, 19 nt, Zaire Ebola virus [ZEBOV]
aauuugagucuuaaugcaa

SEQ ID NO: 4097314 - RNA, 21 nt, Zaire Ebola virus [ZEBOV]
acaacagcacccauaauacac

SEQ ID NO: 4097315 - RNA, 14 nt, Zaire Ebola virus [ZEBOV]
acaaccaaaccagg

SEQ ID NO: 4097316 - RNA, 15 nt, Zaire Ebola virus [ZEBOV]
acaaguccccaaaac

SEQ ID NO: 4097317 - RNA, 19 nt, Zaire Ebola virus [ZEBOV]
acaauacuccguauaccua

SEQ ID NO: 4097318 - RNA, 15 nt, Zaire Ebola virus [ZEBOV]
acacucccucugcca

SEQ ID NO: 4097319 - RNA, 15 nt, Zaire Ebola virus [ZEBOV]
acaucucugcuuuca

SEQ ID NO: 4097320 - RNA, 20 nt, Zaire Ebola virus [ZEBOV]
accccgccaccacaacaagu

SEQ ID NO: 4097321 - RNA, 21 nt, Zaire Ebola virus [ZEBOV]
acucaauaguuaucuugacau

SEQ ID NO: 4097322 - RNA, 18 nt, Zaire Ebola virus [ZEBOV]
guacagacauugcccuuc

SEQ ID NO: 4097323 - RNA, 17 nt, Zaire Ebola virus [ZEBOV]
guccccaaaaccacagc

SEQ ID NO: 4097324 - RNA, 21 nt, Zaire Ebola virus [ZEBOV]
uaagauuacuugacaaaugau

SEQ ID NO: 4097325 - RNA, 24 nt, Zaire Ebola virus [ZEBOV]
uaauacacccguguauaaacuuga

SEQ ID NO: 4097326 - RNA, 19 nt, Zaire Ebola virus [ZEBOV]
uauaacuuaccuacuagcc

SEQ ID NO: 4097327 - RNA, 16 nt, Zaire Ebola virus [ZEBOV]
uauuaacauacagauu

SEQ ID NO: 4097328 - RNA, 20 nt, Zaire Ebola virus [ZEBOV]
ucaaacggagccaaaaacau

SEQ ID NO: 4097329 - RNA, 14 nt, Zaire Ebola virus [ZEBOV]
ucaaaucaaugaaa

SEQ ID NO: 4097330 - RNA, 18 nt, Zaire Ebola virus [ZEBOV]
ucaaaucaaugaaaccag

SEQ ID NO: 4097331 - RNA, 22 nt, Zaire Ebola virus [ZEBOV]
ucaaggaagggaagcugcagug

SEQ ID NO: 4097332 - RNA, 16 nt, Zaire Ebola virus [ZEBOV]
ucacaaccaaaccagg

SEQ ID NO: 4097333 - RNA, 17 nt, Zaire Ebola virus [ZEBOV]
ucacaguuaaucauaaa

SEQ ID NO: 4097334 - RNA, 21 nt, Zaire Ebola virus [ZEBOV]
ucacauguguuagguuucaca

SEQ ID NO: 4097335 - RNA, 14 nt, Zaire Ebola virus [ZEBOV]
ucacuguaagccag

SEQ ID NO: 4097336 - RNA, 21 nt, Zaire Ebola virus [ZEBOV]
ucuuccgacccagggaccaac

SEQ ID NO: 4097337 - RNA, 17 nt, Zaire Ebola virus [ZEBOV]
ugagucuuaaugcaaau

SEQ ID NO: 4097338 - RNA, 13 nt, Zaire Ebola virus [ZEBOV]
ugauuggaccaag

SEQ ID NO: 4097339 - RNA, 16 nt, Zaire Ebola virus [ZEBOV]
ugcccuucuaauuaag

SEQ ID NO: 4097340 - RNA, 18 nt, Zaire Ebola virus [ZEBOV]
ugcugcaaucggacuggc

SEQ ID NO: 4097341 - RNA, 14 nt, Zaire Ebola virus [ZEBOV]
uuacaccauugucu

SEQ ID NO: 4097342 - RNA, 19 nt, Zaire Ebola virus [ZEBOV]
uuauuaacauacagauuau

SEQ ID NO: 4097343 - RNA, 12 nt, Zaire Ebola virus [ZEBOV]
uuauuacuagcc

SEQ ID NO: 4097344 - RNA, 17 nt, Zaire Ebola virus [ZEBOV]
uucauaaucagauauau

SEQ ID NO: 4097345 - RNA, 22 nt, Zaire Ebola virus [ZEBOV]
uuggauuggaaauguggagaaa

SEQ ID NO: 4097346 - RNA, 15 nt, Zaire Ebola virus [ZEBOV]
uuucaaaguucaauu

SEQ ID NO: 4097347 - RNA, 11 nt, Zaire Ebola virus [ZEBOV]
aaaaccaggac

SEQ ID NO: 4097348 - RNA, 16 nt, Zaire Ebola virus [ZEBOV]
aaacaagguuugacau

SEQ ID NO: 4097349 - RNA, 15 nt, Zaire Ebola virus [ZEBOV]
aacaucauagaauug

SEQ ID NO: 4097350 - RNA, 20 nt, Zaire Ebola virus [ZEBOV]
aacauuagauaaguagauua

SEQ ID NO: 4097351 - RNA, 17 nt, Zaire Ebola virus [ZEBOV]
aacucuauacucguaau

SEQ ID NO: 4097352 - RNA, 16 nt, Zaire Ebola virus [ZEBOV]
aacugcugaacuauag

SEQ ID NO: 4097353 - RNA, 15 nt, Zaire Ebola virus [ZEBOV]
aacuuauucaguacu

SEQ ID NO: 4097354 - RNA, 16 nt, Zaire Ebola virus [ZEBOV]
aagagguaugauacaa

SEQ ID NO: 4097355 - RNA, 21 nt, Zaire Ebola virus [ZEBOV]
aagguugguuauuaacauaca

SEQ ID NO: 4097356 - RNA, 22 nt, Zaire Ebola virus [ZEBOV]
aauacucauauuucuugauaau

SEQ ID NO: 4097357 - RNA, 12 nt, Zaire Ebola virus [ZEBOV]
aaucuaagauua

SEQ ID NO: 4097358 - RNA, 14 nt, Zaire Ebola virus [ZEBOV]
aaugauaaacuuga

SEQ ID NO: 4097359 - RNA, 19 nt, Zaire Ebola virus [ZEBOV]
acaaaagacucauaauaua

SEQ ID NO: 4097360 - RNA, 15 nt, Zaire Ebola virus [ZEBOV]
acaaaauugaucaga

SEQ ID NO: 4097361 - RNA, 22 nt, Zaire Ebola virus [ZEBOV]
acaaauaauccuacuauaauca

SEQ ID NO: 4097362 - RNA, 16 nt, Zaire Ebola virus [ZEBOV]
acaacaucaccgcaga

SEQ ID NO: 4097363 - RNA, 23 nt, Zaire Ebola virus [ZEBOV]
acaacccuaacagugaucaaaga

SEQ ID NO: 4097364 - RNA, 23 nt, Zaire Ebola virus [ZEBOV]
acaauugguggacaggauggaga

SEQ ID NO: 4097365 - RNA, 22 nt, Zaire Ebola virus [ZEBOV]
acacaacaacugaagaccacaa

SEQ ID NO: 4097366 - RNA, 16 nt, Zaire Ebola virus [ZEBOV]
acacucaucaccaaga

SEQ ID NO: 4097367 - RNA, 12 nt, Zaire Ebola virus [ZEBOV]
acagacaaaauu

SEQ ID NO: 4097368 - RNA, 14 nt, Zaire Ebola virus [ZEBOV]
acagcacagccucc

SEQ ID NO: 4097369 - RNA, 16 nt, Zaire Ebola virus [ZEBOV]
acaugauuggaccaag

SEQ ID NO: 4097370 - RNA, 21 nt, Zaire Ebola virus [ZEBOV]
accauauuucgggccagcagc

SEQ ID NO: 4097371 - RNA, 22 nt, Zaire Ebola virus [ZEBOV]
accauauuucgggccagcagcc

SEQ ID NO: 4097372 - RNA, 18 nt, Zaire Ebola virus [ZEBOV]
acccaaaccaaaagugau

SEQ ID NO: 4097373 - RNA, 17 nt, Zaire Ebola virus [ZEBOV]
accgcagccggaccccc

SEQ ID NO: 4097374 - RNA, 19 nt, Zaire Ebola virus [ZEBOV]
acguuacauuaaugauaca

SEQ ID NO: 4097375 - RNA, 22 nt, Zaire Ebola virus [ZEBOV]
acuaaaggugcuuuacaccauu

SEQ ID NO: 4097376 - RNA, 15 nt, Zaire Ebola virus [ZEBOV]
acucaagcucuucaa

SEQ ID NO: 4097377 - RNA, 20 nt, Zaire Ebola virus [ZEBOV]
acucaauaguuaucuugaca

SEQ ID NO: 4097378 - RNA, 22 nt, Zaire Ebola virus [ZEBOV]
agaauugcuuuauuauaugaau

SEQ ID NO: 4097379 - RNA, 22 nt, Zaire Ebola virus [ZEBOV]
agacaacgacagcacagccucc

SEQ ID NO: 4097380 - RNA, 13 nt, Zaire Ebola virus [ZEBOV]
agacagcuggcca

SEQ ID NO: 4097381 - RNA, 13 nt, Zaire Ebola virus [ZEBOV]
agaguugucuuuc

SEQ ID NO: 4097382 - RNA, 21 nt, Zaire Ebola virus [ZEBOV]
agcauuuuaucaccagaaauc

SEQ ID NO: 4097383 - RNA, 17 nt, Zaire Ebola virus [ZEBOV]
agccauaauuguaacuc

SEQ ID NO: 4097384 - RNA, 19 nt, Zaire Ebola virus [ZEBOV]
agcuuaaaauauaaaugua

SEQ ID NO: 4097385 - RNA, 21 nt, Zaire Ebola virus [ZEBOV]
aggcugacuaaaacacuauau

SEQ ID NO: 4097386 - RNA, 22 nt, Zaire Ebola virus [ZEBOV]
agugaagaguugucuuucacag

SEQ ID NO: 4097387 - RNA, 14 nt, Zaire Ebola virus [ZEBOV]
aguuaucuugacau

SEQ ID NO: 4097388 - RNA, 19 nt, Zaire Ebola virus [ZEBOV]
aguucaauuugagucuuaa

SEQ ID NO: 4097389 - RNA, 18 nt, Zaire Ebola virus [ZEBOV]
auaaacaagguuugacau

SEQ ID NO: 4097390 - RNA, 13 nt, Zaire Ebola virus [ZEBOV]
auaaacuugacau

SEQ ID NO: 4097391 - RNA, 14 nt, Zaire Ebola virus [ZEBOV]
auaauauaauacac

SEQ ID NO: 4097392 - RNA, 22 nt, Zaire Ebola virus [ZEBOV]
auaguauccugauacuugcaaa

SEQ ID NO: 4097393 - RNA, 16 nt, Zaire Ebola virus [ZEBOV]
auccugauacuugcaa

SEQ ID NO: 4097394 - RNA, 16 nt, Zaire Ebola virus [ZEBOV]
aucgaaccacaugauu

SEQ ID NO: 4097395 - RNA, 12 nt, Zaire Ebola virus [ZEBOV]
aucucugcuuuc

SEQ ID NO: 4097396 - RNA, 17 nt, Zaire Ebola virus [ZEBOV]
auuagaggagacacuuu

SEQ ID NO: 4097397 - RNA, 15 nt, Zaire Ebola virus [ZEBOV]
auucuguauaugcaa

SEQ ID NO: 4097398 - RNA, 16 nt, Zaire Ebola virus [ZEBOV]
auuuuugaugucuaag

SEQ ID NO: 4097399 - RNA, 14 nt, Zaire Ebola virus [ZEBOV]
caaaagugaugaag

SEQ ID NO: 4097400 - RNA, 17 nt, Zaire Ebola virus [ZEBOV]
caaaagugaugaagauu

SEQ ID NO: 4097401 - RNA, 22 nt, Zaire Ebola virus [ZEBOV]
caaagguugguuauuaacauac

SEQ ID NO: 4097402 - RNA, 19 nt, Zaire Ebola virus [ZEBOV]
caauccaaguacagacauu

SEQ ID NO: 4097403 - RNA, 12 nt, Zaire Ebola virus [ZEBOV]
caaugaaaccag

SEQ ID NO: 4097404 - RNA, 19 nt, Zaire Ebola virus [ZEBOV]
gcgaauaauagcagaggcu

SEQ ID NO: 4097405 - RNA, 22 nt, Zaire Ebola virus [ZEBOV]
gcgagaccgcuggcaacaacaa

SEQ ID NO: 4097406 - RNA, 13 nt, Zaire Ebola virus [ZEBOV]
gcuaaugcacaau

SEQ ID NO: 4097407 - RNA, 23 nt, Zaire Ebola virus [ZEBOV]
ggagucgcaggacugaucacagg

SEQ ID NO: 4097408 - RNA, 20 nt, Zaire Ebola virus [ZEBOV]
gguccggacaacagcaccca

SEQ ID NO: 4097409 - RNA, 16 nt, Zaire Ebola virus [ZEBOV]
guauaaacuugacauc

SEQ ID NO: 4097410 - RNA, 21 nt, Zaire Ebola virus [ZEBOV]
guauccugauacuugcaaagg

SEQ ID NO: 4097411 - RNA, 19 nt, Zaire Ebola virus [ZEBOV]
guccccaaucccucacaac

SEQ ID NO: 4097412 - RNA, 20 nt, Zaire Ebola virus [ZEBOV]
uaaccacagauaaauccuca

SEQ ID NO: 4097413 - RNA, 15 nt, Zaire Ebola virus [ZEBOV]
uaguauccugauacu

SEQ ID NO: 4097414 - RNA, 20 nt, Zaire Ebola virus [ZEBOV]
uaguauccugauacuugcaa

SEQ ID NO: 4097415 - RNA, 11 nt, Zaire Ebola virus [ZEBOV]
uauaauacacu

SEQ ID NO: 4097416 - RNA, 22 nt, Zaire Ebola virus [ZEBOV]
uauuaaguaacccaaaccaaaa

SEQ ID NO: 4097417 - RNA, 13 nt, Zaire Ebola virus [ZEBOV]
ucaaugaaaccag

SEQ ID NO: 4097418 - RNA, 14 nt, Zaire Ebola virus [ZEBOV]
ucaaugaaaccagg

SEQ ID NO: 4097419 - RNA, 22 nt, Zaire Ebola virus [ZEBOV]
ucacaguuaaucauaaacaagg

SEQ ID NO: 4097420 - RNA, 21 nt, Zaire Ebola virus [ZEBOV]
ucagaaaauuccucugcaaug

SEQ ID NO: 4097421 - RNA, 14 nt, Zaire Ebola virus [ZEBOV]
uccugagagccaca

SEQ ID NO: 4097422 - RNA, 17 nt, Zaire Ebola virus [ZEBOV]
ucuauuuaguaauccgu

SEQ ID NO: 4097423 - RNA, 18 nt, Zaire Ebola virus [ZEBOV]
ucuucaacuguuccugag

SEQ ID NO: 4097424 - RNA, 13 nt, Zaire Ebola virus [ZEBOV]
ugacuaaaacacu

SEQ ID NO: 4097425 - RNA, 17 nt, Zaire Ebola virus [ZEBOV]
ugcauaguauccugaua

SEQ ID NO: 4097426 - RNA, 17 nt, Zaire Ebola virus [ZEBOV]
ugcuuacaucugaggau

SEQ ID NO: 4097427 - RNA, 17 nt, Zaire Ebola virus [ZEBOV]
uuauccucaaauugccu

SEQ ID NO: 4097428 - RNA, 14 nt, Zaire Ebola virus [ZEBOV]
uucgggccagcagc

SEQ ID NO: 4097429 - RNA, 21 nt, Zaire Ebola virus [ZEBOV]
uuguaacucaauauucuaacu

SEQ ID NO: 4097430 - RNA, 17 nt, Zaire Ebola virus [ZEBOV]
uuguucacaauccaagu

SEQ ID NO: 4097431 - RNA, 20 nt, Zaire Ebola virus [ZEBOV]
uuuaaccacagauaaauccu

SEQ ID NO: 4097432 - RNA, 15 nt, Zaire Ebola virus [ZEBOV]
uuuaucaccagaaau

SEQ ID NO: 4097433 - RNA, 22 nt, Zaire Ebola virus [ZEBOV]
uuuaucuaaauuaaauuacauu

SEQ ID NO: 4097434 - RNA, 16 nt, Zaire Ebola virus [ZEBOV]
uuucauaaucagauau

SEQ ID NO: 4097435 - RNA, 22 nt, Zaire Ebola virus [ZEBOV]
acucuacaggagguagcaacga

SEQ ID NO: 4097436 - RNA, 20 nt, Zaire Ebola virus [ZEBOV]
acugaagaccacaaaaucau

SEQ ID NO: 4097437 - RNA, 18 nt, Zaire Ebola virus [ZEBOV]
agaacaccaacacgagca

SEQ ID NO: 4097438 - RNA, 16 nt, Zaire Ebola virus [ZEBOV]
agacaaaauugaucag

SEQ ID NO: 4097439 - RNA, 13 nt, Zaire Ebola virus [ZEBOV]
agauauauaagca

SEQ ID NO: 4097440 - RNA, 13 nt, Zaire Ebola virus [ZEBOV]
agauuauucauga

SEQ ID NO: 4097441 - RNA, 14 nt, Zaire Ebola virus [ZEBOV]
agauugcuucaugg

SEQ ID NO: 4097442 - RNA, 18 nt, Zaire Ebola virus [ZEBOV]
agcauaauaaauaaauac

SEQ ID NO: 4097443 - RNA, 14 nt, Zaire Ebola virus [ZEBOV]
agcgauuuaucuaa

SEQ ID NO: 4097444 - RNA, 13 nt, Zaire Ebola virus [ZEBOV]
agcucagccucaa

SEQ ID NO: 4097445 - RNA, 12 nt, Zaire Ebola virus [ZEBOV]
auaaaacccuuc

SEQ ID NO: 4097446 - RNA, 19 nt, Zaire Ebola virus [ZEBOV]
auaaacuugaugaagauua

SEQ ID NO: 4097447 - RNA, 15 nt, Zaire Ebola virus [ZEBOV]
auaauuguaacucaa

SEQ ID NO: 4097448 - RNA, 18 nt, Zaire Ebola virus [ZEBOV]
auagugauaacaucuauu

SEQ ID NO: 4097449 - RNA, 22 nt, Zaire Ebola virus [ZEBOV]
aucauaaacaagguuugacauc

SEQ ID NO: 4097450 - RNA, 14 nt, Zaire Ebola virus [ZEBOV]
aucuauuuaguaau

SEQ ID NO: 4097451 - RNA, 23 nt, Zaire Ebola virus [ZEBOV]
augauucaaccgacaaauagcua

SEQ ID NO: 4097452 - RNA, 19 nt, Zaire Ebola virus [ZEBOV]
augcaacccuaauuuacau

SEQ ID NO: 4097453 - RNA, 14 nt, Zaire Ebola virus [ZEBOV]
auuugagucuuaau

SEQ ID NO: 4097454 - RNA, 15 nt, Zaire Ebola virus [ZEBOV]
caaaaccacagcgag

SEQ ID NO: 4097455 - RNA, 15 nt, Zaire Ebola virus [ZEBOV]
caaauaauguuuuac

SEQ ID NO: 4097456 - RNA, 18 nt, Zaire Ebola virus [ZEBOV]
caaucggacuggccugga

SEQ ID NO: 4097457 - RNA, 22 nt, Zaire Ebola virus [ZEBOV]
caaugguucaagugcacaguca

SEQ ID NO: 4097458 - RNA, 20 nt, Zaire Ebola virus [ZEBOV]
cacaacaacugaagaccaca

SEQ ID NO: 4097459 - RNA, 22 nt, Zaire Ebola virus [ZEBOV]
cacaacaaguccccaaaaccac

SEQ ID NO: 4097460 - RNA, 18 nt, Zaire Ebola virus [ZEBOV]
cacaaccaaaccaggucc

SEQ ID NO: 4097461 - RNA, 13 nt, Zaire Ebola virus [ZEBOV]
cacaaucaagaug

SEQ ID NO: 4097462 - RNA, 15 nt, Zaire Ebola virus [ZEBOV]
cacagcgagaccgcu

SEQ ID NO: 4097463 - RNA, 16 nt, Zaire Ebola virus [ZEBOV]
caccacaacaaguccc

SEQ ID NO: 4097464 - RNA, 15 nt, Zaire Ebola virus [ZEBOV]
cacccauaauacacc

SEQ ID NO: 4097465 - RNA, 20 nt, Zaire Ebola virus [ZEBOV]
cacgagcaagagcacugacu

SEQ ID NO: 4097466 - RNA, 16 nt, Zaire Ebola virus [ZEBOV]
cacugacuuccuggac

SEQ ID NO: 4097467 - RNA, 13 nt, Zaire Ebola virus [ZEBOV]
cagacauugcccu

SEQ ID NO: 4097468 - RNA, 21 nt, Zaire Ebola virus [ZEBOV]
caggcguuauaauugcaguua

SEQ ID NO: 4097469 - RNA, 15 nt, Zaire Ebola virus [ZEBOV]
cauacagauuauaaa

SEQ ID NO: 4097470 - RNA, 21 nt, Zaire Ebola virus [ZEBOV]
ccaaaccagguccggacaaca

SEQ ID NO: 4097471 - RNA, 18 nt, Zaire Ebola virus [ZEBOV]
ccaagaacauaacagaca

SEQ ID NO: 4097472 - RNA, 21 nt, Zaire Ebola virus [ZEBOV]
cccaaaagcagagaacaccaa

SEQ ID NO: 4097473 - RNA, 20 nt, Zaire Ebola virus [ZEBOV]
ccucugccacgaccgcagcc

SEQ ID NO: 4097474 - RNA, 16 nt, Zaire Ebola virus [ZEBOV]
cgacagcacagccucc

SEQ ID NO: 4097475 - RNA, 17 nt, Zaire Ebola virus [ZEBOV]
cuaacucauauaugcug

SEQ ID NO: 4097476 - RNA, 16 nt, Zaire Ebola virus [ZEBOV]
cucaaaucaaugaaac

SEQ ID NO: 4097477 - RNA, 13 nt, Zaire Ebola virus [ZEBOV]
cucagccucaaau

SEQ ID NO: 4097478 - RNA, 17 nt, Zaire Ebola virus [ZEBOV]
cucuugcacaaagugau

SEQ ID NO: 4097479 - RNA, 14 nt, Zaire Ebola virus [ZEBOV]
cuguauaugcaaau

SEQ ID NO: 4097480 - RNA, 10 nt, Zaire Ebola virus [ZEBOV]
cuucagauug

SEQ ID NO: 4097481 - RNA, 18 nt, Zaire Ebola virus [ZEBOV]
cuucauggaaaagcucag

SEQ ID NO: 4097482 - RNA, 23 nt, Zaire Ebola virus [ZEBOV]
cuucauggaaaagcucagccuca

SEQ ID NO: 4097483 - RNA, 23 nt, Zaire Ebola virus [ZEBOV]
cuugcaaagguugguuauuaaca

SEQ ID NO: 4097484 - RNA, 15 nt, Zaire Ebola virus [ZEBOV]
gaacagacaacgaca

SEQ ID NO: 4097485 - RNA, 13 nt, Zaire Ebola virus [ZEBOV]
gaagcugcagugu

SEQ ID NO: 4097486 - RNA, 21 nt, Zaire Ebola virus [ZEBOV]
gaauugcuuuauuauaugaau

SEQ ID NO: 4097487 - RNA, 20 nt, Zaire Ebola virus [ZEBOV]
gacaucucugcuuucauaau

SEQ ID NO: 4097488 - RNA, 15 nt, Zaire Ebola virus [ZEBOV]
gagcaagagcacuga

SEQ ID NO: 4097489 - RNA, 21 nt, Zaire Ebola virus [ZEBOV]
gaggcgaauaauagcagaggc

SEQ ID NO: 4097490 - RNA, 15 nt, Zaire Ebola virus [ZEBOV]
gagucgcaggacuga

SEQ ID NO: 4097491 - RNA, 20 nt, Zaire Ebola virus [ZEBOV]
gcaugauugcccuaauauau

SEQ ID NO: 4097492 - RNA, 15 nt, Zaire Ebola virus [ZEBOV]
gccagcagcgggaag

SEQ ID NO: 4097493 - RNA, 20 nt, Zaire Ebola virus [ZEBOV]
gcuuuauucuguauaugcaa

SEQ ID NO: 4097494 - RNA, 14 nt, Zaire Ebola virus [ZEBOV]
gggaagcugcagug

SEQ ID NO: 4097495 - RNA, 16 nt, Zaire Ebola virus [ZEBOV]
gguuauuaacauacag

SEQ ID NO: 4097496 - RNA, 18 nt, Zaire Ebola virus [ZEBOV]
guaagccagcuuccaagu

SEQ ID NO: 4097497 - RNA, 22 nt, Zaire Ebola virus [ZEBOV]
cacauucugggaccggacugcu

SEQ ID NO: 4097498 - RNA, 16 nt, Zaire Ebola virus [ZEBOV]
cacgagcaagagcacu

SEQ ID NO: 4097499 - RNA, 17 nt, Zaire Ebola virus [ZEBOV]
cagacaacgacagcaca

SEQ ID NO: 4097500 - RNA, 18 nt, Zaire Ebola virus [ZEBOV]
cagccggacccccaaaag

SEQ ID NO: 4097501 - RNA, 20 nt, Zaire Ebola virus [ZEBOV]
cauaguauccugauacuugc

SEQ ID NO: 4097502 - RNA, 14 nt, Zaire Ebola virus [ZEBOV]
cauuaaugauacac

SEQ ID NO: 4097503 - RNA, 19 nt, Zaire Ebola virus [ZEBOV]
ccauauuucgggccagcag

SEQ ID NO: 4097504 - RNA, 22 nt, Zaire Ebola virus [ZEBOV]
ccggagaagagagugccagcag

SEQ ID NO: 4097505 - RNA, 23 nt, Zaire Ebola virus [ZEBOV]
ccucugccacgaccgcagccgga

SEQ ID NO: 4097506 - RNA, 22 nt, Zaire Ebola virus [ZEBOV]
cgacccagggaccaacacaaca

SEQ ID NO: 4097507 - RNA, 14 nt, Zaire Ebola virus [ZEBOV]
cgagcaagagcacu

SEQ ID NO: 4097508 - RNA, 15 nt, Zaire Ebola virus [ZEBOV]
cgcagccggaccccc

SEQ ID NO: 4097509 - RNA, 15 nt, Zaire Ebola virus [ZEBOV]
cggacaacagcaccc

SEQ ID NO: 4097510 - RNA, 13 nt, Zaire Ebola virus [ZEBOV]
cggagccaaaaac

SEQ ID NO: 4097511 - RNA, 14 nt, Zaire Ebola virus [ZEBOV]
cucaauaguuaucu

SEQ ID NO: 4097512 - RNA, 19 nt, Zaire Ebola virus [ZEBOV]
cucacaguuaaucauaaac

SEQ ID NO: 4097513 - RNA, 19 nt, Zaire Ebola virus [ZEBOV]
cucuucaacuguuccugag

SEQ ID NO: 4097514 - RNA, 21 nt, Zaire Ebola virus [ZEBOV]
cuguggguugagacagcuggc

SEQ ID NO: 4097515 - RNA, 14 nt, Zaire Ebola virus [ZEBOV]
cuuccggaccaggg

SEQ ID NO: 4097516 - RNA, 23 nt, Zaire Ebola virus [ZEBOV]
cuucuuccgacccagggaccaac

SEQ ID NO: 4097517 - RNA, 13 nt, Zaire Ebola virus [ZEBOV]
gaacaacaucacc

SEQ ID NO: 4097518 - RNA, 15 nt, Zaire Ebola virus [ZEBOV]
gaacucgaagagaag

SEQ ID NO: 4097519 - RNA, 16 nt, Zaire Ebola virus [ZEBOV]
gacaaaugauaauaua

SEQ ID NO: 4097520 - RNA, 18 nt, Zaire Ebola virus [ZEBOV]
gacaggauggagacaaug

SEQ ID NO: 4097521 - RNA, 22 nt, Zaire Ebola virus [ZEBOV]
gacaucucugaggcaacucaag

SEQ ID NO: 4097522 - RNA, 21 nt, Zaire Ebola virus [ZEBOV]
gaccaagauaaaauuguucau

SEQ ID NO: 4097523 - RNA, 18 nt, Zaire Ebola virus [ZEBOV]
gccagcagccgagggaau

SEQ ID NO: 4097524 - RNA, 21 nt, Zaire Ebola virus [ZEBOV]
gcucagccucaaaucaaugaa

SEQ ID NO: 4097525 - RNA, 22 nt, Zaire Ebola virus [ZEBOV]
gcugcagcgauggggcggcaca

SEQ ID NO: 4097526 - RNA, 19 nt, Zaire Ebola virus [ZEBOV]
gcuucauggaaaagcucag

SEQ ID NO: 4097527 - RNA, 19 nt, Zaire Ebola virus [ZEBOV]
ggacuacucaggaugaagg

SEQ ID NO: 4097528 - RNA, 15 nt, Zaire Ebola virus [ZEBOV]
gucaaggaagggaag

SEQ ID NO: 4097529 - RNA, 12 nt, Zaire Ebola virus [ZEBOV]
gucaaugcucaa

SEQ ID NO: 4097530 - RNA, 18 nt, Zaire Ebola virus [ZEBOV]
guuuaaccacagauaaau

SEQ ID NO: 4097531 - RNA, 14 nt, Zaire Ebola virus [ZEBOV]
uaaaacccuuccgg

SEQ ID NO: 4097532 - RNA, 14 nt, Zaire Ebola virus [ZEBOV]
uagccaaugugauu

SEQ ID NO: 4097533 - RNA, 14 nt, Zaire Ebola virus [ZEBOV]
ucauaacuaauaac

SEQ ID NO: 4097534 - RNA, 18 nt, Zaire Ebola virus [ZEBOV]
ucauaacuaauaacauua

SEQ ID NO: 4097535 - RNA, 12 nt, Zaire Ebola virus [ZEBOV]
uccuggaccccg

SEQ ID NO: 4097536 - RNA, 14 nt, Zaire Ebola virus [ZEBOV]
ugaauuuaaagcua

SEQ ID NO: 4097537 - RNA, 20 nt, Zaire Ebola virus [ZEBOV]
ugauacaacccuaacaguga

SEQ ID NO: 4097538 - RNA, 20 nt, Zaire Ebola virus [ZEBOV]
ugauucuuauuuuugaauuu

SEQ ID NO: 4097539 - RNA, 18 nt, Zaire Ebola virus [ZEBOV]
ugcugacucaauaguuau

SEQ ID NO: 4097540 - RNA, 23 nt, Zaire Ebola virus [ZEBOV]
aaaauaaguauuucaugacuuac

SEQ ID NO: 4097541 - RNA, 13 nt, Zaire Ebola virus [ZEBOV]
aaagguugguuau

SEQ ID NO: 4097542 - RNA, 16 nt, Zaire Ebola virus [ZEBOV]
aaagguugguuauuaa

SEQ ID NO: 4097543 - RNA, 20 nt, Zaire Ebola virus [ZEBOV]
aaauguaauaggagcuauau

SEQ ID NO: 4097544 - RNA, 18 nt, Zaire Ebola virus [ZEBOV]
aacaaugggaugauucaa

SEQ ID NO: 4097545 - RNA, 21 nt, Zaire Ebola virus [ZEBOV]
aacuugacaucucugaggcaa

SEQ ID NO: 4097546 - RNA, 14 nt, Zaire Ebola virus [ZEBOV]
aagagauuccaaga

SEQ ID NO: 4097547 - RNA, 23 nt, Zaire Ebola virus [ZEBOV]
aauauaugaagagguaugauaca

SEQ ID NO: 4097548 - RNA, 18 nt, Zaire Ebola virus [ZEBOV]
aaucaauacggugauuca

SEQ ID NO: 4097549 - RNA, 18 nt, Zaire Ebola virus [ZEBOV]
aaucuuucucauugcaca

SEQ ID NO: 4097550 - RNA, 22 nt, Zaire Ebola virus [ZEBOV]
aaugauaauauaauacacugga

SEQ ID NO: 4097551 - RNA, 18 nt, Zaire Ebola virus [ZEBOV]
aauugcaguuaucgcuuu

SEQ ID NO: 4097552 - RNA, 12 nt, Zaire Ebola virus [ZEBOV]
aauuugucuuuu

SEQ ID NO: 4097553 - RNA, 14 nt, Zaire Ebola virus [ZEBOV]
acaacgacagcaca

SEQ ID NO: 4097554 - RNA, 17 nt, Zaire Ebola virus [ZEBOV]
acaacgacagcacagcc

SEQ ID NO: 4097555 - RNA, 18 nt, Zaire Ebola virus [ZEBOV]
acaaguccccaaaaccac

SEQ ID NO: 4097556 - RNA, 14 nt, Zaire Ebola virus [ZEBOV]
acagauaaauccuc

SEQ ID NO: 4097557 - RNA, 19 nt, Zaire Ebola virus [ZEBOV]
acauuaaugauacacuugu

SEQ ID NO: 4097558 - RNA, 20 nt, Zaire Ebola virus [ZEBOV]
acauuaugcuuuuauaacuu

SEQ ID NO: 4097559 - RNA, 14 nt, Zaire Ebola virus [ZEBOV]
acccuaacagugau

SEQ ID NO: 4097560 - RNA, 16 nt, Zaire Ebola virus [ZEBOV]
acccuuccggaccagg

SEQ ID NO: 4097561 - RNA, 18 nt, Zaire Ebola virus [ZEBOV]
agagcacugacuuccugg

SEQ ID NO: 4097562 - RNA, 19 nt, Zaire Ebola virus [ZEBOV]
agauuacuugacaaaugau

SEQ ID NO: 4097563 - RNA, 13 nt, Zaire Ebola virus [ZEBOV]
agcaagagcacug

SEQ ID NO: 4097564 - RNA, 19 nt, Zaire Ebola virus [ZEBOV]
agcacagccuccgacacuc

SEQ ID NO: 4097565 - RNA, 19 nt, Zaire Ebola virus [ZEBOV]
aggauuuaauuauauggau

SEQ ID NO: 4097566 - RNA, 21 nt, Zaire Ebola virus [ZEBOV]
agguuucacagauucuauaua

SEQ ID NO: 4097567 - RNA, 15 nt, Zaire Ebola virus [ZEBOV]
aguacuauaaucacu

SEQ ID NO: 4097568 - RNA, 21 nt, Zaire Ebola virus [ZEBOV]
aguauuucaugacuuacuaau

SEQ ID NO: 4097569 - RNA, 19 nt, Zaire Ebola virus [ZEBOV]
agucaaggaagggaagcug

SEQ ID NO: 4097570 - RNA, 14 nt, Zaire Ebola virus [ZEBOV]
auaaacuugacauc

SEQ ID NO: 4097571 - RNA, 13 nt, Zaire Ebola virus [ZEBOV]
auaauuguaacuc

SEQ ID NO: 4097572 - RNA, 23 nt, Zaire Ebola virus [ZEBOV]
auauaaccugccaagcauaccuc

SEQ ID NO: 4097573 - RNA, 14 nt, Zaire Ebola virus [ZEBOV]
auauauuacuaacu

SEQ ID NO: 4097574 - RNA, 18 nt, Zaire Ebola virus [ZEBOV]
aucauagaauugcuuuau

SEQ ID NO: 4097575 - RNA, 21 nt, Zaire Ebola virus [ZEBOV]
auccaguuuuauagaaucuuc

SEQ ID NO: 4097576 - RNA, 15 nt, Zaire Ebola virus [ZEBOV]
aucuaacaacccuug

SEQ ID NO: 4097577 - RNA, 15 nt, Zaire Ebola virus [ZEBOV]
augcuuuuauaacuu

SEQ ID NO: 4097578 - RNA, 15 nt, Zaire Ebola virus [ZEBOV]
auuaacauacagauu

SEQ ID NO: 4097579 - RNA, 17 nt, Zaire Ebola virus [ZEBOV]
auucuuauuuuugaauu

SEQ ID NO: 4097580 - RNA, 16 nt, Zaire Ebola virus [ZEBOV]
auugucuuuuuucucu

SEQ ID NO: 4097581 - RNA, 15 nt, Zaire Ebola virus [ZEBOV]
auuuuaucaccagaa

SEQ ID NO: 4097582 - RNA, 23 nt, Zaire Ebola virus [ZEBOV]
caaacggagccaaaaacaucagu

SEQ ID NO: 4097583 - RNA, 13 nt, Zaire Ebola virus [ZEBOV]
caacgacagcaca

SEQ ID NO: 4097584 - RNA, 15 nt, Zaire Ebola virus [ZEBOV]
caacugaagaccaca

SEQ ID NO: 4097585 - RNA, 16 nt, Zaire Ebola virus [ZEBOV]
caaucccucacaacca

SEQ ID NO: 4097586 - RNA, 22 nt, Zaire Ebola virus [ZEBOV]
cacaaaaucauggcuucagaaa

SEQ ID NO: 4097587 - RNA, 17 nt, Zaire Ebola virus [ZEBOV]
cacaaccaaaccagguc

SEQ ID NO: 4097588 - RNA, 15 nt, Zaire Ebola virus [ZEBOV]
cagacaacgacagca

SEQ ID NO: 4097589 - RNA, 21 nt, Zaire Ebola virus [ZEBOV]
cagcuggccaacgagacgacu

SEQ ID NO: 4097590 - RNA, 19 nt, Zaire Ebola virus [ZEBOV]
caggacucagaaucccuca

SEQ ID NO: 4097591 - RNA, 23 nt, Zaire Ebola virus [ZEBOV]
cauaaacaagguuugacaucaau

SEQ ID NO: 4097592 - RNA, 16 nt, Zaire Ebola virus [ZEBOV]
cauaacagacaaaauu

SEQ ID NO: 4097593 - RNA, 15 nt, Zaire Ebola virus [ZEBOV]
cauagaauugcuuua

SEQ ID NO: 4097594 - RNA, 22 nt, Zaire Ebola virus [ZEBOV]
cauuacuggacuacucaggaug

SEQ ID NO: 4097595 - RNA, 17 nt, Zaire Ebola virus [ZEBOV]
ccagggaccaacacaac

SEQ ID NO: 4097596 - RNA, 18 nt, Zaire Ebola virus [ZEBOV]
ccauauuucgggccagca

SEQ ID NO: 4097597 - RNA, 16 nt, Zaire Ebola virus [ZEBOV]
ccccaaaaccacagcg

SEQ ID NO: 4097598 - RNA, 19 nt, Zaire Ebola virus [ZEBOV]
ccgacccagggaccaacac

SEQ ID NO: 4097599 - RNA, 21 nt, Zaire Ebola virus [ZEBOV]
cguccauuagaggagacacuu

SEQ ID NO: 4097600 - RNA, 21 nt, Zaire Ebola virus [ZEBOV]
cucagggauagugauaacauc

SEQ ID NO: 4097601 - RNA, 16 nt, Zaire Ebola virus [ZEBOV]
cuuaauuaccaauacu

SEQ ID NO: 4097602 - RNA, 14 nt, Zaire Ebola virus [ZEBOV]
cuuccgacccaggg

SEQ ID NO: 4097603 - RNA, 13 nt, Zaire Ebola virus [ZEBOV]
cuuuuugcccuua

SEQ ID NO: 4097604 - RNA, 20 nt, Zaire Ebola virus [ZEBOV]
gaaaauuccucugcaauggu

SEQ ID NO: 4097605 - RNA, 15 nt, Zaire Ebola virus [ZEBOV]
gaauuauuaucacaa

SEQ ID NO: 4097606 - RNA, 20 nt, Zaire Ebola virus [ZEBOV]
gacacccuuacaaaaaccag

SEQ ID NO: 4097607 - RNA, 19 nt, Zaire Ebola virus [ZEBOV]
gaccagggggacaaugaca

SEQ ID NO: 4097608 - RNA, 19 nt, Zaire Ebola virus [ZEBOV]
gauucuuguacacaaauaa

SEQ ID NO: 4097609 - RNA, 21 nt, Zaire Ebola virus [ZEBOV]
gcgaacuucuuccgacccagg

SEQ ID NO: 4097610 - RNA, 23 nt, Zaire Ebola virus [ZEBOV]
aaaaucgggacccauuucuaggu

SEQ ID NO: 4097611 - RNA, 21 nt, Zaire Ebola virus [ZEBOV]
aaacuuauucaguacuauaau

SEQ ID NO: 4097612 - RNA, 21 nt, Zaire Ebola virus [ZEBOV]
aacaucaccgcagaacagaca

SEQ ID NO: 4097613 - RNA, 20 nt, Zaire Ebola virus [ZEBOV]
aacgaaaacaggaagaauuu

SEQ ID NO: 4097614 - RNA, 18 nt, Zaire Ebola virus [ZEBOV]
aacucauauaugcugacu

SEQ ID NO: 4097615 - RNA, 19 nt, Zaire Ebola virus [ZEBOV]
aacugaagaccacaaaauc

SEQ ID NO: 4097616 - RNA, 18 nt, Zaire Ebola virus [ZEBOV]
aagagagugccagcagcg

SEQ ID NO: 4097617 - RNA, 12 nt, Zaire Ebola virus [ZEBOV]
aagguugguuau

SEQ ID NO: 4097618 - RNA, 14 nt, Zaire Ebola virus [ZEBOV]
aaucaagaugguuu

SEQ ID NO: 4097619 - RNA, 14 nt, Zaire Ebola virus [ZEBOV]
aauccucacuguaa

SEQ ID NO: 4097620 - RNA, 17 nt, Zaire Ebola virus [ZEBOV]
aauuaauaagaugugca

SEQ ID NO: 4097621 - RNA, 20 nt, Zaire Ebola virus [ZEBOV]
acaauccaaguacagacauu

SEQ ID NO: 4097622 - RNA, 16 nt, Zaire Ebola virus [ZEBOV]
acaugccacauucugg

SEQ ID NO: 4097623 - RNA, 19 nt, Zaire Ebola virus [ZEBOV]
accacaugauuggaccaag

SEQ ID NO: 4097624 - RNA, 15 nt, Zaire Ebola virus [ZEBOV]
acgacagcacagccu

SEQ ID NO: 4097625 - RNA, 14 nt, Zaire Ebola virus [ZEBOV]
acgagacgacucaa

SEQ ID NO: 4097626 - RNA, 15 nt, Zaire Ebola virus [ZEBOV]
acgcaccuuuucaau

SEQ ID NO: 4097627 - RNA, 12 nt, Zaire Ebola virus [ZEBOV]
acuugcaaaggu

SEQ ID NO: 4097628 - RNA, 14 nt, Zaire Ebola virus [ZEBOV]
agauauauaagcau

SEQ ID NO: 4097629 - RNA, 21 nt, Zaire Ebola virus [ZEBOV]
agcauaauaaauaaauacuca

SEQ ID NO: 4097630 - RNA, 20 nt, Zaire Ebola virus [ZEBOV]
agcuaggcuuaauuaccaau

SEQ ID NO: 4097631 - RNA, 12 nt, Zaire Ebola virus [ZEBOV]
agcucagccuca

SEQ ID NO: 4097632 - RNA, 19 nt, Zaire Ebola virus [ZEBOV]
agcucuucaacuguuccug

SEQ ID NO: 4097633 - RNA, 17 nt, Zaire Ebola virus [ZEBOV]
aggcguuauaauugcag

SEQ ID NO: 4097634 - RNA, 13 nt, Zaire Ebola virus [ZEBOV]
agugccagcagcg

SEQ ID NO: 4097635 - RNA, 14 nt, Zaire Ebola virus [ZEBOV]
aguuauagccauaa

SEQ ID NO: 4097636 - RNA, 19 nt, Zaire Ebola virus [ZEBOV]
auaaacaagguuugacauc

SEQ ID NO: 4097637 - RNA, 19 nt, Zaire Ebola virus [ZEBOV]
auacucauauuucuugaua

SEQ ID NO: 4097638 - RNA, 18 nt, Zaire Ebola virus [ZEBOV]
auacucguaauuaacauu

SEQ ID NO: 4097639 - RNA, 13 nt, Zaire Ebola virus [ZEBOV]
auacuugcaaagg

SEQ ID NO: 4097640 - RNA, 14 nt, Zaire Ebola virus [ZEBOV]
auagaaucuucuca

SEQ ID NO: 4097641 - RNA, 21 nt, Zaire Ebola virus [ZEBOV]
aucaaacggagccaaaaacau

SEQ ID NO: 4097642 - RNA, 15 nt, Zaire Ebola virus [ZEBOV]
aucaaugaaaccagg

SEQ ID NO: 4097643 - RNA, 22 nt, Zaire Ebola virus [ZEBOV]
auccugauacuugcaaagguug

SEQ ID NO: 4097644 - RNA, 23 nt, Zaire Ebola virus [ZEBOV]
aucgcuuuauucuguauaugcaa

SEQ ID NO: 4097645 - RNA, 17 nt, Zaire Ebola virus [ZEBOV]
aucucugcuuucauaau

SEQ ID NO: 4097646 - RNA, 18 nt, Zaire Ebola virus [ZEBOV]
auggaaaagcucagccuc

SEQ ID NO: 4097647 - RNA, 16 nt, Zaire Ebola virus [ZEBOV]
auuauaugaauaagca

SEQ ID NO: 4097648 - RNA, 17 nt, Zaire Ebola virus [ZEBOV]
auucuaacuagcgauuu

SEQ ID NO: 4097649 - RNA, 21 nt, Zaire Ebola virus [ZEBOV]
auuuuaucaccagaaauccua

SEQ ID NO: 4097650 - RNA, 23 nt, Zaire Ebola virus [ZEBOV]
caaaaacaucaguggucagaguc

SEQ ID NO: 4097651 - RNA, 20 nt, Zaire Ebola virus [ZEBOV]
caaauaauguuuuacucuac

SEQ ID NO: 4097652 - RNA, 21 nt, Zaire Ebola virus [ZEBOV]
caacaaguccccaaaaccaca

SEQ ID NO: 4097653 - RNA, 22 nt, Zaire Ebola virus [ZEBOV]
caacacgagcaagagcacugac

SEQ ID NO: 4097654 - RNA, 18 nt, Zaire Ebola virus [ZEBOV]
caacccuugccacaaucu

SEQ ID NO: 4097655 - RNA, 20 nt, Zaire Ebola virus [ZEBOV]
caagauaccggagaagagag

SEQ ID NO: 4097656 - RNA, 19 nt, Zaire Ebola virus [ZEBOV]
caauacuccguauaccuau

SEQ ID NO: 4097657 - RNA, 21 nt, Zaire Ebola virus [ZEBOV]
cacaaagugauucuuguacac

SEQ ID NO: 4097658 - RNA, 17 nt, Zaire Ebola virus [ZEBOV]
cacaaucuccacgaguc

SEQ ID NO: 4097659 - RNA, 15 nt, Zaire Ebola virus [ZEBOV]
cacaugccacauucu

SEQ ID NO: 4097660 - RNA, 21 nt, Zaire Ebola virus [ZEBOV]
cagacaacgacagcacagccu

SEQ ID NO: 4097661 - RNA, 20 nt, Zaire Ebola virus [ZEBOV]
caggaugaaggugcugcaau

SEQ ID NO: 4097662 - RNA, 19 nt, Zaire Ebola virus [ZEBOV]
cauauuucgggccagcagc

SEQ ID NO: 4097663 - RNA, 16 nt, Zaire Ebola virus [ZEBOV]
ccccgccaccacaaca

SEQ ID NO: 4097664 - RNA, 14 nt, Zaire Ebola virus [ZEBOV]
ccggacaacagcac

SEQ ID NO: 4097665 - RNA, 23 nt, Zaire Ebola virus [ZEBOV]
ccggagaagagagugccagcagc

SEQ ID NO: 4097666 - RNA, 14 nt, Zaire Ebola virus [ZEBOV]
ccucugccacgacc

SEQ ID NO: 4097667 - RNA, 21 nt, Zaire Ebola virus [ZEBOV]
cgcaucuaacaacccuugcca

SEQ ID NO: 4097668 - RNA, 15 nt, Zaire Ebola virus [ZEBOV]
cuaauuuacauuacu

SEQ ID NO: 4097669 - RNA, 15 nt, Zaire Ebola virus [ZEBOV]
cugauacuugcaaag

SEQ ID NO: 4097670 - RNA, 16 nt, Zaire Ebola virus [ZEBOV]
cuggcaacaacaacac

SEQ ID NO: 4097671 - RNA, 22 nt, Zaire Ebola virus [ZEBOV]
cuucagaaaauuccucugcaau

SEQ ID NO: 4097672 - RNA, 15 nt, Zaire Ebola virus [ZEBOV]
gaaagaucauaacua

SEQ ID NO: 4097673 - RNA, 16 nt, Zaire Ebola virus [ZEBOV]
gaagagguaugauaca

SEQ ID NO: 4097674 - RNA, 18 nt, Zaire Ebola virus [ZEBOV]
gaagggaagcugcagugu

SEQ ID NO: 4097675 - RNA, 15 nt, Zaire Ebola virus [ZEBOV]
gaaugauaaacuuga

SEQ ID NO: 4097676 - RNA, 19 nt, Zaire Ebola virus [ZEBOV]
gacaaaauugaucagauua

SEQ ID NO: 4097677 - RNA, 17 nt, Zaire Ebola virus [ZEBOV]
gacaacgacagcacagc

SEQ ID NO: 4097678 - RNA, 18 nt, Zaire Ebola virus [ZEBOV]
gacauugcccuucuaauu

SEQ ID NO: 4097679 - RNA, 16 nt, Zaire Ebola virus [ZEBOV]
gaccagggggacaaug

SEQ ID NO: 4097680 - RNA, 15 nt, Zaire Ebola virus [ZEBOV]
gacuacucaggauga

SEQ ID NO: 4097681 - RNA, 17 nt, Zaire Ebola virus [ZEBOV]
gauaccggagaagagag

SEQ ID NO: 4097682 - RNA, 15 nt, Zaire Ebola virus [ZEBOV]
gaucucuuaaaauau

SEQ ID NO: 4097683 - RNA, 24 nt, Zaire Ebola virus [ZEBOV]
gaugauucaaccgacaaauagcua

SEQ ID NO: 4097684 - RNA, 15 nt, Zaire Ebola virus [ZEBOV]
gcacagucaaggaag

SEQ ID NO: 4097685 - RNA, 17 nt, Zaire Ebola virus [ZEBOV]
gcaggacugaucacagg

SEQ ID NO: 4097686 - RNA, 21 nt, Zaire Ebola virus [ZEBOV]
gcuuuacaccauugucuuuuu

SEQ ID NO: 4097687 - RNA, 19 nt, Zaire Ebola virus [ZEBOV]
ggacccccaaaagcagaga

SEQ ID NO: 4097688 - RNA, 21 nt, Zaire Ebola virus [ZEBOV]
guccccaaucccucacaacca

SEQ ID NO: 4097689 - RNA, 12 nt, Zaire Ebola virus [ZEBOV]
guuaaucuuucu

SEQ ID NO: 4097690 - RNA, 18 nt, Zaire Ebola virus [ZEBOV]
guugguuauuaacauaca

SEQ ID NO: 4097691 - RNA, 16 nt, Zaire Ebola virus [ZEBOV]
uaacagacaaaauuga

SEQ ID NO: 4097692 - RNA, 17 nt, Zaire Ebola virus [ZEBOV]
uaguauccugauacuug

SEQ ID NO: 4097693 - RNA, 21 nt, Zaire Ebola virus [ZEBOV]
uauaugcugacucaauaguua

SEQ ID NO: 4097694 - RNA, 16 nt, Zaire Ebola virus [ZEBOV]
ucaaacaagagauucc

SEQ ID NO: 4097695 - RNA, 14 nt, Zaire Ebola virus [ZEBOV]
ucaaccgacaaaua

SEQ ID NO: 4097696 - RNA, 16 nt, Zaire Ebola virus [ZEBOV]
ucaaguugaacaacau

SEQ ID NO: 4097697 - RNA, 15 nt, Zaire Ebola virus [ZEBOV]
ucacaaccaaaccag

SEQ ID NO: 4097698 - RNA, 15 nt, Zaire Ebola virus [ZEBOV]
ucagccucaaaucaa

SEQ ID NO: 4097699 - RNA, 17 nt, Zaire Ebola virus [ZEBOV]
uccugauacuugcaaag

SEQ ID NO: 4097700 - RNA, 17 nt, Zaire Ebola virus [ZEBOV]
ucuccuaaauguagaac

SEQ ID NO: 4097701 - RNA, 23 nt, Zaire Ebola virus [ZEBOV]
ucucugcuuucauaaucagauau

SEQ ID NO: 4097702 - RNA, 14 nt, Zaire Ebola virus [ZEBOV]
ucuuaaugcaaaua

SEQ ID NO: 4097703 - RNA, 16 nt, Zaire Ebola virus [ZEBOV]
ugcauaguauccugau

SEQ ID NO: 4097704 - RNA, 19 nt, Zaire Ebola virus [ZEBOV]
ugccagcagcgggaagcua

SEQ ID NO: 4097705 - RNA, 20 nt, Zaire Ebola virus [ZEBOV]
uguaucgaaccacaugauug

SEQ ID NO: 4097706 - RNA, 14 nt, Zaire Ebola virus [ZEBOV]
uguuuuuaaaggau

SEQ ID NO: 4097707 - RNA, 21 nt, Zaire Ebola virus [ZEBOV]
uuaacauacagauuauaaaaa

SEQ ID NO: 4097708 - RNA, 18 nt, Zaire Ebola virus [ZEBOV]
uucacagauucuauauau

SEQ ID NO: 4097709 - RNA, 13 nt, Zaire Ebola virus [ZEBOV]
uugcacaaaguga

SEQ ID NO: 4097710 - RNA, 22 nt, Zaire Ebola virus [ZEBOV]
uuuacacgaucguuuuauaauu

SEQ ID NO: 4097711 - RNA, 15 nt, Zaire Ebola virus [ZEBOV]
uggagacaauggaua

SEQ ID NO: 4097712 - RNA, 20 nt, Zaire Ebola virus [ZEBOV]
ugguuauuaacauacagauu

SEQ ID NO: 4097713 - RNA, 13 nt, Zaire Ebola virus [ZEBOV]
uuauucaugauuu

SEQ ID NO: 4097714 - RNA, 17 nt, Zaire Ebola virus [ZEBOV]
uucugggaccggacugc

SEQ ID NO: 4097715 - RNA, 18 nt, Zaire Ebola virus [ZEBOV]
uugagacagcuggccaac

SEQ ID NO: 4097716 - RNA, 16 nt, Zaire Ebola virus [ZEBOV]
uugagucuuaaugcaa

SEQ ID NO: 4097717 - RNA, 23 nt, Zaire Ebola virus [ZEBOV]
uugcuggagucgcaggacugauc

SEQ ID NO: 4097718 - RNA, 18 nt, Zaire Ebola virus [ZEBOV]
uuuaucaccagaaauccu

SEQ ID NO: 4097719 - RNA, 13 nt, Zaire Ebola virus [ZEBOV]
uuucaauccucaa

SEQ ID NO: 4097720 - RNA, 16 nt, Zaire Ebola virus [ZEBOV]
uuuucaaaguucaauu

SEQ ID NO: 4097721 - RNA, 94 nt, B19 virus
cccgccuuaugcaaaugggcagccauuuuaaguguuucacuauaauuuuauuggucaguuuuguaacgguuaaaaugggcggagcguaggcggg

SEQ ID NO: 4097722 - RNA, 66 nt, B19 virus
cuccaguuuugucuguaacauccuuaacagcaauuucugauaugguuacaguuaaagcaucaggag

SEQ ID NO: 4097723 - RNA, 99 nt, Barmah Forest virus
ggaacuaaucacuauuagcaagccuagacucgcuaguacugugaugguccaguaaggguacaggucauaguaaugugagacuaugcuaauaggguuacc

SEQ ID NO: 4097724 - RNA, 79 nt, Barmah Forest virus
uaguaugugcaagacacuagcagaauaguauguaugauaguauauuuauaagauuaguuuguuauguaaguauguagua

SEQ ID NO: 4097725 - RNA, 84 nt, BK polyomavirus
caggggcugaaguaucugagacuugggaagagcauugugauugggauucagugcuugauccauguccagagucuucaguuucug

SEQ ID NO: 4097726 - RNA, 80 nt, Colorado tick fever virus
gaggagauucgcaaggugaggcaguucauggucaaguuuccguuuggccgaacuuguccucauugagauuggauauuuuc

SEQ ID NO: 4097727 - RNA, 130 nt, Colorado tick fever virus
guaaagcuggugagaggcaucaaguuggucggcggccuagagugauacagaugguugguacugagggucaauuguccgcauuuguauugcacaauguacuucguccugccuauaaggcuacuagguuuac

SEQ ID NO: 4097728 - RNA, 85 nt, Dengue virus
agcccugauagcuggaguuugguaucuuauuggaaguccucuaagggcuuccuccauuucagcugccacgacucuagugggggcu

SEQ ID NO: 4097729 - RNA, 64 nt, Dobrava virus
uaguaguagacuccgcaagaaauagcaguuaaauaacagcaugaucaugugggguuuacuauug

SEQ ID NO: 4097730 - RNA, 64 nt, Dobrava virus
uguggcugaagaguacaucuccuaugguggugaaaggaaaauuuuauguauucaaucagcuuua

SEQ ID NO: 4097731 - RNA, 61 nt, Eastern equine encephalitis virus
gucaucgacacugacgucagucgccaguaucccggucaucuggucgcacagugucgcuggc

SEQ ID NO: 4097732 - RNA, 56 nt, Eastern equine encephalitis virus
augcuaauguggucaacgcugugaugauuagugacacguaguucaccucguagcgu

SEQ ID NO: 4097733 - RNA, 55 nt, Eastern equine encephalitis virus
cgccuaggcggauuaggaucccgguaagccaucggguuaaucggcgccauaggcg

SEQ ID NO: 4097734 - RNA, 63 nt, Eastern equine encephalitis virus
guguggauauucgguagcagcacagcguucaaccugcgcacaagcucucgauguauaccacau

SEQ ID NO: 4097735 - RNA, 91 nt, Eastern equine encephalitis virus
cuauccaaaauggagaaaguucauguugacuuagacgcagacagcccauucgucaagucacugcaaagaugcuuuccacauuuugagauag

SEQ ID NO: 4097736 - RNA, 68 nt, Hepatitis A virus
uaaaucuuaugauugguggagaaugagauuuuaugaccaguguuucauuugugaccuuucaugauuug

SEQ ID NO: 4097737 - RNA, 78 nt, Hepatitis A virus
guuaccauugccugauuuauagauccaagguuuuuaaguuucugaugaacucuugcuauacaaucucucaaaggugac

SEQ ID NO: 4097738 - RNA, 110 nt, Hepatitis A virus
gagaauuaugaaaguggaguuuacucaguguucaaugaauguggucuccaaaacgcuuuuuagaaagagucccauuuaucaucacauugauaaaaccaugauuaauuuuc

SEQ ID NO: 4097739 - RNA, 81 nt, Hepatitis A virus
caucacagccauuggaucaauuucagcuuuagaaaagggcauagcugcaggaaaauuaaucaugguuuuaucaaugugaug

SEQ ID NO: 4097740 - RNA, 66 nt, Hepatitis B virus
uggaugaugugguauugggggccaagucuguacaacaucuugagucccuuuuuaccucuauuacca

SEQ ID NO: 4097741 - RNA, 68 nt, Hepatitis B virus
ucauguucauguccuacuguucaagccuccaagcugugccuuggguggcuuuggggcauggacauuga

SEQ ID NO: 4097742 - RNA, 102 nt, Hepatitis C virus
gccggaacgaggaccaucgcaucacccaaggguccugucauccagauguauaccaauguggaccaagaccuugugggcuggcccgcuccucaagguucccgc

SEQ ID NO: 4097743 - RNA, 55 nt, Hepatitis C virus
ggccgggagaagguuggcgagagggucacccccuucuauggccagcuccucggcc

SEQ ID NO: 4097744 - RNA, 100 nt, Hepatitis C virus
acgccuucuacgggauguggccucuccuccugcuccugcuggcguugccucagcgggcauacgcacuggacacggagguggccgcgucguguggcggcgu

SEQ ID NO: 4097745 - RNA, 74 nt, Hepatitis C virus
gacugcaauuguucuaucuaucccggccauauaacgggucaucgcauggcaugggauaugaugaugaacugguc

SEQ ID NO: 4097746 - RNA, 68 nt, Hepatitis C virus
gccauccugcacacuccggggugugucccuugcguucgcgaggguaacgccucgagguguuggguggc

SEQ ID NO: 4097747 - RNA, 56 nt, Hepatitis C virus
gacgacugguuccacagccacggccagaucucgcaggccguugugcgcccagucuc

SEQ ID NO: 4097748 - RNA, 78 nt, Hepatitis C virus
ggccccucuauggcaaugaggguugcgggugggcgggauggcuccugucuccccguggcucucggccuagcuggggcc

SEQ ID NO: 4097749 - RNA, 113 nt, Hepatitis C virus
ggucccccacguagagggccgagcagaggguggcgcucccgacaagcagaucgauaugacgucgaagcugcguuguggggaguuugccgucccugguggccaccguggggguc

SEQ ID NO: 4097750 - RNA, 71 nt, Hepatitis C virus
ggucuuggaggguagugccagcaguaggggcguucgucgaggccgcuuccguuggcauaacugauaggacc

SEQ ID NO: 4097751 - RNA, 100 nt, Hepatitis C virus
cauguacgcucguagccuaacuguagucucggcgggcgugagcucauaccaagcacagcccgcgucauagcacucacagaggacggacgagucgaacaug

SEQ ID NO: 4097752 - RNA, 55 nt, Hepatitis C virus
cugcccaguugaagagguacuugccacauauggcagcccugccuccucuggacag

SEQ ID NO: 4097753 - RNA, 100 nt, Hepatitis C virus
ggagcguccgcgcuaggcuucuguccagaggaggcagggcugccauauguggcaaguaccucuucaacugggcaguaagaacaaagcucaaacucacucc

SEQ ID NO: 4097754 - RNA, 92 nt, Hepatitis C virus
gguggccaccagggacggcaaacuccccacaacgcagcuucgacgucauaucgaucugcuugucgggagcgccacccucugcucggcccucu

SEQ ID NO: 4097755 - RNA, 125 nt, Hepatitis D virus
uccgaaggaggacgcacguccacucggauggcuaagggagagccacuuuucucucgcuucucucugggaagcuagagagauuugugggucccauucgccauuaccgaggggacgguccccucgga

SEQ ID NO: 4097756 - RNA, 56 nt, Hepatitis D virus
ggagagccacuuuucucucgcuucucucugggaagcuagagagauuuguggguccc

SEQ ID NO: 4097757 - RNA, 66 nt, Hepatitis D virus
ggcuccacugguccccaauguucaaagucaccccccucggucacuuugaaaggggguccgggaguc

SEQ ID NO: 4097758 - RNA, 62 nt, Hepatitis E virus
ccaccgccggaaccgccgcugcgccgcccacggcggcggccagacggcugaccgggcggugg

SEQ ID NO: 4097759 - RNA, 70 nt, Hepatitis E virus
ugugaccuugguccagucgagcgaccgggcaacggccugcgcgccggucgcuacauuaaccaaggucaca

SEQ ID NO: 4097760 - RNA, 70 nt, Hepatitis E virus
ugugaccuugguuaauguagcgaccggcgcgcaggccguugcccggucgcucgacuggaccaaggucaca

SEQ ID NO: 4097761 - RNA, 78 nt, Hepatitis E virus
gagacugaaagggccggcggccauagugcucugacuggcaucaaaagagagauuguggcgcucugggccauuagucuc

SEQ ID NO: 4097762 - RNA, 76 nt, Hepatitis E virus
cccgcgccaccgcccggucagccgucuggccgccgccgugggcggcgcagcggcgguuccggcggugguuucuggg

SEQ ID NO: 4097763 - RNA, 85 nt, Human
aaaaaaauccaagucagggauaguuugacuacagaggagaaaucauacaugaggugucaaauuauccccugacauagauuuuuuu

SEQ ID NO: 4097764 - RNA, 80 nt, Human
aaaaaauaccaugccuggacuccacucucagaguuacuaauucaauuaaucugagaugacccuagccgcuggcauuuuuu

SEQ ID NO: 4097765 - RNA, 69 nt, Human
aaaaacaucaaauuaggccaugaagcagaaauccuauguuugagcuaugggcuuggauuuguugucauu

SEQ ID NO: 4097766 - RNA, 88 nt, Human
aaaaacuauuuggugauaaagcagcuuggguugaugauuaauuauaaaauauuaacagcaaccacagugcugguccuagauauuuuuu

SEQ ID NO: 4097767 - RNA, 74 nt, Human
aaaaagagauuauacuuguuuuuaccauuuguguccuagauguaguacacugguaggaagagauggcucuauuu

SEQ ID NO: 4097768 - RNA, 70 nt, Human
aaaaagccagagcaagcugucacagauaggcucauauaucaacagcacugugacuuuuuguuugcuuuuu

SEQ ID NO: 4097769 - RNA, 68 nt, Human
aaaaaguaaucauuuuuauuugcauuggcauuuuugucaauucagacugagaaaugaugagccuuuuu

SEQ ID NO: 4097770 - RNA, 78 nt, Human
aaaaauagagcaaaguggaccaaaagaagagguaagcagauuuuauuacacuuauuuuuguccacuuccucaguuuuu

SEQ ID NO: 4097771 - RNA, 129 nt, Human
aaaaauaugcucucuuuguggcucuuuuacaauaaguugcuucagcuuggugaacgcuuggggcccccauucucccuguagacauggcugggguauacauuaaugaaaacaaaaggguccauuuucauu

SEQ ID NO: 4097772 - RNA, 91 nt, Human
aaaaauguagauaagcuggaagagaagagucacaguuauaauuuucaauaugauuucuucuaauuuccaucauguauucauuugcauuuuu

SEQ ID NO: 4097773 - RNA, 67 nt, Human
aaaaauuauugaaauggcuugguaaggaagguuaucacuauccuacauguagguuuccuuaauuuuu

SEQ ID NO: 4097774 - RNA, 103 nt, Human
aaaaauucuacuauauuuauauuagauauauuuagagagguuaagcuuccaucucugcccucucuccuguguucugauguuuucccuauagguacaaauuuuu

SEQ ID NO: 4097775 - RNA, 101 nt, Human
aaaaauuugagugauuguuauucuaauuaucuugcugauuugauuauucuuaaauaaggaagagaacuguaaaauaauuggcaauaacaucuuagauuuuu

SEQ ID NO: 4097776 - RNA, 94 nt, Human
aaaacaaugaugaaagaacaugcuauaauuaucuuuaugaggcuaucacaucccacuuaagauaggaaaguauguguuuuucguuuacuguuuu

SEQ ID NO: 4097777 - RNA, 129 nt, Human
aaaacagaaugaaaaaaugucuuaugaaguucaccaguguagauaguuuagauuucaaagaaaauuucuuaauugugugucuauacuaucugaaugccuugauuauugacuagauuuuuaccauguuuu

SEQ ID NO: 4097778 - RNA, 70 nt, Human
aaaacagacuuucgucauucuugugcagagauaugcuuugcaggcccaggagauguaagacuucuguuuu

SEQ ID NO: 4097779 - RNA, 62 nt, Human
aaaacagugcaggaaguuaagcaaguugacuaauaacaugccaaacuuaaaugcaaaguuuu

SEQ ID NO: 4097780 - RNA, 62 nt, Human
aaaacaguuuaggcaucacaguagauucuauucugggucacuuugcauacccaaauuguuuu

SEQ ID NO: 4097781 - RNA, 82 nt, Human
aaaacauuagggccucaugcucccaagacacuuggccggguagaccauggcuucugggguggccugcauggcccuauguuuu

SEQ ID NO: 4097782 - RNA, 72 nt, Human
aaaacuaagacugugagcucagagacucuggucaguauuaccuuagucacacuauggccacaguuguguuuu

SEQ ID NO: 4097783 - RNA, 65 nt, Human
aaaacugaggcuagauugcuguucuuugggaugacuuaucuuaggauggauuuuaguuuuguuuu

SEQ ID NO: 4097784 - RNA, 82 nt, Human
aaaagauggagagacugauguggcuauguagcucaaacugacuccuuccuacuacguuuuauauuaucuuaccucuucuuuu

SEQ ID NO: 4097785 - RNA, 60 nt, Human
aaaagauuuccuuuauucaacaugaccacuucauuuguuuccugaugugggagaucuuuu

SEQ ID NO: 4097786 - RNA, 74 nt, Human
aaaagcaggugugagccagugggccccacguccccucuucagccagggcgccugcucucucugcuucugcuuuu

SEQ ID NO: 4097787 - RNA, 71 nt, Human
aaaagcauucuggauucuguuguacuuuuuccaaguugaaugaaguucucaaggaucacagaaacucuuuu

SEQ ID NO: 4097788 - RNA, 72 nt, Human
aaaagcuaaaugucauggaguuguagaaaaaaguuauucuggucuaauucauucugugauguuucuucuuuu

SEQ ID NO: 4097789 - RNA, 66 nt, Human
aaaagcuaacugugaaaucucuggauuuuguuuuagaaggaaaucacuuuuuucauaguugcuuuu

SEQ ID NO: 4097790 - RNA, 62 nt, Human
aaaagcucugguuuggagcauuugaugauuucccugguauaaacacucccaccaaagcuuuu

SEQ ID NO: 4097791 - RNA, 66 nt, Human
aaaaggagcucuuaaaaucagagaaugaugcugccuccugguaucugucucuuucagucuccuuuu

SEQ ID NO: 4097792 - RNA, 64 nt, Human
aaaaggccuaauugaaucaagucuccuuuccaucuggcaggagacauuuuaauaaggacuuuuu

SEQ ID NO: 4097793 - RNA, 58 nt, Human
aaaagggcaaaaccaucauggaggucacauuugacaaaccaguuuguuuuucccuuuu

SEQ ID NO: 4097794 - RNA, 76 nt, Human
aaaagugcauugacacauaugguugcugcagugaagcaaagcucacuaccuguagcccauauccaauaaaucuuuu

SEQ ID NO: 4097795 - RNA, 58 nt, Human
aaaagugugaauuaaucaauucuugguaccagccaauuauuccauaguuggcacuuuu

SEQ ID NO: 4097796 - RNA, 71 nt, Human
aaaaguuagcuggauguggcuguugccaaggaaugucuuuuauuagcaacaagugacuaucuauaacuuuu

SEQ ID NO: 4097797 - RNA, 68 nt, Human
aaaaguuagggagguucucucuuugcagagccccaaaagggggucaggaacuagagccuccuccuuuu

SEQ ID NO: 4097798 - RNA, 64 nt, Human
aaaaguucuguauuucaaugucuuuauuuucaguaugggccgaggagugcagaucacugcuuuu

SEQ ID NO: 4097799 - RNA, 62 nt, Human
aaaauaaggcacacauagauaggguuaagugauuugccugugucauguaguagcuucuuuuu

SEQ ID NO: 4097800 - RNA, 57 nt, Human
aaaauagcuguauuuacccuguagucaagucacuaugaaaguaagugcagcuguuuu

SEQ ID NO: 4097801 - RNA, 75 nt, Human
aaaauagggagaagggaguguuuucuugauagugcgcuguggcauuguucagaguagggcucugugaccuguuuu

SEQ ID NO: 4097802 - RNA, 87 nt, Human
aaaauaucugcucauacgcauaugauaguaauggcuuuuccacaucuuaagccauugaguuuuaugugcuauccauagagauguuuu

SEQ ID NO: 4097803 - RNA, 69 nt, Human
aaaaucacauugaaaauguugcaggcuguauucaucaaagcauagccagagauauuuucaguugauuuu

SEQ ID NO: 4097804 - RNA, 58 nt, Human
aaaaucauagaggcuaaaauuauuuggcuuaauugcacaaagagggcucuaugauuuu

SEQ ID NO: 4097805 - RNA, 77 nt, Human
aaaauccagauuccaguucuccucucuaaagucucuaauucaguaggucugggguggagauuggcaaucuguauuuu

SEQ ID NO: 4097806 - RNA, 105 nt, Human
aaaaucugaaaauuuacaacuggaauuuuacaagaaggccucguauuauaaaguuuguugcuugguuugugagacuuggguuguggacaguuugaauaagguuuu

SEQ ID NO: 4097807 - RNA, 113 nt, Human
aaaaucuuugcaaccaccuaaccccaauuuucacauuugugcaacguauccacagaguuuaaguaauuuucuaggaggcacacaaguaguugggauuagaucccaaggguuuu

SEQ ID NO: 4097808 - RNA, 71 nt, Human
aaagccaaucuaggauguguuuugagcugacuaccaacuauggugguuuuaaaaacaugcugcaugguuuu

SEQ ID NO: 4097809 - RNA, 115 nt, Human
aaagccaaugacauuucacagaaauauaguucuagaaauauuuuauuucccauuaaguuacuagugaaaauauuccugagguauauggguagcuguugaaaugucauuuggcuuu

SEQ ID NO: 4097810 - RNA, 60 nt, Human
aaagccagaagagcagugacuuauggccuccaaggaaauaauccugcuucuucucccuuu

SEQ ID NO: 4097811 - RNA, 61 nt, Human
aaagccuaugaaggagagcauuaugcuauaccuguauguauguaugcaucuuuuauguuuu

SEQ ID NO: 4097812 - RNA, 70 nt, Human
aaagcggugucuuuugugagauaucuuccaacaaguuucauggaacuggcuuacaaagaggcaucgcuuu

SEQ ID NO: 4097813 - RNA, 76 nt, Human
aaagcuaaugagaacagugcugauaaaucauacccguggguugaacuaaauuagacauuguuuacgucaaagcuuu

SEQ ID NO: 4097814 - RNA, 72 nt, Human
aaagcuaggcauuucuguggcaguucuuauauuuggugagaaauguugaauacacaaaaugcuucuggcuuu

SEQ ID NO: 4097815 - RNA, 102 nt, Human
uugagacggagucucgcucugucgcccaggcuggagugcaguggcgcgaucucggcucacugcaagcuccgccucuggguucacgccauucuccugucucag

SEQ ID NO: 4097816 - RNA, 103 nt, Human
uugagacggagucucgcucuguugcccaggcuggagugcaguggcgcuaucuuggcucacugcaagcuccgccucccggguucacgccauucuccugccucag

SEQ ID NO: 4097817 - RNA, 103 nt, Human
uugagacggagucuugcucuguugccuaggcuggagugcagugacaugaucuuggcucacugcaagcuccgccucaaggguucacaccauucuccugucucag

SEQ ID NO: 4097818 - RNA, 55 nt, Human
uugagacggagucuugcucuuuugcccaggcuggagugcaauggcucagucucag

SEQ ID NO: 4097819 - RNA, 66 nt, Human
uugagacggggucucacugugucaccuaagcuaaaguguaguggcacaauuuugacucccccucaa

SEQ ID NO: 4097820 - RNA, 60 nt, Human
uugagacugagucucgcccugucguccaggcugcacugcaguggcgugaucucagcucag

SEQ ID NO: 4097821 - RNA, 130 nt, Human
uugagaggaauauuacaggucacuguuuaacacuaguuucuuuaacuaccccaaacaaauguccaguuauggaagagucagugaaaacuagaauguugcuugccugcuguuuuucucuacauuucauuaa

SEQ ID NO: 4097822 - RNA, 55 nt, Human
uugagauggagucucacucuguugccuaggcuagaguacaguggcgccaucucag

SEQ ID NO: 4097823 - RNA, 103 nt, Human
uugagauggagucucgcucugucacccaggcuggagugcaguggcgcgaucucggcucacugcaagcuccgccucccggguucaugccauucuccugccucag

SEQ ID NO: 4097824 - RNA, 55 nt, Human
uugagauggagucuugcucucucgcccaggcuggagggcaguggcgcuaucucag

SEQ ID NO: 4097825 - RNA, 103 nt, Human
uugagauggagucuugcucuguugcccaggcuggagugcaguggcacaaucuuggcucacugcaagcuccgccucccggguucacgccauucuccugccucag

SEQ ID NO: 4097826 - RNA, 88 nt, Human
uugcauucuucuaaauguagccgccuuguuucagcaugcugugauuuccucauauuguugacuauaagaguaacuauuucaggagcag

SEQ ID NO: 4097827 - RNA, 66 nt, Human
uugcauugauguuccuucuugccuccuucagcaaugcuguucuuggugcugaggauacaguaguaa

SEQ ID NO: 4097828 - RNA, 88 nt, Human
uugccaaagaaauagcuaagcuuucuagaguauggagucuguccagauaaucuugguauagucuccuuuuuuggagggugugugguag

SEQ ID NO: 4097829 - RNA, 67 nt, Human
uugccaacagggaagcuugggcugcagcugcagcagcaggugcuggcugccagguucccuguggcaa

SEQ ID NO: 4097830 - RNA, 75 nt, Human
uugccaacuuccuuuuaaaaguucaugugggaauuuugauuuggaaauugcugaacuuauaaaugaauuuggcaa

SEQ ID NO: 4097831 - RNA, 123 nt, Human
uugccaagugucuguuggagcaggauaauauugucucuuucaauaacuuguuuuuauucucucuuuagaaacaguucuuuggauggaagaauaaaguuaucaauaguuuuagcugcuuggugg

SEQ ID NO: 4097832 - RNA, 66 nt, Human
uugccacugcuucccugugcaccagacauaccagggagcauuuuacagucuggaagcagggggcaa

SEQ ID NO: 4097833 - RNA, 81 nt, Human
uugccaguagauugaagagugcuugccuucucaucauaaaacuuaugauacagagaaagcaucuuuuccaagacuuggcaa

SEQ ID NO: 4097834 - RNA, 83 nt, Human
uugccauauugaccagacugacacacaucuaauaauuugaggccaauauaaaagacugugcagcugagugcuaauuugugcaa

SEQ ID NO: 4097835 - RNA, 56 nt, Human
uugccauucuuuugcauggguacacuccuuccugggaugugggcaagggauggcag

SEQ ID NO: 4097836 - RNA, 62 nt, Human
uugccauugcaaaguacuaugaaacaaagaaaucaugcugucauggaauagagcaguggcaa

SEQ ID NO: 4097837 - RNA, 77 nt, Human
uugccccugggaacaguggguuggcucuuauguauccugcagaggagauguuucccacacuguuucccaaauugcaa

SEQ ID NO: 4097838 - RNA, 99 nt, Human
uugcccggugguuguggggaagggcagccugacucacggucugagucccaggaacggaucugaccuggaggaggucccuucucuggaggugcugggcaa

SEQ ID NO: 4097839 - RNA, 65 nt, Human
uugcccugucaguagaagugcagguccugcucuagacuguucuccuugcucugcugucagggcag

SEQ ID NO: 4097840 - RNA, 87 nt, Human
uugcccuugcuguguucucccucuagccugaguguuuccagagccugagcccuccaaagguugggggaggcagcacagccggggggg

SEQ ID NO: 4097841 - RNA, 69 nt, Human
uugcccuuugcugggaagccuucacucuccagcuuuccugggguagggaaggucucccacauuaugcaa

SEQ ID NO: 4097842 - RNA, 81 nt, Human
uugccguuuuuguaggacauagucuuguuaggacuuucuuuauuaucuucaagagacaauuguucuaaguaaaaauaguaa

SEQ ID NO: 4097843 - RNA, 87 nt, Human
uugccuacuugcgugauguuaugcccaaucaaaaucucagaacaagaagagguaaagaaagguguaacauuaaaaagaguaagguaa

SEQ ID NO: 4097844 - RNA, 61 nt, Human
uugccuagcacugagcacacuucugagcuucuuagacucacagaaugucagaguuggggag

SEQ ID NO: 4097845 - RNA, 77 nt, Human
uugccuccucucaaaagcacaacauugauuuuauccaccuggaaguuacugucugccugcuuuuagauagagagcaa

SEQ ID NO: 4097846 - RNA, 64 nt, Human
uugccugaguuguaauucucacaguaguccugcaggacagcugcuguuacugcuuauuacgcag

SEQ ID NO: 4097847 - RNA, 57 nt, Human
uugccuggccaggagguaaccagauggugcaccugcacccuccccuuggaccagcaa

SEQ ID NO: 4097848 - RNA, 59 nt, Human
uugccuggccagucuaacagagguguuaagauccuaagcacuaguucuacugccagcaa

SEQ ID NO: 4097849 - RNA, 56 nt, Human
uugccugugaggauucugguugcuuaaggugaaccaaucaguguucucaggggcaa

SEQ ID NO: 4097850 - RNA, 65 nt, Human
uugccuguguguguugaugucagugccccggcguuggguacacccucuucacaucacacaagcaa

SEQ ID NO: 4097851 - RNA, 84 nt, Human
uugccuuauucuuaggggagaauuacauggcguggaguugucacacagugcuccauccauuuucuuugcuguuuuaugaggcaa

SEQ ID NO: 4097852 - RNA, 70 nt, Human
uugccuucaaccauugggcuaaagucugucuuucauccuaaaucaaacgcuacccagugguggaugguaa

SEQ ID NO: 4097853 - RNA, 70 nt, Human
uugccuucucugucgggcugggcagcguguggcguucuccuuaccugugucaccggaacggaggagguaa

SEQ ID NO: 4097854 - RNA, 56 nt, Human
uugccuuguuauucucucagaacgguccauucuuucauugagagcauucgaggcaa

SEQ ID NO: 4097855 - RNA, 79 nt, Human
uugccuuuagccagcuggacagucuacauuuguauauacccuuuagaggaguacagaugacuugucugcuguaaggcaa

SEQ ID NO: 4097856 - RNA, 95 nt, Human
uugccuuugccagccacagggaagcucaggggcucuggccagcuagagaacaagaaacccuguagcuuccccacugcuguguuguguagugguag

SEQ ID NO: 4097857 - RNA, 65 nt, Human
uugccuuuuccuuucaucaggacaaagcucagccaggcugaucagaauaagagaggaaaggguaa

SEQ ID NO: 4097858 - RNA, 64 nt, Human
uugcgucaggcaaaccuuucuagagaauaucaguuuuauuuuagaaagaauagccuggcugcaa

SEQ ID NO: 4097859 - RNA, 60 nt, Human
uugcuaaugcccuagaaguauuaauucacuuugauaugcuaauuagagggcauuaugcaa

SEQ ID NO: 4097860 - RNA, 112 nt, Human
uugcuaauuugcuaaugcucuuaaaagcaccacugcacagaagaaacuaucaaaauaaauugguuauggcuuucuugugcguguggguggagaguagcggaguauguagcag

SEQ ID NO: 4097861 - RNA, 95 nt, Human
uugcuacgcccacccagaucacugugucagaguaugaugauuuccagcgagaugucagcuccauguacagaaagaugacgcugggacagcugcag

SEQ ID NO: 4097862 - RNA, 78 nt, Human
uugcucacuauucuguggaucaagaauucaggcaucauccaugaggaugcuucccuuugcuccacaugguacuggcag

SEQ ID NO: 4097863 - RNA, 56 nt, Human
uugcuccuccuccucauugcaggaguuuccagacacaacugcuagggggagaguag

SEQ ID NO: 4097864 - RNA, 70 nt, Human
uugcucgagcccaggaguuugaugcugcagugaguuaugaucacagcacugcacuauauccuggugacaa

SEQ ID NO: 4097865 - RNA, 109 nt, Human
uugcucuaauaggaccuguguuguccagguaucuucauaaaaauguacucagagaagguucauugcaguacaauuuaaugaagauagcagauuuauuuguccagaguaa

SEQ ID NO: 4097866 - RNA, 64 nt, Human
uugcucuggacgcugagugguuucaugcucaauuugaagcaacuggcucauugucucagggugg

SEQ ID NO: 4097867 - RNA, 85 nt, Human
uugcucuguggggauuauuuuuguucuggaaaacauuguuauuugcaauaguugguccaugaaaaaagucuauuuucaaaugcaa

SEQ ID NO: 4097868 - RNA, 76 nt, Human
uugcucuguuucccaggcuggaaugcaguggugugaucuuggcucacugcagccuccaucucugggguucaagcga

SEQ ID NO: 4097869 - RNA, 80 nt, Human
uugcucuugaauauggcucaaaggagaugacuaaguuaauccaacuuuacaauauccugugacuuuuuucauuggagcaa

SEQ ID NO: 4097870 - RNA, 59 nt, Human
uugcucuuggcuaauacaguaugucacuagacauaguacugccuggggccagagagcgg

SEQ ID NO: 4097871 - RNA, 79 nt, Human
uugcucuuguugcccagaggcuggagugcaauggcgugaucucggcucacugcaaccuccaccuccuggguucaagcga

SEQ ID NO: 4097872 - RNA, 61 nt, Human
uuuguaaguucuauggaagucuauauggcaaacuguguaguccagaaacugagcuuauaag

SEQ ID NO: 4097873 - RNA, 71 nt, Human
uuuguaauaagcuuuuaaagcuacuuugauaucuuaaauagaggcaagguuaaagagcuuauaaauacaaa

SEQ ID NO: 4097874 - RNA, 59 nt, Human
uuuguaauuagcacggugcgggcuucucugcccucugaaaccauaauguuaauuacaaa

SEQ ID NO: 4097875 - RNA, 63 nt, Human
uuuguacacaggauguuauaaugggauauugacauuuuacggauccagcauccuguguauaaa

SEQ ID NO: 4097876 - RNA, 55 nt, Human
uuuguagacuaucucuggggugcugcagaaccccaugaaggagagugucugcaaa

SEQ ID NO: 4097877 - RNA, 80 nt, Human
uuuguagguaauggauauguuuaguaccuugaugauggcaaugguaucacagguguaugaauauguccaaauccaucaaa

SEQ ID NO: 4097878 - RNA, 63 nt, Human
uuuguaguaaggguuuugagagagcguuccggacuuaaucucuucagcagccucuugcauaaa

SEQ ID NO: 4097879 - RNA, 55 nt, Human
uuuguaugaacugguauguagguguuaucaaaaccccugcucaacagcauauaag

SEQ ID NO: 4097880 - RNA, 79 nt, Human
uuuguauggugcuuuuaacuuuugaaaggauuuuucuuuauauauccuugaucugaagagguuagaaggauagggcaga

SEQ ID NO: 4097881 - RNA, 80 nt, Human
uuuguaugugcauuguaaauuuugaugucauuaaauaacaaaacuaagauauuucagauagugauaauagcauguauaga

SEQ ID NO: 4097882 - RNA, 68 nt, Human
uuuguauuuuggggguaguuuagacuugcguuauaccaaugcaaguaaccaucacuaucucuugcaga

SEQ ID NO: 4097883 - RNA, 76 nt, Human
uuuguauuuuuauguauuuuauagaugugcauuucagaugcaugaauacauugauggaguaccuagcuuguacaaa

SEQ ID NO: 4097884 - RNA, 55 nt, Human
uuugucaucaguuauuaauaugaggucuuuugccuccugucaguaaagugacaga

SEQ ID NO: 4097885 - RNA, 78 nt, Human
uuugucaugcuaccaccacugacugaaccaccugaauuaagucucaaacucaggcuuauagguagugguuaugacaaa

SEQ ID NO: 4097886 - RNA, 59 nt, Human
uuugucaugguagcugaaggaugucucaaucagcaacaucuggaaaguuacuugagaaa

SEQ ID NO: 4097887 - RNA, 91 nt, Human
uuuguccauuucuuccuccuucccuuuuccgccagaaguagccguccggggcuuuuggccagauggggaaacugaggcaagacugggcaga

SEQ ID NO: 4097888 - RNA, 64 nt, Human
uuugucuagcccaucuaaauaaccugacuacacuuugccaggucuuuucaauggcuuagagaaa

SEQ ID NO: 4097889 - RNA, 59 nt, Human
uuugucugcccugcacuuaggaaccaagguugaguucaaacaggggucagggagauaaa

SEQ ID NO: 4097890 - RNA, 56 nt, Human
uuugucugcuuguucagauggaacgcaccccugucccacacugacaaggcaacaaa

SEQ ID NO: 4097891 - RNA, 65 nt, Human
uuugucuguaauuauuaaagaaaggaauagcagcuuaugaaaucuuuuuuuaauagucagaugag

SEQ ID NO: 4097892 - RNA, 78 nt, Human
uuugucuuacauucgugauuuccuuccacuucugacaugucuuacagcugaaggauucaagaaaugguguagcacaag

SEQ ID NO: 4097893 - RNA, 69 nt, Human
uuugugaaacuccuguucuaugacaagagcuuuaauagcacuggugauauaauggugaguagguauaaa

SEQ ID NO: 4097894 - RNA, 66 nt, Human
uuugugaauagguuggcuuccaguccuuggauugagauugcacaaguuaugugauucacucacaaa

SEQ ID NO: 4097895 - RNA, 84 nt, Human
uuugugagaaaauggcaucagugucuugaccugggugugggucaggcuggccucugcucagggagggucacuacaucucauaaa

SEQ ID NO: 4097896 - RNA, 76 nt, Human
uuugugagagccaaacauguaaguuugcugauacugaaaauuaccaacuggcagcucuuacgugucucuugacaaa

SEQ ID NO: 4097897 - RNA, 109 nt, Human
uuugugagauagaacaagaauaguguaaauuuguacuuguaaauaauguacuuucuauagagauuuauaguuguacaaauuguucacauaugucauuucauuucacgaa

SEQ ID NO: 4097898 - RNA, 60 nt, Human
uuugugcaaugguguuuagguuuuauggcuauauauuugaaguucuacaccauuggcaaa

SEQ ID NO: 4097899 - RNA, 80 nt, Human
uuugugccaacaauguguucagcacuguggaaaacacccaaagagucuguccucaaguaugaucacguugaauguacaaa

SEQ ID NO: 4097900 - RNA, 68 nt, Human
uuugugccaggcaauguucuaagugauuuacagguuuuagcucacuugauaaauauugcuuuuauaaa

SEQ ID NO: 4097901 - RNA, 62 nt, Human
uuugugcuaaguauuuucuuauuuuuaagguaaaucucuagagguggaauuacuggcacaaa

SEQ ID NO: 4097902 - RNA, 95 nt, Human
aaaaaaaagauuauuuuagacaugauauagagaguagauuaaaggguagaauucuuuaggaucucucuuguuacauuuaaaauauaaguuuauuu

SEQ ID NO: 4097903 - RNA, 106 nt, Human
aaaaaaaagguauuaagaaacuaaugcaauaagagaauugagcuuaguucuguaucuauucugaggucucgcuccuguugcacuaguuccugaauaaaauguuuuu

SEQ ID NO: 4097904 - RNA, 129 nt, Human
aaaaaacccgcuacguauacauaucucaagagagaaauacauuuguuuuacccuaguagaugguccauuugcaggaaaaauaaauaguguuuuugcaacuaaggggugggugaagaauucagguuuuuu

SEQ ID NO: 4097905 - RNA, 62 nt, Human
aaaaaaggagauuuuagcuugguuuuugaauauuaagaagucaguggucugucuccauuuuu

SEQ ID NO: 4097906 - RNA, 87 nt, Human
aaaaaaguaaauugccuucucacuucaucuggaugagaauccucugcagcagacugaguaugagaaauaaaaagcuuucccuuuuuu

SEQ ID NO: 4097907 - RNA, 62 nt, Human
aaaaaaucaugcuuauagagcaccuucgcuugaacaguguucaaaauguagguagauuuuuu

SEQ ID NO: 4097908 - RNA, 77 nt, Human
aaaaacuguaggacauguacuuguaacagcaauucaucuuucaauucuagucagcaauguucauguucuggguuuuu

SEQ ID NO: 4097909 - RNA, 120 nt, Human
aaaaaguggagaugaaaauaguacuuuaguguuguugugaggauuaaaugaggaaauacauuuaaaguaccuggaacauaacaggcacuaaauaaauguuagcuauuauuuuuucuuuuu

SEQ ID NO: 4097910 - RNA, 101 nt, Human
aaaaaugaaauaaaaacagauucuucaccauggauaauuuggucuaccuuaccagggcuuaguaaucuuaggucaagauaguuuacuuuuuguucauuuuu

SEQ ID NO: 4097911 - RNA, 65 nt, Human
aaaaaugcauauucuuagccccuccugcagauaagaaucuucaggaaugaggaaucuguauuuuu

SEQ ID NO: 4097912 - RNA, 98 nt, Human
aaaaauuaguaauuuacaaaugugugggaauuuuaagagaaaguuaaagaauaguucuaggaaauuguuacuauauuuguuuaaauuauuauauuuuu

SEQ ID NO: 4097913 - RNA, 65 nt, Human
aaaacaaauaaggcagaaaugauucuagugaucauguggccacuagauuugcugucuuuuguuuu

SEQ ID NO: 4097914 - RNA, 65 nt, Human
aaaacaaaugaguuucuuaauagcugccccacuuagucugagugucuuaggaagcuuaauguuuu

SEQ ID NO: 4097915 - RNA, 122 nt, Human
aaaacaaauguugauauguauacgugagaauggcaaaaucggugagauuaaaccaauaauuaaaugucauuaguuucagccauucuuuuaacauggaauccagauuuuuaauagcuuguuuu

SEQ ID NO: 4097916 - RNA, 90 nt, Human
aaaacagaacaaguuugcuuauuagccuuaggucauuucuacccaauacuguuaccauauggcuucuauaaggaagcuuacuucuguuuu

SEQ ID NO: 4097917 - RNA, 70 nt, Human
aaaacagcaaagcuucuuucugaucugagguuguggcaaaccuaaccugggaucugacgggaugcguuuu

SEQ ID NO: 4097918 - RNA, 67 nt, Human
aaaacaucuucucuugauucuuucuuagcauaacugagauaggcuggagaguucaaggaaguguuuu

SEQ ID NO: 4097919 - RNA, 91 nt, Human
aaaaccaugauccucauuuauguaaugauuaaggcaacuugacuuuuaguaguuucuccuuagucagugcuggguauaaaagggugguuuu

SEQ ID NO: 4097920 - RNA, 62 nt, Human
aaaacccuucugcagacucugagaaaugacaaggggaagcugagaagcugagacuggguuuu

SEQ ID NO: 4097921 - RNA, 130 nt, Human
aaaacuacagucugcggagauaaaaguagaauuauuacagcaggcauagaguagcacucaguaacaucaaaugcaugaaugcaaaucaugauuguaauaauacuuuuuacuuuuguaucacuguaggauu

SEQ ID NO: 4097922 - RNA, 91 nt, Human
aaaacuagaggccagagguugggucugaggugagaaaaaugauagggacaacacugcacgacucucccuagacugcuugguguuugauuuu

SEQ ID NO: 4097923 - RNA, 129 nt, Human
aaaacugguuuaaauucauauuuggcccaaugggaagggacagauguuaucauuuuuaugugcaguuacuucucacagugaaaauaauaucuucaauuuagcuuuggugcaguuuuuggaucccauuuu

SEQ ID NO: 4097924 - RNA, 84 nt, Human
aaaacugucaguuacuugagacguuuaugaaagaagucuagcugggcaccauuuaauucauaaaugcuggaagcuaucaguuuu

SEQ ID NO: 4097925 - RNA, 90 nt, Human
aaaacuuuaaagguuauacuaauuuaaugauuaauguggacccaaauacauaauuuggccaaaaaagucauuagaauggguaaugguuuu

SEQ ID NO: 4097926 - RNA, 75 nt, Human
aaaagaauguaacucuccuuuugaucuucagaaaaagagacccccuucugugguugaaaggagagauauacuuuu

SEQ ID NO: 4097927 - RNA, 114 nt, Human
aaaagacuagauagggggauuaaugaugagacuuuucuguuauuuagcaugauuuacaacuauugcuggcaaccauacuaaguaguuucacauauaauguccccucagccuuuu

SEQ ID NO: 4097928 - RNA, 99 nt, Human
aaaagagauaugugcuuuccucagcuuugguuuacucaucaaaaaucacaccaccccucauugaaagaguaaaauuagugaguuagaacagucuuuuuu

SEQ ID NO: 4097929 - RNA, 84 nt, Human
aaaagagucuuuggcuuacauuuacguauauucaaaguucccuuaguauagcaggggugcugaauaauguguaaugucucuuuu

SEQ ID NO: 4097930 - RNA, 63 nt, Human
aaaagaugugaaauagcuggauaugaagaaucaaaacuucauuuuuucuguuucaucuccuuu

SEQ ID NO: 4097931 - RNA, 80 nt, Human
aaaagcaaacuggagagucuagugcaccuaguuuuugaauacacccauaagucaggugucugauuugaacaguugcuuuu

SEQ ID NO: 4097932 - RNA, 59 nt, Human
aaaagcagaucuccaaagucuaaaagccuuaauguuugcuagguggaggguuuguuuuu

SEQ ID NO: 4097933 - RNA, 127 nt, Human
aaaagccugcagugaaggaaggugauuuagauaauugaacauugguaccuuacaucguuaauauuacuguugauuaugguaacaaugauuaaaaauugggcacuauuuuuucauguaguuaguuuuu

SEQ ID NO: 4097934 - RNA, 76 nt, Human
aaaagcuucuaauauguuagggaaauauuggaaauuacuuguaauggcaguugguguuacucugauaggugcuuuu

SEQ ID NO: 4097935 - RNA, 76 nt, Human
aaaaggauggagcagcucauggcauuuucugcauguugaccuuuccaacacagugucaucaguuucucaaccuuuu

SEQ ID NO: 4097936 - RNA, 66 nt, Human
aaaaggcuagcuaguaacagaaauaggaugaagacgugucucuugcucugaguacagcugucuuuu

SEQ ID NO: 4097937 - RNA, 57 nt, Human
aaaagggguuauauacuuauguacuuaaaauacauaauccugguguagcccucuuuu

SEQ ID NO: 4097938 - RNA, 64 nt, Human
aaaagguucuuuucaaugguuguaaaauauuucaagguauggcuauagguagaaggaaucuuuu

SEQ ID NO: 4097939 - RNA, 68 nt, Human
aaaaguacacuauagacagagcauuuuugaaaugauuguuuggaaauguuccauuauuguguaauuuu

SEQ ID NO: 4097940 - RNA, 76 nt, Human
aaaaguuaauagaagugauacauuagcuuucuugggcaaagugcuuaagaagugagugcaccuucuucauccuuuu

SEQ ID NO: 4097941 - RNA, 83 nt, Human
aaaaguuacccauaccugggccuccuccucagaucaauuaaaucaaaauuucugagauuggagccugggcauuaguaauuuuu

SEQ ID NO: 4097942 - RNA, 104 nt, Human
aaaaguuauuguugagacuaguugcauaaagccuuccucauaaauguuuauauuagauuucacauauggguaagaucuuuuguauuugucucaguguaucuuuu

SEQ ID NO: 4097943 - RNA, 63 nt, Human
aaaauaaucuagucuaagaggagcugggaaauuuuucucuuuauguaagacugggcuuguuuu

SEQ ID NO: 4097944 - RNA, 95 nt, Human
aaaauaaugguccuuagaacaauguuaaauuauuaagaaguucuagauauguuugcuguuuugauaauuaaaaauuguaguugacuaguuguuuu

SEQ ID NO: 4097945 - RNA, 73 nt, Human
aaaauacuagacuguucuguuaucacuuggccaggaauguacuggagugggggacaggaaagcuaguuauuuu

SEQ ID NO: 4097946 - RNA, 86 nt, Human
aaaauagaguacugugccaucauucaauaaauucaaagcagccagcuuuuccuccagcuuugaaacagauugaugguuucuauuuu

SEQ ID NO: 4097947 - RNA, 69 nt, Human
aaaauagaugaaaggaagucuguuuaaaaggaugagaauccaagguauggauuuccuuuucagcauuuu

SEQ ID NO: 4097948 - RNA, 96 nt, Human
aaaauaguacagaagaacuuguaaugaaaggcaauaguccuauuauucucuguauccauugaagccaccacuguaagucacuuuuguuauuauuuu

SEQ ID NO: 4097949 - RNA, 101 nt, Human
aaaauaguuucuuccagagcuuagaauuucagaugauuggaaaauucauacaucuaggucugaaaguuuaagucuuucgcaucuauggagaucucuauuuu

SEQ ID NO: 4097950 - RNA, 67 nt, Human
aaaauccauuuuaguaccucaaguauccauuaguuaauagcuaauggaucugugcugaaugcauuuu

SEQ ID NO: 4097951 - RNA, 101 nt, Human
aaaaucuuauuuuucaauguaccuaagaaugaaggaauauugcuuugcuuuuagagauuaacuaaaacaagguuugguccuauauuuugguacuagauuuu

SEQ ID NO: 4097952 - RNA, 102 nt, Human
aaaaucuuuucauugcuguccuuuuagaaggcuucugcucagucuagccuuucuucagcagggcugaugaugagcagaggugaagguauuccucaagauuuu

SEQ ID NO: 4097953 - RNA, 83 nt, Human
aaaaugcaagauccuuuuaucagucaggguuuauagcugcaagcaaaagcaacugccccuggcuggugaagcagagacauuuu

SEQ ID NO: 4097954 - RNA, 57 nt, Human
aacaagaagagagggacguaaucccacugcuuggaaugcgauccucaauccucuguu

SEQ ID NO: 4097955 - RNA, 72 nt, Human
aacaagccagcucugaguugaaguacucacuggggcgaggggugcuucauauuuuuagaacugagcacuguu

SEQ ID NO: 4097956 - RNA, 65 nt, Human
aacaagccaguauucaauggggcuagggggaaaauuaccugggcuucaggaauuacaggagaguu

SEQ ID NO: 4097957 - RNA, 129 nt, Human
aacaauauaauuggauuaauguggguggacuaauuuguuuuaucaucacuuaaaggacacuuuguuuuuagauguucuagaagugugguguucacauuugcccccuuugcuacuuaaauccaguuuguu

SEQ ID NO: 4097958 - RNA, 77 nt, Human
aacaaugagauuccaauagcuccugcagggcccacuguuaccuaaaugaagccccagcagccuggaauuucacaguu

SEQ ID NO: 4097959 - RNA, 61 nt, Human
aacacaacacagggguuaugccaugguugcagcuagcccauagaguaccucugugugaguu

SEQ ID NO: 4097960 - RNA, 130 nt, Human
aacacaauuguaaucagcuacaaucaauaugcaggagcugguuuucauuuuccacuuugcacugagaggcaguucuuaaagugcugaagaccuagcuguacuugaaaauggcugagauuuaguugugcuu

SEQ ID NO: 4097961 - RNA, 95 nt, Human
aacacaccucuacccagguuggagaucugucuauggcagugcagaaauuuucccagucauuacaagauuuccaauuugaauguauuggugauguu

SEQ ID NO: 4097962 - RNA, 58 nt, Human
aacacagaucaaaauauuuccugucuguauaugaagguaaugccauugaucugcuguu

SEQ ID NO: 4097963 - RNA, 76 nt, Human
aacaccagaguccauaucucuuuccugguuugugcuuguucaaagauugaucauggaagagguauuuuuuguuguu

SEQ ID NO: 4097964 - RNA, 55 nt, Human
aacaccaggaagucucccaggcauucuauucuagccuuuauauuuuucugguguu

SEQ ID NO: 4097965 - RNA, 64 nt, Human
aacacuccaagcuugcuuuagccacagggccuuugcacuugugguuccugcuguuuggaauguu

SEQ ID NO: 4097966 - RNA, 68 nt, Human
aacacucccaguagcccacuguuuggcugacuguaccuaugccacagugaucccugccugcgaguguu

SEQ ID NO: 4097967 - RNA, 77 nt, Human
aacacuggacacuuuagagcccagucuuugugugaagaaaaugaaauuuucacccaggugugguuaagugcaguguu

SEQ ID NO: 4097968 - RNA, 84 nt, Human
aacacugggaucaaaauuaaaccaacguccaguuucuagacugccuuuagauauuauuaggaacucaggauuuuucucaguguu

SEQ ID NO: 4097969 - RNA, 65 nt, Human
aacagaaccuggagaaguuucuuccuagguuugaaaucuuuaaucuagaaacuucuuguucuguu

SEQ ID NO: 4097970 - RNA, 114 nt, Human
aacagacacugccucuuaccuagccucucuaggacaaugucaaaauaggaaacauuaucuuuacauguuuaaucuauuuggcauuuuccugggaaaagugagaaacugauuguu

SEQ ID NO: 4097971 - RNA, 62 nt, Human
aaauauucauugaaaaacguugacugagugccuacgcugggccagacuuucaaugucuguuu

SEQ ID NO: 4097972 - RNA, 60 nt, Human
aaauauuggccagacaaucugaugaguggacacuauuccaguucaaauuggccaauauuu

SEQ ID NO: 4097973 - RNA, 85 nt, Human
aaaucaaauaucauauuuuacaugacagguguuuaguauuguaauacgugcuaacuagcuugguuauguaaaguuaaauagguuu

SEQ ID NO: 4097974 - RNA, 68 nt, Human
aaaucagacucuuucaaacagaaagccagucugaguuggcaggcugguuugacaaugaggacugguuu

SEQ ID NO: 4097975 - RNA, 74 nt, Human
aaaucagauacugguauuggauacuuuaauuuauaacauuuuuuuaaaguuacaguaauucaguguaaagguuu

SEQ ID NO: 4097976 - RNA, 111 nt, Human
aaaucagggugcaucauaugugaagcuuucuauaaaugaauguguauauugagccaaaauguaaaauauauacuguauauuguagucagaaacauugaaagccacugauuu

SEQ ID NO: 4097977 - RNA, 77 nt, Human
aaauccacauucucuuccuaaauauacuccuggcauaagacaacaaaagugauauuuguggggagauguuccgauuu

SEQ ID NO: 4097978 - RNA, 84 nt, Human
aaaucuaaaaaguguacauguuuacagcaucugaguaucuccaauaauaagaugacuuuaauaugugaaaacauuuguggauuu

SEQ ID NO: 4097979 - RNA, 73 nt, Human
aaaucugggacacuggccacauuucaaaauacuacacuuaggaauuucuguaauuggccaagucacaugauuu

SEQ ID NO: 4097980 - RNA, 84 nt, Human
aaaucugucuucucaaaguaaacaaggcaagucugugagcaucuccgacaagauguaugaagcuuuguuugggauaauggauuu

SEQ ID NO: 4097981 - RNA, 73 nt, Human
aaaucuugguucucuuagcuguaaagucaauucuaguguuucucaaacugucuuguguuaaagaaccagauuu

SEQ ID NO: 4097982 - RNA, 67 nt, Human
aaaugacagaguaagcuguuuaaagucaaacucacgucccagcuaugcagcuugcuuugggacauuu

SEQ ID NO: 4097983 - RNA, 80 nt, Human
aaaugaguuagaugagaaaauaagcgaggguuaaauauugccucuuccucuucucuucuuuccucauuccuaauugauuu

SEQ ID NO: 4097984 - RNA, 121 nt, Human
aaaugaugagaaaugaaauaacuguucugacuuugagagugguagagggaagacaauggcaaauguuucuaggcagguauucccauuccacuuaucaaggcuaaacagggcucacacauuu

SEQ ID NO: 4097985 - RNA, 86 nt, Human
aaaugauugcaaaagcccuggcauccacaaaugcuuagauucauuaugguaucuuugguauuuuggauggggcuuaagcuacauuu

SEQ ID NO: 4097986 - RNA, 72 nt, Human
aaaugcacacaccaggaaacuauaaauuugcuccagccuggagugaucuuuuauucugguagauguuuauuu

SEQ ID NO: 4097987 - RNA, 79 nt, Human
aaaugcacuuaaauaacauaacuuauguaggcuaaauauugcaaaaauggauauggaguuaugcuguuaauaugcauuu

SEQ ID NO: 4097988 - RNA, 67 nt, Human
aaaugcagguucuugagccaagcccagcucuacugaaugagaauugcuggcccagggaucugcauuu

SEQ ID NO: 4097989 - RNA, 77 nt, Human
aaaugccuggaaugcaggaccggaaccaugggauaugcagacauagauaaaccauauuuccuuucugcugggcauuu

SEQ ID NO: 4097990 - RNA, 57 nt, Human
aaaugccuuuacuuuugcuggcaagugguacuagugcccacaaaaguaaagacauuu

SEQ ID NO: 4097991 - RNA, 59 nt, Human
aaaugcuauacucaaagaaauucaauuugaauuggaaaugaaugaggaggauggcauuu

SEQ ID NO: 4097992 - RNA, 81 nt, Human
aaaugcuaugaagauuuugaguuagaaaaguugcuuuuaacuggaaguaacagcaucaagucucaaguggucacagcauuu

SEQ ID NO: 4097993 - RNA, 79 nt, Human
aaaugcugggacugagacagugaccuggguuuucucucucaucuaauguaccuaugguugcuguaacacucuuacauuu

SEQ ID NO: 4097994 - RNA, 63 nt, Human
aaaugcugucaguguuauuggaaaaugagcugugguuuauagcaauaauacuaacagguauuu

SEQ ID NO: 4097995 - RNA, 65 nt, Human
aaauggaagaagugcaauacugacugcauucccuguaguucaacaugcauuuuucaaucucauuu

SEQ ID NO: 4097996 - RNA, 57 nt, Human
aaauggaguccucucucaccugggagagccaggugcugccccgagaaggaugcauuu

SEQ ID NO: 4097997 - RNA, 128 nt, Human
aaauggcauuauauauaaaagaaaagauugguucuacuacauacaucaggcuuauuaagucacacuagacaacugagguugccuaagacgucauuguccuggacuugcaagggccuccaacuccaguu

SEQ ID NO: 4097998 - RNA, 71 nt, Human
aaauggcuucgaguauauacauagucuaugaaagggaauaaaagucuguuuguaugugcuuggauuuguuu

SEQ ID NO: 4097999 - RNA, 76 nt, Human
aaauggguaaaagaaugaguuacucaaaagcagaacacccugucuuuuugacauuggcuuauucuguuaaucauuu

SEQ ID NO: 4098000 - RNA, 85 nt, Human
aaauggugacaaaggguccagaauuacuacuguuugaguaagacugcugaaaugguuuuggauuuuguccauaguacaaccauuu

SEQ ID NO: 4098001 - RNA, 97 nt, Human
aaaugguuuuucauucugggcaguggcgcaaucucugggugugaaaucacgucugagguuuacaagcuauugcugacaucaaugaaaugcaacauuu

SEQ ID NO: 4098002 - RNA, 65 nt, Human
aaauguaaggauaguacaagaagcuccugugcucuuuauggggauucaucaacuguuuuacauuu

SEQ ID NO: 4098003 - RNA, 66 nt, Human
aaauguaccagccuaagaaguggcaccauauuuucuauuuaucccacuaauuaagcugucacauuu

SEQ ID NO: 4098004 - RNA, 58 nt, Human
aaaugucuacuucccaucuguauuucagguuagauacacaagugggaaguagauauuu

SEQ ID NO: 4098005 - RNA, 100 nt, Human
aaaugucucucccagacuaucuuugcagacuagcuuacaucauauaaaaauauucucaguccuauaagauguaucaguuaagucuucauggcagacauuu

SEQ ID NO: 4098006 - RNA, 88 nt, Human
aaaugugaaaauuucugaaauagaaagcugaguaauacauuucucaguugggaaaaugggugccagcuucugaaagaggaaaacauuu

SEQ ID NO: 4098007 - RNA, 66 nt, Human
aaaugugaucuuggcccuuaauuacuuucuaugauugguauggucuggggaccgaggguuacauuu

SEQ ID NO: 4098008 - RNA, 57 nt, Human
aaaugugcauguaugugcauguuuuaguaugcaugcauacuuguauguguuacauuu

SEQ ID NO: 4098009 - RNA, 64 nt, Human
aaaugugugcacaaagacagcuucucauuauccuuagugguuuucagucuuggugcucacauuu

SEQ ID NO: 4098010 - RNA, 58 nt, Human
aaauguucccaauaugaagcugucggcuuaguuuuguccguuugauugggcaacauuu

SEQ ID NO: 4098011 - RNA, 63 nt, Human
aaauguucugaaagacccgcucuucacuccaguuuucccuaggguguuucuggcagggcguuu

SEQ ID NO: 4098012 - RNA, 82 nt, Human
aaauguuuauaaauucugcuuuuguuugggggaaaaguccaguugaaagauaaaagaggaaauuuguucaaugaaagcauuu

SEQ ID NO: 4098013 - RNA, 84 nt, Human
aaauguuuauuguuuuagguuucuaaucacagugguuauaaauaagcacagauucugaagaguccuuauaugcgguacacauuu

SEQ ID NO: 4098014 - RNA, 110 nt, Human
aaauguuuauuugcaaauaguguuugguaaaguugauuggugcucuguguuaauacagcuagauuguauuguauuaauuuuacuagcaaacauuuugugauagagccuuu

SEQ ID NO: 4098015 - RNA, 92 nt, Human
aaauguuucagagaugcauacagauuuaaaauuuuccuauccaauuucuguaagagugauaauuuaaauuaguaugugauugugauacauuu

SEQ ID NO: 4098016 - RNA, 56 nt, Human
aaauguuucuacuugugagcaucaugaagaaaaauugcucccugguagaaauguuu

SEQ ID NO: 4098017 - RNA, 72 nt, Human
aaauuaacuaaccuguugaaggaauugcuaugugaaguauauaugagcacuucccuugcagguuaugaauuu

SEQ ID NO: 4098018 - RNA, 83 nt, Human
aaauuauacauuccugggcuccacccuagaacccaugaacuagauucauuaagaauggggugggguccagggaucuguaguuu

SEQ ID NO: 4098019 - RNA, 55 nt, Human
aaauucagcauccugcacuggaucauacaauugguaagcuguggaugugggauuu

SEQ ID NO: 4098020 - RNA, 84 nt, Human
aaauucccugagcuucuauuuuuccagagugcccuagagaugaaucucaaugcagcuuuguaaaguaugaagcacaaggcuuuu

SEQ ID NO: 4098021 - RNA, 79 nt, Human
aaauuccugagcauuuuaggaucacauuagaaagcaagagaaaaaaaguaaagugacccuuagaagcugcagcgaaauu

SEQ ID NO: 4098022 - RNA, 126 nt, Human
aaauugcccaggaucuacacaguuagugaaauggauacuaggauguuacgaugcuuuacagaaaaaaauaucuaagcauggcuguucuagcuauauacacaaacccagaagauccucagacaauuu

SEQ ID NO: 4098023 - RNA, 57 nt, Human
aaauugcuacaggugucuaguagcuacuguguuggauagcacagcuguagacaguuu

SEQ ID NO: 4098024 - RNA, 130 nt, Human
aaauuggcccugaaaaaaagacaaagaaacuauaggacacagauauguuucaguauucaagucaaacaauguugaaauggauugggugcugaagcauagugguccagauaguucugacauggccaaugau

SEQ ID NO: 4098025 - RNA, 63 nt, Human
aaauugucagaauucagaaaguugcuccaugugccccugucacccugaauucuagaccaauuu

SEQ ID NO: 4098026 - RNA, 57 nt, Human
aagacuacuuuuggcaguguguauaagagauguguauacauguagguagguagucuu

SEQ ID NO: 4098027 - RNA, 79 nt, Human
aagacugugucuauggcuacucacuuaaacaagaaaauuuuauggucaguucugccuauauagaaacucacacaguuuu

SEQ ID NO: 4098028 - RNA, 57 nt, Human
aagacuuauagucaguaauucuuacauaauagacauuuacugcauacuauggguuuu

SEQ ID NO: 4098029 - RNA, 66 nt, Human
aagacuugacuccacaauuugacuuauauuuccuuuaaauaauuuuguccugguggaguaagucuu

SEQ ID NO: 4098030 - RNA, 58 nt, Human
aagacuuuucugcaaguuuaacaguguaaccaucaccucuuaaagugcgagaagucuu

SEQ ID NO: 4098031 - RNA, 120 nt, Human
aagagaaauagauuaagcaaagcuagagguauugcacgugcucucuacagacaacaucucacuuuguagagaaaaauuuuacugcaaugcuucccauugcaccugccaacuccuucucuu

SEQ ID NO: 4098032 - RNA, 83 nt, Human
aagagaagccuucuuacucuacuccucaaacuacaggcccagcuucuaaacaggccugagcuagggaaggaagaccuugucuu

SEQ ID NO: 4098033 - RNA, 72 nt, Human
aagagaauugaccuguucuuguggcucuggucagauugagaccagcaguuaugaggccaggacuagucuuuu

SEQ ID NO: 4098034 - RNA, 70 nt, Human
aagagacuuauuggaggaucuaagagucacaacccucuuuguggcucucagauccuccaauaagucucuu

SEQ ID NO: 4098035 - RNA, 73 nt, Human
aagagagaggaugaauuuuuuuuaaguugcauaggugaauugaaauaggcacgaaugaaaguuucucucucuu

SEQ ID NO: 4098036 - RNA, 69 nt, Human
aagagaggagggagcagggacuauaaccagccuagggcuuuucucuggauccugcugccaccucuucuu

SEQ ID NO: 4098037 - RNA, 60 nt, Human
aagagaggaugagcuucaguugggugaccugucacacccagcucauccauuaccucucuu

SEQ ID NO: 4098038 - RNA, 129 nt, Human
aagagaggcagaaaaacaagauguaugcaguuuauuuaggagaaugggcauauuaauucuuaacuuuaauaauuuuaaaauaaugucuaugguuccaaaaugcgcauuuaauuucuucucuguucucuu

SEQ ID NO: 4098039 - RNA, 113 nt, Human
aagagagucgucugucugguuucuucugaccuuuugucauuggcaaauuaaaacccaaaguagcugauggcacaggaauuuagaugcaggagccagugaacauaauaucucuu

SEQ ID NO: 4098040 - RNA, 129 nt, Human
aagagauauggccaggagacacauuccaccugaagacugagagggaggcuguccgguaccauguaacaguugcgucagacugggacacuuccuuuuuacagaggacuauaaaaccccugcccuguccuu

SEQ ID NO: 4098041 - RNA, 86 nt, Human
aagagaucaguuaguugcuuaaacccugaucaugugucaggcacuauucuagaugcuggggguuagagcagaaagguagauuucuu

SEQ ID NO: 4098042 - RNA, 71 nt, Human
aagagaugguaauaguaacauuuccauuguuaguuauuacaaacauguacaaugugugcuauuuaucuuuu

SEQ ID NO: 4098043 - RNA, 72 nt, Human
aagagauuaccuuggacuccagaugcugacuaaagaucagauagaucuggaaaaucacaggugcaagcucuu

SEQ ID NO: 4098044 - RNA, 117 nt, Human
aagagauuuguggagaaggagaaauuuaugguguuagcaaggaaagaaauuacaaaauuauaauaagcucuggcuaagcugauaaauuuacagauuuaccuuuuaaggguugcucuu

SEQ ID NO: 4098045 - RNA, 71 nt, Human
aagagauuuucacagauguuuuggagucuauuuagucagucagauucauccaucauuugagaagguuuguu

SEQ ID NO: 4098046 - RNA, 61 nt, Human
aagagcagagcagggggaaucacagucugacaaagagaguucuccagcccuguucccuuuu

SEQ ID NO: 4098047 - RNA, 58 nt, Human
aagagcaugugcagacucugacaggcuuucagggaagccacgucccccaugugcucuu

SEQ ID NO: 4098048 - RNA, 63 nt, Human
aagagccaccuuccaaaauaaucacaaagaagucucacuuuguauuaugugagguuggcacuu

SEQ ID NO: 4098049 - RNA, 55 nt, Human
aagagccugcaguaccuugcuauguggaccagguuugcaggguggcagagcucuu

SEQ ID NO: 4098050 - RNA, 111 nt, Human
aagagcuaauagaggucuggcucuuacucccucugucuuguccagaaaggcagaccuacccugaggggacaggacaggagggcugagcacagcacacacuucuguucucuu

SEQ ID NO: 4098051 - RNA, 55 nt, Human
aagagcucaggauuucauccauguguccuuggacaaggaacuuuuucugacucuu

SEQ ID NO: 4098052 - RNA, 62 nt, Human
aagagcuguugauuuaaaccuauuccuuagugaugguguaggccaggaaucagcaagcuuuu

SEQ ID NO: 4098053 - RNA, 70 nt, Human
aagagcuuauuaauuuuucugcaugugaaagcuuugacuuccuauuagaaagcuuaauaucguggcucuu

SEQ ID NO: 4098054 - RNA, 81 nt, Human
aagaggaaaagagcacucaugacccuagugugcuggcauccuguuguccuuuauagcuaaggucagacuguuucuccuuuu

SEQ ID NO: 4098055 - RNA, 66 nt, Human
aagaggaggaugcuuuacagcuggauucauucauucauuuaaccauuuaugaagcauccacuuuuu

SEQ ID NO: 4098056 - RNA, 64 nt, Human
aagaggcagaaauaucgcugaauggugaaaaacagcucccccauauucagcagugucugcucuu

SEQ ID NO: 4098057 - RNA, 84 nt, Human
aagaggcaguccuauguguauucuuacaggacauguacauuauauuacugcuuugauuagaagaguacauggaggacuaaucuu

SEQ ID NO: 4098058 - RNA, 84 nt, Human
aagaggcaguuaggacacagcuugaugagggcuuugcuggggaaaguacuggugcuccagaagcucguggucaaggugccucuu

SEQ ID NO: 4098059 - RNA, 86 nt, Human
aagaggggagacgagaugugucagguccugggggugggaagucacuuccugcgcccgcuggcccugcgaucuccgccuucccucuu

SEQ ID NO: 4098060 - RNA, 55 nt, Human
aagaggugagaagcuacacuuagauucucugagugcauggacuacuggcuugcuu

SEQ ID NO: 4098061 - RNA, 124 nt, Human
aagaguagaggaaauaaugucuauagguucacaguucugaggucugcauuacauagugcagcucuaguguguaauucagugcccagcacagucagaacuacaagaaguuauuuacucuccucuu

SEQ ID NO: 4098062 - RNA, 65 nt, Human
aagagucuccauggaaaguagccaguugggcaugacugugcauuugucaugggguuuaugcucuu

SEQ ID NO: 4098063 - RNA, 56 nt, Human
aagaguggaggcuccuguuggaagauuaccuguucccagcccagccuccuucucuu

SEQ ID NO: 4098064 - RNA, 59 nt, Human
aagaguggugcaggugucacugcagauccucgauuuguugacaucccuguacuuuuuuu

SEQ ID NO: 4098065 - RNA, 62 nt, Human
aagaguuuuuaauggguacugggauuuauucaauaaaguuuauuacucaguccaaaacucuu

SEQ ID NO: 4098066 - RNA, 74 nt, Human
aagauaccgaugcuugagucccuccacuagauucggauuuauuggucuggggugugaccugagcauggaauuuu

SEQ ID NO: 4098067 - RNA, 89 nt, Human
aagauauguuuccaacugugaucuuacuuggaaauagggugauugcagaucucaucugcuacagugaggucauacuggagagggaucuu

SEQ ID NO: 4098068 - RNA, 90 nt, Human
aagaucaagguuccagcaggguugguuucuucugaggccucuuuccuuggcuuuagauggcugucuucuugcuuacccucauguggucuu

SEQ ID NO: 4098069 - RNA, 63 nt, Human
aagaucacugagcuucagugcuggccuagaaauaagcugggaaagcucucuccucaggaccuu

SEQ ID NO: 4098070 - RNA, 104 nt, Human
aagaucccugguaaaucuguuuuguaauguugagugaaauucccucaagagauucuguucauauaucugcaaagcaguauuuaccaccaacaaauagggauuuu

SEQ ID NO: 4098071 - RNA, 115 nt, Human
aagaugaaaucuuacaagucuuuuucaugucuucugagggcugagauauaacuuugaaguagagcccaaacaugaagaucaugaagacggcuucuucuccaaaugauguuaucuu

SEQ ID NO: 4098072 - RNA, 100 nt, Human
aagaugaaauuacuagaaugaggcuuuugugggaaauuaaauaugucuggauuuaucaggaagauuaguuuccuaccucuuucaacagcaauuucuuuuu

SEQ ID NO: 4098073 - RNA, 67 nt, Human
aagaugauguguuagcuuaguggauauuuccuguuaacauauucauuacaguuaauuacaacaucuu

SEQ ID NO: 4098074 - RNA, 60 nt, Human
aagauggcccagggcacagcagggagauggccuuauuuccuuaugccuuuuggcuaccuu

SEQ ID NO: 4098075 - RNA, 90 nt, Human
aagauguagcacuaguucugacuaagucguaauuaacuucaucgggaguuacaugauagcaacauagaacagaauuuggcugaacauuuu

SEQ ID NO: 4098076 - RNA, 84 nt, Human
aagaugucuuuggaaggaaucaugauccaaauuacuuagucuguaauuacaagccaccaucagugacuucuuccaaaguuucuu

SEQ ID NO: 4098077 - RNA, 57 nt, Human
aagauguuaaaucuguagaauuccaccauggucuaaaguuacaaggugugacaucuu

SEQ ID NO: 4098078 - RNA, 82 nt, Human
aagauguuguguaugccagggucacagucauauuuugaccuauguuaaaucaugccuauugcuuugugugucacaauaucuu

SEQ ID NO: 4098079 - RNA, 71 nt, Human
aagauuaggaucuucauugugcugcaaauagcuauaauauauaugcagucuaacugggaagguagugucuu

SEQ ID NO: 4098080 - RNA, 78 nt, Human
aagauucugauaauguugccauguugcaguaacacuuuuaggcuuagcacugcuauacagcagcuuacuaguuaucuu

SEQ ID NO: 4098081 - RNA, 109 nt, Human
aagauuuuuguaugucauagaagcuuuaauuaucuuacuuauguugaaggagaucaaauucuguuucagaguuauguaagaaaauaagaguuuauacuaugcuaauuuu

SEQ ID NO: 4098082 - RNA, 69 nt, Human
aagcaaacaucccagagguucaaguuaacugaggccgacuccuggcuaggaccucugcggagcaugcuu

SEQ ID NO: 4098083 - RNA, 59 nt, Human
aagcaaagcuaccaauuauugagugcuaugugccaagcaugaugugaaaugcuuugcuu

SEQ ID NO: 4098084 - RNA, 107 nt, Human
aagcaacagcauagucauauuguaggauuggacuauucauuguaggauuagacgauucauuaaguagugaauaguccaaucccgcaaucugacugugcuugggguuu

SEQ ID NO: 4098085 - RNA, 81 nt, Human
aagcaacuucccaaaaaagaugaacugagccuauucauaaucauuguagaaacaagcuucuucuauuuuggggccauguuu

SEQ ID NO: 4098086 - RNA, 78 nt, Human
aagcaagacugucuuuaccaucaaauaaaugaaaucuggggcuauguguaguuccgcuucauauuuggagucuugcuu

SEQ ID NO: 4098087 - RNA, 72 nt, Human
aagcaagggagacagcagaaacuagagcacuugaguaaaagcuggaugcuuaggucccuguuguucauguuu

SEQ ID NO: 4098088 - RNA, 129 nt, Human
aagcaaguaagucauggacauucuaugcauaggucaaguuaauguuauuuuaugcuaaauugcauagcauucugugauaggcauuuaacucuaaguguaucuaaggauaaaaaaugugauugccuguuu

SEQ ID NO: 4098089 - RNA, 94 nt, Human
aagcaauguaccucuuuauuuagguugaaaauugauucaaaagaauuguaacuggcucagugacaacuaugaauauuuagguaaauuucagcuu

SEQ ID NO: 4098090 - RNA, 89 nt, Human
aagcacaaugugacuagcauuuucuauguauaugaaguauugaaaaugcccaauagcuuuaagacauggugaauguauuacaugugguu

SEQ ID NO: 4098091 - RNA, 93 nt, Human
aaauuccuaauugugucuacuaaauuuauuuuagcauuaaacauucuuuaaauggaagucuggugagaacauaaauagaugugagagugguuu

SEQ ID NO: 4098092 - RNA, 87 nt, Human
aaauuccugaaauucuucucuuugcuuugucuauaugcaaaaagcccaaauguugcauagacacaagagaaggguauaauugaguuu

SEQ ID NO: 4098093 - RNA, 66 nt, Human
aaauucuucuugaaacuuuagguuguuguuugugcaaagcucuucaacauguugcaggaaggauuu

SEQ ID NO: 4098094 - RNA, 70 nt, Human
aaauugaaguuucaaauauaaaauuacaggaaauuaccaacuuucuguuuugugaauggaauuuugauuu

SEQ ID NO: 4098095 - RNA, 60 nt, Human
aaauugagacuuuuuuccuccaaauauguuuugacuuuggagauuuagaaggaucaauuu

SEQ ID NO: 4098096 - RNA, 67 nt, Human
aaauugcauugccaccuaguacuucggcaaacacuuacugaggaccugccaggugcaaagcacauuu

SEQ ID NO: 4098097 - RNA, 63 nt, Human
aaauugcuaaauuguaagagggagaucaugaauaauugaaauacucagauaauucagcaauuu

SEQ ID NO: 4098098 - RNA, 62 nt, Human
aagugaguauucaaggcucauaauaauuaauaucuguugcuagcuuugcuuuguacucauuu

SEQ ID NO: 4098099 - RNA, 65 nt, Human
aagugagucugagcgcuuugggauucccccucccaucuaucuucuuggagcugccauauuuaguu

SEQ ID NO: 4098100 - RNA, 62 nt, Human
aagugaucugacucccaguuagagguucuuuccuugcccucuuuuaggugaucagaucacuu

SEQ ID NO: 4098101 - RNA, 127 nt, Human
aagugauuccaucaaccugccuauguacuuugagucauuugaacaguuucaagaaaacuuugaaucauauugaaagaaauugccauuguauucauaugaaaguacagaacaaaacuuggaaacaguu

SEQ ID NO: 4098102 - RNA, 57 nt, Human
aagugcaaaucuguggcugaaaggaucauauccccucguccaaacauuugccagcuu

SEQ ID NO: 4098103 - RNA, 60 nt, Human
aagugcacagacuugcuucuugccugcuacucagggaauuaaguauauguccguguacuu

SEQ ID NO: 4098104 - RNA, 68 nt, Human
aagugcagaagaaaugcaucuaccauaggggucucuagcccuagcccagaucauucuucugagcacuu

SEQ ID NO: 4098105 - RNA, 98 nt, Human
aagugcagagauguuucuucuuuugguggugggcuuggcagccuggacagcagcaguguuaaguugucagcagcacuggcaaagagacuccugggcuu

SEQ ID NO: 4098106 - RNA, 78 nt, Human
aagugccaguguuuaaucauugugaauuuauaagugugugcguuaauuuguaaggggauuaaaaauacauggguauuu

SEQ ID NO: 4098107 - RNA, 88 nt, Human
aagugcccauaucuguacaaacuuaagauguucagauaauuuggaggcauuguuaacuguuuuucuggauaucagugcaugggcacuu

SEQ ID NO: 4098108 - RNA, 73 nt, Human
aagugccucccaaggggcuguuggagggacauucaauccccucaacaauuuucaagcuucuuuggaaacauuu

SEQ ID NO: 4098109 - RNA, 55 nt, Human
aagugccuuuucuucauaguuacuuugaaaaaaggugaauagggaaagguuacuu

SEQ ID NO: 4098110 - RNA, 77 nt, Human
aagaugguacucacagccucaggcaagcugccaugagauugucauuccuuggcacuggugccuguggcgagcaucuu

SEQ ID NO: 4098111 - RNA, 63 nt, Human
aagaugguugccaacucaaggauuuccgccuucuggaggccgcguagucugagcaucugucuu

SEQ ID NO: 4098112 - RNA, 69 nt, Human
aagauguaucuuuccuuuaauucugauuauagaauuuguaaauuaguagaauaaagagggauacauuuu

SEQ ID NO: 4098113 - RNA, 116 nt, Human
aagauguauuuacuuugaggaagaccuaaugagaucuugguaaauccccuuacacaaagagaugcuuuuuuguguaaauuuaaaggaugacacucccucuaaguguucuacauuuu

SEQ ID NO: 4098114 - RNA, 69 nt, Human
aagaugugaaauugucucuggggacuuggagguguucuaaaccuguugaaccagagacauuggcaucuu

SEQ ID NO: 4098115 - RNA, 73 nt, Human
aagauguuaggguggaagggaugaaugguucagcaacccuggcuccuaacagaccuuacuuccccuuugucuu

SEQ ID NO: 4098116 - RNA, 91 nt, Human
aagauuaaaaaaugcguggaggcagaaaucuucuguugacucacuuuggucaauguguagauguugcauuccucucaaauuuuuagguuuu

SEQ ID NO: 4098117 - RNA, 64 nt, Human
aagauuucucuccuggaaagcaauucaccacucucuaugcuucuuuuucuuucugagaagucuu

SEQ ID NO: 4098118 - RNA, 63 nt, Human
aagcaaauuauugacgccaagcuguggauuuucugaaucaacaaugggucuguaauggagcuu

SEQ ID NO: 4098119 - RNA, 82 nt, Human
aagcaagguaauucuagccagaugauucccaaauaggaggugcugcucuccuuguugcuuucugguuggauuaauuuuguuu

SEQ ID NO: 4098120 - RNA, 69 nt, Human
aagcaauaagccagauuuggaucaugaaccacaguuuaccaaguccuggucuaacuggucuccuugcuu

SEQ ID NO: 4098121 - RNA, 65 nt, Human
aagcaaucaaauaugugauagaagcuaauuugaaacaauauuagcuuuauauauuuggaucgcuu

SEQ ID NO: 4098122 - RNA, 93 nt, Human
aagcaaugaaauuugauguccucagacacccugcuggcuuuacgcuuauguaaaguccgcauuuguguucucuggcagcuguauuucuugcuu

SEQ ID NO: 4098123 - RNA, 56 nt, Human
aagcaauucacaguucacuuaaagcaauagugcugaaagucuauuuagaguugcuu

SEQ ID NO: 4098124 - RNA, 64 nt, Human
aagcacacagcaaaggggagcugggccauaccagcuaaauccuacuuuuguauuugaugagcuu

SEQ ID NO: 4098125 - RNA, 66 nt, Human
aagcacagagaugggcacgccucuuuacagaaccaaagauucagaacugugccuuacccuuugcuu

SEQ ID NO: 4098126 - RNA, 59 nt, Human
aagcacagcuggaacagcaggaaaauauuccccaacccugcuguugacauggcuugcuu

SEQ ID NO: 4098127 - RNA, 60 nt, Human
aagcacagggacucaggaccgggcgcuuucuaaucucuucagucucugggucuccugcuu

SEQ ID NO: 4098128 - RNA, 59 nt, Human
aagcacauacauaauaaaguccuuugugcccuucaaaagggauuuauuuguaugugcuu

SEQ ID NO: 4098129 - RNA, 68 nt, Human
aagcacauguguagguauaacuugugaguaagcacuauuuacucuacaaauaaauuacuauguagcuu

SEQ ID NO: 4098130 - RNA, 92 nt, Human
aagcacccgggggugggugcucccccuggaggguucacccgcagucagccugcucuguucucccgcaggggcagcccucaucccggcuguuu

SEQ ID NO: 4098131 - RNA, 62 nt, Human
aagcaccugcuggguguagaggcuucugcuggcuccaaacagccuccaccccacagggacuu

SEQ ID NO: 4098132 - RNA, 64 nt, Human
aagcaccuucugagaaagauuugccuccguggauacuccucaggaggccauucucaagguguuu

SEQ ID NO: 4098133 - RNA, 75 nt, Human
aagcacguucuacaugguugcucagaggguccucaauaggacugaggccuaggaguccacugagauaaccugcuu

SEQ ID NO: 4098134 - RNA, 83 nt, Human
aagcacuggauacuuaaugugaaaccgcacagaauaacauuaguguuucacugugguuuccauggauuucuguauuuguccuu

SEQ ID NO: 4098135 - RNA, 66 nt, Human
aagcacugggacuguuucucuuucuucccugaccuuuggaauuccugaagcguuucccacuugcuu

SEQ ID NO: 4098136 - RNA, 58 nt, Human
aagcacugucccuguuuccuggaaaauuuuuuaauuuugcugagguugggacauguuu

SEQ ID NO: 4098137 - RNA, 83 nt, Human
aagcagaaguucugaauguuuucugacugcuaacuuggugcucucucuaccacagcaugagagaugaacauuccuuucugcuu

SEQ ID NO: 4098138 - RNA, 130 nt, Human
aagcagaauguaacacacacaaaaaauucuucaacaauccuuuauuaagugccuacaauaaagugccucacauauuguaggcacuuaauaaaggauuguuggagaauuuuuuggguguaacauucuauuu

SEQ ID NO: 4098139 - RNA, 57 nt, Human
aagcagaauuucccacuaguuguuugaaugacacuggcaccaagggaaauacugcuu

SEQ ID NO: 4098140 - RNA, 129 nt, Human
aagcagagaaaggauaaguaacucauucaagacauacagacagugagccacagaaccaacacuugaaaucagguauuuuggacuccagugucuguguucuuggcuguuuguaauacugucuuuuauugu

SEQ ID NO: 4098141 - RNA, 104 nt, Human
aagcagcagcuguuuuauggugugaacuuuugcacagaggauuucaagaggcucauucuccucggaagucuguuugcaaagugguucuuucuuggcuguugcuu

SEQ ID NO: 4098142 - RNA, 55 nt, Human
aagcagcauguggguuaucgggaagagugugaacuuccgagcccaccugcugcuu

SEQ ID NO: 4098143 - RNA, 56 nt, Human
aagcagcugugugacauaaucugguuugcauguugggaaggucacacuggcugcuu

SEQ ID NO: 4098144 - RNA, 74 nt, Human
aagcagggcuuuaagcgguuuuauuccccuuggguuguaaaaguccagccuagaggcugcugagagcccuguuu

SEQ ID NO: 4098145 - RNA, 55 nt, Human
aagcagguaaauauguuucccuuuuucuguuucagaggucaacauuuaucuguuu

SEQ ID NO: 4098146 - RNA, 68 nt, Human
aagcagguccuggcaucaggcaggucuggucuuuaaauauucuggaucugggugaccuugggcaacuu

SEQ ID NO: 4098147 - RNA, 63 nt, Human
aagcagucaacugcauuaggaaaugagggcaagcuuuuguucaguaaugcauuugauaaguuu

SEQ ID NO: 4098148 - RNA, 78 nt, Human
aagcaguccagccuucaaucuuagugacacaucuucuucugcugagcaccacuaucuuguagggcauggcaguugcuu

SEQ ID NO: 4098149 - RNA, 73 nt, Human
aagcagucuuggcuggguucagugaguuuagacagauauagcucucugaguccuuuacagccuggacuggcuu

SEQ ID NO: 4098150 - RNA, 61 nt, Human
aagcauaaaaugguaaacgaagcugaagaucguuuucaguugaaaaggcaauuuuaugcuu

SEQ ID NO: 4098151 - RNA, 71 nt, Human
aagcauaugaacucuggagucugagugcuuggguuuaaauucuaccacuuacuuaagaguuguaugagcuu

SEQ ID NO: 4098152 - RNA, 102 nt, Human
aagcauucuaauaguguaggcaucuacauucauguugaaauuugugaucaauauuuuaaaaauucacaauguguagucaugcuuuucuaauaguaauagcuu

SEQ ID NO: 4098153 - RNA, 75 nt, Human
aagccaagguucugggaguuugggucggcugaugauacuuagaagaucuuugcaauuccguuuauuaaccugcuu

SEQ ID NO: 4098154 - RNA, 57 nt, Human
aagccagcauuuucccauuccuuacaggccccucaugaggugaagggagugcugcuu

SEQ ID NO: 4098155 - RNA, 57 nt, Human
aagccaggagcgaggccucggcagaaaacgccccagccgccccuugaucuuggacuu

SEQ ID NO: 4098156 - RNA, 56 nt, Human
aagccagugggcauagcaguugaauuuaugcagcuguuucugauauuacauggcuu

SEQ ID NO: 4098157 - RNA, 76 nt, Human
aagccagugugacaggaaacuuugugucuucugugugacauaaaaccauccauuguuucuuaaauuccauuuguuu

SEQ ID NO: 4098158 - RNA, 100 nt, Human
aagccauaugguuuaucgggcuuucugguucucaaagcacuuuuccaugugaggaaaaggcuaauauuuaugaaaccaaggugccgagcuauauacguuu

SEQ ID NO: 4098159 - RNA, 69 nt, Human
aagccaucuccuuccaaacccaggguaugggcugggugacugcucugauucuuuugggaggugagguuu

SEQ ID NO: 4098160 - RNA, 93 nt, Human
aagccauuaaggagagguauuucucccagcuuugccuacaaggaggucaaaggcuguccaggagaaaauaguuugaaguguuuuguuuggcuu

SEQ ID NO: 4098161 - RNA, 129 nt, Human
aagcccagaccugcaggcccugaggagacaagggagcuauagauuauuuugugagaccugcauuucaauaggcagcauuucacaggccuuuuguagcccugcuuaucuuagaaacuuugugugcggcuu

SEQ ID NO: 4098162 - RNA, 55 nt, Human
aagcccucauuagccauagcccuagaccauccugggcuagggcuaaugagggcuu

SEQ ID NO: 4098163 - RNA, 56 nt, Human
aagcccugggauguucagcaguuaccuagggaggcuaguacacauguuaggagcuu

SEQ ID NO: 4098164 - RNA, 71 nt, Human
aagcccuuugcccagcacucucucucucucuaccugguguggcagagugauggaaugugggugaagugcuu

SEQ ID NO: 4098165 - RNA, 76 nt, Human
aagccuaauugugacuauuucugaaggcagagaacacagaaucaguucucuuaauuuuggaauaguguuaagguuu

SEQ ID NO: 4098166 - RNA, 57 nt, Human
aagccugaauuuauccauaugcuuaggaugcagugauuggaagaagaacucaggcuu

SEQ ID NO: 4098167 - RNA, 74 nt, Human
aagccugacagcugaagggucccagagcagcaaauaucaccuuguuucuaugggaccauuccagcugucugcuu

SEQ ID NO: 4098168 - RNA, 78 nt, Human
aagccugaugauccgucuauuucucuuggcucuguguacagcauucaagagacaggacguguuucauuuccaaggcuu

SEQ ID NO: 4098169 - RNA, 63 nt, Human
aagccuggacuaucgcgugugccugcccuacgccaacgcagugcugcucgagauccagugcuu

SEQ ID NO: 4098170 - RNA, 94 nt, Human
aagccuuaacgauuuauguacaggauuucauguuacauuuaaaauguuguggcacauuucagauguaaugugaugucuauuuguaugugggcuu

SEQ ID NO: 4098171 - RNA, 63 nt, Human
aagcgaggaaggugugaacugauucauuggugugaacaccaauugaauucacaccucuugcuu

SEQ ID NO: 4098172 - RNA, 62 nt, Human
aagcggcagcaucccauggaccgcauggggccucuccagguggagcagggagcaugccucuu

SEQ ID NO: 4098173 - RNA, 77 nt, Human
aagcugagcacagaacagcuuagaaauguugcuaaagcuccuggucuugguggcucuaaagccuguaccucaagcuu

SEQ ID NO: 4098174 - RNA, 69 nt, Human
aagcugagggugugaccauggucuaugauuauccuaacuucaucuacuugaccagcccacucccaguuu

SEQ ID NO: 4098175 - RNA, 82 nt, Human
aagcugagugaaauaacuuaagaaauuuccccacugucauugcaaacuuaucaguggagaugcaaagauauuuuaugagcuu

SEQ ID NO: 4098176 - RNA, 83 nt, Human
aagcugcacggcauucuuuagacugagagauagcugcuggaguuuuacuauuucaaugucaaagaauguaacuagugcuccuu

SEQ ID NO: 4098177 - RNA, 78 nt, Human
aagcugcagaugaggggcauauaacaauaguauuuuggacuauuaguugugugguucucaauuuacucuuugcugcuu

SEQ ID NO: 4098178 - RNA, 55 nt, Human
aagcugccacacggugaguacucuacaaauauggaaaucacugggugugcagcuu

SEQ ID NO: 4098179 - RNA, 58 nt, Human
aagcugguccaaaauucggcacugcgagcgccgcgggucuggcuucgggaacuaguuu

SEQ ID NO: 4098180 - RNA, 64 nt, Human
aagcugugccuuugccuagaauuucccuccacccuugaaauucuucucccuuagggcccagcuu

SEQ ID NO: 4098181 - RNA, 73 nt, Human
aagcuuagccuggggacagagucaaguuccuaagcaugauauuggaaugggagcugcccccagggcugugcuu

SEQ ID NO: 4098182 - RNA, 72 nt, Human
aagcuuccuguacagugaaugaaugugacaaggguuauugaaguugccucacucauucaucugcugaagguu

SEQ ID NO: 4098183 - RNA, 70 nt, Human
aagcuucuugaccaagccuguaacuugaaaaucgcuucagaauuugccaacuguuugguuaagugaccuu

SEQ ID NO: 4098184 - RNA, 62 nt, Human
aagcuuguacuccaggauguagaaucagagauuauuuuugcuugcuccugagaguuauguuu

SEQ ID NO: 4098185 - RNA, 82 nt, Human
aagcuuuagagaugaguuccuuuaaaagcaaacugauuacacgaaaaacuuuccagucuuuggaauugauuauuugaaguuu

SEQ ID NO: 4098186 - RNA, 55 nt, Human
aagcuuugacuacugccucuuggaugucauccugaaagcuggcaggucauagcuu

SEQ ID NO: 4098187 - RNA, 100 nt, Human
aaggaaaauauacucaauuuauuuaaauuacuguuuuguucuccacgcauucuaaaggagaauaugacauagaauugagaugagggucuuuuaguuccuu

SEQ ID NO: 4098188 - RNA, 70 nt, Human
aaggaaagcauugaaagcuugaauccuguuaacuugaaaaguugaguucuggucuuuuaaaagcuuccuu

SEQ ID NO: 4098189 - RNA, 129 nt, Human
aaggaacagugagacuaaggcgcuucuagaaggucauccugguuagguuuguaacuuuauguagaaguuacaagacacugcugacacagggacugguaugguugugguuuuaauguaaaauaguucuau

SEQ ID NO: 4098190 - RNA, 77 nt, Human
aaggaacccuuuuucugucaaguuucucugcaauuuauuuaagcgaagguacauuugauaaaaauagcaggcuccuu

SEQ ID NO: 4098191 - RNA, 130 nt, Human
aaggaacucauuauuucagauguguggacucagaaugugacacuguaagaugagcuuuuuuaacugggaaaguuaacaaauuuguuuuagguauugcuaucugucacucaauggaauguucuacccccuu

SEQ ID NO: 4098192 - RNA, 55 nt, Human
aaggaacugcugauguggugacauauuagucaucgcgccucuagagcaguuucuu

SEQ ID NO: 4098193 - RNA, 62 nt, Human
aaggaagaaucaucacguugggacacaaauccgaguccugucuguccuuugcauucuuccuu

SEQ ID NO: 4098194 - RNA, 61 nt, Human
aaggaagagucaggaugagaggccagguguuucuagugcuuaaaauccaugauuuuuacuu

SEQ ID NO: 4098195 - RNA, 81 nt, Human
aaggaagcuccaaauaggagggaugcugagcaggggccccucccuugaugcucccugcuuguuucccuucaggggacccuu

SEQ ID NO: 4098196 - RNA, 93 nt, Human
aaggaagcugguccuaagagauuaagucacuuggucagggucucuuggugagguacuuaagugaaauugguuuuccaggugcuggucuuccuu

SEQ ID NO: 4098197 - RNA, 130 nt, Human
aaggaagggauuuuaguguguucuguguuuucgcucuagagcuuuuuccucuuguaaaagguaguacaagacuuauaaagggaagaacuuugguacaggagaucagcagagauugacuagaaaaccccuu

SEQ ID NO: 4098198 - RNA, 79 nt, Human
aaggaagggucagugguauuugagagaauggauaacuugaaguuguccaaauuccacagauuucucuauuuccauucuu

SEQ ID NO: 4098199 - RNA, 60 nt, Human
aaggaaguuuucuugguuccuacuuguacgaccuguggagguuucaugacaaauuuccuu

SEQ ID NO: 4098200 - RNA, 61 nt, Human
aaggaaugaagaaucuaggauucccugaucaauacuauaggcacuuagaacaucauuccuu

SEQ ID NO: 4098201 - RNA, 79 nt, Human
aaggacacaauggauuaacaaaugaaaauuacuauaugcauccagcauauaguaagcagucuguaaauucuuguucuuu

SEQ ID NO: 4098202 - RNA, 59 nt, Human
aaggacacacuguucucacguaaagccaaauugcugacuuugagugagugugugugcuu

SEQ ID NO: 4098203 - RNA, 69 nt, Human
aaggacaggagaaaacgggauccuaguuccggaagagaaaaaggagcaaauucaccuuucuucugccuu

SEQ ID NO: 4098204 - RNA, 130 nt, Human
aaggacaguguaucuuucuggaauuaaaaauugcauugguuaagagcuuuggggugcaagaaacaaaagcuuuccuuagguaacuuaaguaauggaguuuuaauacuccauuuuaaagaucaccagaauu

SEQ ID NO: 4098205 - RNA, 73 nt, Human
aaggaccucacaggucaugugguggcuuuuggacuugauccugaagucagugaagaaugacuuggagaaucuu

SEQ ID NO: 4098206 - RNA, 61 nt, Human
aaggaccugccugagccucaguggccaagugucuucaccccuguagcccaggacaggcuuu

SEQ ID NO: 4098207 - RNA, 88 nt, Human
aaggacgagaauucagucaggacugaggaacuugaggcagggacucauacagcaccagaauguucucuccaguccuggauucugcuuu

SEQ ID NO: 4098208 - RNA, 62 nt, Human
aaggacguuucucuuccaggccuggcugccaggaugugaggcccggguggaggaaugcgcuu

SEQ ID NO: 4098209 - RNA, 64 nt, Human
aaggacugacaaaugucuuccuggugcuaaauucuaagcaaaaugggucaugugugugguccuu

SEQ ID NO: 4098210 - RNA, 65 nt, Human
aaggagacugggcugggucuggcuugaaucccagcuuugacacucgcccagcccuggguggccuu

SEQ ID NO: 4098211 - RNA, 60 nt, Human
aaggagaguacaggaguugguacuggaagccaucuggcaucagagcccugugcucuuuuu

SEQ ID NO: 4098212 - RNA, 76 nt, Human
aaggagauuaggcagucaaggcuaagaucuuuucucucccaaccagaguucuuuacaguccucugucaaucuccuu

SEQ ID NO: 4098213 - RNA, 91 nt, Human
aaggagcauagaguccagcaguuguaugacaaaauuugccauauuuagcaaugggcugagaaucaacaaccugcuccuggauuuugccuuu

SEQ ID NO: 4098214 - RNA, 75 nt, Human
aaggaggaauucugaguucaugccaaucugauguuuuacugguuuauucuagcucagaauaguuaauuccucuuu

SEQ ID NO: 4098215 - RNA, 74 nt, Human
aaggaggcaauucuauaggcaagcuauuuuuauauauaacuuaaaggagaaaaaacuaauggaauagcuuccuu

SEQ ID NO: 4098216 - RNA, 89 nt, Human
aaggaggcggcuuuuuacagguacuugcugcugaaaaauaauuucccugccagauacacugugagugcauuagccuguucuuacuccuu

SEQ ID NO: 4098217 - RNA, 127 nt, Human
aaggagguaccugaaaacaagcagaacucacaaggcaaugacugauuuagaauucgggcaacuggguucuuuuguaccaguuauuucuugcuguuuuuaaugcuuacgugcuucaguuguaugccuu

SEQ ID NO: 4098218 - RNA, 60 nt, Human
aaggagguaucuugauaaauuggagcccagcaagguuacaaaguuugagaaugcuuucuu

SEQ ID NO: 4098219 - RNA, 102 nt, Human
aaggaggucagucaacacgugucaucuuucauauagaaguuaguuucacuucugagaaaagugaaccuuuauaugaaagaugacauguugacugaccuccuu

SEQ ID NO: 4098220 - RNA, 82 nt, Human
aaggagguguugggaaggcauaccugagggagagacugcgagccuagcucuucuucagaacuugccuuuucaauggcucuuu

SEQ ID NO: 4098221 - RNA, 88 nt, Human
aaggaguagguggcaacaaggcaguggauguauuuuccuuuauucuuguaaagauaagacaucaacugagcauugccagacugcccuu

SEQ ID NO: 4098222 - RNA, 80 nt, Human
aaggaguccguguucuucuuggguaaagcugagccaggggcacacagacuggcuggauggcuggggaagagcaggcccuu

SEQ ID NO: 4098223 - RNA, 86 nt, Human
aaggauaaaacuguguuaguauacugguaguaaaauguauaauuaauaaagaugcugcagcuauauuuucccacagugaaauccuu

SEQ ID NO: 4098224 - RNA, 56 nt, Human
aaggauacuaagagaaaggagagguaaaaacuccuacaucagcucucaguagccuu

SEQ ID NO: 4098225 - RNA, 58 nt, Human
aaggaucugacagacuauagaagaaugggcauuacugcugaaucugguucagaucuuu

SEQ ID NO: 4098226 - RNA, 58 nt, Human
aaggauggagugccaggguggaacuaagcacuccuuagucacuuugcuacucugccuu

SEQ ID NO: 4098227 - RNA, 81 nt, Human
aaggauuacaggucaccagucuauccuugaucccuuucugcuucagcuggcagagguuggauuggugacuucacugaccuu

SEQ ID NO: 4098228 - RNA, 72 nt, Human
aaggauuaguauaauuguucuggaaucaagaguuccuguucucuugcuagaauuagguuaaacaaaguuuuu

SEQ ID NO: 4098229 - RNA, 84 nt, Human
aaggauuauagccaggucacagagcuagcuagcucauuuacagcugagauuagcucuagaucugggcuauuuuguuugauucuu

SEQ ID NO: 4098230 - RNA, 77 nt, Human
aaggauugauacaugcacagcaagggugagagaauggacaaggaccaacuccaucccccugugugucaaucagccuu

SEQ ID NO: 4098231 - RNA, 63 nt, Human
aaggauuggaaagaacagaguuguguaaagagcaguagacauagaguucaauuuucaguccuu

SEQ ID NO: 4098232 - RNA, 55 nt, Human
aaggauuuguccaaagucacacagcuaguaaguguagaagugggaacaaaucuuu

SEQ ID NO: 4098233 - RNA, 62 nt, Human
aaggcaaagaaguuggucaggagugcaauucuuuuguuuacuuuuaauuuccuucuggcuuu

SEQ ID NO: 4098234 - RNA, 59 nt, Human
aaggcaaugcuaagagguuuggagcccaagaugcggccauucaucucagucauugcuuu

SEQ ID NO: 4098235 - RNA, 61 nt, Human
aaggcaccauaggcaaauccaggaugcucuccuuaugcccugauuguucuugcugggccuu

SEQ ID NO: 4098236 - RNA, 61 nt, Human
aaggcacgcuuucucaccuucaagcccaguccauguucuuaaaguugcagagaguugucuu

SEQ ID NO: 4098237 - RNA, 63 nt, Human
aaggcagaagacaggcaaaucauggcuuauaagguuggugggaggcugccugucauuuggcuu

SEQ ID NO: 4098238 - RNA, 95 nt, Human
aaggcagagaccugauucguacaguaguaaaagugaaugaacauuggcaacauuuauucaccauuuauuaugugaaguccugaaaauccugccuu

SEQ ID NO: 4098239 - RNA, 56 nt, Human
aaggcagagggcuggaucagagggucucuuaagaccccuucuagcucaucuguuuu

SEQ ID NO: 4098240 - RNA, 69 nt, Human
aagugcuggacauguguauuaccucgauugugaugauaguaucacaaauguuugcaugugucuaaacuu

SEQ ID NO: 4098241 - RNA, 61 nt, Human
aagugcuuggagcauaccuguuacauaguaaaugcuacguuaaugugugcuacuaucauuu

SEQ ID NO: 4098242 - RNA, 65 nt, Human
aaguggagcuauaggcucagauauuaacuaccauggagggcugagugcugggucuguuuucauuu

SEQ ID NO: 4098243 - RNA, 67 nt, Human
aaguggcaggagagcacaguaaauguuggaggcagacagccuggccuugaaucuggcuuugccacuu

SEQ ID NO: 4098244 - RNA, 60 nt, Human
aaguggcauguauaagaaagaaucaucagagaauuaaugguccuuccuuaaagugcccuu

SEQ ID NO: 4098245 - RNA, 67 nt, Human
aaguggccugugguuaucacaacugaaaagagcacauugaagcuuuaguauauaauuacugcuacuu

SEQ ID NO: 4098246 - RNA, 97 nt, Human
aaguggggguccucucucagagucucugggaggcugggucuggcuaagggaaagguugcaagauugagccucgcuaagauugggagagcugccgcuu

SEQ ID NO: 4098247 - RNA, 85 nt, Human
aaugaaaggcucuuuguauuauacugagagugcucagaagaucuuuauaauccuguguuaaucagauaaaggagagcuuagcauu

SEQ ID NO: 4098248 - RNA, 66 nt, Human
aaugaaggcaagacugagguguggaaagcauucaucugccucuucaccccagcuccugucaucauu

SEQ ID NO: 4098249 - RNA, 126 nt, Human
aaugaaugaaaggaggaaagucggccagagcucaaacagucgcaucucugcccuuagcaugccgguggugcugcuuugauuugggcuuugggggacuuccugaccguuuaguuuaguuuuugcauu

SEQ ID NO: 4098250 - RNA, 70 nt, Human
aaugacacugaaaucgaaaaauguaggacauuucuuuuaagguuauauacaagagauuucagcugucauu

SEQ ID NO: 4098251 - RNA, 110 nt, Human
aaugacauguaaguaucugcugugguugaaauagccugucuccagagucccaggggucugcuuugugauucucacucuagugcuugccauuaacuacagucuaugucauu

SEQ ID NO: 4098252 - RNA, 86 nt, Human
aauccuuacagaaccaaaugcugacagcaugacuugucaaacuacggacagaagucaucucagguagcauuuacugugaaaggauu

SEQ ID NO: 4098253 - RNA, 106 nt, Human
aaucgugaauaagaccugugaauuauguuacaucuaguaaacauuuaguuaauacuaguauuuguugauugauaugaagugcagguuaucucguuuuauugcgauu

SEQ ID NO: 4098254 - RNA, 73 nt, Human
aaucuaacacagugaccucuuuaaaaggggccaaagcaagacuccuauuuuguguggucaacugucuuaaguu

SEQ ID NO: 4098255 - RNA, 61 nt, Human
aaucuaugugcuggcccugaagagccaucgaacaucuuucccaaggcugguaccauagguu

SEQ ID NO: 4098256 - RNA, 65 nt, Human
aaucucaccuuaaacuguagcucucguaauucccacguguugugggagggacucggugggagauu

SEQ ID NO: 4098257 - RNA, 130 nt, Human
aaucucccuguugcacaugucugccacccuuggcugcuuagcagugugugcuuuugacaagcauuguaaggucacagcuggacacguuggcaugccucaagccuggcuuccagucauuugggaccauguu

SEQ ID NO: 4098258 - RNA, 68 nt, Human
aaucugaaaaccacuuauaucgugauuugaacaaggaauggucaaguuauaagggagguuugaggguu

SEQ ID NO: 4098259 - RNA, 66 nt, Human
aaucugcaauauaauucauauauucaucgguccccuguaugucuugugaauuguaguuaaaggauu

SEQ ID NO: 4098260 - RNA, 60 nt, Human
aaucugggcucagcccuggcuuugguggcaaaauauccuccccaggucuggggccagauu

SEQ ID NO: 4098261 - RNA, 78 nt, Human
aaucuggguugguuguguguaugggaaugucuuugucaauaggacacccagauuaugcacacaaaucaaguuuagauu

SEQ ID NO: 4098262 - RNA, 118 nt, Human
aaucuguacauggaugcuuauagcagcuugauucacaauuaccaagacuugggagcaaccaagauguccuuugguaggugaaugaguaaacagacugcaguauauccaggugaugauu

SEQ ID NO: 4098263 - RNA, 94 nt, Human
aaucuguggaauguccuucaagguccuuggugugucuaguguagaguuuggagucacaggcuugaggaccauggaggagauucuggcacagauu

SEQ ID NO: 4098264 - RNA, 80 nt, Human
aaucuuaaaauccauaauguugugggguuuguaaaaauugugucaaauuuaguuuaauauuaugugaaaauuuuaagauu

SEQ ID NO: 4098265 - RNA, 98 nt, Human
aaucuucaacuuguauuuccaguacccagaacagaggcuuguacuaagaaggcauucaauugguauguaauggauuagaauaaguugaauugaagauu

SEQ ID NO: 4098266 - RNA, 58 nt, Human
aaucuugagggacucaugaggugaccuauagaggcaaaaaacaggcuccuuccagauu

SEQ ID NO: 4098267 - RNA, 67 nt, Human
aaucuugaguguuacucucauuggacaaguuuagaucaugugguugauggaaagugauacaaagauu

SEQ ID NO: 4098268 - RNA, 77 nt, Human
aaucuuuuaauauauuugugauuaacuggcaacuauaauaaggaguugcagggaaauagaaauaaacagaaaagguu

SEQ ID NO: 4098269 - RNA, 70 nt, Human
aaugaaaauuuaaugaguguuuacucugugcuagguauuauacuaagcagguuacauacauuaucucauu

SEQ ID NO: 4098270 - RNA, 72 nt, Human
aaugaacuaaaauaugcauuaacuguguacauuuuaaaugugcauuaaaugucaauguuggaaagguucauu

SEQ ID NO: 4098271 - RNA, 79 nt, Human
aaugaaguugggcggaaaaguaaacacuaggggucaggaugcccuuccucuuuuaucuuuuucauuuuccccuuucguu

SEQ ID NO: 4098272 - RNA, 122 nt, Human
aaugaauaagcuaagcagaguugauaauugauggcuggcuauaucaggggaccccuucugcuggaaggaguuuguugaauagguuaaacauuacucucuuaauugugcuagcacaauucauu

SEQ ID NO: 4098273 - RNA, 77 nt, Human
aaugacagccacagugauuucauccuucugggcuucucuaacaagccacauuuggagaagauacuuuuuggaucauu

SEQ ID NO: 4098274 - RNA, 82 nt, Human
aaugaccccacugcaaacauaguacuugagcccagaccagccacaagauccugggauuaggcuuuguuuauagcaaguuauu

SEQ ID NO: 4098275 - RNA, 62 nt, Human
aaugaccccuaaaauuuacuguccucagcagcacaagcaugacaggaaauauggggguuguu

SEQ ID NO: 4098276 - RNA, 57 nt, Human
aaugaccuccagguaaaugcacaagaaaguccugaugccuuuaaaaaggaagucauu

SEQ ID NO: 4098277 - RNA, 72 nt, Human
aaugacgguuuuagcacgguaacacauaaagucauuuccuggcuuguguuuuacauguggcuuucuauuauu

SEQ ID NO: 4098278 - RNA, 112 nt, Human
aaugacuucuguauaagcaaagguaaauuaaaggucauguuaaagggguauuauugccuucagugcauguuuauaaucacacauuguuuauacguaggaaaacagaagcauu

SEQ ID NO: 4098279 - RNA, 56 nt, Human
aaugagcauggcuguguuccaauaaaauuuuauuuguggacacagaaagcugcauu

SEQ ID NO: 4098280 - RNA, 56 nt, Human
aaugagcuagaccugcuuccuccucuaccauuaaggagcucacagucuaggucauu

SEQ ID NO: 4098281 - RNA, 93 nt, Human
aaugagugauuucagaugccuuuuaaaagagaagguaaaaggagaauuggauugcacuuuauuauaaauuugagaggcacuuugacauuuauu

SEQ ID NO: 4098282 - RNA, 64 nt, Human
aaugauagcaccuuagaccagcaagauauuuuuuggaagucaucuugagucuaagauuaucauu

SEQ ID NO: 4098283 - RNA, 76 nt, Human
aaugaugaauaccucagcagguaaugauuugguauuuacuuuacucuuuuaaauuauucuugagguguuuauuguu

SEQ ID NO: 4098284 - RNA, 79 nt, Human
aaugaugauguuuaucuugguauucccuuacauaucuauacaugaagaaaggccuuaauacaaaggaaggcaucacauu

SEQ ID NO: 4098285 - RNA, 77 nt, Human
aaugaugucuugaguuuugaguuuugccagguucucuacuucuuugggguguggcagagugcagaagaggcauuauu

SEQ ID NO: 4098286 - RNA, 65 nt, Human
aaugauucaguauucacuguguuguuacaauccuagugacaguauuugcgauacugaugaugguu

SEQ ID NO: 4098287 - RNA, 64 nt, Human
aaugcaaaauuaccauucuguucugcuccugacagcaguguggaaaaugugauuucucuguauu

SEQ ID NO: 4098288 - RNA, 130 nt, Human
aaugcacaggaacgaaaaauuucauuugauauugcccuucuguuuacugcagaauguacgaaacauucuguggaauaugaacuagcaaaauaagggaaauaagggacuaaauuucuuuauucaugugugu

SEQ ID NO: 4098289 - RNA, 74 nt, Human
aaugcagaggaauuuuaauaugcuugucucuugaagaauugagucaguaugacuuauaguucucucuuuguguu

SEQ ID NO: 4098290 - RNA, 74 nt, Human
aaugcagccaagaacauuuguguaccaguuuuugaguuuucaguuguuugaguuucagauguuuucaguucauu

SEQ ID NO: 4098291 - RNA, 56 nt, Human
aaugcagcugcugacagcuuucacuaagugauaguggcuuuucuuccaggugcguu

SEQ ID NO: 4098292 - RNA, 60 nt, Human
aaugcaguuuucucacccccacaacuccagaugguugugaaagccuagaaaacaugcauu

SEQ ID NO: 4098293 - RNA, 63 nt, Human
aaugcauacaugugcacacaugguuaugugggucaccguagcuuugccacacauguagauauu

SEQ ID NO: 4098294 - RNA, 84 nt, Human
aaugcauauauagguagguguauauauaguaaacuguaugcuuauuucucuguauuuauauuugugugugcaucuguauguauu

SEQ ID NO: 4098295 - RNA, 129 nt, Human
aaugccacagacaaaagcagaauucaauugcagugcagacugaaaugaccuucuugcaaaagagagaagugauauucccaagucugacaagcaauuuugagugcacuaucuguuaauacugugaucauu

SEQ ID NO: 4098296 - RNA, 74 nt, Human
aaugccagaauugaguucuuuuagaauucaguguccuuguauugaauucuuuuagaauucaguguccuuguauu

SEQ ID NO: 4098297 - RNA, 90 nt, Human
aaugccugaacuguuauuaaauaauucucucuuuaccuacuuacaauauagaugaaggugcaggauuugaaauauuuaguaaaagguauu

SEQ ID NO: 4098298 - RNA, 59 nt, Human
aaugcuaggccuuucagcccaccaccuuaauaaauaguggcuuggaagccaccuguauu

SEQ ID NO: 4098299 - RNA, 64 nt, Human
aaugcuauucguuucugacuuggcuuuuucaacagcuaaauacagguggcaaaugaguagcauu

SEQ ID NO: 4098300 - RNA, 95 nt, Human
aaugcucauauggggaugucagauagaauuggccuagcacuaggugauagaccuuaugccaggccaauucuauuugacauccccguaugaguauu

SEQ ID NO: 4098301 - RNA, 67 nt, Human
aaugcucucugcuuuucuuccaacagaguuggcaagugauucugcaggagguacuguagcuggcguu

SEQ ID NO: 4098302 - RNA, 129 nt, Human
aaugcugaaugcaccucgguuguaacaggguuggagaugccaguguuauaaauagauauuuuauguaaguguagugugacauagguguccaccaauauucaacuuuagucaaauaugcaaagaaacguu

SEQ ID NO: 4098303 - RNA, 79 nt, Human
aaugcuuucuucagaauuagagcucuucuugagguggcgaauucacucaagguaugcauuaauacucuagaaacacauu

SEQ ID NO: 4098304 - RNA, 61 nt, Human
aauggaucuuuguaagacuucaucgccuugacaggaagugagguccuaauagacaucgauu

SEQ ID NO: 4098305 - RNA, 73 nt, Human
aauggcaaacagcuagaauucuacuggcugaaauacuuuuuagcuuaagguuucaguuuuuguuguuguuguu

SEQ ID NO: 4098306 - RNA, 70 nt, Human
aauggcagaacacaaacuggacuggugagaacaagguaggaacugagaucugagguuauugucugccauu

SEQ ID NO: 4098307 - RNA, 61 nt, Human
aauggcgaagaagguuauaauuguuuuaccaagacaguuacucaauaauucuugcgcuauu

SEQ ID NO: 4098308 - RNA, 68 nt, Human
aauggcuacauaguagaccuuugcuuaaagguaacaugcuuuaaggcauucuccuacuaauaggcauu

SEQ ID NO: 4098309 - RNA, 64 nt, Human
aauggcugggaguguauuuuggguaauuuucauauaaugcaccaaaaccagcuccccaguaauu

SEQ ID NO: 4098310 - RNA, 71 nt, Human
aaugguaagcugaagccacgaguuggaacggaauacaggccgcucuagggugaugauucaggaugacuauu

SEQ ID NO: 4098311 - RNA, 58 nt, Human
aaugguguucucuguuaggaacaauaucagauucuguuucugcuaagaaaacauuauu

SEQ ID NO: 4098312 - RNA, 97 nt, Human
aauguaaaauuggugcaauauuuauggagggcaacuuuucaguagguaccaaaacccuuaaaaauauguccuccuugugaucaaguuauuuuacauu

SEQ ID NO: 4098313 - RNA, 101 nt, Human
aauguaaauuauguccucugaaguugugcaaugccugaguccuaggugugggcaaaagcauuugagcacauuuuaaagagaaauaauuccucaucugcauu

SEQ ID NO: 4098314 - RNA, 99 nt, Human
aauguaagagguaauccuacucauuguucuugguauauagucagcuuauagcugugcugugucuaucaggaauaauaauaaauaauuaucuacuauguu

SEQ ID NO: 4098315 - RNA, 78 nt, Human
aauguaggggucuaucuuauuuuaugccauaaaaccagaaauguuacacaaaaauaagauauggcugcuuuuagcauu

SEQ ID NO: 4098316 - RNA, 111 nt, Human
aauguaguaauugcacaaaaauucaaaaucagagucugauuuuaagguuucugugaaccugagccauuggguuugguuuuucuguuuuugagcccguuaagucacugcauu

SEQ ID NO: 4098317 - RNA, 93 nt, Human
aauguaguauaauuguuaguaaaugcaguacaaauuguucuacuguuuuaaaaaguuuuccgcagaacagugcauuuauggcaaugcuauguu

SEQ ID NO: 4098318 - RNA, 91 nt, Human
aauacauucauuucucugccaacagcuauugguccacagguaugucauaugacccaaacuggcccaaucagccagaaggaaagaacuuauu

SEQ ID NO: 4098319 - RNA, 96 nt, Human
aauaccaagaugguuucacugacgucuagcccagcucaaaugaccgguuuucuuaggccucauuguugcuggcgacugcuggugccucuugguguu

SEQ ID NO: 4098320 - RNA, 77 nt, Human
aauaccaugaauaagaauugccagauuugaaaugcuuuguuaagcuuuuuuuaggcaugcaguucuauuuaaguauu

SEQ ID NO: 4098321 - RNA, 86 nt, Human
aauacgaauuaugaaacugggcuuuuugaaacaguaccaagagcaagaugcuucuuuucagaaagcaucaucaaaguuugcauauu

SEQ ID NO: 4098322 - RNA, 58 nt, Human
aauacgucccaucaucuuuuucacuaacaggugaaggguauucuagaugagauguguu

SEQ ID NO: 4098323 - RNA, 64 nt, Human
aauacuuaugugaccucauuuugugcccugaggccccgggacauucagguuacauaacuguguu

SEQ ID NO: 4098324 - RNA, 129 nt, Human
aauacuuuaccaucuuaaugagaaaguaaggaaugaggagauuguuuucuaaagcuuuacuuagaucauuuuaugaagauaauuuucugauauuuuucucuuccucuuauauuuaaauauuaggguauu

SEQ ID NO: 4098325 - RNA, 96 nt, Human
aauagaggagauuuguaugucuaaauguaaggagauuaucccccagaaaggagggggaguuggcuuuuauuugaguuuuacaaagucucucauguu

SEQ ID NO: 4098326 - RNA, 84 nt, Human
aauagagugauuuuuauuguuaaugcacacucauauaugaauauacauuauagagcuuuggcauugauuauuuugucagcuauu

SEQ ID NO: 4098327 - RNA, 57 nt, Human
aauagaugguauuuagacuagcgcuacucaaaguauagugcugguauauuaacuguu

SEQ ID NO: 4098328 - RNA, 62 nt, Human
aauagcaaacacugguaaaguuuucaagagcucauuccuugggauuuaauaaguuugcuguu

SEQ ID NO: 4098329 - RNA, 72 nt, Human
aauagcugaugggaaagaagccacugcccaaugcucucugaaagugacucccuuucaccaguuagggcuguu

SEQ ID NO: 4098330 - RNA, 129 nt, Human
aauagcuucauaucauucccacauguagacacaugccuagaucuauuagcaaacugccauuuuaguccuccugaaauucauaugguuuugagauagcuuccuggaguguuuuauugaaagaggaguauu

SEQ ID NO: 4098331 - RNA, 79 nt, Human
aauaggcaguuuuggaagggagaaguuaagugaaguaauauaauuacuagcuaacauucucaccaaucacaugccuauu

SEQ ID NO: 4098332 - RNA, 80 nt, Human
aauaggguuugucauggaaacagcaaugcuaaugggacaguaucccaaguagccuuaugguuuuccagacacguccuauu

SEQ ID NO: 4098333 - RNA, 85 nt, Human
aauagguguguggugagaucucacuuauuuugaugugcauuuuucuaaugacauaugauauugaggaucucauccuaugcuuauu

SEQ ID NO: 4098334 - RNA, 89 nt, Human
aauaguaacuaggaaaggaauacuuucuagauggauuauuuaacuauuugggcuaauuccuagaaauuauucucagacaaguuacuuuu

SEQ ID NO: 4098335 - RNA, 126 nt, Human
aauagucugccccauuugugaauuuucugaaucucugucuguccugcuuccuuggacuccucagcaccuccagaagccuagggaagagguggaagugaauucagcccguauuuauaacguacuguu

SEQ ID NO: 4098336 - RNA, 57 nt, Human
aauagugaacaggaacaugcuuacauccauugugucgcagagcaccuuuucauuguu

SEQ ID NO: 4098337 - RNA, 63 nt, Human
aauauaaagggguguauguguguguguuagcuacuaugaaucaacacaagcacuucugguauu

SEQ ID NO: 4098338 - RNA, 75 nt, Human
aauauaagaugucagaagcuucagugacaaauauaauaaaugugcugaaguccaucuguuugacuauccaauauu

SEQ ID NO: 4098339 - RNA, 81 nt, Human
aauauaaucauagaauaagccccuuuuuuuaguguuuagucuucugaagaauuuccuagggacuuguguccuauguauguu

SEQ ID NO: 4098340 - RNA, 71 nt, Human
aauauaguucugguauuguuaaccuuaaauuccuucuggcaguaauuagauagcaaagccagauguauauu

SEQ ID NO: 4098341 - RNA, 85 nt, Human
aauauauacuaugauuaauuuuaugugucaacuugacugggccacacgaugcccagacauuuggccaaacauuguucugguuguu

SEQ ID NO: 4098342 - RNA, 121 nt, Human
aauauauauuuuagcaauuuggauauucaugucagcuggagacugcucaaugagauaacaacuaauauuuauuguguacuuccucugugcugggcaucauacuaagugcuuuauguguauu

SEQ ID NO: 4098343 - RNA, 129 nt, Human
aauauauuaacaaaugucaccggcaggugagaagcaucuuuguuguuuguugcagacaagauauuuaguacgacucuugcuguuacagaauuaacagucuuccucccugcuaauucccccauauauguu

SEQ ID NO: 4098344 - RNA, 118 nt, Human
aauauauuauuggucuugcaucucagauaucaaauaaagguaccuagcuugacacaaaaguugguagcugcaagguuaagcuguauuaguuugaugaugggccaggaaaugauauauu

SEQ ID NO: 4098345 - RNA, 130 nt, Human
aauaucacuguguuuacaucuccaguuaaagucuauuacauccacuuuuauugcaugcaugcuacuggaugcgauggccagagaguggaagucggauuuguaugaaggagaaggaacaauaucugguaau

SEQ ID NO: 4098346 - RNA, 95 nt, Human
aauaucuagaaauuaggccuacaucauaaacuggguauuuagggaacuucccuguuccacacuuugagaugacuaggaaaccccuuucugauauu

SEQ ID NO: 4098347 - RNA, 104 nt, Human
aauaucuauacaccugauauguuuuaggaauuaauuguuaccaauguuaaguuaaauacagugucuuggaauuugguuuuaagagcaucagguuaaaggauguu

SEQ ID NO: 4098348 - RNA, 68 nt, Human
aauauggcaaacaugugcucauuuuguguugcugagcaaucaccggcgaggaauauguuugcuguguu

SEQ ID NO: 4098349 - RNA, 81 nt, Human
aauauguggaucugggcuggagacugagaauuugcaguucuagcaaguuccuaguugaugcuucuucaaagaccacauguu

SEQ ID NO: 4098350 - RNA, 78 nt, Human
aauauguggguuucaguuucauggcacagcuaucuucagcuaaauauagcugugccaugaaacugaaucccauguauu

SEQ ID NO: 4098351 - RNA, 67 nt, Human
aauauguugggugaggaauaguuuauagaagggcacaguuuaaauuucacuuccuccucaccauguu

SEQ ID NO: 4098352 - RNA, 84 nt, Human
aauauguuuuguaucuguuuguuuuuauguguuucuguuguugcaagaaacaucauuggaacacaaguggguaauuguuguauu

SEQ ID NO: 4098353 - RNA, 60 nt, Human
aauauugaggguuuuuaagaauguaaauggggacaacccacacuggaaggcuucaauauu

SEQ ID NO: 4098354 - RNA, 75 nt, Human
aauauugaggugguuuugcuuuaugagugaaguguaagaucacuucucuacuuaggagaacuuuacuacaauauu

SEQ ID NO: 4098355 - RNA, 88 nt, Human
aauauugcaaggaagaaagacauuuauuuugaggcucaugcuuugaaacugcuuauugaauuugucuuuccuuuucucccuagauauu

SEQ ID NO: 4098356 - RNA, 105 nt, Human
aaucaagauuaauuuuaggucauauguggucccaaggcaacuggaagacagaaacuucuguguauguuucagcugcuuuggcaggacuaggauggucccuugauu

SEQ ID NO: 4098357 - RNA, 58 nt, Human
aaucaauaaaugcaaucaauuuuuaugggccauuggugaaggugagcauuugcugauu

SEQ ID NO: 4098358 - RNA, 55 nt, Human
aaucacagccacaaccugggggagaagaaucaaauccuccacagggauugugauu

SEQ ID NO: 4098359 - RNA, 58 nt, Human
aaucagauuuaaacauguacaagagccucguuucacuuugauacauguguaucugauu

SEQ ID NO: 4098360 - RNA, 130 nt, Human
aaucagauuuaucugucaugaucucagauguuugugugucacugaaagaaaucuguguaacuugauugaauccuaaucuauucagggagagguuucuagggacaugcaaaguuuaugauagaaaauacgu

SEQ ID NO: 4098361 - RNA, 75 nt, Human
aaucaggacauguuccuuuucaucuuugccucccauaauuuucuuugguagaggucuuaucaaacaugcuugauu

SEQ ID NO: 4098362 - RNA, 78 nt, Human
aaucagggucuucaaaucaggcuuugaaguauauuucaggaaacucaucuuucaaaugcuugaauuggaaauuugauu

SEQ ID NO: 4098363 - RNA, 107 nt, Human
aauccaaacacaaaggcuuuagugcucauccagauggggguuucagauguuaucaaguuaaucuggucucucuguucccugggugacauuuucucacguguuggguu

SEQ ID NO: 4098364 - RNA, 65 nt, Human
aauccagaaggaaaauauuguuugauucaauugucacaauauagaaucacuuuccuucauggguu

SEQ ID NO: 4098365 - RNA, 85 nt, Human
aauccaugugaaguguguucuugagucacuccugaguuugcagucugaaccagaagucacccucagaauaacuccuucauggauu

SEQ ID NO: 4098366 - RNA, 61 nt, Human
aauccauuaaaaacaagcgcaugcaaaucgucauuuacugcagugacugggagaauggauu

SEQ ID NO: 4098367 - RNA, 100 nt, Human
aaucccuaugcacaugaguuugcauuugguucugccugguaccccaaggaauuuaccaguugguaccaguuuuucaacucauuuuguuggcuuaaggauu

SEQ ID NO: 4098368 - RNA, 77 nt, Human
aauccuaaacaguaaguucuaguauuaucugcauuuuauauaugaugaaaaugagccuuaggaacuuacccaggauu

SEQ ID NO: 4098369 - RNA, 56 nt, Human
aauccuggcugcguuggccagcacccccuucugugcucauccuugcugcuaggguu

SEQ ID NO: 4098370 - RNA, 66 nt, Human
aauccuucagcaaccagaaaggcugggucacuuggccagggcuucaguuaguggugagcugggauu

SEQ ID NO: 4098371 - RNA, 68 nt, Human
aauccuuuuaaaacauaaacugacagcccaugggccaagcccaacugcuguuauguuuuguuuggauu

SEQ ID NO: 4098372 - RNA, 81 nt, Human
aaucuacugaacagcguggcugcagucauuuacacaccaggaagaaauagagucccugagccacugcuuguucaguguguu

SEQ ID NO: 4098373 - RNA, 110 nt, Human
aaugacucuaagaaggcaagagaugagacuguaugauuugaguuuauugugcuauuuaccuguugaccacauuaugcaguaauaccuguuugcuuucuaaagagguuguu

SEQ ID NO: 4098374 - RNA, 97 nt, Human
aaugacuuguucugcaaagacccagaggugucuagcaagcuuaguuaaggacaagccacccuccuuggacauuugugauuauugagaacauuucauu

SEQ ID NO: 4098375 - RNA, 129 nt, Human
aaugagaagccugcgaugacuacacccuuuuucugguccagucuuucccuucuagacauuggugaaaugccuaucuagccaaaggaagacuagccagaauaggggaaaucacaucugguuuuacucauu

SEQ ID NO: 4098376 - RNA, 90 nt, Human
aaugagccugaaugggcaagggguaaggacacuuauuuuccuuuggcugaauugaagguucuuccuccccaugucccagaaugguucauu

SEQ ID NO: 4098377 - RNA, 100 nt, Human
aaugagcuggguuggaauugcagcugggacauuuuugauacugugaucuuagauacauucaucugucagacuccagcugauuccaaacuccuuguucauu

SEQ ID NO: 4098378 - RNA, 56 nt, Human
aaugaggccaguagaaggaaguggauuccccacugcaacuugcugagggccucauu

SEQ ID NO: 4098379 - RNA, 58 nt, Human
aaugagggaguggggcuuguccguauuuacguugaggcgggagccgccgcccuucauu

SEQ ID NO: 4098380 - RNA, 129 nt, Human
aaugagguuagaaacguggucuagaauaagaucaucuagggccuuggaggccaugaugaggauguggauuuuaugcuaaauugaaaggcccuggaugguuuugagaagggacaugaucuaguuugcauu

SEQ ID NO: 4098381 - RNA, 92 nt, Human
aaugauaaucuuuaauuauagaaugaggacauagcuuuuuguuucauuuauuuaaaaggcuguguccucauuuuauaucaugauuugccauu

SEQ ID NO: 4098382 - RNA, 102 nt, Human
aaugauaauucacagaagauguuuggucucuaaaagauuuggauacccagcacugaaguagggaaucuuccuuuuuuguaagcugacguuuuuguuaucauu

SEQ ID NO: 4098383 - RNA, 65 nt, Human
aaugauacagugauuauuaguuggugguguggaaauacuaaaugcugcauaaaugcuugauuauu

SEQ ID NO: 4098384 - RNA, 56 nt, Human
aaugaugaguucuaauagacccugcuuuugccucuggauaguggaacucuaucauu

SEQ ID NO: 4098385 - RNA, 100 nt, Human
aaugauugugucuuagaaccuaaugaaaguuugcauuccucaguaaaaucagagacugcugauugacuuaaauguuuauagcuucaaaguccuccucauu

SEQ ID NO: 4098386 - RNA, 74 nt, Human
acaauucuuccaauguggcccagggaagccaaaagauucgacaccccugcuguaaagcuucauggaaggguugu

SEQ ID NO: 4098387 - RNA, 74 nt, Human
acaauugaggcaccaguaagaguagaacuagcuaucuuuggaguucuccuguuuuggugauuccaucugauugu

SEQ ID NO: 4098388 - RNA, 74 nt, Human
acaauugaggggguuaauuaggagaguagcuggaugggauuugcacuuuaaaaagagccuucuaaccaaauugu

SEQ ID NO: 4098389 - RNA, 60 nt, Human
acaauugcaauagagaaaagaguccagugugaacugaacucauccuugauuugcagaugu

SEQ ID NO: 4098390 - RNA, 76 nt, Human
acaauugcuuuuauuuagggccagguaccacuacauugaccuguguuaauacuggcccuagagagaagucuauugu

SEQ ID NO: 4098391 - RNA, 83 nt, Human
acaauuucacagcucaguuugauguuuuggcagauguuaugggagcauucugcaagaucauuaaagcagagcuguggcagagu

SEQ ID NO: 4098392 - RNA, 98 nt, Human
acaauuugagcaguuguauaugcuaugaaaagaguauagccacuggauaaguguuguacuuacauuuuaaagcuaaccaaaguuaggcucuugauugu

SEQ ID NO: 4098393 - RNA, 129 nt, Human
acaauuuuugaugaaaucaaccgguggguuuagucuagcaccuggucaauucagucaaaaaugucaaaaacccugugaccgaauugacagguguuagacugacugacuggucaauuccaucaaagcagu

SEQ ID NO: 4098394 - RNA, 65 nt, Human
acacaaggcuuccaagagcguccugagcuguuuuacagcaagauugcuaaugaaguucuugaugu

SEQ ID NO: 4098395 - RNA, 77 nt, Human
acacacaaguaucugcaugauuuugagaaacuaaaacucuuuaaguucucuuuuugcaucaggucuuaaaugugugu

SEQ ID NO: 4098396 - RNA, 58 nt, Human
acacacauauauacauauuugugcauguauauuugcauguuuguguauauguguaugu

SEQ ID NO: 4098397 - RNA, 72 nt, Human
acacagaggaugugucuggucugggcaccuaggcuguggagggugccaggaggggacaccuccucuuugugu

SEQ ID NO: 4098398 - RNA, 60 nt, Human
acacagccaggguaguaaggcuagaccuaaccccugcccaacugacaccacugcuugugu

SEQ ID NO: 4098399 - RNA, 64 nt, Human
acacagccagugacugcagacccuggccaugcagcucuagggucuguguucuuggccacugugu

SEQ ID NO: 4098400 - RNA, 87 nt, Human
acacagccuuugcuucuuccuggggacacugucuugacccuugagcuggaaagaagaggcuggucccagggagggaaugggccaugu

SEQ ID NO: 4098401 - RNA, 59 nt, Human
acacaggacagggauguguuuuccaguuugccacagucccugccacucccuguccuugu

SEQ ID NO: 4098402 - RNA, 72 nt, Human
acacaggcagacaccuuuaugucuaauaucucaacuguagagguuagauaaucacagagugcuauacugugu

SEQ ID NO: 4098403 - RNA, 93 nt, Human
acacagggaggcaguagcuguggugacagcugugaucugaaccagggcuugguugaguacucuucucacuacaccagacugcacuuccugugu

SEQ ID NO: 4098404 - RNA, 87 nt, Human
acacaguaaguacugaauaucuacuguuauuauuaauaguaagaguauuuguauuaauagaagcaguaacagcaauauuugcagugu

SEQ ID NO: 4098405 - RNA, 61 nt, Human
acacaguggugagucuggaccuguaaaacaucaugacaugacuucacucuugccauugugu

SEQ ID NO: 4098406 - RNA, 81 nt, Human
acacauaaucacccaaaguccauaguuugcauuacaguucaccccugguguuguacauucuauggguuuggacaaaugugu

SEQ ID NO: 4098407 - RNA, 129 nt, Human
acacauacacagugcuaaugcauaugcccgcccugaauuuucuccucaugacugguuguggcacaacuuuaaacccagcagagcauggggaggaagcuggaguuuguauuuucaguuuuguucaacucu

SEQ ID NO: 4098408 - RNA, 69 nt, Human
acacauaggacaugcuacauaaauaggugugugcauguacacguguguguguguguguguuuaauuggu

SEQ ID NO: 4098409 - RNA, 74 nt, Human
acacauauacguacauguauuugcauauaugugucuaugcauauuuguauguguguacauauauauguaugugu

SEQ ID NO: 4098410 - RNA, 72 nt, Human
acacaugaaagguagcuggccucauagccacuggguagcccauccuugagagccuggccaccuucagugugu

SEQ ID NO: 4098411 - RNA, 76 nt, Human
acacauucuugaguugauguuuuaaaaaugcauguauucagauggaaaauagcaaagaugucaauucccccugugu

SEQ ID NO: 4098412 - RNA, 75 nt, Human
acacauuguaguaaauuaaaauauugacuuuccaccuggauagauuacaggaaguucuuuugguuuauucugugu

SEQ ID NO: 4098413 - RNA, 79 nt, Human
acaccagaaucaguuucuucaauucagacacugucuuuucuguugcgaguguuuaaacugaagugaugaauccuggugu

SEQ ID NO: 4098414 - RNA, 67 nt, Human
acaccaguccugaccucaugcuggcagagagagaucucuacucugaagccuuuguacaggccugggu

SEQ ID NO: 4098415 - RNA, 86 nt, Human
acaccauuuauuaaauaggguauccuuucccauugcuuguuuuugucagguuugucaaagaucagaugcuuuuagauguguggugu

SEQ ID NO: 4098416 - RNA, 103 nt, Human
acacccagccuggguucugcaccucaccuccaaguccgagggcucucaaggugaguguuuugcuucucucagacuuggggggucugaggacaaggcugugugu

SEQ ID NO: 4098417 - RNA, 88 nt, Human
acacccaugagagcagagcagagggugcagcugggccccacggacccugugggugcucagaguacccccaggaagugcacgugggugu

SEQ ID NO: 4098418 - RNA, 73 nt, Human
acaccgagcauccuuuuuuccugcccugcggcugcuccaggcugagagcagacucucaaagcugguuuggugu

SEQ ID NO: 4098419 - RNA, 102 nt, Human
acaccuaagguacugacagcuuguauaauguacuuguauuugguugaauuguguccaccaaaaagauauguugaagcccucacacccaguaccucagaaugu

SEQ ID NO: 4098420 - RNA, 79 nt, Human
acaccugaagaaaauucuguuuuuguuugcuugcuugauguggcucuaucuugugcugacaaaacacauucuuuggugu

SEQ ID NO: 4098421 - RNA, 77 nt, Human
acacuaaaagggguagguaagacaagaugcaucuauuaggccaagccuaagagcucuuugauuugcuucucuugugu

SEQ ID NO: 4098422 - RNA, 61 nt, Human
acacuacacacucugcuuugcuuguucuauaauacuggugaguuuugagaguggguagugu

SEQ ID NO: 4098423 - RNA, 89 nt, Human
acacuaggguuugggcacagucaaacuuauaggcacauuugaaaaauaaguaaaguuuuuguaaguugauucuacucuuccuuuaaugu

SEQ ID NO: 4098424 - RNA, 70 nt, Human
acacucuuucacuaccuuaauuccagagaaaagccucauaggcuuccguauuguagguaugcaggagugu

SEQ ID NO: 4098425 - RNA, 64 nt, Human
acacugacuuuuaggcuguaauuagcaaguuggcucgugucucucuaaggccaaaaguaagugu

SEQ ID NO: 4098426 - RNA, 98 nt, Human
acacugaggaaugucauaggaagcaauucuaugaagcuuauuucuguguuuacugcagggauguugucaaggaugugguugaugacauuccacagugu

SEQ ID NO: 4098427 - RNA, 113 nt, Human
acacugauaguuuuuaucuagagacccuuucagacccuuuaguaugcauuugcauaugaguauacauaaagcacugaauaguuaugucuuuaggagucuguuuauuuaagugu

SEQ ID NO: 4098428 - RNA, 75 nt, Human
acacugauguuggcccuggucauauggaaggugauuggucauaacaugacaugucugaccagaggccuucggugu

SEQ ID NO: 4098429 - RNA, 64 nt, Human
acacuggggaaggagagagugaagacccuccaguugguuccucagucagcuccguucuuggugu

SEQ ID NO: 4098430 - RNA, 83 nt, Human
aauuauacagugcucuuuuuucucccacaaguauuaauaacaaggaaaauacugauacggaagaaaaaaguggcugugcuguu

SEQ ID NO: 4098431 - RNA, 68 nt, Human
aauuauacaugaaggcauuauauguauggacauuauuaagucauacuugcuuugcuuccauuguaauu

SEQ ID NO: 4098432 - RNA, 73 nt, Human
aauuauacuaaacuguucaucagcaucucugcccuaccucagagggaggauaguagucaguuuaguuauaauu

SEQ ID NO: 4098433 - RNA, 66 nt, Human
aauuauagguaagagcacugucuccugcugaugguuuacaucagagguacccgcccuuacagaauu

SEQ ID NO: 4098434 - RNA, 104 nt, Human
aauuauccauguuagcacauuuggaacaaauguauaaauguacuuucugaauaaagucaaaagucuaacuuguuuuuaguuccauaauguuuuaauguuuaauu

SEQ ID NO: 4098435 - RNA, 97 nt, Human
aauuauggagggacaccauuuagucuguaacaguacaguuacauaaguagauccauuugccaauauuguacgguuaagauuuguauuuuccaugauu

SEQ ID NO: 4098436 - RNA, 61 nt, Human
aauuauuggcagaauuaaccacugaagccaucucaguguuggcuuuucuuugcgaguaguu

SEQ ID NO: 4098437 - RNA, 77 nt, Human
aauuauuuguguccacagaauacccuuguuuuugaucuugaagcucuaaguaauguauugcugcuggacauguaauu

SEQ ID NO: 4098438 - RNA, 65 nt, Human
aauuccaagcacuguuaauuaaacuuggcuaauauguuaagcgaaauuauuucagguuugguuuu

SEQ ID NO: 4098439 - RNA, 84 nt, Human
aauucccacuuagaacuacaagcauuaaaagucacaguaucuaagacaagugagcuuuuagcuccugguugcaauaggggaauu

SEQ ID NO: 4098440 - RNA, 118 nt, Human
aauucccuauccaucuuccuacacacuuucauagccuuugucgucugagggaaaaagaaagguuuucaucaugccaguuaaaggcugugaaugugaccuagauaauucuuggggaauu

SEQ ID NO: 4098441 - RNA, 96 nt, Human
aauucccucagcuauggguguccaucucuguaugcugcucauauuauuagaggcugcauuucacaagauguaaucaucguguagcauauuggaauu

SEQ ID NO: 4098442 - RNA, 89 nt, Human
aauucccuuuugagaaauuauuuucuguagaccagaaggaaucaaagaugagcccugggauacaguaaaagcuguuacaaaacggaguu

SEQ ID NO: 4098443 - RNA, 76 nt, Human
aauuccugugacaagucugaacauucugguuguaauuucagaggccucuguuguucagacguguuaagaaugaguu

SEQ ID NO: 4098444 - RNA, 69 nt, Human
aauucuagcccaggcaaaacuaguauauacugugagaaagcaaaucuguguuugccuagggccaggguu

SEQ ID NO: 4098445 - RNA, 86 nt, Human
aauucucauuuuuaaugguguguucaugguguaauugauguguuauugcauugguacuccacacgcuauuauaauguuuuaggauu

SEQ ID NO: 4098446 - RNA, 62 nt, Human
aauucugcaucuucagcugagaacgaacaaaaucuugaucagaacagugaggaugaaggguu

SEQ ID NO: 4098447 - RNA, 75 nt, Human
aauugaaaauauaguuuuccagacugaaggaaacaaagccucaggauuggauaucagauuugaguauuuucaguu

SEQ ID NO: 4098448 - RNA, 65 nt, Human
aauugaguaaauauaccuagaagugugacugcuggaucauaugguaagaguauauuuacuuuuuu

SEQ ID NO: 4098449 - RNA, 56 nt, Human
aauugaucacuguuuuuccagucuacacugaggcaggcaucaucaguugaucaguu

SEQ ID NO: 4098450 - RNA, 95 nt, Human
aauugauuugcaauguugaaccagcuuuguauaccugaaauaaaucccacuugguugugguguauaaugcuguuuguacauuguuggauucaauu

SEQ ID NO: 4098451 - RNA, 72 nt, Human
aauugcaauggccucccaagcagggggaaagaccaacauuugccuccuugacucucuugugaggccucaguu

SEQ ID NO: 4098452 - RNA, 127 nt, Human
aauugcuagauaagugacuacuuagguacucuaauuuggaauggucuggcauuuggaacuguaucacaguauagaaaguuuuaaauugguagcucucagucuuauucaucuuucugucuaguuaauu

SEQ ID NO: 4098453 - RNA, 97 nt, Human
aauugcuucucguaaauauguuccacuuaaagcuggcauucuccuuucaucccugugacuguggguuugauugcaacaugucuugaugaagccaauu

SEQ ID NO: 4098454 - RNA, 108 nt, Human
aauuggauuuagaagucuauggaaauuauuaggaagauggguuuuaagugaccaguuuuuuauacaucuucuuugacagugauuugugcauaagcuucugaaguaguu

SEQ ID NO: 4098455 - RNA, 77 nt, Human
aauugggacguuuaucuuuauuagugaaucaaagugggacucaguuaaugguaagggugaaagagauugucuuaauu

SEQ ID NO: 4098456 - RNA, 128 nt, Human
aauugugcaggaggcauguaucuuaaauaaagaauaaaagggcaaauggaauacaaaauuuggaacaaagaauuugauucccugcaccuguuuuucagaaagguuuuaauauguaaacauaaacaauu

SEQ ID NO: 4098457 - RNA, 56 nt, Human
acacaaacugcuagaaaauuggaaauucccuucgguguucaugugcguguuugugu

SEQ ID NO: 4098458 - RNA, 76 nt, Human
acacaaaucuaguggucuaacuucauuuaaccaggaaagaaucagccuggagauguaaagcaaggcuuaagagugu

SEQ ID NO: 4098459 - RNA, 63 nt, Human
acacaagagagugcgcguugcaaagugcgguggagcauuuguguguguguguuuucugggugu

SEQ ID NO: 4098460 - RNA, 65 nt, Human
acacaaugcagcauguaaaugcaucuacuuaaaguguaugugugugugugugugugugugugugu

SEQ ID NO: 4098461 - RNA, 56 nt, Human
acacacaaaucuauuagugaauaauaaaaacuguuugucacugagguuaugugugu

SEQ ID NO: 4098462 - RNA, 60 nt, Human
acacacagguaaaggagccuggaaguauuucaugaauuuuuaggccccaccuccuguugu

SEQ ID NO: 4098463 - RNA, 89 nt, Human
acacacuauauguaucugcaucugcauguguauuguuuaugcuugucuguauacucauguaugcauagugaguaaaugugugugugugu

SEQ ID NO: 4098464 - RNA, 63 nt, Human
acacacuggcaggagcuauaaaauccagcuaugggguuugucauguuuccuccucaguguugu

SEQ ID NO: 4098465 - RNA, 102 nt, Human
acacagauauuuaugaguugaaagggaacuuuucauuguuuguacaugcauguguacaugucuucgcuacaaugaaaaggauuccuuccaauucaccugugu

SEQ ID NO: 4098466 - RNA, 64 nt, Human
acacagcaagaccccuagcaugguggcacaaaccuguaguaccagcuacucgguuggcuguugu

SEQ ID NO: 4098467 - RNA, 61 nt, Human
acacagcuccugggccaucacaaccaucucuagggaguggccagaguccagugagccuugu

SEQ ID NO: 4098468 - RNA, 76 nt, Human
acacaggaauuagaagaacaugucaaacuauaaacugcuugugauugugaauggcuuuguucuuugcuucuugugu

SEQ ID NO: 4098469 - RNA, 68 nt, Human
acacaggacacagauucugaagucuagcugcuggcucagcucuagccucugacucugauuagcugugu

SEQ ID NO: 4098470 - RNA, 57 nt, Human
acacaggggaaaguggagcugagagaucaaccaguuacccaagccaaccccugaugu

SEQ ID NO: 4098471 - RNA, 62 nt, Human
acacagggucuagaguuaggccaaaguucaaaucucaguccugccucuuaguaucuaugugu

SEQ ID NO: 4098472 - RNA, 71 nt, Human
acacaguggcugagaguggacacuggaguuugacugccuguguuugaucccaacucugcuauuugcugugu

SEQ ID NO: 4098473 - RNA, 60 nt, Human
acacagugguguuuacaaaauucaagugccuuugcaaaggauuuuagaucaucaccgugu

SEQ ID NO: 4098474 - RNA, 98 nt, Human
acacauauauauauaggagauguauuugaaauuugagacaugagauggaugaauaagcagguaaacagacagauacauacuaguuagauauuaagugu

SEQ ID NO: 4098475 - RNA, 67 nt, Human
acacaucagguagaccuacagaggcaccauaauucauuguugauuucaugagauuaucugcaugugu

SEQ ID NO: 4098476 - RNA, 89 nt, Human
acacaucugugcuuucaccaacaaugaagcuccacugagcuuuggccuagaguuuuuacugggguuucauuauauaggcauaauugagu

SEQ ID NO: 4098477 - RNA, 69 nt, Human
acacaugcucauuggcacuguuccugguacagagcugugcccaguuggaggggccauuuugagcagugu

SEQ ID NO: 4098478 - RNA, 66 nt, Human
acacauguauguuuuguauuugcuaugcuguggaggcuaaaaccaaaaucaaaacauuagaugugu

SEQ ID NO: 4098479 - RNA, 65 nt, Human
acaccagcugcagaucauguuuacagcucagcugaaacaaaacaucagaucugccugcugccugu

SEQ ID NO: 4098480 - RNA, 77 nt, Human
acaccaguguuggccuucuguacucuggcugcagacugaccuugcucaggugagacuuuagaagagccagccugggu

SEQ ID NO: 4098481 - RNA, 72 nt, Human
acaccauccugcuccugcuauucuucugguaagagcacugccagaauaaaaugcaugagcaucagacggugu

SEQ ID NO: 4098482 - RNA, 76 nt, Human
acacccagggacagaugggcagcuaacccagguacugugucuucugcgucuggcuuuauaccuuugccuuggaugu

SEQ ID NO: 4098483 - RNA, 59 nt, Human
acaccgucaaggcuacugagugcccuguguagguucagggcuguggcuuugugcugugu

SEQ ID NO: 4098484 - RNA, 78 nt, Human
acaccucucagagccucagcuuccccaugugagaaauggguuuaauguuucauguuggggaguugagugagucaaugu

SEQ ID NO: 4098485 - RNA, 74 nt, Human
acaccuuucccacucuagagcccucucccuaacucagggccaauuugggacaugggcucaguggaaaagagugu

SEQ ID NO: 4098486 - RNA, 83 nt, Human
acacgaugaaacagcacaauuuucaggaguccacaauuccagcgaggcgcguggaugggaaauugucacguugugaauugugu

SEQ ID NO: 4098487 - RNA, 57 nt, Human
acacuccauuucccagcugcucuuauugccagguguagacacaggggaaugugaggu

SEQ ID NO: 4098488 - RNA, 71 nt, Human
acacucccuggcacagcgagagguugaauccuccucaggcgcagccucagggcucugcgcagacucagugu

SEQ ID NO: 4098489 - RNA, 118 nt, Human
acacugaaaauaacaacucaggucucauaaagaaggaaaucauaauuuugugaauguagucauucugauuugauaugcaaaauuauggacccuaagaccuuuaguuguuguuucaugu

SEQ ID NO: 4098490 - RNA, 57 nt, Human
acacugaauauacaaugaauaugggcauucccuagagauucgauguguguugcaugu

SEQ ID NO: 4098491 - RNA, 55 nt, Human
acacugacgcuugacagucaccugcccaaggucgccggcuggcaagugacagugu

SEQ ID NO: 4098492 - RNA, 61 nt, Human
acacugagcaucucuagaggcacauuaaggaacaguguuuauuaaugagaugucuuugugu

SEQ ID NO: 4098493 - RNA, 56 nt, Human
acacugaguauugaguaggguaauuaaaaauacaucucgaucuagacacucagugu

SEQ ID NO: 4098494 - RNA, 130 nt, Human
acacuguacucucuuuuggucuuuguuagguuuuuuuucccccuuuuuuucuaucacucacucuguggcagcugagaaguacuacaagagagggaggacagagauacugaacaaggcuguguauaugugu

SEQ ID NO: 4098495 - RNA, 68 nt, Human
acacuguaggagaaaggaguuugccucaguccuuucagcguguuuuuuccuucuuguuccugcggugu

SEQ ID NO: 4098496 - RNA, 56 nt, Human
acacuguggccuuuaaccccaucaauaacucuuugaaggccuggaggacgcguugu

SEQ ID NO: 4098497 - RNA, 123 nt, Human
acacuuaauugcuucuauaugcuuauugcuuaauuacauaaaaugcgguagucccuuuauaauguuucuguaaaagugcccaccuuuacugugauuuaggcagaccaaaaagcaagagagugu

SEQ ID NO: 4098498 - RNA, 57 nt, Human
acacuuaucaguugucucuaauguggagagacuacauggagaggucauuguaggugu

SEQ ID NO: 4098499 - RNA, 79 nt, Human
acacuuccagcucucugcagaaaggacuaagaggcuccaauagccugaugacagucucgcugcaaagagucauaggugu

SEQ ID NO: 4098500 - RNA, 66 nt, Human
acacuucucuuugaagaacaauaccacacuugaaacuuuauaagguaugggcugguuaggaagugu

SEQ ID NO: 4098501 - RNA, 79 nt, Human
acagaagggauggagacgaaaaggacauaauauuuuaaaauaaaauaauguuuauuuguauucucccuacaaucuuugu

SEQ ID NO: 4098502 - RNA, 63 nt, Human
acagaagguaggauaguaauuuaccacucuuacuaugagguguggguguacuguucuagaugu

SEQ ID NO: 4098503 - RNA, 78 nt, Human
acagaauaaggccuaaagaaggguucuucaauguuaguuuauucagcaucaaggacuccaauucuuucaucuuucugu

SEQ ID NO: 4098504 - RNA, 81 nt, Human
acagaaucuggcuugacuuugcgacuugcuuucaccaaucaaaugcagaagaagugaagucugguccucaggagguuuugu

SEQ ID NO: 4098505 - RNA, 64 nt, Human
acagaaugaguagcaucuucaccugucaaauaauagcaguugugaugacacccucauauucugu

SEQ ID NO: 4098506 - RNA, 79 nt, Human
acagaaugcagcugcagaaagcaagcagguucaauaaauaaaauguaaaugugcagcccucugccagcacaaguucugu

SEQ ID NO: 4098507 - RNA, 85 nt, Human
acagaauuaggagcaccaggaggugauguugucaguugcauugcugagcauucuuuuugacuccugguuggcuuacuaugccugu

SEQ ID NO: 4098508 - RNA, 55 nt, Human
acagaauucucucugcagaggcagcuacggcuguuuuguggaaguagguucuugu

SEQ ID NO: 4098509 - RNA, 58 nt, Human
acagaauuguuagcuuaaugguuguugucuuaagccauuaaauguuggcauauuuugu

SEQ ID NO: 4098510 - RNA, 61 nt, Human
acagacccuugagauuuucugugcaggaccuccugaacugcaggaaucucagugggggugu

SEQ ID NO: 4098511 - RNA, 109 nt, Human
acagacuaagacacaugcugauuccuauuuuuucauaagaaacccggaacacggagcuauuaaggguguaaauggcagaauuaggauuucaagucaugguugggucugu

SEQ ID NO: 4098512 - RNA, 63 nt, Human
acagacuucagaggcuugcauuugcuuugagcaauguggcaacauugcuucuggagcuucugu

SEQ ID NO: 4098513 - RNA, 78 nt, Human
acagagaacugccagaggagguaucugaagucauucacagacacaagugauucugauuuguucuuuuggugucuuugu

SEQ ID NO: 4098514 - RNA, 67 nt, Human
acagagagaaaggauaacagcucaacuggguuacauuaaacaaguacugacuggcugucuucucugu

SEQ ID NO: 4098515 - RNA, 89 nt, Human
acagagaugcaggcagcgcagcagugaaacagcugcauauguuuggaaagacuuggagcucccgcacugauuagcuccugcauuuuugu

SEQ ID NO: 4098516 - RNA, 72 nt, Human
acauacagcuacauaaauauuuaugugucuuuaagaaauugugagugauagguauuuugugugugugugugu

SEQ ID NO: 4098517 - RNA, 56 nt, Human
acauacaguagcauuauguuucccuuaaguagucuugagguaguucuauugugagu

SEQ ID NO: 4098518 - RNA, 56 nt, Human
acauacgugugugcacacauaugcacacaaagacauacacaugcacacaugugugu

SEQ ID NO: 4098519 - RNA, 92 nt, Human
acauagaaauagaaaauuaaugcaagguggauuuuagaaaauacugaauaucaagugugaaauuguauuuggcauugaauuuauguauaugu

SEQ ID NO: 4098520 - RNA, 64 nt, Human
acauagcuggugaacacgcaccugugcuuccuucccuguacagguguugacucacaggcccugu

SEQ ID NO: 4098521 - RNA, 58 nt, Human
acauagugagagaaagaucagcuugcucuaauuaaacaaguugaauucuucuacaugu

SEQ ID NO: 4098522 - RNA, 73 nt, Human
acauauaagggaucagugacagaauuaauuucugaguaaugcagaauaaacaucaauauugaccuuuguaugu

SEQ ID NO: 4098523 - RNA, 83 nt, Human
acauauauaccuuguaccauaggucuaucauucucugucuaagggggaggauaauauacguaugguacaaggauguccuaugu

SEQ ID NO: 4098524 - RNA, 103 nt, Human
acauauauaugaucuuacgugauacucacuauucuaucagauagguuuucugaauggagcccgaucuuguggguaguguauugcuuguacgaaaugaauaugu

SEQ ID NO: 4098525 - RNA, 84 nt, Human
acauaucauugucacccaaagcucauaguuuacauuaggguucacucucgguguuguacauucuaugaguuuugacaaaugugu

SEQ ID NO: 4098526 - RNA, 80 nt, Human
acauauguaugauugauuguauaacagcauguauuuucauuuggaaaaugucugaguuaugcagaucuuacaaauauugu

SEQ ID NO: 4098527 - RNA, 74 nt, Human
acauauuaaaguucucaagguuaggaaaagucacuauauuuguauacuuccuuaauuuggggaaaauaaaaugu

SEQ ID NO: 4098528 - RNA, 61 nt, Human
acauauucacagguuccggagauuaggauguucacaucuuugucugugugugugugugugu

SEQ ID NO: 4098529 - RNA, 130 nt, Human
acauauuucaacugugagauuucaaaugaagccuguuguuggcucuguguuuccaggcagcucacagaucccugucuaaaagcacuggguauagcaaugaucucaugauguuaucucaauaaauuucugu

SEQ ID NO: 4098530 - RNA, 90 nt, Human
acaucacauauaguucaaaguagaguuguggaauuacuuuuccaugacaauguuuaagaauuguacagcuuugcuguuaucuagugaugu

SEQ ID NO: 4098531 - RNA, 70 nt, Human
acaucaccucagcuauuucaaaacagagcuaaaguuccaguccagggaauggcugauucuucaggugugu

SEQ ID NO: 4098532 - RNA, 130 nt, Human
acagcucuuuguauccuuccuucacgucacuacucucaguuucucauuauaaaagugugugaucauuuuacaguugaggaaacugagagcuugagaagcagagguaauuuucccaaagaaaugaagcugu

SEQ ID NO: 4098533 - RNA, 58 nt, Human
acagcugacaagaguccuuggaggauuucccgaagaauuccauggacccugucagugu

SEQ ID NO: 4098534 - RNA, 80 nt, Human
acagcugccugacacugccgccaccccgccagccuccuccuuggccugugcggggggcagcagucgcucagucccacugu

SEQ ID NO: 4098535 - RNA, 55 nt, Human
acagcuggugaauguucucuguguccugugggacacauaugacaaggccaguugu

SEQ ID NO: 4098536 - RNA, 56 nt, Human
acagcugugacuuagagaaguugaacuaacuagcucaaucuaagugccaaagcugu

SEQ ID NO: 4098537 - RNA, 67 nt, Human
acagcugugcuaccuuuucauugaguugacuucugauuuccuuuccaugcaaacaguggcuagcugu

SEQ ID NO: 4098538 - RNA, 77 nt, Human
acagcugugggauaaguuuugaaauacugaagugugagucuuucaacuuuguucuuuuucaaaauuguuuuggcugu

SEQ ID NO: 4098539 - RNA, 109 nt, Human
acagcuguugguucaggauugugaagcuucaaugagauaauuguuuagcauguuuuuauuccaucaugaacaccauuuguauuguguuuuacaguuuacaaagugcugu

SEQ ID NO: 4098540 - RNA, 100 nt, Human
acagcuuccauuugcucccaaguucaaugcauucuuucauggaccuggcucugcugacauccaggaaggagguaucuugcuggggaggggauagcacugu

SEQ ID NO: 4098541 - RNA, 65 nt, Human
acagcuucuccaauuauuuucuaaggauagauuccuagcaguaaaauuaauggaucagaaggugu

SEQ ID NO: 4098542 - RNA, 57 nt, Human
acagcuucuccucgaugucaugcacgauuucccgcuuggccgugguggugaagcugu

SEQ ID NO: 4098543 - RNA, 114 nt, Human
acagcuuuuaaagaaaggaaccguuuguaauaaaguggaaaugcaaggauucuaauaaucauguccaucuuaacuuucuuuaaauaugguuuauucauuuucuccaaaaguugu

SEQ ID NO: 4098544 - RNA, 91 nt, Human
acagcuuuuagcccuaucuggccuccacuguggguggcugauaucuacuaccacaguggaggccauaugguccugguuaagaguaagcugu

SEQ ID NO: 4098545 - RNA, 55 nt, Human
acagcuuuucaauucugcugagugacaaaucuucucuuagcuaguaagaagcugu

SEQ ID NO: 4098546 - RNA, 64 nt, Human
acaggaagaaagugcaguagauucucauuauucacaaguucuaaauuugcaaauucuucccugu

SEQ ID NO: 4098547 - RNA, 58 nt, Human
acaggaagugggaagaaacaggcagccuaaugaugagguccugggguccccuuuaugu

SEQ ID NO: 4098548 - RNA, 85 nt, Human
acaggagccacugugcuuggccuuagcuucuucuuaaauggcagcaguuugaguagugagacuaggcagaagcaccccuccuugu

SEQ ID NO: 4098549 - RNA, 69 nt, Human
acaggauugcaaaucacaagagcagagcccugacuccagcucugaugcuacugugcuuugugaccuugu

SEQ ID NO: 4098550 - RNA, 56 nt, Human
acaggauuuuguaguuuuguugccccuucuaugagcaacaaacuacaaaauuaugu

SEQ ID NO: 4098551 - RNA, 58 nt, Human
acaggcaagaggaaagcaaguaagaaugcuuucugagcugcuguuucucucuuucugu

SEQ ID NO: 4098552 - RNA, 65 nt, Human
acaggcaccugccaccacaucuggcuaauuuuuguauuuuuaguagagaugggguuuugccaugu

SEQ ID NO: 4098553 - RNA, 63 nt, Human
acaggcagcaggccucuguugagggccuucuguuggagggcccaugucgggcgcucugcuugu

SEQ ID NO: 4098554 - RNA, 57 nt, Human
acaggcagggaccuuggcuaagucaccaccuaucugagccucaguuucccugucugu

SEQ ID NO: 4098555 - RNA, 75 nt, Human
acaggcuacucagggacugugacaugaugacacuuguaggaacccagugugucauuuaguccucugugugucugu

SEQ ID NO: 4098556 - RNA, 77 nt, Human
acagggacaaggagugugcccacaucucuggggcagguacagcuguccuaggaaguggaggcaccugcugagcuugu

SEQ ID NO: 4098557 - RNA, 56 nt, Human
acaggggagacuggaaucuaacaucuuuacugauguggaaucacagccuucuaggu

SEQ ID NO: 4098558 - RNA, 55 nt, Human
acaggggugcauggugcauggucucugggacugauagcagcggugacacccuugu

SEQ ID NO: 4098559 - RNA, 55 nt, Human
acaggucuccagagugagaggaugaaugccaucuccucuuuauggaaaaacuugu

SEQ ID NO: 4098560 - RNA, 71 nt, Human
acagguggcacugcuguuacucuccugucacacuccagaaaaaagaagucgaguuauaacugccacacugu

SEQ ID NO: 4098561 - RNA, 63 nt, Human
acagguuccugguccuccuagagcuucuuauucaaugggucugggaugaagccagaaacuugu

SEQ ID NO: 4098562 - RNA, 103 nt, Human
acagguuucuccacuucucuagaagguugggcaggugcuaggaagguaaccugcaaacacuucccaacacuuuugagaugaacagaaaguggaguuaccucgu

SEQ ID NO: 4098563 - RNA, 56 nt, Human
acagguuugcagcuuguuaccucuggcuucccacagccuucaugcugugcaucugu

SEQ ID NO: 4098564 - RNA, 66 nt, Human
acaguaaggcauuuuucauguuuauccuccacaugugccguaaagguguugcgaugucuggacugu

SEQ ID NO: 4098565 - RNA, 91 nt, Human
acaguaaugacuagaaaaacaauucaguuuuaggacuggaaaugucaaagcacucuaucagccuuuggaugguuuuucuauuucuuacugu

SEQ ID NO: 4098566 - RNA, 66 nt, Human
acaguaauuaaggucugaaacgcuucccaaucaaagaacaggaagaguucacuccgaguuaacugu

SEQ ID NO: 4098567 - RNA, 83 nt, Human
acaguaguaggucagugaucauucagucucugggacagucaauggacagacguuuacagcucugagugcuaaacugcuacugu

SEQ ID NO: 4098568 - RNA, 68 nt, Human
acaguaguccuuuauuuugguuuaguggaaagacuuucagaggucagugccgaaugaaggaugacugu

SEQ ID NO: 4098569 - RNA, 64 nt, Human
acaguagucucuuuaaucacagugucugcuugguuccaauuacugucuguaaagggaauucugu

SEQ ID NO: 4098570 - RNA, 83 nt, Human
acaguaucagacucaagcagauaggaauuagacaaucaaccagaguaaguuugguccaguuuagcauugagugcuuuaauugu

SEQ ID NO: 4098571 - RNA, 94 nt, Human
acaguauccuguuuucuacagucugggucucagccccuugggaccgcucuuccaagcucaaagacaccagaaucuguugagcaacugaaccagu

SEQ ID NO: 4098572 - RNA, 96 nt, Human
acagucagagagaacaaaauaccaauauucaaccaaccugaggaaaagugaauucuaugucaggagggauuguugccuauuuuggcucacugcugu

SEQ ID NO: 4098573 - RNA, 127 nt, Human
acagucucucaugcuccucccccaccccucucuguuauaaguuauauguuucccuaacugcagguguuauggaaauguaacuucugauucaagcugagagaggacuugaggaacuugaggaaauugu

SEQ ID NO: 4098574 - RNA, 67 nt, Human
acagugcauuauugcugaaugcgucuguuauagguaguuccuaguuuauaaagcaauauuguauugu

SEQ ID NO: 4098575 - RNA, 59 nt, Human
acagugcuggcuacaacccugggaaggccuaacaggguuaguaacgugacagcaucugu

SEQ ID NO: 4098576 - RNA, 60 nt, Human
acaguggagaaucuucaagaugccaaggcacauacuugccagccagaauuucuccacugu

SEQ ID NO: 4098577 - RNA, 69 nt, Human
acagugggauaucagggcccagucugugcaucucucauuccagggaggccggggcccugaauccacugu

SEQ ID NO: 4098578 - RNA, 73 nt, Human
acagugucaaugaacacagcccucuacuuugcugaauuccagaaggagacgacugugcucaugaagacaaggu

SEQ ID NO: 4098579 - RNA, 85 nt, Human
acagugugguuggcccaggaggccagagggcagcacccugucauuguccuuacccuccugggagaucuuagccaaccuuuucugu

SEQ ID NO: 4098580 - RNA, 64 nt, Human
acaguguuguauuuaguuugauagauacaauuacaucuaucuagccagauaauuacaguacugu

SEQ ID NO: 4098581 - RNA, 72 nt, Human
acaguuaagcaguaugaucacaccgaacccuaugcuuagaagggauccauacuugauuuauugcuccacugu

SEQ ID NO: 4098582 - RNA, 56 nt, Human
acaguucaagucuuagacaacaaggguguauccuguugugcucaggguugagcugu

SEQ ID NO: 4098583 - RNA, 87 nt, Human
acaguucccaaaugcagacaagucgugggaucuuccgggagaacuuggaucuucccacaucugucugcuacugggagaaguugcugu

SEQ ID NO: 4098584 - RNA, 87 nt, Human
acaguucuagaagcuggaucaagucacuggcagggaugcuuucuucugaggccucucuccuuggcuugcagauggcuucuccuaugu

SEQ ID NO: 4098585 - RNA, 83 nt, Human
acaguucuggaggcugggaaguccaauaucaaggcagauucagugucuggugagggcccacuucuuaguuuuuacaggacugu

SEQ ID NO: 4098586 - RNA, 74 nt, Human
acaguuuacauauuuuaauuggugaccauagguuucggaaugccaaaguuacagguacaauaugaauaaacugu

SEQ ID NO: 4098587 - RNA, 56 nt, Human
acaguuuaugccucugagccugcagacucaaagaugcaguuuacaacauaaauugu

SEQ ID NO: 4098588 - RNA, 57 nt, Human
acaguuuccagaacaugagcuaguuguguuucagaaguuuauguguaagacagcugu

SEQ ID NO: 4098589 - RNA, 64 nt, Human
acauaaaggugacuaacaucuugagacauaugccuuugucgccaagauuuaauaaucuucaugu

SEQ ID NO: 4098590 - RNA, 61 nt, Human
acauaacaugucaaucacccgauucugggcggcugagucgggaggugacgggcaugggugu

SEQ ID NO: 4098591 - RNA, 90 nt, Human
acauaacuugagugauagcagagccaacucgauucauccagaauugauuucaucccaggcucuggaagaaaucuaaugcucaggcuaugu

SEQ ID NO: 4098592 - RNA, 85 nt, Human
acauaauuuuugguugaggggaugggggcuguucuguggacugcauagcauuuagcagcauuccuggcuucuauccaauguaugu

SEQ ID NO: 4098593 - RNA, 67 nt, Human
acauacacugugcaugcauauacacacauguaugaacacgugugugcauguauguauagaugugugu

SEQ ID NO: 4098594 - RNA, 96 nt, Human
acauacugaacaguuauuggugaaguucuuuagauguuuagaggaagaaaauauuuuuuaaacuacuuccaucuagagaucccaauguuuaguugu

SEQ ID NO: 4098595 - RNA, 70 nt, Human
acauaggacauguguuuuauauaugugaaaauguauacacauacauauaugaaaugcauguuuucuaugu

SEQ ID NO: 4098596 - RNA, 72 nt, Human
acauaguaagugcucaguaaaugucaguuaacacaauccuaacagcuucuauuuauugagcacuugcuaugu

SEQ ID NO: 4098597 - RNA, 61 nt, Human
acauaucugugaacuggcauggccaggaugccaauccaagcuuucagauuuacagaaaugu

SEQ ID NO: 4098598 - RNA, 61 nt, Human
acauaugaguacuauacagugccugcauaccguguguauuuauugugaauacugcauaugu

SEQ ID NO: 4098599 - RNA, 82 nt, Human
acauaugucacuucguuuuuaaauuuaugacuacggaagucauauggcuaugucuaaacuuagggaucgaacaggacaaugu

SEQ ID NO: 4098600 - RNA, 65 nt, Human
acauauuucagcuuuacuuaggaaaggcaucugcuucgaguauuuucugggaaaagccaauaugu

SEQ ID NO: 4098601 - RNA, 90 nt, Human
acauauuuugccauugaagguuuaaugaacuguguuaacugaauauguuuucauauuagguguguuuauaagaccuucuuuagaaaaugu

SEQ ID NO: 4098602 - RNA, 75 nt, Human
acaucagucucaugaggaaaaugucuuauagauuuggaaaucagaucucagagagguuuuucaucugcccaaugu

SEQ ID NO: 4098603 - RNA, 109 nt, Human
acaucauuuaaucugccagaaauuuaacaagaauaaggauaagagauuggccucaagguacaauucaucuuucuccucauauuccuuguaggugcauaucaaaugaugu

SEQ ID NO: 4098604 - RNA, 71 nt, Human
acauccacuagaaugacagaguuggcaggaauguggagcaacuggaacucucaugcauuccuagugggagu

SEQ ID NO: 4098605 - RNA, 63 nt, Human
acaucuagacucuugcccucuuuucuaauaauauuucagagaggcagcucccaguuugggugu

SEQ ID NO: 4098606 - RNA, 56 nt, Human
acaucucuggguccuccaugcauuccauguguuagaauccaagggaacagaguugu

SEQ ID NO: 4098607 - RNA, 74 nt, Human
acuaagacauggcuucuaggaagcuuuugaaccucaaccagagaauuuagccaagaaaagucagguguuuuagu

SEQ ID NO: 4098608 - RNA, 67 nt, Human
acuaauccuuaaggcuucagcauucaaaacauguggcaaacuguuucaugaagucuggauaucuagu

SEQ ID NO: 4098609 - RNA, 91 nt, Human
acuaauuagcugcuuuaauaugaacuuugguaagaaauuuucuuuccauucuugcagaaauaaguuuaaaugaaggcucuaggcuucuagu

SEQ ID NO: 4098610 - RNA, 76 nt, Human
acuacaaaaggcugaguaaaacagagaacccugaaaaaagaguuauuguccauuuauuuagcacaguuucuguggu

SEQ ID NO: 4098611 - RNA, 78 nt, Human
acuacagagauuuauugcuaaggcucaugcuuuugccuccauuugcccaccguuguuuugucagucaaugucuguagu

SEQ ID NO: 4098612 - RNA, 64 nt, Human
acuacauuugcagagaagcaauauggcuuuaucuuccaaucagggcuucauuugcaagucuagu

SEQ ID NO: 4098613 - RNA, 130 nt, Human
acuaccaaauauuuuacuauaguuacccugaauaaauuacguuuugucuuaauuuggauucuacugaaagcagagccugaggcaaggacuugguggcagggaguacauuuggguggguauauaaggaagu

SEQ ID NO: 4098614 - RNA, 80 nt, Human
acuaccacacagaccuauuagggguuuuaaaugaccaacaucuauaaaacaccuguagugucugccauguaauagguagu

SEQ ID NO: 4098615 - RNA, 89 nt, Human
acuaccccauugcuauaaaaugucauuaaaauugugcugcauuuacaauuuuguauuuguugcauuuugaagacauagaauggggcugu

SEQ ID NO: 4098616 - RNA, 78 nt, Human
acuacuauaugucaagaaaugugcuuggauauauuucagugugguguauuucaguguaugucuugaaggacggguagu

SEQ ID NO: 4098617 - RNA, 83 nt, Human
acuagaaaagacuuuagagauugucuaguauuguggcucccaaccaugaagccauuucuggaagucuuuaagcaauguuuagu

SEQ ID NO: 4098618 - RNA, 66 nt, Human
acuagaacuuauuuggcauuauuucauuucugauuccuaaugagcuuggcuaccuggguuccuggu

SEQ ID NO: 4098619 - RNA, 81 nt, Human
acuagaagauuuccauuuuaauauuagcacagggacaagccuuguuucacaauuaaauuagagccagguaaguuuucuagu

SEQ ID NO: 4098620 - RNA, 79 nt, Human
acuagauauagacagcuguuccuucauguuugaaagauaaaaaucacaggaaauacaaggaaaguuuucuuuauucagu

SEQ ID NO: 4098621 - RNA, 68 nt, Human
acuagauggcgaggaagaaguuugagucaagagaccuauucuuggcacugucuucuucguguaagggu

SEQ ID NO: 4098622 - RNA, 57 nt, Human
acuagcaaugauucuaccaaguuguugcaaaggggcuguggcagagacaaugcuagu

SEQ ID NO: 4098623 - RNA, 86 nt, Human
acuagcagaauguaggccuucaguguuaacauagccuuuuucuguuauugcauuuaucugccuuuguucugaagccccagucuagu

SEQ ID NO: 4098624 - RNA, 108 nt, Human
acuagcuguaaugcuuaacacuguggcugggauucaggccuaaguagggucuuauucuuagcuugucucucagccccagucaaguuacuguuaagucuuagagccagu

SEQ ID NO: 4098625 - RNA, 59 nt, Human
acuaggacacaggcugcugcuucauucacccccggggaaggcuuucugugauccucagu

SEQ ID NO: 4098626 - RNA, 55 nt, Human
acuaggagagacuuugucucuggaugucuggaggaauaacagagugucccgcagu

SEQ ID NO: 4098627 - RNA, 58 nt, Human
acuagggagaagcacuuacacagcaaaaucugcugaguuucugaauugucuccuuagu

SEQ ID NO: 4098628 - RNA, 64 nt, Human
acuaguauucuuggucuuguauuuauuguucucugccaaguuuugcagggcuugaauauuaugu

SEQ ID NO: 4098629 - RNA, 74 nt, Human
acuaguuuucaauugacuuuggaagaaagauuuuugaaucauuucauucauguguuaaaggugaagucucuagu

SEQ ID NO: 4098630 - RNA, 66 nt, Human
acuauaucuucuuggguuguuauaaauauguaaaguaaucaugacagaguccagaaguaguguggu

SEQ ID NO: 4098631 - RNA, 61 nt, Human
acuauaugaaauugccauuuuguagcucaaagauguucaaauaccagcaauuucauguggu

SEQ ID NO: 4098632 - RNA, 104 nt, Human
acuaucagucucuaggaugggcccagcauuccugcaccugccccugcugcccuugaagcuguguggacugguugaggcccugaaacuucuuggggacagauagu

SEQ ID NO: 4098633 - RNA, 67 nt, Human
acuaugaagcagcaaguauaggacaggguaaacuccacuucaugaacuuugacuuguuguuuuuugu

SEQ ID NO: 4098634 - RNA, 63 nt, Human
acuaugaagugcaagcugcuuuguuucuucuugguguacauucagcaucuugcaucuucaagu

SEQ ID NO: 4098635 - RNA, 83 nt, Human
acuaugaaugcaagucacacauuucuuccauuguagcuucucauaaagagcuagagacuguacguggcaaguaucuaaguagu

SEQ ID NO: 4098636 - RNA, 81 nt, Human
acuaugacccuuuagagaugucccaaaaugaaggaagaguuauccauuauugaauuggaacuaucuccagggagauguagu

SEQ ID NO: 4098637 - RNA, 98 nt, Human
acuaugaugauugggguucaggagagauuuguuuaagaugcuuaagacaaaaccagaaaaucucuacccgaugguuugugauaccuguaauccguagu

SEQ ID NO: 4098638 - RNA, 68 nt, Human
acuauguuggccaggcuggucuggaacgccugaccucaagugauccguccgccucggccuuccaaagu

SEQ ID NO: 4098639 - RNA, 67 nt, Human
acuauucagauauaccaguauuuguauuuagauauucccauuuagauggcugguguucugagcuagu

SEQ ID NO: 4098640 - RNA, 92 nt, Human
acuauugugcuaaccauggauugauuucauuaugaauuuaaaaguuauaaauuuagaaccauaaugaaucaaugaauaauuggccgaugugu

SEQ ID NO: 4098641 - RNA, 90 nt, Human
acuauuuucaaagucucugagagcauuuuauuuaccuauaagccagaacacuaaaacuuaaggagcagaaugcuuggaccaugagauggu

SEQ ID NO: 4098642 - RNA, 66 nt, Human
acucaaaagcagggcuagaccaagaagagccucuagagcucuuuuuuugcccuuguuuccuugggu

SEQ ID NO: 4098643 - RNA, 56 nt, Human
acucaagguguggcccuagggacccccgccuugccccugugggccucacuuggggu

SEQ ID NO: 4098644 - RNA, 105 nt, Human
acucacaguccauggugugacugagcuguggcagcagccguggcauuggccuugcaacagugucagggcaugcgguccagccuuucuugugauuuggcucugagu

SEQ ID NO: 4098645 - RNA, 95 nt, Human
acucacggcgugucccucugaccagguggacggcgaguacagguaccgcugcggcacuugugagaagaccuuccgcaucgagagcgcgcuggagu

SEQ ID NO: 4098646 - RNA, 55 nt, Human
acucagaguuugcguuccauacgccguuccacggcucgaagcaacaguucugagu

SEQ ID NO: 4098647 - RNA, 72 nt, Human
acucagauccauggcuuugcuucaguucuucucacccuuggugcuucuggcauccagccaugugauuuuagu

SEQ ID NO: 4098648 - RNA, 78 nt, Human
acucagcaccaguucugucuccucuuuucagccgccuucucucuagcuacugaggggaaaagucaggaugaagcgggu

SEQ ID NO: 4098649 - RNA, 60 nt, Human
acucagcuggcugcaugaugccaaaaugacuccuugcuuuggcuaauucagucagcuggu

SEQ ID NO: 4098650 - RNA, 84 nt, Human
acucaggcacuugauaucaagauuauuagggucaugauuguguuuaagacccuaagaccucuugaugcuuuuacaagaaugggu

SEQ ID NO: 4098651 - RNA, 72 nt, Human
acucaggccucccaggcacagggaggagccacagaggcucucggcuccucccgaagccggcugggccugggu

SEQ ID NO: 4098652 - RNA, 68 nt, Human
acucaggccugugugcaggacugugcaccagucucggagguguggauggcccugcacacagguagggu

SEQ ID NO: 4098653 - RNA, 118 nt, Human
acucauuacuccgucaaggauuuggcauuucaaucgaugggaaaugaugugugaucauucuaauuuauuauacaucauuucccaucaaucgacgaacuaaagccuugacguaauaagu

SEQ ID NO: 4098654 - RNA, 79 nt, Human
acgauuauacuaauagcuauuauauugaaaaguuacuauaugucuggcaauaugcaagcuauuaaguauguuuaauugu

SEQ ID NO: 4098655 - RNA, 78 nt, Human
acgcggagcgcacugugggccugucguggguggggccagcagcacaugcaugccuggcucacagagcagccuuugggu

SEQ ID NO: 4098656 - RNA, 57 nt, Human
acgcggcaucaucuugauuuauggacugcacuuccuugagcucaggaagagcugagu

SEQ ID NO: 4098657 - RNA, 84 nt, Human
acgcgugcacauauacuguguuaaauacagagauggguggucgcuuaccuguguguuugauacauaauaguauuuggucaaagu

SEQ ID NO: 4098658 - RNA, 56 nt, Human
acgcuugcagaggcuguuccagauggguaaaauuagaugucuccucaugcaagugu

SEQ ID NO: 4098659 - RNA, 86 nt, Human
acggaaaaucuuaugggucuaucuagaaagcuguguggaugugauugugaaucuccacacacauuucuaugugcauuacccaccgu

SEQ ID NO: 4098660 - RNA, 127 nt, Human
acggaacaccaccaggcucgucuuuuugcgucaauucacccaauagcuguuugaaguccaagaugggcuuccaggggcugugggcugaggaagaggcucuggggcaaggcuuggugggaugaacagu

SEQ ID NO: 4098661 - RNA, 79 nt, Human
acggagaugaugcaacagucaguacauccgggaaaagcacuuaugguagcucuguguacuauuguugcaauuuuucugu

SEQ ID NO: 4098662 - RNA, 89 nt, Human
acggaguuucugggagcaggcagggccgugucuguuacugcccaacccaggguagccccggacggaguuugccggguucccugcucugu

SEQ ID NO: 4098663 - RNA, 78 nt, Human
acggauggucucugcaggccaggcucaaagggccucccacaccuucccugggcacuggccuggacaggacagguccgu

SEQ ID NO: 4098664 - RNA, 128 nt, Human
acggauuguggcucaccuaagcagggaagccgauuuggaacuuaaacaagcucccaaguugugaucagucgagcuuggcaagcacuguuugagagaguaggcuucccgcaagcaggagccgguuuugu

SEQ ID NO: 4098665 - RNA, 66 nt, Human
acggcacagggugauguugcaguucccacacauugucacugaucugcuggcucgcccuguuggugu

SEQ ID NO: 4098666 - RNA, 93 nt, Human
acggcagguaggaaggcgggagcuggaggcagugcugaggucucggugucagggggcaggacucaccuacuagcagcacuucuuacuagcugu

SEQ ID NO: 4098667 - RNA, 69 nt, Human
acgggaccuuggugacuguuuccucaucugaaaaugagcagagugggacacgggcgcugucuguccugu

SEQ ID NO: 4098668 - RNA, 65 nt, Human
acgggagagucugguagagcagcaagcccuacuuccuggagcuguuguugccacauuguuauagu

SEQ ID NO: 4098669 - RNA, 94 nt, Human
acgggaggucagagggcugccuggcgcaguuucucugcugccuggauugaccaugaggacaaggacuagcugugcccagcccccugcuucccgu

SEQ ID NO: 4098670 - RNA, 82 nt, Human
acggggauccuugcauggcccugggucuagguuaugugcuuuccacacagaagcacccugcacucccagccauagaccuugu

SEQ ID NO: 4098671 - RNA, 63 nt, Human
acguagaaauaguuagcuuaguucuguauuauguuugaaauagaauuaacuagcuacugaugu

SEQ ID NO: 4098672 - RNA, 55 nt, Human
acguagcccauggcucaguauuuucugcucaaaugcuggcuccucgaggcuucgu

SEQ ID NO: 4098673 - RNA, 87 nt, Human
acguauaaaagcaugcaaguauucacaggcuucccuuugagugguuucaaaggagaauuuggcuugugaugcucuaacaugaugcgu

SEQ ID NO: 4098674 - RNA, 58 nt, Human
acgucaccaucuacagcuccaaaccuccucuggggaguucacaugaggaugaugaugu

SEQ ID NO: 4098675 - RNA, 86 nt, Human
acgucauaauauuuuaccacuguguaugcuagugagaugauuuacucacauugcauguguaugguaggaauauuaaauaaugaugu

SEQ ID NO: 4098676 - RNA, 80 nt, Human
acguuacuuccuggaggaauaaguuuuccacagaaacauuuugcauaauuggaaaacuucucuugagugagguauuaugu

SEQ ID NO: 4098677 - RNA, 104 nt, Human
acguuuauuagaagaaaaugcagauuccugaaacuuccugcagaccccaugagugacaaucucagggagauggaguuccagaaucugcuuuuuuucauagaugu

SEQ ID NO: 4098678 - RNA, 78 nt, Human
acguuucaacaucuccugcuuuuagauuuugccuuguacuauggcaagccagauuccuuaagcacagcuuugaaaggu

SEQ ID NO: 4098679 - RNA, 82 nt, Human
acucugucagcugugcaaggucacuguccucuacagaguagaacaucgacacugagaaagugaccugccaaggccacagagu

SEQ ID NO: 4098680 - RNA, 57 nt, Human
acucugugccaggcacuuugggguaugcuauagacaaagaaguguaugccacagcgu

SEQ ID NO: 4098681 - RNA, 56 nt, Human
acucugugccuagcucaguauaccugaagaauguaagcugggagggagcccagagu

SEQ ID NO: 4098682 - RNA, 59 nt, Human
acucugugcuucuuacucuggagcugcuuacuuggagcugccccaugagaggcaggugu

SEQ ID NO: 4098683 - RNA, 58 nt, Human
acucuuaugggaacaaggauuagaggagguauuaauucuuccuugugccuguaagugu

SEQ ID NO: 4098684 - RNA, 60 nt, Human
acucuucauccuccuagagagcauggcaccucugucagcaccauggguagugaugugggu

SEQ ID NO: 4098685 - RNA, 62 nt, Human
acucuugagcaucuaugacugaagacaucaacaagaaaucucacagcaucauugcucauggu

SEQ ID NO: 4098686 - RNA, 75 nt, Human
acucuuggcagcuuuuggaggagccagacuauuaauacuuagcccagggcuugggaagcuguuugcacuuagagu

SEQ ID NO: 4098687 - RNA, 64 nt, Human
acucuuuaaaggcaggauguucaccuguuguacucagugauguauccuuagcacuuagaagagu

SEQ ID NO: 4098688 - RNA, 55 nt, Human
acucuuuacuuaaacucuaaguugcuaaccaacuaaugaaguuuggguugagagu

SEQ ID NO: 4098689 - RNA, 63 nt, Human
acucuuuauuugggcauagaaauuaaugacgcagaccguuuuauuucucccaagugcaagggu

SEQ ID NO: 4098690 - RNA, 75 nt, Human
acugaaauaaacguauuuggaagacagugaaacagcacuucacaagugaacauuuucuugcaaauugauuucagu

SEQ ID NO: 4098691 - RNA, 60 nt, Human
acugaaauauuuagaagugaagagucaugauuuuugcaauuuacucuuaaaugauucagu

SEQ ID NO: 4098692 - RNA, 62 nt, Human
acugaaaucuguuuccaauacuugcuaugaaaaauccauagaguaucugaauagguuugggu

SEQ ID NO: 4098693 - RNA, 55 nt, Human
acugaacagccuuucaaacuuagcuuugacagaaugguuuugaaaggaugucagu

SEQ ID NO: 4098694 - RNA, 86 nt, Human
acugaacuauuagguuggugcaaaaggaauugugauuuuugccauuaagaaaucgcaauuacuuuugcaccaaccuaauauauagu

SEQ ID NO: 4098695 - RNA, 130 nt, Human
acugaauaauuucauacuuaaguguuggguuaagucacuauguaauaucuauacagucaaaucaauaauuggaauguauagauguuauguaaugacuuaacccaacacuuaaauaaugaaauauuucugu

SEQ ID NO: 4098696 - RNA, 107 nt, Human
acugaaugauuuauuugcaacuuguuaucugguauaguggggaagagccacuuaugucucuuuaagccaagauauauuuaagauaacaauaaagauaaaauaucagu

SEQ ID NO: 4098697 - RNA, 55 nt, Human
acugaaugcuccaaggcugcuucuucacgaagucccagggccuuggggccucagu

SEQ ID NO: 4098698 - RNA, 57 nt, Human
acugacaaauauagcuucgucuuaaaagauucuuaagagggagcuuuauuuuucugu

SEQ ID NO: 4098699 - RNA, 56 nt, Human
acugacaguugguuuggugaugucuggacgcucuaaaucaucuuuacaaugucagu

SEQ ID NO: 4098700 - RNA, 80 nt, Human
acugaccuccagauggauccacuuucacuuuuacuuuccauuuauguagaauaugugguaggaucuggaugggcgucugu

SEQ ID NO: 4098701 - RNA, 55 nt, Human
acugacucacaauacugcaauuugagaaugcuauaugcagaauccugugaucagu

SEQ ID NO: 4098702 - RNA, 71 nt, Human
acugacuuagcagguuucuggcucuuggcucuugaggacaaggcccaaggaugagaccuuguugaaaaagu

SEQ ID NO: 4098703 - RNA, 61 nt, Human
acugagaaacugaauauuuaacggggccuauugcucugaaaaaacucagauuucucuuagu

SEQ ID NO: 4098704 - RNA, 60 nt, Human
acugagacuaaccgaggagguuaugguuacucuucugccugcuccuucccugguuucugu

SEQ ID NO: 4098705 - RNA, 57 nt, Human
acugagagaauauuugcaacguuacucugcucugauaacucugcuuguucucugagu

SEQ ID NO: 4098706 - RNA, 77 nt, Human
acugagagugaugauggaggcaccacuggcugcccgcuaucaccagcaggcaacuggggcuuucuucccaccuuagu

SEQ ID NO: 4098707 - RNA, 72 nt, Human
acugagcagauauaguggcuugccuggggcucaauccuccugucuucauugcuauucacuguacugcucagu

SEQ ID NO: 4098708 - RNA, 60 nt, Human
acugagcaguagauuuucuguugugauuuuauuuagcauauguagaaacugaggcucagu

SEQ ID NO: 4098709 - RNA, 84 nt, Human
acugagcugcacagcgagccugggagaugguugugccgugcucccacagcacagccagcaucugagggaugauggcggacgagu

SEQ ID NO: 4098710 - RNA, 94 nt, Human
acugaggaggcacugcaaguuuagcuaacuggcccaaggucacacagcugguagaugguggggcugagacuugaacccagucugccuccacagu

SEQ ID NO: 4098711 - RNA, 77 nt, Human
acugaggcuuaaagaucuuaggaagauuuuccaaggaaacaacuggagagugcuagagcugagauuugaacuucagu

SEQ ID NO: 4098712 - RNA, 63 nt, Human
acugagggccuugacaguuaagagaccuuccaaaggucacacaacugucagaggcaaaucagu

SEQ ID NO: 4098713 - RNA, 73 nt, Human
acucagacucagaagcagccucauucucuuuucuacuuguacuggagauugauaacuuuaauuugaucugagu

SEQ ID NO: 4098714 - RNA, 61 nt, Human
acucagaggaaaguugagauugcccuagacaccuugggaguuggaaggcuauucucugggu

SEQ ID NO: 4098715 - RNA, 60 nt, Human
acucagcuugcacacaucaaugaccuuuggggauauuguucacaccugugcaguuugagu

SEQ ID NO: 4098716 - RNA, 64 nt, Human
acucaggaugcagugggacccaggggagggacacugagccucacccucugggcugcaucuuggu

SEQ ID NO: 4098717 - RNA, 81 nt, Human
acucaggcuccauagguaaugagcugagauuacaugauuuauugcuuucaguuugucggccuuggacuguucugccugugu

SEQ ID NO: 4098718 - RNA, 128 nt, Human
acucaggcuggccccuggaccugcaccugcuccggggagggcaucaaucaggccuggaccacaccaggaguggcuggugaccuucugcggguuggugcuagcauugccuggggcccaauccccugagu

SEQ ID NO: 4098719 - RNA, 85 nt, Human
acucaggugcuggcuaugugguuagacauaagaauuaugugugauagacguaugaauuaugguacuaugaagccaaagcuagggu

SEQ ID NO: 4098720 - RNA, 67 nt, Human
acucaguaaauguuuagcaucaguugucuuaauugauacuugagguuguauaaauauuuugaugagu

SEQ ID NO: 4098721 - RNA, 69 nt, Human
acucauacauauguaaaggcuaauggaguuguaaauguaacuuuugaggacuuuauuguauguaugcgu

SEQ ID NO: 4098722 - RNA, 57 nt, Human
acucaugagaacagagagugagguaguacauucuuacauucuguauuuuuauagagu

SEQ ID NO: 4098723 - RNA, 112 nt, Human
acucauugaacauugaauacucucagcucagagauaaucaagagacaguucauucuugagagugcagguuuucagaauguucugagaaagagugaaugauuuuaaggugagu

SEQ ID NO: 4098724 - RNA, 64 nt, Human
acucauugcuaucuuuagauugcagucucaagguccuuccugagcugugcuaagugaaaugagu

SEQ ID NO: 4098725 - RNA, 66 nt, Human
acuccacugauucaagaauuaacguacagaaaaagauucugucucuuuguucugugagucgggggu

SEQ ID NO: 4098726 - RNA, 67 nt, Human
acuccauacagagucauucauuguccaguacguuaguggaugauguauauuuugcaguuaauggagu

SEQ ID NO: 4098727 - RNA, 69 nt, Human
acuccaugagguucagcugcugccugguacauguggucaccugcagcuucuucagcccuacaugugagu

SEQ ID NO: 4098728 - RNA, 71 nt, Human
acuccccagucccugugagaaaugaagcagguucucugucagcuuucuuuacacuuacaggagcuggaagu

SEQ ID NO: 4098729 - RNA, 93 nt, Human
acuccccugugacccguuucuggcuagcaccucagcucagaaggcucuuauuucuugguuugccuggcaagagauggguucaccaucuggagu

SEQ ID NO: 4098730 - RNA, 71 nt, Human
acucccugcaagauuuuccaugucaaccuccaucuaaaugauaucucucggaauauuuuucagaagggagu

SEQ ID NO: 4098731 - RNA, 57 nt, Human
acucccugggccucggagcacaggagacauuuguacucuugccaucugagccugagu

SEQ ID NO: 4098732 - RNA, 59 nt, Human
acuccuaacccaaccucucaccaaaagacagccuggugagcagaauaaggguugagagu

SEQ ID NO: 4098733 - RNA, 62 nt, Human
acuccuagaggccccaugggauggcggugcagacagcaccuucuccuggggcccuccugggu

SEQ ID NO: 4098734 - RNA, 96 nt, Human
acuccuauaaagcagaguuucucaacaucagcacuauugauacuuuaggcugaauaauucuuuguugugggaacuguccuaugcauuguaggaugu

SEQ ID NO: 4098735 - RNA, 55 nt, Human
acuccugccuuaagagauuuacaagcagagaaguagcuaaaauucaaggcagggu

SEQ ID NO: 4098736 - RNA, 58 nt, Human
acuccuggccauccagccuggggaaguuacugcuucacuuugcaaauggcacgggagu

SEQ ID NO: 4098737 - RNA, 67 nt, Human
acuccuggggcugccaucacaguguaaguaacaaauaaacaagauggcugguuugagcuuuagcagu

SEQ ID NO: 4098738 - RNA, 69 nt, Human
acuccuguguggcugggagguuaccagauagccccgucccgucccuccacccagccuucacacaggagu

SEQ ID NO: 4098739 - RNA, 100 nt, Human
acuccuuuggucaaugaugcucuuucuuuugcugaaggcuugacauacaugaauaugcagcuuccauaagagauggagaugacgaucauaugagaggagu

SEQ ID NO: 4098740 - RNA, 59 nt, Human
acucggcagccugagaguucacggggggccagccugccuuggacacagcccuguugagu

SEQ ID NO: 4098741 - RNA, 73 nt, Human
acucgucuuuuugcuuuuaauuucucuagaaugaguggacucagaaugguggcaaaagaggcaaagugagagu

SEQ ID NO: 4098742 - RNA, 59 nt, Human
acucuaaauagccucuuaaacaccaaaggaauacagggacagagguuaacacuuagagu

SEQ ID NO: 4098743 - RNA, 86 nt, Human
acucuaagagcuaauguuucuauaaagaaguuuggggcuccacacaaaagccuuaucauucuucaaagaggcagaguuuuuugagu

SEQ ID NO: 4098744 - RNA, 85 nt, Human
acucuaagucugugugaguuuagguucaugaacgaguuuccccagaacuuaaucaacugugcacuaaauaacauagacuuuuagu

SEQ ID NO: 4098745 - RNA, 55 nt, Human
acucuauuuucucauuuugcauguccuguagcugugcucuaugaggauauagggu

SEQ ID NO: 4098746 - RNA, 106 nt, Human
acucuauuuuuacuaaaacaagccauacaugugucccugauuuauuugcacacauccuuuugcaauauauaucuacguguguguguuuguguguguguauguaggu

SEQ ID NO: 4098747 - RNA, 63 nt, Human
acucuccaagaggcucacugggcaaagacucagguuaguucuccuggccuugagcuggagggu

SEQ ID NO: 4098748 - RNA, 59 nt, Human
acucucccugcuauccacuucccuccaccaucccugggaaaaggacauguuggaguagu

SEQ ID NO: 4098749 - RNA, 67 nt, Human
acucucccuuuguacucugcacaauucuucuggaauauagucuuuguguucagucaaggaucagagu

SEQ ID NO: 4098750 - RNA, 79 nt, Human
acucucuuugaagagauaaaguggcuuuauuuucucuccaacucaaauaaaguguauucuuugucaucuguuaguaggu

SEQ ID NO: 4098751 - RNA, 59 nt, Human
acucugagaacugagauucccuuuucuuacugaauaaacaugucucaaguuuuuauggu

SEQ ID NO: 4098752 - RNA, 85 nt, Human
acucugcccucuguaugggauuuacugguuccuccguaacaaacaacauuguuucaaucagcaaaugcuuacucagggccuaagu

SEQ ID NO: 4098753 - RNA, 56 nt, Human
acucuggcuuuauuuucaucaucuucauuuuauaggugaagaaauuaaagcuaagu

SEQ ID NO: 4098754 - RNA, 63 nt, Human
acucugggaaguggagacuucaguggcaggacuuuuguggcaugauauuuaucuucccugggu

SEQ ID NO: 4098755 - RNA, 75 nt, Human
acucuguaucccucucaaauuguuccuacuucaaggugaaaucagugaaauguuuugagagcccuggugcagagu

SEQ ID NO: 4098756 - RNA, 65 nt, Human
acucugucaccaggccagagugcaguggcaccaucuuggcccacugcaaccucugccuccagggu

SEQ ID NO: 4098757 - RNA, 111 nt, Human
accuacucauuuuaguauugauuuuauauuccaggaugacauaaacaauuggaaucuucccugugacccagaugcauucuggaaaguagcaauuuguguaaaaugagaggu

SEQ ID NO: 4098758 - RNA, 74 nt, Human
accuaggacaaaggaccagaucuggaaaguuccuguccuugaagagcuuucacaaacaacuguuuguucugggu

SEQ ID NO: 4098759 - RNA, 61 nt, Human
accuaggacgguuagugaugugggaaaugauaaaucugacacauuuuucccguucugaggu

SEQ ID NO: 4098760 - RNA, 76 nt, Human
accuaggauucuugggaugggugucacaauaauacgaaccaguguacuucugaccuuuucaucaagagaacugggu

SEQ ID NO: 4098761 - RNA, 86 nt, Human
accuaggucacacugugggaggaacacagccagaacccaaacauucuggguccuucuucacugcuuuuuccaggguugggcuaggu

SEQ ID NO: 4098762 - RNA, 78 nt, Human
accuauagagagaucucuaagcucuggguuaugcagcccacacugcccagaggugcuucagaggugcuuccuauuugu

SEQ ID NO: 4098763 - RNA, 61 nt, Human
accucacaagucucugucagcucugaaaccccauggaccucugagagagagugugucaggu

SEQ ID NO: 4098764 - RNA, 99 nt, Human
accucaccauuucuuucuugguuuugcuugaauacauuuguuucuugaaaaugaagaaaagauuguuagggagaauguggugaaaguaagugguuaggu

SEQ ID NO: 4098765 - RNA, 69 nt, Human
accucagcaguaagugaagacuaguuugaagcaaaugcuuauaaaaucaguacacuuuauuuugcaggu

SEQ ID NO: 4098766 - RNA, 71 nt, Human
accucaguucucucaugccugcccuaagucaguugacaucagugcaguggcauugaggagaaaugagaggu

SEQ ID NO: 4098767 - RNA, 58 nt, Human
accucauaguuuucgugggucagaacuuugaguucuggcucagggucucuuaugaagu

SEQ ID NO: 4098768 - RNA, 99 nt, Human
accucauauuuugaaaaaaggaggggcaaacucaauuauuacaaauuuauuuaaguuugcaaaaugucuuguguuaguaccuucugagucaaaacaggu

SEQ ID NO: 4098769 - RNA, 76 nt, Human
accuccaaauucuuuuugaaagggugauuuggcuuguguucacaacagcugcuuuuucaaaauauaauuuucaggu

SEQ ID NO: 4098770 - RNA, 95 nt, Human
accuccacccugggccuugauauaagagcuguagcuuccuagagcccuaaggagggggaguagcaggcacagccucaagaacuggggugggaggu

SEQ ID NO: 4098771 - RNA, 77 nt, Human
accucccaaagugcaaggauuacaggcaugagccacuaugcccaagccaugccucguacuuugcuauuuuuaaaagu

SEQ ID NO: 4098772 - RNA, 70 nt, Human
accuccugguaaacaaacucucaggccagucucuuaaagagacaguauguguuuguugccaucuggaugu

SEQ ID NO: 4098773 - RNA, 81 nt, Human
accucgguuuuagcccugcugugaugugaaguauuaugagguuauaccacaucccagccaagggcauuacccguaagaggu

SEQ ID NO: 4098774 - RNA, 75 nt, Human
acugauaagaaauggagaaugauauuccaucauuuggaaaaugauagaauauugggcucucugucuaaccucagu

SEQ ID NO: 4098775 - RNA, 97 nt, Human
acugaugcaauuccuucauugaguuacugccugggccacugccugauuaguuugcuguggcauugccuagaagcaguuaaugaauugcuuguucagu

SEQ ID NO: 4098776 - RNA, 63 nt, Human
acugcaacccacaggugucuauaccugacagguauaaacuaugacauccaugugaguggcagu

SEQ ID NO: 4098777 - RNA, 64 nt, Human
acugcaauuacugggagguuuuauagacaccauaaaauuguaaaacugcagaggugauuucagu

SEQ ID NO: 4098778 - RNA, 94 nt, Human
acugcauccucuucaggcuagaagccuccacgauaggguuuuaguacucacuggagcucagcgggugguuucuggcugucaggauaaaggcagu

SEQ ID NO: 4098779 - RNA, 64 nt, Human
acugcauuaggcuaaugcagugguccagguaaagaaaacugggcuuggaguaggcugaugaagu

SEQ ID NO: 4098780 - RNA, 114 nt, Human
acugcauugccaaagucacugagaaugcaggaguaucuauacauuaaacuaauacuuacugaacauaguaugugcaguuugcucuuaacauucacagacaauaaaaagaugagu

SEQ ID NO: 4098781 - RNA, 57 nt, Human
acugccaaugguaguuugaugggaguaguauugaaucuuucaaauacuuugggcagu

SEQ ID NO: 4098782 - RNA, 69 nt, Human
acugccagacugucuuccaaaguggcuguaccauuuugcaguacugagaggugacagcgugcuggcagu

SEQ ID NO: 4098783 - RNA, 57 nt, Human
acugccauuuugaauaauuacugccaaaaauaugggcuuaaucuucaacuugguagu

SEQ ID NO: 4098784 - RNA, 78 nt, Human
acugccucaacagcuagaaauauagagaacuugcaaacuucuuuguuucugucuuugcauuuuaugccguuauguagu

SEQ ID NO: 4098785 - RNA, 60 nt, Human
acugccucugccaacgccccugcacugggcagcccuggguaccuggcuugggggaggagu

SEQ ID NO: 4098786 - RNA, 75 nt, Human
acugccuugauucaugcugaugugaucgguuucaccccauugccucugcaccaucaguuugaauguuagcacagu

SEQ ID NO: 4098787 - RNA, 61 nt, Human
acugccuuuguaacucuuuuauugucuaguaauuuggaagaagaggagcacaaaggaaugu

SEQ ID NO: 4098788 - RNA, 83 nt, Human
acugcuaggcugugcuucagagucagugcuggacucaaacuaggcaguaugcaguaccuacuuugacagcacugaauaguagu

SEQ ID NO: 4098789 - RNA, 93 nt, Human
acugcucugcuccaggcuuggcacaugagucacucacuaagucuuuggagacaaauuuacuggaaaaacuaugagccaggcccucagggcagu

SEQ ID NO: 4098790 - RNA, 57 nt, Human
acugcucugugguuggaagccugaaugugaaucgcugcaaccagaccacagggcagu

SEQ ID NO: 4098791 - RNA, 105 nt, Human
acugcugcaaaaguggcacucuuugauucucauguuugagguucuaauuacuaccucaugcaggacuuacaagagaucagccaugcugcuuacauuguguguagu

SEQ ID NO: 4098792 - RNA, 62 nt, Human
acugcuucaacugagcucuaucuggccugcaaucgcuagauaugaugagucacuugaguggu

SEQ ID NO: 4098793 - RNA, 115 nt, Human
acugcuucuggcccagucuccuguguacuuuuguuucuaagccucggaagcuuagggaucuuuuguggcuggaugauggcaaggugcauggaauauagaaagaggucaggagagu

SEQ ID NO: 4098794 - RNA, 59 nt, Human
acugcuuuaaaaaagcaagcuuuugaggguguacuuuaaagcagcuuaauaaaguaugu

SEQ ID NO: 4098795 - RNA, 71 nt, Human
acugcuuucagugcuggaggggugcuugcaggagcauuguguaauucuaauccagagcuggugagagcggu

SEQ ID NO: 4098796 - RNA, 75 nt, Human
acugcuuucugcuuucuauccuugucacaguacagaaacagcuauugacaaggauaugaauggcuugauaauagu

SEQ ID NO: 4098797 - RNA, 63 nt, Human
acugcuuuugaucucuucuguacuagcuaagauaugaugucaagaacugauuaaauaagcagu

SEQ ID NO: 4098798 - RNA, 129 nt, Human
acuggaauuuuaauuuucaguguuggugguacagagauguggaugagggauuguuuuagcauaagaaauuaaaugccugucaacauagucugcagaauuaacauagaaaaaaaucauuuccagcauuuu

SEQ ID NO: 4098799 - RNA, 60 nt, Human
acuggacgucaauuaauauucuuccaaaggacuggcaggaagccaugguggacgucuagu

SEQ ID NO: 4098800 - RNA, 68 nt, Human
acuggagauagcggaacaagaaguuguggggugccuggguggucccccugcaucugucccucaccagu

SEQ ID NO: 4098801 - RNA, 57 nt, Human
acuggagguggaucuucaugaccuuaacaguaggaggucauggaaucucacucuagu

SEQ ID NO: 4098802 - RNA, 64 nt, Human
acuggauacugauuaguugagaaagcaguucaauagcaugcuugaaagccaauuugugcacagu

SEQ ID NO: 4098803 - RNA, 65 nt, Human
acuggauguuagggauuuuauuguaucacuuccaaaauguauauguugaaguccuaaccuccagu

SEQ ID NO: 4098804 - RNA, 74 nt, Human
acuggauucuacuucugcuuccauugcacaccugguuacucccaaugucaagggaagcaggaaaugaauguagu

SEQ ID NO: 4098805 - RNA, 56 nt, Human
acuggcagcauuaacagagagcaguagaagcaucaugccccucccagucugccagu

SEQ ID NO: 4098806 - RNA, 71 nt, Human
acuggccacugauuccuccccugcaggucuggaagacuauaaacagaagaaggggugagugguugaccagu

SEQ ID NO: 4098807 - RNA, 58 nt, Human
acuggccagguucaaaauacagggugcaucuuuacauaaaugauauagucuggccagu

SEQ ID NO: 4098808 - RNA, 74 nt, Human
acuggcccagcucacugcagccuuggacacauauauuggcaauggcuguuuauaauaugcagugagcagccggu

SEQ ID NO: 4098809 - RNA, 66 nt, Human
acuggccugccucccggcuucuuucuccaagguaaugaaaaagccaagcugggaaggcaggcuggu

SEQ ID NO: 4098810 - RNA, 80 nt, Human
acuggcgaccaggugaccuuuguccuaaguuucaagauucuggcucuagugucaacuuagccacauggucaucauccagu

SEQ ID NO: 4098811 - RNA, 58 nt, Human
acuggcugguuaugaggaguggcagcgcuugcuggcagcccuuucuggccagcucagu

SEQ ID NO: 4098812 - RNA, 94 nt, Human
acuggcugucuucuguuuacccugaggcaggacauggacaacuguucucuacagaaaaugaaccaucugucucagaaaagcuaggacugcuggu

SEQ ID NO: 4098813 - RNA, 67 nt, Human
acugggagaguuuggaugaaacuauugaaugaaauuauuuuggggguuucuuucuggcucucacagu

SEQ ID NO: 4098814 - RNA, 60 nt, Human
acugggccaggggcuuuggagcaugcaaagauaagcagaacauagggucuuuugucuagu

SEQ ID NO: 4098815 - RNA, 64 nt, Human
acugggcggcuggguuccucucaggccuugggcaugugagagaugaaguuaguuguuccucggu

SEQ ID NO: 4098816 - RNA, 61 nt, Human
acugggcuguaaagagaggcaaugaugaacaauuuuaagaccaucagcuuuggaguccagu

SEQ ID NO: 4098817 - RNA, 66 nt, Human
acuggggccuugguacuguaaaccgagcagucaggguuccaaugcaguccaaggcugcuuuccagu

SEQ ID NO: 4098818 - RNA, 66 nt, Human
acuggguuuaggccaggcaggcccaggccugguuucgggccuggcgccgggcugccugucuuuggu

SEQ ID NO: 4098819 - RNA, 128 nt, Human
acugguagguuuucuuggucuggguggaguuuaucuaaaagcaugguuaaagacaguggguauuuuuuuaagcagucuugagccaucuuuauuuauauuauuuacaagcuaugaagucuuaagccagu

SEQ ID NO: 4098820 - RNA, 79 nt, Human
acuggucuguuuucucuucugugggauggcaguaacauaggcuuucuccucccaggguggccaggagaaauggaugagu

SEQ ID NO: 4098821 - RNA, 57 nt, Human
acugguuucccauuaucugcaggaucaaguccagacuuccugauaugguaaacuagu

SEQ ID NO: 4098822 - RNA, 57 nt, Human
acuguaaaguuacgaucaaguuguaaccacaauuuugcccuugaagaauuuugcagu

SEQ ID NO: 4098823 - RNA, 56 nt, Human
acuguaaccaguguggugagagaaacaauucuggucuaguccacaugguuaccugu

SEQ ID NO: 4098824 - RNA, 129 nt, Human
acuguaagcauuuuuccuuucauaauugagauuuuguugguuguguugaggaccaguccacagauaucucaauuuguacacaauucuuaacauacguaccaagaaucuaaaaagcuuauguguugcagu

SEQ ID NO: 4098825 - RNA, 73 nt, Human
acuguaaggagguugguggguuggauuggggcuuuuguggaacuaaauccaccccaucugcuauucuugcagu

SEQ ID NO: 4098826 - RNA, 63 nt, Human
acuguagcugccacuggaugcaaagcaguaccuguuuacuuuagauccagugaaucagccagu

SEQ ID NO: 4098827 - RNA, 92 nt, Human
acuguaggugggacuuaauaacauaauuagaucuuacucccaugaauagguuauaucuuaugggaaagauguaauuaaggucccuaaucagu

SEQ ID NO: 4098828 - RNA, 106 nt, Human
acuguauuaugggagagcaugugggaugggagauauugcuguggcugucuuugaaaauacaaucugucguguuuccccuuccuuucuguuuuccagcuacacuagu

SEQ ID NO: 4098829 - RNA, 109 nt, Human
acuguauucuuuaaggggaaugauuuuggugggggaauauauauauguaaaggauuuuucaugugucuaaucuacuaauauccuuuucuucuuucuuuuaaaauauagu

SEQ ID NO: 4098830 - RNA, 62 nt, Human
acugucacuacuauguguuugugguuuacuugucugcagccacauccuagagaagucacagu

SEQ ID NO: 4098831 - RNA, 100 nt, Human
agacaugcacacgccagggucucucccuguauuuucaggaauauggagaagccaucgucuuccugaaaauacagggagacccccugucgugugcaugucu

SEQ ID NO: 4098832 - RNA, 74 nt, Human
agacauuaugcugagugaaagaagcuagucacaaaaggcuacauauuauauaauuucauucauaugaaaugucu

SEQ ID NO: 4098833 - RNA, 76 nt, Human
agaccaaacacaagucucaacagcagccagcugccaugggccucacgcuguugggcugucaugagacuaguggucu

SEQ ID NO: 4098834 - RNA, 71 nt, Human
agaccaaagagagggauuugguuuauugcuagugcagaaguuaaaaaccaucuuccuuuccugaguggucu

SEQ ID NO: 4098835 - RNA, 79 nt, Human
agaccaaaugcucuggaguacgugaaauuugucuaucagcaaaucaacagacuaguuaaccuuucuccaggcagugucu

SEQ ID NO: 4098836 - RNA, 78 nt, Human
agaccaaguacaugcuaggaauuccagucaauuaaugguuauaauuuacaugcaacuaggagguucuuagcuuggucu

SEQ ID NO: 4098837 - RNA, 70 nt, Human
agaccaaguuucucuauuaggggcuagcuuuagagaagcaaguaggcugaagagaaagaaaaacuggucu

SEQ ID NO: 4098838 - RNA, 59 nt, Human
agaccacuggccuccugcagacuuucucuugauggggggugagggaggagugguggucu

SEQ ID NO: 4098839 - RNA, 64 nt, Human
agaccagaaggaaguuuauuuuagaagagauacugccucucuuucuuucucuuucucuggugcu

SEQ ID NO: 4098840 - RNA, 64 nt, Human
agaccaguuaguuuuauagcacaaaaucagaaggugagccagugugguaaagcugaguaggucu

SEQ ID NO: 4098841 - RNA, 81 nt, Human
agaccauaaauuguauauuccauuuguaugaaauauccagaauagguacaucuauagagacagaauguaaauuagugguuu

SEQ ID NO: 4098842 - RNA, 82 nt, Human
agaccaucugauaguguaaauuccaggcagguucuaaaucuguuucccaaggagcuuucuggauauaacauucaguccuucu

SEQ ID NO: 4098843 - RNA, 130 nt, Human
agaccaugagaggaagaagggguucucuaacgucugcucagugaaacaucaaauagugacuuuauuaguuaaugggauaauuguucaugggagaucauuagagagcccaaaucaaagaauuucuuaggau

SEQ ID NO: 4098844 - RNA, 72 nt, Human
agacccacagggacucgguugagugccccugguaucugcgaccagggcacccucucugcaguaccccggucu

SEQ ID NO: 4098845 - RNA, 80 nt, Human
agacccaggcugaucccagggagccccaauuccaugccuuuauuaucacaagggaggauggcucucggacauuuggguuu

SEQ ID NO: 4098846 - RNA, 69 nt, Human
agacccguccugccugagccccauucucucccuuucccaggauggcagcugaauggcuggaugggaucu

SEQ ID NO: 4098847 - RNA, 83 nt, Human
agaccuccaaucaauaggugauaugagcugggcuacaucauuagucagggcuaauuagaaucuaguucauucauuugagguuu

SEQ ID NO: 4098848 - RNA, 82 nt, Human
agaccuccuccuuccuggcuaggagagcugggcucugggcagcagaucccagggccgcucccacaguagaaggauggaggcu

SEQ ID NO: 4098849 - RNA, 72 nt, Human
agaccugggacagagugagcuuuggccaugcacagcgugucugaggacucucucucucuguccaggaggucu

SEQ ID NO: 4098850 - RNA, 56 nt, Human
agaccugguuuaucaccagcauuuauaaaaacagacguagggaaagaacuaggucu

SEQ ID NO: 4098851 - RNA, 63 nt, Human
agaccuugucuuuaagcccacacugaagagugaaaguauuucauguggaaaaggaucuggucu

SEQ ID NO: 4098852 - RNA, 57 nt, Human
agaccuuuucccacauuagguaacauucuuaguuucuagggaaugggaugaggaucu

SEQ ID NO: 4098853 - RNA, 81 nt, Human
agacgcuugccauuccuacuuugacuggguggagauguggaaaucuuguuauucagaggugaaguagggagggcaaguucu

SEQ ID NO: 4098854 - RNA, 78 nt, Human
agacuaaggcucagaacuacauggacauguuaagugucaaacgcuuggagccaaacugguccuggccuaggaaagucu

SEQ ID NO: 4098855 - RNA, 76 nt, Human
agacuagguuaugcuguauuugugucagauugcuuuguuuaaugacacaugauuaaugccaagcauagucuaguuu

SEQ ID NO: 4098856 - RNA, 61 nt, Human
agacucagaagguacagaagggaaguaucucccagccacccuguugcucucuccugaguuu

SEQ ID NO: 4098857 - RNA, 55 nt, Human
agacuccauggggaaaugaagguggcugaaaaacucugucaucuccauggaguuu

SEQ ID NO: 4098858 - RNA, 62 nt, Human
agacucuggcuuugguccccugugccugcaaugcaggcaacaaacaaccaagcucagccucu

SEQ ID NO: 4098859 - RNA, 78 nt, Human
agacugagauucuuucaugcaguugacaaggugucuucuccaaguacuuuaucuaccugcagauggagaucauggucu

SEQ ID NO: 4098860 - RNA, 130 nt, Human
agacugcaccaaaguggggagagaucaaaagaccccguuuucagacugaagauuccaaaccuguacuuggaacaacucuucuugagagauggguggcuagucugugugccucucugcaacugcugcuuau

SEQ ID NO: 4098861 - RNA, 66 nt, Human
agacugcauuaagaauuucugaggauguggcauuugaguugcaaucugaugguucauagugggucu

SEQ ID NO: 4098862 - RNA, 57 nt, Human
acucauggugaacaugucuacuucccuaaauaaauaguuuguaaguucauuaugagu

SEQ ID NO: 4098863 - RNA, 81 nt, Human
acuccaagauauuuguagaaucacucaaucuuaaaugaaaaaaucaaaaugaucaggaagaucuagcgaaugucucagagu

SEQ ID NO: 4098864 - RNA, 68 nt, Human
acuccaagggcuuugcuggggccccaagguuaauguugaaggggcuuucaaagacuuucccuuagagu

SEQ ID NO: 4098865 - RNA, 72 nt, Human
acuccaccucucgccaccggccacaccgcgccccaaaccggccuggaggucgcuagcgagcgggcuuggggu

SEQ ID NO: 4098866 - RNA, 65 nt, Human
acuccacucugggccaccgcugguguauccaagaucaggacaccagucccugggcaccagggagu

SEQ ID NO: 4098867 - RNA, 64 nt, Human
acuccagaaaggagacuucagaucuccuucuaaauucuagaagucuuuagucuccuucugaagu

SEQ ID NO: 4098868 - RNA, 62 nt, Human
acuccagguguauuuacugaaguaaaaaaaucacuuguauuuucuucagaugcuuuuggagu

SEQ ID NO: 4098869 - RNA, 73 nt, Human
acucccgcugacgcacugaaggcugguuaccgagugccagcugggggccagcuucgcgugcucuuccgggagu

SEQ ID NO: 4098870 - RNA, 58 nt, Human
acucccucuguguucucuagcucaauaaagucacccagcaaggcagaccagagugagu

SEQ ID NO: 4098871 - RNA, 65 nt, Human
acucccuugaaaguauaugcucaauuuugugggaauuagcuuauguguacuuuucugaggagagu

SEQ ID NO: 4098872 - RNA, 101 nt, Human
acucccuugcacauccaggcuaugugccugagugcugagcgggcacccucagguauccugggcugcacccucagccucugggacaccaagggcaagggggu

SEQ ID NO: 4098873 - RNA, 58 nt, Human
acuccgggguagauggcugggguucaauucuugacucugucacuuucugcuguggagu

SEQ ID NO: 4098874 - RNA, 59 nt, Human
acuccucccagcauuguacagaugaaagaaagaucauuucacaggcucagggagagagu

SEQ ID NO: 4098875 - RNA, 126 nt, Human
acuccugcuugauuuuacugucaacuuuaucuccagcguccagcccugucuaugacugaugaucuauaaauaucuuagaguaaauggcuaaugcaugagaaaguggcagacaaaaagaaaaggagu

SEQ ID NO: 4098876 - RNA, 70 nt, Human
acucggauggauauaauacaaccugcuaaguguccuagcacuuagcagguuguauuaucauuguccgugu

SEQ ID NO: 4098877 - RNA, 59 nt, Human
acucuaacuaauuaauaaagccaaguaguguguguuggcuauaggaaaaguguuagggu

SEQ ID NO: 4098878 - RNA, 124 nt, Human
acucuacaauuuagauuuuaauuagauaauuaacguaguguguuguggaaagagcccuggacugggguucuaguucccacauaguugccuuaaacuuucuacaaaccacuaaaccuucccgagu

SEQ ID NO: 4098879 - RNA, 77 nt, Human
acucuacuucugcagagaaaacuccuggguacuucuaauaagaaagauacacuggagcuuccugacaggaacagagu

SEQ ID NO: 4098880 - RNA, 77 nt, Human
acucuaugauguagcuuuuguuauuagccucauuucagguaaggaaacugaggcuuacaaagguaaagucuguaagu

SEQ ID NO: 4098881 - RNA, 63 nt, Human
acucucaguggauugacaugaaaaaggcugauugcuuuauaauuaucacaguccagugcaggu

SEQ ID NO: 4098882 - RNA, 76 nt, Human
acucucucuguccuaugaguacucacuaguuugucaaugaccuucuuagugugcagugcucaggguuagauacagu

SEQ ID NO: 4098883 - RNA, 61 nt, Human
acucucugggcaugccccaccagagcaauuacaggugauggagcugggcagcugggaaagu

SEQ ID NO: 4098884 - RNA, 61 nt, Human
acucugacuuccuuuucugauccaguugauaauugauccgaaacuugaaggaagugagugu

SEQ ID NO: 4098885 - RNA, 65 nt, Human
acucugcccuaggccucuggggcuccacugagaaacugagauuucacugaggucagggguagggu

SEQ ID NO: 4098886 - RNA, 76 nt, Human
acucugcuuguuacauguguguguguugcaugugugaauguacauauguacaagcacacaugugacauuugccagu

SEQ ID NO: 4098887 - RNA, 77 nt, Human
acucuggacugaggcugaagagggccuacgggaggccauauuauaacuucugugggcccuaggcaccuugucuuugu

SEQ ID NO: 4098888 - RNA, 60 nt, Human
acucugggcaggagaggugguuggaauugggaaaacuaaucuggcagcaguuuguugagu

SEQ ID NO: 4098889 - RNA, 113 nt, Human
acucugggggugggggcgcggggguacccagcagcaggccaggcccuccaagggacuggagggacuaguuggaugcuucugugucaccuugcaccccagaauuccuccagggu

SEQ ID NO: 4098890 - RNA, 59 nt, Human
acucuguaauuuucuuagauuuggagaaaagccggcucuagaacugacgauuucagagu

SEQ ID NO: 4098891 - RNA, 64 nt, Human
acucuguacucuagaggaaguggucaguagagaucaguugagaguuacauuucuaagacagagu

SEQ ID NO: 4098892 - RNA, 75 nt, Human
acucugugauccacucaugaauaucuggucuggcucugcguuccagucagacccuuuucugagaggaccacaagu

SEQ ID NO: 4098893 - RNA, 60 nt, Human
acucuucuagagcuggagcaaaugucacugcucuguguaccuucuccuccucuaggcagu

SEQ ID NO: 4098894 - RNA, 85 nt, Human
acucuucugcaccccaugcagauuguucauagacauggggcagcuccuccgaugccagaagagucugcagggauaccagaaaagu

SEQ ID NO: 4098895 - RNA, 63 nt, Human
acucuugaacugauuaagaauggaucauaaaauaaauuuacauucaugauacaguuuuagagu

SEQ ID NO: 4098896 - RNA, 56 nt, Human
acucuugcagauaccuugaaggauggaggcauaucugggguaaguugagcaagagu

SEQ ID NO: 4098897 - RNA, 94 nt, Human
acucuugugccugaaaauguuagugauacgaauugacacuuuaauguuguaugcuugguggggaucuuuuuaucacaaggcauuuuccaagagu

SEQ ID NO: 4098898 - RNA, 91 nt, Human
acucuuguuuuggauguauaguuuuagaaaauacucacuuuaaaaauguauuggauggauaguggugaaggcuguacaacgaaacaaaugu

SEQ ID NO: 4098899 - RNA, 62 nt, Human
acucuuuccaaugcauuuccaaugugcagugcacauguaucugaucugcaauuggaaaaugu

SEQ ID NO: 4098900 - RNA, 72 nt, Human
acucuuuucauccauaguuugguuggacuauauauucauauauuccuucuauucucuguggguaaggacagu

SEQ ID NO: 4098901 - RNA, 70 nt, Human
acugaaaaaugggagugugcauuugucuuuagagacauucucugaagauuaaauggcucccauauuuagu

SEQ ID NO: 4098902 - RNA, 88 nt, Human
acugaaaaucacuuguaaggaauucaauucaauuucuuuaaucuuugaacucaugaaauuaaugcaggugagguuauuuguuuucagu

SEQ ID NO: 4098903 - RNA, 57 nt, Human
acugaaaaucuugugagaucugugacagcaaggcucucagcagaaagcaaggucagu

SEQ ID NO: 4098904 - RNA, 79 nt, Human
acugaaagcacagggacuuuaggaauauguuaccuaaccuggcaacuuaauccuuucccugcugcuucuaaaagucagu

SEQ ID NO: 4098905 - RNA, 127 nt, Human
acugaaaggcguccaaauacccuuacaguuagauugucgagucguggcuuaggugcuugcuaacagccaggaauuggacaacacaucuaaaaggugcuuagggaugaggaugggccugacuuucagu

SEQ ID NO: 4098906 - RNA, 84 nt, Human
agagaugguaaaccuugcauauuuuugaaagcauuugaagaccucaaaucaacuguuuauguaaguaugcagcuuuuauucucu

SEQ ID NO: 4098907 - RNA, 72 nt, Human
agagauuaugagugucugcaagccaggaagagggcccucaccaagaacagaacuugcuggcauuugaucucu

SEQ ID NO: 4098908 - RNA, 66 nt, Human
agagauugcuagcuggcuuuaauaguugucaaaaguaauagaacuaauuuuuagcuagcauuuucu

SEQ ID NO: 4098909 - RNA, 77 nt, Human
agagauuguucaaugaugagaacuggaguaauuuaagaguaaacuucuaagacuuaguuuuaucuagaacacuuucu

SEQ ID NO: 4098910 - RNA, 67 nt, Human
agagauuuggaaauacgcguaggcagauuaggaugaaaaucugcucacguguauucuccauuuuuuu

SEQ ID NO: 4098911 - RNA, 81 nt, Human
agagcaacauuuugcuauuaggguccugucaucucauuacugcuugaugugauugacaacccugguaugagcagucugccu

SEQ ID NO: 4098912 - RNA, 91 nt, Human
agagcacuggucauaguuccuuggagaauccugguuauucauaaggcaagaauaugaauucucuuuccuggagcauagaccaugugccucu

SEQ ID NO: 4098913 - RNA, 85 nt, Human
agagcagaccaggagugcacagguggcugcccugucagccuuuuccgggaguggugguggcgcuugcaacaacugcucuggcuuu

SEQ ID NO: 4098914 - RNA, 72 nt, Human
agagcagcaggaaagacaucugagcauuuuguaguuaaagucaauauugcuuacgauuucuuccagugcucu

SEQ ID NO: 4098915 - RNA, 71 nt, Human
agagcagccccuccaggcccaagacugaugagucucagccaugaggcccagccuggggugugggggccuuu

SEQ ID NO: 4098916 - RNA, 79 nt, Human
agagcagcugaggcaguuugccaugccaggaggcuuuuccuucuuugauauuucuggagggcaugcugcugccugcucu

SEQ ID NO: 4098917 - RNA, 58 nt, Human
agagcagcuuugaucucacuggcaguuuguuuagaagccugagaucuggaguggcuuu

SEQ ID NO: 4098918 - RNA, 56 nt, Human
agagcaggugguagacuuaacucuuucuuggcugggaguaugauccacucugcucu

SEQ ID NO: 4098919 - RNA, 79 nt, Human
agagcaucccggcugacccugcaggucuggagugaaaagacccugcacuggacucuucagggcagugagcgggaucucu

SEQ ID NO: 4098920 - RNA, 79 nt, Human
agagcauccucgccuccccccacucacccauauuuuauugucaguucuuuugcaagggugaaggcagaggacauguuuu

SEQ ID NO: 4098921 - RNA, 78 nt, Human
agaaagggaaaacaagagaaugauguuugcaauccuaaacaacaaaaauauuuauuuucuuguuuuaaguuauuuucu

SEQ ID NO: 4098922 - RNA, 129 nt, Human
agaaagggcuaagagagaaaggccaggcuuuugaagacauuguauacagacuuagucagcuggacacuucucugcugggcugcugucaaguccuuccuguccuauuccucucacaaccauguccucucu

SEQ ID NO: 4098923 - RNA, 63 nt, Human
agaaagguauuguucccuaguuucuaggcuugcuucuagagagguuaguuugcaguacuuucu

SEQ ID NO: 4098924 - RNA, 65 nt, Human
agaaaguacucucauaacuugggcuggaaugaauauuucaugcucaucauuagagugacauuuuu

SEQ ID NO: 4098925 - RNA, 106 nt, Human
agaaagugggguaagaaagggcacauggcacaguuaaaguuguagaaaucaaauuacuaucauuuuuuguugccaaaacaaagucuuacauuuaaccccccuuucu

SEQ ID NO: 4098926 - RNA, 59 nt, Human
agaaaguuugacucucuagauagcaaccguccagguuucugucuugcugucagcuuucu

SEQ ID NO: 4098927 - RNA, 128 nt, Human
agaaauaaaccacuguagugggccaggagggaacaauaugaacagucauuuagaaugugcugcugcagagagaauaacuaaauggcaguucuuugaagccacuuugcuaaacuauaguuuguauaucu

SEQ ID NO: 4098928 - RNA, 119 nt, Human
agaaauauaggucaaacuaggggaauacaagcccaaaugucucucuaaauaaacuuuucuuugacuucucugagaaaaguugauuuggagggauauucuccucuuugacacuguuuucu

SEQ ID NO: 4098929 - RNA, 57 nt, Human
agaaaucagaacccugaaguucuguucccagcuuuagguaagccccuuuugguuucu

SEQ ID NO: 4098930 - RNA, 81 nt, Human
agaaaucuagguucucaagaaggaugccagacaacuggagacuuuucucuaugucagcaucuuucuacccugacaaguucu

SEQ ID NO: 4098931 - RNA, 130 nt, Human
agaaaucugaaaucaagguguugacagggcuguacucccucagaagacuuuagggaagaaucguuccuugcuucuuccuggcuucugguggcucccagcaguucucgacaguccuugguuuguagcugcu

SEQ ID NO: 4098932 - RNA, 58 nt, Human
agaaaugagugguggagccaaaaugaaaaucuucaguuugacuccagagcccauuuuu

SEQ ID NO: 4098933 - RNA, 111 nt, Human
agaaaugggcugugucuucuaaacauuaugauaguagaguuaacauugaguuguugguucuuuaaagaaauuaucucugauguaggcauuguauuuccuagccuuaauucu

SEQ ID NO: 4098934 - RNA, 70 nt, Human
agaaaugguugcuagcuaugucuacuuucacucuuccuauaucuguggaucauaaaauugcaccauuucu

SEQ ID NO: 4098935 - RNA, 74 nt, Human
agaaauguacacagagcauuucuaugucucgagccaacuggaagggaaggccuagggaugcucugcgugccucu

SEQ ID NO: 4098936 - RNA, 67 nt, Human
agaaauguuuauggcugccuauuauaagucaggcucugugcuagguuaugggcacccaaaaaugacu

SEQ ID NO: 4098937 - RNA, 55 nt, Human
agaaauucacccuggagaaguaguauugagucacuaguucacaggccaaauuucu

SEQ ID NO: 4098938 - RNA, 129 nt, Human
agaaauuuaaaaauacgguauuuacucuuaaggaaggaauagcuuaguagguaaaauuauaauacagcguuauaagaaacuuaacugggaacuauaccaccuggucauuuaacccaguuuuggguuugu

SEQ ID NO: 4098939 - RNA, 70 nt, Human
agaaauuucaugucuucuugaacuuugagagagacguccauuuuggcagaggaagaaggcacauauuucu

SEQ ID NO: 4098940 - RNA, 83 nt, Human
agaacaagcugcugcugaacgagcuggccaaguuccgcucggagcacgagcuggacguggcgcugucggaggacaguuguucu

SEQ ID NO: 4098941 - RNA, 69 nt, Human
agaacaaguagcccugugcucuggagaaugauuuacagugguucucuuccucagccuggggccuuuucu

SEQ ID NO: 4098942 - RNA, 74 nt, Human
agaacaauguuuaaaggagucagagacucaaagacaauagauuuuccaaguugauggcucuauucagcaguucu

SEQ ID NO: 4098943 - RNA, 66 nt, Human
agaacaugaaguuuucuauagugaagauagucuuuacuuauagcucauggaauuguucacuguuuu

SEQ ID NO: 4098944 - RNA, 79 nt, Human
agaaccaaaaggcagaggaaggucuaguuugcucucacuucuugagcuaaggcauccaucuucuugugucccugguucu

SEQ ID NO: 4098945 - RNA, 75 nt, Human
agaaccaucguccagacucugcucacaugccucucuccuugcuucacagaggaucugggcaucuggagugguccu

SEQ ID NO: 4098946 - RNA, 65 nt, Human
agaacccuaaguucaugagaaguuaacugaguuacucaguuucuuuacucauagaaugggggucu

SEQ ID NO: 4098947 - RNA, 59 nt, Human
agaacccuagcauguccuuuaggaugaagugaaucacguucugagguaugauagggucu

SEQ ID NO: 4098948 - RNA, 71 nt, Human
agaacgugagaaggaaaggaucagugucuaucuucagagaccaggcuuaauccuuugcuauccaaacgucu

SEQ ID NO: 4098949 - RNA, 94 nt, Human
agaacuaaaaugagcuguggcaaccuugucagacugcauuuuacagccuccuuuguagucugcuauaugaguugcccuggccaaauauaguuuu

SEQ ID NO: 4098950 - RNA, 58 nt, Human
agaacucuaggauuggcuggauagagcuuuagcuuuucagucaggagccaaggguucu

SEQ ID NO: 4098951 - RNA, 86 nt, Human
agaacugcugcuagaauccaaauuuaccuuacagauaucacaaaaguuaagugguguuacuaaaauuugauucuuaggacguuucu

SEQ ID NO: 4098952 - RNA, 80 nt, Human
agaacuggaaucaggaacucaagugcauugaggaucucucugccccucagagcugcuucccaguuuguggucccgauucu

SEQ ID NO: 4098953 - RNA, 64 nt, Human
agaacugguuacagagggauguugccguaaucaaaacacaacuuccugacuucuaaugaguucu

SEQ ID NO: 4098954 - RNA, 56 nt, Human
agaacugugucacauggccacuccuagcugcaagggaggccaggaaauguaguucu

SEQ ID NO: 4098955 - RNA, 74 nt, Human
agaacuuaggaacaacagcuuaggggacucuuugacuuguccuuauccuucuuugccuguguucucuaacuucu

SEQ ID NO: 4098956 - RNA, 100 nt, Human
agaacuuugagcagaaacuugguguauuagcucucacugcccuaccaaaauaccacagcauggguggcuuaaacaacagaauuuuuuuucucacaguucu

SEQ ID NO: 4098957 - RNA, 60 nt, Human
agaagaaaugaggccguucugcuauaaaaucauguguaguaguuauugcuguuuacuucu

SEQ ID NO: 4098958 - RNA, 71 nt, Human
agaagaccuggagaauggaaaguaaagguaaucucauccaaaacaaauacaccauucccagguggauuucu

SEQ ID NO: 4098959 - RNA, 57 nt, Human
agaagacugaguucaaaucacagccucuuccuagcugugugaccugggcaagucucu

SEQ ID NO: 4098960 - RNA, 65 nt, Human
agaagagccacuguugacggcacggcagagcaagauggcaggguugagugugcagcggcuuuucu

SEQ ID NO: 4098961 - RNA, 55 nt, Human
agaagagugggcuggcacaaggcagcagcuacgcucugcucagaccaacucuucu

SEQ ID NO: 4098962 - RNA, 82 nt, Human
agaagauggguuggggaaaggcagggcaggcucuuccugguaacacgggcgaccaggcuuggcugucucccagcccagugcu

SEQ ID NO: 4098963 - RNA, 72 nt, Human
agaagauuguuguauagagggcaugaaucuaaugucuuagaaauuaguccuuuugcaaaucaaaugucuucu

SEQ ID NO: 4098964 - RNA, 71 nt, Human
agaagcaggggcuccuccacagccaugaugcaacacugaaagcugagcucugaugagggccaccuucuuuu

SEQ ID NO: 4098965 - RNA, 130 nt, Human
agaagcaucccgggcuacauuuucaucuucgccgucuuccaaucuugcauaaucuauaauaaugugauuccaaaugcauuuuagcaaaugcaagauggaaugggacucccccggcugcucccgaacaucu

SEQ ID NO: 4098966 - RNA, 82 nt, Human
agaagcauuuguuccagcuauugcuguguaacagucauccauacuuaguggcguaaaacaacaauaguugauuauuguuucu

SEQ ID NO: 4098967 - RNA, 73 nt, Human
agaagccagaguuucugccuccugggcuaaggcucugggcuccauucccaggaggaggaaaaagcucguuucu

SEQ ID NO: 4098968 - RNA, 92 nt, Human
agaagcccucugccucugaguaggacacccuccucuccuucccuccccugcagcugggucugggcuguccuguucuggcgugagugguuucu

SEQ ID NO: 4098969 - RNA, 67 nt, Human
agaagccucacuguccagcccccagcaucacagguauugaauggugagcagcagcaguggggcuucu

SEQ ID NO: 4098970 - RNA, 75 nt, Human
agaagcuaggaagaagcaaggaaagauucagagggagcauggcccacccugcugaugccuugauuuuggacuucu

SEQ ID NO: 4098971 - RNA, 67 nt, Human
agaagcuauaacaacaauuauagacacauuauuaucaacgugguauguaauauuuguuaagguuucu

SEQ ID NO: 4098972 - RNA, 84 nt, Human
agaagcuccuuaccgaggagugugaaggcuugucgagucuucucaaaguccucagcaucguccacacccucgauggaagugucu

SEQ ID NO: 4098973 - RNA, 118 nt, Human
agaagcugagagaaggaaacugggguuaauguuaugcaaugccuugagugcugugauggagagccugccguggaagcacuuggguuuuguuguuguuguuggguuucuuucuguuucu

SEQ ID NO: 4098974 - RNA, 56 nt, Human
agaagcugccuacaugaccagcccccaauaaaagccuugguuauuucuaagcuucu

SEQ ID NO: 4098975 - RNA, 80 nt, Human
agaaggaaaagaagacagcaagaaugagaaagugaaugaaguuaauuucuuugaacuuggcugaucucucagaaacuucu

SEQ ID NO: 4098976 - RNA, 58 nt, Human
agaaggagacagaaaauucaggauauaauaacuaaucuuauauccuucuguucuuucu

SEQ ID NO: 4098977 - RNA, 130 nt, Human
agaaggagacguucgugugggucuuugggaaaggaggaauguggccuagggaggagagaagcugauuucaagcuccauucaaguguuacaucguuaccucucucuguuuggcauguuuccaucuguuucu

SEQ ID NO: 4098978 - RNA, 80 nt, Human
agagccaagacaucuuugccugggaauucuaguguauccaucauaauuggguuuauuuuacccaguaaagagagggcuuu

SEQ ID NO: 4098979 - RNA, 61 nt, Human
agagccugaggccaggaaaauggcaugugaaagcccuucuucugcagcugccucuggcucu

SEQ ID NO: 4098980 - RNA, 90 nt, Human
agagccuuaaauagcccugaaaguacacugggacgguuugcgauggaauuaaaauuggaagugaauauuuuuaggugcucuugaagcuuu

SEQ ID NO: 4098981 - RNA, 98 nt, Human
agagcgaggugcucccggacaggcuggcugagcugcagccugcauccucugugcugccacaaauucagcugccuauugggggugucggcaccagcucu

SEQ ID NO: 4098982 - RNA, 92 nt, Human
agagcuaaggaaagcugagagcugugucaagauaauuguccuccucugaauuagcagauaucuuucagcuguuuucaguucuccuuaucucu

SEQ ID NO: 4098983 - RNA, 58 nt, Human
agagcuagggguagucaggagaccugcauuguaggcaaggcuuuuacauccuagcucu

SEQ ID NO: 4098984 - RNA, 66 nt, Human
agagcucagaggggagagaggccagccccacagugauggggaguccagcccuccucacugagcucu

SEQ ID NO: 4098985 - RNA, 60 nt, Human
agagcucccugcugauggagcugcccagacugagccugucagugauuuguagggaauucu

SEQ ID NO: 4098986 - RNA, 61 nt, Human
agagcucuuauaguucuagcaguugguucccuagaaguggcuguuauagguaaaguguuuu

SEQ ID NO: 4098987 - RNA, 61 nt, Human
agagcugcuugggaaccaucaauuacugaaucgaagcaauugagggagcccggcgcggccu

SEQ ID NO: 4098988 - RNA, 61 nt, Human
agagcuguguucaugaggagaaauauuuuaauauauaauuuauucucagauacauaggucu

SEQ ID NO: 4098989 - RNA, 69 nt, Human
agagcuuacaugugaguaaauuuaauguuuaaaguguaaauauauagauagggcucacaaaguaguuuu

SEQ ID NO: 4098990 - RNA, 112 nt, Human
agagcuuguucauggcuaaaaaccauucuaauaucauuccugagggaguugacuuacagaaggauggccucccuccagaauggugaggaaguuuagcugugguuucuacuuu

SEQ ID NO: 4098991 - RNA, 57 nt, Human
agagcuuugggacauuugcuaggacaccggauauucuggcauuuaugaaccaagccu

SEQ ID NO: 4098992 - RNA, 58 nt, Human
agaggaaauggauaaagggugacaaucucucugccucuccccuuauccauccuucucu

SEQ ID NO: 4098993 - RNA, 78 nt, Human
agaggaaauguggcuuuaagagauuuaggaacauuauuuuaaaagaagacaauguuucucuuuagucauucuucuuuu

SEQ ID NO: 4098994 - RNA, 62 nt, Human
agaggaagauuuuauuaaccagguggaugggaugaccuguuuuggggauggcagucuccucu

SEQ ID NO: 4098995 - RNA, 117 nt, Human
agaggaagggucacuaugcaguggucaggagcacuagcuugagucagacugcucagcucugccaccagcugugugacucuaagcaaguuacuuaaccgccuugugccccauucuucu

SEQ ID NO: 4098996 - RNA, 60 nt, Human
agaggaauaaauuucuguagugagauaguuacccaaacuacaacaguuauuuauuucuuu

SEQ ID NO: 4098997 - RNA, 55 nt, Human
agaggaaugcagccaacccuuccagggacaagaaggacuuggcucuauugccucu

SEQ ID NO: 4098998 - RNA, 60 nt, Human
agaggaaugucaaggcagagcccagucuggaaccagaccccagguggccuugacuucucu

SEQ ID NO: 4098999 - RNA, 60 nt, Human
agaggacauugcugaaaggaagguaguuaauuaagcugaauucugcuguagcaagucccu

SEQ ID NO: 4099000 - RNA, 61 nt, Human
agaggagagaagcuaacggugcucaucguguggcacgcaggugcguuguuuucucuccacu

SEQ ID NO: 4099001 - RNA, 62 nt, Human
agaggagccaagaaacaauauugguaggugagaucuccuaacuuuuacauuuggcucacuuu

SEQ ID NO: 4099002 - RNA, 108 nt, Human
agaggagggagcuggagugagggagcacacuuguuuucagccuucagccuggcuuccaccuuccuggcuggcuagcagagugcauccuucuauaucagcucagccucu

SEQ ID NO: 4099003 - RNA, 64 nt, Human
agaggaggggcaggggguggccagaccucuugcuuucacucuuccacuuccugcccgcuccuuu

SEQ ID NO: 4099004 - RNA, 55 nt, Human
agaggccagcccugggcugagagaggaagccaccaucucucacggguugguuucu

SEQ ID NO: 4099005 - RNA, 64 nt, Human
agaggcccagcaucuugugaaguuucuagagagaaacuuuguagagaaugcuggcauauccucu

SEQ ID NO: 4099006 - RNA, 70 nt, Human
agaggcccaugggugcaugugcuguucccuuuguuauauugugcaggcaggugauucacccugggccuuu

SEQ ID NO: 4099007 - RNA, 62 nt, Human
agaggccccaggugagcaugccugcuguagaauuaagcuguauuucuccaagggggcccucu

SEQ ID NO: 4099008 - RNA, 59 nt, Human
agaggcccugggcuggugugcuucaggggacaaagaagugggccacaucccagggcucu

SEQ ID NO: 4099009 - RNA, 104 nt, Human
agaggcgcaaggagauuuagagccucgagcagcugaggcaguggcaguuuucccacugcaucgcucgcuuagguccucuacauuaucacccaucacgugccuuu

SEQ ID NO: 4099010 - RNA, 70 nt, Human
agaggcgggcagaucaccugaggucaggaguuggagaccagccuggccaacguggugaaacccugucucu

SEQ ID NO: 4099011 - RNA, 72 nt, Human
agaggcucgcugaggcugcacggcugccugggagaggcucgcugaggcugcacggcugccugggcggccucu

SEQ ID NO: 4099012 - RNA, 78 nt, Human
agaggcucgguuagaaggccugguguucauucauucgggaacugcuuguuaagcuccuggucuuuguccagagcuuuu

SEQ ID NO: 4099013 - RNA, 69 nt, Human
agaggcuuggcaggugucugcggcuccccagggguggggugcugggaggcugacaucuguggaguguuu

SEQ ID NO: 4099014 - RNA, 70 nt, Human
agagggagaagaaagccucuuguguugagauuaauguaugcuauaagagucuuguuuucuuauuuccuuu

SEQ ID NO: 4099015 - RNA, 82 nt, Human
agagggcacauucccuuggccucauggacagcucauccuuagggaagguuguggcuggaugaggcccagagugaagcucucu

SEQ ID NO: 4099016 - RNA, 58 nt, Human
agagggcauacagggaagugggggagcugaucacagcucuuuacucugcaaugauucu

SEQ ID NO: 4099017 - RNA, 71 nt, Human
agagggcccacugggcaggccaggacugguaaaaccuugaauuuccccucugguugacccaggagcuguuu

SEQ ID NO: 4099018 - RNA, 56 nt, Human
agaggggagagaguucagagguauuaggucucugaggcacugggccucugcccuuu

SEQ ID NO: 4099019 - RNA, 66 nt, Human
agaggggcagggucuccggauucuuugccaugacuguggaagacuuuccagggcccuggcuccucu

SEQ ID NO: 4099020 - RNA, 105 nt, Human
agagggucucacaggaggugacauguagcuagaauagagguaagagcaagcuaccagagcugacuggcuuuguucugauugcuucuuucugcuuugagaucuuuu

SEQ ID NO: 4099021 - RNA, 55 nt, Human
agaggguggcacuugcuguagaaucuggaaguucugucuucugcugucguccucu

SEQ ID NO: 4099022 - RNA, 62 nt, Human
agagggugggcuccuaucuggguuacuggcguaaugucccugcccucugggaucccuccucu

SEQ ID NO: 4099023 - RNA, 56 nt, Human
agagguaaagagaggggaaauuggcaggagugauugcuugccuucucucugccucu

SEQ ID NO: 4099024 - RNA, 85 nt, Human
agagguacagaggucaggcagcuccaggaaugguauuccaggaaucugguuuugcuucuuaguagcuguguuggcucugaccucu

SEQ ID NO: 4099025 - RNA, 66 nt, Human
agagguaccaagugcugcacuguggagagggucacauggcacagaacagcaggcuaggcugccucu

SEQ ID NO: 4099026 - RNA, 65 nt, Human
agaggucagaggucgccaggucacccucuuuuggaauaagaguaccagggaacucuugacucucu

SEQ ID NO: 4099027 - RNA, 57 nt, Human
agaggucugugggccggccuuucuccucucuggggacaccgcucugccccagccucu

SEQ ID NO: 4099028 - RNA, 58 nt, Human
agaggucuuaaguuccuugaugguaauuuugccaaccacagggauuuucaagaccuuu

SEQ ID NO: 4099029 - RNA, 79 nt, Human
agaggugaccuugugcucaugcauaggagggggucagcacaugcaaacuucccuucugugcagggcagaggccaucucu

SEQ ID NO: 4099030 - RNA, 79 nt, Human
agagguguugagugaggaaggaauugagguuuuaucuguaguugguagcaucuuuuucugucuucuaaacgaggccucu

SEQ ID NO: 4099031 - RNA, 70 nt, Human
agagguugggcagaggugugucucuggcucuccugggugagucagcacagaguugcucacugccgccucu

SEQ ID NO: 4099032 - RNA, 63 nt, Human
agaguaugggaaggucuuugauauaaggcuuuuaucuauagguuuaaguccuuccuuugcuuu

SEQ ID NO: 4099033 - RNA, 58 nt, Human
agaguccugaggacuaacaggaaggagaaaugcuucucaugaaaguaccuuagguucu

SEQ ID NO: 4099034 - RNA, 71 nt, Human
agagucuauauuccauggugauaugcaaauauuaacagcuuacaaguaguuaagcauaucagauagacucu

SEQ ID NO: 4099035 - RNA, 86 nt, Human
agagucucucuuugucauccaggcugaagugcaguggugugaucucggcucacugcaaccucagcuucccggguucaagugacuuu

SEQ ID NO: 4099036 - RNA, 74 nt, Human
agagucuugaggguucugccccaggcaggugguugcauuugcagccuggcuguggcggugcucucaggcacacu

SEQ ID NO: 4099037 - RNA, 86 nt, Human
agagucuugcucuguugcccaggguggagugcagcggcgugaucacggcucacugcaaccuccgccucccggguucaagcgauucu

SEQ ID NO: 4099038 - RNA, 67 nt, Human
agagugacauuccagaagcuauguacuucuugcuguuaauacaguauauaugguuaucugauacuuu

SEQ ID NO: 4099039 - RNA, 55 nt, Human
agagugacugcuuuucugagagucuuuuaccuacucccagaaaguuauuuacucu

SEQ ID NO: 4099040 - RNA, 93 nt, Human
agagugacugguaacacagaagaucucuuaaugcugcaaaguauuauuaguuguccagcugcaaagaugauuuguuguauuuaccuuuauucu

SEQ ID NO: 4099041 - RNA, 86 nt, Human
agagugagcaggaccagggcgcgccuuuggcaggcgacaguguucacuggcaacuugugcucccuguuuucuuuccggcuuacuuu

SEQ ID NO: 4099042 - RNA, 64 nt, Human
agagugagggugggggcucaggcaugccagcacugggcaucucucugugccucaacccucaucu

SEQ ID NO: 4099043 - RNA, 55 nt, Human
agagugaugguguaacugcugaccuacaagcaucacacagaggcaucaucacuuu

SEQ ID NO: 4099044 - RNA, 55 nt, Human
agagugcauuuuuagagcuuuuagcaaaaaugugaaaaguucauguuugcacuuu

SEQ ID NO: 4099045 - RNA, 130 nt, Human
agagugccagccaggccgacuguugugcaaguucugggcuggccugcgagggcaggcuggcagaggagucaugccugaucagcggccagcauggugucugcccagcccucuuggccuguccuaugagacu

SEQ ID NO: 4099046 - RNA, 63 nt, Human
agagugcuauagggucucaguucugaaauuauucacaaguacucagcagacucagugcacuuu

SEQ ID NO: 4099047 - RNA, 107 nt, Human
agaguggaaugaguggaacuugcgucaguagcccuuggcuuaggcauuccuggcauggugcaggacucugagcugggcacagaaggcguccaccugguucucgcuuu

SEQ ID NO: 4099048 - RNA, 81 nt, Human
agaguggacuggugcgggaacacguggccccggugccaccagcuggucacaguggggucacaguguggucacuagcugucu

SEQ ID NO: 4099049 - RNA, 55 nt, Human
agaguggggaagguguugagaagauguaaauauucuuagauaauugccuuacucu

SEQ ID NO: 4099050 - RNA, 60 nt, Human
acugccaucuggucucuauggguggaacuaaggucacaugccaagagggcagagggcagu

SEQ ID NO: 4099051 - RNA, 69 nt, Human
acugcccagugauuggugguuaucaaaucaugcuucuuagacuagcugcuuagaaaucacugagggggu

SEQ ID NO: 4099052 - RNA, 63 nt, Human
acugccccgcaucaggcuuccuucagcuguccccagucaaguaguacccaaugcguggguagu

SEQ ID NO: 4099053 - RNA, 59 nt, Human
acugcccucccaucuauugcaaauucaaggaggaagaugcaggaacugggagggauagu

SEQ ID NO: 4099054 - RNA, 81 nt, Human
acugccuuucaugucuauuauucagugacuggcauaaauuauauacuguauauacuguauauuggacaaggaaaagaaagu

SEQ ID NO: 4099055 - RNA, 73 nt, Human
agcaggugaggcugaacagaugaaaagccuucaaacaaguccacuguuauuucauuugucuacuucacuuguu

SEQ ID NO: 4099056 - RNA, 73 nt, Human
agcagguuagccuuguucaucaaggggcaauccuccugaguuuugucucuggaaggaaaaagcaaugccugcu

SEQ ID NO: 4099057 - RNA, 73 nt, Human
agcagguugugauacacucagauuugcugcucaauuccccuucaacgauccaugaguguagucagaaacuucu

SEQ ID NO: 4099058 - RNA, 63 nt, Human
agcagguuugggaguagaaaucagaaguuuauuuuugaacacauaagacuuccaaugccuguu

SEQ ID NO: 4099059 - RNA, 68 nt, Human
agcagucagccucuaugcccccgucacccagccagcucucuggguuucggggcgggaggcugagggcu

SEQ ID NO: 4099060 - RNA, 56 nt, Human
agcaguccuucuuuagagagccucucugaugcuggggcccucuuagaaagcuagcu

SEQ ID NO: 4099061 - RNA, 63 nt, Human
agcagucuaggguguauaaggaagccucacacuuuuggggcucuucuggcaugcugcucugcu

SEQ ID NO: 4099062 - RNA, 62 nt, Human
agcagugaggcucugcugagcggucugccgagccgcuggcccucuccaugaaccucacggcu

SEQ ID NO: 4099063 - RNA, 55 nt, Human
agcagugucuuccuccuuuguugggucagucaaaagagcacagguggacaaugcu

SEQ ID NO: 4099064 - RNA, 56 nt, Human
agcaguuauguucuauaaagucauuaugaacauugaguuauugaacgcugauugcu

SEQ ID NO: 4099065 - RNA, 65 nt, Human
agacugcagcaaccccuucagccgcuccacuucagccagaguugaagcauuugcuauagcauucu

SEQ ID NO: 4099066 - RNA, 57 nt, Human
agacugcaguugaggcagcuggggaauuuacucaauuuuucucaaucgcugcagucu

SEQ ID NO: 4099067 - RNA, 56 nt, Human
agacugcugugaaaauguugacccaucucuggccuuaacauuaaaagcagcauuuu

SEQ ID NO: 4099068 - RNA, 58 nt, Human
agacuggaguuuuaaaggaacuuguaucagccugaauauaguugcuggacucuagucu

SEQ ID NO: 4099069 - RNA, 78 nt, Human
agacugguaaguagggacuuguuuuacuaguauucaaauaucacuagcacaugaacagucauuccuagaagccagucu

SEQ ID NO: 4099070 - RNA, 73 nt, Human
agacugguagaucaaaucccaggacguacccucgcacagccaagugggguccugggguccugacugcuucccu

SEQ ID NO: 4099071 - RNA, 73 nt, Human
agacuguuuacagaagagaaagaauucaggguaauuuuuguucugagguucuguuuuccuucuggucuaguuu

SEQ ID NO: 4099072 - RNA, 76 nt, Human
agacuuauauaucuuuauucauccucaaguaucaucagaucuacuuuaaagagguguaaugaggacucagugagcu

SEQ ID NO: 4099073 - RNA, 106 nt, Human
agacuucaaucuuauucaaaucaauucugaagccuuccuguguuuuuuaucaugucuuagacaccuguuacagcugaguaugcauucaagcagaguugugaagucu

SEQ ID NO: 4099074 - RNA, 58 nt, Human
agacuucaccucugaggagggggcugcugcuuuaguucagggccucagaggugaagcu

SEQ ID NO: 4099075 - RNA, 63 nt, Human
agacuucauuggguuuuauacuggcuuucuuuuugguaguccacugaagaauccagggaguuu

SEQ ID NO: 4099076 - RNA, 69 nt, Human
agacuucccagccuuucuuuucugcuggccucuguuuuggcaccaguacuugggaaugcuggggaugcu

SEQ ID NO: 4099077 - RNA, 107 nt, Human
agacuuggaaauauaaauuagauuaaaacacgauguacugauuuacaaugaaaauuauaacucguacggaucagaauucuuguguguuucaugcuguucucaagucu

SEQ ID NO: 4099078 - RNA, 68 nt, Human
agacuugggugucggggcagucugggcaggaggaggacacugaaggaugucucccagcaccaaagucu

SEQ ID NO: 4099079 - RNA, 64 nt, Human
agacuuuuauuuucaccauguaucccuguucuuagaacacaaccgugguggagauauucagccu

SEQ ID NO: 4099080 - RNA, 60 nt, Human
agagaaacugauguccuuugaagccaacccuggccuugaauuaggcaaauuaauuucucu

SEQ ID NO: 4099081 - RNA, 79 nt, Human
agagaaauaaggauuucucauuuguggauugaacagacucuucuaaaacaaaguucaaguuucacaagaaaauuucucu

SEQ ID NO: 4099082 - RNA, 67 nt, Human
agagaaauucucaguggaagauuugauauuaaauuucuucaccgagucaaccuacuuggauuucucu

SEQ ID NO: 4099083 - RNA, 61 nt, Human
agagaaauuucccugccuucugagccucccaauaguuuagcagguagguugaaauuuuccu

SEQ ID NO: 4099084 - RNA, 83 nt, Human
agagaaccacuguuucccgcaguguccugucuguuuguccuauuuaaacaaugacaacacagcugcguaggaacacaggcucu

SEQ ID NO: 4099085 - RNA, 81 nt, Human
agagaagaaccuugaauugacugagauuugaguuuuugugauucagcaaaauaucucagauaguuacugagauucuuaucu

SEQ ID NO: 4099086 - RNA, 71 nt, Human
agagaagcaugucccuugugauucaaaagaccaaauuuccucuuuuggaggauaaggauauugauuucucu

SEQ ID NO: 4099087 - RNA, 65 nt, Human
agagaaguguuccauguuugagguaguuggcaaaugcuaagcuaccuauguggugacaguugucu

SEQ ID NO: 4099088 - RNA, 70 nt, Human
agagaaguucaguggaggcucaagugugcuuuuauaggagaguacagagcaaauuccaccuaucuucucu

SEQ ID NO: 4099089 - RNA, 109 nt, Human
agagaauacaauaucgagucgcugacuggaucuaauugguuauagugccuagauacuguauuuguccuagguccaggaucauguggcuaguuuuauauuuguauauucu

SEQ ID NO: 4099090 - RNA, 57 nt, Human
agagaauuccugccuuaugaaguuuuuaugaugauuaaauaaggcagugacuuuuuu

SEQ ID NO: 4099091 - RNA, 61 nt, Human
agagacacacccaagguuaugagagcagcagagcaggauucuggcuguggguggcgucucu

SEQ ID NO: 4099092 - RNA, 61 nt, Human
agagacaggaguucuguuuccauuuagaauauauaacuuugggcaagucacuucugucuuu

SEQ ID NO: 4099093 - RNA, 57 nt, Human
agagacaguacaaaagucacugaugcaacaucaucauuaagugugacaugcugcucu

SEQ ID NO: 4099094 - RNA, 68 nt, Human
agagacauuaauucaccuuucugaaccaugauuuccucacuggggaauggaacugggaaugcgucucu

SEQ ID NO: 4099095 - RNA, 80 nt, Human
agagacauucaaaauugugguuuagauaugaugaaccagaaaaaaauguuguuuuuuaguccacuuuuugaaaagucucu

SEQ ID NO: 4099096 - RNA, 88 nt, Human
agagacauuuuuauaagguuucuacuguguuaagaaaaguuuuaaaauaauuucucuagagaacaguacaaacuuucuguguguuucu

SEQ ID NO: 4099097 - RNA, 90 nt, Human
agagacguuuguuuucagcauccugcacucaggauaucacugaaacuguuaguguuccugugcuuuggaugcuuagaaagcacauccucu

SEQ ID NO: 4099098 - RNA, 64 nt, Human
agagacugagaagcagaaauauagauucaugguuccugaucaucuuuuccugcuuccagccucu

SEQ ID NO: 4099099 - RNA, 59 nt, Human
agagacugcaaaucauaagaauauguggaugcugcauauucuuccaucuguaaguuucu

SEQ ID NO: 4099100 - RNA, 77 nt, Human
agagacugggaaauauaauuuagcugugugcucagaaagaacaggauauagguuugauaaguauucauccagucucu

SEQ ID NO: 4099101 - RNA, 57 nt, Human
agagacuuuaaaaaacauuaagagcuguuuaaaugcucuugaaaaguuagauucucu

SEQ ID NO: 4099102 - RNA, 93 nt, Human
agagacuuuucugagaguaaacauagccuguggcucacacuuugauaccaacacaguuugcuuaguuuucuuuucccaacauagagaagcuuu

SEQ ID NO: 4099103 - RNA, 109 nt, Human
agagagagaguaaauuuucuuagguggugcaaaaguaauugugguucuugccauugaaauuaauagcaaaaacugcaauuacuuuugcaccaaccuaaugcuuuccucu

SEQ ID NO: 4099104 - RNA, 78 nt, Human
agagagagaugagaacucaauaugauggaugcuuguugcuguaauacagauuucauuacugaauucucacuacaaucu

SEQ ID NO: 4099105 - RNA, 62 nt, Human
agagagaggcagcagugcucacgccgcaggagacagccgagcccgcagugccagccucuccu

SEQ ID NO: 4099106 - RNA, 88 nt, Human
agagagaguagauuuuuacuuacagacaguagacucugccacagccagguaucaguugugugauaugagugacuaauuuaaucucucu

SEQ ID NO: 4099107 - RNA, 96 nt, Human
agagagauuugaucuuuucuguagauggggugagacuaggauuaaauuucaaaauuugagaaaaauauuuucauuccauuuaugggagaacuuucu

SEQ ID NO: 4099108 - RNA, 74 nt, Human
agagagcaaaaguguucaagcccuuuugaggucuacauuugggagaggaaaugccagcacuucaauugcacucu

SEQ ID NO: 4099109 - RNA, 75 nt, Human
agagagcugcagugauauauguugccagagaggacaccaucagucaugaccucugugguaaaauagcaguauucu

SEQ ID NO: 4099110 - RNA, 67 nt, Human
agagaggaagccauugcuuacugaacacagacugugucaggccccacacuaagcacauuuucccucu

SEQ ID NO: 4099111 - RNA, 65 nt, Human
agagaggaucacuugagcucagggguucaagaccagccugaguaacauggugagaacccaucuuu

SEQ ID NO: 4099112 - RNA, 61 nt, Human
agagaggcacagcagaaaguguaggaggagaucagggucuuuugcuguuugcugucucucu

SEQ ID NO: 4099113 - RNA, 81 nt, Human
agagaggcagccaccacuguucaguccaauguuggaaaauccugcugagguuuucuugcugcacugaacuauugccucucu

SEQ ID NO: 4099114 - RNA, 87 nt, Human
agagaggccaccugacgagcagucuauaaaguauguuaaaugagaaaaacagagguugggugugaugcuugucaagauggguucucu

SEQ ID NO: 4099115 - RNA, 83 nt, Human
agagaggggaaauaaagugagcuggaagggaagaaaacaaagauugacuuucugaaagacauuuuaacucauuuucacucucu

SEQ ID NO: 4099116 - RNA, 63 nt, Human
agagaguagucuuuagggaauucagugggcaguggcuaaugaauaaaucaaagacugcccucu

SEQ ID NO: 4099117 - RNA, 69 nt, Human
agagagucaagaucccaggagagugagaagugagugaggagguuuucauugucagcucuugacuucucu

SEQ ID NO: 4099118 - RNA, 126 nt, Human
agagagugaaaaauucagaauuccaagauaauuacccagaagauugucagcaaaggccucucauuuucugucacuuugccauuagacagcuucuggcugauuuccacaccaaugucugaacccucu

SEQ ID NO: 4099119 - RNA, 81 nt, Human
agagauauguguaauacuccucugcacuguacccagaaauauacuaggcacugaaggcacagaaguaaaauacaagucucu

SEQ ID NO: 4099120 - RNA, 56 nt, Human
agagaucaguuaaaaucuuuuuaggacacucucuaguuagguugcuucugauuucu

SEQ ID NO: 4099121 - RNA, 67 nt, Human
agagaucugcucucauguuuuucuuauggcaaugacagaagugcaagaggcaaugaaagcagucucu

SEQ ID NO: 4099122 - RNA, 97 nt, Human
agagaugaugcuuauuucauaucuaugucugcacaaaggagacugugaucugaccagaaagguuguuagcuuucuuuggcagacgugugucaucucu

SEQ ID NO: 4099123 - RNA, 65 nt, Human
agagaugccuuuuuaucauggaugauguugacaaacaucgugugccccggaugaaaggcauuucu

SEQ ID NO: 4099124 - RNA, 57 nt, Human
agagcaagggggcaggaucacacuuggggaucccacaggccacagugcccuugcuuu

SEQ ID NO: 4099125 - RNA, 86 nt, Human
agagcaaggucugugucaucugcuaucgugcucucagcaucuucuaaagugcugggcauagagugcuuaguagugacauggguucu

SEQ ID NO: 4099126 - RNA, 68 nt, Human
agagcacagacuuuagaaucagauagccuggauuuggacucaggcuucgcaagguuagagcuggcuuu

SEQ ID NO: 4099127 - RNA, 73 nt, Human
agagcacaguaucugcacaucaugacaugcucaguaaagccugaucauuauugauguauagacaaugcgcucu

SEQ ID NO: 4099128 - RNA, 57 nt, Human
agagcacaugguuccuguguccaggcaguaaagcccaauggguaagccaagugcuuu

SEQ ID NO: 4099129 - RNA, 56 nt, Human
agagcagacagggcagagccagagagacacuguuugauggccaccucugcuguucu

SEQ ID NO: 4099130 - RNA, 76 nt, Human
agagcagacuagaaagagaaacuaugagauaauucaguguugaauacuuaaagucuauccuuucuagaguuacucu

SEQ ID NO: 4099131 - RNA, 70 nt, Human
agauccagauccuuccugguugccucacuaccugccuuguggcagcuuggaaaccaggggggcuggguuu

SEQ ID NO: 4099132 - RNA, 67 nt, Human
agauccuaggggcuuguaauuuaauagaccguauuuugcuuuuggaacuaaauggccccagggcucu

SEQ ID NO: 4099133 - RNA, 72 nt, Human
agauccuauauugguggccauuuggaaaagaagaccacaacuuugcuuuugguuuggcuccaaauagggacu

SEQ ID NO: 4099134 - RNA, 65 nt, Human
agauccuugguguuuauggagugcuugcuggcccuaagauauuuucucugagcccaccaggaucu

SEQ ID NO: 4099135 - RNA, 110 nt, Human
agaucuaaaauucugaauuggaauauuuggaauuuuugaaugccccaaguauauauuuucuguugcaaauacuuuggcucaugguuuuauccaauuuggaauugaauucu

SEQ ID NO: 4099136 - RNA, 92 nt, Human
agaucuaagagacuaaggcaggaagagacgcagcagcuugucuuugauucugccaagcuucugcaucuuuucuucccuagcccuuagcgucu

SEQ ID NO: 4099137 - RNA, 94 nt, Human
agaucuagugcuuauccuagaaucagcccuugcugccuaugaucuucuugauccaguccagguagcggcagauguugguauagacgccagguuu

SEQ ID NO: 4099138 - RNA, 92 nt, Human
agaucucauucugagucauuccaggguuguacugguacaagaacaacugcauuuuuacuauaacccauggaauauaagaacauugcagaucu

SEQ ID NO: 4099139 - RNA, 63 nt, Human
agaucugcauuuauuccuggucauaaguaaacucuugaggccuguagucauggauguagaccu

SEQ ID NO: 4099140 - RNA, 65 nt, Human
agaucugucuucuucauugccuauaguuccaaguccaacuauggcagaggagaggcacuagggcu

SEQ ID NO: 4099141 - RNA, 90 nt, Human
agaucuuuacagaaauuauuuagaaaucgauugaaacggguuacuuuaagauuuucaauuuuauuucuaaagagugguaggugaaauucu

SEQ ID NO: 4099142 - RNA, 59 nt, Human
agaugaaagaguuugacaugauucucagguaaccugaggaagguaggauuuugucaucu

SEQ ID NO: 4099143 - RNA, 65 nt, Human
agaugaacccagcagggggcuuacugcauaaagaucagagcuuaucucuugcuggaaaguuauuu

SEQ ID NO: 4099144 - RNA, 65 nt, Human
agaugaccaguguugcuggccccgcugaagauucagccuaaagcaaucuacauugcauguuaucu

SEQ ID NO: 4099145 - RNA, 87 nt, Human
agaugagaagaguggggugggcuuccaugaggacauggcaugcuuuuugagucuugucuucaugauacccuaagccacucucugucu

SEQ ID NO: 4099146 - RNA, 74 nt, Human
agaugaguucuuucuauucuauuuuagguuauuuguuugauuagcaaauuugguggggcagagacgggccaucu

SEQ ID NO: 4099147 - RNA, 74 nt, Human
agaugcagcuuuccauuuccagguuuuagaacagugcuguuuaauggaacuucaugagauuauggaaauguucu

SEQ ID NO: 4099148 - RNA, 76 nt, Human
agaugcauucgggauguuuacuuugacagcuuuuuagguucauuaugcuucugagugaauuccccgacauguuucu

SEQ ID NO: 4099149 - RNA, 129 nt, Human
agaugccagguaauuucagagaaacaacaaauguuuuuuaguauaaguaugucccaugcaauauuuaggaggugcucauaccaaaaaaaauuuguuguauaucugaaauuugaauuuaacugggcaucu

SEQ ID NO: 4099150 - RNA, 57 nt, Human
agaugcccucgcagcccuuucgcgcuucccaguggagcugggcuccaagagggaucu

SEQ ID NO: 4099151 - RNA, 92 nt, Human
agaugcguaaaaccacauugucugagaaucuugcauaucaucaauauucauuggugagagaugcuuucuuaacgcugguguuuuaugcauuu

SEQ ID NO: 4099152 - RNA, 76 nt, Human
agaugcuaacucugaaaaacgggauuuggcugguagcaccugacacagccaaucuugaauuuccacuaaaguaucu

SEQ ID NO: 4099153 - RNA, 57 nt, Human
agaugcugcagccuggacuggaagccagagugacucaucagcccagggugagcaucu

SEQ ID NO: 4099154 - RNA, 66 nt, Human
agaugcuuauuuuucucuauccccuguuaggcucuacguuccacaauggcagagaaauguccaucu

SEQ ID NO: 4099155 - RNA, 85 nt, Human
agauggacugagggguacacccggugcaccaguuccuuuugguggauggagcuuccugcccugccugugccacuucuuaucauuu

SEQ ID NO: 4099156 - RNA, 58 nt, Human
agauggaguuaguaccagagucuuaggaagggaaaggaugugguacugugguuuauuu

SEQ ID NO: 4099157 - RNA, 83 nt, Human
agauggccacucucuuuaaaagaagggccagacuccagaaguggagucuauuuccccuucucuugaaucugaguugggccucu

SEQ ID NO: 4099158 - RNA, 101 nt, Human
agauggcuacuauagaucuaagcagagauccaugugauuuggaguucagggggucugggcuggaaauacacauuggaaucaucugcaaauaugugacauuu

SEQ ID NO: 4099159 - RNA, 56 nt, Human
agauggcugauuaacuccauggauaaucucccuauggacugauuguccagccaucu

SEQ ID NO: 4099160 - RNA, 73 nt, Human
agauggcuggagccuguucugagaagccgggccuucugcucuccuggcauugaucaggaggcuccagauauuu

SEQ ID NO: 4099161 - RNA, 78 nt, Human
agaugggcaguuaggaggccaggaugcugacccuagauuugcucuaacaugcucuguggucuuggugaccuuccaucu

SEQ ID NO: 4099162 - RNA, 62 nt, Human
agauggguaggaaucucaagguuucaguuacacacacaaaaucuagaaugaccuacucaucu

SEQ ID NO: 4099163 - RNA, 80 nt, Human
agauggugacaaaauaguucagccacggugacuagugaaaagagcugaaucagcgaagcugacuaugcuaugguccauuu

SEQ ID NO: 4099164 - RNA, 57 nt, Human
agauggugaggucugugcaguauucaucugagauuaauggcuuagugcuucacuucu

SEQ ID NO: 4099165 - RNA, 73 nt, Human
agaugguggaggagcggggcaagcuggugggcacuccuggccuugccucacuguccagcucgagacacuaucu

SEQ ID NO: 4099166 - RNA, 65 nt, Human
agaugguggcugaguggucgagucagaauucaagcugaaacucuuccucacgcucagcugccucu

SEQ ID NO: 4099167 - RNA, 60 nt, Human
agaugguuacagcuguggaaauggagcuugauuucccuauaccagcagcuuugauucucu

SEQ ID NO: 4099168 - RNA, 64 nt, Human
agauguaagguucagaguaugugaagagcuaaggauuucuugacauucugcugcauuuuuaucu

SEQ ID NO: 4099169 - RNA, 69 nt, Human
agaugucuguuagugauaacuguuuuaauggcuacucuucaugaagcgcuuaccaguuggcagucauuu

SEQ ID NO: 4099170 - RNA, 63 nt, Human
agaugugauagcaugccagugaaagaccuggaccugguagcuauaagcaugcugauuacauuu

SEQ ID NO: 4099171 - RNA, 63 nt, Human
agaugugucagcaucauuuguugaagggacuauucuuuccucauugaaugaucuugacucucu

SEQ ID NO: 4099172 - RNA, 76 nt, Human
agauguguuuaacucuguuacuguggacuauucucacuuugagaaauguuucaaauauauagaguuguauagauuu

SEQ ID NO: 4099173 - RNA, 82 nt, Human
agauguugcuucuggauuauauaggacuugcccuuccagucacaggcaugucugggaguucauuguguaaaaagcaacaucu

SEQ ID NO: 4099174 - RNA, 89 nt, Human
agauuaaaugagaugauacaugauacuuaguacguaguaagugcugaagaaacauuugcugcuaucuuuguucacaucauuauuaaucu

SEQ ID NO: 4099175 - RNA, 108 nt, Human
agauuaagccuucuggagaccugaugugagcuuuuuaacuuuagauguuuuuuauaugccuaaggcccgugaguuucauaucucgguuuccacaaagagcuuggaucu

SEQ ID NO: 4099176 - RNA, 59 nt, Human
agauuaucuccugauuuuaaggccaacugugccguguaacacaaucaggggaauaaucu

SEQ ID NO: 4099177 - RNA, 71 nt, Human
agauucagacacacuggguuaccuguacuauuucuuucaagugguagaauaugacucaguugucugccucu

SEQ ID NO: 4099178 - RNA, 101 nt, Human
agauucagaccacagcauuaaugaggcaaggaucagguaagggucaggcaaaugacccuuaaaaugcuacuugacuucuuggggcuuugggaucuuuaucu

SEQ ID NO: 4099179 - RNA, 60 nt, Human
agauucagcugcuguauguaauaauuacggaaguauguuugcaaauaauagccugaaacu

SEQ ID NO: 4099180 - RNA, 66 nt, Human
agauucucaggccccacccagacuaacugaaaaaucagaaucucugcagggagggcccagcaaucu

SEQ ID NO: 4099181 - RNA, 113 nt, Human
agauucuuccaaagcaaugcuaugcaugcaacaauucuucuauaacucucuuuggagacagagcccagcugcugugguaaggguuagcugcaucuuauggcuugggaucaucu

SEQ ID NO: 4099182 - RNA, 58 nt, Human
agauugaacgagcuggcauggaugccucaggccgccaagucauuaucucuucuaaucu

SEQ ID NO: 4099183 - RNA, 72 nt, Human
agauugagaaaucgaaugguugccgugucuguguagaaagaaguagacaugggagacuuuucauuuuguucu

SEQ ID NO: 4099184 - RNA, 72 nt, Human
agauugagaaaucggaugguugccgugucuguguagaaaguaguagacaugggagacuuuucauuuuguucu

SEQ ID NO: 4099185 - RNA, 101 nt, Human
agauugagaagaggcgccgaacauguuacaugguaaacacucuuuuauuaguggucuuuugagggaaaguugcuguguuguucuuugcuguuauuucugcu

SEQ ID NO: 4099186 - RNA, 59 nt, Human
agauugauguauucccugaguuguaagaauagagcugagaguccaggaaaacaucagcu

SEQ ID NO: 4099187 - RNA, 94 nt, Human
agauuguaacugaguuucagagacauucaguaaauuaucccaaagucauauaggauaaaacuuagguaugucuuggcuccaaaguucacaauuu

SEQ ID NO: 4099188 - RNA, 60 nt, Human
agauuuacuguaggagcugugguggaagaaaauuccugcaggugguucgaacagaaguuu

SEQ ID NO: 4099189 - RNA, 82 nt, Human
agauuuagaguguauucaucugcugguuuuuggcauaaauauucauugguuuugagcucucagguguuggaacuuuaaaucu

SEQ ID NO: 4099190 - RNA, 63 nt, Human
agauuucaggggauuugaaaacgggaguguucuucggcuucugccuucaguccucugacuucu

SEQ ID NO: 4099191 - RNA, 56 nt, Human
agauuucuaacacagcacgccauucuauucuaaugggcaugcauuguuggaaauuu

SEQ ID NO: 4099192 - RNA, 60 nt, Human
agauuucuccaggagaaauaugaaggagccaccgugcuuccaucucugccugggaacucu

SEQ ID NO: 4099193 - RNA, 130 nt, Human
agauuuguauuuguaaaaggucauaguaacugcuggaugaggaauggaugacucuuaaugcaaaugcagagcagcuaaaauucucaugcacugcagguaggauuaugaauauaaaguugauacaaaugcu

SEQ ID NO: 4099194 - RNA, 99 nt, Human
agagcaucacugagucuaggaggguuuuccacaauuugagcagcagauucuaucugaaguuaaaauuacggagaaaacuuuuacuuucuguacugcuuu

SEQ ID NO: 4099195 - RNA, 58 nt, Human
agagcauggcuuuuuucucuguuucagaucauucugguauaaaguauaagcuuguuuu

SEQ ID NO: 4099196 - RNA, 75 nt, Human
agagcauuccuaaggaaggcuggcaaggcacacacuaggcgcacucugucuuacggcagaaccuaggaaugaucu

SEQ ID NO: 4099197 - RNA, 68 nt, Human
agagcauugguucaagguugugcagcugggaaauggccuguacucuucuacccugagaauaaugcucu

SEQ ID NO: 4099198 - RNA, 60 nt, Human
agagccaauucaugaugguggugaguucugccucauggcagcaagaaucaggaaggcucu

SEQ ID NO: 4099199 - RNA, 72 nt, Human
agagccaauuuaucuuacucgugcucaggaauacuauuguguaacuaagcaacuaaagacaaaauauggucu

SEQ ID NO: 4099200 - RNA, 65 nt, Human
agagccagacugccugaagcucacuguaacaaguccugccuugaggaagaaggaaguuugccucu

SEQ ID NO: 4099201 - RNA, 129 nt, Human
agagccagaguaaccaugaagauaugaaccccaaggaauucucagaaauguugauaaggguacuagauuucccauagaacaugggauagaguuuuugaauuguggguuuagaggaagcaggcacgagcu

SEQ ID NO: 4099202 - RNA, 71 nt, Human
agagccagcaagugaauagugacaaaaggcaagacauucauaacuaggcccacaguuuacuuaaugccucu

SEQ ID NO: 4099203 - RNA, 61 nt, Human
agagccagcauuugacacuggcuuuucuaccagaaaggagugugguguucaagcugguucu

SEQ ID NO: 4099204 - RNA, 80 nt, Human
agagccaggagcucugcugucugaagaugggaaaagauggguuucccagcucaagcagagagcuaauuugcccuuccucu

SEQ ID NO: 4099205 - RNA, 72 nt, Human
aggaauacuuauacacuguuguugggagucugaauuaguucaacuauuaugaaagacagugugacaauuucu

SEQ ID NO: 4099206 - RNA, 57 nt, Human
aggaauagcugagaguucucugcuaucgaauuccaguagagaaaagaagcuguuccu

SEQ ID NO: 4099207 - RNA, 70 nt, Human
aggaauauuuuuaaagggacuaauugcaaacaauucugccuguugagauuuaucuuuaaaaacgguuccu

SEQ ID NO: 4099208 - RNA, 69 nt, Human
aggaaugccuggauuugggacucaaauaaugucauuaugacucaguuugucuguaucuaaauccuuccu

SEQ ID NO: 4099209 - RNA, 56 nt, Human
aggaaugcucugcaguucccaguugagggagcucucugggcuggcaggcauuaccu

SEQ ID NO: 4099210 - RNA, 64 nt, Human
aggaauguuaagaaggucuaccuuguaguaugaguucaugggaaagaccuuuauaauaccuccu

SEQ ID NO: 4099211 - RNA, 71 nt, Human
aggaauucuucaagagaaugcagggauguugaagcuaaaacaaggaaggucaucauucucuuggggucccu

SEQ ID NO: 4099212 - RNA, 68 nt, Human
aggaauuuguaggcagagguaugguaaggacugcuaagugauuacugguaucccuccuuucuuuuccu

SEQ ID NO: 4099213 - RNA, 99 nt, Human
aggaauuuuuaaaacauuaguuacagaauguacagagguuuaugguuuauuucccagauagcuuguguuuuucuaaguaucugauuuuuauuuauuucu

SEQ ID NO: 4099214 - RNA, 58 nt, Human
agccagagcagggaauuggacacacgaacgugugauuccaauguuccugcuuucagcu

SEQ ID NO: 4099215 - RNA, 87 nt, Human
agccagagcugguuaacaggcacugccuugcagggcccgccuggugcugugcagucuuuggugugccugcaggagccaugcauggcu

SEQ ID NO: 4099216 - RNA, 60 nt, Human
agccagagggaucuuucuaagaugcguacauugcauguuggauaauguuucuuuuuggcu

SEQ ID NO: 4099217 - RNA, 59 nt, Human
agccagcaucuugcuucuugagaaaaguguuuuuuaaaaagguaaugguguuccaggcu

SEQ ID NO: 4099218 - RNA, 97 nt, Human
agccaggaaauugugugggugcccuuuuuaaaacaucaagcugaaugaaaugaugauuugacaccuggggcauauauaugguugaacacaagugguu

SEQ ID NO: 4099219 - RNA, 65 nt, Human
agccaggauggggagcagauagaaucagagagaccuagauuuuaaucaugcuucuauguccuacu

SEQ ID NO: 4099220 - RNA, 84 nt, Human
agccagggcaggcucaggaggcucaagaccuggcacuguucaguggcugggauggggucuggccucugcaggcccugccuggcu

SEQ ID NO: 4099221 - RNA, 60 nt, Human
agccagggcugcagguuccuuggugagcuuugcaaaucguccccgaccucagugcuggcu

SEQ ID NO: 4099222 - RNA, 60 nt, Human
agccagguuaaaccacagucaagccuggcagucaggaaaacuguguguaggccuaaggcu

SEQ ID NO: 4099223 - RNA, 76 nt, Human
agccaguauacagaucacauaaguaaaaauuuuuuggaagaaaauuuucuaaggugaugaucugacaacuuugguu

SEQ ID NO: 4099224 - RNA, 56 nt, Human
agccaguggaauucccagggguuucucaaacauaccuuugggacuuauccauggcu

SEQ ID NO: 4099225 - RNA, 129 nt, Human
agccaguggucaaccaacuugcuaagaugguaggggacauuaagagucagaguuggggaacaaaucugagucuuggggucccuauuuccaacacuuagauuauauacgaguuauauuacacuacugguu

SEQ ID NO: 4099226 - RNA, 75 nt, Human
agccauacuauauuaggggaaggauagggagaaaagcagaaacagucuccuuaugcuacuagaaauaaaauggcu

SEQ ID NO: 4099227 - RNA, 65 nt, Human
agccauaucaagcauucuucacuugaaguaucuugccagcuucugaguaaugcuuugauuugguu

SEQ ID NO: 4099228 - RNA, 56 nt, Human
agccauaugcacacauacuucucaaaccuugacccaaguuugugugucuaugcgcu

SEQ ID NO: 4099229 - RNA, 68 nt, Human
agccaucccaagagggcucugccaaaguggccacuuguagggcgauuggccccaucaagggaugaguu

SEQ ID NO: 4099230 - RNA, 129 nt, Human
agccaucugucagcacuguagccacuuggcguggcaugggguccugggcugcuggggccuccccuccuaauaccugccuuguccccagguccucugccguccacaggucaggcagggcugcugaggccu

SEQ ID NO: 4099231 - RNA, 60 nt, Human
agccauggaaagcuaagccauuuaccuauuaguauaggugcccgcaaugguuuuccugcu

SEQ ID NO: 4099232 - RNA, 59 nt, Human
agccauggagcaagagccgaaagccuuuuauuuggaggcuggccuauuucuuuaucgcu

SEQ ID NO: 4099233 - RNA, 101 nt, Human
agccauuuguucuuaguuucugugucugguugggccaguaaagcccuuuccucaucccucuuucugcuuaucacuagagacagaaacuaaaaacuauggcu

SEQ ID NO: 4099234 - RNA, 85 nt, Human
agcccaauuaagauauauuugcuuuugugccacagauucuaugcuuuuccaaauagaacuguuagaugcuaagcaaauggggacu

SEQ ID NO: 4099235 - RNA, 55 nt, Human
agcccagcaggacagagugguuuggaaugcagcauucaguguguucuguuuggcu

SEQ ID NO: 4099236 - RNA, 60 nt, Human
agcccagcuuuuugaggcaggcaggcggggccccacuugcucgccuucaggacuugggcu

SEQ ID NO: 4099237 - RNA, 56 nt, Human
agcccagguucuaaagccaaaccaaguucaaauucugcuuuggccaugaccuggcu

SEQ ID NO: 4099238 - RNA, 68 nt, Human
agcccaguuacugauuccuuuggccuaagcaagacaggucaauuuuuaaagagggaguagcugagguu

SEQ ID NO: 4099239 - RNA, 62 nt, Human
agccccaagucccuauguuuccaccccuuucuaaggacaggcguggaggagcggcuggggcu

SEQ ID NO: 4099240 - RNA, 58 nt, Human
agccccacguugucuagcaccuauggcuuuacuaucaccucucuaguaguguggggcu

SEQ ID NO: 4099241 - RNA, 64 nt, Human
agcccccacacauaugcagaucccccacaaacucucacugugugcguguguaugugugugugcu

SEQ ID NO: 4099242 - RNA, 110 nt, Human
agcccccuggggagagaaaaacaacucuucucugcagccuuugaaggaaggagagccuucuuuuaguagcccuuggaggaagguuggccucuuucuuugccuguaggguu

SEQ ID NO: 4099243 - RNA, 129 nt, Human
agccccugagaacacagcuccucaccauggacuguaccugggggauccacuucuugguggcagcugccacagguaaggggcucccaaguaccagugaugaggaggggauugaguucagucaagggggcu

SEQ ID NO: 4099244 - RNA, 65 nt, Human
agcccgauguguuauucagcuuucuauuagcaaagcauaguaaagugucuuaacacauaguggcu

SEQ ID NO: 4099245 - RNA, 95 nt, Human
agcccucaacucucagggucagaacgcugugacacugaacuccaaagcaauugcguuucucaucaguuucugauaucuagaaguaagguagggcu

SEQ ID NO: 4099246 - RNA, 77 nt, Human
agcccuccauuaugagcagacagugguuuuacaaauccucuaauccccugaaauguaauacugucucuggagaggcu

SEQ ID NO: 4099247 - RNA, 57 nt, Human
agcccucugcaaacaccugauaaugcugaagaguguguuagucauuguagaggagcu

SEQ ID NO: 4099248 - RNA, 68 nt, Human
agcccugauaggagggugaccucaggguucaaagucacugcugggucccaggucccucccucgaggcu

SEQ ID NO: 4099249 - RNA, 63 nt, Human
agcccugcacaguucgggaggagcguggccucaggggaacgcaggcccagggcugccagggcu

SEQ ID NO: 4099250 - RNA, 64 nt, Human
agcccuggcuggauggagccccugggggagccaguucccagggacuccccauccaugucuggcu

SEQ ID NO: 4099251 - RNA, 56 nt, Human
agcccugguuugcagcauuugcccauuucugugguguaaauacuuccaccauggcu

SEQ ID NO: 4099252 - RNA, 128 nt, Human
agcccugugaggacagacugacauggccuggagagugcggcaauccauugcugcagagaguggagcaggcggcgcucacucucagugcccagguuaguucuguuuuucuccauuacaccacaagggcu

SEQ ID NO: 4099253 - RNA, 70 nt, Human
agcccuuaguacauuucucaaguuuccaggacauucuauaaggauuagguugagaauuacugacuuggcu

SEQ ID NO: 4099254 - RNA, 65 nt, Human
agcccuucaguguuuguagagauaacugucagugucaacuuugaaaguuguagcacugcagggcu

SEQ ID NO: 4099255 - RNA, 58 nt, Human
agcccuugcagacugucagcauuggagugggccccacaugaaggcagugccaagggcu

SEQ ID NO: 4099256 - RNA, 57 nt, Human
agccgcucugucuaacuuaaacagagaaggaauuuguuacaagcaccacagguggcu

SEQ ID NO: 4099257 - RNA, 82 nt, Human
agccggagccaguggaguggggcgaagucggcgaguuggaaacuuccugcaaucguccacuccuagccuuuggcguucggcu

SEQ ID NO: 4099258 - RNA, 129 nt, Human
agccuaacauacaucaccugacugcuuaauuuauacauuuauuauucaacuauguauugagcuacaacuauguaucaggcacuggcugagugauggggauagagcagucaacaaaaugagacaacagcu

SEQ ID NO: 4099259 - RNA, 61 nt, Human
agccuagaagaaguggcuacuucugccugugguuuauagcccuacuuuauucuagacagcu

SEQ ID NO: 4099260 - RNA, 64 nt, Human
agccucaaguguaagacaaugcgagcugugcaaagguuggcaggucuggagggcacugggggcu

SEQ ID NO: 4099261 - RNA, 63 nt, Human
agccuccugggcaagaaacagguuguauacauuaagcaauagaagcugaggcuuagagagguu

SEQ ID NO: 4099262 - RNA, 71 nt, Human
agccucuagcccugggaggccagcuuguagcuccuuaucuggcauugcagaagaccuuccagggcugagcu

SEQ ID NO: 4099263 - RNA, 127 nt, Human
agccucuccacacccccaaaccguuugcucgaaacuugaucuccuuggcccucagagucaccucaguggagaagccugcacagggcuuugauggcugaguuuccccagauguggccuuagagaagcu

SEQ ID NO: 4099264 - RNA, 77 nt, Human
agccucuucucuuggcccucuccacuuguaguccaugccguagacugugcacccuggacagugucacauagagugcu

SEQ ID NO: 4099265 - RNA, 80 nt, Human
agccugaaugaaagagccaguggugagacagugaguugauuacuucucacuguuucaccacuggcucuuugguucaugcu

SEQ ID NO: 4099266 - RNA, 67 nt, Human
agccugacuuguaacauuuugccaaugucugugugauaaauacugguaccaugacaaaugucagguu

SEQ ID NO: 4099267 - RNA, 64 nt, Human
agccugagcacccaucugccuguugggccaccgggcagcuucugcagaugggagucaucaggcu

SEQ ID NO: 4099268 - RNA, 70 nt, Human
agccugccuugggcugcuugagaaccucugcugagucagcacucacuggggcagcggcccagccagagcu

SEQ ID NO: 4099269 - RNA, 91 nt, Human
agccugcguccuaaacgugcaaagcacuucacucccaugcaaaagcagguucuggggaagagcauugcacgguguuuuaagaccacaggcu

SEQ ID NO: 4099270 - RNA, 55 nt, Human
agccugcugggaagggaggcuuccuaucugggggggccuggaagucaaguagguu

SEQ ID NO: 4099271 - RNA, 79 nt, Human
agccugcuguagugagcaaagguuaaacauuuacuauuuuucagucuuguguuuauuuuguauacguaaguauuuggcu

SEQ ID NO: 4099272 - RNA, 60 nt, Human
agccuggagcuugaguuaugaguucagccgugccaugaacuccuugggccauuccuggcu

SEQ ID NO: 4099273 - RNA, 55 nt, Human
agccuggagguaaugaggaaacuacuuuuuccauguauacguuaccuuuuaggcu

SEQ ID NO: 4099274 - RNA, 56 nt, Human
agccuggcugucaccuggaaagagaaggacucagucuccccaggcuauaccaggcu

SEQ ID NO: 4099275 - RNA, 74 nt, Human
agccugggaugcugcuaucauuuuuacagagacuuuuuucuucuucugacagaugcugcuggcaguaccagccu

SEQ ID NO: 4099276 - RNA, 123 nt, Human
agccugggauugugcaacuuuaauuggcauguuuuuuggcaaucuguuugaugcuugugauaccugacugguauagcuagcacgaugcagguggcuguuaauguauagugcacaacccaggcu

SEQ ID NO: 4099277 - RNA, 61 nt, Human
agccugggguuucaguuugcacccaagcaauagccacaaaguaaguugagauugccaggcu

SEQ ID NO: 4099278 - RNA, 61 nt, Human
agccuggguccuugcugauugcugagcgggcagugcagcuuugucaugaggacacuuugcu

SEQ ID NO: 4099279 - RNA, 57 nt, Human
agccuguggagcaauggcaucaccuaauccuuccugguuggcuguggcucccagguu

SEQ ID NO: 4099280 - RNA, 66 nt, Human
agaggccuggaauuccagccugggccaugggggccugagcuguuuaaucccagauaaccugccucu

SEQ ID NO: 4099281 - RNA, 62 nt, Human
agaggccuuggcugucuuauucguugcugaaucuucagugccuaggacagggccuggcuucu

SEQ ID NO: 4099282 - RNA, 61 nt, Human
agaggcugauauuagcucauggauuuucacggauagaaaaaucaugaaauaucaguucuuu

SEQ ID NO: 4099283 - RNA, 56 nt, Human
agaggcugauggaguagugucuuuaaaacuuacaugauaguuuaccuucagccucu

SEQ ID NO: 4099284 - RNA, 77 nt, Human
agaggcugauuucacucuucaggauugaaacgcucugguagaaaaguuguggagcaaucuuuaaggacucagucucu

SEQ ID NO: 4099285 - RNA, 69 nt, Human
agagggaaagagaggaggcugaggacugggggcuccagcucaucugaagccaccucugcuugucccuuu

SEQ ID NO: 4099286 - RNA, 129 nt, Human
agagggaauugaacaggcaaaggccuauuuuaggaggcucugugacuaaagaggauuauacccaucuucuucaaggaucuggagcguauucugauuuaaugguggccugauaagccaaagaucuccucu

SEQ ID NO: 4099287 - RNA, 62 nt, Human
agagggcuaagguuugggagauucacaccuggaagcaucugaccccaaaacccaugcucuuu

SEQ ID NO: 4099288 - RNA, 60 nt, Human
agaggggcaaguaaagagucuuucuauaguuugaauuuuaagaucucguacuugcuuucu

SEQ ID NO: 4099289 - RNA, 63 nt, Human
agaggggcuguugaaguuaguugagcuuuugaaguuggggaaacuucagcuagccucauuucu

SEQ ID NO: 4099290 - RNA, 79 nt, Human
agaggguacagagggcagucucagauugggaagugcguccacaggcuucccacagaggcucugcccuuugguaccuccu

SEQ ID NO: 4099291 - RNA, 74 nt, Human
agagggucaagaaacacaggagaaggaagaaugucauagcacaucaucaucuaaauugugucgcuaaacucucu

SEQ ID NO: 4099292 - RNA, 63 nt, Human
agagguaauuacuauguucagauuccugggaccuuuccagguaucugauguauaaauaccucu

SEQ ID NO: 4099293 - RNA, 60 nt, Human
agagguauuagguaauucaguaggcaaaaugacuuggccuacugaugucagauagccucu

SEQ ID NO: 4099294 - RNA, 70 nt, Human
agaggucacaguaaaagucacucuaaaacagagcuccaaauucaauagggauguggcuuuuugaccugcu

SEQ ID NO: 4099295 - RNA, 73 nt, Human
agaggugagccuaaauaauugugagccauaauugcaggacuuggccaagaaugauaggcucaguuacuccucu

SEQ ID NO: 4099296 - RNA, 94 nt, Human
agaggugcaaaauugguaggggagaguagagggucugauugaaauucugucccuggaacaagaagccaaucagcucucugcuccucucuucucu

SEQ ID NO: 4099297 - RNA, 72 nt, Human
agaggugccacauuuggauaaauauuuaauguucuuuaagcauguuuuaaguguucaaacguacacauuucu

SEQ ID NO: 4099298 - RNA, 64 nt, Human
agaggugcuagaaaaccuagaugccugugauuccauuucaaggcuucacauuuucuaggccuuu

SEQ ID NO: 4099299 - RNA, 73 nt, Human
agagguggcuccaggagcaaugcucugagguuccauggaaggugugaucuugcugugcucccagcccaccucu

SEQ ID NO: 4099300 - RNA, 120 nt, Human
agaggugggcaggcucuggagaaagggcugagaaguggggcuggcguuuccuuccuccuccccugagcuccauccucugcccuacuuucaugucucccccucccagcucucccuaccucu

SEQ ID NO: 4099301 - RNA, 89 nt, Human
agaggugggcagugguguuggcuggaccugggcuggaauucugggggucacuaguuagguuucugucuccagcuaagcugcagaccucu

SEQ ID NO: 4099302 - RNA, 66 nt, Human
agagguuuaacuggcuuaugguucugcaagcuauacaagcaugccacuagcaccuguucaacuucu

SEQ ID NO: 4099303 - RNA, 68 nt, Human
agaguaaccuuucaggcauguagguuugacccucugaucacaggcuuaaaacuuugaaaguguucucu

SEQ ID NO: 4099304 - RNA, 78 nt, Human
agaguaaguagucagacauaccccaugcauuacuauucauaaagucgugguggugguugggcuauuuucugcaacucu

SEQ ID NO: 4099305 - RNA, 59 nt, Human
agaguaagugguagagucaggguuagaaacuaggcagucuggcucaaaauacguacucu

SEQ ID NO: 4099306 - RNA, 83 nt, Human
agaguacuuaguucucuuguuguccaguauaucuaauaaguguuucauauuauuuccacauaagggaaauaagggaguacuuu

SEQ ID NO: 4099307 - RNA, 69 nt, Human
agagucagugcaagcuggcuaggaaggugggggcagccacaaaguccugguaggcuaugucaugucuuu

SEQ ID NO: 4099308 - RNA, 86 nt, Human
agagucagugucugaugcuugcaacaaagaacccugacugacacguagaggguuuucuuauuguaaaguguugucggcacugcucu

SEQ ID NO: 4099309 - RNA, 64 nt, Human
agaguccaggcaucccucccauagcccauagccaaguaugggagaagggugcuucagggucucu

SEQ ID NO: 4099310 - RNA, 71 nt, Human
agaguccccaguacaaggaagcacauauuuuuggauuuugccgugugaccuugucuggcuggcuggacuuu

SEQ ID NO: 4099311 - RNA, 75 nt, Human
agagucgcugagagagcagaugugugccaggaugcuguucccgcagccaccuggaccucugccuguacugacucu

SEQ ID NO: 4099312 - RNA, 71 nt, Human
agagucugagcagaaauccacuguucugcauguggggaaagguuuaaggcacagaggcauuuucagacucu

SEQ ID NO: 4099313 - RNA, 71 nt, Human
agagugaauguucguugcuuuaagccacuacgugugggugacuuguuaaggcagcaacggaugaacacacu

SEQ ID NO: 4099314 - RNA, 61 nt, Human
agagugaggcccagccaccuagguuuuaacaggaccucccaggaaugcugaggcucacuuu

SEQ ID NO: 4099315 - RNA, 58 nt, Human
agagugaugauuaacuucauaugagguacuuaacgugccugaauuagaauuauccucu

SEQ ID NO: 4099316 - RNA, 58 nt, Human
agagugcagaggucaaagaacaggagcuucauuguuuuacaucaacacucuguacuuu

SEQ ID NO: 4099317 - RNA, 81 nt, Human
agagugccgggaagggcauuuagagacucugccguagcgcuaccauugccugggcaggcuccagagcccucuccccuuucu

SEQ ID NO: 4099318 - RNA, 56 nt, Human
agagugcuagccugagggagguggagaaccuagaauccucucuuuucuggcauuuu

SEQ ID NO: 4099319 - RNA, 65 nt, Human
agaguggcagcaagucagguagacuaaggauucuacaggauucugacuccuggcucugucauuuu

SEQ ID NO: 4099320 - RNA, 55 nt, Human
agaguggguuauaggcagacuugggagaccucuccccaaggccacaagucacucu

SEQ ID NO: 4099321 - RNA, 98 nt, Human
agagugugagcauucaagggcaccuagaaacugacagaauauuucccuuaaguauuauuaccuucuaggucaccugccuuuugcuuucucugcacuuu

SEQ ID NO: 4099322 - RNA, 56 nt, Human
agaguguggaaauguucagaguacuucggaaggggugaaagacuuucuacgacucu

SEQ ID NO: 4099323 - RNA, 84 nt, Human
agaguuauauuuugauucauauaagaguauggacuugagcuucaaaggaauaauaaggccaaacuauuauaguucaaggacuuu

SEQ ID NO: 4099324 - RNA, 71 nt, Human
agaguuaucuucuucuaaagcuuaaaauaagaacuacuuaaaagcagcgaauuuagaagaaugagcacuuu

SEQ ID NO: 4099325 - RNA, 56 nt, Human
agaguugggcaaauuaucccagauauucugcagucagggaugagaguccuagcucu

SEQ ID NO: 4099326 - RNA, 121 nt, Human
agaguuucaccauauuggccaggcuggucucgaacuccugaccucgugaucugccagccuuggcuucccaaagugcugggauuacaggcaugagccaccacgcccggccgccaagaacucu

SEQ ID NO: 4099327 - RNA, 72 nt, Human
agaguuugaagcagaggagggucgugaucuaaauguuuuuaacaggcucacucugacuucuaagaauacucu

SEQ ID NO: 4099328 - RNA, 57 nt, Human
agaguuuguguccuuuaucaggaagcauuggcaucaaauggggagggcauaaauucu

SEQ ID NO: 4099329 - RNA, 130 nt, Human
agauaaauauugauagaauaguccaacuagaaugccugaggccugcuuggaauugaauuuugaaugcauagaacaaaaauguuucaauuaagucuuuuaguucaaguuguuugguuugguguuuugauuu

SEQ ID NO: 4099330 - RNA, 73 nt, Human
agauaaauuuuagugcuggggucauauugauuuuuauccauugcacugugauuuccagccauuaaaaaagucu

SEQ ID NO: 4099331 - RNA, 78 nt, Human
agauaacuaauuaguauuuuuggauugaacacgacaggguuuauacaggcugcuucuaaucuacugcauuaguuaucu

SEQ ID NO: 4099332 - RNA, 72 nt, Human
agauaaggaagagagcagcaaacuggagucacuacaggacacuagcugcuccaggcugcucugucccauucu

SEQ ID NO: 4099333 - RNA, 60 nt, Human
agauaauggagggauuugcauuuugcugaagaaaccccaaagugcccuccgacauuguuu

SEQ ID NO: 4099334 - RNA, 74 nt, Human
agauaauucaugacguuuuauucccaugcagcauuugaugacaaaugaggcacagagauguuaauggcuugucu

SEQ ID NO: 4099335 - RNA, 58 nt, Human
agauaccccaguguugaugccugguuguuccauuaugccaggacuccauggggucucu

SEQ ID NO: 4099336 - RNA, 56 nt, Human
agauaccuacuuggaucuguucugggguuccaaucucuccaaauccuaggaugucu

SEQ ID NO: 4099337 - RNA, 85 nt, Human
agauaccugaaacaaaaugucagcauugaugaaauguggguaguguguccauccaugguguugguuguauagcuucuggauauuu

SEQ ID NO: 4099338 - RNA, 69 nt, Human
agauacugaaauccaauggccaguggaacaacuuagcaaugccaaaaaccauucacugauucaguaucu

SEQ ID NO: 4099339 - RNA, 80 nt, Human
agauacuuacaugaauucaagagcaguuauuaucaacguguaccugaaaaaaugugacucugccuugauguuaaguguuu

SEQ ID NO: 4099340 - RNA, 98 nt, Human
agauagauagauagacagaugauagauacuuguagauacagacuaugcuugaugcucuaaauccaaauaaguguccaauuaauuagcuauuuucuucu

SEQ ID NO: 4099341 - RNA, 65 nt, Human
agauagccucaagugaagugguuagcagacugucaaguggugcucugcuuuacuucagaggaucu

SEQ ID NO: 4099342 - RNA, 77 nt, Human
agauagcuaacuccauggcagacaagcugaugcuccccguuggagggaggccuuagcuuuucucuauguuggcuucu

SEQ ID NO: 4099343 - RNA, 96 nt, Human
agauagguuaaaaagccaucaguaaaaugauuuagaauucguaugcacagugaaugugugggccaagucauuugcugagguggcaucuaccugucu

SEQ ID NO: 4099344 - RNA, 55 nt, Human
agccuugaaccaauuguuuagcuugaagaaugcagcuuuuugauuggccaagguu

SEQ ID NO: 4099345 - RNA, 75 nt, Human
agccuugaagauuccacagcuacaucaaucuagagugguuaucuugguucuuacuguguuguggucuguagggcu

SEQ ID NO: 4099346 - RNA, 78 nt, Human
agccuugaauuagcaguagacagacuggguuuggaggaaccacagauuuggggucuccuguuaguucaucuuuagguu

SEQ ID NO: 4099347 - RNA, 56 nt, Human
agccuugacacuggggaaacugggaauguggucgcagacuuccuaugucaaguguu

SEQ ID NO: 4099348 - RNA, 69 nt, Human
agccuugggggaccgcagaggaggccaccgcauaggccaggcauaugcagggucuccaucuccccagcu

SEQ ID NO: 4099349 - RNA, 77 nt, Human
agccuuguggguuacucaggccccuugucagcucugugaucauccuucacaccugaaagcuuguaacccgagaggcu

SEQ ID NO: 4099350 - RNA, 60 nt, Human
agccuuuaagcugccacagcugcuaagagaugccuuauaugcuggaagggcuagagggcu

SEQ ID NO: 4099351 - RNA, 59 nt, Human
agccuuugauaugccaggcuggaaaaagaacaagacuagcauuggcauucacagaagcu

SEQ ID NO: 4099352 - RNA, 57 nt, Human
agccuuuguuccuucuggaaugguacaagaagagucaaugucuaggagagcagagcu

SEQ ID NO: 4099353 - RNA, 67 nt, Human
agcgaaauuuugacagcucgccuuugggguguaugucaccucuuggcuggucauuuaaaaucauguu

SEQ ID NO: 4099354 - RNA, 63 nt, Human
agcgaagcuuaagaggcuguauucuugcuuaagcacgcacagcuugaaucuuaagcucuugcu

SEQ ID NO: 4099355 - RNA, 130 nt, Human
agcgaagguggccaucggugagugagcaagugaucgccuggcugggcaccaggggaggcggaaagaacaugagaacaagccuccccacugcugcccgccuggaagcugucgaucucccacagggcccgcu

SEQ ID NO: 4099356 - RNA, 66 nt, Human
agggcaaaucuuucccuuuacuauccagagcuuucccuuuggauaagagguugaugguagagaccu

SEQ ID NO: 4099357 - RNA, 55 nt, Human
agggcaaguugagugugcgugggcaugaaggauucacuguacgcaucccagcccu

SEQ ID NO: 4099358 - RNA, 76 nt, Human
agcauuuagaguugaguauucauugguccagcucuucccauccagcuuugucacuuaugccagcucuggaagugcu

SEQ ID NO: 4099359 - RNA, 79 nt, Human
agcauuuaugucuuucucauacaagcccaagaagaugaacuuaauucuguaaauggacuucggaaagauaauaguugcu

SEQ ID NO: 4099360 - RNA, 68 nt, Human
agcauuuggggcauuuaguuuucauauucugaaacuguuuagaagauaagacaagugcugccuuugcu

SEQ ID NO: 4099361 - RNA, 61 nt, Human
agcauuuuuuugaggcuuuagacaaaaaguguaaauagagaaucagcuuggagaagauguu

SEQ ID NO: 4099362 - RNA, 76 nt, Human
agccaaaauuaagccucuuauguugccuuggauucuguuacuuuaaauaggcacucaccagauuauaauuuuggcu

SEQ ID NO: 4099363 - RNA, 63 nt, Human
agccaaauauaaagugguuuuggccaggaguuccccggcuaaguccaaggguaugaguuggcu

SEQ ID NO: 4099364 - RNA, 59 nt, Human
agccaacucgaaagcagggugaacagcuugaguccuguugcugcugaucgggguuggcu

SEQ ID NO: 4099365 - RNA, 85 nt, Human
agccaacugcuuuucuucagcagccugaugccccauucuuucuugagcaaaaauaugagauacucugaagugaguuaaguugguu

SEQ ID NO: 4099366 - RNA, 62 nt, Human
agccaagaguucuuuagcgguggaagaagauggggucuuacacgaauggaagggucuuggcu

SEQ ID NO: 4099367 - RNA, 57 nt, Human
agccaaggacucagugguaggcguggaauggcuuugcgaaaucccugauucuugguu

SEQ ID NO: 4099368 - RNA, 65 nt, Human
agccaaggguggcaccuggaagggauggguuacaaagagccguccacacaccugcacucugggcu

SEQ ID NO: 4099369 - RNA, 57 nt, Human
agccacacuugccaggggaagggacuugucccaaaagacccuggaggaguguuggcu

SEQ ID NO: 4099370 - RNA, 56 nt, Human
agccacagagagggagcugcaaauuuuguguauaaauucuguccuaaucuguggcu

SEQ ID NO: 4099371 - RNA, 56 nt, Human
agccacagagcaggagaccuuuuccaagcagagagggucuuccuggcacugugguu

SEQ ID NO: 4099372 - RNA, 61 nt, Human
agccacauggcuaauacgccacuggacacagaugugugcaguuuuguguuugcugugggcu

SEQ ID NO: 4099373 - RNA, 67 nt, Human
agccacauucugcuguugaauguagcuuuaugcucagcagcuacauucaacagcagaguuuuaagcu

SEQ ID NO: 4099374 - RNA, 74 nt, Human
agccacucacagggccucaguuuucccaucugcacagggagaagggaagguucaguggcccugugagcuuugcu

SEQ ID NO: 4099375 - RNA, 61 nt, Human
agccacucagugcuguauugacagaaauuaaauuagccaucagugcgggcaaucaguggcu

SEQ ID NO: 4099376 - RNA, 58 nt, Human
agccacugucucuggcacuaguucuuuccagacaagagcucuuugcuggcaguaggcu

SEQ ID NO: 4099377 - RNA, 59 nt, Human
agccagaagaggagaaguuggguuuaaaacuacaucuaccauaccuaccucaccugguu

SEQ ID NO: 4099378 - RNA, 74 nt, Human
agccagaaguucaagaucaagguuccagcaggguugguuucuucugaggccucuuuccuuggcuuuagauggcu

SEQ ID NO: 4099379 - RNA, 55 nt, Human
agccagagagcggggcuuagggagacuggccuuggagaugccccacucccugucu

SEQ ID NO: 4099380 - RNA, 122 nt, Human
agccagagcaagacucacuggcacuguggacugaugcucccuauugaagcuaaucuugcucuguuuauuuuccauguguuaaagcaucgcuccaucagugucugcaugagucaugucuuccu

SEQ ID NO: 4099381 - RNA, 72 nt, Human
agccagagcaggggagaaaacugcaggucuaccacauggcaggccagcauucucucuccaggccaacaggcu

SEQ ID NO: 4099382 - RNA, 103 nt, Human
agccagaggcuuguuagagagggguguggagaagaaggccacugcagggaugagcccugggccugauuuaucaucuucacagcugaucugagcaagagggguu

SEQ ID NO: 4099383 - RNA, 129 nt, Human
agccagauagagcucaaauuuccuugucaucagcaacgaucacaggcaaaucuucagcucaaggaauuucagcuuugcugaggcagaugucugugacucugggacugggaccagguugacuucuuagcu

SEQ ID NO: 4099384 - RNA, 60 nt, Human
agccagauccaggagacagcucaaaagccugaccuugacuuucuccagguaagucuggcu

SEQ ID NO: 4099385 - RNA, 61 nt, Human
agccagccagacuuuaaaauagaugagaccauucuuagucuuggugagucuugguucagcu

SEQ ID NO: 4099386 - RNA, 79 nt, Human
agccagcucaaauugucuucagccaaaacagaauuauauugauucauguaggcugcaaugcacaagggguaggguggcu

SEQ ID NO: 4099387 - RNA, 66 nt, Human
agccagcucuuggcucauggagagcaaggaccacuccucuugcaugagauccaggagucccuggcu

SEQ ID NO: 4099388 - RNA, 130 nt, Human
agccagcugcuucugcacgcuuuucggguggguaguuguuuaccccuggagccugggcugcuugcugccuggcauggggcucccuggcccuggggacacaacccaccccuugagaggagucggcauggcu

SEQ ID NO: 4099389 - RNA, 56 nt, Human
agccaggauuugaaccugcauccagugauguacuggguaauauuuaacuccuggcu

SEQ ID NO: 4099390 - RNA, 118 nt, Human
agccagggccccaacacuaugacaugccagcaccuuccugcucccuggcuacagaaaagcagcuugcagggggcaucagguccuggcuccaucauuuaccagcuugggggccuuggcu

SEQ ID NO: 4099391 - RNA, 63 nt, Human
agccaggguggacauuuccacaagcuuggacacccuccagcucacaguguccuuccucaagcu

SEQ ID NO: 4099392 - RNA, 76 nt, Human
agccagucuucggcuguuaugcaguguaauuuuaugggaauaguuuuauaauguuaacaucuguagacugagagcu

SEQ ID NO: 4099393 - RNA, 77 nt, Human
agccagugagagcuuauaagcaucaggaccaaguauaccuguauuugucucucuggguuuacuuaacuccaaaggcu

SEQ ID NO: 4099394 - RNA, 55 nt, Human
agccagugcaacagcagugaaguuauucuuugcuacaauacugcuccacuggacu

SEQ ID NO: 4099395 - RNA, 57 nt, Human
agccauagagccgggauaagaaagagccuucugcccuggcugccuggcucugugguu

SEQ ID NO: 4099396 - RNA, 73 nt, Human
agccaucacaguauugcuggagauaacccuauugacuuucccuuggguggugucaagcagaacugugaagguu

SEQ ID NO: 4099397 - RNA, 59 nt, Human
agccaucauuucugucacuggcuauagcacaugcacagaaggacaguagagugcaggcu

SEQ ID NO: 4099398 - RNA, 59 nt, Human
agccauccuccacagccuugaucaccugggccacagggguggggagcagagaggaggcu

SEQ ID NO: 4099399 - RNA, 65 nt, Human
agccaucuuaauggggccaugucucaguguaauagaaagagaaaguggcuagcauuaaaaugacu

SEQ ID NO: 4099400 - RNA, 67 nt, Human
agccaugagaaugaagaagacuuaauggauaucauccuccuuuauaaucuauuugguucacauugcu

SEQ ID NO: 4099401 - RNA, 55 nt, Human
agccaugggagacugugggagacaaugcauucccuccggcucaguucccuuggcu

SEQ ID NO: 4099402 - RNA, 61 nt, Human
agccaugucaaccaguuguuugaauggaucagcccauuccaucauaggaauugaccugguu

SEQ ID NO: 4099403 - RNA, 57 nt, Human
agccauugaaggcacuugagcagaggagugaccugaucugacuuauccuucaaggcu

SEQ ID NO: 4099404 - RNA, 64 nt, Human
agccauugucccauugcgaaugugaguggaccccuccagacucacuuugccaugguauagggcu

SEQ ID NO: 4099405 - RNA, 64 nt, Human
agccauuugccuucucugaaccuauuuccgcaucugcaaaguggaaaucaaagagggcuuggcu

SEQ ID NO: 4099406 - RNA, 63 nt, Human
agccauuuuccugaaauauaacauguuuauguccuuucuagacauauggagggaucaguggcu

SEQ ID NO: 4099407 - RNA, 76 nt, Human
agcccaaagcaaauaucuaaauggaauauuccagagcauugcucuggugguauacaucuaggaguuugaauggguu

SEQ ID NO: 4099408 - RNA, 69 nt, Human
agcccaaugggagagccauuuucugcacaaacauuaaggagaaagugguccugcaaacccguguggucu

SEQ ID NO: 4099409 - RNA, 68 nt, Human
agcccacccguccugcucgggccgccuuccugguccggaccgcgagugccgagagggcagggccggcu

SEQ ID NO: 4099410 - RNA, 62 nt, Human
agcccagaggguagcagaagaaagaaguugaauauuuuuucucucuguucuccucucuugcu

SEQ ID NO: 4099411 - RNA, 86 nt, Human
agcccagccucaaucacugaccugcagaugcaugagccuaauaaaugauuauuguuugaggucacugauauuugaggugauuuguu

SEQ ID NO: 4099412 - RNA, 61 nt, Human
agcccagccugauucuacacccugagaugacauaugggagggguggggaccaugcagggcu

SEQ ID NO: 4099413 - RNA, 56 nt, Human
agcccagugggccgaggcggggaguauuccauaauccaauugccugcucaggggcu

SEQ ID NO: 4099414 - RNA, 65 nt, Human
agcccauggggagauguaucagacugcacgggauaccugucagaggaucaugucccuacucugcu

SEQ ID NO: 4099415 - RNA, 77 nt, Human
agccccacaugggcgagagggcggccuucauucugaacccauuuaggcagcacgggcagcccuccucgccgugggcu

SEQ ID NO: 4099416 - RNA, 58 nt, Human
agccccaguccgcugcgggcgggcgucgacaucugccgcgugagcgcgagcuggagcu

SEQ ID NO: 4099417 - RNA, 70 nt, Human
agccccaugaaucaugccacugagcucccaaguuauugucaacuggguugacagccucagguaugaugcu

SEQ ID NO: 4099418 - RNA, 122 nt, Human
agccccccacuuaaagugaagaauuguguuuguguacaugcucaguuuguguacauguuuguauacauguucguguacauguucaguauuaucagccucuguuauuucuauguggggguguu

SEQ ID NO: 4099419 - RNA, 118 nt, Human
agccccccaggccccucccugucagccaugagcagccgggaggugugcaggcccuguagggaaccagcauugaucccaggcugugggauggggguggggagggaguaggagaggggcu

SEQ ID NO: 4099420 - RNA, 58 nt, Human
agccccuaaaguagcuguucuuaaccuggaaucugaagaacagccuguugguggggcu

SEQ ID NO: 4099421 - RNA, 77 nt, Human
agccccuauuaaucagauauaaacuguucauugacugugcgagcucaacugcacuguguggaaauuugugaggggcu

SEQ ID NO: 4099422 - RNA, 62 nt, Human
agccccugcugucagcauccucgcgagugacacagcucagccugccagcagcagcaggggcu

SEQ ID NO: 4099423 - RNA, 79 nt, Human
agccccuucaaaauuccaggaugcaggaggugcccuggucaccaggaggaguggcuccuguguuuggaaggguggggcu

SEQ ID NO: 4099424 - RNA, 63 nt, Human
agcccuagagcuggaggucaguggauucugguucugccuuggccuugacuuagcucugggacu

SEQ ID NO: 4099425 - RNA, 78 nt, Human
agcccucauuaucacacgccuugcuucauuuacuuuaucagaaagaaaaugguggugguggugguggugagaauggcu

SEQ ID NO: 4099426 - RNA, 55 nt, Human
agcccucucuauggcccucuuguucacacguugcuggagcuguaggugggaggcu

SEQ ID NO: 4099427 - RNA, 67 nt, Human
agcccugaagcuuaguuuacgcuccaaaguuucccuguggagucaggcuaaaggcuguucuugggcu

SEQ ID NO: 4099428 - RNA, 78 nt, Human
agcccugauuuggaaagagauacuacugcggaguuuucagcucuagcuccccuuccuggagugucuuccccaagggcu

SEQ ID NO: 4099429 - RNA, 90 nt, Human
agcccugcccugacuuccccagagaacuucuccuaaaucucagugaggcaagcacuggcauucaggagagcuuccugagaagggucuguu

SEQ ID NO: 4099430 - RNA, 55 nt, Human
aggaagguuuguuucucacuucccaggguauagcccagaggaacauucaccuccu

SEQ ID NO: 4099431 - RNA, 65 nt, Human
aggaagucaggaggugaaggagaaccagugcuaccaucuggcguuuacuuccuuccugucuuuuu

SEQ ID NO: 4099432 - RNA, 69 nt, Human
aggaaguucuauaucugccucaccaacacuucuuccaggaggguggagaaucagauaugaauuauuucu

SEQ ID NO: 4099433 - RNA, 101 nt, Human
aggaauaaauaucuaacauaaguugaaucuguuaaauugggaugaugauuaaagauaucgguuuuauaaagagagucaguuggccuuagauauguuauccu

SEQ ID NO: 4099434 - RNA, 60 nt, Human
agcugcgauuuguuuuuguccuauuagcuccugcaaaggacagaaacagauugcugggcu

SEQ ID NO: 4099435 - RNA, 90 nt, Human
agcugcgguccccuccucccuugaccucuaggcugcccaggacuaagaauuccagccuacagagggcagguggaggggagacagcuagcu

SEQ ID NO: 4099436 - RNA, 61 nt, Human
agcugcguuggaggcuguaggaccggguaugagaaaucccauuacugagccccgggcagcu

SEQ ID NO: 4099437 - RNA, 78 nt, Human
agcugcucuugaacuucucuuguagaggguuuucuagggggaagcccugagcacugcagagaacaguuggaagcaacu

SEQ ID NO: 4099438 - RNA, 62 nt, Human
agcugcuggugcuggagccuagucccuauguucaggcucagggaugguucugcacaguggcu

SEQ ID NO: 4099439 - RNA, 81 nt, Human
agcugcuuucugcaugcugugccuucucugugccagucucugcuuggcacagacagcacagcaaugaacaagggaguggcu

SEQ ID NO: 4099440 - RNA, 89 nt, Human
agcuggaagcacauauacuuuguaagugacuucuuauuaauaauacauucaaauauaagaagcauuauaacaugcaaggucuuccaacu

SEQ ID NO: 4099441 - RNA, 84 nt, Human
agcuggacuguuaucuggcugaggacagaaaaauucccuuacacugagaugggaaucuaaagcccaguggggaaauagcuagcu

SEQ ID NO: 4099442 - RNA, 72 nt, Human
agcuggcagagcauuuguggccucugcucagaugaaauuuuaagcuaaacaccaacagauccucugcuugcu

SEQ ID NO: 4099443 - RNA, 68 nt, Human
agcuggccuguuagagcugaguuguuuugggcugcaaugaggcccuugcucauuuucuggaggcagcu

SEQ ID NO: 4099444 - RNA, 111 nt, Human
agcuggcgcaugguagaugcucauaaauauuuguugagugcuuugaaaacugugaacaguucccacuagacugcuacuuaacaguuaucaggauuuauuuguguuccugcu

SEQ ID NO: 4099445 - RNA, 68 nt, Human
agcuggcucuguucgccaucaggaguucacacccacagagauucuuugaugagaaacaggguaaugcu

SEQ ID NO: 4099446 - RNA, 72 nt, Human
agcuggcuggccccuuccugccuucccguaagucggcccaacggagccaggaagguauguggcccagcggcu

SEQ ID NO: 4099447 - RNA, 55 nt, Human
agcuggcuucuuuaaagcacauacuuuuguaaagugugcuucagaagccauugcu

SEQ ID NO: 4099448 - RNA, 57 nt, Human
agcugggagcugcagugccgugaggguuauggagccuucagcaccauagcuccuucu

SEQ ID NO: 4099449 - RNA, 125 nt, Human
agcugggcauuguggugcacaccuguagucccagcuacucuagaggcugaggcaggaggaucacuugaguccaggaguuuaggcugcaaugggcuaugauugugccacugcacuacagccuggcu

SEQ ID NO: 4099450 - RNA, 58 nt, Human
agcuggggcugugguugugauuguggcuggggcugugguugugguuggggcugcagcu

SEQ ID NO: 4099451 - RNA, 66 nt, Human
agcuggguagauauaaaaacaagacuaaaguaugaucuucuaguaucuuucuauauuucccaggcu

SEQ ID NO: 4099452 - RNA, 81 nt, Human
agcuggucccccacucuaaaggagccuuuccuguucuuccaugccggaaggagcccgugguagaugggaggguguuuagcu

SEQ ID NO: 4099453 - RNA, 56 nt, Human
agcuguaauauaagcaaugaaaagaccguucuucacaugugucuuguguuacugcu

SEQ ID NO: 4099454 - RNA, 91 nt, Human
agcuguauccugacccagugcuuggcacuuugaaugagcucagcaagaguuuguugaacacuuagagugugagugcaugaguuagggggcu

SEQ ID NO: 4099455 - RNA, 56 nt, Human
agcuguauucucuuuguauuaauaucuuuaccguguuucacagggcagaaacagcu

SEQ ID NO: 4099456 - RNA, 57 nt, Human
agcugucucucugguguccauaugcauauguaucuuggugcaauaugagagauggcu

SEQ ID NO: 4099457 - RNA, 56 nt, Human
agcugucucugguauuaugugauauuugcacagcaaacuuuaaugccaggacaguu

SEQ ID NO: 4099458 - RNA, 56 nt, Human
agcugucuugaugauuggaugcuuaacagagcauauaaauucagccacagauaguu

SEQ ID NO: 4099459 - RNA, 76 nt, Human
agcugugacuccguuugcuggcuauggugucuccaggggcuggccccuggccuggcacagagcgguggucacagcu

SEQ ID NO: 4099460 - RNA, 57 nt, Human
agcuguuaucuucuaacuuuuccccugaagggccucgaagggcagagggaacagacu

SEQ ID NO: 4099461 - RNA, 57 nt, Human
agcuguugcagggaucagcaccugugccauccccacaguggcucccugaggacagcu

SEQ ID NO: 4099462 - RNA, 75 nt, Human
agcuuaagugcaggauguugggaaucaggacuccaauucauugaacaugugccugauccuuucaccugugaaguu

SEQ ID NO: 4099463 - RNA, 83 nt, Human
agcuuaagugcuuuugauugaguaaagaaagagggauaaggauuguuuauucuuuaccacuacucuuccaaagauuuuaagcu

SEQ ID NO: 4099464 - RNA, 71 nt, Human
agcuuaugcaauucucuuaauauucuugugguuucuuucuuggcuuauggauuguuuagaagugcauugcu

SEQ ID NO: 4099465 - RNA, 69 nt, Human
agcuuauuagaguuguguucuguuaccugcuacuaugacagcaaaaacaaggaauauucuaaugcagcu

SEQ ID NO: 4099466 - RNA, 61 nt, Human
agcuuccauacuaagacaaaaggguguaauuaugugauuuuugucuuuagcuauggaugcu

SEQ ID NO: 4099467 - RNA, 83 nt, Human
agcuuccuguacagaaauuccuacuacauuucuuuucucaugaugcacauuauguauaggaguuaucuguugugugggaggcu

SEQ ID NO: 4099468 - RNA, 98 nt, Human
agcuucgguggugacugcaucccucacauccgaggagggugagaugcucgccggccagcauucccuucuuaggaugggucaccgccaucggugaagcu

SEQ ID NO: 4099469 - RNA, 55 nt, Human
agcuucucaaguguuugcgggguugcaguaggcagcgcagagaugggaagaaguu

SEQ ID NO: 4099470 - RNA, 79 nt, Human
agcuucucagcgcaggugcccaugagcuccauggcgaugaagacguccgucugcagggagaggggcacccgggggagcu

SEQ ID NO: 4099471 - RNA, 68 nt, Human
agcuucugauguuuucugcuuuagcuacuguguucaccuucuggacuaaagaggaaagauguaaagcu

SEQ ID NO: 4099472 - RNA, 67 nt, Human
agcuucugcuguuuacugugugauaugcucacacacagaggagaugucauccggagacagugaugcu

SEQ ID NO: 4099473 - RNA, 62 nt, Human
agcuucuucuuggucuuucccaccuuuaacuguuggacuucuucaggacuaggucuugagcu

SEQ ID NO: 4099474 - RNA, 78 nt, Human
agcuugaggguugcaaaucagaaguauagauucaaauugcccugaauaugcacucugauuuagcaguacuugcaaguu

SEQ ID NO: 4099475 - RNA, 65 nt, Human
agcuugagguuauuuauuaugcaugaucauguuaaugguuacaugaauacauaaccauucauguu

SEQ ID NO: 4099476 - RNA, 127 nt, Human
agcuugauacacuggggcaaagccaguucuuagagaaagcuugauacacuacuuaaucuguuuuucccuuaaagaggcuggcuacaaaauaauaaugcuucuuuuuauguuucuuaaaaaaaaagcu

SEQ ID NO: 4099477 - RNA, 106 nt, Human
agcuuggcuggcaguucuuccagucucugcugggcuccucaugugacuguggucagcuacagcccacuggguagcucagcuucugggaguuggccagcuauuggcu

SEQ ID NO: 4099478 - RNA, 107 nt, Human
agcuuguacagcugcuuugauucaguaaagcuaaauuucuaagauuuccuugaccuuugcuuaaacugaguuugagacagacuauuuuucuuaucgccugaugagcu

SEQ ID NO: 4099479 - RNA, 80 nt, Human
agcuuuagggauggucagagacaggaucucgaagacugucuucaguccuuggucucucucucuuucuucaucucucagcu

SEQ ID NO: 4099480 - RNA, 62 nt, Human
agcuuuauucauuucaauauucucaggauuauauauuuugggacuggagcuuggagagggcu

SEQ ID NO: 4099481 - RNA, 112 nt, Human
agcuuugaauuuccugauguuuacauaguacaaagguuuauuagaagaggcugacgaaugucuaaaaggcucaguuucuucuauuguauuuucaaauagcagagaaauagcu

SEQ ID NO: 4099482 - RNA, 58 nt, Human
agcuuugagcugcuccugccuuugagacacauuggcugaagguccuuggcuggaaguu

SEQ ID NO: 4099483 - RNA, 75 nt, Human
aggaaaaagcauguggauucaugagugaaacagcagauaccccacugccaauuaccaaaucccgugcacauuccu

SEQ ID NO: 4099484 - RNA, 67 nt, Human
aggaaaagcauuuugccacuugaaguuaaggugugauucaaauuacaggauggcagagucaauuccu

SEQ ID NO: 4099485 - RNA, 92 nt, Human
aggaaaagugauggcaucuauaucauaaaucugaagaggaccugggagaagcuucucuggcagcuugugcuguuguugccauugaaaacccu

SEQ ID NO: 4099486 - RNA, 87 nt, Human
aggaaaaucgcugaucuacaggaaguaaguaaugaaauuaaacuagaauauccaagaguuuagacuuucuguccagugauuucuccu

SEQ ID NO: 4099487 - RNA, 86 nt, Human
aggaaagcaggacugucaugaucgaagaugucacagagugcacacaauuuugauaggaaugaucaugaucagggaaugguuuucuu

SEQ ID NO: 4099488 - RNA, 107 nt, Human
aggaaaggcaugaugagugggggaaggauuggggaaggaggguuguacaaaaggaucagaaauauuuucccccuuccacagugcuuccuaaaaauucugccuuuccu

SEQ ID NO: 4099489 - RNA, 56 nt, Human
aggaaaggcucugugguuccuaaaggcucagacucuuaacuacagcgcacuguccu

SEQ ID NO: 4099490 - RNA, 62 nt, Human
aggaaaguauacuuuguggaugcacaucagaacauuccgugccuuuacaauuuugcauuccu

SEQ ID NO: 4099491 - RNA, 66 nt, Human
aggaaauaaggaagucacaagaaucgcuaggagccuauuuuaggugauucuaaggggcugccuccu

SEQ ID NO: 4099492 - RNA, 92 nt, Human
aggaaaucagaagcucugccugucagcagcuuaagauuaauauauggguuuggcaagaaaaugugauugacaggcacugcuauugucagccu

SEQ ID NO: 4099493 - RNA, 82 nt, Human
aggaaaucuguaagcaauugcucagaggaggaggaaguagaagaaggaauuuggcugagcauguuuuacaugaaguauuccu

SEQ ID NO: 4099494 - RNA, 81 nt, Human
aggaaaugucaaauugucuucugaaguuauuguacaaauuugucaccccaccggcaguguauaaacuuuaacauaguuccu

SEQ ID NO: 4099495 - RNA, 71 nt, Human
aggaaauuuacacagcugggaaaauuuguacaaauaaucauuuguacuuaugagauccuagucguguuccu

SEQ ID NO: 4099496 - RNA, 85 nt, Human
aggaacacagcccccaaagaacagaccaaaaaaggauauuggugcaucuugcacauauccagguuucuuugguuuuguuuuaccu

SEQ ID NO: 4099497 - RNA, 79 nt, Human
aggaacagaaaaaaacaggauucaaaacaaggcacuugaaugaaacaagguccaguuuucaguucucauuuucuuucuu

SEQ ID NO: 4099498 - RNA, 79 nt, Human
aggaacagcauuuggaggagaggcuuuggggcucaaaggcaauuuccaaaaccaccucuguuagauguauuuuguuucu

SEQ ID NO: 4099499 - RNA, 117 nt, Human
aggaacagggccaacaggaauuaggguauuuuauugugugcaucuggaaguuggagaggccaucagguguuuaaggauagugaugucugucuguuucugacuuuuggcccuguuacu

SEQ ID NO: 4099500 - RNA, 74 nt, Human
aggaaccaccgcggagugauggagaaacuggucuaagacaagcgacagcguuuuguuauccgccccgguggccu

SEQ ID NO: 4099501 - RNA, 76 nt, Human
aggaacuagugcaacaggagcgagaccucagaauagauacagaacuaagcucaauucucuuauugcauuaguuucu

SEQ ID NO: 4099502 - RNA, 83 nt, Human
aggaacugcaguuaguguauauugccuucaaacauaacccaaaaauuguauuugaaaauuaagcagugauuuguagugguccu

SEQ ID NO: 4099503 - RNA, 87 nt, Human
aggaagaagccuccucaucuuaggugaugagacaguugauaggguuuucccuacugccuuccaccuauggaugaauauggucuuccu

SEQ ID NO: 4099504 - RNA, 79 nt, Human
aggaagacaaggaaacggauuuggguuaggucaccacugggaccacuguggagaauuaggccaaaucuccaugguuccu

SEQ ID NO: 4099505 - RNA, 58 nt, Human
aggaagacccugccaccauccuuuguauuuacaguguuuugucuggcagggcugcccu

SEQ ID NO: 4099506 - RNA, 87 nt, Human
aggaagacuuucaguuauuccccauucaauaugauauuagcugugggucugucauucauggcuuuuauuauguugagauaucuuccu

SEQ ID NO: 4099507 - RNA, 64 nt, Human
agccugcugugcucuccaccagcugggguucucuucugucggggcuguggggagucagggggcu

SEQ ID NO: 4099508 - RNA, 56 nt, Human
agccuggaagccaggacaccguccguuccaaugagcggcuucugcauuccagagcu

SEQ ID NO: 4099509 - RNA, 71 nt, Human
agccuggaugaacagcagguccuggcaugggugcugcacacccgagcucugaccccugcugcucccuuguu

SEQ ID NO: 4099510 - RNA, 85 nt, Human
agccugggaaguuccucagugucauuuccacgacauucaguugguauucaauugguaugaaugagucacuaaggccagccaggcu

SEQ ID NO: 4099511 - RNA, 76 nt, Human
agccuggguguguuuggcggcagaggcccugcucuuuuccucucuggggagcagcuguccccaaagcuuccuggcu

SEQ ID NO: 4099512 - RNA, 75 nt, Human
agccugugaaaucucugccacuaucaccaauuuuauagaugaggaugcugaggcagaggugaaguucacaaggcu

SEQ ID NO: 4099513 - RNA, 57 nt, Human
agccugugguuaugaauuuucagagaauauguaauauucugacccagagcccaggcu

SEQ ID NO: 4099514 - RNA, 60 nt, Human
agccugugugaagcccucagaguaucauucaugguugcagcagggcuacucacagagguu

SEQ ID NO: 4099515 - RNA, 75 nt, Human
agccuguuauguuuacaaaaaggaggcuugacuuacacaggguaaggcuccucauuugcuagauguggcuuagcu

SEQ ID NO: 4099516 - RNA, 128 nt, Human
agccuguugugauauauuuugaccauuggcuugcacacuauggauugucugugguguaauaccuugcacaauuuggacuucacugguuggcggccgagacucuugaaguuguagauguacaacaggcu

SEQ ID NO: 4099517 - RNA, 74 nt, Human
agccuuaaacaugaugacauuguaagcuucuuacagcaguguaauugaggcauggagauaaugucuucaagguu

SEQ ID NO: 4099518 - RNA, 86 nt, Human
agccuuagacuguuaacacgcaggcaguuaagaaagagaaguaaacuuccaucuuguuuaagccgcuguuaagccacugguaugcu

SEQ ID NO: 4099519 - RNA, 58 nt, Human
agccuucacugggaccuuggauggcugccgaaugaagccaucacguuucagugaggcu

SEQ ID NO: 4099520 - RNA, 70 nt, Human
agccuuggccguaagguaugcucccuaauacagaauaaagggcaggaugccacagugcggccagcaggcu

SEQ ID NO: 4099521 - RNA, 72 nt, Human
agccuuucagagaacucagaaugucuuucaucacagaaggauguggucuguuuucugagaugauuuauggcu

SEQ ID NO: 4099522 - RNA, 62 nt, Human
agccuuucauuuucugagaucaggaagauauuuucuugaagucacacagaaagugaguggcu

SEQ ID NO: 4099523 - RNA, 73 nt, Human
agccuuucucugggcuguuggcagccacugcaggcagcggagggagcgccaccugcccagagcacaugaggcu

SEQ ID NO: 4099524 - RNA, 76 nt, Human
agccuuuggaagagggaaugcccaaagaggauuuucaauuagucuugcuguguauugcaucucccuugccaucucu

SEQ ID NO: 4099525 - RNA, 77 nt, Human
agccuuuucauacaugaguucaucugcuucucuucauuauuccaugagcugggcugaugacucauguuuuauagacu

SEQ ID NO: 4099526 - RNA, 74 nt, Human
agccuuuugggaacugauuaagucaugagaacaucacccuuguauauggaauuaguguccuuauaaaagagguu

SEQ ID NO: 4099527 - RNA, 87 nt, Human
agcgaaauauuugacaaauccuucagcaauggccuaucauucaacauauauuagcacagugcuagguauuugcagugguauuuuguu

SEQ ID NO: 4099528 - RNA, 129 nt, Human
agcgaaccccggcagcacagaauucgaaccgccgcgggagccguugggacgcgccuacccggucacugccccgccccggcgcagacugcgugaggcgccgccgaaggcgcggggcuugccggggaucgu

SEQ ID NO: 4099529 - RNA, 70 nt, Human
agcgaacuucuuggaaucugacggcugugccuucaaccacaggcugcuguauuuauuuucuaggguugcu

SEQ ID NO: 4099530 - RNA, 62 nt, Human
agcgacccugcugugaaacuggcauaugauuuuuaaauuaugugaauacagcaguggaugcu

SEQ ID NO: 4099531 - RNA, 75 nt, Human
agcgagaggguaugugcugggugucuaagagcccagaaaugcauuagaagaagcccagcauggaaccagcucacu

SEQ ID NO: 4099532 - RNA, 63 nt, Human
agcgauucuaauuggagauuaacauguguccucaucacaguugaccuuauuuauggaguggcu

SEQ ID NO: 4099533 - RNA, 75 nt, Human
agcgcaaaggcgccgaacuucauguggcggaucuguguacgcaggacgcucucgcugaacuucuugcucuugccu

SEQ ID NO: 4099534 - RNA, 125 nt, Human
agcgccacaaaauccccuggggccugugagaacacagauguuggggcaccuccccagcauuucugauucaggagggcugggcagggccugagaaucugcauuuccaaugaguccaggguggcgcu

SEQ ID NO: 4099535 - RNA, 73 nt, Human
agcgcggccauggggauggagaugucacagucacaggcucuguggcucugaggaccaauuccuguggcuugcu

SEQ ID NO: 4099536 - RNA, 77 nt, Human
agcgcuuuccucuagucuaggccaauuuauuucacacguuuacuauugaccauuaacacaugcuggagggagggguu

SEQ ID NO: 4099537 - RNA, 73 nt, Human
agcggacuaggagccauaccuuucccagccucucgcacagcugggcagagagcuggaacuccuuggcauagcu

SEQ ID NO: 4099538 - RNA, 99 nt, Human
agcggagccuaagcuucagcugcgacaggggccugagcaucacgcgugaggggcggggcccagguugcaccucagcgcugaaaggcuuaaauuucugcu

SEQ ID NO: 4099539 - RNA, 119 nt, Human
agcggggcgggggggaggugcucuuuucgucucuggccacaaggggucgcugugaccucgccugugcauccgguggucauugacaucaaagccaggucucccccuccccagccccgacu

SEQ ID NO: 4099540 - RNA, 101 nt, Human
agcggugacuggcgagucggcagcgcggcugccagggcaucccgggcucugucuggcuucccugagccgccugccgugucccugcuuggaaauucacugcu

SEQ ID NO: 4099541 - RNA, 70 nt, Human
agcggugccgggagccuuggagaagcagugcugccuggcugcugcagcuccucuggcugccugagcugcu

SEQ ID NO: 4099542 - RNA, 67 nt, Human
agcgguuagagaaaggauauaacccuuuuaguauucuagcauguuugaauuccuuucuuuaccuguu

SEQ ID NO: 4099543 - RNA, 84 nt, Human
agcgguuuaaugcuauucauugaagcacaagugaucuugaaggaaacugagagauauucuuuuucaaggacagcuuuaauagcu

SEQ ID NO: 4099544 - RNA, 75 nt, Human
agcgucauguuggcacugguuccccuugccccucaagucccacagggguaaccuggaugugccaacgugaaugcu

SEQ ID NO: 4099545 - RNA, 129 nt, Human
agcguucacagugcuaggaaugaugcaagacaggggaggauggaagcggcauuggaccagcaguuccagcaggccaggcugccaaagcuucugucuccccucccucgcuucccuauuacugggagugcu

SEQ ID NO: 4099546 - RNA, 56 nt, Human
aggggugggaccaggaauguuugaguuucaaucucagcuauuccugauucaucuuu

SEQ ID NO: 4099547 - RNA, 79 nt, Human
aggguaacuguuguagcugcgcugcuucagagcuuggcauucugaguucuuggacggugggguugacagcaguaucccu

SEQ ID NO: 4099548 - RNA, 75 nt, Human
aggguacuguuuuagucauauaucauaaugcaauuucagaauguuuauugauuguaugauugaaauauuuacuuu

SEQ ID NO: 4099549 - RNA, 66 nt, Human
aggguagcaggcagagagggguuuccagaaccaucauuugaacccucacucugugccggccacccu

SEQ ID NO: 4099550 - RNA, 60 nt, Human
aggguagcauguguuauuaaaacuuguaucacaauacaggccaauaucacaugcuaugcu

SEQ ID NO: 4099551 - RNA, 76 nt, Human
aggguagcauuucaggaggaagauacgggcugacuggcaaucacccccucucuggucucuuucuggaagcuucccu

SEQ ID NO: 4099552 - RNA, 69 nt, Human
aggguagucuucaugcugggguccucuggcugugggagcagcauggggcuccgcaaugaacaaggcccu

SEQ ID NO: 4099553 - RNA, 96 nt, Human
aggguaguuuccauuaccuauuguuacuucuugguaaaggagacaaagaugucauccaugaagagugacagaagguucuuagggaacugggcaccu

SEQ ID NO: 4099554 - RNA, 94 nt, Human
aggguaugcuuggcuugucacagcagcaaaggcucugacaaaugaugaagaagauggggccuuuucugaauguggaaauggccgggugaucccu

SEQ ID NO: 4099555 - RNA, 80 nt, Human
agggucaaaacucugguuucagacucacuugcuccaauucuuaucuaggauuauguuaguuuguagaguagaugugccuu

SEQ ID NO: 4099556 - RNA, 63 nt, Human
agggucaugucccugcuggucagaaggcaggaugagggccggccuugagcaggggcugaccuu

SEQ ID NO: 4099557 - RNA, 77 nt, Human
agggucuccucuaugagcucagcgugggucuguuuuaagcuaauucaaaacccuuccaaaugagcuuauuagauucu

SEQ ID NO: 4099558 - RNA, 62 nt, Human
agggugaacaaucauaccacaauuauuuuguaagaggaaauuuggaagauguuguuuauccu

SEQ ID NO: 4099559 - RNA, 73 nt, Human
agggugacuuuucugaacuugguacuggagcuauucuuagauccaacuuucauuagaaaugcagugucaccuu

SEQ ID NO: 4099560 - RNA, 89 nt, Human
agggugagaaguagucuaucuaugguuaguggccauuuucucuaguucacagaccaugcauauugauuauagauucagaaaguuacccu

SEQ ID NO: 4099561 - RNA, 57 nt, Human
agggugauaguuuagagagucagccuguuagauuggcugauuucucuucuauuccuu

SEQ ID NO: 4099562 - RNA, 57 nt, Human
agggugcagaaggagccuaggagucgaauauacuguccuuuauuccuucuguauucu

SEQ ID NO: 4099563 - RNA, 75 nt, Human
agggugcagcuuucugcaaugucauccagccagucaccacaggggcaggaugaacagggcaggcaagagccuccu

SEQ ID NO: 4099564 - RNA, 63 nt, Human
aggguggcagagaggagguaguuuagagaagucucuacacuaucuuaauuuuucuguaaaccu

SEQ ID NO: 4099565 - RNA, 64 nt, Human
agggugggaagagggucugguagucacuaggguuccccagccauuccuugcucucaucaaccuu

SEQ ID NO: 4099566 - RNA, 88 nt, Human
aggguggggaugguggggacgguggugguccagggacagacaaaggugucacugcucucuaagcaucgccacuucccauccccauccu

SEQ ID NO: 4099567 - RNA, 67 nt, Human
aggguggggcagguuggcacuucccucuggcucuccccggagcagggcuugccgcuuguccuccucu

SEQ ID NO: 4099568 - RNA, 62 nt, Human
aggguggugaaugggauuuuccugaagaaaaauggguugucaguauguuccuucccacaccu

SEQ ID NO: 4099569 - RNA, 60 nt, Human
agggugguuggaguggauguugagggccaccccaccauauccaccauucugcaccuuccu

SEQ ID NO: 4099570 - RNA, 60 nt, Human
agggugucagccacggaaugggacaggguccccagguucccugucugagguugggacccu

SEQ ID NO: 4099571 - RNA, 55 nt, Human
agggugugauuucagacugucuggcugagagucugucucugcuaaucacuacccu

SEQ ID NO: 4099572 - RNA, 129 nt, Human
aggguguggccaacugacuagaucaagauguggggcagggucuggacugaaagcugaggggccacucacacuggcagcuuuggggacagccaagguugccccaugcuucagugggaaggugauuuuucu

SEQ ID NO: 4099573 - RNA, 78 nt, Human
aggguucaugaggaugacugaccccuugucuuaaaaagaaggccuagaagagggcguucagucagugucucuaaccuu

SEQ ID NO: 4099574 - RNA, 59 nt, Human
aggguucugggccuuacaggugagaaaagaaugucacuuccuggcaggcccaggacccu

SEQ ID NO: 4099575 - RNA, 115 nt, Human
aggguugaaguagauuuuuuccacaaggaagaugaugagcacuggagucaaagggaugcaguucaaaucccagcucuguugcuuucuuccugugugauuuuggaugagugacccu

SEQ ID NO: 4099576 - RNA, 75 nt, Human
aggguugcacaggcaccuccagggguauguucuggccacuccgugcugcaaucuuggggcugccugcccaucccu

SEQ ID NO: 4099577 - RNA, 63 nt, Human
aggguuggggaagcccuaagcaccccugagccugaagggggcaaagggagagucccuacuccu

SEQ ID NO: 4099578 - RNA, 110 nt, Human
aggguuuuucuauuuugauccucuaaugaagcugcuuucuaugacuauagaauccccuuccucacuuuuuucaucuggaagcaggcuacucaugauuaaaagucgacccu

SEQ ID NO: 4099579 - RNA, 80 nt, Human
agguaaaauagcaaaaaugacaaaagaagacaugagguguuuaaucacccucuuuuucuuaggucagggcuaugcugccu

SEQ ID NO: 4099580 - RNA, 76 nt, Human
aggaaugaauggagaacaacuuugaaacaugaagagauguuuucuucuaguacagacuguuguuccuguucuaccu

SEQ ID NO: 4099581 - RNA, 81 nt, Human
aggaaugaguaaacuaguuuugagauggaaaugcaggucauuaucagauuuuuagcauauccuauaaaacuacucauuuuu

SEQ ID NO: 4099582 - RNA, 97 nt, Human
aggaauggggcuucgggcgcugggcgcgcuccgaacccggcgcacguaagagccugggagcgcccgagccgcccggcugcccggagccccaucgccu

SEQ ID NO: 4099583 - RNA, 68 nt, Human
aggaaugguuauggggauaguagaaucauuugcuaggggugacagugguaucugcauaacuuauuccu

SEQ ID NO: 4099584 - RNA, 58 nt, Human
aggaaugucugagaaagaggcacuggacugccugccuugaaaaacucagcugucuccu

SEQ ID NO: 4099585 - RNA, 55 nt, Human
aggaauguuaggagaugagucuagagauuaugcucagauuauuccuaagauuucu

SEQ ID NO: 4099586 - RNA, 77 nt, Human
aggaauguuuuucauugcucucuuuccugcccugaaugaggaauagacacuugggguagagaacgaagaacauuucu

SEQ ID NO: 4099587 - RNA, 72 nt, Human
aggaauuacuuugggauauuauuuuagauucuuuuaaaaguuuucagaauauuauuuuaaaggcuuguuccu

SEQ ID NO: 4099588 - RNA, 60 nt, Human
aggaauucuggcauuuuauuauggagcugcacuauugcagaauccuauugucagauucuu

SEQ ID NO: 4099589 - RNA, 73 nt, Human
aggaauucuuguaaauuuugugugaaguauaucaaacauuaaaaaguacuuuuaugaagccaacaaguuuccu

SEQ ID NO: 4099590 - RNA, 70 nt, Human
aggaauugggaaauauggauuguuauuccuuuaaaucaccuugggaaaaugauuuaucuucucugguccu

SEQ ID NO: 4099591 - RNA, 110 nt, Human
aggaauuguuuuucauguauaucccgcugcauuuuacuuaccuguuaguugccugucucuccaacuaggcuguaaagagcuaggaggaagaaugugaauugcagcuuccu

SEQ ID NO: 4099592 - RNA, 72 nt, Human
aggaauuuggaauuuuuccugugugaaauuagaagcccuuggaggcuggugaaggagaaauucgggacaccu

SEQ ID NO: 4099593 - RNA, 109 nt, Human
aggaauuugguacuugggggaacacaagaaagacuacuguucaagcaauguuuucaauuuauuugugcagagaaaucuuucuuggaaaccuccuaaguuucauauucuu

SEQ ID NO: 4099594 - RNA, 62 nt, Human
aggacacagguaagccaguggaugcgggaccuugccccagccauucugaagcucuguguccu

SEQ ID NO: 4099595 - RNA, 62 nt, Human
aggacacagugguggggaaaaggguugucuaggcagggaccuugucuucauuauggugcccu

SEQ ID NO: 4099596 - RNA, 83 nt, Human
aggacagcugcuguugaaucagaaguccuggcucugcuguaugcauggcauagguccuuguucaacugaaaagcaguuggccu

SEQ ID NO: 4099597 - RNA, 60 nt, Human
aggacaguggcaaggcaggacacuagugaagagugccaggaaagagccuuacccuguccu

SEQ ID NO: 4099598 - RNA, 86 nt, Human
aggacaguugugugcugguaaauguuuguaaauuggcucugaggagcagggagcccugauuugcagcauuugucaguaucuguucu

SEQ ID NO: 4099599 - RNA, 71 nt, Human
aggacauaaagacacccagggagggacuagggugacucagaacuucgggucucuuccgugaguguuuuccu

SEQ ID NO: 4099600 - RNA, 61 nt, Human
aggacauaugcaggagcugcauuuuaggaagcuaaguccagcaguuuauguaauaugcacu

SEQ ID NO: 4099601 - RNA, 64 nt, Human
aggaccaagguugucuuuuauacugaacacuuccucugccccagugcucaacagcucggguccu

SEQ ID NO: 4099602 - RNA, 75 nt, Human
aggaccaggcccuuuuggaauugugaauagguuuauugccuuacauccugguacacauguccaaggucagguccu

SEQ ID NO: 4099603 - RNA, 56 nt, Human
aggaccauuaugcuugcugaaacauggaucucccaaguuuucacauacuggauccu

SEQ ID NO: 4099604 - RNA, 57 nt, Human
aggacccaggcucgugggacggcucaggccccugccucgguguccagccuggguuuu

SEQ ID NO: 4099605 - RNA, 95 nt, Human
aggaccugaaauugugagacugaaccaaauaaaacugaaucauguguuuuaaacuauauauuuggucagaacucucuuuaguguagccaaguccu

SEQ ID NO: 4099606 - RNA, 58 nt, Human
aggacgcaaugaucacuuguccugugaacagucuacuuuugucaucauugcaacuccu

SEQ ID NO: 4099607 - RNA, 97 nt, Human
aggacuauaguuuuuacaucuuugcuuuaaugagauuuugccauggguuauuugaugcuagauuuuaguuuggaaugaagauucuaauuaugguccu

SEQ ID NO: 4099608 - RNA, 76 nt, Human
aggacucucccuguguuguuuuauguucacuacuaauucuucaagcaggaacugaugagcagccagggagauuccu

SEQ ID NO: 4099609 - RNA, 96 nt, Human
aggacucuggaggccacagaaaguugucuagaguagagauauacuacaucuccuccucucuuuagacauccaguuucucucagguuucuauuuccu

SEQ ID NO: 4099610 - RNA, 62 nt, Human
aggacugacuuuugccaugaaacuugccagucacuccugugagauggcaaaucgucaguccu

SEQ ID NO: 4099611 - RNA, 86 nt, Human
aggacugcauuuuuccauucucuguuaguaaaauaucucagcugccuuuugauucugcuagcugcgagaauggcagaauggggccu

SEQ ID NO: 4099612 - RNA, 55 nt, Human
aggacuggcaauucucuaaggcugacacucucaagccaaggggguagcuauuccu

SEQ ID NO: 4099613 - RNA, 62 nt, Human
aggacuguauacucuaggugaacugaauuaccuuccguucacuaugcccagaauacaguuuu

SEQ ID NO: 4099614 - RNA, 60 nt, Human
aggacugucugagacuuucauuuguucugugcaacauauaagucaauacagauaagucuu

SEQ ID NO: 4099615 - RNA, 75 nt, Human
aggacugugucaauuaauguuugauguguguguuuccuuacuugacagacauuuuaauuauuaaaucucaguuuu

SEQ ID NO: 4099616 - RNA, 129 nt, Human
aggacuguugcuccuagaaaauaucacuaaucucuuuaugagaagaagguuagauuggguuaccuucuuucuuuguuuuuccucugguuaaagagauuaaauagacauaaggcaacugauuaauaaccu

SEQ ID NO: 4099617 - RNA, 93 nt, Human
aggacuuggccuugaugacaggguggcuggaggaaucagaacggucagaccuucuuugaccugcgggcaccuuuaguuggaauggucaggccu

SEQ ID NO: 4099618 - RNA, 66 nt, Human
aggacuuuagagccagaaagacgugaguuugaauccccuuucuaucacuucuuugcugcaaguccu

SEQ ID NO: 4099619 - RNA, 77 nt, Human
aggacuuucacgguggcugugugagaguagaagucggauucuuucauucccauagccauccggagagagcuucuccu

SEQ ID NO: 4099620 - RNA, 72 nt, Human
aggacuuucuucuccacuggccauuuccucuguuacggagacuaacaaauugccagggaguuaaagagucuu

SEQ ID NO: 4099621 - RNA, 80 nt, Human
aggagaaaagaaagggagaaggauggugugucagaaacuauugauuauucucacaauaucaguucuucuuuucuuucccu

SEQ ID NO: 4099622 - RNA, 63 nt, Human
aggagaaggaagugcaucacuagcagaaaaguugguaaagaguacuuuuccuauuaguuucuu

SEQ ID NO: 4099623 - RNA, 90 nt, Human
aggagaaucgcuugaacccgcgagguggagguugcagugagcugagauugugccacugcacuccaacuugggcaacagagugggacucuu

SEQ ID NO: 4099624 - RNA, 57 nt, Human
aggagaaugguacaauauaucucugaaaugggaagagauuuaguggcuguucuaccu

SEQ ID NO: 4099625 - RNA, 55 nt, Human
aggagacagaauuuaaauuugggucuugcugacuccaaagugaaugcuguuuucu

SEQ ID NO: 4099626 - RNA, 55 nt, Human
aggagagaagcaucugcagccagaagccuugagcacugguccagcuucuucuccu

SEQ ID NO: 4099627 - RNA, 74 nt, Human
aggagagaggaagaugggagagcucuggaaugacugugauuucuccacccugcuuucuuaucucccuuuauccu

SEQ ID NO: 4099628 - RNA, 75 nt, Human
aggagaggaggccaggcccacaccucugcacggccaguuucaggcugaauagguccucgggcugcuuccuguucu

SEQ ID NO: 4099629 - RNA, 100 nt, Human
aggagaggaugugacacaagagaaaugauuccugggcagaucgugauuccuggaugaucccuaugggcuucauuucuugaauucacacagauacccuucu

SEQ ID NO: 4099630 - RNA, 73 nt, Human
aggagaggggcagggcaggacagugaaaauagguugauggaucugaaaugauugaccuguuuagucucucccu

SEQ ID NO: 4099631 - RNA, 90 nt, Human
aggagaugccuggccuagggcuuggucauggcagggauaaaagcccaucacuguuaucuucuacaaggccugcuggccuaggcaacuccu

SEQ ID NO: 4099632 - RNA, 130 nt, Human
aggcugggguccuccugggggacagcacagucaguggagagagccaggggcuggagguggggcccaccccagccucuggucccagcucugcugcucacuugcuguguggccucaagcaggucacuggccu

SEQ ID NO: 4099633 - RNA, 79 nt, Human
aggcuggggugcaauggcaugaucccaguuuaccgcauccuccacuuccuggguucaagcaauucuccugccucagccu

SEQ ID NO: 4099634 - RNA, 63 nt, Human
aggcugguggagagugggcucuggagucagccuuccaguuuugaauccugcuucuaccaacuu

SEQ ID NO: 4099635 - RNA, 64 nt, Human
aggcuggugucucuguccugucaaguauauguuaaaguugcuuacagccacaagagaucagcuu

SEQ ID NO: 4099636 - RNA, 56 nt, Human
aggcuguagugcaugugcuaugaucaugccugugaauaaucauugcacucuagccu

SEQ ID NO: 4099637 - RNA, 59 nt, Human
aggcugugcucagccaaugggaccugcuccucccuugaagguugcagaggccacagccu

SEQ ID NO: 4099638 - RNA, 68 nt, Human
aggcuguguucucaucuggaucucaggauucucuuauaaguccaugugguugugguggaauuuaguuu

SEQ ID NO: 4099639 - RNA, 87 nt, Human
aggcuguuaugagaagguuccuuuagggaaaucgucucacccuugagagugaaucugauuucccuggaggccucauucagauagccu

SEQ ID NO: 4099640 - RNA, 65 nt, Human
aggcuguuuaaugcaaugaaaugaggcauuagauugaagcccauuucaagugcuuugaauaaucu

SEQ ID NO: 4099641 - RNA, 62 nt, Human
aggcuuaacuuaacuuuagagcucuucaaagaaaaucuaagcuacucauguuaagcaagccu

SEQ ID NO: 4099642 - RNA, 79 nt, Human
aggcuuaagugcagugguacaaucacagcucacuguagccucaaccuacugggcucaagugauuguccugccuuagccu

SEQ ID NO: 4099643 - RNA, 70 nt, Human
aggcuuaauaggucaaugggaggcagaacuuggacuacuaauugaaagaauguuuccccugaccaagccu

SEQ ID NO: 4099644 - RNA, 69 nt, Human
aggcuuauuaagucacacuagacaacugagguugccuaagacgucauuguccuggacuugcaagggccu

SEQ ID NO: 4099645 - RNA, 75 nt, Human
aggcuuauucuccagggaugccaagcuuuaccaugcacauauaauaguaacagcagcuucccugugaaugugcuu

SEQ ID NO: 4099646 - RNA, 101 nt, Human
aggcuucuaccacagacgccgaaagaggcagaucugccugcagcaggguacaaccagagcaggcagggacuuugcaaaucuuucuggccggugaaaaguuu

SEQ ID NO: 4099647 - RNA, 80 nt, Human
aggcuucuggguugcuuccuugggaaaauuagaugcaauuuauggguugugucuugcaagacaggcaaauacccuggccu

SEQ ID NO: 4099648 - RNA, 60 nt, Human
aggcuucuuuuagaggggaugguuugauaaaacugaagaccucauguuagaagaaggccu

SEQ ID NO: 4099649 - RNA, 68 nt, Human
aggcuugaauucuuggcccaauuucucucacuucugcaugaagucaccaaaugccagugauucugcuu

SEQ ID NO: 4099650 - RNA, 83 nt, Human
aggcuugcaccaaaguggcaguguggagggaggaguguggucuuuggagccagcccaggccugcacugcccuugggcaagucu

SEQ ID NO: 4099651 - RNA, 104 nt, Human
aggcuugccugccccagccagguucgguggagucgggagccucgaggguuuucccugcugaggcucuuccuccccugcuccuccuggggcaguggacacagccu

SEQ ID NO: 4099652 - RNA, 60 nt, Human
aggcuuuaagcaagcauauuguuguauuuuaauuacuucaacaauacucuuguggagcuu

SEQ ID NO: 4099653 - RNA, 71 nt, Human
aggcuuuagguucagucuuuggaccccuccccagaguggggaguucuccagaggugaaccccacgaagcuu

SEQ ID NO: 4099654 - RNA, 83 nt, Human
aggcuuuuaaagagccauuguaugguuuugggagaacauaugcccauagauaaaaguaaugguuacuuuauaguguugagccu

SEQ ID NO: 4099655 - RNA, 70 nt, Human
agugggucuguacauuuggggaccccagguccauccagugggggccuggccucccagaguggggacaacu

SEQ ID NO: 4099656 - RNA, 81 nt, Human
agugguaaaagccugaaauucugccucugcacaaaccaugcuaaguggaaauuugugacagaagaggcuccuuuuauugcu

SEQ ID NO: 4099657 - RNA, 72 nt, Human
agugguacuuucuuugaggaaaaagauuccaaacaauuccuggaaacucuaccucucuaagaagauggcauu

SEQ ID NO: 4099658 - RNA, 103 nt, Human
agugguagaaucgcugagucacuuggcaaguaucuauaaaguuugauuuacuguguguuuaaguuugaggaauugccaaguuuuccaaagugguuguaucauu

SEQ ID NO: 4099659 - RNA, 76 nt, Human
aguggucacaguucauaacggacauguaguguaaaacaugaacagggucauuuuaugaucugugaacuucaccacu

SEQ ID NO: 4099660 - RNA, 78 nt, Human
aguggucugcaguuuggaaaaugugccucugggauuucaguuuguucuauagaguugugcccaugacugcagaucucu

SEQ ID NO: 4099661 - RNA, 55 nt, Human
aguggucugccugccucagccuccuaaagugcugggauuacaggcaugagccacu

SEQ ID NO: 4099662 - RNA, 55 nt, Human
aguggucuuagcuugcugggcuccaugggggugggaucugccgagcuagaccacu

SEQ ID NO: 4099663 - RNA, 111 nt, Human
aguggugauauggcagugccaagcaguggcaucgccagaguaucuguuugguuagcaaaugagcagucauuuuaggucaugcagauugcugauaucugcccaguagccacu

SEQ ID NO: 4099664 - RNA, 68 nt, Human
agugguggcaguagacagugcaucuacaggagaaguggcccuuuggaaugcauggcucugugacggcu

SEQ ID NO: 4099665 - RNA, 68 nt, Human
agugguuguuucucuggucuugagugacuguguccacaguucauuuuuuuccgguaggaauaacuccu

SEQ ID NO: 4099666 - RNA, 72 nt, Human
aguguaagguuuugagaccagaacguuuggagguugaaagcauuuggagguuugggugucaagaucuucauu

SEQ ID NO: 4099667 - RNA, 73 nt, Human
aguguacaucuaguuaauuguucuaauguuuggcagcacaaugcauauagaacauuugacauuauuugugacu

SEQ ID NO: 4099668 - RNA, 81 nt, Human
aguguagagauucagcagaggugguucacauuguaaguaauacuuauaguuacucaugaucuuauggcuuacuccuacacu

SEQ ID NO: 4099669 - RNA, 72 nt, Human
aguguagccucgcuaugcuuuugcucuguguaaagaaucauacacagagaauucccauaugugauauacacu

SEQ ID NO: 4099670 - RNA, 60 nt, Human
aguguaggugagggccuggguuccaggugggggacugggguuucaggugaagccugggcu

SEQ ID NO: 4099671 - RNA, 55 nt, Human
aguguaguagaggcuuuagagucugaaagaccuggguucaaagucuggcuccacu

SEQ ID NO: 4099672 - RNA, 70 nt, Human
aguguauugauuggaacagccucucucggguugcccaagcccacugauaauggguguuccagugagcacu

SEQ ID NO: 4099673 - RNA, 79 nt, Human
agugucagcccugaaacaaccuccucucaaucacaaaaccaccacuugagaugcuguucuggucaugggcugcaauacu

SEQ ID NO: 4099674 - RNA, 82 nt, Human
agugucaucuucgcagagugauuuuucuuaaaacccuggccucugugauauugagaaagucacaauauuggaaggugacacu

SEQ ID NO: 4099675 - RNA, 70 nt, Human
aguguccacugcguuccugggaagggcugcgaggccugcccuccaaaccugacuggggaugggcggcacu

SEQ ID NO: 4099676 - RNA, 79 nt, Human
agugucuagcaugcaugguucacugacaucucuucccacccccauccgucacccaacagcauauucaugccagacuacu

SEQ ID NO: 4099677 - RNA, 58 nt, Human
agugucugagcuaucauuaggggcacuaauacauuucccuagcaugguuucauauacu

SEQ ID NO: 4099678 - RNA, 57 nt, Human
agugucuggucucugaacuaaaagaacaacccuuuugaauuuuagagauucaggacu

SEQ ID NO: 4099679 - RNA, 55 nt, Human
agugucuguagcugccccuuuccacaaaagguggcaggaagcaucuauagguccu

SEQ ID NO: 4099680 - RNA, 69 nt, Human
agugucuuccuauacugggagcauuuaucuauuuauaagguuugauuuccuaauuuagggauagacauu

SEQ ID NO: 4099681 - RNA, 78 nt, Human
agugucuugauacuguuuuugagaauaguaaugcuucaaauauuuggagcaccauuucucuaaagcacucaaaacgcu

SEQ ID NO: 4099682 - RNA, 61 nt, Human
agugugaccuuauuuaagaaauuccaucuguaaugaugugauuuccaaauaaggucacauu

SEQ ID NO: 4099683 - RNA, 68 nt, Human
agugugaguuuggggugcgggguuccggagccuucucuggcagcccucggguacucacgugcuccacu

SEQ ID NO: 4099684 - RNA, 101 nt, Human
agugugcugauuaaaucauucaauucaacuugccuuuguagcucagggaaaucauuaaaaauggagcuggcuguugaauaauggcauauauuuggcacucu

SEQ ID NO: 4099685 - RNA, 84 nt, Human
aguguggcaggaaucacuucaccaguucggaggguuccccucaggggaucugacuugcugguggguaauguggugggccacacu

SEQ ID NO: 4099686 - RNA, 67 nt, Human
agugugggcugugcagaugggccugggccacucccaggcagaggcucugaugcaagcccagggcacu

SEQ ID NO: 4099687 - RNA, 125 nt, Human
aguguggguguggacuccaggcugucccacagcagaacaggcagggaagcuuguguaaccccaacaaauaaaucaaguacugugugcuucugcuuugaggccuguugccauguggaacccacgcu

SEQ ID NO: 4099688 - RNA, 95 nt, Human
aguguguucuagugacacucaaacuggacucacuauggcuucagauuguucuagucugagcugagugagcccaggcaccugcacaagagcugccu

SEQ ID NO: 4099689 - RNA, 76 nt, Human
aguguuaaacagcuuucagaaucucucauuccuuacuuuaaaaaaaaugagaauuccacuggaguuguauugcacu

SEQ ID NO: 4099690 - RNA, 58 nt, Human
aguguuaauaucuggcccuaggcccgaggcuucugguuaagcucaguguguuaacacu

SEQ ID NO: 4099691 - RNA, 55 nt, Human
aguguuauuuaggcaguauauuuugcuuaaaaugugcuuugcuggaaaugucacu

SEQ ID NO: 4099692 - RNA, 61 nt, Human
aggagauggagcucagugggcaagccagggucucaggucagguccaggggcuccaccuccu

SEQ ID NO: 4099693 - RNA, 88 nt, Human
aggagauuaccaauuuauacaccaucacugccuuggccuggaagcgggauggcucacggcucugugugguguguuacuaguaaucccu

SEQ ID NO: 4099694 - RNA, 93 nt, Human
aggagauuagauucucauaggagcgugaaccuuauuguaaacugcacaagcaagggaucuaggcuguaugcuccuuaugagacucuaaugccu

SEQ ID NO: 4099695 - RNA, 70 nt, Human
aggagauugguauggaugcuuaagguuuaaugaguuaaacgugaaaucucauuauuuauaccauaauccu

SEQ ID NO: 4099696 - RNA, 64 nt, Human
aggagcaagacucacugcaucuugcaguuguacugcagagcuggccugugauuuuugaacuccu

SEQ ID NO: 4099697 - RNA, 58 nt, Human
aggagcagaacugauucugacuuaauugaauuuaaaagcagguauuacaucugcaccu

SEQ ID NO: 4099698 - RNA, 70 nt, Human
aggagcagaauuuaaugugcagggagugggugacuauuaaauucagugacugcagcaaaacuuugcuccu

SEQ ID NO: 4099699 - RNA, 130 nt, Human
aggagcagacuuuucucuugucacuuuggaaggagaggauugugaggcugccccuuuaaauagcauucccguaggaggcagaucacauccauccgucaccuacugccaaagcaucauuuuugguuucuau

SEQ ID NO: 4099700 - RNA, 130 nt, Human
aggagcagcacugucauuuacuugcuuuccagugugccuuccugggagacccagcuguggaguuacagcucacagaggugacugggucccaaggaguaggucagguggguggaugccaaccuguccuucu

SEQ ID NO: 4099701 - RNA, 84 nt, Human
aggagcaggcucccauccagugggacagagaaacccugggguguagcucugugucccacugugugaugacgugugcgugcuucu

SEQ ID NO: 4099702 - RNA, 73 nt, Human
aggagcauugggugaauaaccuacuccaggccuugcagccaacuagccaaggcaggucuguaucuagucuccu

SEQ ID NO: 4099703 - RNA, 62 nt, Human
aggagccauggaggugaggcgggcaagccacagaauaaucccucuucaccuccacugcugcu

SEQ ID NO: 4099704 - RNA, 58 nt, Human
aggagcccuccguugcuucauccucacuaacccugucccagagcagaggaggguuuuu

SEQ ID NO: 4099705 - RNA, 56 nt, Human
aggagcccugcugacaugggugucugugcaccacgcaaggacacagcaggguuucu

SEQ ID NO: 4099706 - RNA, 92 nt, Human
aggagcccugguuccuuacagugagggugacauuuacaaaccacgaucugggugcuuguugugcucacugucacagggauaucauugcuucu

SEQ ID NO: 4099707 - RNA, 86 nt, Human
aggagccuccccagcucgcgggugacgggugugguuuguaaauaguuuaugcaccuguuacauccacguguugcgggacugcuccu

SEQ ID NO: 4099708 - RNA, 85 nt, Human
aggagccucguuguggggagaaauagagccuccccgaagguagacaggugacaggcucuguuucuccaugcuguggcuggcaccu

SEQ ID NO: 4099709 - RNA, 92 nt, Human
aggagcuaaaugaaaugggccagguguuacacgaguguuaaaaugaugguauuuugaccaagcagaauaccugccucauuucuuugccuuuu

SEQ ID NO: 4099710 - RNA, 80 nt, Human
aggagcucagacugcacacccuggucucugacaccaaggcucgcuccaugcccaggacuaggggcagcgugggagcugcu

SEQ ID NO: 4099711 - RNA, 72 nt, Human
aggagcucugggcagggccucccacgcccagccccacuaugcaccaggagacaccugccacccagagcuccu

SEQ ID NO: 4099712 - RNA, 78 nt, Human
aggagcugggaauuggaucaucuaaaacuggggguaaaagaggaaauacucuagacagaggucuuccaaucagcuccu

SEQ ID NO: 4099713 - RNA, 67 nt, Human
aggagcugugcagugggaguucggugcagguuagccggccauugcacucuggcuggaacgggcuccu

SEQ ID NO: 4099714 - RNA, 83 nt, Human
aggagcuuaccaucuuuagugugaauuuauugagggaaauuaagucccugcauuucacagacugagaaauggcuucuguuccu

SEQ ID NO: 4099715 - RNA, 59 nt, Human
aggaggaagggaagacaaguaagagggugaagccagucucccugucuuccuuccauccu

SEQ ID NO: 4099716 - RNA, 59 nt, Human
aggaggaagguagcagacgugguaaaguguuuguuccacauggaagcugcucuucuccu

SEQ ID NO: 4099717 - RNA, 58 nt, Human
aggaggagcccacucaaaggggagacagaggcagugcucccugugagcagcucuuccu

SEQ ID NO: 4099718 - RNA, 93 nt, Human
aggaggagggagggcagugcggacccacagcugugggcccaggggugauccuuggcaccagggcaagggucuuucucuugcaucuuuuuuccu

SEQ ID NO: 4099719 - RNA, 88 nt, Human
aggaggauagugaugauaucucaugauuugaguaguaaacuuccuuuaggaauacuuaacuguggagucauugagaucauuguucccu

SEQ ID NO: 4099720 - RNA, 60 nt, Human
aggaggaugaguugcauuauaaauguacccccuuugguacuaaugcuuaacacauccccu

SEQ ID NO: 4099721 - RNA, 80 nt, Human
aggaggauggcaagaaugcucagucccuggaagcugaacaccucauuauaguaccagagccuggcaucugcauaauuccu

SEQ ID NO: 4099722 - RNA, 66 nt, Human
aggaggcaucaggggagaucugguggucaaggguucucuccaccagagccuucccaugcuccuccu

SEQ ID NO: 4099723 - RNA, 83 nt, Human
aggaggcauucagguggcuucggggaguggcagccugugggggcgcagccgagccccuuccugagggcuuuccuuugcuuccu

SEQ ID NO: 4099724 - RNA, 59 nt, Human
aggaggccaggaugggaacucaaggccuguucuacuuuggauucaguuucugggcuucu

SEQ ID NO: 4099725 - RNA, 68 nt, Human
aggaggccuacgcacaugucuaaauugagcuuccuuuuuaccugcuagacaaguucugugggucaccu

SEQ ID NO: 4099726 - RNA, 56 nt, Human
aggaggccugcagcguggucccugagggcucucggggacccaugaacagguucccu

SEQ ID NO: 4099727 - RNA, 84 nt, Human
aggaggcugaggagugugauggcagucuugcucucuaagaggcuguugucagagggcucuuggcugccugcuccauggccuccu

SEQ ID NO: 4099728 - RNA, 89 nt, Human
aggaggcugcugggguugucccagggggcugugguuugaggggacugugcuguuucggccuccuggggaacucaggcccagcugcaccu

SEQ ID NO: 4099729 - RNA, 123 nt, Human
aguuauuugauauucuuagagcauuuaauucaguguuugauuuuuaggggaagcuuauuguagaacuguuagcuucuuguagaacucaaaaguagagcugaaucuaaaaaaauacagauuucu

SEQ ID NO: 4099730 - RNA, 71 nt, Human
aguuauuuuagacacauacccuugcccaaagguuaauuuagaaccuaagcugaaaugugugucagaugauu

SEQ ID NO: 4099731 - RNA, 79 nt, Human
aguucaauuaaguuuaugaggaaaaguuaugauugucauguuacuaauuguaucacuuuuuccuuauauguugugaauu

SEQ ID NO: 4099732 - RNA, 58 nt, Human
aguucacagaauggccagaacuggggcuuagcacucuucaauucuggccaagugggcu

SEQ ID NO: 4099733 - RNA, 59 nt, Human
aguucagaguuggguuuuauaccuagacuaauuuggauguauaaccuggcuauguuacu

SEQ ID NO: 4099734 - RNA, 60 nt, Human
aguucagccauuuguuaacuauguguucuugggaagcuaauagccaacguguggcuaacu

SEQ ID NO: 4099735 - RNA, 86 nt, Human
aguucaucagcacacacauucauguuuuugacuagugccucucucccaagaggugcacaggugggaaaaugaguggggucagaacu

SEQ ID NO: 4099736 - RNA, 93 nt, Human
aguucaucuguuggcaguaagaacaauaauguguuucugguuaauauccugcuagaucacaguucucuauucguaaguccaauucagagaauu

SEQ ID NO: 4099737 - RNA, 82 nt, Human
aguuccaaauuaauggaguuggaauuaauaagguuaucaugguauuuuuauuggaugggucagcucuauauuauuugguucu

SEQ ID NO: 4099738 - RNA, 76 nt, Human
aguuccauaugguguacuacuggguuucgaggcaguuuuaucauaguuuuccuucuccaguuauauuauguuaacu

SEQ ID NO: 4099739 - RNA, 60 nt, Human
aguucccaagagaagguaggcccuuuaaaguuuuuccagagggguugacccucuuggacu

SEQ ID NO: 4099740 - RNA, 55 nt, Human
aguucuccaggcauuucuccauuuuucaaauugugagaaacauuucuugagaacu

SEQ ID NO: 4099741 - RNA, 82 nt, Human
aguucugggguggaggggaggguuggaggggccucacccagcccugccaaucccgucucucugacagacuccaaugggaacu

SEQ ID NO: 4099742 - RNA, 97 nt, Human
aguucugguagguacggcagaguugggaggugcugugaagguggggauaagaucuuguuuuguacauccuaauucugagugcccuuuuauuacaacu

SEQ ID NO: 4099743 - RNA, 64 nt, Human
aguucuguaggucagaauggaagagucugcucaaaaggcuaagauugaaguauugaccagagcu

SEQ ID NO: 4099744 - RNA, 76 nt, Human
aguucugucuugcugggguaagucugugcuagcacgcagcaagggcagcaaagaaggaaccccaagcugacgagcu

SEQ ID NO: 4099745 - RNA, 62 nt, Human
aguucuguucggugccuuuucuuguguguucuggagcucacaggguucuaucgaagagugcu

SEQ ID NO: 4099746 - RNA, 65 nt, Human
aguucuguugucuagggaagccaggcuaagacaugguucaauggguguccuuagaaagcagaccu

SEQ ID NO: 4099747 - RNA, 78 nt, Human
aguucuucuucuuuauuuuauuucugcauuuuguuuuccaugaggaaggcagcuagagagugaaacugaaggauggcu

SEQ ID NO: 4099748 - RNA, 77 nt, Human
aguucuuuaccacauggcccccagaggcaguucacaacauagaugugaacuuuuucucuacgggccagcaaagaacu

SEQ ID NO: 4099749 - RNA, 85 nt, Human
aguucuuucuuaauauuuacaaauuuauuuaaccugcgaaauuagguauguuagugauaguaaauaguguuuugaaggaagaucu

SEQ ID NO: 4099750 - RNA, 79 nt, Human
agggauuuauuucauauuuugauuauuuaugcaaacacauucauuuagcuaaaaauaaugaaauaugaggaaggucucu

SEQ ID NO: 4099751 - RNA, 70 nt, Human
agggauuuguaggucuuuuccugguacaggcuuauuguucucuagaaagauacuuaaaucaagauucccu

SEQ ID NO: 4099752 - RNA, 56 nt, Human
agggcaaauacaaaguaguuuaguauguuuuuaacuaaacuaaagguguuugguuu

SEQ ID NO: 4099753 - RNA, 113 nt, Human
agggcaaugacaaauguggagaaugauacagaggucugguuacuucuuagccaaugacacagaaucacaauugagaaaacacagaguuuauucauucccauugugcaugcccu

SEQ ID NO: 4099754 - RNA, 69 nt, Human
agggcacaggauacuacaacaggacugucuaauuccaaagcccacacucuuuuugugguugucuacccu

SEQ ID NO: 4099755 - RNA, 60 nt, Human
agggcagaccacgugcaaggaugcucaagaaggcaaacuaagggagaugugggcuguccu

SEQ ID NO: 4099756 - RNA, 57 nt, Human
agggcagagagaugaaugggaugaccccggagggugcuuccaacaccuuucuccccu

SEQ ID NO: 4099757 - RNA, 57 nt, Human
agggcagagggagggcuucugagagcugacacuguucuauuguucuauuuucguccu

SEQ ID NO: 4099758 - RNA, 81 nt, Human
agggcagcacagcugugcuccuguugacaaggggcagaugaugcagaagaguccccaggagccaagaugcugucuggcccu

SEQ ID NO: 4099759 - RNA, 57 nt, Human
agggcagccugagugcuggcccacaaagggcccuggaggaaaaucugaggcugcucu

SEQ ID NO: 4099760 - RNA, 88 nt, Human
agggcaggaaucaggcacagcucugauuagagacauucuucaauuuugauggaaauaucuuuagagcuuaguuagcaauucugguccu

SEQ ID NO: 4099761 - RNA, 56 nt, Human
agggcaggagguccgucccuucagaaucucccugucaggacacggcuuucugcccu

SEQ ID NO: 4099762 - RNA, 58 nt, Human
agggcaggauuuugaguauauuagucuucaccuacaaaugccaaacuucuucugcccu

SEQ ID NO: 4099763 - RNA, 129 nt, Human
agggcaggcaggagggugacauggcagaggaggggcugguggggaaagaggaccaucuggugugugccuugaugguuagcucccacauccacccacucauugccuguguuauuugaccucccugagccu

SEQ ID NO: 4099764 - RNA, 63 nt, Human
agggcagggcaaggacagaugcuaccauccacugagccauagcauugaucuuuauucugcuuu

SEQ ID NO: 4099765 - RNA, 57 nt, Human
agggcaggggguagggccugcugucugcagagaaagcagccagagauccucggcccu

SEQ ID NO: 4099766 - RNA, 58 nt, Human
agggcaucccuuuccccagccuucuccaaggccaccugggcagacgggagcuugccuu

SEQ ID NO: 4099767 - RNA, 70 nt, Human
agggcaucucuaacagucuccuucccccuuagauagugacgagaggcugcgagacuguggaaaugacccu

SEQ ID NO: 4099768 - RNA, 73 nt, Human
agggccaaguaagaucuugaaauuuaagauagagacaucuggucugaguuuucugagaagcuuauugaauccu

SEQ ID NO: 4099769 - RNA, 101 nt, Human
agggccaaugcacacuuugacauuucuuccuucucuuuucugaguuuguuuaacccagaguuuagggcugagagcuuggcagaggccugcacaauggcccu

SEQ ID NO: 4099770 - RNA, 82 nt, Human
agggccagagaauuccacggcuuugaacaaucuuugugaacagagcuuugugucagggcugugguuaugauuuucaggcccu

SEQ ID NO: 4099771 - RNA, 63 nt, Human
agggccaggaacaccugaaggggcaacaaagaucugacucuccuaguagggguuccaggcccu

SEQ ID NO: 4099772 - RNA, 69 nt, Human
agggccaggaucacagccaagaggguuccugucacacaguuucugcuugggcugaugagcccuggcucu

SEQ ID NO: 4099773 - RNA, 65 nt, Human
agggccaugcagggaaaagagauauuauuuaauauuuuaaugauuuaucuucucuuugcugcccu

SEQ ID NO: 4099774 - RNA, 69 nt, Human
agggccccacugagagucagcuucuccuccuucaucugugugggcaggaacaagcaggcucugggcccu

SEQ ID NO: 4099775 - RNA, 56 nt, Human
agggccccauagucacugcccgggcauugucccaggcagcaggauuaggggcaucu

SEQ ID NO: 4099776 - RNA, 60 nt, Human
agggcccccagcaacaaaccagggggagcuccgcauucuuugggcaauugcuggcccccu

SEQ ID NO: 4099777 - RNA, 67 nt, Human
agggcccccuguggcugucuggaggaaaagagcuccaggcagaaggauccgcaggugcaaaggcccu

SEQ ID NO: 4099778 - RNA, 60 nt, Human
agggcccugcaugagauuaagguugguaagaaggaacgccagcugucuaaggcaggcccu

SEQ ID NO: 4099779 - RNA, 90 nt, Human
agggccugagaccugcucugcccucucuuaaggagagaaggcuuuuucugucuggccuggaauccucuggggucagggcacuacagcccu

SEQ ID NO: 4099780 - RNA, 75 nt, Human
agggccuggaaugccucccugucagagaccaugaguacccuggcucccugcccauuuggggcaucccagugcucu

SEQ ID NO: 4099781 - RNA, 61 nt, Human
agggccugggccagcacccuuugaggcccacaacagggcacacaggggagggccaggcccu

SEQ ID NO: 4099782 - RNA, 70 nt, Human
agggccugguucuguguagggaaaaugagagcuuuuccccucucuucucauuccggcacauagcuguccu

SEQ ID NO: 4099783 - RNA, 88 nt, Human
agggcgcgcgcuuugcggugcaaggguagcggcaggcgggcguaccaggcgggcggcuucaucuugcccuuccacagcgugacgcccu

SEQ ID NO: 4099784 - RNA, 58 nt, Human
agggcggggacaguggcuguuuuguuugccagcauagcuagcauaaugucuggcuccu

SEQ ID NO: 4099785 - RNA, 64 nt, Human
agggcuagaaugcagcuugaaaaaucaggagaaccuuucugcaugaacaguuuauuccagcccu

SEQ ID NO: 4099786 - RNA, 58 nt, Human
agggcucagaacaaugaguguagguuggcaucaaccaccuucauauucucugauaccu

SEQ ID NO: 4099787 - RNA, 58 nt, Human
agggcugcuccuccuucaggccuagguuuauugucugcaccuggggguaggcagcccu

SEQ ID NO: 4099788 - RNA, 86 nt, Human
agggcuggccauggcagccaugggagccaccagcgcaccuuagcuauagugaugcugccuuggcugaccaccaaagccaggguccu

SEQ ID NO: 4099789 - RNA, 124 nt, Human
agggcuggucaaggggcagcgcucugucgugggggccuccaugguagucgguaagcccagguagcgguggacuggggcuccagccagguguccccacucagucccgcguguccugccuagcccu

SEQ ID NO: 4099790 - RNA, 65 nt, Human
agggcugguuguugccagcauggaggucgcagucuuugugucagcccgagcacacagccagccuu

SEQ ID NO: 4099791 - RNA, 100 nt, Human
agggcugucaaggcagacgcacucgugacuuugacaaagggaagcagcuggaagguugcgggucccagggucacaggcagcuguauuagugacagguucu

SEQ ID NO: 4099792 - RNA, 73 nt, Human
agggcuguuuuuccaucugugcauguugaagcucucuuuugacuacagaauaacagaugugauaugcagucuu

SEQ ID NO: 4099793 - RNA, 56 nt, Human
agggcuugcugauuuaaagagcugcacagccuuggguagccuuuagaaagcacucu

SEQ ID NO: 4099794 - RNA, 74 nt, Human
agggcuuugagcaucuuauagaaagagcucauuuacugauauuagcucuuauucuccuagagcucaguggccuu

SEQ ID NO: 4099795 - RNA, 55 nt, Human
aggggaaagaccacuugaggaggaugaguuuuucucugucuugugggcuuccccu

SEQ ID NO: 4099796 - RNA, 58 nt, Human
aggggaaccccuaaggucaccccucagccagggggaacuguuuaacagggguuugucu

SEQ ID NO: 4099797 - RNA, 60 nt, Human
aggggaagcgcagugcagccuuugaggaccugacagcuggcagugcccggugccuccucu

SEQ ID NO: 4099798 - RNA, 128 nt, Human
aggggaauggaggcucagcaggguggccgggugccucgcuggcugccagcaccauggucacuuggcugcuggccucuacaggccggccaggcacuaccaccaaaccuccuucuagcugcauucccucu

SEQ ID NO: 4099799 - RNA, 74 nt, Human
aggggagaaaaaugccuucuguuucuguuucugugccgugcaucuaggccaccgggagguuacuuuucuucucu

SEQ ID NO: 4099800 - RNA, 62 nt, Human
aggggagccaugucuccaggccaucagcucaugcagguuagggagucagguggcucuuuccu

SEQ ID NO: 4099801 - RNA, 75 nt, Human
aggggagcugccugagcuggcagagcuugcugagcccuccugcuugcugagcccuccugcuugcugagcccuccu

SEQ ID NO: 4099802 - RNA, 100 nt, Human
aggggaggagauuucuugucugccaaggguaguggaggccccugcaucugucaugcagauccauccagcacucuugccagaucuagcgugcugaucccuu

SEQ ID NO: 4099803 - RNA, 67 nt, Human
aggggcacaauugaacugaauccuggauugcuguacugcagcacuaaccagcaaguucacugcccuu

SEQ ID NO: 4099804 - RNA, 56 nt, Human
aggggcaguuccaaguuuugugaggccuaaaagguaaacaauuuggagacucucuu

SEQ ID NO: 4099805 - RNA, 59 nt, Human
agggagccauggaggguugugggcagagagggccucccccauccacugagugguucccu

SEQ ID NO: 4099806 - RNA, 55 nt, Human
agggagcugacuggcugccauuuugaaucacaacaaaaacuugccagagcucucu

SEQ ID NO: 4099807 - RNA, 59 nt, Human
agggagcuuucagguagcuuaaggucauuuuccacugaugaagaagcagaaaguuuccu

SEQ ID NO: 4099808 - RNA, 59 nt, Human
agggaggaaggauguuccaaaguguccagacugugcgauuuaauuuccuucaccucccu

SEQ ID NO: 4099809 - RNA, 94 nt, Human
agggaggauggagaaggaggugagucauguccagguuauggcucccaugcuuggucguuggccugggcaugaagcaucgugugccauccucucu

SEQ ID NO: 4099810 - RNA, 79 nt, Human
agggagggaggggaaaugcauggaucuuggcagaugcaaaugauaagcuuuaccuaguauaaugcaaccuucuuugccu

SEQ ID NO: 4099811 - RNA, 67 nt, Human
agggagggagugcagggacagaccggggcacuccaggccccauccacuggccacugcaccucuuccu

SEQ ID NO: 4099812 - RNA, 110 nt, Human
agggagggcagcagcagggguccaugcugcagcugcaggaucagaugugguucguuaaaucaguucaauuuuugaaacugucagcuuggcuugccucaaugccccuuccu

SEQ ID NO: 4099813 - RNA, 58 nt, Human
agggagguagcaagccugcagcucaguucaacuauggaguauagccuguggccucucu

SEQ ID NO: 4099814 - RNA, 70 nt, Human
agggaguagggaugcuggugacuccggugggaggcacauggagucagugaucgcgugucucuacuggccu

SEQ ID NO: 4099815 - RNA, 79 nt, Human
agggagucaggggcagugggccagaugcuaggucuuccuguacccagccuggcuucuuuccacuguccuguggcuuucu

SEQ ID NO: 4099816 - RNA, 58 nt, Human
agggagucuggccgucggcuggcucagggcgggccgguuggcuguacccaggcucccu

SEQ ID NO: 4099817 - RNA, 66 nt, Human
agggagugccugguguugcagcugguccgguaggcagagagggccagcagcccagaaggacuuucu

SEQ ID NO: 4099818 - RNA, 85 nt, Human
agggagugggugcugaugcugucugugaccucugcaugucuggaagucaggccagcagaccucagggacucucagccugcuuccu

SEQ ID NO: 4099819 - RNA, 83 nt, Human
agggauaccacagaaugaugacacuucagcaaaacuuuagcaguaugugcaugacauguugacagcuucugacagguuuuccu

SEQ ID NO: 4099820 - RNA, 55 nt, Human
agggauacuugaagcugggaagcugggauccuucagauguccaagaagugccccu

SEQ ID NO: 4099821 - RNA, 71 nt, Human
agggauaucugggcugcagcucggggcuccccucaguccuccagcugccaccagauguuuucuaaaccccu

SEQ ID NO: 4099822 - RNA, 70 nt, Human
agggaucggguggguucugccaucaggaccagggagcccacugaguggccuggagccccgccuggucccu

SEQ ID NO: 4099823 - RNA, 59 nt, Human
agggaucuccuuuugcuuuacagaugaacugucugaauuuugagcccugggagaucucu

SEQ ID NO: 4099824 - RNA, 81 nt, Human
agggaugcuuaauguuucuucugugaggugugugccuguaccacacacauguacacauacaguggaguggaaaguauuccu

SEQ ID NO: 4099825 - RNA, 65 nt, Human
agggauggaaugaauggcagauacauauucuucugguugaauguagucauuuagcucacauuucu

SEQ ID NO: 4099826 - RNA, 74 nt, Human
agggauggggggccaucuucaaggauguggcauuuaucccaaauuaaugucuuaucaugugguucuguauuccu

SEQ ID NO: 4099827 - RNA, 98 nt, Human
agggauguaugguauuuauggcuggguaggaccagaaaugcacuuuguauuacagaguguuaaggcugguugcuauaguauggaacagaaacaccucu

SEQ ID NO: 4099828 - RNA, 56 nt, Human
agggauguuggaaaaugcagucuuuaccugggcuguccuaugcagcuaaaauuccu

SEQ ID NO: 4099829 - RNA, 64 nt, Human
agggcaaaauacuuauaaaggcuaugcuuauuuguccacguaggucggccuuaguaugugccuu

SEQ ID NO: 4099830 - RNA, 59 nt, Human
agggcaauccagccagcugaucugagcauacacuuuuccccugggcugaggucugccuu

SEQ ID NO: 4099831 - RNA, 78 nt, Human
agggcacaucugcugggaauggguagagcggggugggaggaguccuggcaggggagccguuccuaugcaaugggccuu

SEQ ID NO: 4099832 - RNA, 101 nt, Human
agggcacauuaugcagcgguaagaguuuuacguuguuuguaaaauagugcaacauuauuuacagacaaacuguguuaaguugaagaugcauauugcacccu

SEQ ID NO: 4099833 - RNA, 60 nt, Human
agggcacuggcuugcaaacucagaagugucauuggcaucucgagauggguucagugcucu

SEQ ID NO: 4099834 - RNA, 75 nt, Human
agggcagaacaacucuagcugcucagccuucugcccacuuaccaccaggcuguguuuccccuggagcuucucccu

SEQ ID NO: 4099835 - RNA, 68 nt, Human
agggcagacauauguuuuaacagauuauagcauuagucuuaguuuuaauuuugauuugugucuucccu

SEQ ID NO: 4099836 - RNA, 55 nt, Human
agggcagauuguauauucuccacugguuggcacauuagaguauugaauuugcccu

SEQ ID NO: 4099837 - RNA, 69 nt, Human
agggcagcagcccauggcucugacggggcagcucucuuccuguuuaccaucgugguggacugcugcucu

SEQ ID NO: 4099838 - RNA, 67 nt, Human
agggcagcagcugucccugagauucauagauaaagccuugacuugcagaagggauaagcugugcuuu

SEQ ID NO: 4099839 - RNA, 82 nt, Human
agggcagcuuauuauagcucauauguugaaugguuaaaaagccguaucaaagcaaaacauauuucuauuaaagaccugcuuu

SEQ ID NO: 4099840 - RNA, 83 nt, Human
aguaaguuaaaauuagcagggacuuuggcaacagguguuuguuuagaugcguguuuaugaaaauccuugcugaucuucuugcu

SEQ ID NO: 4099841 - RNA, 69 nt, Human
aguaauacaaguugugauaauguaaaauauaugucuaauuuaugccuuuuaauugucacauuuguugcu

SEQ ID NO: 4099842 - RNA, 58 nt, Human
aguaauauccaguccuucugaaauuaaauggauaucaggauaacuauaggauaaugcu

SEQ ID NO: 4099843 - RNA, 56 nt, Human
aguaaugugccugaaauacuugcguagggcuuggcaaguggcaggcgaucauuacu

SEQ ID NO: 4099844 - RNA, 126 nt, Human
aguacauaauugucuccucuuaaggcaaggauguuagguauagcacugcagcgaugggaccuggacccagcugccugcauuuauauccugcucaauuugaccuugagaggguugcugaauuguucu

SEQ ID NO: 4099845 - RNA, 106 nt, Human
aguacccuccuguaggcucaggacuagggcagagcuuguacacgauagaggagaugcucgaucggguucucucuccaaguccugcuucucauggauuuaaggggcu

SEQ ID NO: 4099846 - RNA, 79 nt, Human
aguaccucaguuucugcuuaauacugcagaacuugauucucucaaguucugguggccagaagucugaacugaagguauu

SEQ ID NO: 4099847 - RNA, 95 nt, Human
aguaccuugauuuuggacuucuggcuuccagaacugagcaacaauaacuuucuguugaagccguccaguuuugaagccacccagucuguggugcu

SEQ ID NO: 4099848 - RNA, 62 nt, Human
aguacuuggagccuugaauauguaucaagaaggcacuugauacauauucaacguucaguauu

SEQ ID NO: 4099849 - RNA, 76 nt, Human
aguacuuucggaaaugucuucaguucuguauuguguucacauacacaaacaggcuuuacaagauugcuucgguacu

SEQ ID NO: 4099850 - RNA, 77 nt, Human
aguagacccuggaaugcugguaaaauagcacauuaugcugaugaauauauguaaugauaccagcauccauguuugcu

SEQ ID NO: 4099851 - RNA, 77 nt, Human
aguagacggggacgugggcugcuuuaauagaggcagagugccccaucuggggagggagccacagguccccgccgacu

SEQ ID NO: 4099852 - RNA, 67 nt, Human
aguagaucagagugggucuggcaugagcauguuaauaaaugauuuuugccauuucuuucugagagcu

SEQ ID NO: 4099853 - RNA, 80 nt, Human
aguagccggaauuuacaggugcacucgccaugcccugcagaagccucauguguuagggcgcaccugcaauuccagccacu

SEQ ID NO: 4099854 - RNA, 81 nt, Human
aguagcucuucuacagggaugaccagagggaugugaguacugauuuaagaccacuuccaggguccccugaaggaagacucu

SEQ ID NO: 4099855 - RNA, 90 nt, Human
aguaggacaauauaugaaaacacuuuagaaagggacuugcgauuagguagcuuuuuugagguguuuguuuguuuguuuguuugucccucu

SEQ ID NO: 4099856 - RNA, 75 nt, Human
aguaggagcaacuggaaggaaaaugagagacagaaguggaugauaacuguuuuccuucucagccauugcccuccu

SEQ ID NO: 4099857 - RNA, 60 nt, Human
aguaggccccuggugcccugaggccaaguguggccaaaacagagggcccugguggccauu

SEQ ID NO: 4099858 - RNA, 68 nt, Human
aguaggcuguuuuaugggccaauauuaguucccuauucccaguacugauuacauaaaacaguucuauu

SEQ ID NO: 4099859 - RNA, 130 nt, Human
aguaggcuucacuccgcaagacuaucugcaaguaaaaucugacuuuggaacauacugcugagcuuggucucaauccuggagcacugugguuccaaauugucugcuucagccagugcgagguugcagaacu

SEQ ID NO: 4099860 - RNA, 61 nt, Human
aguagggaacuuaugauaugacuuuagacuuuugucuucauaggaaauaguguucuuuauu

SEQ ID NO: 4099861 - RNA, 129 nt, Human
aguaggggcucgguccugggggcacacaguaggggcuuggucccggagcgcacauuggagauccugaagggagcggacauccagugugggcccggccuccucucuggagcucugccuggcugccuggcu

SEQ ID NO: 4099862 - RNA, 59 nt, Human
aguaggguauugagucuauuccuuuucuuuauacugugguaauagauuaauuauccucu

SEQ ID NO: 4099863 - RNA, 91 nt, Human
aguaggugagagcuucucacagagcugcuuugccaaugcguuccugggucaugggccugggaauggcaguagagcgaggcucccaccuauu

SEQ ID NO: 4099864 - RNA, 67 nt, Human
aguagguuuccuaggcuuauacagcuguugaguggagaaaugggauaugggcucaggaacucgaacu

SEQ ID NO: 4099865 - RNA, 74 nt, Human
aguagucacuuaauagguucaucugaagaaggaaucauuuauucauugcagaaauauuuauugagugacauacu

SEQ ID NO: 4099866 - RNA, 72 nt, Human
aguagucugcucagaauugcgcugguggagccagugcauggcuccaccuacguugucugacucuagacuacu

SEQ ID NO: 4099867 - RNA, 79 nt, Human
aguagugaguagagaggcagagcugggauuugaagccuaguggacuggcuccacaguugcugcuuuuaaucacccugcu

SEQ ID NO: 4099868 - RNA, 91 nt, Human
aguaguuaaauuuuaagccaggguuagaagauagucaaaggggaauaaaaaagcuucuuuacuaaacaucuggcauuaaauuccaaauacu

SEQ ID NO: 4099869 - RNA, 56 nt, Human
aguaguuguuaauacucaguaggguuguuaucaguucuuuaguuauuaacagcacu

SEQ ID NO: 4099870 - RNA, 76 nt, Human
aguauaacagcagcugccugaauuugcucacaucaaauugcagcaacuuguuucauucugguuuugcugucuuacu

SEQ ID NO: 4099871 - RNA, 63 nt, Human
aguauaaguuuuugagaauuuacuaugugccaagcgcuugggauauggcucagagcugguacu

SEQ ID NO: 4099872 - RNA, 57 nt, Human
aguauacacugucuccucuaggugguacccaacauuuaaaauacugcaguguauauu

SEQ ID NO: 4099873 - RNA, 56 nt, Human
aguauacuccccauccuagaaacugaaaaguuuugaggaugcucuugggauauacu

SEQ ID NO: 4099874 - RNA, 130 nt, Human
aguauaggcaagggguacacaaauuuucacugauaggaaacagcuuuuaaaacauaacauuggauucacagaaccaaaugauccuugcaagcugugaucagucaaaguaaauucccccaaaugugauucu

SEQ ID NO: 4099875 - RNA, 62 nt, Human
aguauagguacagcagauauucuuagugagcauguucuguaagaauaacguuguacuaggcu

SEQ ID NO: 4099876 - RNA, 76 nt, Human
aguauaugugcacauaugcauguguguguguguguguguguguguguguguguguguguguguguguguguguauu

SEQ ID NO: 4099877 - RNA, 96 nt, Human
aguauauuuggcauuuuuuccgcauuuuuaaggcuugaaaugaaaucuguaagcaggaaguucacagaguuuauuucaagggauagguguauuacu

SEQ ID NO: 4099878 - RNA, 122 nt, Human
aguaucaccugggagcuuguuagcaaugcucuuuccuggguucccucucauucuauggaaucagaaacuguaggggaugaggcccaggaaucuggguguugucagccuuuccaagugaaacu

SEQ ID NO: 4099879 - RNA, 80 nt, Human
aggggcagaagccuguggauuuggggguccuggaaauaagcauucaccugagggcccucagucccaggccuucugguccu

SEQ ID NO: 4099880 - RNA, 55 nt, Human
aggggcagaggaaguggugcugcauuccuaguucaaaucauugaucuucaccccu

SEQ ID NO: 4099881 - RNA, 90 nt, Human
aggggcagcacaaagcaguggcuaggagucuggcgucuggagccaacugucuggauucagacucuggcccugccacucguguaugacccu

SEQ ID NO: 4099882 - RNA, 58 nt, Human
aggggcaggugcugcacuuagacuggccaagagccauauccgggaagacccugccccu

SEQ ID NO: 4099883 - RNA, 87 nt, Human
aggggcucuacaggucagcuccuauggucucugauguccaguccaaguuuccuucaguuuccauggcuccuugcccuguagccaccu

SEQ ID NO: 4099884 - RNA, 92 nt, Human
aggggcuggagagacaucuaaggaggaaggauggagagaggagggaggguucuccuccugccuuugcuucuuguugucuccccauugccccu

SEQ ID NO: 4099885 - RNA, 80 nt, Human
agggggaagcaggggcaguuucucguuugccaucuuagaggagauguguuuaccaggggaacauguuuucuuuugcuccu

SEQ ID NO: 4099886 - RNA, 78 nt, Human
agggggaugcucaggaggcugcuuggggcuuuugggagaagcaccaugagagggcugagcugccucccgcaccccucu

SEQ ID NO: 4099887 - RNA, 58 nt, Human
agggggauggaauagaacuuugcaaugcaucaacagaggaauccuauuucauccuucu

SEQ ID NO: 4099888 - RNA, 77 nt, Human
agggggccccagugggcucagggaagcuuggccugguguccccaccagccuugugcugaggccacuggggagccucu

SEQ ID NO: 4099889 - RNA, 67 nt, Human
aggggggcuucucugggaguccugguugguccugagacagggacacccucccagugaagcccuaccu

SEQ ID NO: 4099890 - RNA, 86 nt, Human
aggggguucuggcuuuaauuuaguaaggcagugcagaauuuugaauugagaacuuauuuaaugaggguuagaauaaaaaaccuucu

SEQ ID NO: 4099891 - RNA, 65 nt, Human
agggguaaggcccucugagcacugauggaccacagacacgguuaccucaggauugucuagccccu

SEQ ID NO: 4099892 - RNA, 90 nt, Human
aggggucauuguuaauucuguugguuagaguuggagagggagcaucaugcugcuguuuaacccaaauaaccacaggagccaguggucucu

SEQ ID NO: 4099893 - RNA, 62 nt, Human
aggggugaaggcccgauaggagcucagacaauuugaccccugaguuccaggucuguacuucu

SEQ ID NO: 4099894 - RNA, 66 nt, Human
aggggugagccuagcagguguucgaaucacauccgcggauugguacauggcacugcuguuccccuu

SEQ ID NO: 4099895 - RNA, 58 nt, Human
agggguucauauguacucaguucuguccuagggacuguauuaguccauuugagcugcu

SEQ ID NO: 4099896 - RNA, 73 nt, Human
aggguagaaagucccagacuccaguuuucugcuuugucaauuaguagcugggucaucugggacuaguugcucu

SEQ ID NO: 4099897 - RNA, 130 nt, Human
aggguagauacgucagcaagucagauguuuggaaggcuuaauuuaagucacugauuucaguucaagagaagggaccucugccagcugccauggccugaauuuaccuuuauacauacagauacucugcccu

SEQ ID NO: 4099898 - RNA, 70 nt, Human
aucaagagagcacuggcaucuaagggugguagguuugccaccauuuugacugugccagggcucaauagau

SEQ ID NO: 4099899 - RNA, 91 nt, Human
aucaagcuuguuuugcuguuuucccagcuucucaucuuccaaaauuguguaaucauuuuuugggggaggagcugcaagauacaaguaggau

SEQ ID NO: 4099900 - RNA, 82 nt, Human
aucaaggcauuggcagggcuaggucuucuagggcuucaggggagaaucuguugcuugcaucuucuaguuccuagucuuugau

SEQ ID NO: 4099901 - RNA, 55 nt, Human
aucaaugcuugccaaauggaagagagcaagucuuaauuuggcaugaaguauugau

SEQ ID NO: 4099902 - RNA, 75 nt, Human
aucaaugggcucugcucugcucagcuugucucuuggguuacaaaguggcagagccgugcagguaggaccccgggu

SEQ ID NO: 4099903 - RNA, 84 nt, Human
aucaauuacauuuccacaaauaccaguuuccuaacaaaaccaaagguauguuaaaugagauuggaauuuggcuaaugcauuggu

SEQ ID NO: 4099904 - RNA, 105 nt, Human
aucacaaauccaaauucuuucagaaaacuuaucaucaguuaaauuacuaauaggaacaaagugagguugcgauuaguuuuuuaugaaguaguuugggugggugau

SEQ ID NO: 4099905 - RNA, 59 nt, Human
aucacacacuucagauguaauuuguugccugaagcaacaaaccacuaucaaggugugau

SEQ ID NO: 4099906 - RNA, 66 nt, Human
aucacagaaagaagagcuucaguucagccuuggacaacugaaaaaagaagugucuuguuucuggau

SEQ ID NO: 4099907 - RNA, 88 nt, Human
aucacauguggagaauuaaaaaauacugaugccagggccucugggaauguggccagguuugauguauuauuuaaagcucccaggugau

SEQ ID NO: 4099908 - RNA, 80 nt, Human
aucaccagcuuugucugauuccucuuuuuuuguaaugcuaccaagaaguagaagaguaaaauuugagcaagguaggugau

SEQ ID NO: 4099909 - RNA, 61 nt, Human
aucaccauggauggagacugauauggguauguuuuaccugugauucaaauaccauggugau

SEQ ID NO: 4099910 - RNA, 75 nt, Human
aucaccucccccagcaaagccugauggucaaaguccuucagccccuuucuccacgccagcuugcuuaggagggau

SEQ ID NO: 4099911 - RNA, 114 nt, Human
aucaccugagagcuuauuaaaaugcacaggacugggacccacaccuggaaucucugauucagcaggucaggggugggcccaggaaucugcauuucuagcauguucccaggugau

SEQ ID NO: 4099912 - RNA, 80 nt, Human
aucaccugcagccugcagcuuaaaucaggguuucuggcagggccucgggagccacaguuuauagugauugcccaggugau

SEQ ID NO: 4099913 - RNA, 70 nt, Human
aucaccugcuccaccuaccauaagaggcuguugugagaaucagccucuuaugguagguggagcaggugau

SEQ ID NO: 4099914 - RNA, 77 nt, Human
aucaccuggugcccuuuccuuccagagcauucauuagaauguguaagcucugagagagcaaagucaccacaggugau

SEQ ID NO: 4099915 - RNA, 78 nt, Human
aucacucuaucacccaggcuggagugcaguggugcaaucucagcucacugcaaccuugacauccuggguucaagugau

SEQ ID NO: 4099916 - RNA, 66 nt, Human
aucacugaacaguacuuaagggcuaauuggcuuaauacauguaaagcucuuaguacuguuccuggu

SEQ ID NO: 4099917 - RNA, 72 nt, Human
aucacugcaaggacuaguaaaugaauuagaccgaagcugccuuauuacucaagauacugguccuuuuaugau

SEQ ID NO: 4099918 - RNA, 101 nt, Human
aucacugcagaaaguuguauuggacagugcagaucuacacgcuggugaggcccuguguguucauuagcauugccuuggaagauguaaccuucaaaggugau

SEQ ID NO: 4099919 - RNA, 79 nt, Human
aucacuggagccuucggagguugaggcugcagugagccaugaucgggccacugcacuccaaccuaggugacagagugau

SEQ ID NO: 4099920 - RNA, 72 nt, Human
aucacugucgucaucugagauuuaagaacauugcaauuuuaaaucagguaauagcagaugcaacgugguggu

SEQ ID NO: 4099921 - RNA, 77 nt, Human
aucacuugggaguuuguuagaaaugcagaaugacaggcuuuaccccagacuugcauuucaguagaucccugggugau

SEQ ID NO: 4099922 - RNA, 85 nt, Human
aucagaaguauugcauuuaauggguagacauuguuagguuagaauuuaacaaaaaauauagacuugaaauugaagcauuucugau

SEQ ID NO: 4099923 - RNA, 86 nt, Human
aucagaauggccauugcagaguuuugagagaagaaucauauguugugugauuuacaauuguaaaaguuuccucuggcuacuuugau

SEQ ID NO: 4099924 - RNA, 55 nt, Human
aucagaccuuuauuucaugauaggauacuucauguccugugauucaggguuugau

SEQ ID NO: 4099925 - RNA, 126 nt, Human
aucagacucaccuggggacuuguuaaauacagauuguugggucucacuccuagaguuucuucuucaguauucuagggagcagccugugaaucuguauuuccagcaugauuuucaggugcuauugau

SEQ ID NO: 4099926 - RNA, 69 nt, Human
aucagagagauugucuuguacguuugccuguugcaaacaggcugguuuguaaaagauguauguuuuggu

SEQ ID NO: 4099927 - RNA, 55 nt, Human
aucagagcacugagcaggacaccuggaggcaguuugaccuuuucgaggcuuuggu

SEQ ID NO: 4099928 - RNA, 57 nt, Human
aucagagccauaggggcaguaaacuauaguuucucugcugugaaacaugguuuuggu

SEQ ID NO: 4099929 - RNA, 62 nt, Human
aucagauugucaagaggcugcuuugaauugugaaaguaguaguuucccucuggcaauuagau

SEQ ID NO: 4099930 - RNA, 59 nt, Human
aucagauugucagcaugguuggguucuagugagggcucuuuucauggcuugcagauggu

SEQ ID NO: 4099931 - RNA, 93 nt, Human
aucagcaguuggacuuugccacuugcuccagcuuguccuucuucuugauggcauagaaguuggagaagcccuuggcaaagauauugagcugau

SEQ ID NO: 4099932 - RNA, 95 nt, Human
aucagcgagcucucugcacgacuucaccucugggcauucaaaauggauuaugaaacuacagaaaagguaagcucucuguaagagaggccgcugau

SEQ ID NO: 4099933 - RNA, 70 nt, Human
aucagcucacagucaagagcaagauugggccaggccaggcuugccacagcagugcuuugacaguggggau

SEQ ID NO: 4099934 - RNA, 81 nt, Human
aucagcucguacaaugcaggacagucauguggagcaggagaacaacuggaauggcuucuagcauugucacaacuagcuggu

SEQ ID NO: 4099935 - RNA, 83 nt, Human
aucagcucucccgaaugaucauggaagccuaucuugagaggcagccuuucaagcucuucaguguuauuuguggaaaguaugau

SEQ ID NO: 4099936 - RNA, 82 nt, Human
aucagcugaggaccuuguuggaagugcagauucugauuccacaagucugcgauucuguauuucuaauaagaucucaggugau

SEQ ID NO: 4099937 - RNA, 87 nt, Human
aucagcugccagaaagcuuccgcuucagugcuuuguugauacuggugucagcaggacauuaaaagcuugaagcuuuuuacguuugau

SEQ ID NO: 4099938 - RNA, 65 nt, Human
aucaggauccucuuuuccuaggaaggugaugucaucauuccuauguaaaggauggagaaacugau

SEQ ID NO: 4099939 - RNA, 70 nt, Human
aucagggaucuacuuucugucaauggauuauauccagggauaaaaguaagguucucaaauaugaccugau

SEQ ID NO: 4099940 - RNA, 72 nt, Human
aucaguagacagccuuugaacuucagagguuuggaucccugcaggccucugcaacuggcuguggcuauagau

SEQ ID NO: 4099941 - RNA, 75 nt, Human
aucaguaugcugcuuuaagaugauccaacuuuuuaaacagaagaaauguggaucguuuuaaaaaggcaggcuggu

SEQ ID NO: 4099942 - RNA, 58 nt, Human
aucaguguaccuuauggauuuuuuuaauccucuuuaaucgaucccucaguaugcuggu

SEQ ID NO: 4099943 - RNA, 109 nt, Human
aucaguguuuuaaucggauuuuuaaaaaacauuuuauuucuuuguacaauuaccauccuauguaaagaugaaauuuguguugaguugaagauugucauggaauaaagau

SEQ ID NO: 4099944 - RNA, 58 nt, Human
aucauaaagugcuaucugauuggauuucacccaucuuuucagaauuugccucugugau

SEQ ID NO: 4099945 - RNA, 55 nt, Human
aucauagguauaaguaaauuagacauuaggucuugcugacuuuaguaccuuuggu

SEQ ID NO: 4099946 - RNA, 62 nt, Human
aucaucaugagucauuagcacuauuaauaguggcuaugcuauuagcuuuggauucagaagau

SEQ ID NO: 4099947 - RNA, 65 nt, Human
aucaucccagcagccucguaaaggagaacucaauugucacaauuuuacaggcucugagagaugau

SEQ ID NO: 4099948 - RNA, 73 nt, Human
aucauccuaaacuggggaaauggauauuauuauuuacacugaauauucuucaccugagucagucuaggaggau

SEQ ID NO: 4099949 - RNA, 59 nt, Human
aucaucuugcuuucuguuuacuucuaguaaauuucuagaguggacauuaacaggaugau

SEQ ID NO: 4099950 - RNA, 69 nt, Human
aucaugaauucaacccacuauauaucaaacagauuuguuaucaguccaggguuuugugacauucaugau

SEQ ID NO: 4099951 - RNA, 65 nt, Human
aucaugccacagaguuacaaaacagucauugaauuguauaccugcaauggcugaacucuuaugau

SEQ ID NO: 4099952 - RNA, 126 nt, Human
aucauggaaugucaauaaccauuacauaugauuucuggugaggcagcaauaaaaagaauuuuuaauugccuguguagguucaaauuguugcaguuucuaaguugucagguaggauucaaacaugau

SEQ ID NO: 4099953 - RNA, 87 nt, Human
aguucguuuauucauuggccugugacuuccggggucaguuaauuacuagauuucagaguuuauuagguuaauggacacauaagaacu

SEQ ID NO: 4099954 - RNA, 68 nt, Human
aguucuaaguaaauauuuuauauaguuccucaguaguguugaaugagaagauguuuugcuuuagaacu

SEQ ID NO: 4099955 - RNA, 66 nt, Human
aguucuaugccuggcaaccuucagcaaccucggccucccuggacugcuugcuaugcauccugaacu

SEQ ID NO: 4099956 - RNA, 70 nt, Human
aguucucuaucugccacuggccgcguguggcucagaacgcuugaaauguggcuagugcagaugaauaacu

SEQ ID NO: 4099957 - RNA, 62 nt, Human
aguucucuucucaucacccaggaccacuggacagaaguggcagggagacaagaaguagagcu

SEQ ID NO: 4099958 - RNA, 80 nt, Human
aguucuggacuggcaaauucuuuaaguaucucuuguuuuauggaauaauacagugaauacuuacaguguuugcaagaacu

SEQ ID NO: 4099959 - RNA, 124 nt, Human
aguucuggggcugcaggcguuccuccuguguccgccagucagccggggcucucuggcgccuggcugugucaggccugucccagcugaggacggugacccuggagccgcgcccgcgccuggagcu

SEQ ID NO: 4099960 - RNA, 113 nt, Human
aguucuuagacuuuugcucauuacacugcugcauuugcaguccuuuaacccacaggauugagggugaaaagauugggaaugcagcaguauaaugaacaaaaguaaugaaaacu

SEQ ID NO: 4099961 - RNA, 71 nt, Human
aguucuucagccucaaauaguacuucacuggguguuuucaggaaccuacaucuguuuggggaggaauugcu

SEQ ID NO: 4099962 - RNA, 129 nt, Human
aguucuuugcauagugcuaggcacaaaguuggcuugcagugaagacuuucugggguguaaaggugacuuuccuuuacacauggaaugggucuaauuuacgaagcuagauugcguaguuggcaguucucu

SEQ ID NO: 4099963 - RNA, 61 nt, Human
aguucuuuggcagcugggcugguaaacacagaaguuuucuagcaaggacguccaaagaacu

SEQ ID NO: 4099964 - RNA, 74 nt, Human
aguugaaccauaugaaauugcuuuuggguggaucaagaacagcugaauauuggccauuucauuugguucaaacu

SEQ ID NO: 4099965 - RNA, 68 nt, Human
aguugaagcaggguggccagauugucauucuuuugguauccuagguagacaaugaugguguuucagcu

SEQ ID NO: 4099966 - RNA, 91 nt, Human
aguugaagcuuucuuguuaucacugccuuagaacaaagcaggaucuccccugugauccuagucauuguggcaaguccaaaggaagacaacu

SEQ ID NO: 4099967 - RNA, 96 nt, Human
aguugaauuauuuuccuuuucaaugcuuucuguauauuaaguccaguauaaauuuauagaucauuugcauuggucguaagggcagugagucacauu

SEQ ID NO: 4099968 - RNA, 58 nt, Human
aguugacauccauaacaggaagugagguuaggccuuuuucucuguggauguacauacu

SEQ ID NO: 4099969 - RNA, 75 nt, Human
aguugagccuggggagaagcgacucggcuggcacgcuggcuuccagcccugcccuguccuucccgccggccagcu

SEQ ID NO: 4099970 - RNA, 100 nt, Human
aguugauauguaaauccaguuagcaaagagaaaaauuaugcuaauauuaacauugucauuuuuuuugccacaguaagucuggauuugucagacaucaauu

SEQ ID NO: 4099971 - RNA, 93 nt, Human
aguugauuuucuucauuguuuaugugaaauugccauacguuugcuuuggcaaacaguuguuauuuuuauaugggugguugaguugauacaacu

SEQ ID NO: 4099972 - RNA, 73 nt, Human
aguugcagguggaugggucuguguucuggccaaaaauaaugcuagaauaaaugcuaccuaucacaucuggacu

SEQ ID NO: 4099973 - RNA, 77 nt, Human
aguugccuggguagauagcagcagcagcucaccagccccacgcugccaggcugcuggcugcuguccaccaggcagcu

SEQ ID NO: 4099974 - RNA, 57 nt, Human
aguugcucagggacuauggcaaagucgggaagaagccugucuccucucuggguuacu

SEQ ID NO: 4099975 - RNA, 58 nt, Human
aguugcuucccuauucuuagcaggugugaaccuuuccugagguagaggaaauguagcu

SEQ ID NO: 4099976 - RNA, 66 nt, Human
aguuggaauuucauguaagugacucauuagaaugacucaacuacuugagacuccuuucccaugacu

SEQ ID NO: 4099977 - RNA, 64 nt, Human
aguuggcacuuagccccagucuaaagcaaaagucuuaaauuuagcuguggcguaaggcucagcu

SEQ ID NO: 4099978 - RNA, 88 nt, Human
aguugggggaaagaaaaugaaguaaauucagaagugaugaagccagagaccacuuuagauacauucucauuuguuuucuuaauuaacu

SEQ ID NO: 4099979 - RNA, 61 nt, Human
aguuggggugagugauugauuuacaaaccagcaguagauuaaggcugcacuggccuuaacu

SEQ ID NO: 4099980 - RNA, 55 nt, Human
aguugguauuuacugcaguuggauauuagucuguuuugcaaagugaauagcaauu

SEQ ID NO: 4099981 - RNA, 60 nt, Human
aguugguuauucaugagugcuacugaucccucaacagugaccaucagagaauaacaaacu

SEQ ID NO: 4099982 - RNA, 118 nt, Human
aguuguaagagaaaaugguacagcaguuacaagaggauguggacauggaagaugcuucuuaaaaaaaaucucuguaaccauuucuuuuauguacauuugaaaaugcccucuggagacu

SEQ ID NO: 4099983 - RNA, 65 nt, Human
aguuguauuugcaucgcauugguucaaacuuauucacguaguuuccuugggaugcaagugagacu

SEQ ID NO: 4099984 - RNA, 63 nt, Human
agugcuaaaggguuaugaacaagacaauauugaaguugguuucuucauagucuuuuuagcauu

SEQ ID NO: 4099985 - RNA, 61 nt, Human
agugcuaugacagcauuguuaccuguugaguacacacagggccauuaucuguucuaggacu

SEQ ID NO: 4099986 - RNA, 85 nt, Human
agugcuaugguagacaagguggaaacugcauggccuuuuauuaccuaaucuugaaagucacauagcaucacuucugucauacacu

SEQ ID NO: 4099987 - RNA, 81 nt, Human
agugcucaagguuuuggugagagcugaccgugcgaggguuacuggcacguaguucucaaggcaguucucaccuacagcacu

SEQ ID NO: 4099988 - RNA, 76 nt, Human
agugcucaaguuguucaucuuauucuguagguuucucuuuccuuggcuuauugauaugcagaacugacuugguacu

SEQ ID NO: 4099989 - RNA, 61 nt, Human
agugcucaauggggugccuuuuuuacagucaaacugucaggaugguccuuuaugagaagcu

SEQ ID NO: 4099990 - RNA, 62 nt, Human
agugcucaccugcuccagggacgucugaccucgggucucgcccucccucccagguggguguu

SEQ ID NO: 4099991 - RNA, 60 nt, Human
agugcucuucccugauagcaucuguuggccugcugagucacacugcaggugaagugcacu

SEQ ID NO: 4099992 - RNA, 87 nt, Human
agugcugcaugguauaaaagaguaaacuaugcaucauuauucuaacaggaaaaguauuguuuacuguguacuggauuuugcagcacu

SEQ ID NO: 4099993 - RNA, 77 nt, Human
agugcugggcacauguauugacauuauauucuuuuaauccaagagaaaacuuuucauaaugcagugucuaaggcauu

SEQ ID NO: 4099994 - RNA, 76 nt, Human
agugcuguaggcuccauuuuccugcagcugcgcauacacucaauaagccuaaauguagucaaaggagccucgcacu

SEQ ID NO: 4099995 - RNA, 71 nt, Human
agugcugugaauccauuucaggugugcaaggucgggaccucugauuugcgucucauuugaaaucauggccu

SEQ ID NO: 4099996 - RNA, 59 nt, Human
agugcuuaaggcagucugucaaacagagaaugugucggauccucaaugcuuuuagcacu

SEQ ID NO: 4099997 - RNA, 63 nt, Human
agugcuuuauguuguugugcaaauucagcaaaaggccaaaacagccaacaguacugaagcacu

SEQ ID NO: 4099998 - RNA, 61 nt, Human
agugcuuugaacgaaaggcugagagguuaaggaaccacuuacuuuuuaauuucaaaccacu

SEQ ID NO: 4099999 - RNA, 55 nt, Human
aguggaagaacugggauggcuuucuaaagucucuuagaaaugaaguucuuucucu

SEQ ID NO: 4100000 - RNA, 69 nt, Human
aguggagaaaagucuaaauuauucaauaaggguuuuaucuuucauuuguuggauuuggauaacuccacu

SEQ ID NO: 4100001 - RNA, 57 nt, Human
aguggagaauaugcagaaagccugaaaagaacuagagccucugcucucuuuuccauu

SEQ ID NO: 4100002 - RNA, 56 nt, Human
aguggagaggaacccagcucuguuccccuccaacagcccagcucuuucucugcacu

SEQ ID NO: 4100003 - RNA, 61 nt, Human
aguggagcuccggggucagguggguggaagaaguucccguccucagucucccugcuccacu

SEQ ID NO: 4100004 - RNA, 56 nt, Human
aguggauccaacaugcuuccuggguugcugucuuccaagaggcuguggauccuacu

SEQ ID NO: 4100005 - RNA, 71 nt, Human
aguggauuuuaaauugcugugguugccaauagacgcaggccaugcauucuugcaccacacaaaaauuugcu

SEQ ID NO: 4100006 - RNA, 63 nt, Human
aguggcaaaagcaggcuuaggccuacgucuuucugauguuuaagcccauguguuuucuguccu

SEQ ID NO: 4100007 - RNA, 66 nt, Human
aguggcaaggacuuaggauauuacagaacaacuugaaaaagauggacuugucugaguucuuccauu

SEQ ID NO: 4100008 - RNA, 124 nt, Human
aguggcagguuauauagauagacucuuaaauuuggggcaaagaugaucuacaaguucauucauugacuugaaugaaguucuauucauuuucuuugguuggagauuuaucugcauucuuguugcu

SEQ ID NO: 4100009 - RNA, 73 nt, Human
aguggcaguacuuuaucacauggaaucagcuaguguuuacuugaacaauucuguggaugggaguucugcuauu

SEQ ID NO: 4100010 - RNA, 65 nt, Human
aguggccagaaguacuuuaauaggaaaguaaauuaggcuuuuaagaugcuaguauuucagcgacu

SEQ ID NO: 4100011 - RNA, 77 nt, Human
aguggccugacuccccaggcuccugcuguguugacaaaauucugcaagcacaaauggaccuggucagaaagagcccu

SEQ ID NO: 4100012 - RNA, 55 nt, Human
aguggcucacaccuguaaucccagcacuuugggaggcugaggcaggugggucacu

SEQ ID NO: 4100013 - RNA, 55 nt, Human
aguggcucaugccuguaaucccagcacuuuggaaggcugaggcagguggaucacu

SEQ ID NO: 4100014 - RNA, 55 nt, Human
aguggcucaugccuguaaucccagcaugcugggaggccgaagcaggcagaucacu

SEQ ID NO: 4100015 - RNA, 62 nt, Human
aguggcuucuauauugaauuuucuuccuuuguuccggaugacagcuccaugaaguagucacu

SEQ ID NO: 4100016 - RNA, 106 nt, Human
aguggcuuucuuuuucuugcccugaagcagcaaaugaugggagaaauauguguuuguuucuguucuucagagucagagcugcuucaggcauaaaauucuuagcccu

SEQ ID NO: 4100017 - RNA, 57 nt, Human
agugggacaguguagagcgucaggccagagaggcagaaacuauacucuguccccacu

SEQ ID NO: 4100018 - RNA, 63 nt, Human
agugggaggcaucccugagugcucucugacagcugaacggaucuucucagagaugcccuuauu

SEQ ID NO: 4100019 - RNA, 92 nt, Human
agugggaguggugcugguggcuuugcaguuagccuaggauugagcaauugcugcaauuguugcucucugcaucuucgguguuacuucuuacu

SEQ ID NO: 4100020 - RNA, 92 nt, Human
agugggauuguugcagcaaggccacugcucagguuuccgggauagaaucgggccccggggccuagcugggccuuggacagagcaucuucauu

SEQ ID NO: 4100021 - RNA, 88 nt, Human
agugggcuacugaaggacauuauguucaguagcuuaaaaaucugauggucucuuuuaagccccuggacuuugauguuuuaugccuuuu

SEQ ID NO: 4100022 - RNA, 60 nt, Human
agugggcuucagaaagcauggcaucuaugcuguugacgugccuggaucugaggacccauu

SEQ ID NO: 4100023 - RNA, 58 nt, Human
aguggggaagauuuugcagucauucagucauucaaugacuacaucauggucaccuacu

SEQ ID NO: 4100024 - RNA, 104 nt, Human
aguggggaucaugucuccuccuuucuauuauugugagggcaaaguuucuaucaucagaugguggaguuucucuuucaaacugaaauaaggaugauugcuccauu

SEQ ID NO: 4100025 - RNA, 128 nt, Human
aguggggauguuaauaucuuauuagguugccuggaugauugaauuagauccugcauagguugugcuuugcucagagccugacuuauaggaugugcuucaucaaggcaaaccugcuguucauucuugcu

SEQ ID NO: 4100026 - RNA, 74 nt, Human
aguggggccuggccucuguguucaccauagguacucugaguacugagaaccucaugcaggccauggucucugcu

SEQ ID NO: 4100027 - RNA, 77 nt, Human
aguggggccuucaucugggaaacacugcauccccagagugcuuuggggcagguggagugcccacgugcaggcccccu

SEQ ID NO: 4100028 - RNA, 73 nt, Human
augcugaaugggugauuuuggagaacuagcagaugugaaaccuuagaaagcugcuuuagaagaacccaagcau

SEQ ID NO: 4100029 - RNA, 74 nt, Human
augcugccaagucaucgucuguuuucuucaagaaaauguggagaauaggauacauguuugguaaaugauggcau

SEQ ID NO: 4100030 - RNA, 77 nt, Human
augcugccuugaacauccuaaguaucuuuguugcauauauaccuaggaaugcaauugcugggacacagggcaugcau

SEQ ID NO: 4100031 - RNA, 64 nt, Human
augcuggcauacuguggacauucaauaauuagagcuacuguguacugcacagugugcuaagcau

SEQ ID NO: 4100032 - RNA, 66 nt, Human
augcugugguagacagcauuccuuuuucccucccauagaaaaugauauguuguuuacucauagcau

SEQ ID NO: 4100033 - RNA, 64 nt, Human
augcuuagcaggagagaaguuuuaaguuugcaaauaguagacauuucuccuacuuguuauuuau

SEQ ID NO: 4100034 - RNA, 78 nt, Human
augcuuccuaaaugauucagaaauuucaagcuuucauagguaagccugugaauagaguucugugauuauuugggacau

SEQ ID NO: 4100035 - RNA, 76 nt, Human
augcuucuccacauaagacaguaacuacaguucugugguaaaugcaacaggacugaagucauugccaaagaagcau

SEQ ID NO: 4100036 - RNA, 78 nt, Human
augcuuggaaccaaaaguauuuuggaucucagauuuucucagauuugggaaugugcauuauacuuacagguuaagcau

SEQ ID NO: 4100037 - RNA, 55 nt, Human
augcuuuacccacaccaggaugcuaaauugugacaggguguguggguaaaggcau

SEQ ID NO: 4100038 - RNA, 83 nt, Human
augcuuucuaauauccuuuugccugguggcucuuagguagucuugcaagcagccagugggagugauacagaguuuggaagcau

SEQ ID NO: 4100039 - RNA, 59 nt, Human
augcuuugaaaugucaacugagaaugguguggugguugacagauggcacgucagggcau

SEQ ID NO: 4100040 - RNA, 81 nt, Human
augcuuuggcuagguuaagacugggacaaguuaagaugaauggaugaagauaagcaguucucaugucuuuccuacaagcau

SEQ ID NO: 4100041 - RNA, 95 nt, Human
augcuuugucuuuuuucaguugagguggucuauugcguuaccgagcuguggggaugcacccacuuagcugaaguucucaucuaaaaacaaaguau

SEQ ID NO: 4100042 - RNA, 110 nt, Human
auggaaagaauacuagacaaagaguuaggugacuucaguucaaucagaucgugauuacucacucugugacauugaacaucuacacacuccaggcuucaguuuucucacau

SEQ ID NO: 4100043 - RNA, 76 nt, Human
auggaagcagacuuuuuuaggguauggaagcaugcacucauaaacauggcuaucuaaccuuugaaacugcuuucau

SEQ ID NO: 4100044 - RNA, 113 nt, Human
agguuauagaaacucccaaauuuguagcuggcugaucagaagcguggcuggccugggggucccucuugaagcuggcaucugaagucagggcagucuugaggaggacugagccu

SEQ ID NO: 4100045 - RNA, 60 nt, Human
agguuauaugucauacugaagucauacagcugacagugagauuuuuauauguauuagccu

SEQ ID NO: 4100046 - RNA, 89 nt, Human
agguuauguaucuaguaaguagaagagcugugauucaggcuuagaguuugacuugagucuugguuuuugaauacuacauaacacugccu

SEQ ID NO: 4100047 - RNA, 91 nt, Human
agguuauuuauugauuguuuuuguagguuauuuuugauauuuuugcucugugggcaaaauagaaaccaacaaggucagugauucacauccu

SEQ ID NO: 4100048 - RNA, 71 nt, Human
agguuccacuuugcuuagagaacaaggcuuuccuuucaagccuuuaucccuguacaagguguccaaggccu

SEQ ID NO: 4100049 - RNA, 56 nt, Human
agguuccaggucuggguuaugugcucucuuaugugcucccagagcauccugaacuu

SEQ ID NO: 4100050 - RNA, 89 nt, Human
agguucuauuauccuuuuccuuugggugcccuuucagggaaugauuuugaaauggaacccagggucccgaaggagacagcaauaucccu

SEQ ID NO: 4100051 - RNA, 76 nt, Human
agguucucagcacgugguggguggagaacgugcugcccuagucucuucacacuaccccuguguaccuguggagccu

SEQ ID NO: 4100052 - RNA, 105 nt, Human
agguucuuaaguuugagggacacuggcagguuuccuccucauaguaacccuguuggggaggcagugccaggagaucgucacugccuuuuacagaugggaaggccu

SEQ ID NO: 4100053 - RNA, 69 nt, Human
agguucuuuuuuaaaggcagugauugaaaggcccagauaccuaucagacauauuuuuaacaaaguuccu

SEQ ID NO: 4100054 - RNA, 78 nt, Human
agguugagucgaggagaagaaagaaguggaaagguugccccagccuuauuccaauuucuccuacaaaaacucgcaccu

SEQ ID NO: 4100055 - RNA, 66 nt, Human
agguugcauucuagugguuacuuuuuaaaaaaugcuuuuaagcucuuuggcauuuggaggcaaccu

SEQ ID NO: 4100056 - RNA, 99 nt, Human
agguugcuuuaccagcaugaaucucauuuuucuggcuuaaaaucugagacagugaaauuauuccauaggaaagugaauguuauuuugcagaauuagccu

SEQ ID NO: 4100057 - RNA, 73 nt, Human
agguuggaguucaguggcgcgaucucggcucacugcaagcuccgccucucggguucacgccauucuccugccu

SEQ ID NO: 4100058 - RNA, 69 nt, Human
agguuggugcaaaaguaauugggguuuuugcaguuauugcaaaaaccccaauuacuuuugcaccgacuu

SEQ ID NO: 4100059 - RNA, 66 nt, Human
agguuucccagcccacucuggaacccaaucaauguauagaggccccagauucugggcugggucccu

SEQ ID NO: 4100060 - RNA, 81 nt, Human
agguuugcagaaaguaggcagugcuugauuuuccagguuuaugauauuggaacacugaucauugccuuuaucugcaacccu

SEQ ID NO: 4100061 - RNA, 104 nt, Human
agguuuggguggugccuuucuuuuguaaaguggaguaagcauggcuuuggacccagagacuuucuugaccuaguuaauauuaggaaaguguaccacuggaaguu

SEQ ID NO: 4100062 - RNA, 112 nt, Human
agguuuuaucauauaaauuuacuuauaauacacacaacucauuguguaauauuugugugugcgugugugugugugugugugugugugugugugugugugugugauggagucu

SEQ ID NO: 4100063 - RNA, 66 nt, Human
agguuuuuucacuguugauauuuuggcuccuucaauguugaaacaucuuaaacagaggaaugacuu

SEQ ID NO: 4100064 - RNA, 79 nt, Human
agguuuuuugaaggucagaaugagauuagguuaauuuguuaaguuauuaaucuacucaguaacugcuuaggaagaaccu

SEQ ID NO: 4100065 - RNA, 113 nt, Human
aguaaaaaacuguguuuuucugaaagggggcucagaguuaauuggauggguucagauaugggaaccucuggaacuugauuugaaaccccugucacagaaaugaccuuuuuacu

SEQ ID NO: 4100066 - RNA, 92 nt, Human
aguaaaacuguauuacagaaacagguggcaggcuagauuuagcccacaggccauaguuuucugaccccugcucuauaauauuacuuuuaacu

SEQ ID NO: 4100067 - RNA, 60 nt, Human
aguaaaaugacccauuaugccuuaaguuacaaauauuuacaggccuagggucaauuuccu

SEQ ID NO: 4100068 - RNA, 59 nt, Human
aguaaacuuguucucauguugcagaaaugccaugcauaucuuaauagaaacagguuucu

SEQ ID NO: 4100069 - RNA, 82 nt, Human
aguaaaguaaauucaaggaucuguuaaaucugguaaaaguagaucaaaucagagauugacagccuguggagggugcugaacu

SEQ ID NO: 4100070 - RNA, 87 nt, Human
aguaaauauaugacuccacugcaugauuuagugguagaaauagucuauuuauguucacauuuuuuaguagagagucauguuuuuauu

SEQ ID NO: 4100071 - RNA, 84 nt, Human
aguaacaagguggucuugguauuuaaacuguagguggagaaacauacacguaaacaacaaauaccagauuauuuugcaaaugcu

SEQ ID NO: 4100072 - RNA, 57 nt, Human
aguaacacauaucuacaacauguggauaauacaaaucccagugugauaugugucauu

SEQ ID NO: 4100073 - RNA, 62 nt, Human
aguaacacuuggaaugauagcauuguuucuuugcagcaugucauaaaacacaagcuguugcu

SEQ ID NO: 4100074 - RNA, 64 nt, Human
aguaacagaaggccugacuuaaccugccuuuaaacaguaaggacacaaguaugccuauguuauu

SEQ ID NO: 4100075 - RNA, 84 nt, Human
aguaacaucuuugggcaaugaugagggagggggacggaaaaaacaagcccuauuuuauguucccucaacaaucuaaauguuacu

SEQ ID NO: 4100076 - RNA, 88 nt, Human
aguaacguagauaagucuuccauauuucuagaugcagguggcaaaacugaacuauaguaauucuggcaagacuuauguaugucuaacu

SEQ ID NO: 4100077 - RNA, 69 nt, Human
aguaacuggcagggcugguauucaaaauccaguuuaucugauuuuagagugccuguucuuucccaugcu

SEQ ID NO: 4100078 - RNA, 129 nt, Human
aguaagacuucuuuaaugucagccucucucaccuacucuuuacauaguguggacuacucuuuaagcagaccacugguccacacuguguaaagaguaggugagagagacugacauuaaagaagucuuacu

SEQ ID NO: 4100079 - RNA, 130 nt, Human
aguaagauggacuauuguaaagaauuaaucagaguccuuaguuagagaugaauuuugucuggaagaaaauucuuugcagagaaaguggcauuugagcuagaccuugaugacuugguauauuuaaauuacu

SEQ ID NO: 4100080 - RNA, 75 nt, Human
aguaagccccccucaguaaggaugcuucagcggaccccucugauucacaggggucuccauucucacgggcuugcu

SEQ ID NO: 4100081 - RNA, 129 nt, Human
aguaaggcauuacaauuaugaaaauuaauuuucuuggacuaagcuauauuuacccauaguacaaaaagcauuguggguaaauauccuuugugaaaauuagacaugagaccaguaaauauaugcuacauu

SEQ ID NO: 4100082 - RNA, 59 nt, Human
aguaaguccaaggcugggugcaguggcucaugccuguaaucccaaugcuuuggaaggcu

SEQ ID NO: 4100083 - RNA, 83 nt, Human
aguaagugcagcuccucaaauguuucuugaacaccaacaacgggguccauguugagugcugaggauacaggagccacucugcu

SEQ ID NO: 4100084 - RNA, 71 nt, Human
aguaauauuagcuuaucacacaagcugcaaaugcccuagugaaagcagcugucggaaagcuaaguguugcu

SEQ ID NO: 4100085 - RNA, 98 nt, Human
aguaaucaguuuuauacaaguuagaaaguaaaucauuugacaguguuuauucuuuacauguacugguuugacuuauauguguuuguuaagugauuauu

SEQ ID NO: 4100086 - RNA, 97 nt, Human
aguaaucuauguagccccccagaucuuuagaugguggacuaucugacuuggcuaugucgcccgguagaauuuuaccaucugggcuucgaagacaacu

SEQ ID NO: 4100087 - RNA, 65 nt, Human
aguaaugcuguuaugggucaagcaguucuugaaguaggggaacaugaaacccaaacagaauaacu

SEQ ID NO: 4100088 - RNA, 61 nt, Human
aguaauggcuuuggucugggucccaguauaggcagugugggauaggaguagagcuguggcu

SEQ ID NO: 4100089 - RNA, 76 nt, Human
aguaauugucuucuccuuccuggcaauuuguuuuauuauaccuaugaauaugccaacauggagaggauguauugcu

SEQ ID NO: 4100090 - RNA, 62 nt, Human
aguacacagaguuauuuuguguacuuaccgaggaaaaaguacacagaguuauuaugugaacu

SEQ ID NO: 4100091 - RNA, 75 nt, Human
aguacaccugccuccaaugaagccaacucucaggcucuagaagucucugccuugggauggauucaccagugugcu

SEQ ID NO: 4100092 - RNA, 73 nt, Human
aguacagggacauuguaauuagacuuggguuugaaucucaacuuugccuaauaacuagcuguguaacugugcu

SEQ ID NO: 4100093 - RNA, 57 nt, Human
aguacaguuacugaguuaggaaaaccaagaaagugugguuuccuaaaaagcugugcu

SEQ ID NO: 4100094 - RNA, 75 nt, Human
aguacaucaugcagggacuugugcuccauuuucguggauuaugggcuccgccagucccugggaaaugaaguuacu

SEQ ID NO: 4100095 - RNA, 84 nt, Human
aguacauuguaauuugaucacauuguuucauacauauucugggacauccuaaaauuguacaugcagugagucaucuuacgugcu

SEQ ID NO: 4100096 - RNA, 90 nt, Human
aguaccaaauucacccuuguaaugauugaaauacuguguuuuuuucagauacagugccccuuuucacauggacuaggcugaauaaaugcu

SEQ ID NO: 4100097 - RNA, 78 nt, Human
aguaccaagcuagagggauuccaggguaauguuaucucuaucucccucacuaagcccaagucccuuuggucagguauu

SEQ ID NO: 4100098 - RNA, 69 nt, Human
aguacccuggguuacacuaauugaugcuuuagaaauuaaagcagucacuccagugugaugcaggugacu

SEQ ID NO: 4100099 - RNA, 64 nt, Human
aguugaaaacauguccauacagaaacuuguacacucaaguuuguagcagcaugguuuaauagcu

SEQ ID NO: 4100100 - RNA, 78 nt, Human
aguugaagguuggcugauccaugccaggcucagcugaauggcucugcuuucaguucuggaucuggcuggccuucgauu

SEQ ID NO: 4100101 - RNA, 129 nt, Human
auggaagucagugauaccaggccuuuuuaccuuuuucuucaccuuuauuccuuaucaagaagaaugcaaaauaaaucgguugguucaagguaauaagguuugcccuuauaguucauuguuucauuccau

SEQ ID NO: 4100102 - RNA, 68 nt, Human
auggaaucacagaaguugaauuugcaugacuaaauuuaagugaauauuuucuucuguaauuuuuccgu

SEQ ID NO: 4100103 - RNA, 60 nt, Human
auggaaucugccaacuuguuuuaauuaacugaauguggcacaagaccuggcagcuuccau

SEQ ID NO: 4100104 - RNA, 84 nt, Human
auggaaucuucuacagaagcacuugcuuagaugugguuauguuauacccauaugcauguaaugcuuuugcccagguagcuccau

SEQ ID NO: 4100105 - RNA, 80 nt, Human
auggaaucuuggcuggaggagcauuugggaacugcuggacuagauggucccagaggucucugcugguucuuugguuucau

SEQ ID NO: 4100106 - RNA, 109 nt, Human
auggacacaagcaucugccugccccagcaacagaguccugcuucccacagaaaccgguuccaaagccggcagagacggcgcuuugaacuugcucaggccuuuugaccau

SEQ ID NO: 4100107 - RNA, 130 nt, Human
auggacauucauuaaaaugggcucugacuugauagccacguuagcagaaaauggaaaaguccaucuaucacugucuguucccauuuucugcauaaucauuccuggaagaaagaggccugcaaguguguau

SEQ ID NO: 4100108 - RNA, 75 nt, Human
auggagaauuggaagaggacuuagagaauauuuugcugcauguuguaagauguacuuuuguccucaccucugcau

SEQ ID NO: 4100109 - RNA, 60 nt, Human
auggagacugcgucugccaucccugcucccccccagggauguaggacuaggcuucuccau

SEQ ID NO: 4100110 - RNA, 65 nt, Human
auggagaggguagagaccuucugaugaaaggaguagggguuuuucaaagaagauuacccucccau

SEQ ID NO: 4100111 - RNA, 89 nt, Human
auggagaugggcauauguagcguguguucuggacacggcacguggaggcagagcacacaugcauagaguguguaaugcuucacuuccau

SEQ ID NO: 4100112 - RNA, 64 nt, Human
auggagcauucuuuuacuuuaggauaacugacuuugaugucuuccuugaaaagaaugucuccau

SEQ ID NO: 4100113 - RNA, 80 nt, Human
auggagggaaagauacuggaaaaugacaggucuuuuuaacucaacuauaaagucuugucuuauuuuaauagauccuuuau

SEQ ID NO: 4100114 - RNA, 72 nt, Human
auggauaucuacauucuuguaucuucuuucagcaaauauuuacagaaagagagagagagugugugugugugu

SEQ ID NO: 4100115 - RNA, 72 nt, Human
auggauuggauuuuuauggacccacaaaaaucagaacucuauuauggaaggguccauaaaaauccaauccau

SEQ ID NO: 4100116 - RNA, 78 nt, Human
auggauugggcucuauguucucugucagaccuguguggcuuugcuacauauccaggcugagaagauauccuuuuccau

SEQ ID NO: 4100117 - RNA, 85 nt, Human
auggcaccuagagagauaguuuauuuuacugacuaauuaaaauccaccaauugaguaugaauacagauuuucucucuauugucau

SEQ ID NO: 4100118 - RNA, 55 nt, Human
auggcaccugaggaggcaucuggagguuggggccccugcucucccuucuccccau

SEQ ID NO: 4100119 - RNA, 62 nt, Human
auggcagaccugaagguucggcgcucuuuucuagccugugagugccccguuauguuuaccau

SEQ ID NO: 4100120 - RNA, 57 nt, Human
auggcagccugaacacuuccuguucccaggaaugggcuugggaucaaagguugcuau

SEQ ID NO: 4100121 - RNA, 58 nt, Human
auggcaggaaaauaguagaaauuuaucaaauaugaaaacugcuuccaauuccugccau

SEQ ID NO: 4100122 - RNA, 80 nt, Human
auggcaugggauaacucagcugucugcuuagggcauggcuuuaaagucagauaucuggguugaaauccucuuucugccau

SEQ ID NO: 4100123 - RNA, 57 nt, Human
auggcauuauagcaaugguuuguguuaugauuaaagcaaauuauucuuauaugccau

SEQ ID NO: 4100124 - RNA, 68 nt, Human
auggccaaagagggaaugugauugcaccauuuaaauguauaucaggaaggugugagacauccugccau

SEQ ID NO: 4100125 - RNA, 62 nt, Human
auggccacccuaccuaagaagcacuuugcuagauuauaggcugcuggaggacaggguuucau

SEQ ID NO: 4100126 - RNA, 57 nt, Human
auggccagucaagccucuggcugcucauucugguaggucugagguuaguuuggcuau

SEQ ID NO: 4100127 - RNA, 63 nt, Human
auggccaguguuucccucaguuuccauuuuuauucagaaauucacguggugaagcaugguuau

SEQ ID NO: 4100128 - RNA, 61 nt, Human
auggcccucaauuagacgucaaaaagauuaacgagauugucuuuuaugucauugaggucau

SEQ ID NO: 4100129 - RNA, 102 nt, Human
auggcccugcuauugcuagaucucaaugcuuuucucauacccgagguuuagguuugggacugggcuggcguggagaguuuagucccccagcaaggagcacau

SEQ ID NO: 4100130 - RNA, 57 nt, Human
auggccuccgacccaugacgugcuuaggaaaguugauauucaugguuugggggccau

SEQ ID NO: 4100131 - RNA, 74 nt, Human
auggccugcccacuccaggagcaacucauuguggaaacaaguuuaguaugaccugagaguaggaugcaagugau

SEQ ID NO: 4100132 - RNA, 56 nt, Human
auggccuggggagcaugggaagaaggcucagcucuuccagcuaagaccccagacau

SEQ ID NO: 4100133 - RNA, 79 nt, Human
auggcgggucauuguuacuguuuaguugccugauggguuucuggcuccuaaauccaaguaacgaagcagauccugcugu

SEQ ID NO: 4100134 - RNA, 130 nt, Human
auggcgguuguccuguugcaggugcccugcugcaggaggagaggcuggacgcggugacccugcuuuacgccaccucgcugcccagcuucugccugcuggcgggugcagcccuggugcuggaggcuggcgu

SEQ ID NO: 4100135 - RNA, 71 nt, Human
auggcuacaccuauuccuuuauguacagugauggcugcuuucacaguacaaaggcagaauuggguaguugu

SEQ ID NO: 4100136 - RNA, 67 nt, Human
auggcucucuagggcccagguuuucugucaagcauucacuagcuagcuugggggccuggggaaucau

SEQ ID NO: 4100137 - RNA, 62 nt, Human
auggcugggaagaguuagagacagcugcagaugcagcuuuugcagacuucuugcccagcugu

SEQ ID NO: 4100138 - RNA, 72 nt, Human
auggcugugguuauggaacuggcuauggcuguggauguggcucuggcucuggcuacuguggcuaccggccau

SEQ ID NO: 4100139 - RNA, 56 nt, Human
auggcuguuggacuugauuuuagcacagauccagcugauuccaaagccaaagcuau

SEQ ID NO: 4100140 - RNA, 58 nt, Human
auggcuucauucuguaguuaaaacauuuacaguguuuuauacugcucaguguaguugu

SEQ ID NO: 4100141 - RNA, 67 nt, Human
auggcuuccugcugccaguaccuggggcucugcuguuagccuuucucuggcagcaggacaggcucau

SEQ ID NO: 4100142 - RNA, 116 nt, Human
augggaaaauggauguuaacauuucugccugacugauaaucucugauguuacccuugggaagccccagcuuucagaaugauuuauuugucagguuuuggcguuuuuuuagucccau

SEQ ID NO: 4100143 - RNA, 86 nt, Human
augggaacacuaugaauuuuauucagggauaacauccagguuguuuugacccacaguuuugccuuggguuucagguucauucccau

SEQ ID NO: 4100144 - RNA, 81 nt, Human
augggaaguggauaaagcaucuugacauuacuugugauucaaauaauauugucaaaaugacuuuacuacaguuuuuuucau

SEQ ID NO: 4100145 - RNA, 112 nt, Human
augggaauagaaguaauuuaaaauguucaagacauauuaaaugugcgacuguggcuccaaauugccauuuaguaugcuuguauuauaggauauagaaacuacugcaccccau

SEQ ID NO: 4100146 - RNA, 88 nt, Human
augggaauggcaggauaaauguuugauucuauuuaccuauuuuuaaauuaaugaguauaguuccaagcauauuuugaugaugacccau

SEQ ID NO: 4100147 - RNA, 64 nt, Human
augggaggcaaagaucgcagaaugggagguugcuucuuccuuuacauagauuuugccaucccau

SEQ ID NO: 4100148 - RNA, 57 nt, Human
augggagugugcuugaggaguugggauaacagcacuauggcuggagcacaguucggu

SEQ ID NO: 4100149 - RNA, 82 nt, Human
augggauucaaaggacuaaugaauagaugaaucuuggaauuucaaaauuagucuucucauuuggauccuugaaugaacucau

SEQ ID NO: 4100150 - RNA, 75 nt, Human
augggcacauugcaaagcuuaggaaacuuuuaaaggauuagccauuuuagcuucuucagcuuguucauugccugu

SEQ ID NO: 4100151 - RNA, 109 nt, Human
augggcauguaguacaccagugaaagacuucccuaguucuaagucuguuucugcagcgaaacagacucacagcuagagaaggagaaaugugucucugcuucuugcucau

SEQ ID NO: 4100152 - RNA, 66 nt, Human
augggccaccggcugccagauggaggcagcgucagcaacaccuccucucaggcuggauggcgcuau

SEQ ID NO: 4100153 - RNA, 81 nt, Human
augggccagaaaugugaaagagguguucaguggggaguauacuucuaacuugaauacauucuuuucagcauuucuacuuau

SEQ ID NO: 4100154 - RNA, 79 nt, Human
augggcuagaaacaucagcuaaccaaaagugcaaagacuuuauaaccagguaggcugaaguucuuugauucugguguau

SEQ ID NO: 4100155 - RNA, 66 nt, Human
augggcugugagguccggcaggugaggccagcaguugucuaugguccugagugagaccuggcccgu

SEQ ID NO: 4100156 - RNA, 77 nt, Human
auggggcagaauauuugaaaucuggguuacucugggaaauccaggagacaguguuauuuuauuuauggugccacuau

SEQ ID NO: 4100157 - RNA, 76 nt, Human
auggggcauaguacuggaacaaugaaacucuguaguauggcuuugcuugugauuucaaagguucugcaugccccau

SEQ ID NO: 4100158 - RNA, 80 nt, Human
augggggugggccacucugauuuuucuaauacuucagcaucugguuaaguauguuagaaaaucaagugcuaacaucuuau

SEQ ID NO: 4100159 - RNA, 78 nt, Human
auggggugcagcaggcagcugggggaguugagaacuugcucacucacuccucuuuugucuuuacccgcugccccucau

SEQ ID NO: 4100160 - RNA, 100 nt, Human
augggguugggguaggucuucugaaaaccaaaagaauaaaauuuauuuucuuugcuacccugugguuuuuugacacugaagaucuacaguacaaccccau

SEQ ID NO: 4100161 - RNA, 55 nt, Human
auggguagacauuccugaaacucgcugacacaguguaguuguuuuuguuucccau

SEQ ID NO: 4100162 - RNA, 69 nt, Human
auggguauaucauauuuguggucccuuuaucuccagcaaaggggacugcuuaaauauaugauguuacau

SEQ ID NO: 4100163 - RNA, 61 nt, Human
auggguccacuucugcacuguggcuuagccucucuuccuagucacaccaggaguggcccau

SEQ ID NO: 4100164 - RNA, 78 nt, Human
augguaacaguuauuaucacauuagugcccaaguuaugggagcaaucuccacuagaugauaaucagcuggaucaucau

SEQ ID NO: 4100165 - RNA, 78 nt, Human
augguaccccuggagcccagauacuuaaguccuccaacauuuaaguguggauuggcuggagcuaucagaggucaccau

SEQ ID NO: 4100166 - RNA, 73 nt, Human
augguauuucuggagacaucauguugugccuacagcugagagagauuguuuucacaaugaugucagauacugu

SEQ ID NO: 4100167 - RNA, 62 nt, Human
auggucagggggaucugugagguagcgaugcacgcuaagggucaaagauuuccccuggaagu

SEQ ID NO: 4100168 - RNA, 59 nt, Human
auggucauucagucaaagagucaugauuugaacauaaguagacuaucucuggagaccau

SEQ ID NO: 4100169 - RNA, 85 nt, Human
auggucgcuuaacaagccucagcaugcucugugggcucagcgaguuuguggugucacccacagggcugcugauggcagccaucau

SEQ ID NO: 4100170 - RNA, 69 nt, Human
aguugaauuaugagugucuuugauuaucuggcuugaagguuguuuugcagggagacucauaggacaacu

SEQ ID NO: 4100171 - RNA, 57 nt, Human
aguugacagagguaugagguuugaguauuugcaaagcccucaagcagacugacagcu

SEQ ID NO: 4100172 - RNA, 61 nt, Human
aguugacccugaguucuggcagccagggucugugaacuuggcucuuggaaggggcucagcu

SEQ ID NO: 4100173 - RNA, 70 nt, Human
aguggugcagaggugaaagacuagcaagauaauuaaccuuugcagguccggaaccucgccguuggccacu

SEQ ID NO: 4100174 - RNA, 83 nt, Human
agugguggagcugggauuugaacugcaaagucuugcuauuaaucgcugcccuauauugccuucaagacccauccuccaacgcu

SEQ ID NO: 4100175 - RNA, 62 nt, Human
agugguuaagacagcagacuuugguuuuagacugccuagucucaaauccugcuguuaccacu

SEQ ID NO: 4100176 - RNA, 72 nt, Human
aguguaauagugugggcagcuuccacuuaguuagguacuucuggacaaauggaagcuugucugcaugcagcu

SEQ ID NO: 4100177 - RNA, 60 nt, Human
aguguaaugccagaaccacuuucuucuggaugugccccaaguguguucuuggcauuaccu

SEQ ID NO: 4100178 - RNA, 60 nt, Human
aguguagaagggugugccaaacagcagacccagcucuggcccaaacccuuucuagucacu

SEQ ID NO: 4100179 - RNA, 82 nt, Human
aguguaucugugcaugcaaacaugaagagaaagagacuucuauggcaucucuuuauuuucuuugcuauugcuuuaaugcauu

SEQ ID NO: 4100180 - RNA, 59 nt, Human
aguguauucagaauguagcaaaauugacaggaaguagagcuuaugauucugaaugcacu

SEQ ID NO: 4100181 - RNA, 58 nt, Human
agugucaagcuuucugucucuuaugggaugacucagcagaacaaggaagcuuaacauu

SEQ ID NO: 4100182 - RNA, 64 nt, Human
agugucaagguugagaaacccugcucuguacuauacccuggggucauucugugacuuuggcauu

SEQ ID NO: 4100183 - RNA, 75 nt, Human
agugucagaaagccaacuccaacugucuacagcaauaacagugugacaguguaucaggagugggguuuuuaagcu

SEQ ID NO: 4100184 - RNA, 91 nt, Human
agugucaggagagggagaaggaugcugcugucacggccccuugguucucuguugcaggggcugacagcacgccuucuguuacucugguacu

SEQ ID NO: 4100185 - RNA, 79 nt, Human
agugucagguagcugcagagacuauuuuacuaccugcagaacaguuacaaaagacuagauucuguaaguauuugauauu

SEQ ID NO: 4100186 - RNA, 58 nt, Human
agugucaucccaugcucagagacuggcacaaaggacaccucugagcugauaugacauu

SEQ ID NO: 4100187 - RNA, 69 nt, Human
agugucaugguagauaacaacaugggcuuagaaauuuaaagaccuaaguucaaaaucaaccaggacacu

SEQ ID NO: 4100188 - RNA, 121 nt, Human
agugucauuggacuggcugauucaccuuucugggcucuguaucuguggggcuuccuuuguucaggaaggacugcuggguggcagccaagccaaaggagaguggccuggucccugagagacu

SEQ ID NO: 4100189 - RNA, 64 nt, Human
aguguccaaaagagccagccgggcgugguggcucacgccuguaaugccagcacuuugggaggcu

SEQ ID NO: 4100190 - RNA, 67 nt, Human
agugucccucaguagucaugaguaaacuuuuuaaaaaaaagugguuuuucagacuuugagagagacu

SEQ ID NO: 4100191 - RNA, 55 nt, Human
agugucugagccagaauuagaaguuacaggugucuaauucuguguuucagccgcu

SEQ ID NO: 4100192 - RNA, 83 nt, Human
auaucugcaugcauagaaugaagaggcugaacugcaugaugucuaagucuucacccagcucuacguuucuaugaaucagguau

SEQ ID NO: 4100193 - RNA, 101 nt, Human
auaucugugcuaaucuguccuaacaauuagcacagauauuagugaucugugcuaauugguuaauaugucugcuaauuguuucucagaauuagcacagauau

SEQ ID NO: 4100194 - RNA, 69 nt, Human
auaugaauuuggggaggacacaguucagucuauaacauucugcucucucuggccucccagaauucaugu

SEQ ID NO: 4100195 - RNA, 60 nt, Human
auaugacagcggauucacauauccuaaaccuuugauaauuaugugauucaguugccgugu

SEQ ID NO: 4100196 - RNA, 73 nt, Human
auaugacuauucuggaucugaaugugaauagcugauaucugcucugcacaaaacugucgcagaaugggcaugu

SEQ ID NO: 4100197 - RNA, 83 nt, Human
auaugagcacauuucacaugacaggcucuuaaaugcaagugugugugcguguaugugucuguggugugugugugugugugugu

SEQ ID NO: 4100198 - RNA, 79 nt, Human
auaugaugcaagcagagguuuauguauuaggacauguuuuaucuugcugcuuuuggaaacccugugaucaccaucauau

SEQ ID NO: 4100199 - RNA, 75 nt, Human
auaugcagcugcugaggaagggguuggauuauccaauaauauagccaguccuaguucuaccuuacauguugcuau

SEQ ID NO: 4100200 - RNA, 130 nt, Human
auaugccauagcuucauaugccauuaguaaauagcuucguaugccauacagucucuguugaaauuacucagauaugucauuguagcaugaagacagcuauagacgauguauagagaaugagcaugguugu

SEQ ID NO: 4100201 - RNA, 91 nt, Human
auaugcgugcaugcaugugugugaauacauguguguauagagguguaugccuaguguuaauguguguucauguguaugugugagugcaugu

SEQ ID NO: 4100202 - RNA, 66 nt, Human
auauggaaguguuguaucuuuuuaauagauacauaguaaucuauuauaaggauauaaaauggauau

SEQ ID NO: 4100203 - RNA, 95 nt, Human
auauggaauuacugcaugauucagcaauuuuauaucuggguauauagcccaagaaguaaaagcugggacaugaauagauauuuguauacccauau

SEQ ID NO: 4100204 - RNA, 68 nt, Human
auauggggcuaaacacgccuggccuuacagugcuccucaggcucaaggucuugucuuaugccccauau

SEQ ID NO: 4100205 - RNA, 86 nt, Human
auauggggugaugaaggacuccuauuuuauauuuuacacacuuccaaacuauuugaaugauaugugaaaaggaacaugccucaugu

SEQ ID NO: 4100206 - RNA, 60 nt, Human
auaugugcaaaguguacaaauuaaugucuaaaauaguaauuuagugcauuaugcaaaugu

SEQ ID NO: 4100207 - RNA, 64 nt, Human
auaugugcaugugugugugugugugugugugugugugugugugcuugcauacauguuaacaugu

SEQ ID NO: 4100208 - RNA, 56 nt, Human
auauguggaggaaaucgagagaauaauaaauguucucucuggcaaauuucacauau

SEQ ID NO: 4100209 - RNA, 83 nt, Human
auauguguguguauaugcauuuaucuauacauuuguguacauguaugugugugcacuagagagagauauauacacacacauau

SEQ ID NO: 4100210 - RNA, 73 nt, Human
auauguguugggcaguuuucuaugcugcaauuuaucgcaagaauagcagcaaagcaggaucugcucacugugu

SEQ ID NO: 4100211 - RNA, 73 nt, Human
auauuacaagcaaguuauguaagccugcuuuuagcuuuuaacuucagcuaggucuacaagcuuaaaguaaugu

SEQ ID NO: 4100212 - RNA, 96 nt, Human
auauuacugaauuuacuguuuccaucaggauguuuggcugucauauagaacaaacuaucacagucuacauacuagucagaacaguuaauguaauau

SEQ ID NO: 4100213 - RNA, 66 nt, Human
auauuccagcacagaaguauacauugagaugagacauuagcagaucuaaaugcugugcuggauugu

SEQ ID NO: 4100214 - RNA, 108 nt, Human
auauuccuacuuuaugauggaauuuguacugaagauuguaaacugcuucaguagucacaguuuauuugggggaucuucagugcauugucuaaauaaugucagugauau

SEQ ID NO: 4100215 - RNA, 119 nt, Human
auauucuacaugugauauguaauuuauuuguucuuucuucuguuguuuccaauuauuauaaacagcaggcaugaaugacacugaauauguaauaaguugcacauguuauaguagacugu

SEQ ID NO: 4100216 - RNA, 81 nt, Human
auauucuggguauuuacaagauuaauuauuggaguguuuaucaacacucuacuaaggugucuuuuaaguuuaccuaaaugu

SEQ ID NO: 4100217 - RNA, 78 nt, Human
auauucuuuucagguggagauccagucuuugugugaacauaucuaaagcagggaccucacuacccccagaagcaaugu

SEQ ID NO: 4100218 - RNA, 111 nt, Human
auauugagcauuuagaaguuuaggcagaacuuggcuugcuugcagcuuauaguaagcaguuaauguuuugucaauuaaugucuaaagugccuauaaauacacauucaauau

SEQ ID NO: 4100219 - RNA, 74 nt, Human
auauuguauugaccuugcagggaagauguucuauuuagacuuaaaacauguuuccaguguaaggccuacaauau

SEQ ID NO: 4100220 - RNA, 57 nt, Human
auauuuauaaggcaggcaaguaaaacacaaaaacgacuugcuugcucuuaaaaaugu

SEQ ID NO: 4100221 - RNA, 119 nt, Human
auauuuaucuuucagauugcuuguuguaugcacauuuucuguuaguacaaauuggagggauuaucaugaccuucauuuguugacagagacaugaacaggcagaacacagugaugaauau

SEQ ID NO: 4100222 - RNA, 80 nt, Human
auauuuguguaaagaggagggguuuuuuaauuuaauuuuauuacuuuauggcuaagaaucucucuacuuuauuacuguau

SEQ ID NO: 4100223 - RNA, 129 nt, Human
auauuuuaauucuacccuucuguugucauaggcauaaguuauuuaucugugacauagagaaauucuauugaguuacagaaaauacuuaauguuucuaaucaauauauuaguauuuugggauuaaaaaau

SEQ ID NO: 4100224 - RNA, 77 nt, Human
auauuuuggaaauagcuccaguuucauuguguagaaaucugcugaaauguaauauagacuauuuaacuucaggauau

SEQ ID NO: 4100225 - RNA, 65 nt, Human
auauuuuggggugaugugcauccuauaguuuuuguggaccuuguugcccaucagcuccaggaugu

SEQ ID NO: 4100226 - RNA, 129 nt, Human
auauuuuguuauaguaacccaugcugaccaagacagguagaucaacuggggagggaagggacaaccaucuaacuuuccuuucccccauauuuauugucuccuuuuagucucaugugacagaaucuaaau

SEQ ID NO: 4100227 - RNA, 68 nt, Human
auauuuuguucuggcuccuuuuaaauguauucauuuguaauuuuggaacagagcucagaaaauaguau

SEQ ID NO: 4100228 - RNA, 58 nt, Human
auauuuuucuucuagcuuuggugagugaauuauuaauugccauuguaaagaaaaaugu

SEQ ID NO: 4100229 - RNA, 115 nt, Human
auauuuuugggguuaacugcuuacagagaucuuuaaaaguuauuauuauccagagaagagauagcaauaauaguuagggaccauuuuguagcaguuaccacuguccuagaaauau

SEQ ID NO: 4100230 - RNA, 75 nt, Human
aucaaaaguuuugcagauaagagcguggacacuuuauacauuuuccaugcaauuucuguaaaaccaacauuugau

SEQ ID NO: 4100231 - RNA, 65 nt, Human
aucaaauagugugcagccuuuaaauauagagggugugucccuaugguuuaugucacacuuuugau

SEQ ID NO: 4100232 - RNA, 130 nt, Human
aucaaaucaaauuuauauuaaaaauaagaucuuuagaugcuguauucucccucugaggagcugaaauaaaagcaguuuagaaauacaagugagguugauauuuagcauaugaaaacaugaaaauuugacu

SEQ ID NO: 4100233 - RNA, 90 nt, Human
aucaacauaauugugcagaguggaguuuuucagcgggcuugaagaaaguuccuaaaaugugauuccacuuuuauaacacaaguucuugau

SEQ ID NO: 4100234 - RNA, 63 nt, Human
aucaagcaggaguguacugagugccugaaugaggagcuuauucuugcuucacacuccucugau

SEQ ID NO: 4100235 - RNA, 57 nt, Human
aucaagccuaggccuacucugguuugccuggggcagaaagucauggccagguuugau

SEQ ID NO: 4100236 - RNA, 67 nt, Human
aucaauacuugugaguuuccaacaauggauuugguaguggccauuguaaaaguauucuaagauugau

SEQ ID NO: 4100237 - RNA, 130 nt, Human
aucaauaggcuugucgguuucauaugcauuuaaugcagugagccauuaaaugguguuuagggaagggagaaaggaagaucacuuacuggcucucuguaucgaucaucaaaugaaugcuuagccauuagau

SEQ ID NO: 4100238 - RNA, 83 nt, Human
aucaaugagagcaaaucuccuuaaagguaaaauagguaaaauuucauuuuuaauuuuuuuuagguagauuugcuuuuauagau

SEQ ID NO: 4100239 - RNA, 73 nt, Human
aucaauuacuguaaccucuguggguguguaaaauaugaaauuaccagcacccucacagagccacagaauuggu

SEQ ID NO: 4100240 - RNA, 65 nt, Human
aucacaacuuuauauuugaauuuauuucucccuuaaaauuaggauuucagaggugaaguuguggu

SEQ ID NO: 4100241 - RNA, 89 nt, Human
aucacaccuuaaugugucugauggcccugaauugacggucaugucaggagggccucugaucugacacaggcaguuuaggaggcuguggu

SEQ ID NO: 4100242 - RNA, 60 nt, Human
aucacagccauagaugcuuauguaaagcuguguucaguguuacaggcaucuguucugggu

SEQ ID NO: 4100243 - RNA, 64 nt, Human
aucacagggcuugcuuauuggaucagccugcagcuuccaaagaaauugaccaagacuccuggau

SEQ ID NO: 4100244 - RNA, 61 nt, Human
auuccccagccauuugcuucucugaaggaaagucucuccggggccagcaauguugaggaau

SEQ ID NO: 4100245 - RNA, 70 nt, Human
auuccgcaucacacuagcaaaagugaggcacugauucacagugccuuaauacagaugggugguguggaau

SEQ ID NO: 4100246 - RNA, 73 nt, Human
auuccuacuuuauuguaaaugcugauggcugucauuauuuaaguuauuaugcauaggcaauaaugguaggaau

SEQ ID NO: 4100247 - RNA, 71 nt, Human
auuccucagacauguuuuaagacuuauuuaugaaggaggagagagguuuuaaguaaauguccaaauggaau

SEQ ID NO: 4100248 - RNA, 92 nt, Human
aucacuuagcuuauuaaagcacacaucucuggcuggguuucuucaccagagauuuugcuagaauuuguguuucuaaaaagcucaaaggugau

SEQ ID NO: 4100249 - RNA, 109 nt, Human
aucacuuaucagccuuuugaacuuagaacugggcauucugccagaacucaauagcaagaagaggguggagagaaauguccagggcuaggaucugggcuuuaaaggggau

SEQ ID NO: 4100250 - RNA, 59 nt, Human
aucacuuccagcugcccugugugcuggcuaggagaugcaucagcauuagcuggaaggau

SEQ ID NO: 4100251 - RNA, 65 nt, Human
aucagaaacucuuagagcagggccuggugaccuguauuuuaagaagcucugcaggagauucugau

SEQ ID NO: 4100252 - RNA, 88 nt, Human
aucagaagaaaggcacuagauuugaaagucuucaggacuugcacauguaagauucaugggaaagcuuuagguguguguugauuuuggu

SEQ ID NO: 4100253 - RNA, 86 nt, Human
aucagaagcaaaugcaggauuaacagcuuuggagaccaccuuuuuaacccagagagcauagcuguauguuuuuaauuuguuaugau

SEQ ID NO: 4100254 - RNA, 57 nt, Human
aucagaaucuucugaacaguggccuaaaaauacacuacagauuuccuggauucugau

SEQ ID NO: 4100255 - RNA, 70 nt, Human
aucagacauuuacucacuaccuacuauguaucaaguauggugcuggggguucagaugaguaagacuugau

SEQ ID NO: 4100256 - RNA, 60 nt, Human
aucagaccauccagcguggaugcaauaacucccagcugcuucaugcuuuuuggcucuggu

SEQ ID NO: 4100257 - RNA, 128 nt, Human
aucagagaccauaagccuuccaagacagucuuugcaggagaaaggacguuucucuaaauagcagagccuguucuccuucugucuuuuuuuccugugcagagcuggcuccaaacaggcucuccucuggu

SEQ ID NO: 4100258 - RNA, 77 nt, Human
aucagauaagugaagcaaaguuuagcuggacagguauggcaaaaucagcuuauacaggacaaugcuucguauuugau

SEQ ID NO: 4100259 - RNA, 79 nt, Human
aucagauuugcuaaucaaguauuuuccaguggcacagagauuaacaaggccucugccacaauguugaggcaaaguagau

SEQ ID NO: 4100260 - RNA, 55 nt, Human
aucagcgccacgaggaagcagcugaggggcagcaccuuccaccagggccgcugau

SEQ ID NO: 4100261 - RNA, 67 nt, Human
aucagcugugucagcuggaguccugggaagaggaugacauugcugcuuccagcugggaacagcugau

SEQ ID NO: 4100262 - RNA, 63 nt, Human
aucaggaucacugggagucuuguuaaaacacagauuauuacgcccacucccagaaauuuugau

SEQ ID NO: 4100263 - RNA, 68 nt, Human
aucaggccaugggcaaaaacuugcuagcacccaggcugccagcagggcagugcccuggacucccuggu

SEQ ID NO: 4100264 - RNA, 89 nt, Human
aucaguauuuuguacuugcuucuggcagauugcguaauaaagugauuggcauucuagugaugcugcugucaugaguauagacauuugau

SEQ ID NO: 4100265 - RNA, 84 nt, Human
aucagucaggagcucucugaguggcuguacuuucugcuuguauaaaaagggaagaugcccaacccagcuuugcuuccuguuggu

SEQ ID NO: 4100266 - RNA, 90 nt, Human
aucagucuuuuaacuuuggaauuuaguaaaauaaugcaguaacacauaauuguguaauuaguaguaaauucaaaagaagcaagaauagau

SEQ ID NO: 4100267 - RNA, 62 nt, Human
aucaguuccauuuuacuugugagggaacugagguucagcacaguucaagaugguacucuggu

SEQ ID NO: 4100268 - RNA, 62 nt, Human
aucaguuugauaauaaggcuuggagagaugugauuuucaaagcuugaaccuaucaaacugau

SEQ ID NO: 4100269 - RNA, 90 nt, Human
aucauaguugguugcuagcugcuuuguuagcacaaucuauuccugagauuuuaugagaucuggcuuacgaagcacugguugauaaaugau

SEQ ID NO: 4100270 - RNA, 67 nt, Human
aucaucauucuuggauaaagcaauuggccuuuuacaucaagaccauggccugucuaacagaggugau

SEQ ID NO: 4100271 - RNA, 62 nt, Human
aucauccaagcguaguucuucuauaguccugggcaaaccccagggaauugugcuaaggugau

SEQ ID NO: 4100272 - RNA, 55 nt, Human
aucauccauggcugaucauaaaugcuucuccagagagugaauggucauggcuggu

SEQ ID NO: 4100273 - RNA, 57 nt, Human
aucaucuccuuuuguuuaguuguauuaggaagcagcaaauuaggucaaggagaugau

SEQ ID NO: 4100274 - RNA, 61 nt, Human
aucaugaauguuuuguauagaucacuggacaacagaacucagagacugaagcauuuaugau

SEQ ID NO: 4100275 - RNA, 68 nt, Human
aucauguuguauguaaucuuuugggacuuuuuuuuccacuucauguaagaauacguaucaacaauggu

SEQ ID NO: 4100276 - RNA, 72 nt, Human
aucauguuugacagcauauccucauauuuuauuuauaguguugaaauguguauuugcugccaaaugucugau

SEQ ID NO: 4100277 - RNA, 82 nt, Human
aucauuaaguauuggcuuuauguaaguccaaaggcagggagcugucuucacuuccuuauauaaugccugguacauaauaggu

SEQ ID NO: 4100278 - RNA, 82 nt, Human
aucauuaccuucaacaaacuguucacgaaugugucauauauuacuuuugugauguaaguggagguuuguagacauuagugau

SEQ ID NO: 4100279 - RNA, 62 nt, Human
aucauucucugcuugagcacucuucuguaaucucaugagguguccagggaagagacaaugau

SEQ ID NO: 4100280 - RNA, 64 nt, Human
aucauuggauuuguauggauggaggucacuggugaccuugaaaaagcuauuacaaugcaguggu

SEQ ID NO: 4100281 - RNA, 78 nt, Human
aucauuuuucugacccuuugcuuccucauuguuacaauaaggauaacaaggcugagcagggugagugaaauaaaugau

SEQ ID NO: 4100282 - RNA, 62 nt, Human
auccaaacauguaccacacuaaccaguuuccugaggugaaaagaagguacauuauuuugggu

SEQ ID NO: 4100283 - RNA, 68 nt, Human
auccaagauuaauucaggaucaggaaauaagguaauuugguucuagugacacugaauugagucaggau

SEQ ID NO: 4100284 - RNA, 58 nt, Human
auccaagccagggauggaaugauaggggaaagcccaucugcacaauuuugguugggau

SEQ ID NO: 4100285 - RNA, 60 nt, Human
auccacaccgucaagagcucccugcugacaaacagcauggcagugaggauggugcugggu

SEQ ID NO: 4100286 - RNA, 88 nt, Human
auccagcucauggcucagcgccuuucugugguccuucugcuaugaaaucagcagcgucccauggagagguugacccaucagccugggu

SEQ ID NO: 4100287 - RNA, 68 nt, Human
auccaugcucagggugugaggucgcugauaucuauuagggaguauguuccacauuuugagucugagau

SEQ ID NO: 4100288 - RNA, 90 nt, Human
auccauggugccuuguguccuggcuguggcaaccugcaugcugaacugaguccaacagcaggcaccaaggcuaugacauccacugugggu

SEQ ID NO: 4100289 - RNA, 80 nt, Human
auccauuuauguuuuucuuacuguauuuguuuuguuuauuuuggugccaaagcagacgcaguaaggguagauaauuggau

SEQ ID NO: 4100290 - RNA, 74 nt, Human
aucccagucagcccucuaccuuggcuauagaacccacaggaggguuuccccaguuuggagagagcacuuggggu

SEQ ID NO: 4100291 - RNA, 107 nt, Human
aucccauucucuucagacccuccucagggauuaaggucaaaggugggaggaagaaggcuuccauuggccuuuuauccuagagguucuaauggaggggaaaaggggau

SEQ ID NO: 4100292 - RNA, 74 nt, Human
auccccuggcuuacacccucuuuuugauagagcucauccuucaguagcuucuugagaaagggugccucggagau

SEQ ID NO: 4100293 - RNA, 77 nt, Human
auccccuggguaccuacuguauacuacugcuguucuagaguuuggagccacagagaaucagagauacagagguggau

SEQ ID NO: 4100294 - RNA, 64 nt, Human
aucccguugcagcaucacugcugagugucaggaugaucucaaucugugggugcuacaacucgau

SEQ ID NO: 4100295 - RNA, 58 nt, Human
aucccugcccucauggagcuuacagaauaaugaaccagggacucaaggaagcaggggu

SEQ ID NO: 4100296 - RNA, 65 nt, Human
aucccuggacggcgccuccccacggaugcgggaagcacaagugggaaaugaggcuguccaaggau

SEQ ID NO: 4100297 - RNA, 95 nt, Human
auccguaaaauguaugcauuuuucugcuaagacugcuaauuaauuuaaaaagagauuguuagaauaaaaggucagagaguaaacauauuacagau

SEQ ID NO: 4100298 - RNA, 92 nt, Human
auccuaguguuucaugggacacguuuuaaggaaaauuguuauaaaugagucagaauaauuuuucuuacgugguuccaacuggcucuggagau

SEQ ID NO: 4100299 - RNA, 82 nt, Human
auccuaguuauccaggaaaucauaaauugcuuugucauuaacaguaaucauaugauuuucucaaauggaaugugguaagggu

SEQ ID NO: 4100300 - RNA, 76 nt, Human
auccuauugggucucucgcccuccaccagagcccuucuccaaggggagagggugaguggagggagggauccaggau

SEQ ID NO: 4100301 - RNA, 73 nt, Human
auccuauuugcuuuuaagccacauaauuaaaugccuguuguuuacaguggccucaaagaaagagaaguagggu

SEQ ID NO: 4100302 - RNA, 70 nt, Human
auccucccaaauaggcucaagguagagggugcaccuccuaacaacuugcuuuuaucuuagggaaaaggau

SEQ ID NO: 4100303 - RNA, 63 nt, Human
auccucugaggcucagcuuucucuucuguaaaguggccugaugugaugcugcccucugagggu

SEQ ID NO: 4100304 - RNA, 78 nt, Human
auccuggacaacauggugaaaccccgucucuacuaaaaauacaaaaauuagcugggcauggcaccuguacuccuagau

SEQ ID NO: 4100305 - RNA, 80 nt, Human
auccuggguuugugaguuuaugaagaagcugaagagcuccaucacuucccagcuaaacauagcucuucagaucucagggu

SEQ ID NO: 4100306 - RNA, 64 nt, Human
auccugguagauugcuacauuugcauagaaauccugcuugugaagguaagguuugcuugaggau

SEQ ID NO: 4100307 - RNA, 69 nt, Human
auccuguucuguauaaacauauuuucaaguuugucaaaacuggaugugcacugucuguacugaacugau

SEQ ID NO: 4100308 - RNA, 55 nt, Human
auccuuacugaaugcguauuguauguuaaugacuguugagcaaucaguaaaggau

SEQ ID NO: 4100309 - RNA, 104 nt, Human
auccuuauccugcccugccccaugagcuacaggugauugggccuugggugggcgccggacacaaaggcagccaaucaucugccuuugguuugggcaggaggggu

SEQ ID NO: 4100310 - RNA, 59 nt, Human
auccuuccaggugucucuuaaggucuuagcgacugucaguagaaucaucuugaagugau

SEQ ID NO: 4100311 - RNA, 79 nt, Human
auccuuccugccagucauugcaacuguggcuuuuaagguuggcacauggggcgcugcauuggccuguucauaggaggau

SEQ ID NO: 4100312 - RNA, 86 nt, Human
auccuugccuauuaauucuugccaauucuccuuguacaaauucaagguggauuugccuggagaagugggaggaaguaauagaggau

SEQ ID NO: 4100313 - RNA, 82 nt, Human
aucgagugcaagacacuggcugugcuggaguugaggaaaguuuugcuggagaccugcuugcaccauaugucuggucacugau

SEQ ID NO: 4100314 - RNA, 68 nt, Human
aucguuaaucuugugugucaacuuggcuagguuacgguuuccaguuuggugaaacacaaguuuaagau

SEQ ID NO: 4100315 - RNA, 78 nt, Human
aucuaaaacauauacuguuggcuuuggugaugggagugauugguagcuaaagaggcagugaaacaaugauuaguagau

SEQ ID NO: 4100316 - RNA, 59 nt, Human
aucuaaaaugugguuaguugguaagauugcaguuaaagccuaacuaaccacuuucugau

SEQ ID NO: 4100317 - RNA, 92 nt, Human
aucuaaagucucacucucuggcagucugguggaaggccucaguuucucucuacaugagccucaccauauggcugccucaguguccucaggau

SEQ ID NO: 4100318 - RNA, 70 nt, Human
agugucuguuguucagaacucuccaggucaaaucacaggauuuguaaagagauucaggacagcagucacu

SEQ ID NO: 4100319 - RNA, 84 nt, Human
augcaucauugucacucagaguccauaguuuacaguaggguucacucuugguguuguacauucuguggauuuggacgaauguau

SEQ ID NO: 4100320 - RNA, 61 nt, Human
augcaucuuuagccucuccguggcaguucuguguuaaaucuguccaaagcuuuaggugcau

SEQ ID NO: 4100321 - RNA, 85 nt, Human
augcauguaauuuuguaugugcaugcauguauaugguguguggugugugauguaugguaugcaugugguauaugcuuauguguau

SEQ ID NO: 4100322 - RNA, 63 nt, Human
augcauguguaugucuuauucaaagaugugugcaacaguaccauuuuaaguauauaugugugu

SEQ ID NO: 4100323 - RNA, 65 nt, Human
augcauucugugagcugcuggcuuuucuaucagauggaaagcaagacaggaguuucagaaaguau

SEQ ID NO: 4100324 - RNA, 82 nt, Human
augcauugaacaacaagacucaguggguaguuauguugucauaaauguacugcuucacccuugagucuugguuacucagcau

SEQ ID NO: 4100325 - RNA, 56 nt, Human
augccaagcucuaucccugaccaaucagaucagcucugaggguggggcccaggcau

SEQ ID NO: 4100326 - RNA, 66 nt, Human
augccacaguuagcugugugcaccccccugcccaguacuuggcacagggcuagcugacagugguau

SEQ ID NO: 4100327 - RNA, 88 nt, Human
augccacaguuuauuucuccauuuaccuacacaugggcauuuggguuguuuuucauuuuggguaauggagaaauaaaucugcugacau

SEQ ID NO: 4100328 - RNA, 72 nt, Human
augccacauuuaucucucuccggugaaguucagaaugaaaauuuacauguggagggggcauaaaugagguau

SEQ ID NO: 4100329 - RNA, 55 nt, Human
augccagggucccuucagagauucugauuaaucagucuaggauguggccuggcau

SEQ ID NO: 4100330 - RNA, 109 nt, Human
augccauaauggauugaaagaggauuugggcauagaauuuagagacaaaagccccagguuugauucuaaguucugucaacuucuaauaaaaugaccucgaacauggcau

SEQ ID NO: 4100331 - RNA, 71 nt, Human
augccaucacacugccucgccugugcuauuaccaauggaggugcugagcaucaugaggcacuugguggcau

SEQ ID NO: 4100332 - RNA, 76 nt, Human
augccauuagugcagacagcugcaugcugcuuuuagaucuuaaaaaguuauaugugucugucgugcauaaauguau

SEQ ID NO: 4100333 - RNA, 79 nt, Human
augccccaaguuuuauaguccagucugaggaggcagugucugauuuagauaggacucauagauugguucaaucaggcau

SEQ ID NO: 4100334 - RNA, 97 nt, Human
augccccaggccacaugcccugcccauggcugaggcagaagcuuugucagaagugucugccuggccuggagggcacaggggccaucauccagggcau

SEQ ID NO: 4100335 - RNA, 102 nt, Human
auagaauguguauagauguagauuauguguaguauguauucuauaccuacuuaugaaugguauguugucuacaucuauacugaucuacauucauaucucuau

SEQ ID NO: 4100336 - RNA, 89 nt, Human
auagaauuaaaacaugacuuuucucuuccagaguccuggggcugucuaaggaacuauggugagauagaguguuauggguugaauuuugu

SEQ ID NO: 4100337 - RNA, 66 nt, Human
auagaauuugagaagaugugagagugaaguaauauagacagcuuuguacauuuucucagaguuuau

SEQ ID NO: 4100338 - RNA, 59 nt, Human
auagacauauggcuuuguuucuggacucucaauccuauuccauuggucuauaugucuau

SEQ ID NO: 4100339 - RNA, 55 nt, Human
auagagaaucgcucuugucaguuacuacuuuugugacucuugagaaauucucugu

SEQ ID NO: 4100340 - RNA, 102 nt, Human
auagagccaaugaauguuugacuaaagguagcuaaugugucccuaagcccagcaacaaucugacaggaagcucacuccuggucaaacuacucuuggaaaugu

SEQ ID NO: 4100341 - RNA, 61 nt, Human
auagagcuaugaacuuggaauuuuggugucagaaggaccuagguucaaguucaggcucuau

SEQ ID NO: 4100342 - RNA, 59 nt, Human
auagaguccaggucuuccuauuccagguaguucucauucuaccugguaccuggcuuuau

SEQ ID NO: 4100343 - RNA, 64 nt, Human
auagauaauauugagcaggugagauuguucaucuuugaaaucacaugugcucaauuuuaauugu

SEQ ID NO: 4100344 - RNA, 58 nt, Human
auagauauauggguuuaguucuguacucucaagucagugccauugacccuaugucuau

SEQ ID NO: 4100345 - RNA, 80 nt, Human
auagauaugcugugaaaagcaggcuacuuucuauucugccucccuagaaaagaguacuuuucugcuuuuuaauuauuugu

SEQ ID NO: 4100346 - RNA, 76 nt, Human
auagauguggucaggcugggccuucccugccuugccuguccauggguuccgggaggcuggcucuggccacagcuau

SEQ ID NO: 4100347 - RNA, 65 nt, Human
auagauuucugucaccuucuaugcuaacaaacaucgcuuagcguaggguaaugauggguguuuau

SEQ ID NO: 4100348 - RNA, 57 nt, Human
auagcagggauuaaaguuuuucugggauaccuuagaaguucuuucuucucaugcugu

SEQ ID NO: 4100349 - RNA, 128 nt, Human
auagcauaucaucacuguugccaguuuucaccagaugauuuuucuucagcucaguaauuaguucucuguguuuguagaaaaugguuuggggaugguggaaucagagagaugaccuuugucuguguugu

SEQ ID NO: 4100350 - RNA, 82 nt, Human
auagcccaacaaccucagguacacucccuugugcugaucaaugaucagccauugucagugacacuggccauuguuaaccugu

SEQ ID NO: 4100351 - RNA, 58 nt, Human
auagcuaacuuuuacuuaccaucugaggcuugauucauccucuuugaggguuggcuau

SEQ ID NO: 4100352 - RNA, 99 nt, Human
auagcucuuuacaaauauuagcauauggcagaccaauuagaagcaaaaaaguccguauuggugguugugauguggcuguuauagaaguauuugugcugu

SEQ ID NO: 4100353 - RNA, 130 nt, Human
auagcuguaaaguaaugaaauggauucuucuguguagcuuuaugaaaaucuuuguauauuuacuguauauuauguagauaaauuagaaaguuuacuuguagcacaaaggcauuuuuacauuuacaacuuu

SEQ ID NO: 4100354 - RNA, 81 nt, Human
auagcuguaauuaauguauagagugccuaugacaaacacuuuacaaauaucuucauggaaacucugaaaauuaauaguuau

SEQ ID NO: 4100355 - RNA, 70 nt, Human
auagcuguuagauuggggucgaaaaccaccugucuucuccuacaggugagcugcaaauucuaacaauuau

SEQ ID NO: 4100356 - RNA, 60 nt, Human
auagcuuacaggugauaucagcaaggcacacauaugugaguugaauuuauuuguaacuau

SEQ ID NO: 4100357 - RNA, 72 nt, Human
auaggauuaggcugugggacaguuaggagacugcuuuuucggcauuucucccaacuucccuggccuuccugu

SEQ ID NO: 4100358 - RNA, 69 nt, Human
auaggcuguugucuucugguaggaccagagucagguaugaugcucaacugcaggaaguauggugccuau

SEQ ID NO: 4100359 - RNA, 76 nt, Human
auaggcuuugcugaagaauauuuacuggaggauaaagcaaugauuccuuaagcuaguguuucucagaagggccuau

SEQ ID NO: 4100360 - RNA, 130 nt, Human
auagggagaaaaaacuaacucugguccacuuuacauuuaagagaaauauuuaguucacaauccgugaaugaauaacaauccucuggagcuugaagaacgaucuagaugaauuacacuucuucccaguuau

SEQ ID NO: 4100361 - RNA, 77 nt, Human
auagggcuggaaugaauuuggcuuccuccuggagcaccacuuuuggggagaauaaaucagauuuuaacuggcccugu

SEQ ID NO: 4100362 - RNA, 81 nt, Human
auaggguuggugguaagaauaggggcuuuggagccaggcaaaugugauuuguauuccagcucugauucucacuagcucugu

SEQ ID NO: 4100363 - RNA, 129 nt, Human
auaggguuucaccauguuggccaggcuggucucgaacuccugaccuugugauccacccgccuuggccucccaaagugcuaggauuacaagcgugagccaccaugccuggccaagauguuucauuuuugu

SEQ ID NO: 4100364 - RNA, 77 nt, Human
auagguuaauaauuuuggguagauaacaaagaucuuuggccaacuugaagauaauuauuuacuucaaaguuacuuau

SEQ ID NO: 4100365 - RNA, 105 nt, Human
auaguaaaccuggauucugggaaggagguuaucccaguggacuccguaauagauggagaagcauuaaagggggugauuauguccacuggaauuucaguauacugu

SEQ ID NO: 4100366 - RNA, 66 nt, Human
auaguaaauaagauacccuaaguccugguaugaaguaccaggacuucauuagguucuuuguauuau

SEQ ID NO: 4100367 - RNA, 58 nt, Human
auaguaccuaugcauaaggcugguaugaagauucaauaaaucagugcaugagugcugu

SEQ ID NO: 4100368 - RNA, 79 nt, Human
auaguaggucauuaguaguagcaguguguguauuuauggcccuucauuacuauaugucugcuacuguauaaaucuuugu

SEQ ID NO: 4100369 - RNA, 85 nt, Human
auaguaucuacccacugaacacaauauaaaggaagguuuaauaccucuaauaaauguuaaguuuagcaggcuaggccgcuacugu

SEQ ID NO: 4100370 - RNA, 59 nt, Human
auaguauugugucaaggauuuuucuguguaccuuacacagaucaucucgaaacaacuau

SEQ ID NO: 4100371 - RNA, 57 nt, Human
auagucagcuuugaguaaugugaaaagauaaaauccacagggcaugcagcuggcugu

SEQ ID NO: 4100372 - RNA, 77 nt, Human
auagucuuuagcuuuugcccagccaugguucucacuaucccuuuccuagaauuuugcaguaagggcuaauggacuau

SEQ ID NO: 4100373 - RNA, 55 nt, Human
auagugucaaagugcuauguguauuuuuccaguacauuaaguaccagggcacugu

SEQ ID NO: 4100374 - RNA, 74 nt, Human
auaguuacagauuucacuuuucuuccucuacagaaauuccgaggaguuaaaguguaaggaauuuaaguaauugu

SEQ ID NO: 4100375 - RNA, 64 nt, Human
auaguuaccuaacuuaaaacauguggugggguauuuauuaaccaauauaaguauagguaaguau

SEQ ID NO: 4100376 - RNA, 83 nt, Human
auaguuuucaguguacagauaucucacguucuugauuaaauuuauuuuuaaggauuuguuucuuuuugauauugugaaauuau

SEQ ID NO: 4100377 - RNA, 96 nt, Human
auaguuuugaagagugcuacaaaauaacguggcuguugaaagaaaugcuuuuugcccaauuucuuucuggccacgguuuugagaaaagaaaacuau

SEQ ID NO: 4100378 - RNA, 61 nt, Human
auaguuuugcugucagguccuaaagaucaaaggucaacauaguauauugcaguaaggcuau

SEQ ID NO: 4100379 - RNA, 67 nt, Human
auauaaauauuugagggcaauaggguggacuauagugguuugaauucuggcucucaaaaacauaugu

SEQ ID NO: 4100380 - RNA, 102 nt, Human
auauaaauguuuucuaauguuaauuucuuuagaaguggaauaaaagcauuauugagacuuggcacugaggaacuaguuaauagaaugaaaauaauguuauau

SEQ ID NO: 4100381 - RNA, 97 nt, Human
auauaacauuuguguauguguguaugcuuguguguauaugugucugauuauauaugugcauaugcauacacacauguguguauauagauguuuauau

SEQ ID NO: 4100382 - RNA, 87 nt, Human
auauaauaugaguauuuuacaucguguaauugacuacuugaucgauucauaaauuauauuguggugugaaugugucugauaauauau

SEQ ID NO: 4100383 - RNA, 67 nt, Human
auauaaugcugcuuggguuaucagaaaguauugaauacuucagauaagucaaguuaguauuuaguau

SEQ ID NO: 4100384 - RNA, 119 nt, Human
auauaauuuauaguuaucagaucaggguaauucgcacauccaccaucucauauguuuaucauuucuuuauguugagaaugugcaauauccuuccagcuauuugaaacuauauauuguau

SEQ ID NO: 4100385 - RNA, 86 nt, Human
auauacagagagguccaguuuuaugaaugcuuauuagauggaauuuuauaagucuaaugcaguaucagaauagcaaauauguguau

SEQ ID NO: 4100386 - RNA, 77 nt, Human
auauaccucacacaucagaaauaugaaugagaugccaauacaucaguuacuugugaaugaugucucugaugguaugu

SEQ ID NO: 4100387 - RNA, 56 nt, Human
auauagagagagagagagagacuaggcaagaugagggcugucucuccuuucugugu

SEQ ID NO: 4100388 - RNA, 58 nt, Human
auauaggcuaacaacuauugaggauuggggcuuuuuuuaguccucuguugguuuaugu

SEQ ID NO: 4100389 - RNA, 74 nt, Human
auauaggcugauggcuuccugagucuuucuacuugauaguguucucuauccucaggagcuuccucagcccauau

SEQ ID NO: 4100390 - RNA, 62 nt, Human
auauaggucuucuuuaauuucucuuagcaaaguuugcagauuuuaguguagaggacuuguau

SEQ ID NO: 4100391 - RNA, 101 nt, Human
auauauaaauuuguucagaauuccuauuauguaaagguuauugcaggguacagugugcuguagugauaucugcugauuuuucucugugauaaauuauauau

SEQ ID NO: 4100392 - RNA, 89 nt, Human
auggcauugauaagaggaauuacagaagaggcaaacuuugcaccugucuuggcuucuguauuuccuguugagaguaaagaaaaugcuau

SEQ ID NO: 4100393 - RNA, 61 nt, Human
auaucaguauggauucauggauuccucuuguauucaaugaguuauaaucugcuacugauau

SEQ ID NO: 4100394 - RNA, 95 nt, Human
auaucauaaacuuuagaaaagaaauuccacuuccgaggcuaaaguuugaguaauuccucaguguagcuuuggagugggaggccuuucugugaugu

SEQ ID NO: 4100395 - RNA, 55 nt, Human
auauccaguucaaugaaagaaaugauccuauuguguuuuucauugagugugauau

SEQ ID NO: 4100396 - RNA, 87 nt, Human
auauccuagaacaugauggcuguuauuuugggcaguuuauuuguaacguuccauguccaagaaugacucacucuuauauuagguugu

SEQ ID NO: 4100397 - RNA, 58 nt, Human
auauccuauacacuaaccccaggaguuuaggucuuauucccagggucuuaugggaugu

SEQ ID NO: 4100398 - RNA, 106 nt, Human
auaucuccaagagcccuauucccugcucuuauagcuguuuccaagaagacucuggcuuaaugugguagcugcauagggguaaggaucuaggcugcuuuggugaugu

SEQ ID NO: 4100399 - RNA, 65 nt, Human
auaucucuauuaucucccccauaagacauauuuacagccguauuaaaagggagaugaagggauau

SEQ ID NO: 4100400 - RNA, 64 nt, Human
auaucugaggcagcuugccacucuaaauaggcccucccuaucuacugccagcagucucaggugu

SEQ ID NO: 4100401 - RNA, 112 nt, Human
auaucuuccucagagaaaugucuauucaagucauuugcucauauuuuauuuggguugucguuuuguuguugagucguagacauucuuuggauauuaaaccuuuggcagauau

SEQ ID NO: 4100402 - RNA, 72 nt, Human
auaugaauacgcggucauacacaucacaauuaaacuuuuaaaauaccuauguagaugauuguguguaaaugu

SEQ ID NO: 4100403 - RNA, 88 nt, Human
auaugaauggaaucauacaguggguggccucuugagucaggcuucuuagcacagugcauuugagagucauccauuuccuuguuuguau

SEQ ID NO: 4100404 - RNA, 91 nt, Human
auaugacuagaaauuucuguggaacauguccauauacauuuuaauagaaauguauauagaaaugucuaaagauaauggccuaauagcauau

SEQ ID NO: 4100405 - RNA, 62 nt, Human
auaugcaacccgcacuuaaggaauggaaaguuaugcuguaccuccuugaaagugggguauau

SEQ ID NO: 4100406 - RNA, 62 nt, Human
auaugcacuauggaaguagcucauguaaauaaaaacugaauaaucauguccauaguguauau

SEQ ID NO: 4100407 - RNA, 70 nt, Human
auaugcgguguuugguuuuuuguucuugugauaguuuacugagaaugaugauuuccaauuucauccaugu

SEQ ID NO: 4100408 - RNA, 55 nt, Human
auauggaaugguaaucuacaaucacacugugugguagguauuauuaucuccauau

SEQ ID NO: 4100409 - RNA, 72 nt, Human
auauggacaucucaagcuaguguuuauaguaaggauauauccuacuucauuauucuaguuuugagcuuauau

SEQ ID NO: 4100410 - RNA, 72 nt, Human
auauggucuccauucucauaaauccugagaccuauuaauaguagcauguccaggauacugagauuuccauau

SEQ ID NO: 4100411 - RNA, 91 nt, Human
auauggugguaacaaacacaaugccuacuaguacuauuuuguggcacugcuucaauuugugcuaaggcaccgguagucuuauccacuguau

SEQ ID NO: 4100412 - RNA, 129 nt, Human
auaugguuuuauucuggacacaguuuuauaaauuuauugaagaacaucugugaucucuuugggaguauuuaugauucccaacguuaugcaugauucuuuuauuaugaaugcuugucuagguuuccaugu

SEQ ID NO: 4100413 - RNA, 61 nt, Human
auauguacagggauagaacuugaccagauuagaaacuggugaauuuuugaccuguauuuau

SEQ ID NO: 4100414 - RNA, 67 nt, Human
auauguguaugaucagugugcuccagcuguucuuaaugggcagcuuugcaggcuggucagugccugu

SEQ ID NO: 4100415 - RNA, 75 nt, Human
auauguuaacaacacugugagugcugccaaaacucugagaguucuuucaugcggauuauggucuuguuuacauau

SEQ ID NO: 4100416 - RNA, 81 nt, Human
auauguucacagucuaagauucaggugaaaaggcaggaugccaaaucuuguguacuugcugaucuuaucuguguagaauau

SEQ ID NO: 4100417 - RNA, 106 nt, Human
auauguugacagcaguucccucccuucacaggcagagccuucacugugcaguauuuucaggcccugcauuguacugaggggagacaggacugugagguuaauaugu

SEQ ID NO: 4100418 - RNA, 69 nt, Human
auauuacaauaauguuaugaggcugacucaucaaaccuugguaucaggcuuauuacguuauugucauau

SEQ ID NO: 4100419 - RNA, 126 nt, Human
auauuacucaaauuuauucauggucacacagguaggaauugggagucagguucaaauccaagccugguuugcuucauaagcuugccucuuaaucaccucauguguacuucauuaaagagauaaugu

SEQ ID NO: 4100420 - RNA, 67 nt, Human
auauuagggauaauggucucaaaggcagucguuuuaucugcuuuguucacugauguaucccaagugu

SEQ ID NO: 4100421 - RNA, 85 nt, Human
auauuagguuggugcaaggguaauugcgguuuugccauuaaaaauauuggcaaaaaccacaauuacuuuugcacuaaccuaauau

SEQ ID NO: 4100422 - RNA, 122 nt, Human
auauuaugcuucauuuuacaucaguaggaucauauaagcuccagcuaaauucaaaaucuuagcuccuuucuagaguuugcugcaguauauauuucuugggaucuaaacuugaaguguaguau

SEQ ID NO: 4100423 - RNA, 64 nt, Human
auauucaagucaauagguuaguagguaccaaacacuguaucugacaaccuauugacuugaauau

SEQ ID NO: 4100424 - RNA, 59 nt, Human
auauucauaaaaucaguuggaaauucccuuuagcaauguccagcugugauuaugaaugu

SEQ ID NO: 4100425 - RNA, 55 nt, Human
auauuccaaugucaguuauaucaguaaccugaucugaaaaugauguugagaauau

SEQ ID NO: 4100426 - RNA, 69 nt, Human
auauuccuugguagggacaacucugaggcaugugcuacauugucacccagagguccccacugggaauau

SEQ ID NO: 4100427 - RNA, 83 nt, Human
auauucuaugaagugaguuaugguugcuuaaagggccacauccuaggagucagaggcuauaacucagguuuguuagugaaugu

SEQ ID NO: 4100428 - RNA, 60 nt, Human
auauucucugugucugcuuucccacuagagcugugagcuucuuggagacauagacaaugu

SEQ ID NO: 4100429 - RNA, 124 nt, Human
auauucuuaaagaacucaggaacaucuuaagagauacagauguugaauguuauaucuccucuucccucugguauauuuuuggcauguaucuucuguuguuucuuuaaaaguugcuuuugaauau

SEQ ID NO: 4100430 - RNA, 86 nt, Human
auauugaacacauuuuacaguugucuggcuauauuauauaaaugugguaagcaacuuuuguagagauaguacgugugugauaaugu

SEQ ID NO: 4100431 - RNA, 99 nt, Human
auauugaauguuucacuguuccgggaacuauuuuaagcacuugauauggauuaucucauuaaugcuuacaguguccugcgagcuagaaacaauuauuau

SEQ ID NO: 4100432 - RNA, 66 nt, Human
auauugcauggcuuugcugguuaaacaccugauaaucaguuugaaacugcagggcuauaaaaauau

SEQ ID NO: 4100433 - RNA, 67 nt, Human
auauugcucauacaucguuuauuuuaguucaacuguaguuuggauuaguuuaacaauguggcaguau

SEQ ID NO: 4100434 - RNA, 69 nt, Human
auauuuaaacaggguaccaauauaaguuuuucuucugaauggcuuacugauggguaccuugcuagauau

SEQ ID NO: 4100435 - RNA, 69 nt, Human
auauuucaugggguuccauacuaaguagcaauggauuuuccagaguaacaugaaguccccaucugaugu

SEQ ID NO: 4100436 - RNA, 56 nt, Human
auauuucuuaucuugauuuucuccuggauaagauccuggagcuuggugagaagugu

SEQ ID NO: 4100437 - RNA, 67 nt, Human
auauuuuggcauuaagaauaucauuaaaagccaacuguuuuugagaaaacuuuuaauguugggaugu

SEQ ID NO: 4100438 - RNA, 67 nt, Human
auauuuuuugaaauaaggaagcucgaaaucagcuggugguuaucuuuugcuuuguuuuaaaaaaugu

SEQ ID NO: 4100439 - RNA, 129 nt, Human
aucaaaauugucuguagagcuuuuuaaaaauaacuaugcccgguccccaucccagaucuguggauuuacagucuccagaaauggggcuggggagugugcacuuuauaaagcuccauagaauauuuugau

SEQ ID NO: 4100440 - RNA, 58 nt, Human
aucaacaugugagagcaccaguuucacccugacucugcuaguguuauuauuuguugau

SEQ ID NO: 4100441 - RNA, 86 nt, Human
aucaagaaaaaggcacaaaagcagggugaccauacauucaguuugacuggaauagucuuggauugauccugcuguccuggcuugau

SEQ ID NO: 4100442 - RNA, 77 nt, Human
aucaagaugguguugcagaaaaggcaccucugggaccacagcuugggacaugcauacugcugccaacgccacuugau

SEQ ID NO: 4100443 - RNA, 96 nt, Human
aucaagggccaucucucuucaaaugcaggagagcauguuuaagagccugggcucuugauucauguucccugcauuggaaucacgacuccccuaggu

SEQ ID NO: 4100444 - RNA, 73 nt, Human
aucaaggugucuguguuuauaauuguuaacucuugacuuuguuugaaaugauauagcagacauagccuaugau

SEQ ID NO: 4100445 - RNA, 58 nt, Human
aucaaguuggauuuuguauggcuagauacagauggugccauacagauguauccaugau

SEQ ID NO: 4100446 - RNA, 59 nt, Human
aucaauaguauuuauugaacaccugcuaugcuacaggcacucugcugaauacugaugau

SEQ ID NO: 4100447 - RNA, 90 nt, Human
aucacaaacuucauaacaguggcuucagcaaguaaaauguucaauguauguggcauaaacugccuaaagcucuguugucaaccuuguggu

SEQ ID NO: 4100448 - RNA, 76 nt, Human
aucacagaagucccuuauuuugaccugugaauuguucauccuuuaaaaacuccaggaaacuuaggggaaaugugau

SEQ ID NO: 4100449 - RNA, 75 nt, Human
aucaccaguacuuuuggaguagcaaguauuuuauugucauuuguaauaaaggcaacaccaggguaugaagguggu

SEQ ID NO: 4100450 - RNA, 59 nt, Human
aucaccaucgcacugcacacugucauccuucauuaacggcuaaagcagaugggggugau

SEQ ID NO: 4100451 - RNA, 113 nt, Human
aucaccuggaggauuguuagaacagauugcugggcuucaccuccagaguuuguggugcauggauuuggaggagggccagaaaagucugcauuucucacagccuuccaggugau

SEQ ID NO: 4100452 - RNA, 65 nt, Human
aucaccuugggcuuccuguuacaugaauuaccagaaccacagaagcugagagcccagcagguggu

SEQ ID NO: 4100453 - RNA, 67 nt, Human
aucacuccaagugcugaggugacaaggggagcguccuguuggcacuaucucauguuuuggcuguggu

SEQ ID NO: 4100454 - RNA, 79 nt, Human
aucacugaaacacauaugaacaguugaugaggucagauacuuuaagacaacaccaauugaugaauauggugauauugau

SEQ ID NO: 4100455 - RNA, 66 nt, Human
aucacuggggagcacugacauguuccacaaaucuacauuggaugugcugguuucucucuccagggu

SEQ ID NO: 4100456 - RNA, 61 nt, Human
aucacuguggaaaacuguauggcaguuccucaaaaacugaaacauacaauuaccauaggau

SEQ ID NO: 4100457 - RNA, 85 nt, Human
aucacuucuguuucccguucacuugcucugcaucugcucugguugcugccaagggccaucugagggcacugugacgagauuugau

SEQ ID NO: 4100458 - RNA, 77 nt, Human
aucagaaauucuggggacaugaccgucaucuguuuuagcaaguauacccagugauucucauguuccugaaguuugau

SEQ ID NO: 4100459 - RNA, 128 nt, Human
aucagaauuccuuggaggguuuuuuaaaacacagauuucuggucuucacccuuagcaugucugauucaggagauuugggauggagccugauaauuuguauuucuaacaagcucccauguagugaugau

SEQ ID NO: 4100460 - RNA, 120 nt, Human
caaauccagucagauauuaccuccaggugcaauauuuggcacugagaugagcauuaaaguuaaauauuuauuggugccuuaauauugucagagacuuguuccaacacugacccagguuug

SEQ ID NO: 4100461 - RNA, 56 nt, Human
caaauccauagaauguauaacgcuaaaagugcauccuaaugcaagcuauggauuug

SEQ ID NO: 4100462 - RNA, 129 nt, Human
caaaucuuuaagccacuauaauaggugagaguuuuuacaaaagucaagaaacacagaugaugaccccugcuguggcuuugugucuauuguauccaaaaagcuuuuauaccauauuauguguuuuaugug

SEQ ID NO: 4100463 - RNA, 67 nt, Human
aucagguuauccuccuugaaacaaaguaacuuuuaauaaagugggcugguggcagggagaaccugau

SEQ ID NO: 4100464 - RNA, 101 nt, Human
aucaguacuucauuccuuuuuauggcugaauaauguucucuuguaugggauacuuuauacuauuuaucaagggaggguuuucaacagaggaguggccugau

SEQ ID NO: 4100465 - RNA, 63 nt, Human
aucagugaccuguucuuuggcauccuucugaccacuagauucaucagauuuugggucacugau

SEQ ID NO: 4100466 - RNA, 82 nt, Human
aucagugcuuuucucauagucaugccucuuauaguuuuauaauuuuuuaaaaggcaauacuagaugaguuuaaggcgcuggu

SEQ ID NO: 4100467 - RNA, 59 nt, Human
aucaguggaaggaaagcaggaagggucucuucuuucaaauacauucuuugccacuugau

SEQ ID NO: 4100468 - RNA, 62 nt, Human
aucaguuaacugucucaggccaugggcgcuauugacauugauaguuggcuuugagaacuggu

SEQ ID NO: 4100469 - RNA, 77 nt, Human
aucaguuuaguuuucuaguguuuaggaaagcuuaaugaaaaauauaagacaacagacaacuagaaaacuagacagau

SEQ ID NO: 4100470 - RNA, 73 nt, Human
aucaguuucucucaagguccuuggcaugggaucucaaaagagucuacccauaaucuggcuuugagagagugau

SEQ ID NO: 4100471 - RNA, 102 nt, Human
aucauaaagcaaaguugcagggcagugcuaaguagcuggcccaguaggcccuguccuacuugagccagcuccuugccugucaguaaugaccagcuuagugau

SEQ ID NO: 4100472 - RNA, 110 nt, Human
aucauaaggugauacuuccaaagcaagugcccaaaauucuucaguugguucccauuucuuuuaaggaaaaacucaaacauuuuggcauaccuuacaaggugucuuaugau

SEQ ID NO: 4100473 - RNA, 59 nt, Human
aucaucuccauugcuuuugacaaagucuaauacaccuggucaaagcaaagggagaugau

SEQ ID NO: 4100474 - RNA, 64 nt, Human
aucaugggcguggccucuauccaaacauuuaaaagacauauuugcauagcagcuauacccagau

SEQ ID NO: 4100475 - RNA, 69 nt, Human
aucauguagcacuggaacaugguaagcacucauuaaaccugagccauuccaugugcuacacauaaugau

SEQ ID NO: 4100476 - RNA, 67 nt, Human
aucauguccuaacuuugucaucuucccuuucugaaucagaacauggauugucaaagguaagacugau

SEQ ID NO: 4100477 - RNA, 75 nt, Human
aucauuacagaguagauuuuugaauguaaguugguuauauuaccaacuugguuguuggcaauuugcuguacugau

SEQ ID NO: 4100478 - RNA, 57 nt, Human
aucauugaauuugguucaauaugcagaaauuuguguaaaugagccuagauucaagau

SEQ ID NO: 4100479 - RNA, 78 nt, Human
aucauuugucuguucguucagucaacaaauguuuauuaaacaucuauuaugugcugagcaccaaaauaggcugaugau

SEQ ID NO: 4100480 - RNA, 88 nt, Human
aucauuuuucccaaauguuuugaguguaagaaugcuguuuccuuuucucucaggucuacauaucuuuacucaucaucucaaaggugau

SEQ ID NO: 4100481 - RNA, 97 nt, Human
auccaaaccaaucucguguguauuugcuggcugagaucuguuuuccucauguucuguagaagggaaggaguaacauggucuccuuuagaugcuggau

SEQ ID NO: 4100482 - RNA, 83 nt, Human
auccaaagauccggcggccaaggucagccgcucucggagagccgagauucuuggugcuggcugggcugcuggagacagcgggu

SEQ ID NO: 4100483 - RNA, 58 nt, Human
auccaaagauggaaagaacuuuacugagguaaaguuuauuuauguucaucauuuggau

SEQ ID NO: 4100484 - RNA, 85 nt, Human
auccaaagcauguuaagguagcucacuaaauauguauuuacagauaaugguauguaaaagugaucuauuuaauucuuuuuugggu

SEQ ID NO: 4100485 - RNA, 65 nt, Human
auccaacauuccuauuaugucccuaguguuaugccaggcacagagauuacagaggagauugagau

SEQ ID NO: 4100486 - RNA, 82 nt, Human
auccaaccuugcucagcaaugagaacuggcauuucugggagcccaaauucuccagagucagugacuuuugcugagaguggau

SEQ ID NO: 4100487 - RNA, 65 nt, Human
auccacucuugccugcaaugaggaccaaggcaaaaagaguuggcugaaucugcagcaggaaggau

SEQ ID NO: 4100488 - RNA, 62 nt, Human
auccagaagaacuuccuaauauauuuucacaugcagguuguauguggagggaagggauggau

SEQ ID NO: 4100489 - RNA, 70 nt, Human
auccagccccgggauguucuucaacaacauggcuucuuugccacaucugagucacuuccugggccuggau

SEQ ID NO: 4100490 - RNA, 86 nt, Human
auccagucccuaccauaaagcaggcaaaugagaaacuacaaauccuguggagcucuuuucaaaccuguuuauggagaauauuggau

SEQ ID NO: 4100491 - RNA, 58 nt, Human
auccauggaggacaagagcaauaaaguaucaucuuugugucucucugcauccagggau

SEQ ID NO: 4100492 - RNA, 64 nt, Human
auccauggcuuagaaguuccagcccuccaugaaccguuggguugagguucucuggguccugggu

SEQ ID NO: 4100493 - RNA, 67 nt, Human
auccauguuguggcaucuaucaguacucacuuauuuucauuacugaauacuauuucauaauguggau

SEQ ID NO: 4100494 - RNA, 66 nt, Human
auccauugaaccuagagaugcuuaugaacaccacugugugccaggcacuguacuagguacagggau

SEQ ID NO: 4100495 - RNA, 79 nt, Human
aucccaaagagcaagaggagaauggcugauuccaaugcaaucuacaagagguucuccucucuacucagcucuucagggu

SEQ ID NO: 4100496 - RNA, 79 nt, Human
aucccaaugccaggaaguggggcagaggccggccuggugcccagagcccagggccuacgucccaccacccugccggggu

SEQ ID NO: 4100497 - RNA, 56 nt, Human
aucccagacacaggugugccucaauauaaaagcagaagguccugguucucugggau

SEQ ID NO: 4100498 - RNA, 107 nt, Human
auccccagcuuugucagcccaguccagcucucagcgggagacucacuuccugggaugugugagauccagcugcagggcugugaugcugucaggcauugauaggggau

SEQ ID NO: 4100499 - RNA, 55 nt, Human
aucccccacuagaugucacuaguugcccaggacaguggucagaacgugggagggu

SEQ ID NO: 4100500 - RNA, 90 nt, Human
aucccccuguguggaccuauauuucacagaaagaaguggaauuuccucuuccugugaaauauagguccauacaggagcaucaugggggau

SEQ ID NO: 4100501 - RNA, 86 nt, Human
auccccugggagcuuguuggagcagcucaggcucugucccagaccuauucaagccaaaucuggauuuagcaagacucucgagggau

SEQ ID NO: 4100502 - RNA, 77 nt, Human
aucccucagcuuuggagggcaagagcuguuccuagacuaugggcaaggggcaggggugcauccagagaagcaggggu

SEQ ID NO: 4100503 - RNA, 69 nt, Human
aucccuccgauuccaaaccucccuaaaaugauuaaauacauuuuaauggcagggcagaauauuagggau

SEQ ID NO: 4100504 - RNA, 64 nt, Human
aucccucuagccucuugucuagaaguuaaguccuggcugcagcauucugguaaaaggcagggau

SEQ ID NO: 4100505 - RNA, 65 nt, Human
aucccuggaaccugugaauauguucuuuauguggcaaaaggaacuuugcagaggugauuaaggau

SEQ ID NO: 4100506 - RNA, 86 nt, Human
aucccugugacccucucaggaucuaauacaugguaacuuugugacccucuugccaagagguccaggugggaaggcaacauggggau

SEQ ID NO: 4100507 - RNA, 58 nt, Human
aucccuugugcucagccucuugggccacagagcuggagggagaggcuggacaggggau

SEQ ID NO: 4100508 - RNA, 65 nt, Human
auccgagugcucucaugcugacuauuaaagguuucaauuuaaaauguuugcaagagaccagggau

SEQ ID NO: 4100509 - RNA, 60 nt, Human
auccuagcaggugcacuccuaucuuuaaaaaagaauaaaaugcacagcugugaauaggau

SEQ ID NO: 4100510 - RNA, 89 nt, Human
auccucagagagcaggaugaucccuggacuugaguaaguaccucaggaccuaccuaagcucagggaaaggccauuguacucagagugau

SEQ ID NO: 4100511 - RNA, 80 nt, Human
auccugaccuaaagaauuuucauagagcugacugauggucaguuagcuauuaaauagaaaauuuuaugcauuguuaagau

SEQ ID NO: 4100512 - RNA, 116 nt, Human
auccugagugaaaugggagcuggggcagggaaaggcugaugcugugggucggucacuugucacuaauaagcccauuuuccugccuugccuugccccaucuuuuaguuuuucagggu

SEQ ID NO: 4100513 - RNA, 61 nt, Human
auccuggcacauaguaaguacuagauauauuuugacuguugcuuuuauuauuugccaugau

SEQ ID NO: 4100514 - RNA, 89 nt, Human
auccugggcugcccagcccuguguguccuugaccucaguggcugcaauagccucuucaccucgggcacacugcuggcucagccagagau

SEQ ID NO: 4100515 - RNA, 70 nt, Human
auccuggucgcuguguagguucagcuaggucgcuugguaucucugagccuguuuacugacaaaaggggau

SEQ ID NO: 4100516 - RNA, 66 nt, Human
auccugguucaaauauuuggggcacucagaauuggaggaauaaauugaaguguguugagccaggau

SEQ ID NO: 4100517 - RNA, 58 nt, Human
auccugugugccaccugccugcugaaaacccuuuguggcucugugucacauacaggau

SEQ ID NO: 4100518 - RNA, 57 nt, Human
auggcauuucuugacagggcauguuccuaaggauaugcagagaauaacaaaugccau

SEQ ID NO: 4100519 - RNA, 78 nt, Human
auggccagccugguacuuggcacucaggagauacucacuaaauuuaaauguaaacuccauaaguaaccagaugguuau

SEQ ID NO: 4100520 - RNA, 58 nt, Human
auggccuccuucagcauuacaaugcagucuccucaauugcuuugccaaaagaggccau

SEQ ID NO: 4100521 - RNA, 81 nt, Human
auggccuucauccuaagcacaaugcuuugaguaugcaguauuuguuuauuaagugcuuuucguuuugcuuuaggggcucau

SEQ ID NO: 4100522 - RNA, 130 nt, Human
auggcucucaugacccaaccuuagauccuggcucuaauaggcucagacauuuguagaaagugccccugaugacacugguauucaagcgagcagaugucuagggcucauuuagccucuaaaauugugaccu

SEQ ID NO: 4100523 - RNA, 86 nt, Human
auggcugauuaugacagacagcuccuuuuggugcauaucagagaugaauaugcaaagagggcuguagcauuuacauauuuacccau

SEQ ID NO: 4100524 - RNA, 68 nt, Human
auggcugcugcuccugccuggcucccagggacugcgcucuggcaggcagagagcggccuuuagcucau

SEQ ID NO: 4100525 - RNA, 72 nt, Human
auggcugcuucucugauggaguccaaugccuucucuagguuuauccugaacuuccaguagggaggugguuau

SEQ ID NO: 4100526 - RNA, 129 nt, Human
auggcuuaucucugcagagcacuuagcucagcacccagugauuagggcuaccugggguuggccauuaggcugagaugcugugguccacagggaguccgugcugaccuuguccugcacauucuaauucau

SEQ ID NO: 4100527 - RNA, 55 nt, Human
auggcuucugccuugauuguucucucucuaggagcacucaugcugcagaagucau

SEQ ID NO: 4100528 - RNA, 78 nt, Human
auggcuugagagaauuaacuggcaguuagugcuguguucuauagcauucaguuuuuccuguuaaaccuuaaaagccau

SEQ ID NO: 4100529 - RNA, 65 nt, Human
auggcuugcuuuuagagagaucuuucauaauuuucagaugcauuuguuuuucuugggcgagcuau

SEQ ID NO: 4100530 - RNA, 55 nt, Human
auggcuuucagauggugaaagaccagcugugugucugaaaauggaugagagccau

SEQ ID NO: 4100531 - RNA, 55 nt, Human
auggcuuuguguucagagcugagagaucgaucaaagcaugaacucauugagcugu

SEQ ID NO: 4100532 - RNA, 58 nt, Human
auggcuuuguuccaauaaaacuuuauaagaacagacaguagauuuggcccaaagccau

SEQ ID NO: 4100533 - RNA, 65 nt, Human
augggaacuagaacagaaaguacaggaaagauauccucucuuucuuacaaccugaucuaacucau

SEQ ID NO: 4100534 - RNA, 80 nt, Human
augggaaugaggugaggaugcugauaggagggggguaggguaagauguccauacuaacagcauuuaucauaggaucccgu

SEQ ID NO: 4100535 - RNA, 75 nt, Human
augggacacacaaggaaguaaagcaaaggaaacauuuaauggguuauauuuguauacuugccuuauuuguuccau

SEQ ID NO: 4100536 - RNA, 57 nt, Human
augggacuaucucugagguuugcuauuacaacucaaacuaagagaucucugucucau

SEQ ID NO: 4100537 - RNA, 69 nt, Human
augggagagcuaagagucaaacccagggauucagacuccagggucuuugcugucuuugcucucaaccau

SEQ ID NO: 4100538 - RNA, 55 nt, Human
augagauaggaacaaacuuacaggaugcuuaucuggaccuuguguucuaucucau

SEQ ID NO: 4100539 - RNA, 55 nt, Human
augagaugaggaauggcccuccaggagagccagaggcuauuuccacucuucucau

SEQ ID NO: 4100540 - RNA, 84 nt, Human
augagaugaguaaauuaguggauuuaacauggggguauugaaucuaauauacuuaguuuuaauccauuagacucuucagcucau

SEQ ID NO: 4100541 - RNA, 91 nt, Human
augagauucggacuguagaaguucagacugccucaguucagacugccucauggggcagucuggaggucagcuggcuucuggugucucucau

SEQ ID NO: 4100542 - RNA, 58 nt, Human
augagcaaggcuuugugauaguugcauaauuauuucaggcuguuugagcauagcucau

SEQ ID NO: 4100543 - RNA, 74 nt, Human
augagcacucugacacaugaacuugaucuaaaugaguaauggauacaugaucacuguauuauaaugaggcucau

SEQ ID NO: 4100544 - RNA, 64 nt, Human
augagcagggacuuugaguguagucuuuggauucauacagaucugggcuugaguuccugcucgu

SEQ ID NO: 4100545 - RNA, 108 nt, Human
augagcagugccugucuugauguaggggggacaaauuagaccagggcuccuggaaucacuggccacccagguuccuccucaggucucaauuucuccugccuggcucau

SEQ ID NO: 4100546 - RNA, 62 nt, Human
augagcaguuuuuaaguagcaagcucuauuucucggcaaggcuaacgaaaaagcgugcugau

SEQ ID NO: 4100547 - RNA, 74 nt, Human
augagcauaacaaauaccaugaucagucccaugaucuuccagaagucuuguggaggagugugauugucugccau

SEQ ID NO: 4100548 - RNA, 67 nt, Human
augagcaugagcaagccaguuccagaguuagcgcugguaacugcucugcuguguuuguucagcacau

SEQ ID NO: 4100549 - RNA, 90 nt, Human
augagccagauggccugagguggcauccuagcucuauugcuaaccagcgguguugccuugggcaugccacuucccuuccucaugccucau

SEQ ID NO: 4100550 - RNA, 72 nt, Human
augagccauggggggcugacuuguuaggccauugccucugaguccuuggagcuccccucuguacguggccau

SEQ ID NO: 4100551 - RNA, 59 nt, Human
augagcuaguugugcuuggaacagggucuuuccaucuauguagugccagcuaguaucau

SEQ ID NO: 4100552 - RNA, 91 nt, Human
augagcucugcucaccauugcccacauaucuucaugagauuagccucuggauauuguuggugagugucaaugguuagaguaauaggcuuau

SEQ ID NO: 4100553 - RNA, 55 nt, Human
augagcugauuugugcuuaucccuugauaagcacaggcaauagauacagcuacau

SEQ ID NO: 4100554 - RNA, 82 nt, Human
augagcuucugccaggccacacagggcacucaagugaacaagguauagggugcccuggggucaugguaagaaagugucucau

SEQ ID NO: 4100555 - RNA, 67 nt, Human
augagcuugcuuucuucagaggugagcaugacuugcucaggucucuucccggauaaaguaaguucau

SEQ ID NO: 4100556 - RNA, 67 nt, Human
augaggcagcugacagcuguucauccagauauagcccugauguccuaagaacaugucagcuucuuau

SEQ ID NO: 4100557 - RNA, 77 nt, Human
augaggcaucuaacauugcaaaaagaacguugucuauaaauaaauucagucugauugggauguauuaguugucugau

SEQ ID NO: 4100558 - RNA, 80 nt, Human
augaggcucagagaggcucagggacuugcugagggacacacugcuuccugaguaccagucccaugggucuccuggcccau

SEQ ID NO: 4100559 - RNA, 56 nt, Human
augagguauuagcaguaacugaacaaggggaaagugaguguuggcuaaugcuacau

SEQ ID NO: 4100560 - RNA, 71 nt, Human
augaggucacaguucagcugccaggcacauugaccacgcaaccgaucccugggcugagcagugaagcucau

SEQ ID NO: 4100561 - RNA, 61 nt, Human
augaggugcaccauuauucaguugcuuuaacaauaaagagcaaaguuguugcuaaccucau

SEQ ID NO: 4100562 - RNA, 61 nt, Human
augaguaacaaauacuucaguaguguugcugugaauauuaagagagauauuuguaacuuau

SEQ ID NO: 4100563 - RNA, 69 nt, Human
augaguaauuuuuugguuuaaguaugucuccacugcuucaugggacauacuuuuuaaaagauugcuuau

SEQ ID NO: 4100564 - RNA, 59 nt, Human
augaguaucuguugggauuuuguugugucuuagaaaauuaaaaucucccagaaacuuau

SEQ ID NO: 4100565 - RNA, 83 nt, Human
augaguccauugcauuuguggcauggguguugucuuagccacucaagcuacuauaacaaaaugccaucagcugaaugacuuau

SEQ ID NO: 4100566 - RNA, 62 nt, Human
augaguggcugcaucggggugaccagggacuucaagucccuggggcucauugcaguagccau

SEQ ID NO: 4100567 - RNA, 86 nt, Human
augaguuaagacaacugcuucacuuggcauuuggauccaucuauuacuacuccagggcucgggugcuuagucauuucuuagcucau

SEQ ID NO: 4100568 - RNA, 78 nt, Human
augaguuuuccucucucuugccagaaugugaagcuuugcauagugccacgugggaggugaggagugaggaaggaaagu

SEQ ID NO: 4100569 - RNA, 59 nt, Human
augauauugagagacaacugcacaauugcaacgcagagcagcaggucugucaaugucau

SEQ ID NO: 4100570 - RNA, 91 nt, Human
augaucaauuucaagcuaucuucaugaagucacugaacacagagucaggaagaaauguguccagugauucucaugagccggugaaagucau

SEQ ID NO: 4100571 - RNA, 69 nt, Human
augaucagcaguuuucaguguucacuaacaacuucacaaaugguguaaagcuuaaaacuguagggucau

SEQ ID NO: 4100572 - RNA, 73 nt, Human
augaucuuuaggucucaauuccugcuccuguugucguuuuugcaaccaggaagcugugagaccuuuggguuau

SEQ ID NO: 4100573 - RNA, 65 nt, Human
augaucuuuaguagcgcauaguauuucuuuaauucccagugguacacaaagcuauugagugucau

SEQ ID NO: 4100574 - RNA, 92 nt, Human
augaugaaaaguauuaaugucaauaucaggcagaccuaaggcuacacuuccuacagcuguacuaguguuggcaauuuauuuaccuuucucau

SEQ ID NO: 4100575 - RNA, 64 nt, Human
augaugaagaguaacaggcugaagcucaggcaaacgcccccgccaccauguguacauuuaucau

SEQ ID NO: 4100576 - RNA, 77 nt, Human
augaugaauuagcuucagcuuguggggcacacacagauggaaguauaagguggccucaggaguaaguaaauccccau

SEQ ID NO: 4100577 - RNA, 69 nt, Human
augauggggagguacaguuguuuguuuauaagggaugcauuuaucucaagaauugguuuccucugucau

SEQ ID NO: 4100578 - RNA, 76 nt, Human
augcaaacauaauguaugugcaauguuuauauguguacacauacacacauauguauguacauacauaaugaggcau

SEQ ID NO: 4100579 - RNA, 60 nt, Human
augcaacuacccccaggauuuuaagauucaaagaaguggaaauccuugggaguggugcau

SEQ ID NO: 4100580 - RNA, 75 nt, Human
augcaagaagaagcaguauuucucuuaaucacuuguuauggggacuaaaugagauacugucuucaaagcuuguau

SEQ ID NO: 4100581 - RNA, 67 nt, Human
augcaagguugauguugucugcccugccaagcuuuuagcuugucaaggcuuuuaauauucuuuguau

SEQ ID NO: 4100582 - RNA, 83 nt, Human
augcaauaucuaggaaaagacugaauauauuagggauacaaaauuuacauuuugaaucuauguauucaguguaucuacugcau

SEQ ID NO: 4100583 - RNA, 55 nt, Human
augcacaaacccacaauuaguccauauuuagaaaacuuucuguggguucaagcau

SEQ ID NO: 4100584 - RNA, 60 nt, Human
augcacaagguagauuauuauucugaugucaugcaaaugaguaccugugugccugugugu

SEQ ID NO: 4100585 - RNA, 62 nt, Human
augcacaguauguagggucuauuucaggggaagcacauauuauaggaacucaugcuuugcau

SEQ ID NO: 4100586 - RNA, 95 nt, Human
augcacaguuauaauggagcaaggaagugccaggaaggugcccaguguaucaccucgguuccacagguauuucuccuugcucccaucuuguguau

SEQ ID NO: 4100587 - RNA, 58 nt, Human
augcacauugaaccauauauuaguggauuauuucugugauauaaaguucaguguucau

SEQ ID NO: 4100588 - RNA, 69 nt, Human
augcagacucaucaacuguuacaaauguaccacucugaugagggauguugauagugauggaggcuguau

SEQ ID NO: 4100589 - RNA, 72 nt, Human
augcagagcaaauauuaugcuuuccucuuggaaaaccuccaggagcugcaaauauuaguaauccagcugcau

SEQ ID NO: 4100590 - RNA, 64 nt, Human
augcagcagccccuugaggugcuaaucuuuuuuuaauaucuuggcgcuccagucgcuggugugu

SEQ ID NO: 4100591 - RNA, 69 nt, Human
augcagcauccucaguguagauuccuuuaucuauuuuaaagaagaaggcuugauugaggaaugccgcau

SEQ ID NO: 4100592 - RNA, 58 nt, Human
augcagcuauuugagcaugucauucucaaagccccauugaaaugcucuacagcagcau

SEQ ID NO: 4100593 - RNA, 65 nt, Human
augcagcuucagguccuuuauaacaugagguaacaauuucagugucuugggcuugaaugcugcau

SEQ ID NO: 4100594 - RNA, 60 nt, Human
augcaggcagacacugugggcaggaagggcaucuccugucacaguggguggugccuacau

SEQ ID NO: 4100595 - RNA, 74 nt, Human
augcaggcugagaccaccacaccaguguuugaugacuacaucagcaucggguggugguggggcuuguccugcau

SEQ ID NO: 4100596 - RNA, 69 nt, Human
augcaggcuguaaucugaggcuacaaguuuuagcuaauucauccugguggccuuaucagcaggcugugu

SEQ ID NO: 4100597 - RNA, 57 nt, Human
augcagggcagaguacguuagccagcaucucuuuggggcugagguuucuuccuauau

SEQ ID NO: 4100598 - RNA, 88 nt, Human
augcaguauagaguaauucugguaaaucauugagccuaucacauccuaaguucucaguaaacauuagcuaugauuaucauuacugugu

SEQ ID NO: 4100599 - RNA, 127 nt, Human
augcaguccccuucuuuuuccuuggugacuacaggccggcaucagagaguccgauuuauaacaugggcucuaccuuugcaaugcaguuacuuucuuuuccuuggggagagggaaggaaggaagacau

SEQ ID NO: 4100600 - RNA, 85 nt, Human
augcagugcuuugauuauauguaaaugaugacacaagauccccacucauugugcauauuagguacaugcuaauucucaccagcau

SEQ ID NO: 4100601 - RNA, 56 nt, Human
augcaguuuaucuccaaaucaugauuuuucccuuuaugauuugaucauggcugcau

SEQ ID NO: 4100602 - RNA, 81 nt, Human
augcaucucauuugucuucaguagguucuuccauaaucucaucauuauugcuauggcccucagaggacagcugacuugcau

SEQ ID NO: 4100603 - RNA, 62 nt, Human
augcaugaaagaauccaagccuuaagauuucuucagugucuuguacugucuuucuugugcau

SEQ ID NO: 4100604 - RNA, 69 nt, Human
augcaugagaauaucccaugcucucugauuugcagcagcaguugagcgaaaagggcuauuuauaugugu

SEQ ID NO: 4100605 - RNA, 65 nt, Human
augcaugaugaacuugcuuucaauuaaggauuauccuuuaaugaagugcguuguuuaaugugugu

SEQ ID NO: 4100606 - RNA, 76 nt, Human
augcaugcaaagugucugcuuugaaagagggaggauuggaucaggcccauccagcagagcaguguuuugcauguau

SEQ ID NO: 4100607 - RNA, 80 nt, Human
auuagggagaaacaccaauuuauucaucuucuguaacuguaaaaaaauucagguaaaguauauugguguuauuccucagu

SEQ ID NO: 4100608 - RNA, 56 nt, Human
auuagggauagaugcagggcugacuuuauuccuuuucagcuuccauauucucuagu

SEQ ID NO: 4100609 - RNA, 119 nt, Human
auuagggcaauguuuaauuuacugucucauggcuuuuugaguaaauauaaauugucauacuaaagugacagguguaaaacccaggauggcuguguuagagagguuaaucugcuguuaau

SEQ ID NO: 4100610 - RNA, 70 nt, Human
auuagggugaaaaggaauaagaaacuaaaguggcuuccaaauguuugugucuugguuucuucacccuagu

SEQ ID NO: 4100611 - RNA, 76 nt, Human
auuagguggccuggguacaugaaguaucuuuuuggaugccuagaacacaaaaagggacgacaacaggccaccuaau

SEQ ID NO: 4100612 - RNA, 82 nt, Human
auuagguugagcuacaugaaauugcugauauucuaacuuuuuugacuuaaagaaacaucagcuucaugugggucaaccuaau

SEQ ID NO: 4100613 - RNA, 60 nt, Human
auuaguagcacacagagaucagagagacaucaaccucuccucucugcgaaugcugauagu

SEQ ID NO: 4100614 - RNA, 67 nt, Human
auuagucacacguggaaaauagaaacagguuuucagggagaagaagguuuugauuccacugaauaau

SEQ ID NO: 4100615 - RNA, 62 nt, Human
auuggcugcuuuacucugacggggcgauauuaaccuuucugcuuuucucuaaaggagccagu

SEQ ID NO: 4100616 - RNA, 82 nt, Human
auugggaagcagcugaucaccaguuucagguguuuucuaucuauuagaagacagccuuucccuggugccagcugugaccaau

SEQ ID NO: 4100617 - RNA, 78 nt, Human
auugggcagagaggagagaagccagagcucugugguucucacagaaccugccuuuacucuccuuaucaacaguccagu

SEQ ID NO: 4100618 - RNA, 64 nt, Human
auugggcauggcacuacuauuaucuccauuuuauagauguggaaaauugaggcucauguuaaau

SEQ ID NO: 4100619 - RNA, 58 nt, Human
auugggcuggccuucuggagaggccuucuggcuuaauccagaccuagggcaccccagu

SEQ ID NO: 4100620 - RNA, 80 nt, Human
auuggggugacagcggggccugugcuggggagccucacuuccuccccaccugccggcugccuccgcuauaucucucuagu

SEQ ID NO: 4100621 - RNA, 78 nt, Human
auuggguugauaggucucgggauuuguauaagguaaaaagcuuuucuuaaaguaaaaugggaccuauuucaacuggau

SEQ ID NO: 4100622 - RNA, 90 nt, Human
auugguaguggugguuggcuuuagaccugagacuguccuugacucagacauuucagauucaugaagugacaacauaaaacuacuucuaau

SEQ ID NO: 4100623 - RNA, 61 nt, Human
auugguuuuuggugaaaaggaguuaaaagauuucaaacuuaacuuuucaucaacagccaau

SEQ ID NO: 4100624 - RNA, 58 nt, Human
auuguacaaugccuggaacauuguaggugcuccuuaaauguuucagugcuuguccaau

SEQ ID NO: 4100625 - RNA, 68 nt, Human
auuguaguauuacacagauuaugacuuacccuuuagaagaagaagggcagaucuguagguacuaccau

SEQ ID NO: 4100626 - RNA, 57 nt, Human
auuguauauucaagccuaaucuaugccauacaguguucuaggggcuggagauacagu

SEQ ID NO: 4100627 - RNA, 69 nt, Human
auuguaucccccagguguuuaauaauggauccaugucaauccuaaaagaaguaucugguggacugcaau

SEQ ID NO: 4100628 - RNA, 109 nt, Human
auuguauguauuaucggacauguccguauauuuuggggacaacugaacuuaucccaugacacccaggccuuccccaaaauacauggacgugucccaucauacauauaau

SEQ ID NO: 4100629 - RNA, 58 nt, Human
auuguauucugcaccuuuguuacguacccgcaaguaucaaacuggugagaaugucagu

SEQ ID NO: 4100630 - RNA, 94 nt, Human
auugucaauacuuacuagaauguucaaaagcaucagugaagcucuaucuaaagcuauaaaaugauauuugaagccaucugaagauauuggcaau

SEQ ID NO: 4100631 - RNA, 116 nt, Human
auugucaccagccaagucuuacaaacaauaaggccuggcuuaucugggagggagggagcaggagcuggguggcaccuggcccagagagcagagcuuagugaguggcuggugacaau

SEQ ID NO: 4100632 - RNA, 64 nt, Human
auugucagagguggcauugggcaacgcaacuucagaguuccuuguccugccgaucucugagaau

SEQ ID NO: 4100633 - RNA, 60 nt, Human
auugucaucuagagcagugcuggacaaagcacaauccuccagccaaaucuggcugacagu

SEQ ID NO: 4100634 - RNA, 81 nt, Human
auugucugguaauuauguaaagaugcuccagugaaacaccauuuuuggcuuagggaaauauuuauauacuuaccagauagu

SEQ ID NO: 4100635 - RNA, 74 nt, Human
auugugagcuacuuuaauugcgaggaaggggagagagggucuuaacugcaccaucaaauuagagaagccaugau

SEQ ID NO: 4100636 - RNA, 79 nt, Human
auugugaugauaaaaugucuuugaguuuuuauaagagauuucauaucucuuaguuggagauuauuuuguaauuuacgau

SEQ ID NO: 4100637 - RNA, 74 nt, Human
auugugcaaugccagcuuuaaaugcaaauuuaagagcauuuaacucauaugcagaaggccugacauugcacaau

SEQ ID NO: 4100638 - RNA, 68 nt, Human
auugugccuuauugacugguguauuccaaggguuugaaauaguacuuggaacacaguaaaugcacaau

SEQ ID NO: 4100639 - RNA, 60 nt, Human
auugugcugaucugggagugcacggggccacaugcccuugcaauuugacgucagcacagu

SEQ ID NO: 4100640 - RNA, 87 nt, Human
auugugguugucuccucucuuuguuauuguagguuaaaaacauucuuuuagugucauuucaguggaguuuugggagauagccagggu

SEQ ID NO: 4100641 - RNA, 62 nt, Human
auuguguaauuuucagcucauacguggugagccauauuucugggcuuuuaaauuuucacagu

SEQ ID NO: 4100642 - RNA, 80 nt, Human
auuguguguugcauuauugucugaaaagguaaauauuuagguuaaauuaaaugacuuuguaggcugguaaaacauacaau

SEQ ID NO: 4100643 - RNA, 55 nt, Human
auuguguuacuggucucagucugacaucaggucuuugacucuuaaguggcucaau

SEQ ID NO: 4100644 - RNA, 128 nt, Human
auuguguuuuguaaaagcuucucaagagauucucauguacagccaggguugagaaguaugucccuagaaaaaagguuccaacuuugucauauauuauaaucacuugaggaauuuugaaaaauaccaau

SEQ ID NO: 4100645 - RNA, 77 nt, Human
auuguuaaguccccauauuauuaguagcuuguugcuauuagguacauaaguuauggauaaaauguuuacugaaugau

SEQ ID NO: 4100646 - RNA, 67 nt, Human
auuguuacuaauugauuuuugaauagggagcacauucccaugguucaaaauucaaaugguauacgau

SEQ ID NO: 4100647 - RNA, 94 nt, Human
auuguuacuagaaaacgguagcuaccaguauacauuauuucuauuucuauuacgagaugcugugaggaagcuaggacuauuucuugugcacaau

SEQ ID NO: 4100648 - RNA, 72 nt, Human
auuguucacuguccugcaacucuagagccugggaaguccaagaucaagguaucugcagauauggugucuggu

SEQ ID NO: 4100649 - RNA, 67 nt, Human
auuguucuguuauucugcucaguauagcaauugcaucauuguuucacagaaaggauaacauuaugau

SEQ ID NO: 4100650 - RNA, 57 nt, Human
auuguuuauaugaccugccucacaaaauuauugugaggggaaggcaugauaaauaau

SEQ ID NO: 4100651 - RNA, 58 nt, Human
auuguuuuccaaagaugcugcuuccucugcaguuuugcagguuguuuuuggauacaau

SEQ ID NO: 4100652 - RNA, 57 nt, Human
auuguuuuccuggcucugaugaguauuucauauggucaguucugcuagaaaaacagu

SEQ ID NO: 4100653 - RNA, 60 nt, Human
auuguuuuggucugugcauggaguuguuacuggaaacuucaugugucauuggagagcaau

SEQ ID NO: 4100654 - RNA, 116 nt, Human
auuuaaauuuuccaauauauuacuuuuucccuugaauaaagauaucuucauuaggauucagaaauuuuugcuuuaggggggcugcacccagaaguaguagaauaggaaauaggaau

SEQ ID NO: 4100655 - RNA, 117 nt, Human
auuuaacuuuuuggugacuuugcuuuucauuuuugagcaguuuuauaauuaagagggaccuaccacacuucuaaagauucucagaaaaaggcuauaagauacugaaagaguuuaaau

SEQ ID NO: 4100656 - RNA, 83 nt, Human
auuuaagaauucaggagugauguugguuaaguaguauguuauagcuuaauuaaacuacugaauauuaguucugaauacugaau

SEQ ID NO: 4100657 - RNA, 61 nt, Human
auuuaauuuagagcuuuuaaaaguugcuacagagcuagcuuuaugggagcuuagauaagau

SEQ ID NO: 4100658 - RNA, 57 nt, Human
auuuacagacguggauuagugcucgacaaauggagagcauuuuccaaggaaguaagu

SEQ ID NO: 4100659 - RNA, 70 nt, Human
auuuacauuuauuugagaagguuuugauugccaaaauaaagaaaaggaaaaacucucagaaaaugugaau

SEQ ID NO: 4100660 - RNA, 63 nt, Human
auuuaccucagagagaccaagcuuucccagaauugucuggcaccucuggcucugaggcugaau

SEQ ID NO: 4100661 - RNA, 78 nt, Human
auuuacuauuuguagguuuucuggguuuguaguacaauccucauguuuggauuauacaaggaaaauuuuauaguaagu

SEQ ID NO: 4100662 - RNA, 71 nt, Human
auuuacuuuaaugcaucauggaaaacucaguuuuaaaaacaugcaaagcuaugauguauuuugcugugaau

SEQ ID NO: 4100663 - RNA, 74 nt, Human
auuuagaauuuuguuagacuaauugaaucagacuauuaauaaaaagucaaauucagugugacaacauuguaggu

SEQ ID NO: 4100664 - RNA, 62 nt, Human
auuuagagcugugcugccacauguggacagaggcuaucucauuggacagcacaacucuagau

SEQ ID NO: 4100665 - RNA, 110 nt, Human
auuuauaucucuagccugacuauuccuugugcuccagaccaauauaugcaguucuuggauuggacugauugagaaggaaggggauccugaauguuacaauagccauaagu

SEQ ID NO: 4100666 - RNA, 97 nt, Human
cacacuagacugcugugccgaguggaaagaacaccagguugagacuuaaaagacuggauuuaauuuccaguuggcacugcaauuuauuagcugugug

SEQ ID NO: 4100667 - RNA, 82 nt, Human
cacacuagguacauauuaggauggcuuguauaccuucauuuaggagguguacaagaauaauuuuauauaugucauacaggug

SEQ ID NO: 4100668 - RNA, 63 nt, Human
cacacugauagauaaaacuauauuuucagguuuuccugaggucauguuuuuacuaacaguuug

SEQ ID NO: 4100669 - RNA, 66 nt, Human
cacacugucagguaaauaacacgggcuccguuuuguugucacgugauguuuucuccuggcagagug

SEQ ID NO: 4100670 - RNA, 66 nt, Human
cacacugugaacggacugaagcccacuuaacuguucacucuaaagugguucaguucguuacgugug

SEQ ID NO: 4100671 - RNA, 57 nt, Human
cacacuguucuuugcacugagaacaaugugacaaguuuuaagcaaaagaauggugug

SEQ ID NO: 4100672 - RNA, 56 nt, Human
cacacuuagcagcacccaagacaccucuucucggugcucugcggucugcuagucug

SEQ ID NO: 4100673 - RNA, 92 nt, Human
cacagaaagagaaacucagggggcagugccgugggagcgcugugugggccaggagcucgugcucccaggcucuguggucugcguccgcugug

SEQ ID NO: 4100674 - RNA, 74 nt, Human
cacagaaagaggcacuggcaaagcaaagucugguaccuaggucuccugacucccaagcuagugcucuuucuuug

SEQ ID NO: 4100675 - RNA, 86 nt, Human
cacagaaaggucuguuuccugcaugccaugucuguaagagucuugacuguggcccaggugcaagagacagacauccuuuuguugug

SEQ ID NO: 4100676 - RNA, 114 nt, Human
cacagaagagaccagagaagagccuccuggaggagagccugcacuuugaccaugcuguccggaugggugcagugcucuuuucugcaaaguguucacuucucugcuuuuucugug

SEQ ID NO: 4100677 - RNA, 80 nt, Human
cacagacaaagccaccccugagauguguaacagaugguggugacaguacugucuauaugcucucauggccugguccugug

SEQ ID NO: 4100678 - RNA, 63 nt, Human
cacagacccaguacuuacaaaccuaugggaucagcgagaccagucugugaucuuacugcugug

SEQ ID NO: 4100679 - RNA, 129 nt, Human
cacagagccccccggcgcgccugccgugcccccagcuccugcagcuggcucccagggagcagggacaccucuggagccaccaugucugccauggagcuguucacaggcacugggcugggggugccugug

SEQ ID NO: 4100680 - RNA, 68 nt, Human
cacagaggcggaaaauucugaaggaaacaugacuauuuguagcucagagcuauuccugcuucccugug

SEQ ID NO: 4100681 - RNA, 77 nt, Human
cacagauaaggcuuuguccccagcucaguucgcucccaucccccaccugugcauuccgggacugagccuuguuugug

SEQ ID NO: 4100682 - RNA, 70 nt, Human
cacagauauuuguguauucacugucaacugcagugcccugaacacagugaaugcccaagaaaagucugug

SEQ ID NO: 4100683 - RNA, 77 nt, Human
cacagauccuuaguuaagaacaggagugauauggaaagugauagacuacuguuagaauuuaacucaggaauuuugug

SEQ ID NO: 4100684 - RNA, 61 nt, Human
cacagaucuuugagaugauucuauuguguuuagacuaauaacuucaucuucaggauaggug

SEQ ID NO: 4100685 - RNA, 84 nt, Human
cacagauuuuaacauguaauugcugcuuuuucccaaaauaaggcccauuagcuggaaagcagcaacagcuguuagaaugcugug

SEQ ID NO: 4100686 - RNA, 58 nt, Human
cacagcagagggagccauugaaauuugagugaucuguuuggaugcaccuucugaagug

SEQ ID NO: 4100687 - RNA, 55 nt, Human
cacagcagccagaacauuuuugguaaaauggaagucaaauuaugucucugcugug

SEQ ID NO: 4100688 - RNA, 79 nt, Human
cacagcagcuuuaauaaacagcuccauuuagugccuccuccuuguaucuagggaggugagcuggucuggggcugcugug

SEQ ID NO: 4100689 - RNA, 70 nt, Human
caaaaguuacuuuguucucaagauaugucauucuuuugggaauaaauacuucuggugacaaagucuuuug

SEQ ID NO: 4100690 - RNA, 118 nt, Human
caaaauaaaugccaccugcaacauuauguauuacauucauugaagugauucauuuguggacaaaucaguugcuguguaauguuuuccauaaugucuggcacagcugguuuuuaauuug

SEQ ID NO: 4100691 - RNA, 67 nt, Human
caaaauagccuguuacucuucucugaucaguuaucugacaagauuuagcuuaaagggcuuuauuuug

SEQ ID NO: 4100692 - RNA, 84 nt, Human
caaaaucaagacugucccaggaagugagugucagucaaagguuuugaaaucccucaaauaguuacuucugcugucuugguuuug

SEQ ID NO: 4100693 - RNA, 128 nt, Human
caaaaugaauaaugcagggcaaagucugucuuugaaaagggagauagaaauugccuaauugcaauuuuccucauuguuucaaagucaaucuuuuuguucucugauauaucugcagauaguuuauuuug

SEQ ID NO: 4100694 - RNA, 69 nt, Human
caaaauugaguuuucauaaaauuagugucaauauuggugaacugacuguacuuuaugaguucaauuuug

SEQ ID NO: 4100695 - RNA, 103 nt, Human
caaaauuuugacccuguuuugacugugcccgaugacaaaauucacaggugugaaauuuuccacuuguggaauuauguuggcauucaaaaaacuggggauuuug

SEQ ID NO: 4100696 - RNA, 85 nt, Human
caaacaucagcaggguuugacuucuaauguucacagucuuuucuauggacuuaacccaauguaagaucaccucugcugcuguuug

SEQ ID NO: 4100697 - RNA, 76 nt, Human
caaacauucaaguacaagucuuuguguggauauguuuucauuucucuuggguaagagauuugugcuugaauguuug

SEQ ID NO: 4100698 - RNA, 85 nt, Human
caaacucuagagaucugaaaagaguauguaguuuacaaaugaaaguaaaggcgucuuuuagauuuuacaucuuucacugaguuug

SEQ ID NO: 4100699 - RNA, 60 nt, Human
caaacugcaacaugaaguguccccugaaucuccagccugcucuucuaccuugcagauuug

SEQ ID NO: 4100700 - RNA, 67 nt, Human
caaagaacacccagacguuguggaaggaaaaaaguucauggaucuuuuacaacauuuguguucuaug

SEQ ID NO: 4100701 - RNA, 61 nt, Human
caaagacacaugucucuuagauuagggcugggacauuccaaucuaccccaugcuguuuuug

SEQ ID NO: 4100702 - RNA, 81 nt, Human
caaagaccagcauagaaggaaagucauuugaaucugaggauaugguuuauuagaguuuucugucuguugugaauuucuuug

SEQ ID NO: 4100703 - RNA, 64 nt, Human
caaagagcuggaguuugcagcccuuucuaguucugaacccaggcguugcaaauguggcuugaug

SEQ ID NO: 4100704 - RNA, 68 nt, Human
caaagaggggcugccugccagcucaguggcccugccaucuccccugggcugcucagcccccucgcaug

SEQ ID NO: 4100705 - RNA, 60 nt, Human
caaagaguccagcacccucuccuuccagguauauaaacggugcauugcugggcuccuuug

SEQ ID NO: 4100706 - RNA, 61 nt, Human
caaagagugcuccugccagcuuucugguuugucuccggaaccagauucaggggcaacuuug

SEQ ID NO: 4100707 - RNA, 67 nt, Human
caaagaucauucucugguccagaugcucugagcugcacaaaucugaagacaaggaggguggcuggug

SEQ ID NO: 4100708 - RNA, 126 nt, Human
caaagauuaaguaucaggcacacagguuuuuaaugccuagauuauucuguuuuuauaauaaauuaguaaaugagauucuagccauuacaaaucuguguguuguugaaaacugucauuugaucuaug

SEQ ID NO: 4100709 - RNA, 77 nt, Human
caaagcagcacauuucccacccuugggaauucaggggaaacuuuguacagguuccuaggguggaagcaaucucuuug

SEQ ID NO: 4100710 - RNA, 79 nt, Human
caaagcagucauuuggcaccuacuguaugccucgacaaugggauggaugcuauuugggggcuacaugauauuuguuuug

SEQ ID NO: 4100711 - RNA, 129 nt, Human
caaagcaguuguugauuagcaguguuuagaauucagauuguagaagcagagaccuacauuacaguccuggcuucacaacuucuuaauucuuagaccuugggcaaguuacuuaacauacuucagccuuug

SEQ ID NO: 4100712 - RNA, 69 nt, Human
caaagccaggugugauuucaucugagguccaugaauggcccaggagaucuggaucucguccugguuuug

SEQ ID NO: 4100713 - RNA, 66 nt, Human
caaagccggcugaugaaauuugagcagcacagggcugcucuagagagcauuagucacuggcgaaug

SEQ ID NO: 4100714 - RNA, 85 nt, Human
caaagcuggagcugcagugaacuguuuugucccccugguaaaggagcuuggcuggagaguuuauugcaguugccccaaaguucug

SEQ ID NO: 4100715 - RNA, 70 nt, Human
caaaggagaguagguuacuccauuccucuguucccuuuuggaaauggaguacuuuuuuacuuucucugug

SEQ ID NO: 4100716 - RNA, 80 nt, Human
caaaggaguaacuaacagucauuaaaagaacuccuuuugaggugugaauuaaacuguugaguuuuucuuaaacuucugug

SEQ ID NO: 4100717 - RNA, 77 nt, Human
caaaggccaauuugugcuugcagauaagaagucugauuaaaaagucagcuuugcaaguuagaaaauggauaccuuug

SEQ ID NO: 4100718 - RNA, 58 nt, Human
caaaggccauuacuugcuuuuagacucuguguguugagagauaaggagaugguuugug

SEQ ID NO: 4100719 - RNA, 62 nt, Human
caaaggcugccacuguggcugugcauuuuaugcauugcacagagacauuugggcugcuuuug

SEQ ID NO: 4100720 - RNA, 58 nt, Human
caaaggcugguagaaugagccaauaaacccagguucaacaauuaaguaucagccuuug

SEQ ID NO: 4100721 - RNA, 118 nt, Human
caaaggcuuguuuuauuuuauuuguuuaguucaauauagcccuacugaucugacauccccuuagaguuuggguagaguuuaaugaaaaaucugaaaaaugaaauaaauucuuccuuug

SEQ ID NO: 4100722 - RNA, 66 nt, Human
caaagggaagauaugucccucugugaggcuuucuguccucuucagacaaggccaucuuucauuuug

SEQ ID NO: 4100723 - RNA, 68 nt, Human
caaagggcauuuuagugaacugcuaggguacucaaccuaucaucacauuuaauuaaaaugucauuuug

SEQ ID NO: 4100724 - RNA, 83 nt, Human
caaagguagucaggauagaacaggcauaagcauuugcauuauuuuaguaagcuuugugauggcuuccugccugauuacuucug

SEQ ID NO: 4100725 - RNA, 83 nt, Human
caaagguuucaugcaauguuauaucuguauguauaugcauguguguguuuucaucacagaauguaacacauuuguuauuuuug

SEQ ID NO: 4100726 - RNA, 73 nt, Human
caaaguaaguauguggcuugaagucaugucaacacugaguuugaaucacagcuucugccauuugcuagcugug

SEQ ID NO: 4100727 - RNA, 65 nt, Human
caaagucacaucgauuauaaaauuuggacucugaguuccccgaguuaugguuuggugugacucug

SEQ ID NO: 4100728 - RNA, 68 nt, Human
caaagucuccauggauuuggaaaugaugccauugucucuggauuaccgcugaguccuauggagaguug

SEQ ID NO: 4100729 - RNA, 58 nt, Human
caaagugccuguaccacuuugcugaccaaccagcaauguaagaguuccaguuacuuug

SEQ ID NO: 4100730 - RNA, 56 nt, Human
caaagugcuaggauuauaggugugagccacugcaucugacccuacucagcacuuug

SEQ ID NO: 4100731 - RNA, 79 nt, Human
caaagugcugggauuacaggccugagccaccacggccagccgugaaguuuuaaguaggggcacuguggaccagauuuug

SEQ ID NO: 4100732 - RNA, 60 nt, Human
caaagugcugggauuagugcugggauuacacucgugagccacugugcccaggccacuuug

SEQ ID NO: 4100733 - RNA, 57 nt, Human
caaagugcugggauuauaggcaugagccacugggccuggccucuucuaguuacuuug

SEQ ID NO: 4100734 - RNA, 67 nt, Human
caaaguggaggcucuggggccagggucccggaaaacauuaacaaggcccccagaugcuucuucugug

SEQ ID NO: 4100735 - RNA, 68 nt, Human
caaauaagagcuaauaaacuuccuguacacuagcuaugugcugggcauuuuuauggcuccuuuauuug

SEQ ID NO: 4100736 - RNA, 58 nt, Human
caaauacgugcacauacauacaugcauacguguguauguauguguguguauguguaug

SEQ ID NO: 4100737 - RNA, 80 nt, Human
caaauccuaucagucaucuugggagucugggaacauguaaauaaaucauguuucucccccaugauaauuucugugagcug

SEQ ID NO: 4100738 - RNA, 78 nt, Human
caaaucuaggaugcauguagugcuuaagaauauauuguuccugguacaagaauagcuugaaacucauguuuagauuug

SEQ ID NO: 4100739 - RNA, 79 nt, Human
caaaugaaaugcuucucugaaaauacucuugacacuuucccauauuggugugugugcccagguaaagcauuuccuuuug

SEQ ID NO: 4100740 - RNA, 66 nt, Human
caaaugauaaggcuguagcuucagauguagauacauucaugccucugaguuauguccuuacauuug

SEQ ID NO: 4100741 - RNA, 57 nt, Human
caaaugcagucccuuuguugcuaugguaauacauuugguuaggggggcugucauuug

SEQ ID NO: 4100742 - RNA, 58 nt, Human
caaauggagggacagagaccagaaagagcucccuggaaucucugaguuuccuaauuug

SEQ ID NO: 4100743 - RNA, 85 nt, Human
caaauguauacauucuggcaacguuuucuauagguaaagaugauuguuuuacagagguauguaugucucugaguguaaauauuug

SEQ ID NO: 4100744 - RNA, 90 nt, Human
caaauuagguuugugaaguggagugguaugguuuacugaugauaagcagggcuuugagaucauacuacuuguacuaaaaaccuggcuuug

SEQ ID NO: 4100745 - RNA, 84 nt, Human
caaauuggugguaagcagaaguagugggaccucaugcaagucugcaggauugagaagcccacacucuuuccuuuccaccauuug

SEQ ID NO: 4100746 - RNA, 112 nt, Human
caaauugucaagaaggagaggacaacuaaacuggcaacagaacuuggauaccaccuguuacucacugcuauaguuuggauguuugucccuguaaaccucaaguugauauuug

SEQ ID NO: 4100747 - RNA, 114 nt, Human
caaauuguccauuggaucucauuuucuagauaauggcuuuaggguuuuauuugcaucugugcaaagaugugucuauucaacaugaaaacauuagugaguucagucaauaguuug

SEQ ID NO: 4100748 - RNA, 58 nt, Human
caaauuuuguguguucucuagugcccuucagggccuuaaaggacaggaacaaaguaug

SEQ ID NO: 4100749 - RNA, 63 nt, Human
caaauagauuguucaauccugaugaaaugcacaaaaauauuggguuagugagcuuuuuauuug

SEQ ID NO: 4100750 - RNA, 80 nt, Human
caaauauggcccuauuuggaaauagagccuuggcaaauauagucgaguucuacucaauuuaggugggcccuaauccagug

SEQ ID NO: 4100751 - RNA, 74 nt, Human
caaauauucuugaagauugauccaguuugaagcauguugugcauggguuuacuguucaacuugcaaguaauuug

SEQ ID NO: 4100752 - RNA, 64 nt, Human
caaaucagaaggaagaagucaugggagauugcucaaucauguaaugucacuuccucccucuuug

SEQ ID NO: 4100753 - RNA, 56 nt, Human
caaauccauagcuugcauuaggaugcacuuuuagcguuauacauucuauggauuug

SEQ ID NO: 4100754 - RNA, 111 nt, Human
caaaucugauggauuuucucuaguggcuguccuggcucuaacuggaaaaggauucugagguuguaucugggcuuaggcaggaagagaggugaaaucuauuagcaacauuug

SEQ ID NO: 4100755 - RNA, 72 nt, Human
caaaucuucacauucuucccugacuucuuaggcagcaaaugucaaagaaacgaagugaugugagaggaggug

SEQ ID NO: 4100756 - RNA, 74 nt, Human
caaaugaaaauggcgucuuggaaaaacagcacauacaugguugcuucaaggauaucgcccaauaccuucauuug

SEQ ID NO: 4100757 - RNA, 127 nt, Human
caaaugaaaugauguguaggcauaguauuagguauuacaguaaucuggacaugauuuaaagaacuggauacaggagguuguuugcagguuauaugcaaauacuaugcuaauuuauaucauugacuug

SEQ ID NO: 4100758 - RNA, 69 nt, Human
caaaugaagcaguccaucugcucugagauauuaagcccuauauuaagauuguagaaacuguagcauuug

SEQ ID NO: 4100759 - RNA, 79 nt, Human
caaaugaagguucagugccuggaacaggguaggaguccagcuauggccgccucuaugccaggcacugggcaagcgcuug

SEQ ID NO: 4100760 - RNA, 64 nt, Human
caaaugagaaaaaggagaggagccauaaagugacuugcuuaagguuacauccucuuccucuuug

SEQ ID NO: 4100761 - RNA, 61 nt, Human
caaaugagauucuaucuccaggcauaaguuauguguuaagucuggguguaaaucuuauuug

SEQ ID NO: 4100762 - RNA, 58 nt, Human
caacuauagggagagugguuaacaugguauaccauaugaaucuugcucccuaggguug

SEQ ID NO: 4100763 - RNA, 100 nt, Human
caacuauuuacacuucaguauguagaacaaguguuuuaugcauaguucauauuuaaucacauggaauauugaauagacaugcaaucgaagguggauauug

SEQ ID NO: 4100764 - RNA, 61 nt, Human
caacucagaagauauaaugacucagacagacuuuagucugacuuauuuccuuuuugggcug

SEQ ID NO: 4100765 - RNA, 85 nt, Human
caacucaggcucaggcagguggcuggcuaugguuuguaucugauuuguuugcauuucuguggcaggcagcugcugugacugguug

SEQ ID NO: 4100766 - RNA, 76 nt, Human
caacuccuggauucauggauuucuugaaggguguuuugugucucuaucuccuucaauucugcucugaucuuaguug

SEQ ID NO: 4100767 - RNA, 126 nt, Human
caacucugagaucauuugcaucguccuuucuggugucaugucauacuguucuucccaggaggacagccuccuccuggcucagaguaugucaucgccugggagggggaaggcaguuggaaggguugg

SEQ ID NO: 4100768 - RNA, 59 nt, Human
caacugcuuggaggaauacugcugcauauaucuuuuguguuuuccuucugaguauguug

SEQ ID NO: 4100769 - RNA, 71 nt, Human
caacuguaaacuagggcugauaagggugcccaaguacacacuuucauaaugccagguuuguaauccaguug

SEQ ID NO: 4100770 - RNA, 57 nt, Human
caacuguuugaacagauggcuuuuaccauguaaaacauggcauuuguugaucaguug

SEQ ID NO: 4100771 - RNA, 81 nt, Human
caacuuuaccaguguaccacccuaaaguaaugguuuucaaaugcaguccugaaaacuggguuguggucaguggugggguug

SEQ ID NO: 4100772 - RNA, 74 nt, Human
caacuuugaacaauuccucaagcuguacuguucaaccauuugauucaguauuuucaggauuuggaagcagguug

SEQ ID NO: 4100773 - RNA, 84 nt, Human
caagaaacaguuaauugcuuucaguuucuccaucuucaagaaagggacaaaaagguaacugaugaagcuguuucuguuuucuug

SEQ ID NO: 4100774 - RNA, 58 nt, Human
caagaaacuuuauucugccauaagcuaugugacuuuggacagaauauuaggucucuug

SEQ ID NO: 4100775 - RNA, 57 nt, Human
caagaacaaugguuguaagaaaucuauuuuagguuuuucuaggaccaugugauuuug

SEQ ID NO: 4100776 - RNA, 75 nt, Human
caagaagccugugcuuuguucucaaguuauuccaucaaauaagaaugucuauuugcuacaaagccaaacuuuuug

SEQ ID NO: 4100777 - RNA, 55 nt, Human
caagaaggcuauaugggccagggcuucagugauucaugauguccaagccuucuug

SEQ ID NO: 4100778 - RNA, 57 nt, Human
caagaaggugugcuuuauauugcuuaugaagcccauuuugaagcaauaccauuuuug

SEQ ID NO: 4100779 - RNA, 69 nt, Human
caagaauagcagauaucccagcugauuucuguagcaggcagaaguguucuuccuaucugcuguucucug

SEQ ID NO: 4100780 - RNA, 77 nt, Human
caagacagcaauccuugaggucuuugagcaaacgcaagaaccguccuucuccugcugcuggugaccucugcugcuug

SEQ ID NO: 4100781 - RNA, 60 nt, Human
caagaccaggcuccuggaguccaccucgccccuagcugcaugguggccagccuggucuug

SEQ ID NO: 4100782 - RNA, 85 nt, Human
caagacccauugguuguuagagguucuguaauaaacuaagacauguaugauacuauugaaucauugucaaucaagcauggucuug

SEQ ID NO: 4100783 - RNA, 67 nt, Human
caagacuguguuuuaagggguuagccucaacaugauuauauggacaauacuuugaauuacagccuug

SEQ ID NO: 4100784 - RNA, 64 nt, Human
caagacuuauuuugucaucuccagaaauauugaggagaguagaacugacaagauaauagccuug

SEQ ID NO: 4100785 - RNA, 59 nt, Human
caagacuuuggaggaauuuggacuaaguuuaaaauuacucccuuucucaaaagaucuug

SEQ ID NO: 4100786 - RNA, 63 nt, Human
caagagcaucccugcauccagccaucacagugugaagugaguuucagaugaggagaugccuug

SEQ ID NO: 4100787 - RNA, 69 nt, Human
caagagcauuuaguuagcuggucuaggccuugcuaguugggccagcucaguucucuugaucgucucuug

SEQ ID NO: 4100788 - RNA, 62 nt, Human
caagagcccugacggggacagaugggugcuggcugucccccucugucaccaucaggguggug

SEQ ID NO: 4100789 - RNA, 80 nt, Human
caagagcucccugucacgagaggcacagaauagagcuuugucucuuaaaaaggcuugauugcuucuacgugacugucuug

SEQ ID NO: 4100790 - RNA, 89 nt, Human
caagagcugaggcuggauaccaggagacagggggccacagagcccuccugugcaugcaucucccuaguguuccaucggcccagcucuug

SEQ ID NO: 4100791 - RNA, 56 nt, Human
caagagcuuuugggaacgcugcagcaggagacuugcaggugugcagagggcucuug

SEQ ID NO: 4100792 - RNA, 87 nt, Human
caagaggaaggaguggggaaagccaggacagaaacccaggccugggacucucagcugacugcuuuccucgcauugccauucaccuug

SEQ ID NO: 4100793 - RNA, 59 nt, Human
caagagggcuucagcggugaugcccucaauagucucauucagggugcuggggccccuug

SEQ ID NO: 4100794 - RNA, 61 nt, Human
caagaguugcuuaucagagucuucaaugucaugauuauaaaggcucagagagaaacucuug

SEQ ID NO: 4100795 - RNA, 61 nt, Human
caagaguuucucucugagccuuuauaaucaugacauugaagacucugauaagcaacucuug

SEQ ID NO: 4100796 - RNA, 63 nt, Human
caagauagauugacuuuguuugaguaaaaugguuuaggucuaaacacagagugagucugcuug

SEQ ID NO: 4100797 - RNA, 84 nt, Human
caagaucagguaaaggcacuagaaguuaccuuuuuuguggacgcuuaagaaaggugacuggagaggccccaaaaauucaucuug

SEQ ID NO: 4100798 - RNA, 92 nt, Human
caagaucucacagacuuuagaaaagcauccauagauaguacauuauuuauuugauugcuuuucugaaccgugccuuugagaaaaacucuuug

SEQ ID NO: 4100799 - RNA, 63 nt, Human
caagaugaaauugugauauuuuaccuuuuuuccuccuagguuaaguagaucacuguucucuug

SEQ ID NO: 4100800 - RNA, 79 nt, Human
caagaugguucacauucaaccaggaagaacaggcaaggcauggcaucccaucugcugucuuuucugggugagucuuuug

SEQ ID NO: 4100801 - RNA, 67 nt, Human
caagauucuggccaauucgguuccugaugaagaaccccuucauggcuugcagauggccaccuucuug

SEQ ID NO: 4100802 - RNA, 65 nt, Human
caagcacaggguguggcugcagugugaggucucagagcccuggaugcacagccauacccuccuug

SEQ ID NO: 4100803 - RNA, 56 nt, Human
caagcagccccaacaugaggaugaaucguauucccagcuugcaaauggguugcuug

SEQ ID NO: 4100804 - RNA, 58 nt, Human
caagcagguuaugaaauauagaaagccuacugguuuuccugagucacaaaaccucuug

SEQ ID NO: 4100805 - RNA, 77 nt, Human
caagcaugcacgcucguggcaguaaugacguguggguguacccaggcuucacucgacaugccaaugaugcaaacuug

SEQ ID NO: 4100806 - RNA, 68 nt, Human
caagcaugcaucuuuucaagguauuucuaccagcaugaguggaaauggcuugcagacaugcuugcuug

SEQ ID NO: 4100807 - RNA, 129 nt, Human
caagcauguggaacaauuggagcucuauuaccuugcugccaggaguguagagugguuuaaccacacuggaggacuauuuaguaguucugauaaagguaaacauagaucuaccuuaacccuaugucuuag

SEQ ID NO: 4100808 - RNA, 58 nt, Human
caagccacucacaauaacuguccuuaucaguagggacuguuugugugagauguguuug

SEQ ID NO: 4100809 - RNA, 70 nt, Human
auuagguugcugcaaaaguaauugcgguuuuugccauucuuaauggcaauuacuuuugcagcaaccuaau

SEQ ID NO: 4100810 - RNA, 123 nt, Human
auuagucauauaguaauuaagauugcauaugauggcaugauuucuauauuuuuaacuaugauuauaugcuuuagaaaugaguaaauuagacacuauagugugcaucuuuacauauauacuaau

SEQ ID NO: 4100811 - RNA, 62 nt, Human
auuaguggcauagcucaaacuggaauugaaaucuguuugaguccuaaagcugugcccuuaau

SEQ ID NO: 4100812 - RNA, 81 nt, Human
auuaguuagaugcacuaugcaauaucuauuugauggaauuccuucagccauugaaagcgauacuguagaggcauagcuagu

SEQ ID NO: 4100813 - RNA, 78 nt, Human
auuauaaagagauugauguguaucaguguguuguaaaagaauguuuaccaugcugugacacaguaguuaccuuugaau

SEQ ID NO: 4100814 - RNA, 62 nt, Human
auuauaaauggcaauuuaguuuauuuagacaauaucuuuggaugaaauauugcauuuaugau

SEQ ID NO: 4100815 - RNA, 66 nt, Human
auuauaucaugcuauuuuaguaucugcuaccucaaaagaauggcagcuagauaguguguuuauaau

SEQ ID NO: 4100816 - RNA, 104 nt, Human
auuauauuaagaugcaauaauuucuaaugugucuuggaguuuuaaugucauuuuaugauguuugaacacuaaggcuauuucuauaauugucaaauuaaucugau

SEQ ID NO: 4100817 - RNA, 104 nt, Human
auuauccuccgcacauagcaagaaaucuagaagucaguggaugcugaguacauauuuacugacuauucuuugggaacuugguaugugcuaggaauuggggugau

SEQ ID NO: 4100818 - RNA, 58 nt, Human
auuaugaggcauauuugcaaaguaugaccccagaugucgcaaaauaugaccucaaagu

SEQ ID NO: 4100819 - RNA, 68 nt, Human
auuauguuuuccccugcaguggaauaauuuuaaaauuccaauugcuuuuccaagggcagaauauuaau

SEQ ID NO: 4100820 - RNA, 58 nt, Human
auuauucaaauucccacuauacauugugcguuauuguagagcuuggggauuuaguagu

SEQ ID NO: 4100821 - RNA, 60 nt, Human
auuauucuuuaaguugugaaucuaagacagaugacuauuuuagcauauuuaaggaaugau

SEQ ID NO: 4100822 - RNA, 60 nt, Human
auuauugcaaaggaagagcuugaaugaguaauuucucgucgguauucuauugacaguagu

SEQ ID NO: 4100823 - RNA, 64 nt, Human
auuauugccuuaggagugcauaucauugaauaucuucucgauggaucuaccuucaggcucuggu

SEQ ID NO: 4100824 - RNA, 62 nt, Human
auucaaaguaaggguuaaucuacuuuugguagguuaaaaguagaacauuuucuuaucugagu

SEQ ID NO: 4100825 - RNA, 85 nt, Human
auucacaaaguuggagcacuauaauagagauuuucaauaauauauguuaaaaggguuuuuaugugaugucuugcaacuugugaau

SEQ ID NO: 4100826 - RNA, 74 nt, Human
auucacaccuccacaggagcugcagugcucaauaaauguuugaugaaucagugaaugagcuccucguggugaau

SEQ ID NO: 4100827 - RNA, 84 nt, Human
auucacaucacugggcucccaggcuugucauuugaucaggcucucaucugcaugucaaugaggcuuagagcccauggaaagaau

SEQ ID NO: 4100828 - RNA, 129 nt, Human
auucacugguguuaggaacugcuaaguuaaguaguacucucuucacugcgggcucugagaaaggagggcucuguuauucaugaagaggugacauuugacuaggacccaggauccaugaauuuuuugaau

SEQ ID NO: 4100829 - RNA, 62 nt, Human
auucagaagcuauucuuaguucuaaggaauauaaugaacuugagcuuugaguccuacugaau

SEQ ID NO: 4100830 - RNA, 87 nt, Human
auucagaaguuuccagucuaguaaggagacaagguaugaaucagaagaaaugccccucacuagcucacugaaacucuaaucaugaau

SEQ ID NO: 4100831 - RNA, 95 nt, Human
auucagauaguuauugacauuucauuauauagacuuuucaguaccccacauaauaauggcugaagaaauaugauugcuuaauaaaaggucugagu

SEQ ID NO: 4100832 - RNA, 80 nt, Human
auucagcagcuuccuugguugggaguguggaggguggguggaccagcuccugugcaccuccagcggcagccacgcagaau

SEQ ID NO: 4100833 - RNA, 85 nt, Human
auucagccuaguauuuauaaucaugcuuaagucuaacuuuguauucacuuagggguuugggccugaucggaauaaggagcugaau

SEQ ID NO: 4100834 - RNA, 60 nt, Human
auucagcucagacagagaccgugugcugcaggugaggaacacaggcuuuggagucugaau

SEQ ID NO: 4100835 - RNA, 55 nt, Human
auucagcugucaccaguuccuagaaucagaguuaaagcuaggugaccagcuggau

SEQ ID NO: 4100836 - RNA, 82 nt, Human
auucaggaccaagacugcagcagaaacaucuaagcugaauugucaucugucuuuguuuauugcugcaauugugccacugaau

SEQ ID NO: 4100837 - RNA, 94 nt, Human
caagggauggaggcauccucuagaagcuggaaaaggcaagaaacggauucuuuucuagaagcuccaggaggaaugcagcucuguugacaccuug

SEQ ID NO: 4100838 - RNA, 101 nt, Human
caagggcacgugaucccuucuugcccugaauuccucaggcuguggacucccugggaccacaaguuugaacuucuaggaaagaagggacucagguuuuuuug

SEQ ID NO: 4100839 - RNA, 55 nt, Human
caagggcagcagccucaagcgggacacgcugcucggggagaaggagcugccccug

SEQ ID NO: 4100840 - RNA, 62 nt, Human
caagggcucuuuugaggaauguccuaucaguugcaggagagcauuuaccacuggagcccuug

SEQ ID NO: 4100841 - RNA, 63 nt, Human
caagggcugggcuagggaggcaguucccagagcucugcugucccuucccaagcccagccucug

SEQ ID NO: 4100842 - RNA, 110 nt, Human
caagggguugaguuguacuggccagugacuccgggagccaggagaggcugcuccuuggagcccagcuuccucacuaagucauaaaugagccucuugcgacgggcuccuug

SEQ ID NO: 4100843 - RNA, 101 nt, Human
caaggguauuggaaaguuuaauuguauuuugaaauucuuugcaucugucaaagaguaaagacaugcaaagucuaauuaggagcgaugaguuaguauucuug

SEQ ID NO: 4100844 - RNA, 94 nt, Human
caagguauguggcuguggggcugaguggagccagaagggcuggaucuuguaccucucuuccauguuucagccccauccuucaaucaucuucuug

SEQ ID NO: 4100845 - RNA, 59 nt, Human
caaggugcagcguugucaagcugaauccuaauaaugugcgcaacggacccugccccuug

SEQ ID NO: 4100846 - RNA, 57 nt, Human
caaguacaaaaugauauuuagucaauaaauauauauugaauaucuauugugugcuug

SEQ ID NO: 4100847 - RNA, 98 nt, Human
caaguagccuuuaaagauaagcuguacaauguggccaguguuaauaugacaauuuguuaauggacuaggcaguuguaaucaguguuaaaaauuacuug

SEQ ID NO: 4100848 - RNA, 69 nt, Human
caaguauuuauugagcaccuacuauguguccagauacuguucugggcacugggaaugcugaugggcuug

SEQ ID NO: 4100849 - RNA, 67 nt, Human
caaguauuugcggaguuccacguuugccagcuaggaucaaauccccgugguagcuagccaauacuug

SEQ ID NO: 4100850 - RNA, 55 nt, Human
caaguccagggccaugaaguugcacaccuccaggugguugguggcccuggaguug

SEQ ID NO: 4100851 - RNA, 56 nt, Human
caaguccgaguuucgggauuuggggagggguccugcacaccuugagcuuggaaaug

SEQ ID NO: 4100852 - RNA, 90 nt, Human
caagucuaaacugcagcuuaaaggaguucaauaaauuucaaguuguuuuuaaugucaaaggguugaauuuagacaagcuguguugacuug

SEQ ID NO: 4100853 - RNA, 125 nt, Human
caagucuucagguacuucgauacuguucuacuaguagguagagucuaugucccuuccccuugcaccugaggggcuucuguaccuaccuggaagaauaggacacaaaggaaguggcuaucaguuug

SEQ ID NO: 4100854 - RNA, 55 nt, Human
caagugaaguaaaggcagacaccuauuccagguucaaguuugcuacauucacuug

SEQ ID NO: 4100855 - RNA, 63 nt, Human
caagugaaugaugugaaguguaaaccaaccauuguuguguuucauguuacugucauacacuug

SEQ ID NO: 4100856 - RNA, 62 nt, Human
caagugucaggagaagagaagccacauccaucuguccuugacuucuuuguuccuuacauuug

SEQ ID NO: 4100857 - RNA, 78 nt, Human
caaguguuuaugaaauuucaggcauuuugagaaauuugcauguacucaaaagucuuguuacguuccauuguucacuug

SEQ ID NO: 4100858 - RNA, 57 nt, Human
caaguuuguggggcaacagcaggugaagagccagcuucucucuguggucccauuuug

SEQ ID NO: 4100859 - RNA, 116 nt, Human
caaguuuuucagugaugcauguuaacaguuagguccuaaaauucuguggugcuaauucucccauacccaauggugcuuuuguggaugcuaacugcacacaugcugaacaaagcuug

SEQ ID NO: 4100860 - RNA, 78 nt, Human
caauaaucuagaaguuuauagaugucuguauuauaaauuuuaauugguaguggguggcauuuauaauuuuagucagug

SEQ ID NO: 4100861 - RNA, 128 nt, Human
caauaaucugagucuauuucuacguacuuauuagauacacagauuuccacuuaguuuccuaacagaaguggggaugguguaggugauguagaguccuggguaggaguauauuuuagaaaccccuauug

SEQ ID NO: 4100862 - RNA, 90 nt, Human
caauaaugcaacuucagugcgauucugcagauuuccuuccgaagugagagaagaaauagaaucacauuuugauaagauauugcauuguug

SEQ ID NO: 4100863 - RNA, 65 nt, Human
caauaauggugcaucaauauagguucauugauuguaacaaauggaccacucuggugcccauguug

SEQ ID NO: 4100864 - RNA, 100 nt, Human
caauaccuggguaauaagggacugacucgagaugggguuccagcuacugcaaugaauuucccagcuuugaucaguuuucaccaguacuuucgugguauug

SEQ ID NO: 4100865 - RNA, 70 nt, Human
caauacugagauauuaaugagcaaguaagugaaugaauuuuuucauucagcaauuauugauugaguguug

SEQ ID NO: 4100866 - RNA, 89 nt, Human
caauagaauuucucaaugaaagagcaugcauuuuaaaauuuaauuaugugcauuugaaaugccuuaucauugagacagaaauuuuuuug

SEQ ID NO: 4100867 - RNA, 93 nt, Human
caaucauuuuguaucuccagccaggaacacaaugccaagcuuggcuccuccaaacuuggcauuguguuccuggcuggagauacaaaaugauug

SEQ ID NO: 4100868 - RNA, 73 nt, Human
caaucuaaucuaucaagcaacaaagugcucagccuucuaaccuuggguacguuguugguugguugguuaauug

SEQ ID NO: 4100869 - RNA, 78 nt, Human
caaucucuguguaugcguguuugugcauacucacuaaaacauuuggaaggcuguucacuaacauguuaacaaagguug

SEQ ID NO: 4100870 - RNA, 70 nt, Human
caaucugcucuguuguguuuuucuccagcugcuuaaauacaagaagagagacagcacacaguguggguug

SEQ ID NO: 4100871 - RNA, 80 nt, Human
caaucuucacaugauguccgugcugugguuucuucucuguguccaaauuccuccuuuuuagcaggacaucaguggaauug

SEQ ID NO: 4100872 - RNA, 57 nt, Human
caaugaacccuucaagcucugauuugucagaacucagagaaacagcaggguguguug

SEQ ID NO: 4100873 - RNA, 72 nt, Human
caaugaauaaguauaugggaaauagaaggaaggggucagguccaacuuuugaugaaccuauauaauuuguug

SEQ ID NO: 4100874 - RNA, 82 nt, Human
caaugaauccuucaaucauucuaguugucuuccguggccugcaauacagagccuugaagaucuggaaaauugauguugguug

SEQ ID NO: 4100875 - RNA, 73 nt, Human
caaugaaucuugcuguuugggagggcucugucguauaaauggaagcuggcucuuauaaauauuugguuaauug

SEQ ID NO: 4100876 - RNA, 60 nt, Human
caaugaggaacacugaacuccagacacuaggcugggcauugugcauguguucucccauug

SEQ ID NO: 4100877 - RNA, 116 nt, Human
caaugccaaaagagagacaauuagguuaagagcaagaagacacauuuauaagucuuuccuuuuguacuucuuguucuuucuaacuuaagauguuguuacccaugauuugugcauug

SEQ ID NO: 4100878 - RNA, 81 nt, Human
caaugccaaaaguacagugccagacuucuagguggucccaacaugaugacuuggaggggauggcauucuuuuggacauaug

SEQ ID NO: 4100879 - RNA, 71 nt, Human
caaugccagagggcuugguuugggccaagauaucuugcugcccuuaaaacaaaguccaggcucuggcaaug

SEQ ID NO: 4100880 - RNA, 60 nt, Human
caaugcuuguggagugccugcugcaguccaggccugggcuaggugcuuccacacgugcug

SEQ ID NO: 4100881 - RNA, 77 nt, Human
caauggaagaguaaagugcagaacuguucucacuaaugaacuuuagugagaaauguuuguuuuuacuuuugccagug

SEQ ID NO: 4100882 - RNA, 57 nt, Human
caaugggcacuagggccacccaugucaggcaggagguagggagcccagagcccagug

SEQ ID NO: 4100883 - RNA, 78 nt, Human
caaugggugucucuguguccuccagggagaugugaagaggauuuuacaucucccuggaggacacagagacaccuauug

SEQ ID NO: 4100884 - RNA, 122 nt, Human
caaugugcuggccauggagaccucaguuaauucuacagggaacucuggagcugggauggcccuccagagcuguccuacugugagagagcugggccuuugcaucccccaucagccagucauug

SEQ ID NO: 4100885 - RNA, 130 nt, Human
caauguuuaauaaauauuuuuaagugugcguuuuuccuuucucaagagccggcaauccauccugauauugccacaucaaugugcugagcuucuucaaggagaucaaugugcagacuguguauuaggcuug

SEQ ID NO: 4100886 - RNA, 63 nt, Human
caauuagcauuucccauauaaauuucauacuauaaaggagguuguaauggauaaugcaaauug

SEQ ID NO: 4100887 - RNA, 72 nt, Human
caauuagucacaaagucacaauaauuaaccuacaauuagguuaaauauaguugcuuuccagggaacuaguug

SEQ ID NO: 4100888 - RNA, 129 nt, Human
caauucuuauaauuauaugggucaccuggaccauuuuggucugggcaaauccuucugaucuguagucagcuggugguuuggcuggggcugggugaucuaggauggccucacucauaugucugguaauug

SEQ ID NO: 4100889 - RNA, 69 nt, Human
caauucuuucagcugcauuugugguucaaauagaagcaaggaaugcuauaaauguucugacaaggauug

SEQ ID NO: 4100890 - RNA, 55 nt, Human
caauugcauauauaugaggccaugugaaguuguuccaugguucauuuaugcuuug

SEQ ID NO: 4100891 - RNA, 75 nt, Human
caauugcugguauuuuauacacacuuagacuauacaugauguacucagugcuguguaaauguauuacaguauuug

SEQ ID NO: 4100892 - RNA, 115 nt, Human
caauuguuccuaacuuccagugccacuuacagaauuggguggcugguugcagcucuagcuaccugugccugcugcaaaccugccaccugguggacauugcugaagcugacaauug

SEQ ID NO: 4100893 - RNA, 64 nt, Human
caauuguuuuccauuuuuguugugucagccuggcugcagggcaaauguggaaaggagaguuuug

SEQ ID NO: 4100894 - RNA, 85 nt, Human
caauuuaauauguuuguuauacagcaacugcagagcacagaauuuuguacucuuuggauguuuaugauaagguacacauuauuug

SEQ ID NO: 4100895 - RNA, 74 nt, Human
caauuuauucucacagauauuugcuucagguggggugacuccacuuuauguuugauaucuaugggucuagguug

SEQ ID NO: 4100896 - RNA, 104 nt, Human
caauuuccucccucugagugggaaggaacuucucuuggaaggaguuuucuugcuuuauuuccuacaauuagagccucuuuucuacuugacuuaaggguuuuuug

SEQ ID NO: 4100897 - RNA, 74 nt, Human
caauuucuuucucuauuuuuauuaguuaggucuauaaaaagaccagaacaucuugaagauugggaaagcauuug

SEQ ID NO: 4100898 - RNA, 87 nt, Human
caauuuugcaucauucaauguaagcauauauaccauucuauuauauucuagaugucuaugugaaacuacagugagggugugaauuug

SEQ ID NO: 4100899 - RNA, 119 nt, Human
cacaaaaaaaguguaugaguccucuguugcuucucagggccugaugcagucuuagaucaugagugcccagccugagaaaggaguuuggaggggaaaauaacuuauuuggagaacaugug

SEQ ID NO: 4100900 - RNA, 93 nt, Human
cacaaaaacaguuucacugcugauaacccagcagagugaaccucaaaguuggcucugcuaauauuguaguaccagagcauccacuguagugug

SEQ ID NO: 4100901 - RNA, 116 nt, Human
cacaaaagggaccucacaucaaagcccauuacagcuaggcagacugagcucuagggccaaggguuugcccugcaggucgcugcugggguaagggugaggguggggucccuccagug

SEQ ID NO: 4100902 - RNA, 77 nt, Human
cacaaagacagaauuagcuuuucugaaacaccuugcugacgccuccagcauucugaagggcuaagugucuauaagug

SEQ ID NO: 4100903 - RNA, 61 nt, Human
cacaaagucugcagcugcuguacauggacaagaagcccacaagcagcuagaggaccuugug

SEQ ID NO: 4100904 - RNA, 109 nt, Human
cacaaagucuuuauauuugaaaaaugcuuuauaaucauuuuaauuagugguuucucaccaaagcccuggaugugguauuauuggcaccauuuucugagaagaccgugug

SEQ ID NO: 4100905 - RNA, 68 nt, Human
cacaaaguugcccuuuucuggaaugcaaggcuccuaaauuagcugcaggcuggaggagggacuaagug

SEQ ID NO: 4100906 - RNA, 77 nt, Human
cacaaaugacugaaacgacuguucagaguguccccgccagcugagcaguaguuucaaaacaagaaaagucaucugug

SEQ ID NO: 4100907 - RNA, 104 nt, Human
cagcagugucaugcucuguccugucuucaggacccggaauuuuggggucugagugacaccagcauucacuggaccugcagagaaggacaaagcugaugcuacug

SEQ ID NO: 4100908 - RNA, 105 nt, Human
cagcaguuugggaagccgaggcggguagaucaccugaggucaggaguucgagaccagacuggccaacauggugaaaccccgucucuacuauacacaaauuagcug

SEQ ID NO: 4100909 - RNA, 60 nt, Human
cagcauaggacaggguuucaucuuucagcaucuucaacgcaugauacccggucuaggcug

SEQ ID NO: 4100910 - RNA, 56 nt, Human
cagcaucacagugcccgaagucaacuacugaauuuacuucucuggacuagaugcug

SEQ ID NO: 4100911 - RNA, 130 nt, Human
cagcaucucaauuucucaucugauuuguauuagucuucucagauguagaaagauugugagguuagcugggguuaugucacacagcugcucuguuuuauugagaaggcugguccagggaagcugagagcug

SEQ ID NO: 4100912 - RNA, 75 nt, Human
cagcaucuccacaaugggguggucggguugaucuccacgcgcuuuuuggccaccauguagcccauuagagaguug

SEQ ID NO: 4100913 - RNA, 56 nt, Human
cagcaucucguggcuggauagagauggcacagccccagccuccauguagauagcug

SEQ ID NO: 4100914 - RNA, 66 nt, Human
cagcaucuggcaccuggcagcacauugacagacauuuguggagugagugcugggcugaggcugcug

SEQ ID NO: 4100915 - RNA, 92 nt, Human
cagcaucuuaucuuucaauguguucuuuauucauugauucaggguaucauuccugggguauauaggugaauaugacgaugauaauaugucug

SEQ ID NO: 4100916 - RNA, 73 nt, Human
cagcaucuucaugugcaucucccaaacccuccaucucagaaauucagggugcuauuggugugugaugauguug

SEQ ID NO: 4100917 - RNA, 58 nt, Human
cagcaucuucuccaaagcugccuuagagaauuuucuuggugauuuuagagaauugcug

SEQ ID NO: 4100918 - RNA, 57 nt, Human
cagcaugcaggggccugagcaccuguggaagccaugagcucuggccucuggaugcug

SEQ ID NO: 4100919 - RNA, 58 nt, Human
cagcauggaaguuauguaccuuuuuucgaaugagaagaaaacaaugacuugccagcug

SEQ ID NO: 4100920 - RNA, 64 nt, Human
cagcauggagggacuccugcuucuaguaaugaugugcuaaggagcuggaaugguccuuuugcug

SEQ ID NO: 4100921 - RNA, 65 nt, Human
cagcaugggguggugggcaaccucaggugcuggcaucuggcucuaggaagccauuacccucccug

SEQ ID NO: 4100922 - RNA, 57 nt, Human
cagcauguaagccacugcccuguaacuuucugcacaauugcuagggcaugcauggug

SEQ ID NO: 4100923 - RNA, 66 nt, Human
cagcauguccaaauuuuucacauguagaauaugaucacucuguuuccauggaggaauuggaugcug

SEQ ID NO: 4100924 - RNA, 55 nt, Human
cagcauguggugauugggacugaacauuuucagacugagggcaucacauacguug

SEQ ID NO: 4100925 - RNA, 89 nt, Human
cagcaugugucugaaucgcuuccuagagggcuuaugaaaacacacauucccgggcaccaccuucagggguucugauuuaguucguguug

SEQ ID NO: 4100926 - RNA, 79 nt, Human
cagcauguugaaaccugaagaaaauauuugcugagaacauucaguucgauaauuuuccucaauucagugguuuaggcug

SEQ ID NO: 4100927 - RNA, 70 nt, Human
cagcauuagaagggaccucuggggggcaacuaggccaugccccauccccaucacucccauuuuacagcug

SEQ ID NO: 4100928 - RNA, 55 nt, Human
cagcauugaacacaguacuaagagagcaggacuuucucucucuuguucacugcug

SEQ ID NO: 4100929 - RNA, 64 nt, Human
cagcauugcccuuuuucucagagaugugcaucuccucucagaaaaacuuugaggguaggagcug

SEQ ID NO: 4100930 - RNA, 74 nt, Human
cagccaaaauguggggcuggaggcaggagacugugucauucagaaucugugccugcuuccccacccaugggcug

SEQ ID NO: 4100931 - RNA, 66 nt, Human
cagccaacauugugagcagauuuuuaucuagcaguugucuaucugcugucuguguauuuguugcug

SEQ ID NO: 4100932 - RNA, 61 nt, Human
cagccaacucccucucauugagcauacacuuuugagaugugccagggaagagaguuggcug

SEQ ID NO: 4100933 - RNA, 82 nt, Human
cagccaaguuagaaaauagagcagcucggggcugugucgaugugacaacugaagucucuuuuguucucucaggcagggucug

SEQ ID NO: 4100934 - RNA, 60 nt, Human
cagccacaaugcaauuguaagguguguuucagacacaagggccuauaguguauuuagcug

SEQ ID NO: 4100935 - RNA, 58 nt, Human
cagccacucggccauaaaggcuucauucuuuauauuguggcagggcugggaugggcug

SEQ ID NO: 4100936 - RNA, 59 nt, Human
cagccacuuccccucuaugggucucaguuuccucaccuguagaaugggugaagggguug

SEQ ID NO: 4100937 - RNA, 63 nt, Human
cagccacuucgagcuuccugauuaauuggugagagacaaucagggcacauucugcaguggcug

SEQ ID NO: 4100938 - RNA, 76 nt, Human
cagccagacaucuccagggagguagcccagugcuaugguuaagagcaugggcucuggccuuggaccuaccugggug

SEQ ID NO: 4100939 - RNA, 55 nt, Human
cagccagcuucagauccaagccacacuccgaggcugcccugucuguggcugucug

SEQ ID NO: 4100940 - RNA, 108 nt, Human
cagccaggagggcugacagugcuggaguggaccaguccgcggagcuccgggggucugaaugcuccagggguguguggauggcaauggccaggauggcccuccugguug

SEQ ID NO: 4100941 - RNA, 92 nt, Human
cagccaggauaccacgcaauguuuuaaguuucuuuauucuuauguacuaugacauuacagaacugucuugaaauuuuggugugauuuugcug

SEQ ID NO: 4100942 - RNA, 101 nt, Human
cagccagucaaacuccagggugacucugucugaccagauuccagcauccucucuuaguaucuguucuaaccacuaggcgugccuuggccuuugccugguug

SEQ ID NO: 4100943 - RNA, 79 nt, Human
cagccaucguagggucggcugcccaugcgcugguaccaaacuaagccaucacaggggccggcuguccgugcccugguug

SEQ ID NO: 4100944 - RNA, 65 nt, Human
cagcccaagaugaaugaugaaguguguucaggagugaaccacauucuagguaaucaguuuggcug

SEQ ID NO: 4100945 - RNA, 60 nt, Human
cagcccacgucagggccacucaaccaugcgcucugggaggagugggcugagauggggcug

SEQ ID NO: 4100946 - RNA, 68 nt, Human
cagcccagagggguuugaggacucccgggcgaagucuucuagucccuugacacacccucucagggcug

SEQ ID NO: 4100947 - RNA, 55 nt, Human
cagcccaggacugcagguguuuuaagcauuuuacuucacuugcccacuugggcug

SEQ ID NO: 4100948 - RNA, 58 nt, Human
cagcccagugcacgcccguuuccacgacuuuauguuggaaugagugugcaugggguug

SEQ ID NO: 4100949 - RNA, 74 nt, Human
cagcccaugucugacagggugggggaacaggcaacagucaaagggccacgcuucugcccaugugggaugguuug

SEQ ID NO: 4100950 - RNA, 74 nt, Human
cagccccuccuugcaguuguucaaaugagccagauccuguaugucagggcucagggacugcagaaaggaggcug

SEQ ID NO: 4100951 - RNA, 122 nt, Human
cagcccuaucucccugucccugguggccucugcugaauggguuccuuggucaacagauagcagccccucuaggccaguggaggacccauggagaggccagcagggacuggcggaaguggcug

SEQ ID NO: 4100952 - RNA, 67 nt, Human
cagcccuccuacccugccaggcacacucauaaaaggccuggauaccagacagggagggagaaggcug

SEQ ID NO: 4100953 - RNA, 69 nt, Human
cagcccucugagcuagucaccaucauuaacugagacgguggcuaagacgguggaggcucagagagguug

SEQ ID NO: 4100954 - RNA, 84 nt, Human
caaacagcuuacuccauaggcagacucuuuuuggagguccguagcuugccuuuccagugauggggucuggcugguauuuguuug

SEQ ID NO: 4100955 - RNA, 56 nt, Human
caaacaucugcaccuugaccggacucgccaucccgccgugggggugcaggugauug

SEQ ID NO: 4100956 - RNA, 78 nt, Human
caaaccaucagcuuaaauucuaggccugggcugcuugcggaaaacuucccagaggagcauggccuugagaaugguuug

SEQ ID NO: 4100957 - RNA, 77 nt, Human
caaacccaggaagccugcaggugacugcucaccagagggcgaucucacacagcaaaccugcagccuucugaggucug

SEQ ID NO: 4100958 - RNA, 92 nt, Human
caaaccuccccagugugaccucagccucccuccccuccucugggcuugcucugguuucauggauggccgggaggugaugcaccugugguuug

SEQ ID NO: 4100959 - RNA, 59 nt, Human
caaaccugagaacaugugcuguguacuacuuugugguccagacaugagucucagcuuug

SEQ ID NO: 4100960 - RNA, 64 nt, Human
caaaccuguuagaggucaucgugaagguacauuugucaaggcaggaggauauucuaacaguuug

SEQ ID NO: 4100961 - RNA, 75 nt, Human
caaaccuuauguccaggcugcaccccagacccauuaaaucaggaucucuggggaugggaccuggcauaaguuuug

SEQ ID NO: 4100962 - RNA, 66 nt, Human
caaaccuuccuuugaugcugguaccuaagcaccaaacaauagauaccagcaucaaaggaagguuug

SEQ ID NO: 4100963 - RNA, 63 nt, Human
caaacgaccucuggcuucuugcccuggccaaccacagaggacaaugugaggcgaguuuguuug

SEQ ID NO: 4100964 - RNA, 60 nt, Human
caaacuccuacaacaccaugcaucucuauccugguagaugucucugggcaguagggcuug

SEQ ID NO: 4100965 - RNA, 63 nt, Human
caaacucuggagauguuuaugcaugugaaagccuuacauaugcaggaaauauaucugagugug

SEQ ID NO: 4100966 - RNA, 58 nt, Human
caaacuguaugacccuaggccggcaauuuaccucuccuggccucaguguccuuguuug

SEQ ID NO: 4100967 - RNA, 93 nt, Human
caaacuugcagggaaggaggaugcucuggccuugagguucgaacucccgccccggggaggcaagagccaggcaccccuuucuccuaauguuug

SEQ ID NO: 4100968 - RNA, 78 nt, Human
caaagaccugagucagaagccugucugacuuguuuggggaauaacaaggaggccagugcagcuggaacagaguaaaug

SEQ ID NO: 4100969 - RNA, 110 nt, Human
caaagacuguaaagguaggccagaugacaaugaaggaaaauguuuugcuuguuauuuaaggccauauauuuuaaucucauaauuugccugaacuuaauuauagugcuuug

SEQ ID NO: 4100970 - RNA, 58 nt, Human
caaagaguaguccagugcugagcugcacagcugcaauucuggacauagucucaucuug

SEQ ID NO: 4100971 - RNA, 73 nt, Human
caaagaucucagaugcccuugcaucaccucccugaagagggcgggugaagcuuuggugucugcagagaauuug

SEQ ID NO: 4100972 - RNA, 79 nt, Human
caaagauuuugagucuuguaugauuugguaguuaguauuaauuaacugaacugauaacauacacggaguaaaaaauuug

SEQ ID NO: 4100973 - RNA, 83 nt, Human
caaagccaugagaacagcugaguuuccaagucugccaaagaaugacugggcaaggccugcagcucagugugucucuguuuuug

SEQ ID NO: 4100974 - RNA, 85 nt, Human
caaagccucagcccaccugguguggggcucuagggcaagcauaccugucagaauuagcccgaaccagguggaaaugguggcuuug

SEQ ID NO: 4100975 - RNA, 68 nt, Human
caaagcguuucuuucauggcucuguggcuuggucuagcuggguccagagaggcaggaggcuacauuug

SEQ ID NO: 4100976 - RNA, 89 nt, Human
caaagcuucugguagguauucuggaaaagcgauaaaccauuuaaucaccaccacugauuaagcuccuucuauaugccaccccuguuuug

SEQ ID NO: 4100977 - RNA, 76 nt, Human
caaaggaggagucaguugggcugcuuugacauugcaugggcaggcgcuugaagacaucccauuggcucuagcuuug

SEQ ID NO: 4100978 - RNA, 64 nt, Human
caaaggagucuuccagagccugacaagaugcuccccuugaccaaauucuaggcaggcucuuuug

SEQ ID NO: 4100979 - RNA, 74 nt, Human
caaaggauucuggagaggaacagaaagguaaagcauaauuggacaccuuugugaguucuccagaacacccuuug

SEQ ID NO: 4100980 - RNA, 55 nt, Human
caaaggcaguuacugaaugaaggcaacaucccaccaaucauuuugucugccuuug

SEQ ID NO: 4100981 - RNA, 63 nt, Human
caaaggcuggauucagagaggugaauucuaaauuacuuucgccaucuggcacuagagucauug

SEQ ID NO: 4100982 - RNA, 69 nt, Human
caaagggcagcccuugaguugugccagguccccauauuuugauaugaacauugaagaggagccccuuug

SEQ ID NO: 4100983 - RNA, 58 nt, Human
caagauucuaguugagguucaaggucaaucucaaaugcuaccaccuccaagaaucuug

SEQ ID NO: 4100984 - RNA, 81 nt, Human
caagauugaugucuuucuuauggucuguuggcuaaucccaguaugaauggccaguucagcuagaagaaacaaacagucuug

SEQ ID NO: 4100985 - RNA, 80 nt, Human
caagcaccagcucaccuggacucauccauagaggugacaucuuaaucaccagacgcgugggucugaggaagcggagcuug

SEQ ID NO: 4100986 - RNA, 63 nt, Human
caagcagaaaucauuauaugguauugcugauaggguucacaggcuauguagaugauuuuuuug

SEQ ID NO: 4100987 - RNA, 121 nt, Human
caagcaggcagguugugguuacuguucuuguggggaagucaugcugagcacauucuguauuuuauauaauacauaauaaguuuugucuguucucugugaauauuuagcaaugugugguuug

SEQ ID NO: 4100988 - RNA, 81 nt, Human
caagccccuugcuguggggcucucuguuacuguguuccuugaaucacacccuuucagucagagagcucucagcauaguuug

SEQ ID NO: 4100989 - RNA, 55 nt, Human
caagcuggcucuuaugcaaaaagccacacacgcuagguguaugggagucagugug

SEQ ID NO: 4100990 - RNA, 88 nt, Human
caagcuuaaguuuuucuacaacacuucugaaucucccaaguugaauagcugacagauucaggagaguugugaaaaaaacuuaagguug

SEQ ID NO: 4100991 - RNA, 81 nt, Human
caaggacguguugaacuagcucucugcagccuccuuggaggaugugauccuaugggagggguaggaguauucagguccuug

SEQ ID NO: 4100992 - RNA, 62 nt, Human
caaggacucugcucuguauuucacuguauuccuuacagugcuuagcacagaguagacgcuug

SEQ ID NO: 4100993 - RNA, 61 nt, Human
caaggacugugggaggaaaugcuguagagaagcaggcagggcccugaccacacaggccuug

SEQ ID NO: 4100994 - RNA, 60 nt, Human
caaggagauuuuuuucugaagccucuguuuguguuuggcuuauagauggcgaucuucuug

SEQ ID NO: 4100995 - RNA, 57 nt, Human
caaggaggugggaaagcagagccugcuuuauguugcagcucucuuuuccccucauug

SEQ ID NO: 4100996 - RNA, 55 nt, Human
caaggauagggccucugacuuccagucucagugggaagauagaauccuaacuuug

SEQ ID NO: 4100997 - RNA, 59 nt, Human
caaggcacagggccacuuucccaguaaaaguauuuucagcuuuuggggccuuguccuug

SEQ ID NO: 4100998 - RNA, 90 nt, Human
caaggcauauugaagggaagccuguccaaacugccucauuaaagagugaaauggcaaggcagagcuuuuuaacaucuuggauauaucuug

SEQ ID NO: 4100999 - RNA, 62 nt, Human
caaggccuuugccccgauacaggaaugcauccuuaugcuccuguaucugggcaaaggccuug

SEQ ID NO: 4101000 - RNA, 84 nt, Human
caaggcuauagagugguugagagcaggcucucgggggccaggccgccuggguuccaaaugccagcucugccacuuccugcugug

SEQ ID NO: 4101001 - RNA, 56 nt, Human
caaggcugcacuguugccauagccuccuacccguuaccugccacauugcagacuug

SEQ ID NO: 4101002 - RNA, 58 nt, Human
caaggcuggaguacagugcaguggugugaucauaccucauuguagccuccaguucuug

SEQ ID NO: 4101003 - RNA, 64 nt, Human
caaggcuguguccaccuucugugagcuacuuaagguauauaggaaaggaguggucacaaacuug

SEQ ID NO: 4101004 - RNA, 55 nt, Human
caagggaccugagauggucucucuugaaaucaacagcuaugguaggacucccuug

SEQ ID NO: 4101005 - RNA, 77 nt, Human
caagggcaccuggggaaaggugggcacagauggagaagucgggacucgaguucuguccaccuuuuugggugaccuug

SEQ ID NO: 4101006 - RNA, 91 nt, Human
caagguaguuaacuucaccuagaagcacagguuaaaggcauugcaagagucacugugcugguagccuaguuucuuugaaaaacugcacuug

SEQ ID NO: 4101007 - RNA, 58 nt, Human
caagguaguucuggucauugacucacgaauugagugguuuuagauaaagcuguccuug

SEQ ID NO: 4101008 - RNA, 72 nt, Human
caaggucucaaaggagguuuggagaccaaauggggcuucaguuccccaggcucugccaggcccuugaccaug

SEQ ID NO: 4101009 - RNA, 71 nt, Human
caaggugguuauuaugagaagguauggugacuugggauaaauucugucccauaaccgacucaacuuucuug

SEQ ID NO: 4101010 - RNA, 81 nt, Human
caaguaaacauuuuauugacaauaggcaacugaggagaaaauuaacccuuuuuauaguuaauuguaaguggaaguugcuug

SEQ ID NO: 4101011 - RNA, 82 nt, Human
caaguacucuacagauucauugcuacgguggucuccauuuacagagguggcagcuguaagaugagugaauguaaggagcuug

SEQ ID NO: 4101012 - RNA, 74 nt, Human
caaguauacuagugcagcauguauuuaguuuucauuaauuuggaaaaaacauacuuugcuacauuguacauuug

SEQ ID NO: 4101013 - RNA, 78 nt, Human
caaguauauacucagggaauuauuucuguccuauugauaauuuagaaggauuugauuggcucuacugaguaguccuug

SEQ ID NO: 4101014 - RNA, 125 nt, Human
caaguaucacagacugggaggcuugaauaacagaaauugauuucuuacaguucuagggggcuggaaguccaagaucaaaguccugauaggauuuaguuucuguugagggcccucuuucuugcuug

SEQ ID NO: 4101015 - RNA, 65 nt, Human
caccucgcaggcgcagcaccaggugcaggguggacuccuucuggauguuguagucugagagagug

SEQ ID NO: 4101016 - RNA, 94 nt, Human
caccugcaacuuugccaucuggggagggugucacccuguuacguaaauggggcauaacuggggacacuucucuauggagagcaauuguucugug

SEQ ID NO: 4101017 - RNA, 57 nt, Human
caccugcacauccuugagcucuagcgaugauauguuuagggcucucugugucaggug

SEQ ID NO: 4101018 - RNA, 63 nt, Human
caccugcccguuugcuucagagacauuccaggggcuucacuucucuaggcaggcaggcucgug

SEQ ID NO: 4101019 - RNA, 112 nt, Human
caccuggagaacuuguuaaaccacagacuacugggcuccacucccacaguguucuauucagaaggucuaggguggagcucaaauauuugcauuuuuaacaaauucccaggug

SEQ ID NO: 4101020 - RNA, 55 nt, Human
caccuggcuggaagugcuccgggcagggccuggacuccuucaccuccagcaggug

SEQ ID NO: 4101021 - RNA, 111 nt, Human
caccugggccccauuaccucuguaauccaagguuccuacuguugcacuccauucuguccaggacucagcacagcacugggaacccaggaggauuaaagaagggccagggug

SEQ ID NO: 4101022 - RNA, 59 nt, Human
caccugggcuaaacuaugcagggcuuuguaggccaugguaagguguuaggcuaagggug

SEQ ID NO: 4101023 - RNA, 59 nt, Human
caccugggcuuucucugggacucaccuaggaguuccccagugugguagguccacaggug

SEQ ID NO: 4101024 - RNA, 96 nt, Human
caccugguagaucagugccucuuagcaaaugccugugcugcugugcaagguacaagaguacgucagcugggcaucugcagaugauggcuccaggug

SEQ ID NO: 4101025 - RNA, 81 nt, Human
caccugguauccugggcccugaagugauugugaguugagggcaaucccugccgagcucacgccaguugggccugccgugug

SEQ ID NO: 4101026 - RNA, 58 nt, Human
caccuguacccacuucccccagcugaacagcagccuuucagaggagguggguaaggug

SEQ ID NO: 4101027 - RNA, 56 nt, Human
caccugucagaggaucucccgcugcccaaccaguggcauuucuauacuggcaagug

SEQ ID NO: 4101028 - RNA, 85 nt, Human
caccugugcuuucaaggagcucagaugccaaggccagguuuggggggcacaggcugccugaggcuccuuguagagaguggaggug

SEQ ID NO: 4101029 - RNA, 91 nt, Human
caccuguggcuguggccggaccacguggccaugcugcaguucaucagcagugggcugcccaagguggccaugccguccaccauccacugug

SEQ ID NO: 4101030 - RNA, 90 nt, Human
caccuuagauuccucauucacuuugaaauaaacgacuucaaaaagacugaauuugguuaaccugcaaaugugagugacagugucaaggug

SEQ ID NO: 4101031 - RNA, 67 nt, Human
caccuugaacuaauagguaucuuguacugaauuuuccccucuucaguacuguuaguuauucaaggug

SEQ ID NO: 4101032 - RNA, 81 nt, Human
caccuugccaacacugagcauuaucuuggauuuuguaucuuuaacaggaaauaaaugguaaugcauuuuaaguuugcagug

SEQ ID NO: 4101033 - RNA, 67 nt, Human
cacgaaggauuggagcagcugccauggugggccuggccagccaagaaagcagugcuccacacuggug

SEQ ID NO: 4101034 - RNA, 76 nt, Human
cacgaccaucucuccacggcagcucucgggauaaauuggccuccagaggcagccgggggagaacgagcugguagug

SEQ ID NO: 4101035 - RNA, 68 nt, Human
cacgagucuuugcccuucuauuaugguuggaguuuucuuagcagcuuccagagagggcaguucuugug

SEQ ID NO: 4101036 - RNA, 67 nt, Human
cacgcgugcuggcuuuuugggugagccccugggguccucacagcagcucugagaggccagcacugug

SEQ ID NO: 4101037 - RNA, 81 nt, Human
cacgcugcccugugcaucagguaaguguaauauauagagaaaaauuucauguuaagugacuugccagaguaugcaguugug

SEQ ID NO: 4101038 - RNA, 75 nt, Human
cacggaccuggccuuucagguacaccagggaugggccucucucccucgucuuagguucugccggaagccagggug

SEQ ID NO: 4101039 - RNA, 75 nt, Human
cacggcucuauucaugggugggccaccuggcacugugcagaugccacuuccagguuccacccaagacucccugug

SEQ ID NO: 4101040 - RNA, 127 nt, Human
cacgggagcauggugcugguuccuugggguucccugccuggcugucagcagagccuaauagaucugggcucuguuagguggggcaggauggacuagguuggcacagccagcccucagcuguccccug

SEQ ID NO: 4101041 - RNA, 69 nt, Human
cacgguuuuauuuuaguuuuagacauaugacaaaucaugccauguuugaaauuguaaguauauuuugug

SEQ ID NO: 4101042 - RNA, 63 nt, Human
cacgucagagccuggugcaggaagccacauaaggucuugcuguguaacuccuggccuggucug

SEQ ID NO: 4101043 - RNA, 70 nt, Human
cacgucgacacauaugcguauaguuuagucguuuuaacugcuguuaaagugugcgcaugugggagaggug

SEQ ID NO: 4101044 - RNA, 130 nt, Human
cacgugcagcaaggaacagggaaccgcuuaaugauuaaucacugucaaccuuuguucucguuaaagacuugauuguuggacaaggcuuguaaugagggacuguuuuggugucuguugcuaugagauugug

SEQ ID NO: 4101045 - RNA, 130 nt, Human
cacguugauagagcuaaugaaagcugucaaguuugaaaugucucuggauuugcuuuuggcuuuugccugaaaguacaugagauucaaggggaauauuucaccugcgacuuugauuuggaaaauugaaaag

SEQ ID NO: 4101046 - RNA, 74 nt, Human
cacguuugcagucccagcugcucagaaggcucagugagaggaucccucaagcccaggaguuggaggcugcagug

SEQ ID NO: 4101047 - RNA, 116 nt, Human
cacuaacaauugcacuucuauaacuguguuucugcuuccucuuuugacuucuggcaaaaagaaaccaggagcaacuagccaggaugcagagggguuuuuuaaaucaacuguaagug

SEQ ID NO: 4101048 - RNA, 59 nt, Human
cacuaauccugugaaaugcuuugcgauggugcuaaaccauuuuggguauuuucagagug

SEQ ID NO: 4101049 - RNA, 128 nt, Human
cacuaaucuucacaauuuagagguacacagagaaacuagagucagaagccaggaacugccuguuggcuacagggcagcaauuugguuccuggaaguuuguuguuuuucucaaaauuggaaguacauug

SEQ ID NO: 4101050 - RNA, 70 nt, Human
cacuaauuacugcugauauaagaaaagauuaacuuuuguaaauuaaugucaaauaguaguaguaauagug

SEQ ID NO: 4101051 - RNA, 58 nt, Human
cacuacagguuucugaagcaauuuuguggaucucuauaguucugcuuagaaaucagug

SEQ ID NO: 4101052 - RNA, 74 nt, Human
cacuacaugcaaggcacuguggguguggccggacauacagaagaacuugucccugcacuccaaguguuguggug

SEQ ID NO: 4101053 - RNA, 75 nt, Human
cacuagacugugggaucuggaaggcaaaggcuguguuucauugguuuauugucaaucuauucccagggucugaug

SEQ ID NO: 4101054 - RNA, 66 nt, Human
cacuagagccuuccuagcauuugcauuagacacguuugugccuugcagccacucaggagcucagug

SEQ ID NO: 4101055 - RNA, 65 nt, Human
cacuaggcuggagugcaguggcuccaucucagcucacugcaaccuccgccucccggguucaagug

SEQ ID NO: 4101056 - RNA, 84 nt, Human
cagaaaauaaagcugauugucaccauuaguguuaccaauguauaugacacagcagguaacacaggugcaguuuuaaaguuucug

SEQ ID NO: 4101057 - RNA, 77 nt, Human
cagaaaccuggcaaacaggcuuuuaagucaauagguuuuauuugaggacagcagcagucugcgugugcagguuuuug

SEQ ID NO: 4101058 - RNA, 58 nt, Human
cagaaacuagauuuagacacaaaucuguaaacugacaguuguguuuuuuauguuuuug

SEQ ID NO: 4101059 - RNA, 59 nt, Human
cagaaacuucuugucucacaguucuggaagccagcgcugcacucccccaagagguucug

SEQ ID NO: 4101060 - RNA, 82 nt, Human
cagaaagagaaccaaagagccauauaugcagcuagaccuugugagucaugcuggguacuauggcugcuguuuucucuuucug

SEQ ID NO: 4101061 - RNA, 65 nt, Human
cagaaagcaagccauucacugucaccuauaacucuugguuaacagggaauggcuuugcuuuauug

SEQ ID NO: 4101062 - RNA, 56 nt, Human
cagaaagcgggaugcagcauguggcuagcugugcagcaauaacuccuugcuuucug

SEQ ID NO: 4101063 - RNA, 64 nt, Human
cagaaagcucaggaaagggauauguuacaucgugacucagugauacacucccugcugggcacug

SEQ ID NO: 4101064 - RNA, 55 nt, Human
cagaaagcuugguacaauaugcugauuucuauugcuuuucuguauuugcuuucug

SEQ ID NO: 4101065 - RNA, 74 nt, Human
cagaaaggcugcugauuucugauuuccuacguuccaccugaagguuggcagucucagucagauggcccucguug

SEQ ID NO: 4101066 - RNA, 64 nt, Human
cagaaagugcagcuuuuucuuuacaugauuuucaaaaaucuugugcgauugaacugcaugacug

SEQ ID NO: 4101067 - RNA, 118 nt, Human
cagaaauaagauggauggauguauagacaguagaguaaaugguuagauaauugauaagcuaaaaauguuaauggugaaaucuaagucauguacacuguaaaauucuuucauuuuucug

SEQ ID NO: 4101068 - RNA, 95 nt, Human
cagaaaucuagagugggcauaugaagucucaagaagugcuugccaaauuggguuuaggaccccugaggccucacuguagucccuccuggacucug

SEQ ID NO: 4101069 - RNA, 68 nt, Human
cagaaaugaagcaguuuucaucaaguuaugcucagagacagcuuauuugguugcuugcuucauuuuug

SEQ ID NO: 4101070 - RNA, 67 nt, Human
cagaaauggguuugauucucagccaagggacagcaggacugguagagagugucaggccacacagcug

SEQ ID NO: 4101071 - RNA, 55 nt, Human
cagaaauggucuguucagcuuagagugaauguucugagcuugagauccauugcug

SEQ ID NO: 4101072 - RNA, 56 nt, Human
cagcccugcagcuggaucucacacaucccaggaagugagucucccgcugagagcug

SEQ ID NO: 4101073 - RNA, 58 nt, Human
cagcccugcugacacugucugacccaguuugacaaucuggauagaaaucauaggguug

SEQ ID NO: 4101074 - RNA, 72 nt, Human
cagcccuggauucuccauugugccagugucauuuuuucaacuguguauuaggcauuugaggauaaacugcug

SEQ ID NO: 4101075 - RNA, 63 nt, Human
cagcccugggaguuggggccgagcuggguuugugucucuucuugccccaucccucuccugcug

SEQ ID NO: 4101076 - RNA, 75 nt, Human
cagccggaaacuccuuugagagccucaacccaaucucacaacuguugacggacuuuagaaagaguuucuucccug

SEQ ID NO: 4101077 - RNA, 74 nt, Human
cagccguuggucucuugcagggcaggcuacuccacucaugcucuggggagaggcugauccugcagagaaugcug

SEQ ID NO: 4101078 - RNA, 64 nt, Human
cagccuagugcacuggcagggcucauugucugggaagacaccgaggucuaggcagcugggacug

SEQ ID NO: 4101079 - RNA, 67 nt, Human
cagccucaggccccuccacuucucagaucaggucccagaccugcccaugaaaauggggagcaggcug

SEQ ID NO: 4101080 - RNA, 73 nt, Human
cagccuccuguuucagcuacuguuccaugcagaggucguuguuuccuaugcaugcugugauacaggaagguug

SEQ ID NO: 4101081 - RNA, 65 nt, Human
cagccucugcugcuguugagcaccgucguggagagcgggcugcauuguuagcauugcugaggcug

SEQ ID NO: 4101082 - RNA, 68 nt, Human
cagccugacaugguuuggcaaaagccacucauggucgucucugaggcuccagccaggccagcagcuug

SEQ ID NO: 4101083 - RNA, 73 nt, Human
cagccugagaaguugauucuaaaauaggaggaaaugauucaauuauuuccucucaagggauuacucaauguug

SEQ ID NO: 4101084 - RNA, 73 nt, Human
cagccugagguagauguggggugagguugcuaacagucuaguggauuuuucccacaugugaauccucagguug

SEQ ID NO: 4101085 - RNA, 72 nt, Human
cagccugagguuuuucggucuuaacuggaaagggacacaaagaggagagacccugguaaacacuccaggcug

SEQ ID NO: 4101086 - RNA, 85 nt, Human
cagccugcgaggcuccucauucaguaugcuguguugugugguuagcuguuccauagucauacugaaaguggcuucucagaugcug

SEQ ID NO: 4101087 - RNA, 87 nt, Human
cagccuggacaacauggugauacccaguuucuacuaaaaauacaaaaauuagucgggcauggugaugugcaccuguagucccagcug

SEQ ID NO: 4101088 - RNA, 56 nt, Human
cagccuggacagcgaccagaguaguggcucgaccgcuucuggcuccugccaggcug

SEQ ID NO: 4101089 - RNA, 129 nt, Human
cagccuggcuuagccagcuugcucucugucccuguccuuuguucccugucucuggcuccuucuccuacaauggcacaagacagaaaaggcaaagugcugagguauagagggcaaguggcuccgaauuag

SEQ ID NO: 4101090 - RNA, 61 nt, Human
cagccuuagcagauaaaaaccuucagaaaacauuuuugaaaggugcugugugcugauucug

SEQ ID NO: 4101091 - RNA, 65 nt, Human
cagccuuauguugcuacuucgcuugucacauagacauaaacuuggcuagaugguauauaaggaug

SEQ ID NO: 4101092 - RNA, 67 nt, Human
cagccuucacaaagcaaaugugcuuugugcacuuccuugccagagcagauguggccuugguggacug

SEQ ID NO: 4101093 - RNA, 67 nt, Human
cagccuuuuccauguauuguugugcuguaagugccaugcacauauuuccuauauguggaaaggguug

SEQ ID NO: 4101094 - RNA, 77 nt, Human
cagcgauuuggaaggucuguucuaggugaggguuuggugaagauuuucacccugaauauauugauccgaaaaugcug

SEQ ID NO: 4101095 - RNA, 80 nt, Human
cagcgcguuuggcucuugcaagcccugaagggcuggaggcuugugccugccagcuccgaggagcugcagcccaacuucug

SEQ ID NO: 4101096 - RNA, 62 nt, Human
cagcggccuccccugugucccugugaccguggcggcaaagacggacucaggagugcaaguug

SEQ ID NO: 4101097 - RNA, 59 nt, Human
cagcgguggcaaggugacugugcugacccacuguaacacuggugcucuggccaccgcug

SEQ ID NO: 4101098 - RNA, 103 nt, Human
cagcguggcugcagaggcguggaugcuuaggcagccuggggagggacaggugggaacacucgugcuccgcaggcgcccacaggcccagugcccacggcugcug

SEQ ID NO: 4101099 - RNA, 62 nt, Human
cagcguuuuauaaggauugauuagugggacaagcaguucagguaaucacuuauaagacaaug

SEQ ID NO: 4101100 - RNA, 92 nt, Human
cagcguuuuuugguggauuucuuuugaaucuagaauucuguagcuaacgcuuuccugagacuuagucaaaagcuucacucggaaaaucuaug

SEQ ID NO: 4101101 - RNA, 130 nt, Human
cagcuaaccaggcccaagaugaccuugcuguucacuacucauuaguuuagccuucauggaggaagagcaucagcuccaaggcugcaaaacuacauggguugcacaggucaaggacugguugccaugcuag

SEQ ID NO: 4101102 - RNA, 73 nt, Human
cagcuaauguguaggugaaucgaggcugguuuaggcagcugaacuuuguucuuggcuaccuguacagcaguug

SEQ ID NO: 4101103 - RNA, 56 nt, Human
cagcuacuccucccaugacuucccucuagggacggucaugaggacagagugagcug

SEQ ID NO: 4101104 - RNA, 65 nt, Human
cagcuaguaaauggcaagacuagcuuacuaguggcaagucuaaacacagccuuuucuguaugcug

SEQ ID NO: 4101105 - RNA, 105 nt, Human
cagcuaucagaaaucccugagucaauaucugagugugcuuuggcagauuaauggcuaagagcagauuucaaauauuggcagagggaauccuucucucugaagcug

SEQ ID NO: 4101106 - RNA, 69 nt, Human
cagcuaugcucauuuguuuauguguugucuauggcugcucucaagcuguaacacagagcugagugguug

SEQ ID NO: 4101107 - RNA, 63 nt, Human
cagcuauuccaggaguagaaucagcaccccagcuagaaaagggggcaggucucuggaaagcug

SEQ ID NO: 4101108 - RNA, 79 nt, Human
cagcucagcuccuggcagugucuuaucaggagugcagaagcuccagaaagaaaucaguguccuuaggggagcagguuug

SEQ ID NO: 4101109 - RNA, 72 nt, Human
cagcucaggagccuuucuaggguucagaaagcuauggcuguaagagcauuccuggaggguagaguugggcug

SEQ ID NO: 4101110 - RNA, 65 nt, Human
cagcucaggccggagcuacaggcuccuggauccuuuccccauccgccccgcccggcccugagcug

SEQ ID NO: 4101111 - RNA, 55 nt, Human
cagcuccagcccuuugugguucacugaaaggucaguguauggagugcuggauuug

SEQ ID NO: 4101112 - RNA, 62 nt, Human
cagcuccaggauaauaaaguuguucucaccuggggagccuuuuggaguuauucugggaguug

SEQ ID NO: 4101113 - RNA, 59 nt, Human
cagcucccagagugaccagcagagggcgcugggcccaacauggucaguucugggagcug

SEQ ID NO: 4101114 - RNA, 74 nt, Human
cagcuccccagccucugacaccacagucguccgggaucacgugcugggcacagucagggugcaggggggagcug

SEQ ID NO: 4101115 - RNA, 58 nt, Human
cagcuccuucuuugacaaguggcagacuccugagucuucccaaugcaaaguaggacug

SEQ ID NO: 4101116 - RNA, 78 nt, Human
cagcucuaauaaucuguggccagagguacuauuuuaagaauguacuauuuuagguaguggccacaauguuagauucug

SEQ ID NO: 4101117 - RNA, 77 nt, Human
cagcucucccuuagcccgguagggacuccagaaaaccaccucugaggaccaucggggagcugcuggggaaagagcug

SEQ ID NO: 4101118 - RNA, 58 nt, Human
cagcucuccugagccugacaaucaccaucuuuagagaugaugaagagcucagagccug

SEQ ID NO: 4101119 - RNA, 63 nt, Human
cagcucugcaacuucuagcagugucaucaaggaaaagagacucucauuagaguugcagagcug

SEQ ID NO: 4101120 - RNA, 57 nt, Human
cagcucugcugggaggaugcagaaauaaaugaucagcgucccggcgugagagagcug

SEQ ID NO: 4101121 - RNA, 76 nt, Human
cagcucuuacacacuagaugguaggugcggggcucucccaccccaccuguucauuacccaucccaggucugugcug

SEQ ID NO: 4101122 - RNA, 85 nt, Human
cagcucuucacaggggaugauccucccgcagcgugccucgucuucaggccuggcugccgcagaugaaucuccaugaaucaagcug

SEQ ID NO: 4101123 - RNA, 63 nt, Human
cagcucuuccuaauaugaaagagcuucagauuugcuggagccaagagucaaggggaggagcug

SEQ ID NO: 4101124 - RNA, 57 nt, Human
cagcucuuggagaaaccagagccuccauggguccaggcugguugagccaaggugcug

SEQ ID NO: 4101125 - RNA, 83 nt, Human
cagcugaaaugugccaucugggaccuacuaaugcuuguugaacuuuacuggaucucagaagcugggucucagaagcucagaug

SEQ ID NO: 4101126 - RNA, 55 nt, Human
cagcugaagcugacacauagugcucaguuaguuacuugagacuuugcuuuagcug

SEQ ID NO: 4101127 - RNA, 65 nt, Human
cagcugaagcuuucaauuaugucagccuguggaaguaucuaaggugagugauugaugggcugcug

SEQ ID NO: 4101128 - RNA, 87 nt, Human
cagcugacugccugggaauccaggagggcugacuccuuagcccacacuuagcugagagucucagaccuccugguucaggcacagcug

SEQ ID NO: 4101129 - RNA, 63 nt, Human
cagcugacuucuugauccaaugaccauccuuuuucguggugcaucaaauucugaaauuagcug

SEQ ID NO: 4101130 - RNA, 60 nt, Human
cagcugagaccagaaugcaggugccccguaaaaccaaucugcauauucuucugguggcug

SEQ ID NO: 4101131 - RNA, 83 nt, Human
cagcugaguuaugucauuucucugagccucaguuucccaucugggaagcuggggguagugagaaauaaggaagaugacuucug

SEQ ID NO: 4101132 - RNA, 83 nt, Human
cagcugcaguuuaagagaauucugguuuuccuaucuugucaccaacacguagucuuaucagaauuuuuaaguucugcagucug

SEQ ID NO: 4101133 - RNA, 55 nt, Human
cacggugauaacagauggcauccuccugcccgggaggccaggcucuuauucugug

SEQ ID NO: 4101134 - RNA, 89 nt, Human
cacggugaucacuguuccugcugucuaguaucuuaaaaacacagguucugccuauuuuuuaugguuuuagauaggagggugauucugug

SEQ ID NO: 4101135 - RNA, 106 nt, Human
cacggugcugagugucucugcgugcugggcuggcgcauccgacacgugggcgaucaugguggugcggcagccagcgguggccagggauucacgcagcagcauggug

SEQ ID NO: 4101136 - RNA, 67 nt, Human
cacguacagggauaagauccggaacgcguuccugcagaacgccucagccguggucaucuucaacgug

SEQ ID NO: 4101137 - RNA, 60 nt, Human
cacgucaggagcaaggauugacagccuauaccccaagaugucagugauuaucucugagug

SEQ ID NO: 4101138 - RNA, 68 nt, Human
cacgugaggcacugaugaccugcuacacucaugcaggacucacauagcuucagaugacucauuacgug

SEQ ID NO: 4101139 - RNA, 59 nt, Human
cacgugcaucugaucuuuucugagaagcagauuuucacagaaaaguggagagccuagug

SEQ ID NO: 4101140 - RNA, 71 nt, Human
cacgugcucuuggggguguauguuuacuuaaaaugcaaugagucagccuuggcagccccuucaccacugug

SEQ ID NO: 4101141 - RNA, 64 nt, Human
cacguggauggagcagugacccaggaauaaagccaaugggcccuggggagcuguauccagagug

SEQ ID NO: 4101142 - RNA, 112 nt, Human
cacuaagcuaugccaucacuagacacaguugacagggagaggguuagugucagguuucacccuggaggugaucuucaccuuguucuuuggucaagguaagguaagucaagug

SEQ ID NO: 4101143 - RNA, 77 nt, Human
cacuaaguccagagauaaaguaggcuucugcuccauuuuucugcaguuucucaggcucugcuuuucuggauauauug

SEQ ID NO: 4101144 - RNA, 129 nt, Human
cacuaaugaaauuucucuaaaaacuauaaauauagggaauaucuuuguucaaagacaugcugaggaucaacagcauguugggaugagaaggaauaguucucuuuaguuucucagagaaguuccuuaaag

SEQ ID NO: 4101145 - RNA, 75 nt, Human
cacuaauggugcaggagugugucuaauacucacccacggccugcagugaguaugaacuuuauuuuugcaccugug

SEQ ID NO: 4101146 - RNA, 93 nt, Human
cacuaauuagcuaagagacuuaagaauaauugagagagggaguuaguuagccucaaugucuucucaagucuuuuccaauguuaauguuuugug

SEQ ID NO: 4101147 - RNA, 129 nt, Human
cacuacacugcaccaccuugugcguaggggcagaucuggguccucucccaagagcgcaucgugauccauggugucucuggagggacccguuugcagcuucucagacacgugcaaaaggcaggugcuugg

SEQ ID NO: 4101148 - RNA, 126 nt, Human
cacuacuaagacuauuuuuaguuuacuuuaucuuuuuaugucugaucuugguaauucuuuugucaagauggacauaaggagagaauagaagaaagaaaaaaaauugaaaauucuuagaaucaagug

SEQ ID NO: 4101149 - RNA, 64 nt, Human
cacuacuuacauguggcuacugggaaauggaaaugugugcccaaagugauaugugcuguaagug

SEQ ID NO: 4101150 - RNA, 72 nt, Human
cacuagaagcaccuguguucaugccucaugaguagcagagcugagugaugagaggagaaugggauucuggug

SEQ ID NO: 4101151 - RNA, 57 nt, Human
cacuaggcuggagacccgccaagaaauuaugagacguuucggucccagaugccugug

SEQ ID NO: 4101152 - RNA, 65 nt, Human
cacuaguguuuuggagagcacaguuuggaaaauucuguuuuagaaugcucuucaaaaucuagcug

SEQ ID NO: 4101153 - RNA, 68 nt, Human
cacuauagccaggguaagguacuuaguaugcuuaaggucguguuaaguucuaacuuauccugugugug

SEQ ID NO: 4101154 - RNA, 57 nt, Human
cacuaucugccauucauuuacuuguuugauucuguauacacauguggcaguauagug

SEQ ID NO: 4101155 - RNA, 118 nt, Human
cacucauguauggaguagguuggcacaacccuauuagcccuguuauccagaugaggaucauccucuugaucauccucuugacagggaguugaaugccaaugccaccuuauaccuggug

SEQ ID NO: 4101156 - RNA, 56 nt, Human
cacuccacagugccugacuccuggcaaacguccaggaagugcucgcuguggggaug

SEQ ID NO: 4101157 - RNA, 78 nt, Human
cacuccaucccuucaccacagcaguaaauaucccuuugccuagaacaccugcugcugcuggugguggaugaaagggug

SEQ ID NO: 4101158 - RNA, 60 nt, Human
cacuccuaccucaauguuuuuguauaggggcggcaggccaggacagggaugggguaagug

SEQ ID NO: 4101159 - RNA, 63 nt, Human
cacuccugggaggaacauuuaccuauauccauauguaugcauaccuguagccucucaguugug

SEQ ID NO: 4101160 - RNA, 71 nt, Human
cacucgcaaaugaagguggugggucauugucaccauaauaaagaugugccuguuucauagugaugagagug

SEQ ID NO: 4101161 - RNA, 69 nt, Human
cacucuacuuucucaggaauucacagaccucgggcaccgccucgacugucuggaccugaaaggugugug

SEQ ID NO: 4101162 - RNA, 90 nt, Human
cacucuaucuucccaucacauuugcaauugcauuguuugaauuguauuguuugaauauguauuuguacauguguuugugauuauugauug

SEQ ID NO: 4101163 - RNA, 83 nt, Human
cacucuauucucucauuuaucuguccuagccaauggaaaccaaaauuaauccugcugggaacauuuugagcugagagagggug

SEQ ID NO: 4101164 - RNA, 59 nt, Human
cacucugacuggcccugcaggagaggguggcucuuuccccuggagacaaagacagggug

SEQ ID NO: 4101165 - RNA, 85 nt, Human
cacucugauggcugccuguggaguguagaugcuggguuaggauccuucagugcucacaaagcacuccuagaagccaggcacggug

SEQ ID NO: 4101166 - RNA, 57 nt, Human
cacucugcacugcagagaucuguuauauauuccgcaguuguucugcaugugaagaug

SEQ ID NO: 4101167 - RNA, 79 nt, Human
cacucugcuguugagagcuggggcauaaaugccacggcaguugcugggcauuuaugccccagcucuuaacaguggagug

SEQ ID NO: 4101168 - RNA, 64 nt, Human
cacucuguccccaggagcccaguuucacugauuaucagaagcagcuuuccucuggggucaggug

SEQ ID NO: 4101169 - RNA, 79 nt, Human
cacucuucccaugggcauguucuuagccagugacugaguguggcagggauacuaaggcagguccauuccaggaaacgug

SEQ ID NO: 4101170 - RNA, 59 nt, Human
cacucuuguucaaaaaucuggcuggcugagugaaaacagcaaggaguagaacaagagug

SEQ ID NO: 4101171 - RNA, 98 nt, Human
cacugaaauugccaaugaugucaaaugcugcaaacucaucaaggaaaaugaagacugagaaugaguucauugcauuugacaguuggagaucuuuggug

SEQ ID NO: 4101172 - RNA, 88 nt, Human
cacugacagaugacauggcccuuugacagugacgccuguaugagcugacagcuccacuugcagucagucaaguccaugcuuugcagug

SEQ ID NO: 4101173 - RNA, 65 nt, Human
cacugaccauggccaauuggcaccaagcuauuuacaaccuuaaugccagucugcauugguuccug

SEQ ID NO: 4101174 - RNA, 59 nt, Human
cacugacuaaguuugugaaggugcagauaguauaacuacaucauaaacugggcacagug

SEQ ID NO: 4101175 - RNA, 76 nt, Human
cacugagcuaguaggcuuaucuuuuucaaagaguaguugaaacuugugauugagaaagucuaaaggggguaaagug

SEQ ID NO: 4101176 - RNA, 61 nt, Human
cacugcacaauguagcaaagaagaaaagaucaacugccuauuuugcaauauuuguacagug

SEQ ID NO: 4101177 - RNA, 67 nt, Human
cacugcacagaugaagcuguaaaugaacaguacacacacaaauguuauuucuaguuguuuugcagug

SEQ ID NO: 4101178 - RNA, 68 nt, Human
cacugcagagguggggugcagagggcaccgugccuuuguuaguugugccccaccgucuccuccaugug

SEQ ID NO: 4101179 - RNA, 55 nt, Human
cacugcaggcccuuacuuggggcaacaguacuuguccugugaggaccugucagug

SEQ ID NO: 4101180 - RNA, 122 nt, Human
cacugccauuuccaugugccugcuacucccuaacuucagccuggcccugcccucacuucugauggaggagcuggaguccaggcaaguaagcuggagagugagggcgccaauggucuggugug

SEQ ID NO: 4101181 - RNA, 67 nt, Human
cacugccauuuggccucuuggaaacuuuaggagacucaggcacaaguuacaagacuaaauggaagug

SEQ ID NO: 4101182 - RNA, 58 nt, Human
cacugcuuugcucugcccccaggaugguuaacccauucacagggccuucagcgcagug

SEQ ID NO: 4101183 - RNA, 75 nt, Human
cacuggagaguguaugcgcaccccagauagcaugugaauaaaccaucuguuugcuggugcauggguuuccgagug

SEQ ID NO: 4101184 - RNA, 57 nt, Human
cacuggaguuugcccuagcuucugucugcuuuuacuggauccuggguccuccagcug

SEQ ID NO: 4101185 - RNA, 57 nt, Human
cacuggauuuccaggaauacucacuauccuaugauaugcugucucugaauuccagug

SEQ ID NO: 4101186 - RNA, 99 nt, Human
cacuggauuuuauauuuuuaacuuucaaccucccaaguuucaguaagagacauguuauuuggagaaguugcuaaaguguaguuguaugaugucucugug

SEQ ID NO: 4101187 - RNA, 78 nt, Human
cacuggcaacucccagaucugauugccuugauguagccuggagcuacgagagguccuuagaaucuguucuugccagug

SEQ ID NO: 4101188 - RNA, 78 nt, Human
cacuggcuuaaacgaauagggauuuuucuaacaaaauaaaaguuuuggagaaggaggauuguuggugauggcucagug

SEQ ID NO: 4101189 - RNA, 72 nt, Human
cacugggaaaaguucuauguuagagauacauccuagcuccauguggugauguauuauaauauuucccaagug

SEQ ID NO: 4101190 - RNA, 130 nt, Human
cacugggaaagacagacuaaaacaucagcgcuucucccuaagguagagcacaggggucccagugaacugcgacuugggccaagcuuugcaggaguguugcauguauacgucuuccacaaaugccacagug

SEQ ID NO: 4101191 - RNA, 56 nt, Human
cacugggaaucugggaaagagaucccagcaccagccucucucguaggaucccagug

SEQ ID NO: 4101192 - RNA, 63 nt, Human
cacugggaggcagucucucuagaagaggucaaccuucugaggaggucagcagucucaucagug

SEQ ID NO: 4101193 - RNA, 74 nt, Human
cacugggcacauccugaagaagccgcacuguuuacaaaguacugucacccacagcgccuucuuuuguccaugug

SEQ ID NO: 4101194 - RNA, 75 nt, Human
cacugguguauuagagcuagaauaaaauucuuaaggggaagacaaaucagggagaagcuggcucagaacaccaug

SEQ ID NO: 4101195 - RNA, 61 nt, Human
cacuguacaaauauugcaaaauaggcaguugaucuuuucuucuuugcuacauugugcagug

SEQ ID NO: 4101196 - RNA, 66 nt, Human
cacuguagcccucugcucaggugcauaggcuggaagcagccagcacagaagugagaggacuuagug

SEQ ID NO: 4101197 - RNA, 68 nt, Human
cacuguaggcaccuugagagcaggagcugcaucuuauguaucucugcaucccucaagguugcauagug

SEQ ID NO: 4101198 - RNA, 79 nt, Human
cacuguauuaauuucaccguugcuagaaaugccuggaaaauaauaggcauucaauaagucacuguggaauaaauaaaug

SEQ ID NO: 4101199 - RNA, 129 nt, Human
cacuguccuuccauugaucuuuuugcuuuggguagucuuccaauuauccuaagaauaguagacuuugggaaggaagugggaagggucugccagguagagcagaaucaacgaucuucaauccagacagug

SEQ ID NO: 4101200 - RNA, 60 nt, Human
cacugugcuaugacacuugguuucaacuuauuugagaguuggaaacuuucaagcauaaug

SEQ ID NO: 4101201 - RNA, 76 nt, Human
cacuguguagcagcacuaagggcagggggaagaaauuacuauccucuucacuuuguuuauugugcaguuacaggug

SEQ ID NO: 4101202 - RNA, 75 nt, Human
cacuguuagguaauaggacagcagacaauuaguagaucagacuacauuggaauucugagguccuuuaccugggug

SEQ ID NO: 4101203 - RNA, 60 nt, Human
cacuguuuuauuccaacauagguucccagcuggagacuauuucauguuggagagauggug

SEQ ID NO: 4101204 - RNA, 129 nt, Human
cacuuaacggugcauucagggguuuaauuugaagcagugcaggaagugagaugccugaacuccacagcgcucucauaucugggcauacacagccuugcgucaaccuggaacccuuuaucccacugggug

SEQ ID NO: 4101205 - RNA, 57 nt, Human
cacuuagagcccagaguaagcugguccauuuccucccaggcucugcauuucugagug

SEQ ID NO: 4101206 - RNA, 120 nt, Human
cagguacacaugaccuaaaaugacagguuuaggucucagugauggcccauuuggauaaggagagaugucuaaggacaguuauuacugggugacuacaugugguuguucaggucgaaccug

SEQ ID NO: 4101207 - RNA, 64 nt, Human
cagguacugucguuacccuuuuuuaacagaaaaaugagccaggaggaauugacacagaagccug

SEQ ID NO: 4101208 - RNA, 85 nt, Human
cagguacuuaaguccacaggcugacagcggguacaaagauagagaggccuguuaaaaagaccaauggauuaaaaagaauacacug

SEQ ID NO: 4101209 - RNA, 110 nt, Human
cagguagcagcagugaugagaacaagcagagaagucucuaggcuaaaaucaaucuccuuagcuuagcauaugaggccucauuugucuugguuauucccaaagcacuccug

SEQ ID NO: 4101210 - RNA, 58 nt, Human
cagguaggaaaagggugucaggucuuccuacaaagaagcuccuucccuuuucuucuug

SEQ ID NO: 4101211 - RNA, 130 nt, Human
cagguaggcugucgucagcacaggucugacaggccccagccacgguggcccacaggugcaagcaagaaauaagcagugccaacuguagccgcugcgcuguuggagaucuuuguuacugcagcacaaucug

SEQ ID NO: 4101212 - RNA, 61 nt, Human
cagguaguccacagugagggagucagaagucuaggcucaauccuaauuucacuacuaucug

SEQ ID NO: 4101213 - RNA, 66 nt, Human
caggucagaggcgcagcccccaccuccagcccccugaacauguggggguuguguuuucuugaccug

SEQ ID NO: 4101214 - RNA, 76 nt, Human
caggucagcguguggagaacuaagcagaccuguucuucauuaacugcggcucucuggggaugucacacacuaccug

SEQ ID NO: 4101215 - RNA, 96 nt, Human
caggucaguggugcugagaggcuucuguuucuuaaaggugcucuucuaguugauuguaaggggcacugccagaagacuuucagcuugaauggcuug

SEQ ID NO: 4101216 - RNA, 72 nt, Human
caggucaucaaaguccgccugcugccguggcaggaggccacgcuccacuaggcgccggguggcuguggccug

SEQ ID NO: 4101217 - RNA, 100 nt, Human
caggucauuuggggauuuuguagagaauguuaagcacuuuggguauuauccuaacugcaguaggaauuuguugcaagguuuuaaucaaaagaaugauuug

SEQ ID NO: 4101218 - RNA, 59 nt, Human
cagguccacagcccaucacugccauaauaggugaccauagaagagagggcugugaucug

SEQ ID NO: 4101219 - RNA, 85 nt, Human
caggucccagugcaggggaaggaaacagagggcaccugagccccucaggcuggguacccuguuuccccuugaacugcacgacuug

SEQ ID NO: 4101220 - RNA, 73 nt, Human
cagguccucaggaggaagaacucugcaacaccacuacaggugugcauucucaguccuuccuccgugggauuug

SEQ ID NO: 4101221 - RNA, 81 nt, Human
cagguccucgucguugaggagaugcgacucgcggggcuggaagcaguucugacacuugcucuuguugaagauguuggccug

SEQ ID NO: 4101222 - RNA, 62 nt, Human
cagguccucugagaugggaggucuaaagggcuccuuugcucugcuucuauuguaguggcuug

SEQ ID NO: 4101223 - RNA, 68 nt, Human
cagguccugaguggcaggguuugggcugaccugcaggcugguagcucaucaucugccuucagaaccug

SEQ ID NO: 4101224 - RNA, 55 nt, Human
caggucggagccgucccuccuggcauuccaggaaaggaggagacagccucaccug

SEQ ID NO: 4101225 - RNA, 61 nt, Human
caggucugaagagucacaugcccaggggcagaauuuaggggccagauuuucuuagaaccug

SEQ ID NO: 4101226 - RNA, 111 nt, Human
caggucuguuuaagagcucucuuuacagucaauacuaggaccauauuuuuuaaauaaacuguaucuuucuuuaauuggcaugucugaguagaagcagaaaaacaggauaug

SEQ ID NO: 4101227 - RNA, 81 nt, Human
caggucuuucggccauagcgaugauuugggauuuuguaccaagugcaaugggaaagcuauuaaagguuguuuaaggauuug

SEQ ID NO: 4101228 - RNA, 57 nt, Human
caggucuuuucuacugguggagggaagaguggcgacccuccaccaguuaugggcuug

SEQ ID NO: 4101229 - RNA, 68 nt, Human
caggugacuucugaggccuucagaaucacugcucugaguucaacugacagaccucuagauuacauuug

SEQ ID NO: 4101230 - RNA, 80 nt, Human
caggugagccagucccucugccugugguucucugggggcaguguguucagggagucccaggcaggggcuggcuugcucug

SEQ ID NO: 4101231 - RNA, 55 nt, Human
caggugcccagcuccugcuguggcuaaguccuagcaggggcuccgggcgggccug

SEQ ID NO: 4101232 - RNA, 60 nt, Human
caggugccuguuucuuuugaauucagucuuaucuaaauuuacccaaggaacauguauuug

SEQ ID NO: 4101233 - RNA, 78 nt, Human
caggugcugcuuccuuccucuaaggaccuagugaauauugagauguuccugacggccaaagagguggaggagucccug

SEQ ID NO: 4101234 - RNA, 65 nt, Human
cagguggcaggagugggccuugaaguuagcacuagucccaugggcuaaauccuguucaccaccug

SEQ ID NO: 4101235 - RNA, 65 nt, Human
cagguggcuaacggccucauaguguaagcaucugauaaaagagguuguugagggugugggcucug

SEQ ID NO: 4101236 - RNA, 115 nt, Human
cagguggcuauugagcacuugaaaugugucugaccacuguauuggacauuacuauuguagacagaacucgugaaccugcagaggucaaaaacaauauuuuaucauccauuaccug

SEQ ID NO: 4101237 - RNA, 68 nt, Human
caggugggagcgaggagcuacuuuaaguagggacaggaaaaagagacucugaggagcccugagaccug

SEQ ID NO: 4101238 - RNA, 65 nt, Human
caggugggccgggguuuguucuugccuuccaucagaguguguuaaacaggccucaggccuuccug

SEQ ID NO: 4101239 - RNA, 90 nt, Human
cagguggggacccacggccuggugcagcaggucgcggcacucgagcagcccggcggccagcacgcgccggucgaaggugaaguccaccug

SEQ ID NO: 4101240 - RNA, 69 nt, Human
cagguggggagaguguggagcagcucuuggauuaggauuaggaaaggagggcugcucuuccuacacuug

SEQ ID NO: 4101241 - RNA, 65 nt, Human
caggugucagcagcacuguacucccucaaaaaccuauggggguccggggcaguggcucaugccug

SEQ ID NO: 4101242 - RNA, 58 nt, Human
caggugucaucagagacaauggaagcugcagaugagcaguuaaaccagaugacaguug

SEQ ID NO: 4101243 - RNA, 87 nt, Human
caggugugagccacugugccgcuggagcuggaauugaauccuugucuguuggacuccaguguuagccacugugcggcucugccccug

SEQ ID NO: 4101244 - RNA, 96 nt, Human
cagguguggcuguucauucuacaggugauucaggcucugggaagguguccucccauugaccuugagucauuauagcaacuauucuagcuacagcug

SEQ ID NO: 4101245 - RNA, 89 nt, Human
caggugugugccaccacaccuggcuaauuuuuguguuucuaguagagacaggauuucaccauguuggccaggcuggucucaaacuccug

SEQ ID NO: 4101246 - RNA, 84 nt, Human
cagguuagagauccuuuuaacagauacuucucuuuacaagguacagugaaguugaauaauucauagaagcuauucucugagcug

SEQ ID NO: 4101247 - RNA, 84 nt, Human
cagguuaugcuaaauuuuaauacugcuauuguaggaaaaaauauauuuuuguuacagcagaauugaaagagaaccuaugacuug

SEQ ID NO: 4101248 - RNA, 84 nt, Human
cagguucuccaucaccuguuacgagggaauaauaauaauaccuauucccugcuuucuugugaggggagauauggaaagcaccug

SEQ ID NO: 4101249 - RNA, 56 nt, Human
cagguugaugaauuaacaacucuugugagcucauagccacagagguuuacagccug

SEQ ID NO: 4101250 - RNA, 82 nt, Human
cagguugcaggugugggcaggggagcaaugccuggaagcagccacauuugcuggugcaccccagcacuaagcgugcaaucug

SEQ ID NO: 4101251 - RNA, 108 nt, Human
cagguugggguagggacuguggccuggggacacuaucuagguguuacuuaaagaaugguacuuccuaagccaccaaauaauaccuuccaagucuccuccuauaaucug

SEQ ID NO: 4101252 - RNA, 59 nt, Human
cagguuuaguuccacacagcuccuucgacuggaaauuguuagaccuggggcuuagccug

SEQ ID NO: 4101253 - RNA, 69 nt, Human
cagguuuucgaggugugugugcauguguauacgugcacaugcuacacagagcuccucgacaagcaccug

SEQ ID NO: 4101254 - RNA, 124 nt, Human
cagguuuugagcauggaauaaggaauggagaggggagaugaugagaucacugcuaucuuuguucuauauaaccuccacuucuacccauaguucuuuuucuuuuuccauacauaaccagaauuug

SEQ ID NO: 4101255 - RNA, 112 nt, Human
caguaaaaaaggugagaaccaccaucacuagggaaagaacaaggguauuaauaucgccuuaauuuauagaauuucuuggauaaugcugggguugauuuucaucugauuauug

SEQ ID NO: 4101256 - RNA, 62 nt, Human
caguaaaaguugaaaagugaggaauguccagucggugcucauucccaucgucaacuucacug

SEQ ID NO: 4101257 - RNA, 65 nt, Human
caguaaacaagaggcaugaucuuauaauuuagcuuagcauaaaauagcuuaugucuuuugaacug

SEQ ID NO: 4101258 - RNA, 55 nt, Human
caguaaacacugucuuuauauaucccucaugcaaggugauguaacauguuuacug

SEQ ID NO: 4101259 - RNA, 70 nt, Human
caguaaacuuuccuguuuguaacuaacugaaaucagcuuugccucacuuaggugcaaagggaacuugcug

SEQ ID NO: 4101260 - RNA, 129 nt, Human
caguaaagcuuuggucccuuucucucacuuauuugccuggaaagagagagcuguccugggacacccugauccaggucagggugggcgguuuaucucuggugaaggagaggagcuaaagagauaauucug

SEQ ID NO: 4101261 - RNA, 116 nt, Human
caguaaauuacacuaaugauacuuauuaauaugaugaauuauguuaagagaguuucuaauauugagaauuuuuucauuucugacauggucaugauguauuauuccuuaaugugcug

SEQ ID NO: 4101262 - RNA, 65 nt, Human
caguaacugcugaugaccucaaacucuuuccaucguuggagugcggucaacaucagcaguugaug

SEQ ID NO: 4101263 - RNA, 66 nt, Human
caguaaggaugcacauaacuaggaaggaaauucuccccuucuguuuuguuguuguuguuguugcug

SEQ ID NO: 4101264 - RNA, 60 nt, Human
caguaaguagucagggguccagggcaggcccugccuccugguguccuggucugcuagcug

SEQ ID NO: 4101265 - RNA, 127 nt, Human
caguaagugcguguauagguuugcuaccuggguauauugcauagugcugagguucgggguauaaaagauccugucaccuagguacugagcaucuauacccaacagcuagccuuucaacucuugccug

SEQ ID NO: 4101266 - RNA, 129 nt, Human
caguaaguggcagaggaagcauguaaacccaggucuuugacuaauaugcuugcuccugguaaacguccauaaguauucagcgauuaguucaauaagggcccuuaucuuccucugugccugugagaacug

SEQ ID NO: 4101267 - RNA, 70 nt, Human
caguaaguggcaggugcaggauuugaacccaaaucugccuauuuccgaagccugugcuuaucacuugcug

SEQ ID NO: 4101268 - RNA, 62 nt, Human
caguaauagguaacauugcccugagaagagcaaaucacagaauaagcaagcaccuguuauug

SEQ ID NO: 4101269 - RNA, 79 nt, Human
caguaauauuucuuagagaugguuaaaaauagguucugagucaucuuaagcauauuucuaggaauuuguuuuauugcug

SEQ ID NO: 4101270 - RNA, 91 nt, Human
caguacagguguuuuguugcuuccuuaguugacugucuuaguugcuuccccaagcugcuucccuaguugacugaggaagccgacacuacug

SEQ ID NO: 4101271 - RNA, 56 nt, Human
caguacuuuucaaccaguaugaacacacuuccuucuuccucugguugucuguacug

SEQ ID NO: 4101272 - RNA, 68 nt, Human
caguagaaggaaagagcacuuuuugaggcuuuugauaccucaagcaaauguccuuuuguucuagacug

SEQ ID NO: 4101273 - RNA, 81 nt, Human
caguagauucaucuguucacucggcauguauguauucaauagcuaguacauacauagcaggguaguagaucagucagacug

SEQ ID NO: 4101274 - RNA, 80 nt, Human
caguagcacucugucagugaagcgaggguauuuuaugauguuucugaccucccauucuaucugaggaugugcuaacucug

SEQ ID NO: 4101275 - RNA, 90 nt, Human
caguagcaugguaguagcuaggaauacagacacugcccuucacauggcauaacuuuguuuuugucuccuugucugcuuuucaugcaauug

SEQ ID NO: 4101276 - RNA, 74 nt, Human
caguagcuugcuuaggcuuuuaaaccauuuuaauguaggaauauaaaggccuuggcauaaacaaaagcuaacug

SEQ ID NO: 4101277 - RNA, 92 nt, Human
cagaugucauaugauaugucuuaacucuagaaagguuuauuuucuguacaaagaaucagaaacuuggagagauaaucccauauuggcaucug

SEQ ID NO: 4101278 - RNA, 64 nt, Human
cagauguccaggaucuauccccagaaacuaacuaguucacucuaggguaggaccuagacaugug

SEQ ID NO: 4101279 - RNA, 69 nt, Human
cagaugugcuuugaaguucaauguucccacuuuguaauccacaaguaacacggaacuugaagcaaucug

SEQ ID NO: 4101280 - RNA, 55 nt, Human
cagauguggaaugcagcaggcugagcccagcacucugccugugcuccagcaucug

SEQ ID NO: 4101281 - RNA, 90 nt, Human
cagauguuuauuugccuuuucaggguauguucuagaucugacugauuuuuuaaguauuugacacuaggugcccugagcaaacaaaaacug

SEQ ID NO: 4101282 - RNA, 98 nt, Human
cagauuaagaagacuggaggggaaaguucugcacaagggaaaacaaaacuaaggcuaaguuuucuuucugucauuacuuuccucccucuccuuuccug

SEQ ID NO: 4101283 - RNA, 66 nt, Human
cagauuauaguuuucaaggauuggagcuggaaggaguugccuguuugagagcuguguuaaggucug

SEQ ID NO: 4101284 - RNA, 85 nt, Human
cagauucaagaacaauaauuuuagaggaauaguaguucuuaaaagugaaaaaucuauuguuauaauuguugacauuguugaacug

SEQ ID NO: 4101285 - RNA, 62 nt, Human
cagauucaguguuugguuuacaaauuccuccugauuuauaaaccauucagacugaaccacug

SEQ ID NO: 4101286 - RNA, 62 nt, Human
cagauucccaucuccugagccucuauaagcucuuacggcuguuuuuccaggaaaugaaucug

SEQ ID NO: 4101287 - RNA, 130 nt, Human
cagauucuaacagggucaaguauguggacagaucaaggcuuagaguggggugagaagcagcaaggccagcuggcccugagaugccucacccuagucaaagcuucauuaacgguguccuggccuugaucug

SEQ ID NO: 4101288 - RNA, 63 nt, Human
cagauucucacuguauucagguuguaaacacuugccugacaacaacugaaagcaaggaauuug

SEQ ID NO: 4101289 - RNA, 63 nt, Human
cagauucugcagucaacuugcuuucuacucuuccuuccagauucaagaucucugcagaauuug

SEQ ID NO: 4101290 - RNA, 65 nt, Human
cagauucugggagauccaagcagaacuacccauaguauuacuucuggagccucucaaggaaucug

SEQ ID NO: 4101291 - RNA, 92 nt, Human
cagauugccagugaauaauuuuuuuuaguaugaguguccuaaguauuguauaggacauacaugggauuaaaaaauuauuuguugauuaucug

SEQ ID NO: 4101292 - RNA, 94 nt, Human
cagauugcugggugccacccuuagagugucugauucuuggucugggguaaagaccagagaaugugcaucucuaacaaguucccaaaugaugcug

SEQ ID NO: 4101293 - RNA, 68 nt, Human
cagauugcuucagugcucugagccuguuuccuauaaaauuagauaacaguaucugccugacagcacug

SEQ ID NO: 4101294 - RNA, 75 nt, Human
cagauuuagauucgcuggggcugggguggagccugggaguccuuguuucuaaccagcucccaggucugaggacug

SEQ ID NO: 4101295 - RNA, 65 nt, Human
cagauuucugggcaccaccacagacuuucugacucaguaagucuguagaggggccugaaaguuug

SEQ ID NO: 4101296 - RNA, 74 nt, Human
cagauuuguuggcuaagcaguuuaagcacccuggagguggagaccucucugaaagcagcugcucaucagaucug

SEQ ID NO: 4101297 - RNA, 70 nt, Human
cagauuuugugcuugaacacaucuuuuagcuguuaaaacucaguuuuucuuugaguuuaaugcaaaacug

SEQ ID NO: 4101298 - RNA, 72 nt, Human
cagcaaauuguaaggcagggauuuaaaccaagguaauguggucucagaauuccugucuuaacaguucugcug

SEQ ID NO: 4101299 - RNA, 81 nt, Human
cagcaacagcaacagcaagacaaauaauccagaccccauauuuuaguucuggucccaguuaucuucuguugccuuguucug

SEQ ID NO: 4101300 - RNA, 63 nt, Human
cagcaagaacagccugaugugcauccuacaaaauacuccacugcgcggacgggcuuuugacug

SEQ ID NO: 4101301 - RNA, 92 nt, Human
cagcaagcuugaauuuccaaacccagcgagcuacacaugaauggucccugcaugcgugggcuguagcacuggguuagaaaucacaauuccug

SEQ ID NO: 4101302 - RNA, 59 nt, Human
cagcaagguagaauccagaggcugugcuugcuggcggaguccuggacuccaucucacug

SEQ ID NO: 4101303 - RNA, 69 nt, Human
cagcaaguauuaauuuaaucuccaugguauuucuaaugccaguaaccuggggauguuaagauuuugcug

SEQ ID NO: 4101304 - RNA, 60 nt, Human
cagcacaugguaggauugcacuuuucaguccccuugaaguuaagcauggccaugugacug

SEQ ID NO: 4101305 - RNA, 75 nt, Human
cagcacgauauuuauguugauguucacggcgugcauacucagaugcggccaggaagggaagaucagcaugggcug

SEQ ID NO: 4101306 - RNA, 56 nt, Human
caggcagggagccacuguauaauuugugaggcaauuugcagaaggcuuccuguuug

SEQ ID NO: 4101307 - RNA, 77 nt, Human
caggcaguugagaggccacauagcuugcauguagcucagccccuugcaggcgguguggcugccauguaaauugcuug

SEQ ID NO: 4101308 - RNA, 58 nt, Human
caggcauagaagggcaagaauaagacaaaaagugucaucuccagccccucugugugug

SEQ ID NO: 4101309 - RNA, 125 nt, Human
caggcaucugcuugugagugccagagggugugggucuguuuucuagggcugaggugaguagggcugcuuuccagagcugagaaggcuuggccaccaccugggugggcucagaggacagaacacug

SEQ ID NO: 4101310 - RNA, 67 nt, Human
caggcauggggaggugcauauggguagugcuuaaucuaagcacugaaggaaagccuuugcaugccug

SEQ ID NO: 4101311 - RNA, 68 nt, Human
caggcauucaugaauucuacaggauggaguucccugcugggacaccaaaguagaauuaauguaguuug

SEQ ID NO: 4101312 - RNA, 85 nt, Human
caggcauuuccacccugcucaguccccagaugugugcugucuuuggaaaggcaagcacguggguuugagaucugggugcugucug

SEQ ID NO: 4101313 - RNA, 117 nt, Human
caggccaauguggagggaaagcugggguggugcaggccucaugcagcugggucccuccuaccaggccuccagaguccugcaccagcuccaggacagcccucuccuccccauggccug

SEQ ID NO: 4101314 - RNA, 58 nt, Human
caggccacagagagugcaugugcgugcagaagcaugugcauacagguuugugugucug

SEQ ID NO: 4101315 - RNA, 95 nt, Human
caggccaccgagccguuuuaaugaggucucucgcuggccagcccguggcuuucagaggccuugagagacccggagagaggguucccuggugccug

SEQ ID NO: 4101316 - RNA, 92 nt, Human
caggccacucacucagucccuggcacauaauagguggccaguaaauggcaguucccauuauuguuagugacagggugaagacuagaacccug

SEQ ID NO: 4101317 - RNA, 58 nt, Human
caggccagaacagcucugcaccaucacauaucguguugcggcuuagcuguuuggucug

SEQ ID NO: 4101318 - RNA, 109 nt, Human
caggccagggguucccagggagccuggcuccacaggccagggugugggaggaccgccuggccacaccucagccauguggaggcggcaccugcacacccaagcucgccug

SEQ ID NO: 4101319 - RNA, 93 nt, Human
caggccccacagaggaggugcagaguaggguugguacucaguuugcccagcuccccaccagaggcucugccaccuccacucugugguggccug

SEQ ID NO: 4101320 - RNA, 64 nt, Human
caggcccuucuuuguaauaaagauuaggcaauaacucccugauuuugagacacagaaggaauug

SEQ ID NO: 4101321 - RNA, 63 nt, Human
caggccgagggaagcaggcugcaaaaacaucacaaccgggcaaaguucucuuccuugggccug

SEQ ID NO: 4101322 - RNA, 57 nt, Human
caggccucccaaaagcagcugagagauuuuccugcucccuggcccuugggagaccug

SEQ ID NO: 4101323 - RNA, 60 nt, Human
caggccuccuaugagcacuagcagaauacaaacucuccugucagauccugggguggccug

SEQ ID NO: 4101324 - RNA, 79 nt, Human
caggcgaggcccaggugggcaggcgaggcccaggugguccauggcacgccucccgucucccgccucauccccucaccug

SEQ ID NO: 4101325 - RNA, 61 nt, Human
caggcgaugguucuggcugcuuguauuccagcccgaggaugcagugcccagaccacgacug

SEQ ID NO: 4101326 - RNA, 59 nt, Human
caggcuaaccaauguuaaacacugaacgcccgcugcaguguaacugguuaaaaagcuug

SEQ ID NO: 4101327 - RNA, 61 nt, Human
caggcuccucacucaugcucccucacucccaccugggaugcuauagcugaaugaaggcuug

SEQ ID NO: 4101328 - RNA, 56 nt, Human
caggcucgguccaguggcacccagcucccuaccuccugugccagccgacuggccug

SEQ ID NO: 4101329 - RNA, 59 nt, Human
caggcucuuuugguggcaaggaacagagacucauccaaacuugcuacaggagaaggcug

SEQ ID NO: 4101330 - RNA, 59 nt, Human
caggcugagcucuggccugggccucugcucccacaugguccccagcuaggcucagccug

SEQ ID NO: 4101331 - RNA, 79 nt, Human
caggcugcagggcacuguggggcccaugcugagggacagacgagugacuugcagccagcugucccaagugccuggccug

SEQ ID NO: 4101332 - RNA, 60 nt, Human
caggcugccgaggcugcagaauagaaucucacaaagccauuccagcccagguccugccug

SEQ ID NO: 4101333 - RNA, 63 nt, Human
caggcugccuggaagaggacugagauucugcaguucucaacaacuccaggugcagcaaggcug

SEQ ID NO: 4101334 - RNA, 78 nt, Human
caggcuucaguuuggggaggauaugugaguuauuuuaauguuuuugucucaauuucuucauuuuucccuaugaaccug

SEQ ID NO: 4101335 - RNA, 55 nt, Human
caggcuuccgccagguuuccaguauccaggcugcagggagccuggcaggggcgug

SEQ ID NO: 4101336 - RNA, 70 nt, Human
caggcuuguggggaaucugugugccccgagggggcuccccucccagguaacaacauucgucagaagccug

SEQ ID NO: 4101337 - RNA, 56 nt, Human
caggcuuuuucugcuguccucucucacccagaagagauuuagcaggaagcagccug

SEQ ID NO: 4101338 - RNA, 63 nt, Human
cagggaaacuaggaaauaagcucucugggacugacccaggcacagcuaacccuacuuucuuug

SEQ ID NO: 4101339 - RNA, 60 nt, Human
cagggaaagggaugcaguaaaaugauuugaaaacauuuuaauuuauucaccuuuaccuug

SEQ ID NO: 4101340 - RNA, 73 nt, Human
cagggaaaguucuuguccacucuguucuugugcuugcuuauuuuuucagaugaggacaaaaacuuuugcccug

SEQ ID NO: 4101341 - RNA, 128 nt, Human
cagggaaggaucaaccuggugaacugaaucggggagugagggucauaaaaucagccccagauccuaguggcaugcuuuaauauucugcauucuccuuauucuacucaaguaguugcucuccuuccuug

SEQ ID NO: 4101342 - RNA, 55 nt, Human
cagggaagggucugucuucacugagucauugccaaugaaggugacuccuuucuug

SEQ ID NO: 4101343 - RNA, 70 nt, Human
cagggaaguggguggauuuuaaugcuauggauuaagugucuauauuaucauaaaaccauucaauauuuug

SEQ ID NO: 4101344 - RNA, 66 nt, Human
cagggaauugguuauaccugugaugagagagcugagaagccucacaaaggaugaugaauucugaug

SEQ ID NO: 4101345 - RNA, 70 nt, Human
cagggacacagcugcuguggagguuuucacugcauuuucaguaaggcauuauagagacagccuguuccug

SEQ ID NO: 4101346 - RNA, 57 nt, Human
cagggacuacagccagcccucccuguggaagucuggguggcuggagggguggccuug

SEQ ID NO: 4101347 - RNA, 69 nt, Human
cagggacugagauccagacugugccaggcuugaccuaugccugccauggggcuggguauuaguuuccug

SEQ ID NO: 4101348 - RNA, 57 nt, Human
cagggagaagaacucaaguuuguauggcaacaagacuagaaaaugacuuucucccug

SEQ ID NO: 4101349 - RNA, 60 nt, Human
cagggagaguaaugagaguguagccagagacuugacucauucugcaucacucuugcucug

SEQ ID NO: 4101350 - RNA, 56 nt, Human
cagggaugugcagcauccagacacugcuuaaucacagugagcugccgucuucccug

SEQ ID NO: 4101351 - RNA, 67 nt, Human
cagggcaacguggccccugaacgauucucacaugaguugagguuuggcugggccuguacuugcccug

SEQ ID NO: 4101352 - RNA, 80 nt, Human
cagggcaauugaggcuuagucaaucagacucaaugagccgcacuucauugauuuuuggaucugagcugcaauggcgccug

SEQ ID NO: 4101353 - RNA, 65 nt, Human
cagguugcgugugaccguuucccuccccucaucaacuugaagguuggaaauggcacacagaccug

SEQ ID NO: 4101354 - RNA, 56 nt, Human
cagguuuagaggugauuuggaccuuucuguuggcuucagaauuaccccuggaucug

SEQ ID NO: 4101355 - RNA, 82 nt, Human
cagguuugucaaagaucagaugguuguaggugugcagucuuaauucuggguucuuacucuguuccauugaucuacaugucug

SEQ ID NO: 4101356 - RNA, 91 nt, Human
cagguuuguuucacuucuaaggugucucauuaauguacuucaucugagaauuuguuuuaagagcgcacuuuauaaucuugauguuugcuug

SEQ ID NO: 4101357 - RNA, 68 nt, Human
cagguuuuuauguugaugcuacuuggugauauuauucacuaaaaaaguaacaugcaaauaacagucug

SEQ ID NO: 4101358 - RNA, 73 nt, Human
caguaaaaaguuggggcuccggggaaggagaaacacugccaacucauuucacagauccuacagcuugugauug

SEQ ID NO: 4101359 - RNA, 56 nt, Human
caguaaagcauguaugucuucaguucuuacuggagaugagccuucaugcuuugaug

SEQ ID NO: 4101360 - RNA, 58 nt, Human
caguaaagguuuuauggggcuuuccuggaagcuucccauuauggaaacucuugugcug

SEQ ID NO: 4101361 - RNA, 115 nt, Human
caguaaauaaucugauuagguugaaccguaugaaauuuuugacauuugaaugcuuuuaagcuacaaaagcagcaaguuuauauguaguucaaucuaauacacacuagguuugcug

SEQ ID NO: 4101362 - RNA, 60 nt, Human
caguaaaugguaaaggguuuauuagcaauuagugcuacaugaaugcugaauuaugaacug

SEQ ID NO: 4101363 - RNA, 59 nt, Human
caguaaauguccucgcagggaaauccucauuuaauacuccuugaauggacauuacacug

SEQ ID NO: 4101364 - RNA, 71 nt, Human
caguaaucaaaagaugucucacucaguucucauaaaaauacaaugaggucacaguguuuggcauuuuacug

SEQ ID NO: 4101365 - RNA, 87 nt, Human
caguaaucgagaccuucacuuuggcaaugccuguuccccgaacaugcuuaauacacuguuaaagggagaguauaagauuuccagcug

SEQ ID NO: 4101366 - RNA, 63 nt, Human
caguaauggaaauggucaggccauaagaugaaauauaacuucauuggaaugaucguuuugcug

SEQ ID NO: 4101367 - RNA, 56 nt, Human
cagcacguugaaguagaguaaggagguuacacuccagaugcuuuuuuaagcuguug

SEQ ID NO: 4101368 - RNA, 85 nt, Human
cagcacuggagcucagcccagguuccagcucaauugaagaaucuccuccuuccacuggaaaccuccuuggcuggguuccaaauug

SEQ ID NO: 4101369 - RNA, 65 nt, Human
cagcacuuaagaaagacuaaaaagcuguaucaaccagugauaaugcauggaucuuuaugaggcug

SEQ ID NO: 4101370 - RNA, 115 nt, Human
cagcacuucagguuuugauaugcccaggacugagguccuuuuagguuuucagaagacugagaauucuuaggaaccuagacagggccucuguuaaggcugagcaagcugcggucug

SEQ ID NO: 4101371 - RNA, 56 nt, Human
cagcagaaaaugugggugauuucauuaucugggauugcuuugucauauuucugcug

SEQ ID NO: 4101372 - RNA, 89 nt, Human
cagcagaaagaccgggacucggaggguggccagagugucauuuuauucucuuuaacaggaggucuggccaccaguccuggccucuggug

SEQ ID NO: 4101373 - RNA, 101 nt, Human
cagcagacaccucguguuuuuugugcccuguagauccccagugcucagcacuguggcuggcucaucauagguguucaaaauaaacagguggaucccagcug

SEQ ID NO: 4101374 - RNA, 55 nt, Human
cagcagagcugggcuuugaauucaggccaacugcacuuuaagucccagcucuuug

SEQ ID NO: 4101375 - RNA, 80 nt, Human
cagcagauuuuagaguuuacacugauucuguguucuaaaagaagaaaauguaauaucacugugaauguuaucaucuuuug

SEQ ID NO: 4101376 - RNA, 58 nt, Human
cagcagcagcaucaccugagagcuggauagaaacgcagcaagccaggcccugcugcug

SEQ ID NO: 4101377 - RNA, 60 nt, Human
cagcagcauggcugacuaaagacauugacaucaugacauugucauguugcucugcuguug

SEQ ID NO: 4101378 - RNA, 64 nt, Human
cagcagcauugcucuggauuccuaagugagagacaaacacucagaacccagcagcagugcucug

SEQ ID NO: 4101379 - RNA, 61 nt, Human
cagcagcucccauccgcugagcaagacacucaccaggcacgccggcgggaggaagcuguug

SEQ ID NO: 4101380 - RNA, 63 nt, Human
cagcaggaggcauggcuucccuucucccucuuucuucauauggaugaagcaaucuuucuguug

SEQ ID NO: 4101381 - RNA, 63 nt, Human
cagcaggccugcaggcccucagggaggcaacguagcuucccugcagacguccugcgggugcug

SEQ ID NO: 4101382 - RNA, 55 nt, Human
cagcaggcguugggagaaagacagaaugccuauugaacucucugagaugcugcug

SEQ ID NO: 4101383 - RNA, 60 nt, Human
cagcaggguauacagggaauuuggcuucucuggcuccugaccuuuccccugugcccucug

SEQ ID NO: 4101384 - RNA, 58 nt, Human
cagcagguggcauugucccgccagcagugugcuggcguccguggugacaccauaguug

SEQ ID NO: 4101385 - RNA, 72 nt, Human
cagcagguucaaucuguacuugaaaaauuauuuguaugaaaaauuauucugacuacagauaaugccuggcug

SEQ ID NO: 4101386 - RNA, 60 nt, Human
cagcaguagagguaguagcacugucaucagagggaagagacaucugccuuagugcugcug

SEQ ID NO: 4101387 - RNA, 84 nt, Human
cagcaguauuuuaugggacacaguuugcauugcuaggaacaaaaaucacuugcaguguuauguuuucuauaauuuacagaguug

SEQ ID NO: 4101388 - RNA, 130 nt, Human
cagcaguggugguuguaaaacgcuaugaaguagauggcuuugaggaauuugaaucugggaaugccagaagaauuccaagccaccuuaucuagacuuuuauuuuuuucaaacuccaaaccauugcccccug

SEQ ID NO: 4101389 - RNA, 69 nt, Human
cagcauaaugaugcaguuacugucucauguuauuuagcuuggguucaggcaucauuauuuuaucaguug

SEQ ID NO: 4101390 - RNA, 65 nt, Human
cagcauagcugauuaaggcaaaaaacuaaaaugaaaauaagagucaagccuuuagucacuugcug

SEQ ID NO: 4101391 - RNA, 55 nt, Human
cagcauaggggagaacuuggggcacuaaccaggguguucaggauugacccuacug

SEQ ID NO: 4101392 - RNA, 58 nt, Human
cagcauaucugaguugaaagaguagcgaacaauauucuuuugguuauguaauaugcug

SEQ ID NO: 4101393 - RNA, 61 nt, Human
cagcaucucugccugccugcaauuccccucguuuggcagaugcugucggcagaagacgcug

SEQ ID NO: 4101394 - RNA, 61 nt, Human
cagcaucuggauuuccuccacuugcggcuucaaguaagauggaagaagaaucagaggccug

SEQ ID NO: 4101395 - RNA, 64 nt, Human
cagcaucuuuauaaaaaguaaagcugauaaaauucaguacauugcuuucugaagaucucagcug

SEQ ID NO: 4101396 - RNA, 57 nt, Human
cagcaugcuugggggagggagcccugaugggugauuauuuuccagaaaguaucauug

SEQ ID NO: 4101397 - RNA, 63 nt, Human
cagcaugugccuucggcuccuggagcagaggaucccugucucucagugcacgcaccaugccug

SEQ ID NO: 4101398 - RNA, 56 nt, Human
cagcauugucuccaagcaggucucugccgacggaagacgcugacagacgauugcug

SEQ ID NO: 4101399 - RNA, 65 nt, Human
cagccaaagaagaguaacuuuuaacuuuacguggcuacaaguauguuccuagugcucuucgguug

SEQ ID NO: 4101400 - RNA, 59 nt, Human
cagccacaggaaacagagacagccuccuuguugaggaagcuguucccaauccugggcug

SEQ ID NO: 4101401 - RNA, 65 nt, Human
cagccacaguggugagugacugauaggcucuccuccugaugcucuucacacccacgcugucccug

SEQ ID NO: 4101402 - RNA, 88 nt, Human
cagccaccacccuggaaagaaggucuggggaaggcuacccacagucauauccucagcacaucuuuacauuuccagggagagugcacug

SEQ ID NO: 4101403 - RNA, 73 nt, Human
cagccacccagcagaggaggcaagagcauggaaaaugucucuuucagccaauuuuccugaggaacccuggcug

SEQ ID NO: 4101404 - RNA, 55 nt, Human
cagccacguagcccuuggccguggugagggccucggccgccagcacgugugccug

SEQ ID NO: 4101405 - RNA, 62 nt, Human
cagccacugacaggaaugguccggugaagagggacgggaugacuugcugaucagagggacug

SEQ ID NO: 4101406 - RNA, 66 nt, Human
cagccacuggugccaggcuguugucugagauccgggcagagacggugcugucgcucacguggucug

SEQ ID NO: 4101407 - RNA, 64 nt, Human
cagccagaaaaacaccaagaggauuuacacuaugauauuuucuagucuacuugauuuuuggcug

SEQ ID NO: 4101408 - RNA, 64 nt, Human
cagccaggagggaaaggacaauuuuagggccacaaucugaaaguggucugcaucccuucuguug

SEQ ID NO: 4101409 - RNA, 57 nt, Human
cagccagggaggauuacaccccagggcccagccuccuccugggucucccuuuggcug

SEQ ID NO: 4101410 - RNA, 72 nt, Human
cagccaggggcacggggcugagccacgacaacuccagggcuucccagucccugcucucaaguucacugguug

SEQ ID NO: 4101411 - RNA, 67 nt, Human
cagccagucgucuuuauuacagcuucugcagaacacuugcuuagacugugagaagauggcugcguug

SEQ ID NO: 4101412 - RNA, 72 nt, Human
cagccaguucucuagugauauuuuacagauaaacaauauauuuuuauucagaugucuuagaaacugaagcug

SEQ ID NO: 4101413 - RNA, 105 nt, Human
cagccauccuccuuccugcugguguggcggcgcccuguagggaccaguggcucugggcugcaacgggccugccacccguguccucggagccaggaaacauggcug

SEQ ID NO: 4101414 - RNA, 89 nt, Human
cagccaucgcaccagccagaaggggaggucuucguggggcagggccccugccugccugcccuggggggccuccuugcggugggaggcug

SEQ ID NO: 4101415 - RNA, 76 nt, Human
cagcccaucccaugugucccugucugguuuucaugcuuugcugugacaggaacuauguggaugguuuucuuugcug

SEQ ID NO: 4101416 - RNA, 69 nt, Human
cagccccacgugugcuguacuguuucuguuuggcccaaacuagagacuaagccagcauagugcuugcug

SEQ ID NO: 4101417 - RNA, 58 nt, Human
cagccccaggaaaggaaaugaaugggucagaacagcccaauacauuuuuuuggagcug

SEQ ID NO: 4101418 - RNA, 56 nt, Human
cagccccaugaaaagggaggagggccuggucuuuggucccucaggucauugggcug

SEQ ID NO: 4101419 - RNA, 64 nt, Human
cagccccgugucccacaagcagcccacuauccuggcugccccucugugaggagcauggccgcug

SEQ ID NO: 4101420 - RNA, 76 nt, Human
cagccccucuccuccucggggaguuugaccugcauggccacaucagaguccucacccugaggauggacaggagaug

SEQ ID NO: 4101421 - RNA, 89 nt, Human
cagcccuacguuucugucccaggcaaaggcagcucauuggaauugucccagcaggcuuguuaugucugagagugaggaggaagaugcug

SEQ ID NO: 4101422 - RNA, 63 nt, Human
cagcccucagaggagagaaaaccaauucuccaacaaacaggucucuccaacaugguggugcug

SEQ ID NO: 4101423 - RNA, 62 nt, Human
cagcccuggaacagcugacucagccuuccccuaccacuggcagagagucacuucuaggccug

SEQ ID NO: 4101424 - RNA, 57 nt, Human
cagcccuggcagcuuucagggugacuggccagaccagaagccaaguuguggggguug

SEQ ID NO: 4101425 - RNA, 78 nt, Human
cagccgggugaauggcagaaagaauagaggcuauuugaauacugauguggcccucacuuucuucuauuuccauuaaug

SEQ ID NO: 4101426 - RNA, 81 nt, Human
cagccuaccuaacacuggcuuuugcugaggcucuagcagccagccaggggcucugcaugugaguggguggugguagaguug

SEQ ID NO: 4101427 - RNA, 63 nt, Human
cagccucacaccaucuuaaggggacuucuuaagcacuugauucucuuagaugauguguuccug

SEQ ID NO: 4101428 - RNA, 92 nt, Human
cagccucaugguccucaaggcuggaguggcguuggagaaaccaggucauaguuguauaaccaagguacucugcaggauggacuauggagcug

SEQ ID NO: 4101429 - RNA, 60 nt, Human
cagccuccugggacacucaccgcucacaggagacugagggagugcuccgcgagagggaug

SEQ ID NO: 4101430 - RNA, 62 nt, Human
cagccucucuguaucucaggauccucgucuguaaaaccgcaguccuaguugccaugaggcug

SEQ ID NO: 4101431 - RNA, 84 nt, Human
caguaauuguaaaguaguaguacagguacucuguuacuaacucaaaauauguaaacuaccacugauauucuauuuugcuugcug

SEQ ID NO: 4101432 - RNA, 58 nt, Human
caguacagcaugguauggaaagaccaaacaaugagcugccucugccauuugcugccug

SEQ ID NO: 4101433 - RNA, 75 nt, Human
caguacuuauuucuauuuagggauucugggcaucuuccgcagcccuaaaccaccuaaauggacuuauaagagcug

SEQ ID NO: 4101434 - RNA, 61 nt, Human
caguagaaagggcauuagccugggagaugagacacuugguucaaggccagcccugcuacug

SEQ ID NO: 4101435 - RNA, 55 nt, Human
caguagaccgucccggcagcccugcaguccuccacagcugccaggacaguuacug

SEQ ID NO: 4101436 - RNA, 74 nt, Human
caguagagcccagcuaaauuuauauaauuauaauagguaauauuuauggaaugcuugcugugggucaggugcug

SEQ ID NO: 4101437 - RNA, 56 nt, Human
caguagcacuagauauguguggcuaaugaacacuugaaauguggcuagugcuacug

SEQ ID NO: 4101438 - RNA, 57 nt, Human
caguagcaggcacucagcacguggcaauucuccuuccacugccagccuugucuacug

SEQ ID NO: 4101439 - RNA, 57 nt, Human
caguagccacuagacacauguaauuauuguguauuugaaguguggcuggugcagcug

SEQ ID NO: 4101440 - RNA, 67 nt, Human
caguaggcagaaguggcauucggagugggaauaguagacaugacugguggccuuuucauguuuccug

SEQ ID NO: 4101441 - RNA, 62 nt, Human
caguagggggcuggcagcuggcucugggguccuaaaaccccagggaaggccaucuucaacug

SEQ ID NO: 4101442 - RNA, 71 nt, Human
caguagugacugugagucgcugugacacuggcuucucgccgucugcugucuuuugauuuacugucgcacug

SEQ ID NO: 4101443 - RNA, 89 nt, Human
caguauaugcagcaaguggacauuuagaauggcacaguuauccauauaggaauauuguugaggcaguucaucuuguugucccuauagug

SEQ ID NO: 4101444 - RNA, 69 nt, Human
caguaucauccaucuagcgcggggggugcggaguagccucguccccucgugccuauggaccaaacgcug

SEQ ID NO: 4101445 - RNA, 58 nt, Human
caguaucuauaucauaguguuguuuagaggauuaaauaauacugcauguaaggugcug

SEQ ID NO: 4101446 - RNA, 70 nt, Human
caguaugcagugguaucauuuuaaagacauagauuuuguauuuaacauggaaauacuugacuguuuacug

SEQ ID NO: 4101447 - RNA, 62 nt, Human
caguaugucugggcucaaauccuaucuccacaguugcuagcugugugaccccagacaagcug

SEQ ID NO: 4101448 - RNA, 67 nt, Human
caguaugucuguuccuuuucggcaucacuuaaacacccuggacugccaaagaaaggaggcaacacug

SEQ ID NO: 4101449 - RNA, 81 nt, Human
caguauuaucuuugcauucuaugauaucaaaacaaaauaauauccuuguugauagucuccuagaaugacagguuuuugcug

SEQ ID NO: 4101450 - RNA, 67 nt, Human
caguauuugguaauuggcuaccucaaccauugacauuuacugagugucugccacaugccaaguauug

SEQ ID NO: 4101451 - RNA, 61 nt, Human
caguauuuuuuagaaccuggccugauugcagggcaaucaaccaaugucugagggaaugcug

SEQ ID NO: 4101452 - RNA, 81 nt, Human
cagucaacaucacuguuuauacucaaaagauacagguuuuuuuucaucuguuaagucuuuucuuguaaacaauguugagug

SEQ ID NO: 4101453 - RNA, 65 nt, Human
cagucaauagaaucaaauugccaugccuugaagugaugccagcaaauagaagauucuguugacug

SEQ ID NO: 4101454 - RNA, 61 nt, Human
cagucacacaaguggacuuggggucagauccuccagccccucccaagucuccugguggcug

SEQ ID NO: 4101455 - RNA, 55 nt, Human
cagucacaguuucuuuucugauaaagaucuuuugucucaaaggaaucugucucug

SEQ ID NO: 4101456 - RNA, 101 nt, Human
cagucaccucuuucuggucccugucugaagcagccagugcuguuccuuuggccuaguggggcaguggcugacuuuagagacuaggggagagugggugacug

SEQ ID NO: 4101457 - RNA, 113 nt, Human
cagucaccugggcacaguauucaucacugacgcugagauuccaggccccgauaguccaauuuagugucggagaugugggucccggcaucagugaaaaaacauccccagguuug

SEQ ID NO: 4101458 - RNA, 83 nt, Human
cagucagcccuuacacaauacagagaacuagcagccucuacucaauucgcuaaagcacucuggaaaauugugugggggugcug

SEQ ID NO: 4101459 - RNA, 83 nt, Human
cagucaggccuaggguuaaggccacauuuagagucaaaguccgcucuggaguuacugcuggcuuuggcuuguuggucagauug

SEQ ID NO: 4101460 - RNA, 65 nt, Human
cagucaguguugaagccuucuuuggucuuccaagauccacaauugaggacugcacacucugauug

SEQ ID NO: 4101461 - RNA, 84 nt, Human
cagucauuugccuuacugaagaaggagcucugcccugcuuacugaaaugcgguuuuuuuuccucugugauggcaaauaagacug

SEQ ID NO: 4101462 - RNA, 63 nt, Human
caguccagaguaccccaagaagucagaccaaaucuguugucugguauagagggcacugggcug

SEQ ID NO: 4101463 - RNA, 66 nt, Human
caguccagccaguaggguguggcagaguuuaaaucgaguggcccuuacuaccuugcugggggacug

SEQ ID NO: 4101464 - RNA, 62 nt, Human
cagucccacaagaucuccacaauucuggaaacucugccuccagaggagggcuuuggggacug

SEQ ID NO: 4101465 - RNA, 62 nt, Human
cagucccaggguugguucagcugcucaacaacauuaggcucugguuggcaucucugagacug

SEQ ID NO: 4101466 - RNA, 82 nt, Human
caguccuauaugaacagauggcccagcagaggguuuuacucuagagaguccugcuugauucuauguugcacagggugggcug

SEQ ID NO: 4101467 - RNA, 125 nt, Human
caguccucgggauccccagcccacagaaagaaugucuucccuggcaggccaagguuuucaaggugcacuuucaaaaguuggcuuguuaaaaaugcaauugcucugggguggaguccuggaaacug

SEQ ID NO: 4101468 - RNA, 93 nt, Human
caguccuuuucuuuauggcuggugcuuuuuaugucuuguuugagaaauccuugucuuugaggcuaaaggugaccagauugugcugggggacug

SEQ ID NO: 4101469 - RNA, 71 nt, Human
cagucgagauuaaaccagucaagaaucagaaugaaggaauaugucugagguaccagcugguuuaucuucug

SEQ ID NO: 4101470 - RNA, 66 nt, Human
cagucuaaucuguuacucauuagaccucuuugucugaagcauucaagugaguaacagguugcacug

SEQ ID NO: 4101471 - RNA, 61 nt, Human
cagucuaccuuucagacauugacaaugauuucuuggcuaaugauacugagaagggagacug

SEQ ID NO: 4101472 - RNA, 60 nt, Human
cagucuagagaaaggagcaggagcugauuacagauaagcuuugcugaagauuuuaggcug

SEQ ID NO: 4101473 - RNA, 71 nt, Human
cagucuauucaguugugggcaacaaugagauugccuugauaugauuguuguuagcaaaugcaagcuggcug

SEQ ID NO: 4101474 - RNA, 70 nt, Human
cagucuccaaagaauagaggugacauuccuaaauugggaauaauguuaugucauucuucuacuuagucug

SEQ ID NO: 4101475 - RNA, 67 nt, Human
cagucucucuccuugcaggcgugcaggcgacagucagccccagcauguucuguggcagagucagcug

SEQ ID NO: 4101476 - RNA, 83 nt, Human
cagucucuggcugggagcgagcugcucacagggaggcaggggccggaccccaccugaucagcaucuucccagcucggcuccug

SEQ ID NO: 4101477 - RNA, 55 nt, Human
cagucucugggaaagaggacaggccagggucuagucauugucuuuuuugagauug

SEQ ID NO: 4101478 - RNA, 102 nt, Human
cagucucuuugucccgauagccagcagaggcuagggcugcccacucagcugggcugaucucccuuuucucacagugaauggucuaucaggcgacaggcacug

SEQ ID NO: 4101479 - RNA, 67 nt, Human
cagucugaggccgucugggucugcagcuccauggcaacagggccguggcugggauggcacucuucug

SEQ ID NO: 4101480 - RNA, 58 nt, Human
cagucugcagcuguggugggcuucagccauauugaauccuauauaaccuuggaggcug

SEQ ID NO: 4101481 - RNA, 60 nt, Human
cagucuguccccuacccgguccucccacgcuguuggagugaguggccaggaggcagaaug

SEQ ID NO: 4101482 - RNA, 65 nt, Human
cagucugugagugauguaccugccucccccaggguaacccagugcaaguacaaacgcaucggcug

SEQ ID NO: 4101483 - RNA, 63 nt, Human
cagucuuacugccccuuuguucaauggaguggcuuguccacacuaagaggggagguaagucug

SEQ ID NO: 4101484 - RNA, 58 nt, Human
cagucuuagaggugacuguggagagggcccccacagcagaacuuaauuucaaaggcug

SEQ ID NO: 4101485 - RNA, 70 nt, Human
cagucuuagccuucccucacccaggacgcacuaccuggagugaagcauggggaggggcagaugagggcug

SEQ ID NO: 4101486 - RNA, 64 nt, Human
cagucuucucccagggucgcccaaguccgcugggauggcagagacuccuccugggaggggguug

SEQ ID NO: 4101487 - RNA, 76 nt, Human
cagucuugaccuuguccucugcuugcuggaagcccugcuguggcuucuccuggccuuuagguuaagguucagacug

SEQ ID NO: 4101488 - RNA, 55 nt, Human
cagugaaaucuuuccuccugaagugacauacaucacuuuagcuuacguuucauug

SEQ ID NO: 4101489 - RNA, 72 nt, Human
cagugaacaacuccaagggacaucauuuaccuagacuaugaugugaguggugcuuccuggaauuguacaaug

SEQ ID NO: 4101490 - RNA, 89 nt, Human
cagugaacugcugguaguucaugccucugaauguguccagagucuaacacuggcauuagucacgaggcaucagaaugucagcaucacug

SEQ ID NO: 4101491 - RNA, 79 nt, Human
cagugaagcaacagaagauagagugaaugaauaaagacacaugaaugcacuaaaucuuuugugcacauggcuuuuacug

SEQ ID NO: 4101492 - RNA, 60 nt, Human
cagugaaguucuacugaaugguuaacucggaugcugaguaucaugacuggggacucacug

SEQ ID NO: 4101493 - RNA, 81 nt, Human
cagugaaucucugucaagguccaggacuacauaaguugucuaaaaaaaaugagguacuuacauugagcuugagauucauug

SEQ ID NO: 4101494 - RNA, 59 nt, Human
cagugaauguuggaaguuauauagaguaguacucaguuuaacuuuccaauaauucauug

SEQ ID NO: 4101495 - RNA, 105 nt, Human
cagugaauuaaaaauuacaggaauuauuucucacucacauaauaguccaaaacuagggaaguauuuagaggagaaaaguggcucuaugauccuuauacauugcug

SEQ ID NO: 4101496 - RNA, 74 nt, Human
cagugaccuagcugcucugagcccugauucuuggcaggagaggcccuggcuagagcagcuccaggguagagcug

SEQ ID NO: 4101497 - RNA, 58 nt, Human
cagugacucacaccuguaaucccagcacuuugggaggccgacgcagguggaucaccug

SEQ ID NO: 4101498 - RNA, 67 nt, Human
cagugacugugggacccagccaaguacccucuaaagaguugcagcaggcuugucaccauagcuacug

SEQ ID NO: 4101499 - RNA, 71 nt, Human
cagugacuuguagauaggauuugaguguucacauuccugaauuuuuacaauuucucuuuauaucucacaug

SEQ ID NO: 4101500 - RNA, 61 nt, Human
cagugacuuugggcaaguggguggucugaguguggucuaauccaaagcccuaaguuaacug

SEQ ID NO: 4101501 - RNA, 69 nt, Human
cagugagacauuucagagcugagaugccacaggaaucuuguuccuuggagggcugugaguugggcacug

SEQ ID NO: 4101502 - RNA, 75 nt, Human
caugcugaagagugcacaggcuauuugcuguaauauuauuucaauuccauggaucuguagcaaucuucagcuaug

SEQ ID NO: 4101503 - RNA, 59 nt, Human
caugcugggcaccauucuugcaggccucaccucgaauuucugcucucuggugcuucaug

SEQ ID NO: 4101504 - RNA, 67 nt, Human
caugcugggcaucauggacagcagaggugaaucuaagcauggucccugccuucauggugcucacgug

SEQ ID NO: 4101505 - RNA, 56 nt, Human
caugcuggguaaagguggugaagaugugccuuagguucacauccucucccaacaug

SEQ ID NO: 4101506 - RNA, 108 nt, Human
caugcuucccagagcuccaaguccaggcccagcagcuccacuuggcuuuugagacaaagauaaaauaaguccuuauguggaggggcuaggcuggggaaggggagcgug

SEQ ID NO: 4101507 - RNA, 59 nt, Human
caugcuuucuguccaaauguuacggcagaagucaaauauuguauuuuucagaaaguaug

SEQ ID NO: 4101508 - RNA, 60 nt, Human
caugcuuuggccaaugagaagugcauggaugugauacuugucaugaggacuagacgcuug

SEQ ID NO: 4101509 - RNA, 60 nt, Human
caucugcuugguuccuccaagugcacauuaugcaaguguauuuggauagacagggagaug

SEQ ID NO: 4101510 - RNA, 57 nt, Human
caucuggaucuuagacagucaacggaggcaucuccagagacuucugauguccagaug

SEQ ID NO: 4101511 - RNA, 60 nt, Human
caucugguaugagguuuugcuuuucacagaauggcaacaucuaaccucaucacacaggug

SEQ ID NO: 4101512 - RNA, 63 nt, Human
caucugucagcaaaguauucauuuauaacaucguuuggaagauggguaauugauggcaguaug

SEQ ID NO: 4101513 - RNA, 129 nt, Human
caucugugauuuuacucuggugaauaaauuuauuuucauuggcauaaucuaaggacuuagcauugcugguuuuaauggcaccucugguuccuauagauacaguggucgaaaggguaagcuuugcagcug

SEQ ID NO: 4101514 - RNA, 61 nt, Human
caucugugccggguguuugucauuauuaagugacccugaugagaauaaccuugcacggcug

SEQ ID NO: 4101515 - RNA, 63 nt, Human
caucuguggauaugcacagagcagcaacauauuugaguugcucgaugugcuuguuugcagcug

SEQ ID NO: 4101516 - RNA, 63 nt, Human
caucuguuuccagaauguagcugcuuuguauuugggagagcuaacuaccuggaaaugugacug

SEQ ID NO: 4101517 - RNA, 80 nt, Human
caucuuaaccaggugggggagcuacagcaaguagcguaacugcccugugccuugguuuccccaucuguaaaaugaagaug

SEQ ID NO: 4101518 - RNA, 74 nt, Human
caucuucaagagaaagcagacuuugucauuuaauuuguaugaugaagaagcugcaacuucuuaaugggaagaug

SEQ ID NO: 4101519 - RNA, 78 nt, Human
caucuucacaagcuggcuugggagaauuugcagacacagguuuggguuucacauuuucaaaagcuggugcugaagaug

SEQ ID NO: 4101520 - RNA, 130 nt, Human
cauuggaaucccacagacaauuuaaauagauucugaugccuggguacugccccucagagauucuaaacuaaucagugugaggugaagccagggcaucaauauuuuuaaaguccuccaggugauucuaaug

SEQ ID NO: 4101521 - RNA, 75 nt, Human
cauuggcauugucuauuugcauucaugauagccacucuacuguuaggaauuuauucagcaguuagauuugcagug

SEQ ID NO: 4101522 - RNA, 64 nt, Human
cauuggcuccucacgcaaaucgacccaccccuuauuggugcugucuguaucagaggagugaaug

SEQ ID NO: 4101523 - RNA, 60 nt, Human
cauugggguugcuuucagaauguugccuuuaucagcagugaugaaaugagcauccuugug

SEQ ID NO: 4101524 - RNA, 87 nt, Human
cauugguguuggagauaaucaauaaguuauaaugaguucauucauucauuuaauaauuuuugaguagcccaaagcuaacacugacug

SEQ ID NO: 4101525 - RNA, 69 nt, Human
cauugguucuaaugauuucauucaaagcaggacaaauugcuuugagcaaggaaucaauuagucucaaug

SEQ ID NO: 4101526 - RNA, 84 nt, Human
cauugguugguaaugcuuacauccucuguaaagaaaguuaucaauaccauuugugcaagacaugcuaagagaugaccaccaaug

SEQ ID NO: 4101527 - RNA, 75 nt, Human
cauuguauuuuucaauuuuuaaacuaugaaguugccuuuucugggucuuuguagucagaaaaaaaucauacggug

SEQ ID NO: 4101528 - RNA, 88 nt, Human
cauuguccaccaauuagcccaaggcugacucaacagggggcccccgugcugggggccuccauucagacagccuguggcuggggcuuug

SEQ ID NO: 4101529 - RNA, 105 nt, Human
cauuguccuacuuuuuaggggcaaauuugucuuaagacacccaucugcaauacaaaaauaauggauagguguuucauaaaguuuguccugagaauagagauaaug

SEQ ID NO: 4101530 - RNA, 81 nt, Human
cauugucuaggaccugucugcaugaucuaaaaccaucauauuuauuggcuuagccuauucagcacagcuuuccuaguggug

SEQ ID NO: 4101531 - RNA, 73 nt, Human
cauugucugaauuacugaagcucaacucaucugauaaaauaggugagcuuugugguaaugaagucagauaaug

SEQ ID NO: 4101532 - RNA, 84 nt, Human
cauugugaagcagguuugggguucauuuuuaagugauauuuauaucauaaaaauagacucuaaaguuuuccccugcuuuagaug

SEQ ID NO: 4101533 - RNA, 101 nt, Human
cauugugauuuagcuguaagucuguaaaauuaguauaauuguacaccauaacauuguuguaagaauuaaagugauuuagacauaaagugcugaggaaaaug

SEQ ID NO: 4101534 - RNA, 88 nt, Human
cauugugcucuauaauuauugucugaagaguuauuuacugacuguugaauacacuuccaaauauugauuaucuugaagggauacagug

SEQ ID NO: 4101535 - RNA, 75 nt, Human
cauugugguuucuuuugugagguacaagcacaaagcauaaugugucccaaccccucagagaggcagagccacaug

SEQ ID NO: 4101536 - RNA, 67 nt, Human
cauuguuugagcaucugggauccagcuacguucagauggcugggcuuuuccauguacugagccaaug

SEQ ID NO: 4101537 - RNA, 87 nt, Human
cauuuaaaaaaucuuagcauuacaggcugaagaaaaucuugguauggugauuaucuuuagugacaguugugcaagaaaaauuaaaug

SEQ ID NO: 4101538 - RNA, 73 nt, Human
cauuuaacacauuucuggaguuucucaacaggaugauuucucuuuguuagaaaguuugaggugugguuaaaug

SEQ ID NO: 4101539 - RNA, 87 nt, Human
cauuuaacuuauacaaaaucaucucugcauccuuagcauaaaagaauaaauaaacgauugagaggaugaaugaaugauaguugaaug

SEQ ID NO: 4101540 - RNA, 129 nt, Human
cauuuaagaaaagggggcuuccaugugggaagaagggcuugugaacccagugugguugugaauucuguaacggaagucaccagcugggcuuuuucuaggcaggaguuaucuucuuuacuggcaaucaug

SEQ ID NO: 4101541 - RNA, 103 nt, Human
cauuuaaggaaauccaauagucaaaaaaccccuuuuauagaagaacagagcuuuucuaggaaaucugcugauggaagagggguagaucagguuuucuaaaaug

SEQ ID NO: 4101542 - RNA, 60 nt, Human
cauuuaaguagaauuccugggggucauccacugguaacccccaggaguccuauuuaaaug

SEQ ID NO: 4101543 - RNA, 69 nt, Human
cauuuaauccucugggcauaccuugguucucuucugccagagcuauugugugcccagcaggagugagug

SEQ ID NO: 4101544 - RNA, 70 nt, Human
cauuuaccuucugucaaugggaugagauuggguucagauauuugcaucuucaccaucaacagaaugaaug

SEQ ID NO: 4101545 - RNA, 67 nt, Human
cauuuacuggccaacaucuggggcacauuuccuucccggaaaagucacgaaguuggucagagaagug

SEQ ID NO: 4101546 - RNA, 120 nt, Human
cauuuacugguuguuugcuaugagccaggcacuggacuagaugcuuuguauacauuugugcaacacaauguggcauugucauuauugggccagcuuuacauagauuaagucacuaaacug

SEQ ID NO: 4101547 - RNA, 77 nt, Human
cauuuagcaguaagcaacugagcuugccaauguuaacaaaguuauuaggcaagaacaauauguuggcugggaaaaug

SEQ ID NO: 4101548 - RNA, 129 nt, Human
cauuuagguuuauuuccuggcaucugugggcauuugaguguggguugcuuauacuucguuaguucaguuugcccauucauucaacaaauaugggugccuacagggucccagacaccauagcugacccug

SEQ ID NO: 4101549 - RNA, 58 nt, Human
cauuuaucaucagaccuuuuaaaagccucugcuuuuaaaacggacauggugauagaug

SEQ ID NO: 4101550 - RNA, 56 nt, Human
cauuuaucuugggugcacagcgugucaggcgucaggcuaagcacuuugauaaacug

SEQ ID NO: 4101551 - RNA, 65 nt, Human
cauuuaugagaaacugcuuugugauauguauauucaucucacagaguuaaaaguuucuuuuaaug

SEQ ID NO: 4101552 - RNA, 66 nt, Human
cauuuauguacauuuugucugcggcugcuuuugugcuacaguggcagagucaaguagucaugagug

SEQ ID NO: 4101553 - RNA, 55 nt, Human
cauuuauguuuuacuuggucacauuauauaugugacacaggucaaaaauaagaug

SEQ ID NO: 4101554 - RNA, 85 nt, Human
cauuuauuauuugacucucuuccacaauaacauugguucugcuucaguuuguguugagacugagggagucagcuaucuacaaaug

SEQ ID NO: 4101555 - RNA, 73 nt, Human
cauuucacagcugacacuuugaccuagaguagccccgucacucauagcugggagguguuugaguugugauuug

SEQ ID NO: 4101556 - RNA, 59 nt, Human
cauuuccuugggagaaaaaauauauauguguauaauauauauaacuucuagggacaaug

SEQ ID NO: 4101557 - RNA, 105 nt, Human
cauuucuaggaaauugucaugaaaaccaaagaauagccuuuguccaaauuuuuuaaaagauuaggaugaguaugguuaugcuguuuuauauaaauucuucaaaug

SEQ ID NO: 4101558 - RNA, 68 nt, Human
cauuucuccugggugauaaauuuccaccaacuguguucuuucaucuguaguuuauuccaggagaacug

SEQ ID NO: 4101559 - RNA, 65 nt, Human
cauuucugauugucaugcuggguguggagcucaugcuacuggcaucuagcauccagugaguagug

SEQ ID NO: 4101560 - RNA, 63 nt, Human
cauuucuguacauguuuuggugaguucaaaauuuaaaccacaaacuuaaaugugcaagaaaug

SEQ ID NO: 4101561 - RNA, 88 nt, Human
cauuucuuuccacaaaguguuuucuuauuauuuuuccuagucauuccuccuggugucccugggagaugaugaugaggggguagaagug

SEQ ID NO: 4101562 - RNA, 68 nt, Human
cauuugaacauucuaugguugaugaguugauguggaaacagcaaagaaaccagauagaguggacaaug

SEQ ID NO: 4101563 - RNA, 64 nt, Human
cauuugaggaggaggguauauuugaaccugugaaacacaacagagggaucaucuuccugaagug

SEQ ID NO: 4101564 - RNA, 100 nt, Human
cauuugaguuuauaugguagauaagauauaaauccacagagucguccaaauuuagagaguuugugauuugugaucuuugaagauaucaaaacuuauuuug

SEQ ID NO: 4101565 - RNA, 65 nt, Human
cauuugcagagggugacacucugagugauuaaacauuuuacccaaaguuacacaucuaguaagug

SEQ ID NO: 4101566 - RNA, 67 nt, Human
cauuuggcuuuaauagauaagguuucuuuacuucaguuaaaaagccuguaucuauaaaaggaaaaug

SEQ ID NO: 4101567 - RNA, 94 nt, Human
cauuugggucuggauaaaauacaauagggcuuuuguuuauguuuguuuucaauccauaaacaauagucuauuaaguuuuaauguaucccacaug

SEQ ID NO: 4101568 - RNA, 56 nt, Human
cauuuguacagaacagcuuuauaguaauuuuaccuauagagucuguaguauagaug

SEQ ID NO: 4101569 - RNA, 117 nt, Human
cauuuguauuagucaggguucucuagagaaacagaaccaacaggguguguguguguguguguguguguguguguccuguuggucuguuucucucgaggacccugacuaauacacuug

SEQ ID NO: 4101570 - RNA, 73 nt, Human
cauuuguuuacucaaugcauaugcugcagacccaucccaggccugcugcccagugugcauugggguaaaaaug

SEQ ID NO: 4101571 - RNA, 76 nt, Human
cauuuguuucaacacugaucguuuacacagcacuacucuaugccagguaaugugaugggcaagugugaaaugacug

SEQ ID NO: 4101572 - RNA, 56 nt, Human
cauuuuaccuagaagcugaaaguccagcauuuuccaccuuuagcuuagguaaggug

SEQ ID NO: 4101573 - RNA, 72 nt, Human
cauuuuaggaaauuaugguuucagauaugcuguggggacucagacuggacauuugaaauaauuuccugauug

SEQ ID NO: 4101574 - RNA, 81 nt, Human
cauuuuauccuagcuucuucaucuuccucccaccaaaauguaauacuaguauggguuaguguuucccaguaggaugaaaug

SEQ ID NO: 4101575 - RNA, 66 nt, Human
cauuuucaaagcaacugaaaaggaagguauagaucaaccuuuuuguagauuuugcauuugaaaaug

SEQ ID NO: 4101576 - RNA, 66 nt, Human
cauuuuccaaaauaauuguuacugagauagccaguauuccugcggugacuguaucuuuggaaaaug

SEQ ID NO: 4101577 - RNA, 68 nt, Human
cauuuucuacuucuccugaaugucuuaauaggauuaaaucagaaaagggaaggaagaagagggaaaug

SEQ ID NO: 4101578 - RNA, 103 nt, Human
cauuuucuucuagauaccuuuacuugcaccuuguccauuuuuggcccagcuccugaaggcuccuggccuggacaaaugcaccaagguucucgugaaagaaaug

SEQ ID NO: 4101579 - RNA, 85 nt, Human
cauuuugcuagcaguuugugcuuuuuguaggaaugugacugacacggauauucuagcccuggaacggcgacugcugcaaaccaug

SEQ ID NO: 4101580 - RNA, 82 nt, Human
cauuuuggaaauacaaagauacaccacuccuuggaaugucacuggggauuuuccauagugguauauuaguguuucugaagug

SEQ ID NO: 4101581 - RNA, 56 nt, Human
caugaauuagcaauggugugcagggaaggaaccaguaucaccacagcucguucaug

SEQ ID NO: 4101582 - RNA, 96 nt, Human
caugaauugcugaaacagcagccccguagccuccagaaaggugcaacgcauugcaucugggagacccuugcgggaaggguuguuucugcaguccug

SEQ ID NO: 4101583 - RNA, 79 nt, Human
caugaauuuuguuaucucagacugaguuacuuguagcuccacaguguuaaaguaauaacaggcuaguaauaaaauaaug

SEQ ID NO: 4101584 - RNA, 105 nt, Human
caugacaaauauucuucaaaucccgugucaaaucuaucuaauucugagucuauuucuguguuaaagauucugaggcugauuagauccaggaauaguauagucaug

SEQ ID NO: 4101585 - RNA, 55 nt, Human
caugaccagagaggacggccaggaguaggcccugcuuacaucuuuucugggcaug

SEQ ID NO: 4101586 - RNA, 57 nt, Human
caugaccccccaaggccugcagaucaugauugaggugugcaggggggaacugucaug

SEQ ID NO: 4101587 - RNA, 79 nt, Human
caugaccucuggaauagcuugcgaggcagucuauuuagaggcuaccauuguaccaagguaauuuuccacgaggcgcaug

SEQ ID NO: 4101588 - RNA, 74 nt, Human
caugagaugggaaccugucuuaguccauucugugcugccguaacagaauacuacagacugguuaauauauaaug

SEQ ID NO: 4101589 - RNA, 71 nt, Human
caugagcaagcuggccuuccagccuugccucuacaugccaccguaggccacaguugaggccagcaacucug

SEQ ID NO: 4101590 - RNA, 91 nt, Human
caugagccugaauugagauugcuguacacuucuagaucugagauaaucagccucagguuaaugaggaaauagcaguggcaauuucacuuug

SEQ ID NO: 4101591 - RNA, 62 nt, Human
caugagcuaaucagaaagcaaggaugcuuaauuaugcauuuaaaccuccugauucagcuaug

SEQ ID NO: 4101592 - RNA, 75 nt, Human
caugagcuuccagccaaggagauaaaauguugagcugcuccuggcagcuacauuguaacuccugaagugccugug

SEQ ID NO: 4101593 - RNA, 129 nt, Human
caugagggucuacggggagugacaaauacaguguacuuuugaaggauccagaggaccaaauuuaugcaucucaaacaugguccuggucaucugggcuggcagguuucugggcuccugguuccaaggaug

SEQ ID NO: 4101594 - RNA, 71 nt, Human
caugaggugcagcaugaguccaacggagaguuaagggagauuugccuuggaaaucaaugcuguuucuuaug

SEQ ID NO: 4101595 - RNA, 113 nt, Human
caugagguuuuguuucaccuauaauugugauggaaaaugcuguauugcugacaacaaugaacuguaaccacaguuauuuacugcauaaacuauuuguguacuaaccacucaug

SEQ ID NO: 4101596 - RNA, 69 nt, Human
caugauaaauagugaagggagccggucugccugugcuacagggccugguuaauuacacuguaaaucaug

SEQ ID NO: 4101597 - RNA, 106 nt, Human
caugauaguuaauuaauuguggguacauuuaugugccugaaccaaguacagcuguuccaaauaaguucacauugaaaugacccaauaauaacuguuugcuaucaug

SEQ ID NO: 4101598 - RNA, 56 nt, Human
caugaucagaaagagaagcuaggacuuuauuauauagcuuuguauuugugauuaug

SEQ ID NO: 4101599 - RNA, 129 nt, Human
caugaugagaggaaaugagacuuuaggggaaaggauuuuuaggcauugggugcucaagugcuuauuuguuucaacuugacuagucaguguguggacucauccaauaaccauuuauuucuuuuaucaaug

SEQ ID NO: 4101600 - RNA, 91 nt, Human
caugauuaagcaggggagugaggguagaggcaggagugcaaaauuguaaaguuuuagcuuuuugagcuauucucagucccugugugguaug

SEQ ID NO: 4101601 - RNA, 62 nt, Human
caugauuccaagcucagcgcaggggccucccucucuccuccugccagcuggucccaauuaug

SEQ ID NO: 4101602 - RNA, 63 nt, Human
caugauuuaaacuaccaccugaggaguaauucuuuuuccugagauuggcuaguaugaguuuug

SEQ ID NO: 4101603 - RNA, 82 nt, Human
caugauuuguuggugcauugcugugaugauguucugagcucacccagccucaguuacucaaugacagcaaguucaagucaug

SEQ ID NO: 4101604 - RNA, 126 nt, Human
caugcaacccauauaaaaaucccucauaaucugccaaaauuagaaaugcagcuguuuuaagucuuaaacagcaauagcacuauucauuaugccaguauggaggaauaaaauagaaaaauguauuug

SEQ ID NO: 4101605 - RNA, 60 nt, Human
caugcacaaagguaagaugcgucaggucccugaggaaagggaaugugucuuucuuguuug

SEQ ID NO: 4101606 - RNA, 85 nt, Human
caugcagaugcaggucaccugagguuagagcugaagugcagguuucgauacugcagaccuggaguggggccucagguucugcaug

SEQ ID NO: 4101607 - RNA, 130 nt, Human
caugcagccagagggugacagagccacccagggcuccugacuccagguccuguguguuaccuagaaauagcacuggacuuggagucagaaggccugaguggagucaccuuccccacucucuggcugggug

SEQ ID NO: 4101608 - RNA, 78 nt, Human
caugcaguagcuuagagguagcaacaggacuagaauccauuucugaugccugauucacugccaucccagcucugugug

SEQ ID NO: 4101609 - RNA, 61 nt, Human
caugcaugcuucuuauaguacuuacaaauaauuugcaaagguaaguuagaaguguugcaug

SEQ ID NO: 4101610 - RNA, 68 nt, Human
caugcauuagcaaauaucuugaaacagggaggcucuguuuucucuguauuuugacuaauaaaagcaug

SEQ ID NO: 4101611 - RNA, 81 nt, Human
caugcauucagaaucucucacaauuuaagcaguguggucuuuuuucuacccgucuaauucaugugggcuuugaaaugugug

SEQ ID NO: 4101612 - RNA, 59 nt, Human
caugccaacaacaagcaaugagcacaaaggcugugcgaaaugcugcauuuguuggagug

SEQ ID NO: 4101613 - RNA, 86 nt, Human
caugccagcugaccuuugccaggaaggcacccacugcuucccucuagggcaagcccugccccucuugagaagcucagcaaggugug

SEQ ID NO: 4101614 - RNA, 117 nt, Human
caugcccaacucuggggccacuuagcucccuuucuccuccccuugccuucugacccugaaugcacaaagguggaaggaggaagcaggaaaauuaggccguuccuaagagaaagcaug

SEQ ID NO: 4101615 - RNA, 63 nt, Human
caugcccuggacuagcuauacuuuauccugcaaggggaauaaguuauggauuccauugguaug

SEQ ID NO: 4101616 - RNA, 59 nt, Human
caugcccuucaacgugaggauuugcaguaucaaagagaggggucaaaguggaggguaug

SEQ ID NO: 4101617 - RNA, 73 nt, Human
caugccucaguuucuccaucagcgaaaugggcguaaagccagaagauuacugggaggauucauugaggugaug

SEQ ID NO: 4101618 - RNA, 55 nt, Human
caugccuucucuguagucccagcuauucaggaagcugaggcaggagaauggcaug

SEQ ID NO: 4101619 - RNA, 67 nt, Human
caugcuguacucugugucagaaccugcucuagguauugaguauacaguagugaacaaggcaggcaug

SEQ ID NO: 4101620 - RNA, 57 nt, Human
caugcuguagaauccuaggguggccagcaggacagccaggaaccagcuacagucuug

SEQ ID NO: 4101621 - RNA, 83 nt, Human
caugcuguccccagucuuguccauuccaugcugcuguguuacaaacucucagagguaguuugcaggggaggaaggggaauaug

SEQ ID NO: 4101622 - RNA, 114 nt, Human
caugcuuuucagaaugcagcugccggauuguaaccaugaugagcagguauagaaguggaugugcggauccugaucuucaugguucugaccucagugaauucacgguaaagcaug

SEQ ID NO: 4101623 - RNA, 56 nt, Human
cauggaacaaggaagauguuugcaauaguauggccagcaucuauccucauucucug

SEQ ID NO: 4101624 - RNA, 63 nt, Human
cauggacagugggacaguguguuacaugccuuuuucugugugacauauuguccauacuucaug

SEQ ID NO: 4101625 - RNA, 101 nt, Human
cauggaggauuggaauagcagacaacccagaugacccagccaacaugaaauagcccagggacuggauuuucuuuuguuuguuugguuugguuuuauuugug

SEQ ID NO: 4101626 - RNA, 70 nt, Human
cauggagucaagucucuggcaaaugaucuuggaugaauccaguuugcacugggauuugaaacuuuccaug

SEQ ID NO: 4101627 - RNA, 64 nt, Human
cauggaucccagugcuuggcauacagcacaggauaacaugucugcauugucuccugggagcaug

SEQ ID NO: 4101628 - RNA, 72 nt, Human
cauggauggcucuugaauugauacucuguaaagccugaggacauaauaucacauuguaagggcaauucugug

SEQ ID NO: 4101629 - RNA, 85 nt, Human
cauggauguugggcugucacggggccuuggccucaccugggcaccuccuuacacagcaaggccuccugggcccagagaucugaug

SEQ ID NO: 4101630 - RNA, 88 nt, Human
cauggcaaggaagugagagguguuggggaggagaaacaccuagaucuguuccuacuccugcccagagcucuccacucuccaggcaaug

SEQ ID NO: 4101631 - RNA, 90 nt, Human
cauggcccacacuuugggugaugccuaggggcccuggaggccaccgccuggucccaggccccagggcuugucagucuauugguggauaug

SEQ ID NO: 4101632 - RNA, 59 nt, Human
cauggccucuguugcaacucuucaacucuguuguaugagaacagccacagagagcugug

SEQ ID NO: 4101633 - RNA, 74 nt, Human
cauggcugcagauagagccaagaggguggccucggguggcugguggcagucuccuggcugugggggcagaagug

SEQ ID NO: 4101634 - RNA, 69 nt, Human
cauggcuucaugaggguuuugccaauaacuaggguugugggaagcacaggcucucuuggggacaccaug

SEQ ID NO: 4101635 - RNA, 69 nt, Human
caugggaaauaguuuugugagaaagcuaggacagaaauguuuuacuugaaaggaaauuaaggucccaug

SEQ ID NO: 4101636 - RNA, 77 nt, Human
caugggaagccgcagaugcugcuauuucacccugggcucuuugggccucagaauaguaaaagacaucugauuccaug

SEQ ID NO: 4101637 - RNA, 60 nt, Human
caugggccaguuggaauggauacucaggucucccugcaguuaggcccccuggucaccaug

SEQ ID NO: 4101638 - RNA, 60 nt, Human
caugggcugggcugcagcaaaaugaggguguacucagugcacugaggcccauguaccaug

SEQ ID NO: 4101639 - RNA, 62 nt, Human
caugggcuuuggaggcuggaggcugucuauucccaccccacuccacccuccccuaccacaug

SEQ ID NO: 4101640 - RNA, 85 nt, Human
caguuccuccugagacaucucugcuggucacguguuuugccuuggaugucucuauggaagaccacagaggugugggagagagcug

SEQ ID NO: 4101641 - RNA, 98 nt, Human
caguuccugcaaaugcuacccaggacccugaggcugcccagggccagguguccaccccaccucccucgccguccacucuggucgcgucccaggagcug

SEQ ID NO: 4101642 - RNA, 59 nt, Human
caguuccugcaaugcaauguguuguuaacugaauagccagcauauagcagggagaacug

SEQ ID NO: 4101643 - RNA, 56 nt, Human
caguucuccuagaguggaccaaaacauggaaucuugguugcauuguaguuggacug

SEQ ID NO: 4101644 - RNA, 61 nt, Human
caguucucugcuccuagacuuuuggauucacauuaguccuagaagauggaucagagaaaug

SEQ ID NO: 4101645 - RNA, 72 nt, Human
caguucuguggcugugcccuguagauacccaugaugugagguggagagcugcuugcugcagacacggggcug

SEQ ID NO: 4101646 - RNA, 78 nt, Human
caguucuuuugaguauauacccagaaguggaauugcuggaucauaugcuaauucuauuuuuaaauguuugaggaacug

SEQ ID NO: 4101647 - RNA, 81 nt, Human
caguugaaagaucauguggcugccugucuagcccuccacugacagaaauacaaagccagccauuuucaaaugaucugacug

SEQ ID NO: 4101648 - RNA, 70 nt, Human
caguugacauguucuugaaagugacaggucaucuaucuuaagcugguuaccaagcucugcauguuaagug

SEQ ID NO: 4101649 - RNA, 60 nt, Human
caguugcacuagccacauuucaaguacucaguaacauuaacauguggcuaguagcuacug

SEQ ID NO: 4101650 - RNA, 79 nt, Human
caguugccagaaggaugucaugugcuaacugguauagaucaaggcuuuucaauagcaguaacacugacauuuuggacug

SEQ ID NO: 4101651 - RNA, 70 nt, Human
caguugccuuaugaacuuuaagcucugugucaguaucauggaaugaaaauugauauugcuugaguaacug

SEQ ID NO: 4101652 - RNA, 62 nt, Human
caguuggcagauuugucaguaagcugcauauuugaguuacugacuuacauucugucuucuug

SEQ ID NO: 4101653 - RNA, 81 nt, Human
caguugugggaugagugaggacaggguggcagugcuggagucucaguugcacacccuucauuccacucucucccugugcug

SEQ ID NO: 4101654 - RNA, 77 nt, Human
cauacacagacacugugcuaguuguuuuugcaauaauauuagaaaucacagaaacucagacacaguaucuguuuaug

SEQ ID NO: 4101655 - RNA, 76 nt, Human
cauacaguauguaggcuuuucagauuggcuucuuucacuuaauccuaugcuuuugagauuccuccaugucuguuug

SEQ ID NO: 4101656 - RNA, 62 nt, Human
cauacauaccacugcugucuuuuccgagugguauuacaagaaagauuuuugugguguguuug

SEQ ID NO: 4101657 - RNA, 129 nt, Human
cauacauggcuuugauucucugcuacacauuucucagaugguuuuaugagaccucaggaauaauaccuauuucuuggcuuugugugaggacucagugaaacauguuaggaaugcugugaagucugguug

SEQ ID NO: 4101658 - RNA, 55 nt, Human
cauacauuugcuuugauuuucagccagucccuuggcuuuugcaaaccaaugugug

SEQ ID NO: 4101659 - RNA, 60 nt, Human
caucuccaggaguucuacucauaagaguggucaucucugagugugaaaauccuggagaug

SEQ ID NO: 4101660 - RNA, 61 nt, Human
caucuccccgagcuuaccuccugaugaccccuuaucagguuguccacugaagcugggagug

SEQ ID NO: 4101661 - RNA, 60 nt, Human
caucucucccuacauccuugccuagcucaccugcccagggagguagcaggagaaaagaug

SEQ ID NO: 4101662 - RNA, 81 nt, Human
caucucugaguccagcccucugccuccagguggaguagcugucacacccugcagggcagaggcuggugcucuccagggaug

SEQ ID NO: 4101663 - RNA, 82 nt, Human
caucucugcccacccucgcuguguucugugaugaagacagacaugugcugcucacacacagugaaugugaagguaagaggug

SEQ ID NO: 4101664 - RNA, 71 nt, Human
caucucugccucucaggucccugagaucaauggcccaagauaguaggugaugccugagagugcccuggaug

SEQ ID NO: 4101665 - RNA, 108 nt, Human
caucugaaaauugcccauuauguugcccauccaucacagauguuguguggaguaaaaauaauacuaagacacuaacauggugccgggucauaauacgucuucaguaug

SEQ ID NO: 4101666 - RNA, 62 nt, Human
caucugacaucucccucugacauguaaacaagacucuugaaaguguucagaggaagaggaug

SEQ ID NO: 4101667 - RNA, 63 nt, Human
caucugagauuuaauggcuaaucuguucagacagcugcuucuuagccauuaaauuacaaggug

SEQ ID NO: 4101668 - RNA, 67 nt, Human
caucugaggcaggucucuuuucuggaaggugaauuccagcggcugguuggagaucccgcugcagaug

SEQ ID NO: 4101669 - RNA, 99 nt, Human
caucugauaugagcagcaggacagaggguuccaaaauugaugugucuaagaaaaaugcauuaauaaaauaccacuuuguucauuaguuugaaugagaug

SEQ ID NO: 4101670 - RNA, 81 nt, Human
caucuggacugccuuccucguaggcacugagggcccggaacaagacauuuucucagugcugugcuggaagcuguucaaaug

SEQ ID NO: 4101671 - RNA, 74 nt, Human
caucuguagcuccaugacaauuuggcagaauacacauuaaagugaaagcugcugccgucaugcggaaauaggug

SEQ ID NO: 4101672 - RNA, 74 nt, Human
caucuguugguuguggucaaagcugaugggguuuuacucugauucacugcuuuguuuacaacuauuuaaguuug

SEQ ID NO: 4101673 - RNA, 85 nt, Human
caucuguuucugguaaugucacaucuaguaaauucuguuuauaacauauaugcugggacugugacucauggccacaggcagacug

SEQ ID NO: 4101674 - RNA, 62 nt, Human
caucuucagcaucccugccugucccuggcguucagugugcccagcagcagauguuggaggug

SEQ ID NO: 4101675 - RNA, 94 nt, Human
caucuuccacucucugcaggugguacuucuuuuucuuuccuuauuuacaauugcaucaagaaaugagaauauugcuuguuuaagugagaggaug

SEQ ID NO: 4101676 - RNA, 57 nt, Human
caucuugcaggaagcgagucacgucccagcgcugcucccuggaguuucuggaagaug

SEQ ID NO: 4101677 - RNA, 56 nt, Human
caucuugugaggaccuucuugcugcaucauaacauggcagaaggugucacauggug

SEQ ID NO: 4101678 - RNA, 70 nt, Human
caucuuuaauuguagcucccauaauccccccuuuucaugggaaggaccuggugggagauaauugaaucug

SEQ ID NO: 4101679 - RNA, 124 nt, Human
caucuuuagaucuuauuacgccaaugacaucaggcuauguguguccaguguauuaucacucuuagucaucuccaauauacaaagcucuugaaggucaaaacgcucuucuuaauauuugguaaug

SEQ ID NO: 4101680 - RNA, 96 nt, Human
caucuuuucugauccuugcaacucugugaggugggcaggaguauugucagaaccucaucugguuuguaaggcauuucuaagucaauuagaaagaug

SEQ ID NO: 4101681 - RNA, 129 nt, Human
caugaaaaaucauaaucauugcuguucgaagcugcuaaguuuugggguuguuacgcagcaagugauagcugauacacucccuaaaauauauucuuugcauaacagugaguacucuuguuaaaaugcaug

SEQ ID NO: 4101682 - RNA, 92 nt, Human
caugaaaauuaugaauguguuucuagagaaaauauuuacauuggcaauaagccuaguaacuauucucuaggagucucucagaaauuaacaug

SEQ ID NO: 4101683 - RNA, 58 nt, Human
caugaaacugccuacaaagcuagucccaaauacuggcugugaaauggcagugucuaug

SEQ ID NO: 4101684 - RNA, 75 nt, Human
caugaaaggggagaggaauaucauuauauuagcauaguuacuguguguagugauaauccuucuccaucacuucug

SEQ ID NO: 4101685 - RNA, 97 nt, Human
caugaaaugaaaacaaguagaagaagggagugacaaaugcacacuuuggauguguguauugauagcuguguauuuccuuuauaugcauuuuuacaug

SEQ ID NO: 4101686 - RNA, 61 nt, Human
caugaaauguguuaaucucuugaaaagaaagauaaucaaaugagauuauugcacauucaug

SEQ ID NO: 4101687 - RNA, 58 nt, Human
caugaaccaaaccaaagugucccaaaguuaaucaaaggggacgcuuuuaaguaucaug

SEQ ID NO: 4101688 - RNA, 72 nt, Human
caugaacucugggacagcuugccugguacugcaacuggaggacaucauugcauccagagagcuucccacaug

SEQ ID NO: 4101689 - RNA, 67 nt, Human
caugaaggaccauuucacggucucauucaaacggacaugauugcaaccuaguaggggguccuuuaug

SEQ ID NO: 4101690 - RNA, 89 nt, Human
caugaaggauacaguagauggaggcuagaugcagggcuuuuacugucaugcuaaguucugugguuugguuuucauuuuuguaggcaaug

SEQ ID NO: 4101691 - RNA, 71 nt, Human
caugaaggcaguggcuggaaaaccugcuccauuuuucccugacuuagagagcagguauuacuuccuuuaug

SEQ ID NO: 4101692 - RNA, 57 nt, Human
caugacagaggagugcaggugauccuuccuguggaaacaagguaguucucuguggug

SEQ ID NO: 4101693 - RNA, 109 nt, Human
caugaccggcuaugagcaauagaauucaguggaugugaugcuccaauucugaacuuauccucaagaagcuuugcacacaucuuguaauccugagcugccugcuggagug

SEQ ID NO: 4101694 - RNA, 92 nt, Human
caugagacagcagggauaaaucaugaggacauuaugccaagugagauaagccacucaccaagugacaaaugccauaugauuccacuuccaug

SEQ ID NO: 4101695 - RNA, 69 nt, Human
caugagccagguacagcccucaacccucaaccaucaugggagaaggcugagggcuguaccuggcucaug

SEQ ID NO: 4101696 - RNA, 58 nt, Human
caugaggaacauaucauuuacuggcugauuauaaguuacaggaugauuuuuccuuaug

SEQ ID NO: 4101697 - RNA, 130 nt, Human
caugaggguaaccaggcagagaggcacagcugacauguguaaucagcuccgugggcagaggagggaugagugacggagcuguuugcggaauguccuaccuguccaucacuggugccaaaaugcccucuug

SEQ ID NO: 4101698 - RNA, 55 nt, Human
caugauaccucaguuguuuuuacaucaaaucgacuuggaaacagugaguguuaug

SEQ ID NO: 4101699 - RNA, 73 nt, Human
caugauaggcccugauucaguggugcccagaggccacugaggucucuggcaauugcugcugacucacugcaug

SEQ ID NO: 4101700 - RNA, 81 nt, Human
caugauauaugaaaggaaaccauucuuuaucauugaccuauugaagauccuggguaaguuccuuuuaauuuuugugccaug

SEQ ID NO: 4101701 - RNA, 71 nt, Human
caugauccagcccagacaccaucauucuagggcuuuaccauuaucccugaagagcugggcaauggacuaug

SEQ ID NO: 4101702 - RNA, 65 nt, Human
caugaucugauaguuugcaaaugaauucugccaggaaguuucaaaugguuagacuguuagccaug

SEQ ID NO: 4101703 - RNA, 72 nt, Human
caugauuaaagauguucucauuucauagguucuuauaucugaauuguaugagagugaaagcauuucugcaug

SEQ ID NO: 4101704 - RNA, 58 nt, Human
caugauugguggucagcaguauggcuucagagccugugcucucaaucaccacuucaug

SEQ ID NO: 4101705 - RNA, 67 nt, Human
caugcacaaucacaaagagacaagugucaugaagggaauguacaugguccuuugagauuauauaaug

SEQ ID NO: 4101706 - RNA, 55 nt, Human
caugcagcaggaucucauucccauugagggacacaaaguggguugcugcuccaug

SEQ ID NO: 4101707 - RNA, 79 nt, Human
caugcagccaggaauacaaaucuuuguucucuucaaacaccaaaaagaggcagcuacuuguauuuacucuaugcucaug

SEQ ID NO: 4101708 - RNA, 96 nt, Human
caugcagcuaauaugauacuuaagugaaacauguaucucuuuacuccaacuuuaaggauguaaauaggguaagcguguuuacucucaccaugcaug

SEQ ID NO: 4101709 - RNA, 62 nt, Human
caugcaggaggaaaaagcagcuucucugccacuucggaauggcuuucuuuccuaccucacug

SEQ ID NO: 4101710 - RNA, 88 nt, Human
caugcauacagcgcucgccugcuuggugccccagccauuccucuccaggaagcuggaggggccagcagguguagggguugggggcuug

SEQ ID NO: 4101711 - RNA, 63 nt, Human
caugcccuuaugcuucccugaggaucuuaucuaaaugagauagccacagaggcaucuugcaug

SEQ ID NO: 4101712 - RNA, 69 nt, Human
caugccgccuguguucuaauccaucucagccaggggcccaaugucauugccagauggauagaggguaug

SEQ ID NO: 4101713 - RNA, 69 nt, Human
caugccucagugcacaggacagccaccacaaagacuuaucuggcccaugugucaauagcacugaggcug

SEQ ID NO: 4101714 - RNA, 63 nt, Human
caugcucuccauuggacacagagcuuacagcacaccugcuaggugccaggcacggagugcaug

SEQ ID NO: 4101715 - RNA, 61 nt, Human
caugcugauucuuccugagcuuuaacucugugauccucacagcucaugggaggaaggcaug

SEQ ID NO: 4101716 - RNA, 59 nt, Human
caugcuggaauugaccuagaaggaacuggagacauuuugaaagucaaccuuccaguuug

SEQ ID NO: 4101717 - RNA, 65 nt, Human
caugcuguccugaaaagauauucauuacuaugguuaagcauaaauguaaguucuagaacagcaug

SEQ ID NO: 4101718 - RNA, 62 nt, Human
caugcuuauucauauauucucgguagcugauuucaugcuacaaugacagaauugaguagcug

SEQ ID NO: 4101719 - RNA, 63 nt, Human
caugcuucacacacugaaugacagguagaaaaaagggaccauuauuuagaccccagaggcaug

SEQ ID NO: 4101720 - RNA, 57 nt, Human
caugcuugcucucagccuucucaaguacaacuggcaaaggcuggagaugcaggucug

SEQ ID NO: 4101721 - RNA, 67 nt, Human
cauggaagaguggggaugaggaugcuuucaugguuguauggcgucucauccucccgcuaauucugug

SEQ ID NO: 4101722 - RNA, 80 nt, Human
cauggaauuuacccgagaugggauaaauauaauuuuguguuuuuuaacagaauaagguuuaucucuccacaguuuccaug

SEQ ID NO: 4101723 - RNA, 62 nt, Human
cauggagcgguaguuggcaaacuacagccuacgggcaagauuuagccugcugccuguuugug

SEQ ID NO: 4101724 - RNA, 82 nt, Human
cauggagggguccaugugacguuguucuggauucccauuguaacuucaagggaaacuuucacaauguccagagcccuugaug

SEQ ID NO: 4101725 - RNA, 57 nt, Human
cauggaguguuuguuuggagggguuaaugucaauuucuucaauucaacacugccaug

SEQ ID NO: 4101726 - RNA, 58 nt, Human
cauggauaccagcucacacaaucuuugugaucagcaucaaagaaagagcuggccuaug

SEQ ID NO: 4101727 - RNA, 99 nt, Human
cauggauguugccuucucuuuuacuguaucuccuucccuucuuuggcaaguugucaaagcaugguggaugauacaguggauaaaagaggcugcaguaug

SEQ ID NO: 4101728 - RNA, 66 nt, Human
cauggcaacuagcuggauuaguguuuuccacauggaagggcuuugggucagagcuauguagcuaug

SEQ ID NO: 4101729 - RNA, 56 nt, Human
ccaaauggugacaugcuuaugugcaauucuugcucaagagcucuccacuagguugg

SEQ ID NO: 4101730 - RNA, 66 nt, Human
ccaaaugugccuguuucaacaaagucaaucaguuaaagaacaauguuuggagagaggaacauuugg

SEQ ID NO: 4101731 - RNA, 83 nt, Human
ccaaauuaaaaguugaagcaugaaccaaggucaaagguuaaggguuaggaugugggauuuugguguucaugcuccagguuugg

SEQ ID NO: 4101732 - RNA, 67 nt, Human
ccaaauuacacuggugauggucagugacagguuucuuauuucaaagcccugccuggccauuccuugg

SEQ ID NO: 4101733 - RNA, 130 nt, Human
ccaaauucuuugugaauucauggcauugguagccccauucuuuguguuuguacaaugcacuagucuccagagugugcauuccuugaaugauagagguuuuuaguuauaguggcaugggccaucacuaggg

SEQ ID NO: 4101734 - RNA, 76 nt, Human
ccaacaaagauaugacauggaaaauggcauuaagaagguauuuuguccauaaucugcucacauauucuuuguaugg

SEQ ID NO: 4101735 - RNA, 86 nt, Human
ccaacaacuagauuaggaaggacuuggauucuggagccagacagcuucagcuuaaaucccaucuuugucucuuucacguugugugg

SEQ ID NO: 4101736 - RNA, 129 nt, Human
ccaacacaaguguagaaucuaggacaaggaaccacauugggcuugcaugcacggccaggagagcauuggguucuguaagcaugugcuuaauaagguuauugacaaacuggaacuagcguaaaugguugg

SEQ ID NO: 4101737 - RNA, 63 nt, Human
ccaacaucagaauuagccagugaggcucugaagcagagcuaaugaaauauuuucugauauugg

SEQ ID NO: 4101738 - RNA, 85 nt, Human
ccaaccagaugaaaagauaagcagcaauaaaggauaugagaacuaaauucuuuuacuguuuaaaggcuuccuuucugucuguugg

SEQ ID NO: 4101739 - RNA, 62 nt, Human
ccaaccaguaaaacacauaaauuugaacaauuccucagaguuuguugaauuuacuugguugg

SEQ ID NO: 4101740 - RNA, 57 nt, Human
ccaaccccaugcuccauguccccuccaucuucucuggggcuggaaguguggguuugg

SEQ ID NO: 4101741 - RNA, 61 nt, Human
ccaaccguguucgggaacacuugucagaacuacaauugacaaguguuuccaauauggcugg

SEQ ID NO: 4101742 - RNA, 65 nt, Human
ccaaccucauuguuuuuuguauagcuucauaagaggggcuucucucaggggcaugaguuaguugg

SEQ ID NO: 4101743 - RNA, 70 nt, Human
ccaaccugcucuggcaggaccaugaagcguaggguguaauuuuugguuucaccccugcugcagcaguugg

SEQ ID NO: 4101744 - RNA, 61 nt, Human
ccaacggggaagcugcuccugguuuuacaguuuaguuugaaaucagaggcuuccuaguugg

SEQ ID NO: 4101745 - RNA, 121 nt, Human
ccaacuagcucugugagcaaaaggcauauaaagccauuucugcuguauuugcuugguaugacuuccauuuaagugagaucugaaaugaaaugcuuucuuuguguucucagugugaaauugg

SEQ ID NO: 4101746 - RNA, 81 nt, Human
ccaacuaguggcccugguuaccacaggggucucuguagcugaugccugucugugaugaaaccccugggagggccauuuugg

SEQ ID NO: 4101747 - RNA, 68 nt, Human
ccaacugaaguuaauugaaauguacaauaaaaucugagaggauguguuuaugucaaaacuacaguugg

SEQ ID NO: 4101748 - RNA, 90 nt, Human
ccaagaaagggcauccugggugaauuugaaggaaaggauagucugagccuuuauuuuucaccuugaagauagguuugucuucuuacuugg

SEQ ID NO: 4101749 - RNA, 78 nt, Human
ccaagaacacacaguaugacauuggcagagcuguggguaagucuccaccuuuccugauuucauaucuguagcucuugg

SEQ ID NO: 4101750 - RNA, 82 nt, Human
ccaagagcaaauggcaccaacuuuaugauugguuugucagugucccccauuggcacccugaaguuggucacuuaguuuuugg

SEQ ID NO: 4101751 - RNA, 75 nt, Human
ccaagagcggggcuggcguuagggaggcauccccgcagugaaggaugcuuggagaaucagucccagcugccgugg

SEQ ID NO: 4101752 - RNA, 67 nt, Human
ccaagaggaccuugccagggcagugcuaggcagagucucucugccugccuaggucuggccuccuugg

SEQ ID NO: 4101753 - RNA, 56 nt, Human
ccaagaugggcaccccagcaccuccuccucugagaggagccacugccccaguuugg

SEQ ID NO: 4101754 - RNA, 79 nt, Human
ccaagaugguagaaaugcugaauucuauuuuaagucugauuagagcacuaggcuucucagcaugguuacugugauuugg

SEQ ID NO: 4101755 - RNA, 88 nt, Human
ccaagauuauugaaacuaauaucacaguaguuguuuaguugauauuucuggagcuaugcugcaguuguggaguuugaguccuucuugg

SEQ ID NO: 4101756 - RNA, 63 nt, Human
ccaagcaaggcuaauucacuugcccaaagccacacagcuaguaagugaugaagaccuguuugg

SEQ ID NO: 4101757 - RNA, 82 nt, Human
ccaagcagucuuuguuuacaaaaauaagcagugggauauaguuuacugacuguuuuuguacaacaaguuuucuagaccuugg

SEQ ID NO: 4101758 - RNA, 96 nt, Human
ccaagcuccugccggagggucuuuccugggagccagcccggagugcucacugcccugcucucucccuaggcaagugaguucccaccaggugcuugg

SEQ ID NO: 4101759 - RNA, 61 nt, Human
ccaagcucugggauagcagagagcaugccugucguuucacugcugaauucccagagccugg

SEQ ID NO: 4101760 - RNA, 75 nt, Human
ccaaggacaccaggcacagcucuccugcuacucagaaugagaggucagagagggcugggcuuggccccaucuugg

SEQ ID NO: 4101761 - RNA, 130 nt, Human
ccaaggacagaucuccaagaauucaggagggaaaagcgaucccucuucuuuccagcccccuuggggguauuccccugggggucuugaaagggagagggguaccucagauguuggggauaaggcucuuugg

SEQ ID NO: 4101762 - RNA, 64 nt, Human
ccaaggaucccacccgggauaccaaguuacacuuaauuaucgugucucuuuggguuccucuugg

SEQ ID NO: 4101763 - RNA, 55 nt, Human
ccaaggcuggaguguaauggcaugaucucagcucacugcaaacuccaccuccugg

SEQ ID NO: 4101764 - RNA, 58 nt, Human
ccaagggaaaccgagaggcugggagugccaaguacugcagucucucugucuuccuugg

SEQ ID NO: 4101765 - RNA, 65 nt, Human
ccaagggugugagcaucuguaggagcugagcuccggauccugcagcugaagcucauguguccugg

SEQ ID NO: 4101766 - RNA, 70 nt, Human
ccaagugacaccugauuguguuccucacguucuugucugauaccaagaaggccaauagggugcacugagg

SEQ ID NO: 4101767 - RNA, 64 nt, Human
ccaagugcaugcacacccagcugggucaugacagcacccaggcucugggugugacagcaccugg

SEQ ID NO: 4101768 - RNA, 64 nt, Human
ccaaguguccugcauuggcucugcccagaugcaccuuccgggcuccaggcaggcaggaaauugg

SEQ ID NO: 4101769 - RNA, 67 nt, Human
ccaaguuguggcugugcaccgcugccuggguaucacuuccagggggaugggccugcuaccuccuugg

SEQ ID NO: 4101770 - RNA, 68 nt, Human
ccaauacuuagauuaaaauaguuugaccaauugaaauuaaaauuguuuuuaagguagucuaguauugg

SEQ ID NO: 4101771 - RNA, 97 nt, Human
ccaauaguuuugcucuacuuucacauggacuuuuuguucuagcuucucucaucuuucucuggaauguuaauugcaugugaaaucagauaguaauugg

SEQ ID NO: 4101772 - RNA, 76 nt, Human
ccaauaucagacagcugguuccuucuugaagcaacucuuaaagacagauggaccagccaugucuucaaaguguugg

SEQ ID NO: 4101773 - RNA, 63 nt, Human
ccaauaucugucagccagugagcacuuguucugugaucauggcuaaugcaguauauucaaagg

SEQ ID NO: 4101774 - RNA, 89 nt, Human
ccaauggaacauuuuccauccuccaguaguguagucagauguacacggaagguggaugacuggcugcgggguggaagaagaauucaugg

SEQ ID NO: 4101775 - RNA, 90 nt, Human
ccaaugggaagaccaguggaauguaaaauugcuucagcuguauguacuguucaauuucagcauccauugacaucugugucuucuccaugg

SEQ ID NO: 4101776 - RNA, 82 nt, Human
ccaauguccacgauucuuuauuuucauugccuuuacuuuaaugguuauuagaagugaaggauuguuuuucugacuuaauugg

SEQ ID NO: 4101777 - RNA, 113 nt, Human
ccaauguuguccaagcucacgugugguuugugggucuauguguuugcugcuggcaaauuugcaagcagaugggacuccaaggcaaggcguggaagugaugaugggaacguugg

SEQ ID NO: 4101778 - RNA, 65 nt, Human
ccaauucacuccacuucugugucuggcugccaaaagaacagacaggcuucagaaagaguaauugg

SEQ ID NO: 4101779 - RNA, 108 nt, Human
ccaauucaguucagccagccucccugaacacuucuauucccugcacaaagggugcugugcucagugcugguggugguggugugguggggguggguuggaaagaugugg

SEQ ID NO: 4101780 - RNA, 66 nt, Human
ccaauucauuucuuccccugguucccaugccuccugcaggcuacauguugggguggaaggagcugg

SEQ ID NO: 4101781 - RNA, 79 nt, Human
ccaauuccugaagaaacgcacccuuggcuucauccugccuuugggaaugaagccaaggaugccuuucucuaggaauugg

SEQ ID NO: 4101782 - RNA, 69 nt, Human
ccaauucugguauaguauaaauuaauguucaaauauaugauuuacauugaagggcuauccaauaguugg

SEQ ID NO: 4101783 - RNA, 129 nt, Human
ccaauucuucaguggauauguucagaauguuucuaggucaauaauuuuuaaauggcaagaaauuuuuauguaaagauacaaaaaugguuguucuagcaacuucugauuucaggcacauugaaggcaagg

SEQ ID NO: 4101784 - RNA, 57 nt, Human
ccaauuggauuugguuuuaguugguacagacuggcugcaauugccugaucucauugg

SEQ ID NO: 4101785 - RNA, 102 nt, Human
ccaauuguaggaagcagcacuaugugugacuaauaccuaugaucaagauauaaaguggaaaauauggguauuuuauacauaaccugccacuagcagccuugg

SEQ ID NO: 4101786 - RNA, 127 nt, Human
ccacaaccccaaguuacagggaagauaaaaugaaacugaaagguauuuauaggaugucuugcaauugcucaagaaauauuaaaguaucuuucaauuugauugcagguaacuuaaaaguauacugugg

SEQ ID NO: 4101787 - RNA, 58 nt, Human
ccacaaucuaaagggcuguaucucauacccuuaagaguaugcaaacccugcuuugugg

SEQ ID NO: 4101788 - RNA, 68 nt, Human
ccacacccaggcacaccccgaacggaacccgcacacccauggucccgcacaggcauggccuggggugg

SEQ ID NO: 4101789 - RNA, 61 nt, Human
ccacacuaccuaauaauuugauauucagcaccugcugucauacagauuuuggguugggugg

SEQ ID NO: 4101790 - RNA, 78 nt, Human
ccacagaagauggggagaguggauugggauggacagucuccauuauacaugcuauuuucuuacugucuugacuugagg

SEQ ID NO: 4101791 - RNA, 58 nt, Human
ccacagaaucauauugucaguuucugguugacagaugacuagaugaacagauucuggg

SEQ ID NO: 4101792 - RNA, 59 nt, Human
ccacagccagcccugcccuccccuuuaugacaggagaauccagaguuacauggcugugg

SEQ ID NO: 4101793 - RNA, 58 nt, Human
ccacagcugaccgcaggugagccuaacccuugaaggagcauuugcugagcggcugugg

SEQ ID NO: 4101794 - RNA, 61 nt, Human
ccacagcuucugucugauuagcaagcuuuuaaagaagcaauuugcuuacauggaagcgugg

SEQ ID NO: 4101795 - RNA, 56 nt, Human
ccacaggauccaagggaaggcagaaugcguccucuguagcuuggaugguucugugg

SEQ ID NO: 4101796 - RNA, 114 nt, Human
ccacagggugccagucccuacaaccucucacagcauuauccagggcaacaggaagaacaguugccuggggauugcucugggccaugugcuucuggccauaauuccuucuugugg

SEQ ID NO: 4101797 - RNA, 88 nt, Human
cauggcacagggcaggucugggucagccugaagggguacaggaacaugucugucucuucucagcuguuuuaaucuccccucugccaug

SEQ ID NO: 4101798 - RNA, 57 nt, Human
cauggcagcuccuccagugugauggagugugagaucucgcugaagaagcugcacaug

SEQ ID NO: 4101799 - RNA, 61 nt, Human
cauggccaaagaauuauauuuuauuauuaaaaugguauagauguauucauuguuuggccug

SEQ ID NO: 4101800 - RNA, 115 nt, Human
cauggcccuauugaagcccuuucucuagguuuuagaugaagaaauuaccaagcccuacucuuaaacuuucuaugucuuccuuguagaauuuagagcaguguaaucaauuucugug

SEQ ID NO: 4101801 - RNA, 56 nt, Human
cauggccuugagugacugcacuggucaaacguccaugcagcguggcacagguuaug

SEQ ID NO: 4101802 - RNA, 67 nt, Human
ccacaugaacuuuaccauuuagguaacucuagcaauaagauguucucuuugugguaaguaucauggg

SEQ ID NO: 4101803 - RNA, 64 nt, Human
ccacaugcacuucaccacuaggcuauacugcuaugcagauagcaaagaaagugugagggggugg

SEQ ID NO: 4101804 - RNA, 56 nt, Human
ccacaugccaccuggagagacuacugucugcaagggugucacaggaggccgugugg

SEQ ID NO: 4101805 - RNA, 56 nt, Human
ccacauucucauguaauccuuucaacaagccaaugaaauagguuaaggagaauggg

SEQ ID NO: 4101806 - RNA, 91 nt, Human
ccaccaaaccaaccagggacuuggcucccccuaaggcaccaaggaagcccuggggaaccagcccacugguguucucaugugguuuguuugg

SEQ ID NO: 4101807 - RNA, 55 nt, Human
ccaccagaagcugggagaagcugggaacagguucucucugagagcaucuggaagg

SEQ ID NO: 4101808 - RNA, 65 nt, Human
ccaccagcgucuuccucuuacgaugcgcuccguugaaauuuagcguguugggaggagcugcaggg

SEQ ID NO: 4101809 - RNA, 89 nt, Human
ccaccaggcugugugggugucugcggggcauggggagcuggcauggcugggccacuaacagcacuggcaggcacugucuagccugaagg

SEQ ID NO: 4101810 - RNA, 90 nt, Human
ccaccauggccgccuccucugggaagauucagagcccuucugcagccucagcacuuuucugccugccccagagaggccaggccugcgugg

SEQ ID NO: 4101811 - RNA, 89 nt, Human
ccacccaaaucucaucuugaauuguacucccauaagucccacguguugugggagggaccuggugggagauaauugaaucaugggggugg

SEQ ID NO: 4101812 - RNA, 64 nt, Human
ccacccaacgcuucuggaagagcccaagccaacguauggcucaggaucccaggggugugcgugg

SEQ ID NO: 4101813 - RNA, 61 nt, Human
ccacccagugaaggagcaagaggaaugggaagagccacucccucccucccuccugaggugg

SEQ ID NO: 4101814 - RNA, 57 nt, Human
ccacccuaacaauccuuacuguauucaacuaaaagaaaccaaggaucuugguggugg

SEQ ID NO: 4101815 - RNA, 92 nt, Human
ccacccucagauuugccucccagcaugggcagcucagccaaggcagggcggcccugcacgugcugaggacaggggcguuucuaagagggagg

SEQ ID NO: 4101816 - RNA, 86 nt, Human
ccacccucauuuuacaggggcuucuagggugccagaucugcgggggucgauugggaagaacuagaagcuaaaaaggagaagggcgg

SEQ ID NO: 4101817 - RNA, 57 nt, Human
ccacccugccuugggccagugacuggggccagugacuggucuguguggaggguuugg

SEQ ID NO: 4101818 - RNA, 59 nt, Human
ccacccugggcaggcugggaagagcuucuccucuaggggaacugccugcccagaggugg

SEQ ID NO: 4101819 - RNA, 113 nt, Human
ccaccgaccucugagugauggcacugugccacaauucaccagggcacaaggaagggagacagccacccaccucugagugauggcacugugccgcucuucaccagggcaugggg

SEQ ID NO: 4101820 - RNA, 107 nt, Human
ccaccggcugucucucuuccaggcucugagcccccagaagcagagcuuuguuuuggagguucugucugggugccucgaguaccggaagcugcugaccgucguggugg

SEQ ID NO: 4101821 - RNA, 63 nt, Human
ccaccuaauugcugacucaaguugcugguuugcaaugggcacagaacuucucuuaguaggugg

SEQ ID NO: 4101822 - RNA, 76 nt, Human
ccaccucccccgccgggccuggccgccgucccaaccucgagccacagcuggcgcggccaggcccggcggggggugg

SEQ ID NO: 4101823 - RNA, 65 nt, Human
ccaccucucaggguuuccuaaugcaaauccuugaacccugcagaaguaagcauccagagaggugg

SEQ ID NO: 4101824 - RNA, 69 nt, Human
ccaccugugcuugguacuccauaccaauuauuuuguguaagcuaccuuaguacucuccaaaguaggugg

SEQ ID NO: 4101825 - RNA, 84 nt, Human
ccaccuguucuacacuggccugucaagaauaacaauaauaauaauuauuauuuuagagagaggccugcuguguuggccaggugg

SEQ ID NO: 4101826 - RNA, 61 nt, Human
ccaccuucaucuccgccaucgcgaacgccugcccgaugcaguuccuuggggagggaggugg

SEQ ID NO: 4101827 - RNA, 83 nt, Human
ccacgaagaccauggcuccccaguucucauggcacugcagccuggcagugcagguuuagggcuggggccugcuguguuugugg

SEQ ID NO: 4101828 - RNA, 56 nt, Human
ccacgagggaaccagguggggugcacucgugccccucucuccuggauccccugugg

SEQ ID NO: 4101829 - RNA, 64 nt, Human
ccacgcccucccugagcccggccgaaaaucaaccggcucucguggguagcagaggaggccgugg

SEQ ID NO: 4101830 - RNA, 117 nt, Human
ccacgcugcaggagcuaugaggcguacaggagcauggggaagggauaucaacacacauaaacaaaguaguuccauccuugccuuaugucugucuuuuuuauaccuccguagaugugg

SEQ ID NO: 4101831 - RNA, 57 nt, Human
ccacgcuggguggccacuggccacugcuccuuugggugugccaggcaagacaggugg

SEQ ID NO: 4101832 - RNA, 62 nt, Human
ccacguucccgauggugcacugguuuucuuuccugucugaccaacaagccucuggagagugg

SEQ ID NO: 4101833 - RNA, 59 nt, Human
ccacguucugccuuccaccuguaacccaaucauugcagcugauuaaagggcagacgugg

SEQ ID NO: 4101834 - RNA, 58 nt, Human
ccacuauggauucacuauuggaaagagaauggaaaagucucuccuggauccauggugg

SEQ ID NO: 4101835 - RNA, 74 nt, Human
ccacucaggcucauaucccaucagcaaaaacuggcccugaaugccaggaggcuggauaauguagccuguagugg

SEQ ID NO: 4101836 - RNA, 58 nt, Human
ccacucccuaagcucuucccugggcgccuuguuaacagcucagcucuggggucagugg

SEQ ID NO: 4101837 - RNA, 60 nt, Human
ccacucugcugugcuccaugaucaagguuuccucaauucuguggggcuuggcaggugugg

SEQ ID NO: 4101838 - RNA, 63 nt, Human
ccacucuggcccuccugcugccaguccucucccugugggaugaggcaucagcagggccgaggg

SEQ ID NO: 4101839 - RNA, 68 nt, Human
ccacucuucacugcuuuucuaagauucugugggaauguuaacucccacagcaaaggacagagaguugg

SEQ ID NO: 4101840 - RNA, 57 nt, Human
ccacugaaaggcaaugcugacaguccagguuggcugggcugaagucuuuucagcugg

SEQ ID NO: 4101841 - RNA, 93 nt, Human
ccacugaaauuguucaaaugccuugccugcuacaacuuuguucaaaaacaguuuucaaacaugugaucagagcuaggcaacuauuucaggugg

SEQ ID NO: 4101842 - RNA, 61 nt, Human
ccacugaaugcucgcucagcuuccgcugacuguuguugcagaagaauguaggcauaagugg

SEQ ID NO: 4101843 - RNA, 71 nt, Human
ccacugaggcaggcaguaucuagcuugggacaugcccauuugaagucuuuuaaggaucuuccugccugugg

SEQ ID NO: 4101844 - RNA, 129 nt, Human
ccacugauuucuguguaauuuguguccaauauuucaaagccauuuaaaaaaggauuuugacugcaugccuaguagcuguuucagaucauuuuuuaaguacagaauggauaauuagucuucagugauuug

SEQ ID NO: 4101845 - RNA, 76 nt, Human
ccacuggaaagucugagguaaaauuucuauuuugauaacaacucuuauuaaaagaugaagagugccuuucuagugg

SEQ ID NO: 4101846 - RNA, 67 nt, Human
ccacuggauucucuuacacagaugccaauaagaacaaaggcauuaccuggggagaggauaccgaugg

SEQ ID NO: 4101847 - RNA, 60 nt, Human
ccacuggcccuuugguuuaugacugagucccagacucagucauaaaccaaagggaagugg

SEQ ID NO: 4101848 - RNA, 57 nt, Human
ccacuggccgguagagagcauucagagaugaggcuguucuaccagggccaagcuugg

SEQ ID NO: 4101849 - RNA, 129 nt, Human
ccacugggucagugccagcuucugcaggaugaccaugcacagcagugaguucagugccuucucauccucugcagcugacagcugcugcugcgucuccuccagcugugauguacucauuucaccuggugg

SEQ ID NO: 4101850 - RNA, 66 nt, Human
ccacugggucugaaggacagagcaucaaaccaaagaggauuguucuugagccuuuagaccuaaugg

SEQ ID NO: 4101851 - RNA, 68 nt, Human
ccacugucccugggcacaaucugcuggcgaauccuggaggucugcgccggcugcccguggggaggugg

SEQ ID NO: 4101852 - RNA, 60 nt, Human
ccacugugcauuugaagggaucauuuaguggaaaauguucccaguggaaaauguucaggg

SEQ ID NO: 4101853 - RNA, 60 nt, Human
ccacugugguuauuaucacuguuacugcuuucacaguaacggccagcacuaccacagugg

SEQ ID NO: 4101854 - RNA, 93 nt, Human
ccacuguuaugccucuccagaugcugaaauccaguucggggaccuaucgucucugggcugccuuuuagcucuugugggacuugauuaacuugg

SEQ ID NO: 4101855 - RNA, 71 nt, Human
ccacuguuuuaaaugcucaguagcuggcugacccuugcucuccaugggucugccugcugugaagucagugg

SEQ ID NO: 4101856 - RNA, 57 nt, Human
ccacuuccuugagugguacacauuauuauauuugugcugguucaaaaaggaaggagg

SEQ ID NO: 4101857 - RNA, 55 nt, Human
ccacuucuccccacccucccacaccucaguucugcaugguuggggagaagcuugg

SEQ ID NO: 4101858 - RNA, 81 nt, Human
ccacuugauuauucagauuacuugugccugcuggccgugcuugggccaaaugccggguauaauacucugacugaacaaugg

SEQ ID NO: 4101859 - RNA, 73 nt, Human
ccacuuugccauguugccugcagaaacuugaggucaacaagagagcguucugcacagcauggccucagagugg

SEQ ID NO: 4101860 - RNA, 61 nt, Human
ccagaaaauccauggcucuuucguugcuguuaaaugacaauaaagcagguggauuuauugg

SEQ ID NO: 4101861 - RNA, 91 nt, Human
ccagaaaccaggaaaaugcguggaaggauccuuccuccagagacuuuggagggagagugacccuaccaacacauugauuuuggauuucugg

SEQ ID NO: 4101862 - RNA, 67 nt, Human
ccagaaagagccaaggcugagagcuauuucuccccagaaaugugauuccacagucuugguuuccugg

SEQ ID NO: 4101863 - RNA, 92 nt, Human
ccaggaggaagggauggagagggaaggaggccaugugucccaaaggggaacccugggggagugguccuuuccuaucugccacuggugccugg

SEQ ID NO: 4101864 - RNA, 76 nt, Human
ccaggaggauggugggaguggaacguggaagaggggcucacuuccucuaaacugcgagcaugcccccuucuccugg

SEQ ID NO: 4101865 - RNA, 58 nt, Human
ccaggagguggagauugcagugacugagcugagauugcgccacugcacuccagccugg

SEQ ID NO: 4101866 - RNA, 87 nt, Human
ccaggaguagguuaaccacauagguuucugaacaggcuuguuucaacaagggcugcaagucacagaaacagugauugaucacauugg

SEQ ID NO: 4101867 - RNA, 57 nt, Human
ccaggagucaauaaaggaagcugucuucaaguugagcaauccagagaugacucuugg

SEQ ID NO: 4101868 - RNA, 83 nt, Human
ccaggauaguuuaaacaguuuugaaaugaaagaaccaaguuugaauacuuagauuuucugauuuuaaaacuguaaaacuaugg

SEQ ID NO: 4101869 - RNA, 65 nt, Human
ccaggaucuguacaccucugagugucccaccaugccucucugccagcaguguguauggaaucugg

SEQ ID NO: 4101870 - RNA, 83 nt, Human
ccaggaucuuggggucauggguuuagcauucauucauucagucagucaguaggugccuccaucagugccuccaaggugccugg

SEQ ID NO: 4101871 - RNA, 89 nt, Human
ccaggauggucuugaucucuugaccucaugauccaccugccuuggccucccaaagugcugggauuaugggcaugagccaccgugccugg

SEQ ID NO: 4101872 - RNA, 58 nt, Human
ccaggcaaaucccucuggcagauuguaagcauagucccuaugccagaaauuugguugg

SEQ ID NO: 4101873 - RNA, 91 nt, Human
ccaggcagcuuuugacuguaaucucuuuggccagaaaauguuuuggauucgccaaaauuuuaaaaucaggggaugucaaaccacagucugg

SEQ ID NO: 4101874 - RNA, 81 nt, Human
ccaggcagggcccggccuggggccaagagugcagggccucuguuuagaggcuccugcaggccuuguaggguuccagccugg

SEQ ID NO: 4101875 - RNA, 114 nt, Human
ccaggcagguucuggcccugggugcuccuggccacccgacagaaguccgggaugggaaggccggauguguguuuguguugggggcagggaagagggucuaggauaggguacugg

SEQ ID NO: 4101876 - RNA, 71 nt, Human
ccaggcagugacaaguuacuuggauggcuaaaucagaacugguccaccaaacaaaauugugcacugugugg

SEQ ID NO: 4101877 - RNA, 58 nt, Human
cauagauguguguaaguacauaaguauacacauauauucauguaguuuuauaucuaug

SEQ ID NO: 4101878 - RNA, 72 nt, Human
cauagcaccaaaguccuguuagggucugcuuucuguuuuccaccuugauggggcuguuggaguuuugcuuug

SEQ ID NO: 4101879 - RNA, 55 nt, Human
cauagcauuuaucuuuuguuugaguucuuguaaacugaauaaggugaaugcucug

SEQ ID NO: 4101880 - RNA, 73 nt, Human
cauaggauggagggcuagucauuucuuuuuguaucuuuuacauaaaaaucuaugacugcuucuccucugaaug

SEQ ID NO: 4101881 - RNA, 129 nt, Human
cauaggauugcacucacugcuucccaccucuccucacuuuucagguuaggcauggccaugugauugcucuagccuguaaaacaugagcagaagaggcaugaagcacuuggugagugcuucuaagagcug

SEQ ID NO: 4101882 - RNA, 56 nt, Human
cauaggcuguggcagcuggaagugguagugacuaaugcuggaugccaagggcugug

SEQ ID NO: 4101883 - RNA, 81 nt, Human
cauagggacugccuaucuguggggagcaggagccgggagggcccuguuuucuggcuccacaccucacugcaagguccuaug

SEQ ID NO: 4101884 - RNA, 84 nt, Human
cauaguccacagucuguuccuguucaugacauuuacgugagucagaugacauucaggccaggagaucagauugaagguaccgug

SEQ ID NO: 4101885 - RNA, 60 nt, Human
cauagugacucaugccuauaaucccagcacuuugggaggccgaguugggcagaucacuug

SEQ ID NO: 4101886 - RNA, 66 nt, Human
cauauaaacuugagucucagaguaucuugggccagaacaugauguuacugggagugaguuugugug

SEQ ID NO: 4101887 - RNA, 118 nt, Human
cauauacccaccucucuaaaugccacauucaacaaacuucaaguccagugauacuggcaggaagacagucucuucuucaguacagcauugauuuauguggcagaaaggaugcuauaug

SEQ ID NO: 4101888 - RNA, 83 nt, Human
cauauauuagcgcuuacugaguugccaaauaaaugaauccauaggagucuauuaaguuggcaacuuaguaagcacuuuaugug

SEQ ID NO: 4101889 - RNA, 76 nt, Human
cauaucauaugguuuucaugggaaaaaaauauuuggagcugaucuucauauuuccauguuagaacuaaguguauug

SEQ ID NO: 4101890 - RNA, 57 nt, Human
cauauccaauaugacuaguguucuuauaaaaacagaacauuuggacacagggauaug

SEQ ID NO: 4101891 - RNA, 55 nt, Human
cauauccuauacacauaguugucguuuaugauauguguguaugugugugggagug

SEQ ID NO: 4101892 - RNA, 125 nt, Human
cauauccuugagcgcugcucccacucuguggucugauauccuuguggcaaugucccagguggauaaaacguggcacgacaauuggcaccaaugaauuacucuuggaguagcaauugcuggaugug

SEQ ID NO: 4101893 - RNA, 79 nt, Human
cauaucuguagauuuauuggucuuucauugguaagcauuggcaaugaaaguuccaauaagaacuggauuuggggguaug

SEQ ID NO: 4101894 - RNA, 59 nt, Human
cauaucuuuguaaguuagagguagaugauggcuuacugaacugucugugcagagaugug

SEQ ID NO: 4101895 - RNA, 74 nt, Human
cauaugaauaaucauaucgucucacauaucggcaaggagguugaaaaaugugggaggauuauggauauucaaug

SEQ ID NO: 4101896 - RNA, 124 nt, Human
cauaugcauaucuggguauauauuuggauauaugugugcauguaugugugugugcauauuuguguauauauguguacacacauauauguauguguauauauauauguauauagguauauaugug

SEQ ID NO: 4101897 - RNA, 55 nt, Human
cauaugcauugggauauuucugaacaauucuaacagaaucuuuccccaugcaaug

SEQ ID NO: 4101898 - RNA, 65 nt, Human
cauauggccacagcuuguuugcaaagaaugcugaucaugcuuucaaacaaaacuguucccauaug

SEQ ID NO: 4101899 - RNA, 109 nt, Human
cauaugugaaaauuuggauagccagacugcuuuuaggacuuuauauacuaaguaauaagagagaagccugaaagcguagguuggaaacuagagaguuuguauucaugug

SEQ ID NO: 4101900 - RNA, 87 nt, Human
cauauguguguuucaaauuagcaacugucuugaaaacauaugguacuguguaauuuccugauguuagaacugaaaaauacagaugug

SEQ ID NO: 4101901 - RNA, 85 nt, Human
cauauguugaugcacuauguuuucuccauguuaugcuuuugaaaaggaaaguucaucaaagaguaaauauuugucaaagcaugug

SEQ ID NO: 4101902 - RNA, 55 nt, Human
cauauucuuuaagcaaugcucucuaaauuggggcauguucaccuugggggaugug

SEQ ID NO: 4101903 - RNA, 77 nt, Human
cauauuguacaguauugguguuaguagcauauugaguuuaugcuggauuuuuaguguuaccaaguacuuugcaagug

SEQ ID NO: 4101904 - RNA, 82 nt, Human
caucaaccaggugguucugaaaggccugggaguacugggacaggccaaugucauucagccaggccuuggccacccagugaug

SEQ ID NO: 4101905 - RNA, 110 nt, Human
caucaacucacacgugaggaauuuaagaggaugaaucuguguauccccuugugcaggcacucacacucacagauacucggaccucuucucucucaccugucccuugcaug

SEQ ID NO: 4101906 - RNA, 58 nt, Human
caucaagauggaagagcaaauaguuucucaugcuggagaaaugcucuccaguguggug

SEQ ID NO: 4101907 - RNA, 83 nt, Human
caucaagcccagugcccagacuucugggaggaucuggcugcuacucagugaaaggaagccugggagguuugggagggcagaug

SEQ ID NO: 4101908 - RNA, 76 nt, Human
caucaaugaaaccugaaguacguuacauaauauguaaaacucaaugucauguaaaguguagguuuagagaaugaug

SEQ ID NO: 4101909 - RNA, 68 nt, Human
caucacaucuacuauaagugaucuguuacucuuuagcaggcuagcccaaacuuguuuuggaggugaug

SEQ ID NO: 4101910 - RNA, 57 nt, Human
caucacugggcuucuaaucacugggacgaucuuguggacaaugaggccccgguaaug

SEQ ID NO: 4101911 - RNA, 81 nt, Human
caucacuugagaacuugcuaaaaaugcagaaucuuggucccugaaucagaaucugcuuuuuaacaagaucccuaggugaug

SEQ ID NO: 4101912 - RNA, 57 nt, Human
caucacuuugaaugguaggcaucaauaugauugaaacggcugccacuuaauguggug

SEQ ID NO: 4101913 - RNA, 64 nt, Human
caucagaauagcucuguggauacaagagcaaagggaaauguuauccaccacagcuguugugcug

SEQ ID NO: 4101914 - RNA, 129 nt, Human
caucagaaucuccaggaaggcuuguugaaacauacaucauuggguccuaaccccagagucucugauucaguaggucuaggguggggcccaagacuugcauuucugacaaguucccagaugaugcugaug

SEQ ID NO: 4101915 - RNA, 80 nt, Human
caucagagugcuaagagagauaaucugaaaugaaaugagauggauuauucuagaacagagguuucuaaaguguuuucaug

SEQ ID NO: 4101916 - RNA, 55 nt, Human
caucagaguuaacaucaugacuaucuggacagacagcaucaugugacugcugaug

SEQ ID NO: 4101917 - RNA, 68 nt, Human
caucagcugcccagcaauaaaccagaagagcuagaaaauaauguagaucagacuggcugggcgcgaug

SEQ ID NO: 4101918 - RNA, 57 nt, Human
caucaggcuguguuccuggaaccccaauaacccugggcccccagggccagccuguug

SEQ ID NO: 4101919 - RNA, 63 nt, Human
caucagucagucucuucaguauugugcuagauacugugaauagaaagaugacuaagacuagug

SEQ ID NO: 4101920 - RNA, 76 nt, Human
caucauguagagauuaaugcccaaugcaguuagcugaaucaauuuuagagcugcagcguucauuuuuccaugugug

SEQ ID NO: 4101921 - RNA, 70 nt, Human
caucauuggagucuacuuucucuccuuuuuugccuacucagcagaaagggaugagguagcugcuaucaug

SEQ ID NO: 4101922 - RNA, 78 nt, Human
caucauuuuuauuguuuuuaucucuguguacaaccuucuaaaauauaagguugucuuagucagaaauaugcaauggug

SEQ ID NO: 4101923 - RNA, 108 nt, Human
cauccaaaaauaauuuuaaaagacaucuauuucaggcagcucauguauaaaaugauucugcugugaguuuggaggucuacaguuaucuuugaaauuguggcaggggug

SEQ ID NO: 4101924 - RNA, 60 nt, Human
cauccaaggcacuagcaugaguaagucaucagacccuagaucagcucugugccugggaug

SEQ ID NO: 4101925 - RNA, 72 nt, Human
cauccauugucuagaaaaaugugaaagaauuugagaaauggcaaauuuacacuugguuuacuagagaggaug

SEQ ID NO: 4101926 - RNA, 57 nt, Human
ccagaaauccuggccucacuguaacaaaacauucguuuugguugagccagggccugg

SEQ ID NO: 4101927 - RNA, 64 nt, Human
ccagaaaugcagugguucuacuucucagcugaaguucauagagagguagaggauacugugaugg

SEQ ID NO: 4101928 - RNA, 67 nt, Human
ccagaacaucugacuagucuagcuaggguaacaggccuacaccuuggccaggcauaaaggugggugg

SEQ ID NO: 4101929 - RNA, 57 nt, Human
ccagaagcagugagagaugugcacugauucaucugcauccuuucgcauguuuucugg

SEQ ID NO: 4101930 - RNA, 62 nt, Human
ccagaagucaaugcagaugugauuauauaagaaaaucaagaucauaucuuuguuacuucugg

SEQ ID NO: 4101931 - RNA, 59 nt, Human
ccagaagugccuucucuccucuagcagaagaggagcugugaaugggagggguuuucugg

SEQ ID NO: 4101932 - RNA, 57 nt, Human
ccagaauguuugugaacagucuuaaugaccacugugacuguucauuugaugaacugg

SEQ ID NO: 4101933 - RNA, 67 nt, Human
ccagaccaaacuguaaauacagaacuaggcacaucucaauguucugucucuguguuuacauuacugg

SEQ ID NO: 4101934 - RNA, 101 nt, Human
ccagacccuaccucucagaaaccucagccuuggccccaggcaguggugggacaacacaaaccacacagcagagggcacaggagcuggaggagagguucugg

SEQ ID NO: 4101935 - RNA, 89 nt, Human
ccagacuccauacuaucagccacuugugaugcuggggaaguuccucuacacaaguuccccuggugccacgaucugcuucacgagucugg

SEQ ID NO: 4101936 - RNA, 59 nt, Human
ccagacucuugagcugauuguauccgaugucgagaaacuugaggcugcggcaguccugg

SEQ ID NO: 4101937 - RNA, 105 nt, Human
ccagacugcuuggcucugagucagccacuucugcugucauccuuuuuauucugcagauggggaaacugaugcucagagaggggcgaguaggccuaguagcucugg

SEQ ID NO: 4101938 - RNA, 64 nt, Human
ccagacuucagaacuguguaagacagugacagcuaugcuauacagugacuagaaguaaugaugg

SEQ ID NO: 4101939 - RNA, 83 nt, Human
ccagacuucuaucuggugucuucugguacuuacuuugagcccaggaugagcucaggagcaucagaagaaauguguaguuaugg

SEQ ID NO: 4101940 - RNA, 100 nt, Human
ccagagaaaggaaggagggggcugaauucgcaggcccaagguguucacacuuguccagaccugggccuugagaaucauguuucuucccucuucacucugg

SEQ ID NO: 4101941 - RNA, 56 nt, Human
ccagagagaaaauggagggccagguauuuucaggcucuuucaacuagcucugcugg

SEQ ID NO: 4101942 - RNA, 64 nt, Human
ccagagcagggguuucccagguucccaccaaaucagggaaacgagccaugaggagacucccugg

SEQ ID NO: 4101943 - RNA, 56 nt, Human
ccagagcugaggagaugggcuugagugccugcucaucuuagcuucuaagguucugg

SEQ ID NO: 4101944 - RNA, 129 nt, Human
ccagagcuggagccaggcuaucuugggucgugggggucaggcaaaguggcuggccgggagaucugcugagugggucagccggucaguccugagcagccgggccucuggugcccagguccacgugacugg

SEQ ID NO: 4101945 - RNA, 84 nt, Human
ccagagcuucuggaggaaugggaugaggccucuguugugacugcaucacacacaguccauucuuccuccauugaauccuucugg

SEQ ID NO: 4101946 - RNA, 104 nt, Human
ccagaggagaggagcaggcgagggcagaggcggacacggaaggacccaggcagaaacgcugucuucuucugcugucuccaucugcccuuuuccuccuucucugg

SEQ ID NO: 4101947 - RNA, 90 nt, Human
ccagaggcauuugaaauaugugucuuuugaaucaaagaaacauagaggauuugaagauggaggagaccgcauuuuauuuuauggcccugg

SEQ ID NO: 4101948 - RNA, 90 nt, Human
ccagaggcugccugugcugugauauugaagauagaaauacuacccugaaguuccuggcaugaaaaauaucacaguacaggcagccucugg

SEQ ID NO: 4101949 - RNA, 59 nt, Human
ccagaggcuggcaagggcuccugaaccaguugucauuucuaucuugccggucucuuagg

SEQ ID NO: 4101950 - RNA, 79 nt, Human
cauucucucuucuucccugagcuuucucaggcugggccaacccaggggccuggggaggugagggcauguggagagaaug

SEQ ID NO: 4101951 - RNA, 76 nt, Human
cauucuucaguuuguacugaauucaauuuaagaaguuguggaggcuguuggauuauucaauauagucugaaaaaug

SEQ ID NO: 4101952 - RNA, 57 nt, Human
cauucuugaaccaggcacuguguagggagaccacaguguuccaguugguugagagug

SEQ ID NO: 4101953 - RNA, 129 nt, Human
cauucuuuacuucuuaacuaagagcuccucaagggagaaagaaugaguuuaggagaagaaccuaacaugcuagacuccacaugaccacucuuuacuucuuacuaagagcuccucaagggagaaaggaug

SEQ ID NO: 4101954 - RNA, 71 nt, Human
cauugaaacagggacaguuacaucaucagacuuuuauguauaagcugcagauuuuugucccuaccucagug

SEQ ID NO: 4101955 - RNA, 85 nt, Human
cauugacccucaugacuaugauuucauuucugaauaugucuuucaagauaauucagggccagaauccccagacaugaacaaaaug

SEQ ID NO: 4101956 - RNA, 115 nt, Human
cauugagaaccuuccuaacauacuucaguacuucccauucugagcucuacaacuguggacagucauauaguuuaagagaauuugggggugacaguguguucagggaguugcagug

SEQ ID NO: 4101957 - RNA, 98 nt, Human
cauugagguagggaaaagauugaaagagaauuugucaccuuauugcaaagaugggcaagcuuuguuucacuuuaucuuuuuccauuugaccuugaaug

SEQ ID NO: 4101958 - RNA, 90 nt, Human
cauugauugguccaagagaagccauuaugcuauuaguugucuaucuauucugucuauaucagcuucuagcaucggcuuugaccaucauug

SEQ ID NO: 4101959 - RNA, 60 nt, Human
cauugauuugcuugccucucaaugcuguucaaacgucaguaacaaggcagcauguuagug

SEQ ID NO: 4101960 - RNA, 73 nt, Human
cauugcagcauuguagcauuuuaaaugagcauucguaaggagucugcuuaaauaaaguuacauucaugcagug

SEQ ID NO: 4101961 - RNA, 121 nt, Human
cauugcaguggucccuacaccuugaagagcaucagaaucauccggggaaugcaguaaaaacacauggacucagcccuguucuguuuuaguagcuugccaggguuugagaaccacugugaug

SEQ ID NO: 4101962 - RNA, 84 nt, Human
cauugcccugaaauuaaauaugaguuugagauuuugauuugaagucuucucuuugaaaugaaauauuuaagcucuuagggaaug

SEQ ID NO: 4101963 - RNA, 94 nt, Human
cauugccuagggagucaagagcucuugcuucuaguccaggccuugacacagacucugagacuucuggcaaguugcuuuauuucucugggccaug

SEQ ID NO: 4101964 - RNA, 67 nt, Human
cauugccugcuggcugcuuccugggauggaaccacuuuauuguccccagggagcccacaggacaaug

SEQ ID NO: 4101965 - RNA, 83 nt, Human
cauugccuggaguucccugagucucccugagucuccaggcagguggggagcagccacgucucagggcagcuccaggugggaug

SEQ ID NO: 4101966 - RNA, 56 nt, Human
cauugcucuagagacaagccugaaauuggaucccagaugugcaacucuaggcaaug

SEQ ID NO: 4101967 - RNA, 56 nt, Human
cauugcuguuucuuucacugccucagauuauaucugaacagaaaagaugcacaaug

SEQ ID NO: 4101968 - RNA, 62 nt, Human
cauugcuugucucccauccccagacauucuguuuacuuugucugggagagucacaggcauug

SEQ ID NO: 4101969 - RNA, 126 nt, Human
cauuggaaucaccuggggagauuuaaaaauuccugcugccaggccucaucccagccauuaagucagaaucucugggaaugggccuggguaacagaaauugucaaaccuucccaggugauuccaaug

SEQ ID NO: 4101970 - RNA, 77 nt, Human
cauuggaugacauauugcacuguauaguauaucuuuuaauagguacauacagccaaguaugaaguaauuuguccaug

SEQ ID NO: 4101971 - RNA, 86 nt, Human
cauuggucaugagguccuccagcuacuaggcaaauacugauuucugugcuuucugugugccaggcccuggggaccaaggaugggug

SEQ ID NO: 4101972 - RNA, 61 nt, Human
cauuggugacauauugugcauuucuuuuauuauagaaucuauuacaaugauguuaccuuug

SEQ ID NO: 4101973 - RNA, 68 nt, Human
cauuggugauaccugagauggacuuuaaggaugugcaugccaccagagggucaacaggagucaagaug

SEQ ID NO: 4101974 - RNA, 77 nt, Human
cauuggugggcacaggggagaaguuugcaugugaugagcaagguuaauacuacuuuuccuuauuccugcuuacugug

SEQ ID NO: 4101975 - RNA, 112 nt, Human
cauuguauuggaaaucaaauucuuuaauggugauaggcugggcagaggccaaugaagggcuauuugcugugcuuauuccauugugggcucuugaauauuccuaacaacaaug

SEQ ID NO: 4101976 - RNA, 67 nt, Human
cauugucaaauccuugucaucugccucagugucuggcauguaguagaugaucaaggguugauuuuug

SEQ ID NO: 4101977 - RNA, 58 nt, Human
cauugucucaguuaauccuucacaacuuuaugguuguagaggaggaaacugaggcuug

SEQ ID NO: 4101978 - RNA, 59 nt, Human
cauugucugguaggaagugggccggaacacauucgagucauuauccucuuuagauauug

SEQ ID NO: 4101979 - RNA, 78 nt, Human
cauugugaauucuuuaugacugaguugucaauugcuuucuuuaggcaaugagccaauguuuaugaaguagcuacaaug

SEQ ID NO: 4101980 - RNA, 93 nt, Human
cauugugaccuuuggggaauguuaaugcacuucuagcucauggaaaccccggaagccagugucgugugacaugagcccagccggauuagaaug

SEQ ID NO: 4101981 - RNA, 88 nt, Human
cauugugugaugcaaguuuuagaagucauacauuauaaaugacaaaacguagacucugaaagcauaauuugucccagaucacacagug

SEQ ID NO: 4101982 - RNA, 83 nt, Human
cauuguguuccuguguucuugacaucuuugauguguccuuuaaugcuggccagugcaagauguuagauuauggggacacggug

SEQ ID NO: 4101983 - RNA, 69 nt, Human
cauuguugaacaccugcuggaugaccagcccaaaggagaagggagagauguucggcguguucagcagug

SEQ ID NO: 4101984 - RNA, 97 nt, Human
cauuguugugaguuagguggaagacaaagauucaauauucaguuauuaacaccuaauuaaaauguucauuguuuuccauauguuguuuauagcuuug

SEQ ID NO: 4101985 - RNA, 80 nt, Human
cauuuaaacaugguacacaaugcauauuuuuccagaugauauucucugacuagaaguuguguugaguaaauuaguaagug

SEQ ID NO: 4101986 - RNA, 121 nt, Human
cauuuaaaggauauuauuuggaagaaaugcacugguggugagugagggaccagcauaagaagagcuguccuuuaacuaguuaccauguuuuaugcaauguucucaauaugauauccaaaug

SEQ ID NO: 4101987 - RNA, 93 nt, Human
ccagugaaauuaaauggcaauuaagaugugggaaaauuuaaucuauuuaaaauuugaucuaaauguaucacaucuggauagaccuuaaacugg

SEQ ID NO: 4101988 - RNA, 98 nt, Human
ccagugagcaagucagagagacagguccagaacacagguguccuagcuaccaggucaguugcacuuucuagauacugugcugucuuccuucuuuaugg

SEQ ID NO: 4101989 - RNA, 71 nt, Human
ccagugcccuucggugucacugaagcucagcccgcggacggcggugugucagugugcaccgggaggccugg

SEQ ID NO: 4101990 - RNA, 58 nt, Human
ccaguggcuugaucuuuugcuguuucgguuuaucacaaaugauuuuccaagccagugg

SEQ ID NO: 4101991 - RNA, 66 nt, Human
ccaguggucuaggucuugugguguccacuugauggaccagccaagacugccuggaaucccuacugg

SEQ ID NO: 4101992 - RNA, 75 nt, Human
ccagugugaaggucucuguugagaacauuugcuucaaacuagaguacaugucucauggcagaauuuuugagcugg

SEQ ID NO: 4101993 - RNA, 64 nt, Human
ccagugugaaguucuuuagugaggaaaggagauagcuuuuucucucuuaaggaguuuaaaaugg

SEQ ID NO: 4101994 - RNA, 60 nt, Human
ccaguuaccaguuccaggggagagguccaaacacuucugcccauugcaucuugguacugg

SEQ ID NO: 4101995 - RNA, 63 nt, Human
ccaguuagcuuuaggcccccaaaccagaucauuaggucucuggaauuggcugaggcaagcugg

SEQ ID NO: 4101996 - RNA, 65 nt, Human
ccaguuauaggagccauuguauaguucguacuggaaggucuugcuaccaacuggcccugaauugg

SEQ ID NO: 4101997 - RNA, 95 nt, Human
ccaguuccugcaggccaccgcccaggaagaagggaucuuuggugagucccaaccagucagcccaggcuccugcaggcagugguguuugcuggugg

SEQ ID NO: 4101998 - RNA, 70 nt, Human
ccaguucuuucugugugcaacacacucauuuaacuccaaugacaaucucauguaauacagaaggaaaugg

SEQ ID NO: 4101999 - RNA, 76 nt, Human
ccaguugagaaacacagucuuaucccaaccaccacuguaguaguggguuguugguuaugugauuguucuuuucugg

SEQ ID NO: 4102000 - RNA, 94 nt, Human
ccaguuuaaagauuaaacaugcaaagcguuuugaccagccaggaagcacugcuguugucuuuuguuuugccaaguuugauccuuaguaagcugg

SEQ ID NO: 4102001 - RNA, 59 nt, Human
ccaguuuaagacuuaucucaaucucuaaauuuagagauugaggauaggauuuaagcagg

SEQ ID NO: 4102002 - RNA, 80 nt, Human
ccaguuugcagcuguuucggguggagguggaggaaguuacgaaucuauucuacuuauuucuugguacaaauuuaaauugg

SEQ ID NO: 4102003 - RNA, 78 nt, Human
ccauaaauaaacucccagugugaugagguugcuaaaaauaacauaauaacauuuuaggcucuucuaacacuggugugg

SEQ ID NO: 4102004 - RNA, 106 nt, Human
ccauaaauauagaauagaaaagcuauauuauauuuguguuuggugaaaugaaguguuacccaaacucagauguggugaagaccuuuuguguucucuauauuuaugg

SEQ ID NO: 4102005 - RNA, 107 nt, Human
ccauaaguaagagcaugaggcugcagcaucgccaccugccucagucgugcuucaugugcgugagcugugugugugaacguguguauccucaguguuugaugcaaugg

SEQ ID NO: 4102006 - RNA, 72 nt, Human
ccauaauaaucucauugcaaaugucugacugugaugcuccagaguucagcuacugcaaaugugucuuuaugg

SEQ ID NO: 4102007 - RNA, 67 nt, Human
ccauaccauucugguccauacuguucucuuaaauaacagagagaacaguguggaccagaauuauugg

SEQ ID NO: 4102008 - RNA, 98 nt, Human
ccauagcuacaggacucaggccugaugagcuuccagcugagcacugggugucacucgggcuuuaccugcuuaucuucaggaucucucuucugguuagg

SEQ ID NO: 4102009 - RNA, 81 nt, Human
ccauagcuagcagguugcaucugucuuauauaugucccuuaaaauagaagaccuggaucacaacacugcugaucucugugg

SEQ ID NO: 4102010 - RNA, 58 nt, Human
ccauaguacuugcauaguacuauguggaguccacauaguacuccaccaguacaugugg

SEQ ID NO: 4102011 - RNA, 79 nt, Human
ccauauucuuccucaucaaucuguagguaauugcugaaguagagguacaggacuccugcauugaucaggcagaaucugg

SEQ ID NO: 4102012 - RNA, 62 nt, Human
ccauauuuggcgucucucaggagcucaggaaguacuuggcugagugaacauguccauugugg

SEQ ID NO: 4102013 - RNA, 59 nt, Human
ccaucacagggggcuagaagucuaagucaaagcuuuggcaagauugguuccuuuugagg

SEQ ID NO: 4102014 - RNA, 89 nt, Human
ccaucacaugcgguccccaguguggcugcaggggccacuuaggauucuucuguucggggucccaggccacacuuggggaacccuauugg

SEQ ID NO: 4102015 - RNA, 79 nt, Human
ccaucacuggcugcuugggacagccaugaaaccguucgugauuguguacucccaagauggccuuuuguagaguaugugg

SEQ ID NO: 4102016 - RNA, 62 nt, Human
ccaucagaaugaauguucuggagcccuagcuggguuguuugagagcacucauugcuccuagg

SEQ ID NO: 4102017 - RNA, 64 nt, Human
ccaucagcaguuugaaaugaggcauagucuggaaucguuugccauaauuugauaugcuugaugg

SEQ ID NO: 4102018 - RNA, 64 nt, Human
ccaucagccuggaaggcagccuggagagugacggaauuccacaggcuguggaccagcuggaugg

SEQ ID NO: 4102019 - RNA, 58 nt, Human
ccaucaggaagaauuggaugcuacaggcagaacuggcagcauucaucucuuccucagg

SEQ ID NO: 4102020 - RNA, 57 nt, Human
ccaucaugccgggucacuguuaggaacauccaagauucugcugugcucgagugaugg

SEQ ID NO: 4102021 - RNA, 63 nt, Human
ccaucauuccauccacucuugaugacuuuugccaucauucagucaaaaaugauggagagaugg

SEQ ID NO: 4102022 - RNA, 95 nt, Human
cccaagugagcaggagauagaggcuguagccaguacugguguuuuugguaguagaggcuccuucacucuggcaccgccuccuugcauaguugagg

SEQ ID NO: 4102023 - RNA, 78 nt, Human
cccaauaacuagaaagauucucugaaccuuaccaguugccugaugggaagcaaggaaucuuaccucucuauuguuggg

SEQ ID NO: 4102024 - RNA, 77 nt, Human
cccaauagcuccaaugaggcaaagguggaggugggguguugguuuccacuggcccaccuccucagugguccucuggg

SEQ ID NO: 4102025 - RNA, 61 nt, Human
cccaauauauucuuaaagaaucugacccauaccugggcaguaggagaagaggaugcuuggg

SEQ ID NO: 4102026 - RNA, 80 nt, Human
cccaaucugcucugcugucuucuugcaggcugggaaacugaggcccauacaggagacaggagggacacacagaagucggg

SEQ ID NO: 4102027 - RNA, 73 nt, Human
cccaaugcucauauuauucuaguaacagugaucuguuagcaaaggauucugugaaaagaauaauggggguggg

SEQ ID NO: 4102028 - RNA, 78 nt, Human
cccacaagccuaugaugguuaguuaucccugucugaaaaucuggacugagggaaauaaucuauucugaggcuuaaggg

SEQ ID NO: 4102029 - RNA, 121 nt, Human
cccacaccauggguucugggcugccucacccucccucauugccuccugcgugcacagaacauccuuuccaugggggacaugcaucaggaguagagaaggcugggcagggacaugguguggg

SEQ ID NO: 4102030 - RNA, 70 nt, Human
cccacacccacgcagcucaccucccugguggcgcucagccugucaggcagguuggcugcaggucucuggg

SEQ ID NO: 4102031 - RNA, 68 nt, Human
cccacacugugcagauucccugugagguuuggaucuaagaacucacauguacugucugugacaugggg

SEQ ID NO: 4102032 - RNA, 71 nt, Human
cccacagaauuggagaaggugcuggaggauugcuucucucuaaagagaaccuuuucucauucccugaaggg

SEQ ID NO: 4102033 - RNA, 66 nt, Human
cccacagccaggccaccuggggcaggaacuuuccauggcucucugggagguccuggcuagaagggg

SEQ ID NO: 4102034 - RNA, 129 nt, Human
cccacagccuguccuccucucuugagagcuguccuggcucaggcuguggcuggauucucaagcagcaucauguggccagguuaggagcaggaugucacagagagagggguccaaaguucagcugcuggg

SEQ ID NO: 4102035 - RNA, 124 nt, Human
cccacaggcucugccuuccaucccccagccccaguccagugccaugcauggcugugcucagccgagcuggcaucccuggccuucugcuagggcugaaagugccaaggacuccacuaccuuuggg

SEQ ID NO: 4102036 - RNA, 57 nt, Human
cccacaguccuuagacucagcauggcaaacccugagcuuggagucuaaagacugggg

SEQ ID NO: 4102037 - RNA, 110 nt, Human
cccacaucagcccagggacagccuuugaaggggccugaggcacuaacaaggacaaggacuguguccugugaccugcuguguuuguccccaaaguguccgugaggaguggg

SEQ ID NO: 4102038 - RNA, 56 nt, Human
cccacaucccuuccccgcugugcccuuugucacagugacacucaggugggaugggg

SEQ ID NO: 4102039 - RNA, 55 nt, Human
cccacaucucacaucuuggaaccaauggucuucugaagaaaaaugagaugauggg

SEQ ID NO: 4102040 - RNA, 68 nt, Human
cccaccagaccugcaccggcacagcccucgcucagcggggcaggaagcucaugguguaguuucguggg

SEQ ID NO: 4102041 - RNA, 69 nt, Human
cccaccagcugcugcaccgugcaugggucugagguggccccaugugaccugugucaguugcuuuuuggg

SEQ ID NO: 4102042 - RNA, 117 nt, Human
cccaccagcuuucccuuccuuucucucccuuucacuuaacuagcccagccuaauagaggcagugaaggacaggcaggugaggggcagacaggacaaggaagguggaggcuggcaggg

SEQ ID NO: 4102043 - RNA, 81 nt, Human
cccaccaggguccaugaaggagcugcacccacggagccuguuccuccccggaguccuggacaagcccuucacccugcuggg

SEQ ID NO: 4102044 - RNA, 112 nt, Human
cccaccccgcaccccagccagcucccagcccucaggcuuugcugggcccccugcagggauggcucagcaccagaccuagggcgugggccuggugaccaggucuggggguggg

SEQ ID NO: 4102045 - RNA, 88 nt, Human
cccacccgccacguggucuggaggcuucuauagugucuucugggaagagacaagaaacugggagucucugcaaugacaggcagguggg

SEQ ID NO: 4102046 - RNA, 79 nt, Human
cccacccguuucucagcagaccuguugccacggugacugaagcccccagcucugucuguagaaacuucagauggguggg

SEQ ID NO: 4102047 - RNA, 61 nt, Human
cccacccuuuuuguggaggccuggcgcuuacaacgcugcagguggcuccacgagggguggg

SEQ ID NO: 4102048 - RNA, 94 nt, Human
cccaccugcugcugcccugagucaucccugccugccuggggcacccaaagcccaggccccagggcuggcuuuccaggucacugcugccaggggg

SEQ ID NO: 4102049 - RNA, 83 nt, Human
cccaccuguauaggcaaucacauuagugaaacacugaaggaucuccuuuaguauuucuaauguaauugccuauaaauauuggg

SEQ ID NO: 4102050 - RNA, 67 nt, Human
cccaccuucuguugcuauuuugagagucauaguugcuuugaacugugcaaugaguaauaaacuuggg

SEQ ID NO: 4102051 - RNA, 55 nt, Human
cccaccuuuuuccucagguccagcuccccugacuggaggauuccuggaaggcggg

SEQ ID NO: 4102052 - RNA, 75 nt, Human
cccacgcggaggaggucaggaggugacacagguucgcggaagaaagcgggacucaucuuccucauuucuccaggg

SEQ ID NO: 4102053 - RNA, 84 nt, Human
cccacggguggagcaguaggagaacccugagcuccagagugaaucuggccaggguucgaauccguauggcucucuuaccguggg

SEQ ID NO: 4102054 - RNA, 110 nt, Human
cccacguccaggcccaucuuccugaggucaccuggaggcagccuucuccaccccauguucauaggcagggcccucagcagguggccuggcgggggucugggccuggaggg

SEQ ID NO: 4102055 - RNA, 61 nt, Human
cccacuaaguaagcuccucuacaagcugcuacuuuguagggcaguuuaucuuaguugaggg

SEQ ID NO: 4102056 - RNA, 57 nt, Human
cccacuacuggaugagcuuggugcccguagccacugcguggccuguccuguuguggg

SEQ ID NO: 4102057 - RNA, 57 nt, Human
cccacugagccuauacaaacagcagcuggcacagcagguuuugggaaacucagaggg

SEQ ID NO: 4102058 - RNA, 55 nt, Human
cccacugaucuguaaacuccaugggaauauggacucuguuuuccugaucacuggg

SEQ ID NO: 4102059 - RNA, 62 nt, Human
cccacuggagggacgcagacacugagaccccaaggagaguggcugcagaggcccccaguggg

SEQ ID NO: 4102060 - RNA, 63 nt, Human
cccacuggcuaggccugccucugauguccacgacaacauucacagcuaagcuuggucacuggg

SEQ ID NO: 4102061 - RNA, 68 nt, Human
cccacuuuaguggcaaguucuuuagucuuugccuuuuugagcuugagaaugugagccacagaucuggg

SEQ ID NO: 4102062 - RNA, 92 nt, Human
cccacuuugucaguucugccuggccugaucuccacgccucauguuccuuuuuggggugauccugugagaagccuggugcuggcaggucuggg

SEQ ID NO: 4102063 - RNA, 81 nt, Human
cccagaacuuuaccucucuuggccgcagucuucucaucuguaaaaugaggauaagauacuaggagggguugaggguccggg

SEQ ID NO: 4102064 - RNA, 70 nt, Human
cccagaaucucagggcucugggagcacucaggcugcauuggccagaacuaucccugcccuggugacuggg

SEQ ID NO: 4102065 - RNA, 57 nt, Human
cccagagacuuuguccgacgacuggcccaggcgcuggcgggacacucaagcucuggg

SEQ ID NO: 4102066 - RNA, 64 nt, Human
cccagagagucgaugggggacacugacaaacgaaucacaaaguuggugccguuugcucuuaggg

SEQ ID NO: 4102067 - RNA, 70 nt, Human
cccagagcaauucucacagaacucuacuaggagcugucaguuucccauaguucugaaugaggaaucuggg

SEQ ID NO: 4102068 - RNA, 58 nt, Human
cccagagcugagggggcacguuaguuuaucaucgccuugucaauccuucuagccuggg

SEQ ID NO: 4102069 - RNA, 63 nt, Human
cccagagguggaagcucugagcagagccacuguggcuucugcaucucaggauucccuucaggg

SEQ ID NO: 4102070 - RNA, 57 nt, Human
cccagauguuugccacucugugagaccaggggauccaguguugucagaucaucuggg

SEQ ID NO: 4102071 - RNA, 76 nt, Human
cccagauuuucacuccccauguuuucucuccuagucacucaacugcaggugaaaauuaugaggauguauuucuggg

SEQ ID NO: 4102072 - RNA, 77 nt, Human
cccagcaaccucauuacuaaugucugcacuuuauggaugaggccgagguuacacagaugguuaguagaggaguuggg

SEQ ID NO: 4102073 - RNA, 58 nt, Human
cccagcagcaggcagagcagacaagagcaacuucuccuggagccaaugugcugcuggg

SEQ ID NO: 4102074 - RNA, 66 nt, Human
cccagcagccuggauguucuuucaggauaacuaaugucagacuagguacucuucaggcuccugugg

SEQ ID NO: 4102075 - RNA, 80 nt, Human
cccagcaguuuauuccuaacucugaauccucacagcagccuugguggguuggagugacagaugaggaaacugaggcuggg

SEQ ID NO: 4102076 - RNA, 71 nt, Human
cccagcaucugggagcagcucagcagauugaucgagcgcagucucucugguucuccccggaugcccuuggg

SEQ ID NO: 4102077 - RNA, 61 nt, Human
cccagccaaaagcaaguuuaccucuacguugaacagaaggagcuagcagcuuuggcugugg

SEQ ID NO: 4102078 - RNA, 55 nt, Human
cccagcccacgguccugggugggcgucuuccgcaugggaggccgugggcgcuggg

SEQ ID NO: 4102079 - RNA, 116 nt, Human
cccagccccugaagggacgacuuggcucuugacuguggagguggauggcccggacgcccgcuccaggccacgaccuccuggaugagcacaggccagcucguacuguggggucuggg

SEQ ID NO: 4102080 - RNA, 65 nt, Human
cccagccccuucguggaagugcauucuccagugaggcaucgcacguccugaaguggaugacuggg

SEQ ID NO: 4102081 - RNA, 58 nt, Human
cccagcccugaccuauuggaaaccaaagcagcaccagggauaguagugaagggcuggg

SEQ ID NO: 4102082 - RNA, 64 nt, Human
cccaaccauucuuucagguucuauaggaagccuacaguagggcuuccuaucccaucugaguggg

SEQ ID NO: 4102083 - RNA, 67 nt, Human
cccaaccccaacuuccuauguugaaauccuaacccucaauguaauauuaggagguggggccuuuggg

SEQ ID NO: 4102084 - RNA, 56 nt, Human
cccaaccccagacagugcaucuuguucggguuucaagaagccuggguggagguggg

SEQ ID NO: 4102085 - RNA, 72 nt, Human
cccaacggacugagcgaugggaggaagugauaagugcagcugucucuucagcccauggcuucuuccucuggg

SEQ ID NO: 4102086 - RNA, 69 nt, Human
cccaacuaugcccagcuuaaaguacacagcuuguacacagcuuguacacagcuugcggcuauagguggg

SEQ ID NO: 4102087 - RNA, 85 nt, Human
cccaacucacgaggccaucuccuucuggagaagaccuuaaucagauccccauggaaggaugauggaaguugcuuguugagauggg

SEQ ID NO: 4102088 - RNA, 107 nt, Human
cccaacuccuucuuaguugacuugggaggauuguccaucugggaggcauccacucauucuucccuuccuggggcaauuuaaagaguuaauauaauauggaccaaagg

SEQ ID NO: 4102089 - RNA, 56 nt, Human
cccaacucucuuaguuaucucauuggaauaguguagaagugcuccagugaguuggg

SEQ ID NO: 4102090 - RNA, 120 nt, Human
cccaacuucaauuucuaguaaaacuauagcuuuaccauagaagaguauugggaauauuaaauagguuuaaauauaucaugaguaaaacuugauagucuuuuacuagaauuauaaaauggg

SEQ ID NO: 4102091 - RNA, 63 nt, Human
cccaacuuucuguuacguccccagagaccuuuuuagggauuuggaagacagggcaggaaaggg

SEQ ID NO: 4102092 - RNA, 64 nt, Human
cccaagaccagccgagagagccugaccucggagaucccuggcucugccacuucuuggcuguggg

SEQ ID NO: 4102093 - RNA, 75 nt, Human
cccaagccccuuucauauacauuguuucauuuacucauaaaucaugaaaugucagagcuggaaggggcauuaggg

SEQ ID NO: 4102094 - RNA, 56 nt, Human
cccaaguauuccuccucugcccuccccgaggcacccugagaugagagugcuugugg

SEQ ID NO: 4102095 - RNA, 70 nt, Human
cccaaguggguauaugugugugugugcaugugcauuugcauacaucaccuauauauucacaaauauuggg

SEQ ID NO: 4102096 - RNA, 75 nt, Human
ccacagucccaggcuccauggcagccacauccaccuuggaguggagcuugguucuggccaugggcuggggaaggg

SEQ ID NO: 4102097 - RNA, 55 nt, Human
ccacagucccauucgagaguaauggcaguaacuauuaugcuuccagggaccuggg

SEQ ID NO: 4102098 - RNA, 58 nt, Human
ccacagucuaugcaacaagguccagccagaugaagccuguagccagguagaacugugg

SEQ ID NO: 4102099 - RNA, 58 nt, Human
ccacagugccuggaauucugcauuuagaaauuugcucuuuggauuaaagacacugugg

SEQ ID NO: 4102100 - RNA, 100 nt, Human
ccacaguggucuuguuucaucucuucuguaggucagcuggccgaagccacagggcugaagcagauggcugagccugcagauggugcaaggcuucugaugg

SEQ ID NO: 4102101 - RNA, 60 nt, Human
ccacaguucuuuguuuauagcuugauaaaaggcucuagcuccuguagcagggaagugagg

SEQ ID NO: 4102102 - RNA, 59 nt, Human
ccacauaauccuguccuggauucuucuccuacaaaggaaggggucugaggauuaggugg

SEQ ID NO: 4102103 - RNA, 71 nt, Human
ccacauccccgcggaaggcaucuggauggaggaggagcuguccuccuccccaccaggccugcugggauugg

SEQ ID NO: 4102104 - RNA, 70 nt, Human
ccacaucugcaaaguccuuuuugccaugcaagguacauacauaaucacagguuucaaggauaagaugugg

SEQ ID NO: 4102105 - RNA, 57 nt, Human
ccacaucugguggccagugcuaguuaguggguucuuggcuagggcacccaugugugg

SEQ ID NO: 4102106 - RNA, 67 nt, Human
ccacaugaugaggaagcugaacaguaaauucaaccuugcugcauuuacagcgucuacagcuaugugg

SEQ ID NO: 4102107 - RNA, 79 nt, Human
ccacauggcuaguaaguagcauugugaggauucaaacccauauuugacuccaaagccccaugcacuuucuacuauaugg

SEQ ID NO: 4102108 - RNA, 57 nt, Human
ccacauuggccucagagguuagacuuccuccuuuucaaaccucugucccacaugugg

SEQ ID NO: 4102109 - RNA, 125 nt, Human
ccacauuuauuaccuccccuccugcuccacacuaaaucuuguggcaaugcuucuaaaagucaauaaaaugagaaggaagaugcgauaaaauuaagguggaaagugcgauggggagaggaaauggg

SEQ ID NO: 4102110 - RNA, 68 nt, Human
ccacauuucuuuuugcagggcugguaggaccaccaccucaggcagucuuucacugcccuguaacgugg

SEQ ID NO: 4102111 - RNA, 73 nt, Human
ccaccaacaguuagcauguucaucuucuguugguuucacaaaaccacggugauggucaugcuucugugccugg

SEQ ID NO: 4102112 - RNA, 92 nt, Human
ccaccaaccuucauaggaucgaugcugugauuguagaaauauuguacaucaaugucauaaucaaguguggggggguauuaaggucaaggugg

SEQ ID NO: 4102113 - RNA, 73 nt, Human
ccaccaagguggcuauauuugaggauacguccugugaggaggugauaaguguuaaauaaagucauaagggugg

SEQ ID NO: 4102114 - RNA, 56 nt, Human
ccaccaauauccuuugaaaugaagguuuauccuugacaucacagaauauugagugg

SEQ ID NO: 4102115 - RNA, 103 nt, Human
ccaccacaagggaaauucuguaagcauuucaauauaauauucacccuuguaaccaaagugaauuauauggaggagcuuaauaaggauuuguugauuuaauugg

SEQ ID NO: 4102116 - RNA, 81 nt, Human
ccaccaccagcagguagagcaccagcuguaaccagggcacagcuccugagccagcgggcucacuuuucaaucugguugugg

SEQ ID NO: 4102117 - RNA, 58 nt, Human
ccaccacugaggcacaggagccaaaggcugggcaacagcuuugugccugagaaggugg

SEQ ID NO: 4102118 - RNA, 65 nt, Human
ccaccagccugggcaucauggugcgggcacgggacacggccucacccaucggugccuuuaugugg

SEQ ID NO: 4102119 - RNA, 87 nt, Human
ccaccaugggccaagccagaaggcauguguuuauugucgucuuggcucaagacacuguucucacaugcuuggcuccccauagacugg

SEQ ID NO: 4102120 - RNA, 102 nt, Human
ccacccaagaaaugguuuaagccagacuguagaguuugagaagucacuaaaacuugaucuccuugcucugcaucugucuuuucuucucauacucucccgugg

SEQ ID NO: 4102121 - RNA, 88 nt, Human
ccacccagcagccuagcugccuucagcccugacuggccaggggcaggcggcccuggggaaggugcuggaggcccuaggcugcuggggg

SEQ ID NO: 4102122 - RNA, 86 nt, Human
ccacccauuuggucuccauacugguuaguagguacucccuccugccagccucuccacaguaggagaugccccaaaacagagggugg

SEQ ID NO: 4102123 - RNA, 67 nt, Human
ccaccccuacguuccugcuuccugccugugaguauguuagggugcugucagcaggacuguggggugg

SEQ ID NO: 4102124 - RNA, 74 nt, Human
ccacccuacaaaagcaacuaaggcaaggaaaugcaaagaauucagguauguucuuggacuaaguuguugggggg

SEQ ID NO: 4102125 - RNA, 71 nt, Human
ccacccucccaccacagcucugccccucagcuuccugccugcgagaggccauggggugggaugcagggugg

SEQ ID NO: 4102126 - RNA, 61 nt, Human
ccacccucccgucagccccugggcuccacagaccccagcaggcauguugggaggaaugugg

SEQ ID NO: 4102127 - RNA, 86 nt, Human
ccacccuccuucuacccuuccugcucuggccugggcugugguagcucccagacugcagagcgggcagagcacaaguaggugggugg

SEQ ID NO: 4102128 - RNA, 75 nt, Human
ccacccugaggaaugguccggccgggccuagcgaggaugucccuaccgcgaugcugguuccguuacccagggugg

SEQ ID NO: 4102129 - RNA, 57 nt, Human
ccaccgagggggcgggaggcggcaggaccagcaggggcagcccguucucuucgcugg

SEQ ID NO: 4102130 - RNA, 55 nt, Human
ccaccggcgucuuucgaccuggagaacaucaucuucaggauggcggauguugggg

SEQ ID NO: 4102131 - RNA, 88 nt, Human
ccaccguggaauaacgugcaacauugcuucugaacauaggaaacucauuuuauggcaaaagaaauguggcaguuggcuuuuacucugg

SEQ ID NO: 4102132 - RNA, 104 nt, Human
ccaccucaauccggagcguucugggaaaggccuggguguccuggguucugaagaccccagggacgcaccccgcugcggucuccuucccugcccggauggacugg

SEQ ID NO: 4102133 - RNA, 57 nt, Human
ccaccuccuggcucaguagaucuggagucccugggccuuacugggccagcaggcagg

SEQ ID NO: 4102134 - RNA, 74 nt, Human
ccaccucuccaucccccacugcccugucagcaaggggaccccagcauggcagcuuugggaggaggaggggcugg

SEQ ID NO: 4102135 - RNA, 80 nt, Human
ccaccucugggggcuuccuuacccucuuauuuugauuguaaaacaagcaucccagggucagguuaagggagucauggugg

SEQ ID NO: 4102136 - RNA, 68 nt, Human
ccaccucuuccucuguaaaaugggucuaacaguccuuguccugccuaccuugcggagguguugggugg

SEQ ID NO: 4102137 - RNA, 57 nt, Human
ccaccugcaaacagucaccucuuggccauucuuggauuuagggauguaugcuggugg

SEQ ID NO: 4102138 - RNA, 58 nt, Human
ccaccugcagcuaaagauguagggggguucccagucuccccuccaaucuuguagaugg

SEQ ID NO: 4102139 - RNA, 69 nt, Human
ccaccugcucccccaggggcuccgccucgugacucacgcucaggcaagucuccgggcgcgaacagcugg

SEQ ID NO: 4102140 - RNA, 61 nt, Human
ccaccugcucuaauggcuucucacugccacgaaugggcugacaggccagaagagcagcugg

SEQ ID NO: 4102141 - RNA, 113 nt, Human
ccaccuggaaacuuguuagaaauggaaauucccaggccccaccccagagcuacugaaucagaaacucugaggucagggcccggcaauuuguauuuucacaagcucuccagggg

SEQ ID NO: 4102142 - RNA, 87 nt, Human
ccaccugugagcacccccaccugugggcuccugcacugaaccccuugaaggugggaugggaggacaggugggaguaaggacagaugg

SEQ ID NO: 4102143 - RNA, 67 nt, Human
ccaccuugcccugugcaggcuccauaauagacccaucauggucuauggggccucacaggcacugugg

SEQ ID NO: 4102144 - RNA, 78 nt, Human
ccacgagaaccaggagggacccugguggccgcaggaguucaggcccaggaacaggucccaggcucccucuuguccugg

SEQ ID NO: 4102145 - RNA, 72 nt, Human
ccacgagcccagccuugacucagucaguucuggagcuauuuacugagcaucagggcugggaacaauuagugg

SEQ ID NO: 4102146 - RNA, 110 nt, Human
ccacgaugauuuuaggagggguuucuacugugguccuuguaaccacauaguuuguacugagcuggacacuggccauuugaguagaugcuuguucuccaguuauagaaugg

SEQ ID NO: 4102147 - RNA, 98 nt, Human
cauucccagagaguuuguucauuuauuucucuucucuauauucucagaaauucuuucugucucagagauguuagggaagagguuggggcaugcugaug

SEQ ID NO: 4102148 - RNA, 68 nt, Human
cauucccaugacuccugcucaggaauacuauuugauauccccccugaauuauauggagugugggaaug

SEQ ID NO: 4102149 - RNA, 61 nt, Human
cauucccgugacaauguuggaucguacaaggauugaacagauggaauguguuaugggaaug

SEQ ID NO: 4102150 - RNA, 61 nt, Human
cauucccuagaacuguuccugacacauaguaaaugcuuagucaacauguucugggugaaug

SEQ ID NO: 4102151 - RNA, 55 nt, Human
cauucccuuggggaguucaugcuuuuccaguuuacuuuauccucccaggggaaug

SEQ ID NO: 4102152 - RNA, 67 nt, Human
cauuccuccacagugaguucuguacucuggugacucuaguuuacuggaacucacuaguuuuggaaug

SEQ ID NO: 4102153 - RNA, 62 nt, Human
cauuccucugccugugccaccgccucauuucucucaggagauggaagggcacuggcggaaug

SEQ ID NO: 4102154 - RNA, 66 nt, Human
cauucuagcucaucuucccauauaacccugucuaccugaaaagggauuuaguggaugagcugagug

SEQ ID NO: 4102155 - RNA, 77 nt, Human
cauucucgcaaugaguugcacaaaagugugcauauaguuaauacuacuguacuguacauguaaacauugucaagaug

SEQ ID NO: 4102156 - RNA, 58 nt, Human
cauucucugccacucgaagucaaggacucacugagucccuuucacagggcaggcagug

SEQ ID NO: 4102157 - RNA, 120 nt, Human
cauucucugcccuucucagccccacucugagcccaagcaggcugacccugaugggccacaucauucuaguuucugguuggguucagccaauaagaggcacugacuggagaccagagauug

SEQ ID NO: 4102158 - RNA, 64 nt, Human
cauucugagaaacuucuuugugauaugugcauucaucucacagaguuaaaaguuucuuuugaug

SEQ ID NO: 4102159 - RNA, 57 nt, Human
cauucugagacaauugccgucaguuaggagaacuuaauaggggcuuauuuuagaaug

SEQ ID NO: 4102160 - RNA, 71 nt, Human
cauucuuaguucaaggcaucuguagcuaacugaaauuaaacauagcuccagagucugaacuauucagaaug

SEQ ID NO: 4102161 - RNA, 61 nt, Human
cauucuucaucagccaaguuuuugaccuagcuaauucaguuacuguuggaaguggagaaug

SEQ ID NO: 4102162 - RNA, 61 nt, Human
cauucuuuaggaugcuagaaaaacuuucauaaaaugucaucuggcuucuccuagagcaaug

SEQ ID NO: 4102163 - RNA, 85 nt, Human
cauugaaggccauaauuuguaagucagagaggcuaaacaguaacuguaaugcuuuguuuugaucuaacuuggugguuuuguaaug

SEQ ID NO: 4102164 - RNA, 64 nt, Human
cauugaauaguuacuuuugcucuucauuaagucuuagugauuuaagaaaggugacuguaagaug

SEQ ID NO: 4102165 - RNA, 81 nt, Human
cauugacauccccuccccaugaagcugggugagucugugccugcuuggaccaguggauuaugguggaaccgauguuauaug

SEQ ID NO: 4102166 - RNA, 80 nt, Human
cauugaguaauauagcuagaugggaugucagcguuuuuugaaugaagcaucucacaaucuagucagcuucuuacacaaug

SEQ ID NO: 4102167 - RNA, 62 nt, Human
cauugagucuccauuugggcuagcagauucccggcagaaucucugguuaggggagauuggug

SEQ ID NO: 4102168 - RNA, 86 nt, Human
cauugaucugaaguuauucaaagccugaguuggggaagagagaauuuccuuccuugguacagaguagcuuucacaucauaucgaug

SEQ ID NO: 4102169 - RNA, 68 nt, Human
cauugccacuauuuucccaccuuucucuuuacaccccuuuaaggaguaucauggccagauguggcgug

SEQ ID NO: 4102170 - RNA, 129 nt, Human
cauugccaugauuuuucuauaacuuggcgcaggccaaugguuucaggcaggacuuucagagcagacuucugucaaauuugccauauggaguuacugggcucagauuauagagguuuuccugguuguuug

SEQ ID NO: 4102171 - RNA, 69 nt, Human
cccaggggacugagccacuugcucacgugcacaugguugugagugguggagcugggcucagacccuggg

SEQ ID NO: 4102172 - RNA, 72 nt, Human
cccaggggggccaaagcuggggaggggcagggccagcacgagguggcucccacccagcuuugaagaucuggg

SEQ ID NO: 4102173 - RNA, 63 nt, Human
cccaggguaaucaugugaagccaaugaaauaauaaaaaggaccacaucggaugaccccugagg

SEQ ID NO: 4102174 - RNA, 74 nt, Human
cccagggucacacagugagcggggcucagagcuugagugucuuugugcuuuguguacauuguguucucccuagg

SEQ ID NO: 4102175 - RNA, 127 nt, Human
cccaggucacacagcugguaagugccagagcugggauuuaagcccaggccacauaguccuucccugugcuguguggccucucaggcuugaucaauuaucucugcuggguauugagcuaggaccuggg

SEQ ID NO: 4102176 - RNA, 95 nt, Human
cccaggucuggcauuuaacaacugcuuauugagugacugguaugugaaagacauuacauuauucuuugauaaauggcagaugaguuagaccaggg

SEQ ID NO: 4102177 - RNA, 68 nt, Human
cccaggugagagcugccuuuccccagagaagguggugugggacuuggcggggcggagccugaccuggg

SEQ ID NO: 4102178 - RNA, 100 nt, Human
cccagguggaagggucaggcugcuggagcuuggguagggcaggcagauccccaaggggagacuguggacccugagucagacagccugacaccaaccuggg

SEQ ID NO: 4102179 - RNA, 57 nt, Human
cccagucagggcauuuggaaggcacugcugagccuagccucaguguccuggacuggg

SEQ ID NO: 4102180 - RNA, 113 nt, Human
cccagucagguuuggggacaagcuggcugcugggccuguucccguauuuugguccaggugggugccaggcccagggagcggggguggcggcgccgucucccagccuugcuggg

SEQ ID NO: 4102181 - RNA, 82 nt, Human
cccagucugagaugcuuuguaauagcagcaggaauggacuaagacacccagguuuccugcagagacagaggccucaacuggg

SEQ ID NO: 4102182 - RNA, 58 nt, Human
cccagugcccucgaggugugcucagaggucaaacgggcaggccugagagaugacuggg

SEQ ID NO: 4102183 - RNA, 55 nt, Human
cccagugcuaagucccgcuggugauaaagaggacacauaguggaacugcucuggg

SEQ ID NO: 4102184 - RNA, 56 nt, Human
cccaguggcaaagcagcuuagaccacauggagacaugaagcaucuuugaaacuggg

SEQ ID NO: 4102185 - RNA, 82 nt, Human
cccagugggauuuguaaaugaugcuuaauagacuuuaaaagccuauuuaaaguuagacagcaucauuucucagaaugcuggg

SEQ ID NO: 4102186 - RNA, 74 nt, Human
cccaguggguguugaguggggguucgcugacuaauugacugagugagugaagcccugugucagcuuccacuggg

SEQ ID NO: 4102187 - RNA, 65 nt, Human
cccaguguuacgugacagccuguagcuuuuuagucaucacugucaggcuuuugcauagcacuggg

SEQ ID NO: 4102188 - RNA, 128 nt, Human
cccaguuaaauuuaaguuucagguggucagcaaauacauuuuuagcauaagcauaucccuuguaauauuuggggcauauuuauacuaaagaaguauuugcuuuuuaucugaaauucagguaugguggg

SEQ ID NO: 4102189 - RNA, 81 nt, Human
cccaguuauacaaguguuagguguagguuccagguauuagaaacugagcaggucacaugguagcacuucgcuguaauuggg

SEQ ID NO: 4102190 - RNA, 67 nt, Human
cccaguuaucacaguuucuucuuuguccaucguuuuccauaacggaagaagcuauacauaauuuggg

SEQ ID NO: 4102191 - RNA, 57 nt, Human
cccaguuccagugcucacauccauucuugguggaggccagagguacugggacauggg

SEQ ID NO: 4102192 - RNA, 129 nt, Human
cccaguucuuuaguucuaauaauaaaggugaacacaaaugcuacuaauaggcaagugauauuuuaacuucuucauuuuaguaaauuguaguauuuuuaagcauuuuauuucauucugggaaauacugag

SEQ ID NO: 4102193 - RNA, 72 nt, Human
cccauaauguuuguaauaaagcucaccacugggcuuucuggccucaguuucuucaucugcagaauccauggg

SEQ ID NO: 4102194 - RNA, 68 nt, Human
cccauagugcacacugcugcuccaggaggaacuuccugagcuggaagagcuugugcuuacucuauggg

SEQ ID NO: 4102195 - RNA, 60 nt, Human
cccauaugucuguggcaauuguugaugguuguagaaguaucugcuagaucaggauguggg

SEQ ID NO: 4102196 - RNA, 74 nt, Human
cccaucagaggcaggagggcauucucugcugaaaugaagagcuguuaaaaauggaucuguuuugccucugaggg

SEQ ID NO: 4102197 - RNA, 123 nt, Human
cccauccaucucugaaccucuguguccccaucaguuuugaggauggaauggcugagagaggcaaaguguaggccuguggcuucugcucccagaaugaugagggauggggaagaaggggcuggg

SEQ ID NO: 4102198 - RNA, 88 nt, Human
cccaucccugggccagccagcauuugccauaccgcuggagagacaucugacccagcacagugcagaugcugacuggcucugugguggg

SEQ ID NO: 4102199 - RNA, 92 nt, Human
cccauccugacuuggcagggagccugaauguuccagggaaagcauuucccugucccaugccucagguuccacaacugucaaauggggguggg

SEQ ID NO: 4102200 - RNA, 56 nt, Human
cccauccuuccugucugagaagcgaaaacaaauguacaaucagcaguaaugguggg

SEQ ID NO: 4102201 - RNA, 127 nt, Human
cccaucucuggggacacuacaucacccacaaccgucgugugguccugcacccgcuuggccaccugcaaaggaaagguguggagggcggggcccacagcucuguuggagggcaugcccuagagacggg

SEQ ID NO: 4102202 - RNA, 56 nt, Human
cccaucugcacugggagcaugucuggcccacaccagcucaagcacugugugaaggg

SEQ ID NO: 4102203 - RNA, 88 nt, Human
cccaugauuuaacaauugcaguagguggagugaauuuuaacguucuaguguuuguuuuaguuacucauuuuguucccagaucaguggg

SEQ ID NO: 4102204 - RNA, 78 nt, Human
cccaugauuuucaggacagacuagacuagcguggcauucuuucacagcuauaaucgucuucugccucauuauuaaggg

SEQ ID NO: 4102205 - RNA, 123 nt, Human
cccaugcugaggcagacgccaagacccugggcacuugcucacagcucuucagacaccacaagcugaacaggagcuucccugugagagggccugugggacuuucacuaaauuugccucaguggg

SEQ ID NO: 4102206 - RNA, 58 nt, Human
cccaugcugaguggccugagaucuuugugugucucucccuuccagccacccagauggg

SEQ ID NO: 4102207 - RNA, 77 nt, Human
cccaugcuucugccuccuccauccuucucaugcagggugccccagggagugggaagauggagugacaggcagcaggg

SEQ ID NO: 4102208 - RNA, 81 nt, Human
cccauggaauaagucucacuuaggucuucaagggcuuuaagagggugcauuguuaaguccugggugagaacugucccaggg

SEQ ID NO: 4102209 - RNA, 74 nt, Human
cccagccggcagcugucuggggagugcucgcggauggcuccucggagcgcuggcgcccucgcggccugucuggg

SEQ ID NO: 4102210 - RNA, 55 nt, Human
cccagcgagcagaccugccuagggcauucauuugcaugcaggcccuguuucuggg

SEQ ID NO: 4102211 - RNA, 121 nt, Human
cccagcgcagcgagcuaaccccgggacacucccaccccggccggcugaacagguugcagcgcgacaccugcgcugucugcugggucgcucaggaccgcggugcggggccuggugcgcuggg

SEQ ID NO: 4102212 - RNA, 73 nt, Human
cccagcgcccaggggcagggcucucuggccuggcuugugcugguucccagagucccugcugucaggugcuggg

SEQ ID NO: 4102213 - RNA, 85 nt, Human
cccagcgggggucagggcucuggugccuucacagaacagccuugcuugggguguggcccucagguuccugaccuucccugcucgg

SEQ ID NO: 4102214 - RNA, 56 nt, Human
cccagcuaccucugcuaggagaggccacauaagcuccauguagauguguggcuggg

SEQ ID NO: 4102215 - RNA, 71 nt, Human
cccagcuacuagcacggcugugagcuuggucucugcagagcacccagcccagggcgugauguuuagcaggg

SEQ ID NO: 4102216 - RNA, 71 nt, Human
cccagcugcaccucuauggccuuucccugagcauaaccccuagcuccccugggccuugagugugcgguggg

SEQ ID NO: 4102217 - RNA, 65 nt, Human
cccagcuggagggcgccaggccagcagccauggggcagagccuggacaccgcccuugcagagggg

SEQ ID NO: 4102218 - RNA, 58 nt, Human
cccagcuggaggggcgcauggaggggcguccuguucuuucugccuuccccuagcuggg

SEQ ID NO: 4102219 - RNA, 57 nt, Human
cccagcuugcucaccauucccaauaauaacugcuugcauggagagcucucugcuggg

SEQ ID NO: 4102220 - RNA, 64 nt, Human
cccaggaaaucaggcuuucuagccagaguagaaacuccugcagaacuuaccuuguuuccuaggg

SEQ ID NO: 4102221 - RNA, 68 nt, Human
cccaggaaggccaugaccacuugcugugaaucuuaauaggacacaugagcugguuuggcccuccuagg

SEQ ID NO: 4102222 - RNA, 73 nt, Human
cccaggagagaggggauaaagcacagaaggcuccaacucacucuccuaccuucuucuuuccucuucucuuggg

SEQ ID NO: 4102223 - RNA, 62 nt, Human
cccaggagauggugcguggucucuaagugauuagcagaauguaaucacccaucugccgaggg

SEQ ID NO: 4102224 - RNA, 58 nt, Human
cccaggaggcagagcuugcagugagcugagaucgccccacugcaacagaucgccuggg

SEQ ID NO: 4102225 - RNA, 55 nt, Human
cccaggaggccugccuggccggagggaggaggggcugggggcagggacuccuggg

SEQ ID NO: 4102226 - RNA, 56 nt, Human
cccaggaggcugagguugcagugagccgagaucgugccacuccccuccagccuggg

SEQ ID NO: 4102227 - RNA, 56 nt, Human
cccaggagguggagguugcagcgagccgagaucgcaccauugcaccccagccuggg

SEQ ID NO: 4102228 - RNA, 79 nt, Human
cccaggcacaccacccgucugcccacugcucugcugcccauggaacucaaggggacagacagaaaguggcaugccuggg

SEQ ID NO: 4102229 - RNA, 57 nt, Human
cccaggccaagggggaaggagaugcagguacacuucucccucaugccuaggccuggg

SEQ ID NO: 4102230 - RNA, 61 nt, Human
cccaggcccuggugccaacuccugcugcucagggacugaacauggcccagaugguccuggg

SEQ ID NO: 4102231 - RNA, 79 nt, Human
cccaggccuggccuccugcuuuuccauuugauucccugccucuuucuauucggacuggaaugccgggccaggcuccggg

SEQ ID NO: 4102232 - RNA, 56 nt, Human
cccaggcgggagugcuguggcgcgaucuccgcucacugcaagcucugccuuccggg

SEQ ID NO: 4102233 - RNA, 55 nt, Human
cccaggcucagggcagacuuucagucuggggcugagguggcccugugugucuagg

SEQ ID NO: 4102234 - RNA, 89 nt, Human
cccaggcugaguguguucuggcuucugcaggauuacuagggaccuucucugccugaggagucagggcagguacuuucacugugccuggg

SEQ ID NO: 4102235 - RNA, 91 nt, Human
cccaggcuggagcucuguggcacgauugcacugcagccucagauucccaggcucaagcaauccuccugccucagccucccaaguagcuggg

SEQ ID NO: 4102236 - RNA, 79 nt, Human
cccaggcuggagugcaauggcgugaucucagcucacugcaagcucugccuccuggguucacgccauucuccugcuucgg

SEQ ID NO: 4102237 - RNA, 56 nt, Human
cccaggcuggagugcaguagugugaucucagcucacugcaaccuccgccucccagg

SEQ ID NO: 4102238 - RNA, 56 nt, Human
cccaggcuggauuucgguggcacgaucucggcucacugcaagcuccgccucccggg

SEQ ID NO: 4102239 - RNA, 56 nt, Human
cccaggcugggggcaggauggcugccuuuucuguuuucccucccuccagcucuggg

SEQ ID NO: 4102240 - RNA, 90 nt, Human
cccaggcuugugcucucuagguucuggucccugggacaguggucacacagacaaaggagguggacgcagccgagggagcaggggccuggg

SEQ ID NO: 4102241 - RNA, 57 nt, Human
cccagggcacggagaagucaccccccgggccgggggaugugugaaucuggcccucgg

SEQ ID NO: 4102242 - RNA, 67 nt, Human
cccagggcucccugcagccucuguguguggucagggagccagggcaggggcccccaggggcucuggg

SEQ ID NO: 4102243 - RNA, 55 nt, Human
cccagggcuuggggcugggagagaccucucucauccugcacuggcuccuccuggg

SEQ ID NO: 4102244 - RNA, 61 nt, Human
cccagggcuugguggcuuguauccaguuuuauuguugauacagaucuuuaacugcccuggg

SEQ ID NO: 4102245 - RNA, 105 nt, Human
cccaggggcucugggggaagaagaggcuauuuguaaaaggaaccuuauauaaaccuguccugauuccuuuuacaaauagccuccuauucccccaggggcucuggg

SEQ ID NO: 4102246 - RNA, 59 nt, Human
ccaaacauuucaaauuuagagauauuucuuuuaaauaucuuggggagacuaguguuugg

SEQ ID NO: 4102247 - RNA, 81 nt, Human
ccaaagaaacacacggccugugacuucuggucauaucgaaucacugauauucccugauguacacuggcauauuucucuugg

SEQ ID NO: 4102248 - RNA, 70 nt, Human
ccaaagcaugaagcauuuuuauucuugugaaagugaugcuuuugcagaauaaacugcuuuagggcagugg

SEQ ID NO: 4102249 - RNA, 64 nt, Human
ccaaagccaacagccagggcugugccucugaggacccacacaggcccagguauguuuguuuugg

SEQ ID NO: 4102250 - RNA, 84 nt, Human
ccaaaggaaucugaacagggaaguucugcaacaggaggggauucugauccuggagccacggagcuuucaacagacacuuccugg

SEQ ID NO: 4102251 - RNA, 56 nt, Human
ccaaaggcuccuuuaccauucuggaggcccagcuucauugauugcaaggagauugg

SEQ ID NO: 4102252 - RNA, 130 nt, Human
ccaaagucacuuccacauuuugggguauguuuuuagcagugccccacucuacugguacaaauuuacuguauuaguccauuuucacacugcugauacagauauaccugagaccagguaauuuauacagggg

SEQ ID NO: 4102253 - RNA, 59 nt, Human
ccaaaguccacaguuuacauuaggauucacucuugguguuguauauucuaugggcuugg

SEQ ID NO: 4102254 - RNA, 59 nt, Human
ccaaagugugggaaguugcuaaaauauggacauauuuuugacauuuuccuaccuuaugg

SEQ ID NO: 4102255 - RNA, 68 nt, Human
ccaaaguuccuuuugucacugauaagauaauuaggguuaauaguuucagugcaaaaauaggauuuugg

SEQ ID NO: 4102256 - RNA, 58 nt, Human
ccaaauacaauuccugagaauacuuguuuuggaagccuuguguuucaggaguucuugg

SEQ ID NO: 4102257 - RNA, 103 nt, Human
ccaaauagaauuuuggaguuuugacaucuuaaaacuaguuuuccauaauauaggacauucauuuugcaauugugaaaacugggagguuaaaagucuuguuugg

SEQ ID NO: 4102258 - RNA, 62 nt, Human
ccaaaucaaaagccaaaaggucaacaaagcagaggugucagcugaagugcuuuugaauuugg

SEQ ID NO: 4102259 - RNA, 69 nt, Human
ccaaaugguaacacucaauuuacaaacucuggauauuugauucggagucuauccuugaauguacugugg

SEQ ID NO: 4102260 - RNA, 68 nt, Human
ccaaauuaagaguaacucuguagaccuuugaugcuauccaaaaaucucuuuagagacucuugguuagg

SEQ ID NO: 4102261 - RNA, 60 nt, Human
ccaaauuaccaguaauaguaugugagaugauacuauccagcagauauuuuggugaacugg

SEQ ID NO: 4102262 - RNA, 108 nt, Human
ccaaauuaucuucagauaaaaacuagaaagaaguuuuuugagaaacugcuuuguuauguguacguucaucucauagagcuaaaccuuucuuuugauucagcaguuugg

SEQ ID NO: 4102263 - RNA, 69 nt, Human
ccaaauucucaucucuucauuagcauuauugggaauuguagcccaggaguaggugaaagagagagaugg

SEQ ID NO: 4102264 - RNA, 60 nt, Human
ccaaauugccagcccacagaguugugaacuaauaaccugcugugcuggucaguccaaugg

SEQ ID NO: 4102265 - RNA, 72 nt, Human
ccaacaaacauuccgcuucucccaggaucuaggcaauggccagcacuuggugacugagcaacgaaugguugg

SEQ ID NO: 4102266 - RNA, 69 nt, Human
ccaacaaauucagagagguuaaauaucuugugaaaacucacagagauggcuuuucagaggcagaguugg

SEQ ID NO: 4102267 - RNA, 85 nt, Human
ccaacacuauaggguuguuuuuauggauuguaugagauaacauacuuaaaauacucugcacacaguggacaagucuuggaguugg

SEQ ID NO: 4102268 - RNA, 75 nt, Human
ccaaccaacaauccuuucuguauuuaaaagaucugggaguuugucaagagaaauauagaaggguuugaagcuugg

SEQ ID NO: 4102269 - RNA, 85 nt, Human
ccaaccaguucuuuugagauuaagaaaauauccuggaauucauagacauuuucaggacuggaagucucaagagaacuauauuugg

SEQ ID NO: 4102270 - RNA, 103 nt, Human
ccaacccccuugucuggaauucuggcuucuugucuaauuuguuauucuuaauaaaaaauuacucacaggaagagugaauaccaagacucuccccuuggguugg

SEQ ID NO: 4102271 - RNA, 63 nt, Human
ccaaccucugcccucagcucuagggauacgauugcucucuuggagcugacagucagagggagg

SEQ ID NO: 4102272 - RNA, 78 nt, Human
ccaacuaugacccauauauacguaauuuguuuggcuaugacccauauauacguaauuuguuuggcucucauaguaugg

SEQ ID NO: 4102273 - RNA, 130 nt, Human
ccaacucugcuaagagaccucaguacacacaaaacaguguuccugccccucaggacuucaaagcgauagacccagguggcaaauacuguuuuucucuguuuacagauguugcagauuuuagugggauugg

SEQ ID NO: 4102274 - RNA, 63 nt, Human
ccaacugcacacuuagcaucugggagugagcgccuccauccuggguggugagcgugaagcugg

SEQ ID NO: 4102275 - RNA, 73 nt, Human
ccaacugcagugcgcucuuuuucucguuguucuggacagagagaagcaaucaguggccauccacugcagcugg

SEQ ID NO: 4102276 - RNA, 77 nt, Human
ccacgccccuagcccgggcuccuucaugcaucuguucagacugaagcugcaucaugcggaacuggcuuugggggugg

SEQ ID NO: 4102277 - RNA, 97 nt, Human
ccacgccuuccucuuugggaccccagagggagccaccaggguguuaccacaguacccuggggacuuccuuuuauggagcccucgagaggggcggagg

SEQ ID NO: 4102278 - RNA, 59 nt, Human
ccacgcuggcuguuucccuuagcugccaagguggaaagcuccagggaacaggcaguagg

SEQ ID NO: 4102279 - RNA, 55 nt, Human
ccacggaagggagggcuuguuauuggaguaccuaucacaguucuaauuucugugg

SEQ ID NO: 4102280 - RNA, 82 nt, Human
ccacguuuuaguuucucugucaaauggaaacuuauccugucagaugacuguaaggauuggugauauuacagaauguacgugg

SEQ ID NO: 4102281 - RNA, 63 nt, Human
ccacuagcuauacauuauguugaaucacuugauacugaaagcauauuguaugucuauaugugg

SEQ ID NO: 4102282 - RNA, 79 nt, Human
ccacucagccaggugggggucgggaggcucccagugcuguaccauaccugccucuugaccccacaaagggacugaaugg

SEQ ID NO: 4102283 - RNA, 80 nt, Human
ccacucagcugucacauguguuguagccucauucagcagugggggugcaggguggggaaauagcgcccucugcugagugg

SEQ ID NO: 4102284 - RNA, 55 nt, Human
ccacucaguugcucucuguuuucgagaagacaugagaagcugcaacaugaccugg

SEQ ID NO: 4102285 - RNA, 100 nt, Human
ccacuccucguagcccuucucagccugcuccaagugcugccagccauuguugauguccuggggcagggcaggagcaggcagggcuaucacaaggaagugg

SEQ ID NO: 4102286 - RNA, 81 nt, Human
ccacucuacccaugaggaugaguuugguccuggcuugcaagguugcugcaagaccugccagccucauccugguagcaaagg

SEQ ID NO: 4102287 - RNA, 108 nt, Human
ccacucuagaaaacacagccaucuuuaugcuuugcuuccuauauucuauuuggaacuuaauauaccaaaaacagaaaggccagguuggcugguauuauggaccugugg

SEQ ID NO: 4102288 - RNA, 87 nt, Human
ccacucuaguuuccaagguucuaaaucgagucacugagguuuucuuuucuagggcuuccaagaugccuucggaauugcuuggauugg

SEQ ID NO: 4102289 - RNA, 59 nt, Human
ccacucuccucacauguucccaauggaaacccugggacaugaagcaucggaggcagugg

SEQ ID NO: 4102290 - RNA, 102 nt, Human
ccacucuuggcauuaagucuucucucagggagagcugcuggcauguggcauguggcauccuuuucccuggauugggacugauguggcugaugccaggagugg

SEQ ID NO: 4102291 - RNA, 57 nt, Human
ccacugaaggcugcagcucagccuaggccucgggcccauggcagugcagucucaggg

SEQ ID NO: 4102292 - RNA, 65 nt, Human
ccacugaucuguuuucagauucugugcuuugcuuguacagaacaugauauaaacagaagcacugg

SEQ ID NO: 4102293 - RNA, 57 nt, Human
ccacugccaugggcuaggcauggagcagcaaugucuuaaguuggaaggugguagugg

SEQ ID NO: 4102294 - RNA, 55 nt, Human
ccacugcccucacugugguucucagcagcuggggacgcagaaagaguggcagcgg

SEQ ID NO: 4102295 - RNA, 78 nt, Human
ccacugcuccuccagggcuugacagggugccucgcacaaggcagaggcccaauggcuauugggugaauggauagaugg

SEQ ID NO: 4102296 - RNA, 75 nt, Human
ccacuggacaaguuggguaggguuuauugcagagcagguggaguucuggaagauaccucuccuaauuucuugugg

SEQ ID NO: 4102297 - RNA, 59 nt, Human
ccacugucugugacaucagaaacuccaguaggacaaaaggcucugauggcaugauaggg

SEQ ID NO: 4102298 - RNA, 66 nt, Human
ccacuuaaaaagaaugaacuguuuaugaaagaaaccuuuugaaagacagaauauuuuugccugugg

SEQ ID NO: 4102299 - RNA, 74 nt, Human
ccacuuauuacgaugggaacaguacuaggcuuccaucugggagcagccacucucauuccacguggcaaaagugg

SEQ ID NO: 4102300 - RNA, 69 nt, Human
ccacuuccaauagagaugcuagcuagcaggguaaggagcuuacucugagucaugcacuccuuggagugg

SEQ ID NO: 4102301 - RNA, 79 nt, Human
ccacuucgcggcugcgcacuuuggaaugcccccgguuacugugguaaccagggcagccgagguguguccucggggcugg

SEQ ID NO: 4102302 - RNA, 80 nt, Human
ccacuuggagaaugaagcuguuuaaaugacuuacuuuuggcuugaggucugaaauuaguuaucuggaugguuauuugugg

SEQ ID NO: 4102303 - RNA, 60 nt, Human
ccacuuggugaggaacugaagccccugccgacagcaagcacagacuccccgccauagugg

SEQ ID NO: 4102304 - RNA, 66 nt, Human
ccacuuuuaugccugugacagcuucaugaagcacaaaacauggagcaauacauggcaugaaauugg

SEQ ID NO: 4102305 - RNA, 71 nt, Human
ccagaaaauguuggguuauuaaauugauagacauguagugucuacaaugagaaaugaucagucuuuucugg

SEQ ID NO: 4102306 - RNA, 63 nt, Human
ccagaaagcaagcaagguguuacauaugaggccaacagagggagcaauacauugcuugucugg

SEQ ID NO: 4102307 - RNA, 55 nt, Human
ccagaaccuuuuggcacuggaauuacaacuguuauccuccuguagaggguccugg

SEQ ID NO: 4102308 - RNA, 91 nt, Human
ccagaagcccccucagcaggcuucugcugauauuucauuggcuauaaccaugucaauuggcugucacggaggcuggagggugggcauuugg

SEQ ID NO: 4102309 - RNA, 67 nt, Human
ccagaaguccaagaucaaggugucagcaggguuuguuucuucugaggccucucuccugggcuugugg

SEQ ID NO: 4102310 - RNA, 97 nt, Human
ccagaauauugucuauuucacauccugaagccccacugguugaauguaccauuguggcauuaauucaguuacugugaaaaguugugguuaauucugg

SEQ ID NO: 4102311 - RNA, 80 nt, Human
ccagaauguuugauaagagcugcugaaacugacaauaaaaccuugcagauuuuuaaguaguagcucauugucacaacugg

SEQ ID NO: 4102312 - RNA, 72 nt, Human
ccagaauugguuagugagcauuccuucaaaccacccuuguguccuuuugacaugugcuuauaacuuuuuugg

SEQ ID NO: 4102313 - RNA, 63 nt, Human
ccagaauuuagcacaauguauggcacuuaguaguugcuccauaaucguguguuaaauaauugg

SEQ ID NO: 4102314 - RNA, 84 nt, Human
ccagacaaaagacaaggacaagagagcacggucuugggcaugguaugagcuugcugcccccugcuuuguccuugaguugcuugg

SEQ ID NO: 4102315 - RNA, 104 nt, Human
ccagacaauagaguacaucccguaagauucuauuuuuguggaacuguagaauaggcaaagucaaucuauggugauagaaaucagaaugggugccuccggucugg

SEQ ID NO: 4102316 - RNA, 82 nt, Human
ccagacacuggggccuugggaggagaacaaagcuccccuuggagcucugggugagccauucuacuccuaacccuugugcugg

SEQ ID NO: 4102317 - RNA, 114 nt, Human
ccagacagaugggauauguuugcaggcauggaucuggaaucauucccuuuccgggacuguuucuaguccuccauucacuucugccuucucaccuacucuaucccucuaguuugg

SEQ ID NO: 4102318 - RNA, 64 nt, Human
ccagacauagcaacagcaucaagucaaauaaauguuagacuggaaggcugaguugauagucugg

SEQ ID NO: 4102319 - RNA, 97 nt, Human
ccagacauggcagcuuccucagcuucgaggggacggccucuggaacacgcucuguccuuccuggugugcaggggccuccccuugcugcccugucugg

SEQ ID NO: 4102320 - RNA, 97 nt, Human
ccagucucuaugugagggucucuccagccuuuagcccacgcgucucucccucccgguggccucagcaaggcuggcagggucucucagugggaacugg

SEQ ID NO: 4102321 - RNA, 55 nt, Human
ccagucugaggccuggugagggugagauaaaacaucccacaagcagugaggcugg

SEQ ID NO: 4102322 - RNA, 66 nt, Human
ccagucuuuucugcaaaaucuaaguuagaguaggaggcucugacaggauuuuuucaggcaagaugg

SEQ ID NO: 4102323 - RNA, 71 nt, Human
ccagugacagccccaagauggccagcagggacuugacccugagcucaggcccuuggggaaaaugcugcugg

SEQ ID NO: 4102324 - RNA, 73 nt, Human
ccagugacauucucugcugcacugauaacacaugagcccacaugcuuguuaucagaacuagagguuucgcugg

SEQ ID NO: 4102325 - RNA, 67 nt, Human
ccaguggaggcugcagcacagcaaauauugcagaacagcaaauauugcugccugagccuuccucugg

SEQ ID NO: 4102326 - RNA, 55 nt, Human
ccagugggaacacuggcauugcugcucuuuugccacaaugccaauguccuucugg

SEQ ID NO: 4102327 - RNA, 69 nt, Human
ccagugggcagccagguuugggaaccacuucuauggggaugguccaucugggaauuggcuguccacagg

SEQ ID NO: 4102328 - RNA, 72 nt, Human
ccaguggucccugagguugcuggguacacuuaaucccacugucaccacgcacucaccacaggggcacacagg

SEQ ID NO: 4102329 - RNA, 82 nt, Human
ccagugugccuugugaugaaugucucuuuuuacaccuuggggcagccuaucagugauaaagacgugucauaauuaauauugg

SEQ ID NO: 4102330 - RNA, 56 nt, Human
ccaguguguucccugccucacugcagcagccugcaaagggcugagggccacgcugg

SEQ ID NO: 4102331 - RNA, 59 nt, Human
ccaguguguuuuucucugacucaugcacauuauuggcucaaggagaagaacagaugugg

SEQ ID NO: 4102332 - RNA, 65 nt, Human
ccaguguugcugguggcuaccauguucaacaguauagaacauuucuuucuauucaguagcacugg

SEQ ID NO: 4102333 - RNA, 78 nt, Human
ccaguuaaaguuaagacacuuucuaaauagaagucuuguauauggggcuuuugagaaaguguuuucccgugaugcugg

SEQ ID NO: 4102334 - RNA, 75 nt, Human
ccaguuacuucaguuucugccucuacccuucuucuugaaggacugaaauguagaggcagaaacugaaggaccugg

SEQ ID NO: 4102335 - RNA, 58 nt, Human
ccaguucuuggacacucuggaguccauccugagacucacugggucccggaagcccugg

SEQ ID NO: 4102336 - RNA, 92 nt, Human
ccaguugaauagaggaugaaaauuauguuauuuucauacaacagaauacaguuuugcgaugaaaauaaaugaacuacaucuaugugcaaugg

SEQ ID NO: 4102337 - RNA, 60 nt, Human
ccaguugauuuuccuccaugugagcaguuccacugaacauuuugcuggggggaaagaugg

SEQ ID NO: 4102338 - RNA, 124 nt, Human
ccaguugucagccuauauuuuggauaagaaacauuauucuuuccaaagagaaguuuucaucagaaaaaggauugggaaaaauauuguuuguuaucugaaauucaguaggagguuuucaacuugg

SEQ ID NO: 4102339 - RNA, 86 nt, Human
ccaguugugcucaccagagcucagugcaagagaccagggaaccaggaagggucugagcuucagugcacugggagcugagcaccugg

SEQ ID NO: 4102340 - RNA, 61 nt, Human
ccaguuuaggacacaugcccaccccuugagccaccucugguggggaguguucugugauugg

SEQ ID NO: 4102341 - RNA, 80 nt, Human
ccaguuuauucaaucucuaucaguaucuauuucauccucuauauaauggagauauuaauacauuauagggauugugcugg

SEQ ID NO: 4102342 - RNA, 67 nt, Human
ccaguuuucuccuuucuaggucacauaucaaacugauaugugguuuuaagcaaaagagaaaaaaugg

SEQ ID NO: 4102343 - RNA, 82 nt, Human
ccaguuuugcaucuugcuuccuaagaaggaaagauugccuuaaaaaauaucaccuccguuagguaaguaggaucaaaaaagg

SEQ ID NO: 4102344 - RNA, 86 nt, Human
ccauaaacagugauacguuccagcuccuuucucagucucugcauguauaucaaggugcugaucucagcugguacaucacugugugg

SEQ ID NO: 4102345 - RNA, 63 nt, Human
ccauaacugaauguauuacaacagaauguguagaaguuuuguuguggcaaauuuguguucugg

SEQ ID NO: 4102346 - RNA, 66 nt, Human
ccauaacuuaaugaagguauuacaaaagcauaaagccacagacgaauauuucucauaagguuaugg

SEQ ID NO: 4102347 - RNA, 86 nt, Human
ccauaacuuccaauaguguauguugcucuuaaaugauuuaaaaagacaggauuggauagagcuauauacagauuauugaguagugg

SEQ ID NO: 4102348 - RNA, 72 nt, Human
ccauaauuuuuccacguacacuggguacacugaguacccagguaagaaaauguaccugugggaggauuaggg

SEQ ID NO: 4102349 - RNA, 84 nt, Human
ccauacauaggugcugcugcucagugucaucauguucguuccuaucagcguggauguggguggguguuuggcucuuauguaugg

SEQ ID NO: 4102350 - RNA, 78 nt, Human
ccauaccucaagaacuuaggagcaagccacaaucuccugaaauguguuuuguggagguuccugauuuuugagauuugg

SEQ ID NO: 4102351 - RNA, 57 nt, Human
ccauacucucuggcccccaagugccccuuuaccuaguucuucaggucagaaagaugg

SEQ ID NO: 4102352 - RNA, 93 nt, Human
ccauacuguguucaaaauauuccauugguuucccuucucacucauaauaaaaccugaaaguuaguaaaaugggauauauuuuguucagucugg

SEQ ID NO: 4102353 - RNA, 72 nt, Human
ccauagcuccaucuugucuacaagauuuuguuagaagccgucaaaauccugcugacucgagaugcgcugugg

SEQ ID NO: 4102354 - RNA, 72 nt, Human
ccauaggaauguacauuuagaucauuucugcauaauuugugugugugucuauaugugcgugauuccagaugg

SEQ ID NO: 4102355 - RNA, 73 nt, Human
ccauaguuuaacagaugaggaggugagggaacagaaagccucagcacaucucucuguugcacaguuacugugg

SEQ ID NO: 4102356 - RNA, 70 nt, Human
ccauauuccuuguuucacugaaaagggacuuagugucauagcuaaaccuuucacuggagaagagaaaugg

SEQ ID NO: 4102357 - RNA, 109 nt, Human
ccaucaagauaggguuagucuuuacaagucacauuuucugugaaguggcuauuggggacaaucaguugucagauaaaugcuucuaaaggaagaauuacuguuuaaaugg

SEQ ID NO: 4102358 - RNA, 56 nt, Human
ccaucagcaugggagcaugggcucuaggcuagagggugcugccccccugcuuaugg

SEQ ID NO: 4102359 - RNA, 79 nt, Human
ccaucaucuagaacucuucaaaaauacagguuuucagauuccagucuggaugauuuucauuugaaaagguccaugaugg

SEQ ID NO: 4102360 - RNA, 95 nt, Human
ccaucauuauccaggcauggauggaacucugcuguggugaggagguugucucgcccacucacccaaguuuuccaugccuguucugcuuuugaugg

SEQ ID NO: 4102361 - RNA, 130 nt, Human
ccauccacagaacuggggccuccagcucuucccggcugagggucccagacccuaagggcaacacauccuuggggcaagagggggacccuggaggcaggggcugcgguauggccauuggguucuguuucgg

SEQ ID NO: 4102362 - RNA, 76 nt, Human
ccauccagcugguccacagccuguggaauuccgucacucuccaggcugccuuccaggcugaugggccacagggugg

SEQ ID NO: 4102363 - RNA, 94 nt, Human
ccauccaguaggucauuucuuucaacauuauauagccacaugccaggcccuauguuaggcaugggagauauaaugguggaccugauaggcaugg

SEQ ID NO: 4102364 - RNA, 70 nt, Human
cccucuaagccuguuuccaucaacacaugcucauuucugggagauaugcacggauagcagguagggaggg

SEQ ID NO: 4102365 - RNA, 123 nt, Human
cccucucacucugaagcguguuuauuucucugggaguugcaggcucucauguucucagggcuuggugagggccugggucuguacuccuccaaguggaaaugaagagcuacagauuuaucuggg

SEQ ID NO: 4102366 - RNA, 55 nt, Human
cccucucagagccucagcuuccugccucuucagaggcagcuucccucugagaggg

SEQ ID NO: 4102367 - RNA, 58 nt, Human
cccucucauuacgucugugguagauugauaaggucugcuggagacaagugugagaagg

SEQ ID NO: 4102368 - RNA, 66 nt, Human
cccucucucgguugcugugguuuuggagacagguucauggugaagcuggcugaagagacagauggg

SEQ ID NO: 4102369 - RNA, 130 nt, Human
cccucugcugauuccuugaaaagcaacaggaaagagcaggcugcuguggaguagacagacuugagacucucugcaccgucuuguuuuguaaacccuuuugcucccuuuccaaggauuucaguucaggagg

SEQ ID NO: 4102370 - RNA, 61 nt, Human
cccucuggaguuacuucaugccaaaguggcugcuauuuggcaaccagguggucuagggugg

SEQ ID NO: 4102371 - RNA, 75 nt, Human
cccucuggcuuucugaagggcagcagacucuugaguauacugcagaggacaugcuuuaucaguagguccugaggg

SEQ ID NO: 4102372 - RNA, 59 nt, Human
cccucuggucagcugaagccccacacuuaaaagguggccuuucaguggaucaggagcgg

SEQ ID NO: 4102373 - RNA, 63 nt, Human
cccucuucuacauucuugagcugaccuagaauuaggguucccccuuuggcaaugagaacaggg

SEQ ID NO: 4102374 - RNA, 64 nt, Human
cccucuucuagaugauaaaccagcagcgcaagagggugcuugguuuuucuuucaggaucuaggg

SEQ ID NO: 4102375 - RNA, 62 nt, Human
cccucuuguuucuucuaagcagcagccagagaucacugguugguuuacaggaauaagcaggg

SEQ ID NO: 4102376 - RNA, 61 nt, Human
cccugaaauccugugcucugugcugcuggacuaggugguaaagaguguuggauucuagugg

SEQ ID NO: 4102377 - RNA, 72 nt, Human
cccugaaggcauuucagagaucucugaggcugcuacucccaucacaggcccagagugcuagugccuugaggg

SEQ ID NO: 4102378 - RNA, 65 nt, Human
cccugaaucuaucuaaucuucagcugugaacacucagaaacacuaaugcagauggagauucaggg

SEQ ID NO: 4102379 - RNA, 63 nt, Human
cccugacaucugucacccugcugacugugaagccugcagagcuaggauagaugaugucuuggg

SEQ ID NO: 4102380 - RNA, 80 nt, Human
cccugacauugacaagcaguaugucuuagugaccauuuucauaguagaauuaguugcugccaauuuguguaauuucaggg

SEQ ID NO: 4102381 - RNA, 65 nt, Human
cccugacggguggcaguucagggcuucgucgauggauucagccagagacuuuaccugugcaaggg

SEQ ID NO: 4102382 - RNA, 55 nt, Human
cccugagaagaucauugccacggagcagaacacgugugcaauggagaaaucaggg

SEQ ID NO: 4102383 - RNA, 70 nt, Human
cccugagcuccagccucuucuggagguacgugcuacucuggucacacccaggugagguuggggcacaggg

SEQ ID NO: 4102384 - RNA, 58 nt, Human
cccugagggcaaagagcagaggggugcucucugguggcccagcaguucugccccaggg

SEQ ID NO: 4102385 - RNA, 90 nt, Human
cccugauggaucucuuccagcugugcuucucuuugguggccucucucuccccaaccagaagaggacacaguguggaauugccuguugggg

SEQ ID NO: 4102386 - RNA, 61 nt, Human
cccugauggcucuugagcagaauguuuuacgaugggaggugcugggcagcagucauugggg

SEQ ID NO: 4102387 - RNA, 85 nt, Human
cccugauucuacaauggauuugcucugugaccuugggcauuuuauuaaagcucuuuggcacugagcagcaucuguaaaauugggg

SEQ ID NO: 4102388 - RNA, 60 nt, Human
cccugcacacucgugucuugacucacguggccuucaugaucgauaccacgaggugggggg

SEQ ID NO: 4102389 - RNA, 57 nt, Human
cccugcagaaccacagacaaacugucuuuagaccaaaguucucacugaucugcaggg

SEQ ID NO: 4102390 - RNA, 57 nt, Human
cccugcagaucagugagaacuuuggucuaaagacaguuugucugugguucugcaggg

SEQ ID NO: 4102391 - RNA, 56 nt, Human
cccugcagggaggauucugaaggugggaugaugcuucagaguuguucugaguuggg

SEQ ID NO: 4102392 - RNA, 90 nt, Human
cccugcagggcugcccugcccagggugguccacuggcaucucugugagccugaccucuucugcccugggcucggcuggcccugucuaggg

SEQ ID NO: 4102393 - RNA, 58 nt, Human
cccugcccacugcuggccaccacccccggcuccccucaggguggggcccagugggggg

SEQ ID NO: 4102394 - RNA, 57 nt, Human
cccugcccugucugcagccuggcuuagaaagccccugcaucauggggaggagcaggg

SEQ ID NO: 4102395 - RNA, 75 nt, Human
cccugccucuugcaugagcucaugccaccacaagucaaucccuugguuccaugagaucugcagggaugggcaggg

SEQ ID NO: 4102396 - RNA, 75 nt, Human
cccuuacaaugaugauacuuuacuggauacccuuggaccacugaguuuagcccaugugguuuuguuauuugaggg

SEQ ID NO: 4102397 - RNA, 69 nt, Human
cccuuacagggauuguuuuaaucaccugcuauucauccugcuggugagaaagggauuccuguuccaggg

SEQ ID NO: 4102398 - RNA, 69 nt, Human
cccuuacccuuuccuggcuggcaguugugguguggcugacuaccaccuaaggcgcccaggaaagaaggg

SEQ ID NO: 4102399 - RNA, 68 nt, Human
cccuuacuaaacccucgauggaucuuaaaucuggaguuuaggaucaaucaccugagggauuuuaaggg

SEQ ID NO: 4102400 - RNA, 76 nt, Human
cccuuagaaagcuucagugugagcauguaaccuugacucagucaauuagaugcacccacuggaucuuuuacuuggg

SEQ ID NO: 4102401 - RNA, 69 nt, Human
cccuuagagaguacugggcugcccuuaauagcugugugauguuaggcaauucacccagacucucagggg

SEQ ID NO: 4102402 - RNA, 62 nt, Human
cccuuagaggcuggaggcagcaaacagaacgugucccucugcugcuuccuggccacugcggg

SEQ ID NO: 4102403 - RNA, 69 nt, Human
cccuucaaggaaaagauaacuugaugaaauagugaucuuguguugauuucauuuuuuccuuuuuaaggg

SEQ ID NO: 4102404 - RNA, 87 nt, Human
cccuucaccacuguagugagcuccaucugcccuuggggcccccuuccugaacaagagagaugcagcucacucacacagugggauggg

SEQ ID NO: 4102405 - RNA, 65 nt, Human
cccuucagaagccugcagccuuugauuguggccugacuuuuaggggucugcggcauuuugggggg

SEQ ID NO: 4102406 - RNA, 75 nt, Human
cccuucagauauuuuaauacuacagauauacaguauauaauaacuauguuaucaguaggguugaacuuuggaggg

SEQ ID NO: 4102407 - RNA, 120 nt, Human
cccuuccaaagauguugcaguauaguucuuggucucuuuaccggaguguuguuaauuacacauuaaccacaugaagacuugggauggaggagggaggaguucuugcagccuguggaaggg

SEQ ID NO: 4102408 - RNA, 63 nt, Human
cccuucccuggcaguccucuuccucgggcgccgcggggcuccuccagggagacugcggaaggg

SEQ ID NO: 4102409 - RNA, 63 nt, Human
cccuucgccgaugcuugcucugugcucccuccucagcuuccagcacaggcuuuggugugaggg

SEQ ID NO: 4102410 - RNA, 78 nt, Human
cccuucguaucuaugaagguauuuuaaucuaacaacugugcugaaggagagguuaacacuauccagauaugauaaggg

SEQ ID NO: 4102411 - RNA, 56 nt, Human
cccuucuaccugugccuuggugggugcauucaccaugaggcaugugaggagaaggg

SEQ ID NO: 4102412 - RNA, 82 nt, Human
cccuucuggaccccagagccucauucuguugggacccaggagcuauuggcucaagagaggcaggauuguggggcuggauggg

SEQ ID NO: 4102413 - RNA, 94 nt, Human
cccuugagcuccagccuggcuauauccagucccgcuauaaccugggcaucagcugcagggcucacugggaggcuauaaccuggggcucacuggg

SEQ ID NO: 4102414 - RNA, 56 nt, Human
cccuugcacauuugucuuuaaugaaggagaaguuaaggaagaucauuguguaaggg

SEQ ID NO: 4102415 - RNA, 83 nt, Human
cccuuggcauugugacuugggcuggcugcacuuggcuggggaacaauucuggaaccaacaugccaguuguccaacaccaaggg

SEQ ID NO: 4102416 - RNA, 56 nt, Human
cccuuggccuccagagacugggcaggggcauagcccugcuaggcuggccuugaggg

SEQ ID NO: 4102417 - RNA, 74 nt, Human
cccuugggcugcgguuuaagacaggcuucacaguauuuacuguuuauaguuuugagcugacagcuauuuaaggg

SEQ ID NO: 4102418 - RNA, 76 nt, Human
cccuuguaggauauuugcuuaagauagcugggggcuaauuuaauuccagaguugcuuauuugaguuucuaugaggg

SEQ ID NO: 4102419 - RNA, 75 nt, Human
cccuuuaucaucagacugacugugguucuaaaauacuaacaauucagagaauaaaauagucugaagauggguggg

SEQ ID NO: 4102420 - RNA, 70 nt, Human
cccuuucagagacagccugggagggacagccaaggccggcuguuuucucagccuguuuaguauuaauggg

SEQ ID NO: 4102421 - RNA, 62 nt, Human
cccuuuccaugugagauacggcuuggacccuuucaaaauuucacauuucacaugggaggagg

SEQ ID NO: 4102422 - RNA, 71 nt, Human
cccuuucccaaucucagccuugagccuggugugggguggaagccccagacuccucuggcuggugggcaggg

SEQ ID NO: 4102423 - RNA, 130 nt, Human
cccuuuccuaaaguuacuuccauuagugagcaaauucacaagagcauugccugccaugaagaauauaucugucuuucuaguaaagugcuuuuggaauuuuuuuucccuagugagagauuuggaaacuuag

SEQ ID NO: 4102424 - RNA, 55 nt, Human
cccuuuccucugacuucuugucuguaacaagacacugguguugauuuggaagggg

SEQ ID NO: 4102425 - RNA, 78 nt, Human
cccuuucggcuucuuagaggcgcucccucuuuaaugguugcguguucgauuuggggugcccugaguugcuguguaggg

SEQ ID NO: 4102426 - RNA, 86 nt, Human
cccuuugaggcaacagcgucuuuccagcuguucuguuggaaaacagcaggaacagcugcuagagaucugugagagcugcuuuuggg

SEQ ID NO: 4102427 - RNA, 59 nt, Human
cccuuuggcauuuccaggauaugcacacuuucacuguccugagauuauugcccaaaggg

SEQ ID NO: 4102428 - RNA, 84 nt, Human
cccuuugugaguguuuauucauggcuaaugaaaaaaagagaaggacucuuggguuuuguguugccauguuaagcauggagaggg

SEQ ID NO: 4102429 - RNA, 78 nt, Human
cccuuuugcauucuucagacucccucuuuaagaagcuguguugggccugcuuauaugggauuugaaggggagcuaggg

SEQ ID NO: 4102430 - RNA, 60 nt, Human
cccuuuugcucagcugccuccuguaugacaacaugggcagggcagcagcagcaacaaggg

SEQ ID NO: 4102431 - RNA, 55 nt, Human
ccauccccagcccagaugcaucacuucuaaagagcagcuuggugaaaggugaugg

SEQ ID NO: 4102432 - RNA, 58 nt, Human
ccauccuuggcagcucagaccuacccuuuaguacuguguucucugcugccaaggcugg

SEQ ID NO: 4102433 - RNA, 80 nt, Human
ccaucuaguggcaaagugcacuagaauccagauucucugauucugaaucuaauguucuuguccauugcaccaucugaugg

SEQ ID NO: 4102434 - RNA, 71 nt, Human
ccaucuaugguaaaauuggaguauuaugucccuggauaugaguucuucacugccaguuuuaccacagacgg

SEQ ID NO: 4102435 - RNA, 65 nt, Human
ccaucucaaacuacacuguaaauugcacagcucaguucugaugucauuuuguuuguuuggggugg

SEQ ID NO: 4102436 - RNA, 61 nt, Human
ccaucucacucauguuucuagaagccuuaugggccacugugcagagcauagaguguggugg

SEQ ID NO: 4102437 - RNA, 100 nt, Human
ccaucucagcugaaagaucauuuccaaauuagaggaagcugcgacugacugagaaggcaggaggugcccucuaguggcaugguuacauuagcuugggagg

SEQ ID NO: 4102438 - RNA, 70 nt, Human
ccaucuccaagaugcuuuucuggguuucucuguuuacaguuagcucuuuugugagcauuuggccagaugg

SEQ ID NO: 4102439 - RNA, 60 nt, Human
ccaucuccccagacccuggacauaaucaguucugauuaguuagggcuccugaggaccugg

SEQ ID NO: 4102440 - RNA, 68 nt, Human
ccaucucguagucucagcucucacgagugcccaacugcugcccucucugaguauccugaacugccugg

SEQ ID NO: 4102441 - RNA, 81 nt, Human
ccaucucuacuaaaaauacaaaaauuagcugggcaugguggcgggcaccuguaaucccagcuauuugggaggcugagaugg

SEQ ID NO: 4102442 - RNA, 57 nt, Human
ccaucucucucauuuugugcacuguuacuuagcaguuuacauaaaaaggcagagggg

SEQ ID NO: 4102443 - RNA, 74 nt, Human
ccaucugcaccugccagagauuucacacugcuauguugcaaauagggcuugaaauuucuggcugugucaggagg

SEQ ID NO: 4102444 - RNA, 70 nt, Human
ccaucugcaugugaauuuccauuuccaaaagucgucagcaauaguaaaugccuagaaaucacgcagaugg

SEQ ID NO: 4102445 - RNA, 99 nt, Human
ccaucugcccaggcccuggagccaagcacucaacuccuggagccuucucuagcucuagguaggcuguguguggaaacagggcagggccaccucgggugg

SEQ ID NO: 4102446 - RNA, 110 nt, Human
ccaucuguuuuaagauuguguuucuguucauacagaguauaguaucguuagaagcaauauugugcuucuguugugcaauauugacauagaaaguuuuaaagauuaagugg

SEQ ID NO: 4102447 - RNA, 63 nt, Human
ccaucuuggcucacauuacugauaaauauuucaguauuuccuauagugagggccuaaagaugg

SEQ ID NO: 4102448 - RNA, 64 nt, Human
ccaucuugggucacugccccccgccggagggcgguuuuucugaggucagugacccacgagaugg

SEQ ID NO: 4102449 - RNA, 93 nt, Human
ccaucuuuccugucaaacaaugccaugcacauaggccaaaucauuuuuaauguaaauauaaaugauucuuguguguagccauugaggagaugg

SEQ ID NO: 4102450 - RNA, 84 nt, Human
ccaugaaaauuggauugggagaaugugagauauagauuagauuccauaugaucauuauuuugucaaauccauuuucuauuaugg

SEQ ID NO: 4102451 - RNA, 68 nt, Human
ccaugaaccaggaggcagccagcacacagcaaugagaggcuugugaggcugcauaguuuggugauugg

SEQ ID NO: 4102452 - RNA, 67 nt, Human
ccaugaagggggccacuguggagaaacaccccagggugccaucaguucuucucagggucccacaugg

SEQ ID NO: 4102453 - RNA, 59 nt, Human
ccaugacaaauaaaccuuugccauuuuaaucuccuuggauuguggguguuuuguuaugg

SEQ ID NO: 4102454 - RNA, 66 nt, Human
ccaugacaaguacaaugguuagaugcauuuguauugcagagacaaucagaaguugugcaugcaugg

SEQ ID NO: 4102455 - RNA, 79 nt, Human
ccaugagauguacaaauccuuccacacaugcauuccauuucuagaaauguauccuaugggaagauauguauguucaagg

SEQ ID NO: 4102456 - RNA, 83 nt, Human
ccaugaguuaauugcucgagaaauaaccuccagauuuaauaaaagaaaagaggagguucuucaugagcuaguuaaaaucaugg

SEQ ID NO: 4102457 - RNA, 68 nt, Human
ccaugccuuucacugaaccagucaguaucaugggcuugccuaugccugggucaugugaauaggccugg

SEQ ID NO: 4102458 - RNA, 64 nt, Human
ccaugcucuguccagugcaccaucauucauuaacucugggaugauggugcauugauagggaugg

SEQ ID NO: 4102459 - RNA, 71 nt, Human
ccaugcuugugggagaagauuuggucaucuagaacucuguucaguguuguuuucucucacuuugagccugg

SEQ ID NO: 4102460 - RNA, 77 nt, Human
ccauggagaucuucugcauugaaaaauucacaauucugguucagcuugaacuuggguuuuccaaaaguuuccacugg

SEQ ID NO: 4102461 - RNA, 80 nt, Human
ccauggcaguguccucucugcugugauuugcuaccugugaccuucaugaggccaaauggcacagaaagcaaaugccaugg

SEQ ID NO: 4102462 - RNA, 59 nt, Human
ccaugggccaggcuugggaugacacagcccucaguuacaaaccgcacuuggacccuugg

SEQ ID NO: 4102463 - RNA, 72 nt, Human
ccauggggcuggcgcaacagaaaaucuggagaacauacgucaugcuauuuucaguguugucccuccccgugg

SEQ ID NO: 4102464 - RNA, 91 nt, Human
ccauggggcuuggcgugcuggaguggcucucccuggagauaggcauguccugggaguggcacucacagcaggauaugaacacagcccuugg

SEQ ID NO: 4102465 - RNA, 58 nt, Human
ccaugguaaauucuuaauugguuuuguuaaaacuaccagugaagagugaaacacaugg

SEQ ID NO: 4102466 - RNA, 58 nt, Human
ccauguagaguagaauaguacaacuguuccauggcacaguuguauuuauuuuaccugg

SEQ ID NO: 4102467 - RNA, 59 nt, Human
ccauguauggaauccuuuaguuuuucuuaagaaagcugaaaaugagacucuacacaugg

SEQ ID NO: 4102468 - RNA, 97 nt, Human
ccauguccccugcaccuucuuggaguauugggccucaggaagcagccucuguucugaaucccaaacucugaaagcaggaguguccuuggggaccugg

SEQ ID NO: 4102469 - RNA, 80 nt, Human
ccaugucuucaggaagggaaaucauccaucuauccaaaaaaaaguauugauaggagcccuucuauuccauggagaugaag

SEQ ID NO: 4102470 - RNA, 76 nt, Human
ccaugugacaguucgguuuccuguucaaacuauugaggcagcuccagcccagaccagaaggaagccgacaacaugg

SEQ ID NO: 4102471 - RNA, 55 nt, Human
ccaugugccucugagaagugagcuuccccagccaagcccacaggaggacauaugg

SEQ ID NO: 4102472 - RNA, 85 nt, Human
ccagcuggucccuucugaucucagcugccucucccuggaagauguagaucuccuugugcugggccagcuucaguggggcuacugg

SEQ ID NO: 4102473 - RNA, 83 nt, Human
ccagcuguguucccaacagcagccugcagcccuguguccaagcuggagauuuuuguccaggcacuugcgggccgcuuggcugg

SEQ ID NO: 4102474 - RNA, 55 nt, Human
ccagcuuagagauagugagucagaugggaaaucaggauucacaucccugggaagg

SEQ ID NO: 4102475 - RNA, 56 nt, Human
ccagcuuggcucuaagacaccuauugguggaaaucguuggcacuuuggcaagcugg

SEQ ID NO: 4102476 - RNA, 85 nt, Human
ccagcuugucugccuuguccagaacuguuuuuugcugcucaguguagcagcuaagaacuugagcucuggauuuugacaaaucugg

SEQ ID NO: 4102477 - RNA, 66 nt, Human
ccagcuuuagagaaaacauauuuguggcucaacucaccacaggugcggguuugacucugaaguggg

SEQ ID NO: 4102478 - RNA, 85 nt, Human
ccagcuuuccccgugccucagccacucuucacguuccaucucugcucugugcugacccgguauggugguguggggagagcaaugg

SEQ ID NO: 4102479 - RNA, 70 nt, Human
ccagcuuuccugcgaguugauuucacuuccacauaaaucauuucuucuagcuugcuggaaaguuccuugg

SEQ ID NO: 4102480 - RNA, 61 nt, Human
ccaggaaccccuccaggucugaacagcugcucuguguuuaucuguuccucuuggaggcugg

SEQ ID NO: 4102481 - RNA, 85 nt, Human
ccaggaagcuuuuccauaacugaccgaaugcaugacccuuuacagaucaguuuacauguaacuuccucagggaugguuuuccugg

SEQ ID NO: 4102482 - RNA, 74 nt, Human
ccaggacacaugcacuuucccugaccaggccuacacaaaugcuuaucauguuagggagggugcauauguguugg

SEQ ID NO: 4102483 - RNA, 59 nt, Human
ccaggacagugaacauguaagaguuugggagcaugaauccgggccucuuccuguccugg

SEQ ID NO: 4102484 - RNA, 97 nt, Human
ccaggacccagccagggcaauaagguaccauggagccucgggggacuuaagcacuuaauuuccaccaucucucugggccuccugcuggggugacugg

SEQ ID NO: 4102485 - RNA, 62 nt, Human
ccaggaccucaucagucacaaugagauguucuccgacaucuagaagaucugggagauugugg

SEQ ID NO: 4102486 - RNA, 55 nt, Human
ccaggaccuggagcucuaugaaggcaucuaguucucgacucaguccagcuccugg

SEQ ID NO: 4102487 - RNA, 56 nt, Human
ccaggacucaaugaccacagggccucagucuuucuggccuccauuguaucuccugg

SEQ ID NO: 4102488 - RNA, 58 nt, Human
ccaggacucaguggggaaagggcaacauggccagcucuucuccccagcgaauccucgg

SEQ ID NO: 4102489 - RNA, 107 nt, Human
ccaggacuccugucccucuguggugaggggauuuggguggaagaguuugagaagcucugcuguggaauccucuccuuuuuaaauaaagagggacacuccaagccugg

SEQ ID NO: 4102490 - RNA, 82 nt, Human
ccaggagacacuggcuuguuucuauuugccagguaggaugucaguggcugcuuggccaacagcgacagggccagcuuccugg

SEQ ID NO: 4102491 - RNA, 60 nt, Human
ccaggagagcagaagcccaggccuguccucaaugaagcagccugggauaguggccuccgg

SEQ ID NO: 4102492 - RNA, 105 nt, Human
ccaggagauguuaaauguuacucugccgggucagucucuuauuuuuuaaacugaagaugaaaugcuauuuuggcuagaagaauuauuccgcaucuuagccacugg

SEQ ID NO: 4102493 - RNA, 56 nt, Human
ccaggagcagaguagguguucaauucaugucugugaaacaaaccuauuugcucugg

SEQ ID NO: 4102494 - RNA, 58 nt, Human
ccaggaggcccuagcagaagcugcucugguguccagcuccugugugaagccucccugg

SEQ ID NO: 4102495 - RNA, 63 nt, Human
ccaggaggcucagagaccugcgaucugaguggcauuuccucaggccuuguccugaccuccugg

SEQ ID NO: 4102496 - RNA, 56 nt, Human
ccaggaggcucugcccaucccaagcauccgugggugacugggucuccaccucuugg

SEQ ID NO: 4102497 - RNA, 67 nt, Human
cccuuccaauagcaacaaagauuauuuucaucauucgcugaguuaauuugcuaauuuuggaucaggg

SEQ ID NO: 4102498 - RNA, 58 nt, Human
cccuuccaggcuggaggcuugggaucaccaauaaacuccaggaaaaggcuugcagggg

SEQ ID NO: 4102499 - RNA, 117 nt, Human
cccuuccauggcccucuccaccugggccuccauccccagacucuccucuugaagggcucuaggcccugcagggagcucuggggugcagggcuggcugggagggugggguggcaaggg

SEQ ID NO: 4102500 - RNA, 55 nt, Human
cccuuccccacuuucaugagauuagagagauaagaacaggaacauggagggaggg

SEQ ID NO: 4102501 - RNA, 83 nt, Human
cccuucuccacuaaaauauaauuuagaaggggaaacagguuuugucuguuuuguucacugcauuguccuugugcugagaaggg

SEQ ID NO: 4102502 - RNA, 97 nt, Human
cccuucugcagcauccuggagucacuucccgaauaaaccccucacaucaccuccuugucucaggguuugcuucuggggggacccagccugagacggg

SEQ ID NO: 4102503 - RNA, 72 nt, Human
cccuucuuacacugacagcugaaaagcaggcugauagucacugcuccacagcaguuuuuaguguucgauggg

SEQ ID NO: 4102504 - RNA, 68 nt, Human
cccuugaaaagacucuucucucuucuaucauuuuaacaaaaauggcaguagaaaagaaucccugaggg

SEQ ID NO: 4102505 - RNA, 77 nt, Human
cccuugaaccuagauggaucucugugacuauuuugacuaaugaaguguggcagacaagauucuaugugacuucuggg

SEQ ID NO: 4102506 - RNA, 86 nt, Human
cccuugcagccucuuuggggguguccucuuuucuuauucauucauucaacaaauguuugugaagcuggauccuggagcugcagugg

SEQ ID NO: 4102507 - RNA, 66 nt, Human
cccuuggauuuggaacucauagacaugcagaggggcauucuggguggugucuuccaagaccaaagg

SEQ ID NO: 4102508 - RNA, 57 nt, Human
cccuuggccacugcgccagugaacucugggagacaggauugaguacguggucaaggg

SEQ ID NO: 4102509 - RNA, 68 nt, Human
cccuuguuggaguagguuucgugccgcuuuuggcuucuugggggcacacagcggaauuugcucuaggg

SEQ ID NO: 4102510 - RNA, 85 nt, Human
cccuuguugggucagggcaggugguuguggcccaguuguuuggccuucugcaggcugcaccccugcccugcugccugccaguggg

SEQ ID NO: 4102511 - RNA, 60 nt, Human
cccuuuaacacacagaggcugcagugaagcccccaaaccacaggcuugguguugaauggg

SEQ ID NO: 4102512 - RNA, 97 nt, Human
cccuuuauuugaaagaacuagaauguuuucauuauccuaacuguauccugacagauaucagagguauugcaaaagccuagauuccaaguacaaaggg

SEQ ID NO: 4102513 - RNA, 62 nt, Human
cccuuuuguucuuucugagcugcagccagaaauugcugguuaguucacaggaacaagcaggg

SEQ ID NO: 4102514 - RNA, 88 nt, Human
cccuuuuuaaucaauugaaggaagucccauuucaccagcugucccagccuggagguggaagggacugccuagaggaggugaaagaggg

SEQ ID NO: 4102515 - RNA, 59 nt, Human
ccgacccugggagcccagaccccucccagaagguccgguccccuggcccccagcgucgg

SEQ ID NO: 4102516 - RNA, 77 nt, Human
ccgacugccucagcccaguugucagagcagacggcucuuguguccagagcugcugagggcuggagcugaggccucgg

SEQ ID NO: 4102517 - RNA, 75 nt, Human
ccgagccugagcaccuaccagacauucagcuucugcccaaacaugaaguuguuguugagguggguaauggcccgg

SEQ ID NO: 4102518 - RNA, 59 nt, Human
ccgaggcggcggccgagccuggcucaccgcaccauggaagcuggccggccgccgcccgg

SEQ ID NO: 4102519 - RNA, 55 nt, Human
ccgaggcuggagugcaguggcgcgaucucggcucacugcaagcuccgccucccgg

SEQ ID NO: 4102520 - RNA, 55 nt, Human
ccgaggcuggagugcaguggcgugauuuaagcucacugcagccuccgccuccugg

SEQ ID NO: 4102521 - RNA, 55 nt, Human
ccgaggcuggagugcaguggcguggucucagcucacugcaaccuccaccucccgg

SEQ ID NO: 4102522 - RNA, 69 nt, Human
ccgagucccagagaggccaaggucgugguccaaguucacaaggcuagaacccgagucuccugacaccgg

SEQ ID NO: 4102523 - RNA, 60 nt, Human
ccgauuuccuuuaggacugcccagccucagacagcugguccuggaagguccugagggugg

SEQ ID NO: 4102524 - RNA, 77 nt, Human
ccgcaagcagaguacucuuagggcuguggcugcagcagccgagucacaugaucccugggccugguaacaccuugcgg

SEQ ID NO: 4102525 - RNA, 103 nt, Human
ccgcaaggguacuucucugccaaguauaguaauauuguuguagcaguguucaagguugucagcaauucuggcuuacucugcagagagccauaauagugugugg

SEQ ID NO: 4102526 - RNA, 70 nt, Human
ccgcaaucaucucucuuugugccuuucucuucuacaguacuugggcagggcugcagggcagcuggugugg

SEQ ID NO: 4102527 - RNA, 97 nt, Human
ccgcacacugucugagaucugcucagccgaucugcuccggccguaguaauccgugaagaggccgucaggguugagcagguagauggcaauggagugg

SEQ ID NO: 4102528 - RNA, 76 nt, Human
ccgcacuaggcauccagacugggcuugggagccgcgcacccucccuacccagauccaggauggcuagaauuaacgg

SEQ ID NO: 4102529 - RNA, 104 nt, Human
ccgcagcgugaggcgcuguuuuaccuucaaguuccuggucccuggcuuagcucaagucacuuccaucagcuggaaacaggcgagcaccucacgccaucuagcgg

SEQ ID NO: 4102530 - RNA, 60 nt, Human
ccgcaggugaguuuccagcucuccucccuccaagggcagggaugcugaggcucagugugg

SEQ ID NO: 4102531 - RNA, 94 nt, Human
ccgcaguggugggccacagggagggcccugggugcagcucuggugggacccauagccuccaugggagccagugcccucugguggacaccagcgg

SEQ ID NO: 4102532 - RNA, 73 nt, Human
ccgcauccaggacugccagucuggauuggagcucgacucagaaauagacaauggcaguggcacuaggaagugg

SEQ ID NO: 4102533 - RNA, 72 nt, Human
ccgcccccaccgcugcucgugccaggacgcgcaguuugcaguugcagcucaggcacuggcgcgggauggcgg

SEQ ID NO: 4102534 - RNA, 82 nt, Human
ccgcccccgcggcgaggucuggaccaagucgccccuagcaacaacagccgggccggcuuucucaggccaugcugauuggcgg

SEQ ID NO: 4102535 - RNA, 83 nt, Human
ccgccccgcgcugacucggcucucagagggcgacugggaggucggaccugggcgcccagagcugggugggcagcggggggcgg

SEQ ID NO: 4102536 - RNA, 71 nt, Human
ccgcccucacugcugccagugccacacgcgcgguuugcagcugcagaucuggcacuggcgcaggauggcgg

SEQ ID NO: 4102537 - RNA, 76 nt, Human
ccgcccucagugucuggggccccagggcagagggucaccaucuccugcacugggagcagcuccaacauuggggcgg

SEQ ID NO: 4102538 - RNA, 55 nt, Human
ccgccgggcacugcugaagcugcuucgucacagccaauggugaguguccaggugg

SEQ ID NO: 4102539 - RNA, 81 nt, Human
ccgccucagccucccaaauagcugggacuacaggcgcccgccaccaugcccggcuaauuuugguauuuuuaguagagacgg

SEQ ID NO: 4102540 - RNA, 89 nt, Human
ccgccuccgaauucguuuccucaucuguaaaacggggcuaugaagucuuucuugcaaggaugcaggaaauuggaguaugcgagaggugg

SEQ ID NO: 4102541 - RNA, 60 nt, Human
ccgccugcccagcgcggccauuguccggggcuccagaggggcuguguucagggcaugcgg

SEQ ID NO: 4102542 - RNA, 59 nt, Human
ccgccuucugacagcaaaacucagccugucuacagauaacuggucaggucaggcggcgg

SEQ ID NO: 4102543 - RNA, 81 nt, Human
ccgccuugugcuguagagccugugacauuuccaacaaugcaacacuauuugguaaauauuaaaggcugcuagagaaagggg

SEQ ID NO: 4102544 - RNA, 56 nt, Human
ccgcgcccgcgcgcucucggcugggcacgguccggcuccaggccugacgggcgcgg

SEQ ID NO: 4102545 - RNA, 82 nt, Human
ccgcgcguggcagcggcccaggccgucucagccggauuuuuccauccccgggguaggcuugguccccuguacacuccagcgg

SEQ ID NO: 4102546 - RNA, 67 nt, Human
ccgcgcugggugcccggcuggcgcuccucccgcccaaggugcccugaucgcuaggcucccggugcgg

SEQ ID NO: 4102547 - RNA, 57 nt, Human
ccgcgucucggggaugcagagugggcucuucggcgcgcccugcagccaugggagugg

SEQ ID NO: 4102548 - RNA, 67 nt, Human
ccucgcugaccucagggaucucucuggccugcagcuccgcugugggcagggucugaggccacagagg

SEQ ID NO: 4102549 - RNA, 78 nt, Human
ccucgguguguccaaggcacggaugacgguggagaggagccggccaucccuugaagucaccugugccacauacugggg

SEQ ID NO: 4102550 - RNA, 56 nt, Human
ccucguggaugggacuagucaggacacagccaaaagacagucgccuaucaaccagg

SEQ ID NO: 4102551 - RNA, 64 nt, Human
ccucuacagggcauagcccaaagucacuggaaaagagaaucugggaagaguggucuguggcagg

SEQ ID NO: 4102552 - RNA, 58 nt, Human
ccucuaccuacucuuugcauuuuccaaaaugggaaacugaauauaagaaagguaaagg

SEQ ID NO: 4102553 - RNA, 116 nt, Human
ccucuacugauccaccugcguuggucuccuaaagugccaggaauacaggugugagccaccaugccuggccgggucuuggauuuuuauaagaagaaaaaaaaggugugggguagggg

SEQ ID NO: 4102554 - RNA, 68 nt, Human
ccucuagguaaugcacagcuaaagugguuccaaauguuuuaucugaugccagcugugcagccuucugg

SEQ ID NO: 4102555 - RNA, 111 nt, Human
ccucuaguacaauguugaaucaaacagugagagcagacauccuugucuuguuccugaucuuugggauaaagcaucuagucugucacuguuaaguaugacauuaacuguggg

SEQ ID NO: 4102556 - RNA, 65 nt, Human
ccucuauugggauaaucugugccugggggacccacugccucccaggcugcguauccacaauaagg

SEQ ID NO: 4102557 - RNA, 72 nt, Human
ccucucagcacuugagcuuucauguaagaguucuagcugcucuaacacugccaugcuggagucacauggagg

SEQ ID NO: 4102558 - RNA, 56 nt, Human
ccucuccaguuuuaacgugaccaauaaggugauaugcaagugaggauuuggggagg

SEQ ID NO: 4102559 - RNA, 59 nt, Human
ccucuccauggggcugccugacuguccucacaacacagcaucuggcuuccccuggaugg

SEQ ID NO: 4102560 - RNA, 67 nt, Human
ccucuccccauguugugguggugccucuggacucaguccuggugcaccagucacaugggcagaaugg

SEQ ID NO: 4102561 - RNA, 87 nt, Human
ccucucuaggucaucuucuucauucccuuacuuccgagcccuucuucaugguuuuggauguggggauggagugggauguuuggaagg

SEQ ID NO: 4102562 - RNA, 81 nt, Human
ccucucuccugugcacccucccugugguccugagcccugagggaaaggcugguccagggaggccuugccugggaggggugg

SEQ ID NO: 4102563 - RNA, 69 nt, Human
ccucucucggcagggcggcgagcagugucugugcaugaggaccagcuccaggccccugcuggugagggg

SEQ ID NO: 4102564 - RNA, 76 nt, Human
ccucucucugagcuuuagucucuccacuuaaaauuaaagugagaaugggaaugaaaguagcaaccucacagggugg

SEQ ID NO: 4102565 - RNA, 59 nt, Human
ccucucuguagcagcccccagugcucugcucuguagcacuggggguggcuacagagagg

SEQ ID NO: 4102566 - RNA, 59 nt, Human
ccucucuguagccacccccagugcuacagagcagagcacugggggcugcuacagagagg

SEQ ID NO: 4102567 - RNA, 73 nt, Human
ccucucugucuauucccccaccuccguuaccacacauagguaagcagugaggugaggaguguugaccaagagg

SEQ ID NO: 4102568 - RNA, 61 nt, Human
ccucucuuuccagauguuagauuaugucugccugaucaugucugccaauuuggaaggaagg

SEQ ID NO: 4102569 - RNA, 77 nt, Human
ccucugaaagauggugcugggacagagcaguaggguggcagagggggggccggcucugcccaggaccguccuugagg

SEQ ID NO: 4102570 - RNA, 79 nt, Human
ccucugaacuucccaccccagcucucaaggcucccuggggcucccugggccucucugggggcugacuugggaagggagg

SEQ ID NO: 4102571 - RNA, 66 nt, Human
ccucugaccaggcucagccaaggcgaagcugcccauuucccagagggccuugcugagcuucacagg

SEQ ID NO: 4102572 - RNA, 69 nt, Human
ccucugacgguugugaggaggauuaaaugcuucaguaugugugcaagacuuccuaagcaauaaaagagg

SEQ ID NO: 4102573 - RNA, 66 nt, Human
ccucugagagaaggccuucagcucagcagugugcucaugugacaagggcuuauucuuagcaacagg

SEQ ID NO: 4102574 - RNA, 56 nt, Human
ccucugagccagcgucuucucuaauauggagaugaggauagugcuggccucauggg

SEQ ID NO: 4102575 - RNA, 75 nt, Human
ccucugcaaagugaucaagguugacaucaacaguggugucacagugaugaugugaacucuugauaugaugugagg

SEQ ID NO: 4102576 - RNA, 85 nt, Human
ccucugcaacccuuuggcuuuugaaaaggugauguacagcuggugcuagcuguauauacacugauuaggauuuucugggcagagg

SEQ ID NO: 4102577 - RNA, 62 nt, Human
ccucugcacccacaggcacuucccuuuaaaaaauuucaccuagggaaagugcggggcagggg

SEQ ID NO: 4102578 - RNA, 62 nt, Human
ccucugcaugugaauauccauuuguuucagcacaauuuguugaaaagacuguucuguagggg

SEQ ID NO: 4102579 - RNA, 75 nt, Human
ccucugcuaaaguccuuguauacagaaucaaugaagaguucauuuguguaucaucaaggaauuuagcacaagagg

SEQ ID NO: 4102580 - RNA, 58 nt, Human
ccucugcucccucugcccugccccacuacugugacaggcugagcucaggggcagcagg

SEQ ID NO: 4102581 - RNA, 59 nt, Human
ccucuggcucacagcaccaacuucuccaagagacuuaaggcugggguguggggcggagg

SEQ ID NO: 4102582 - RNA, 80 nt, Human
ccucuggcugggugagagcuucucugagaaagagggauguuuccaaccuugcccccugggaauucucucccggccugagg

SEQ ID NO: 4102583 - RNA, 108 nt, Human
ccucuggucacugcaacgcuagcccaacuugacagaagcuggacacagggucgcugcacagugugcaaaccugucaguugcugucagggauagguagugcacuucagg

SEQ ID NO: 4102584 - RNA, 97 nt, Human
ccucuguaacaguaaagugaucaaacacuaaaauccugagcugccacuguaauuagggaaguauuuaguaguuuuacacauuugacuguucaucagg

SEQ ID NO: 4102585 - RNA, 71 nt, Human
ccucuguacaggucagcaucuaggagcgcaaagcacgaugaacaaguguauagagccaaacuguacagagg

SEQ ID NO: 4102586 - RNA, 90 nt, Human
ccucuguagcacacggcccagugcugagcgucuggcagggccuaaugcacagcccugccagguggcugagugacugagggugcuaagagg

SEQ ID NO: 4102587 - RNA, 60 nt, Human
ccucuguccuggggaguggagcaagaguccccccuuguaacccauccauggggccagagg

SEQ ID NO: 4102588 - RNA, 78 nt, Human
ccucuguccugggugguguuuggugaucagaggcuugccagggauggcagggacgccagggacagcaaggacggcagg

SEQ ID NO: 4102589 - RNA, 61 nt, Human
ccucugucugaaaugaccuuuccccacuggcggcagcgcuaguucuuucucaccauagagg

SEQ ID NO: 4102590 - RNA, 58 nt, Human
ccucugucugucacuggggcagaguacauuuucugcauguccauaaugaagauagagg

SEQ ID NO: 4102591 - RNA, 84 nt, Human
ccucugugagaugucuggagcuggagggcaaggcacacacggacaguucuugcuugccaaggagcucugcccaucuuagggagg

SEQ ID NO: 4102592 - RNA, 60 nt, Human
ccucuguggggaagaguaugacuuggcagacuagagaugcggagaaucagccccgggagg

SEQ ID NO: 4102593 - RNA, 69 nt, Human
ccucuguuuuguauuuacguagaaaucuccacuuuacaauuggggaaaauguagcuuacaagauaaagg

SEQ ID NO: 4102594 - RNA, 55 nt, Human
ccucuucccauccauguuagugccuucccuccugggcaguggagauuggaggagg

SEQ ID NO: 4102595 - RNA, 57 nt, Human
ccucuucccucccuuuguccuucagucacaugucuuacuuaaaggaagugggagagg

SEQ ID NO: 4102596 - RNA, 110 nt, Human
ccucuucuccucuuccuaccaagcugcucuucugugccucuguuguaacugggucauguuuuugacucuagcaagaggaaacaaggggccuucagugggaaagcaagagg

SEQ ID NO: 4102597 - RNA, 60 nt, Human
ccucuucugcucugacuugcaaggaacucaagcuguucugcauuccagggccaggagagg

SEQ ID NO: 4102598 - RNA, 96 nt, Human
ccucuugaacuaaggaaucacugaggggaaaggaaugcaagcaggucugacaggaucugcagcuuuccccugauuuauugcaccuugcuuuagagg

SEQ ID NO: 4102599 - RNA, 103 nt, Human
ccucuugccauguugucauggaggccuccccuaaauguguaugccacaaaagaagcagugucagcagcaagggggaggaucccagagaaaauagaagaagggg

SEQ ID NO: 4102600 - RNA, 57 nt, Human
ccucuuggccagagaccagagcagggcuuagcccacucauagcuucaggccaggugg

SEQ ID NO: 4102601 - RNA, 63 nt, Human
ccucuugucacuucaggaagcaacagccaggagugaaacauguaaccugaggugggaggaagg

SEQ ID NO: 4102602 - RNA, 83 nt, Human
ccucuuguccuugcagaggucauaucucagaagagacaucaaauuugcauuucccccagauaugaccuuugagcggguagagg

SEQ ID NO: 4102603 - RNA, 72 nt, Human
ccucuugucuuggaaggucauccugcccagagcuugugaaggugcaguggccugagccaggcuuccaagagg

SEQ ID NO: 4102604 - RNA, 58 nt, Human
ccucuuugagauucaguuuucccaccugugaaaggaaauguaugauucucaucagagg

SEQ ID NO: 4102605 - RNA, 60 nt, Human
ccugaaaauauccucuccuuugcauacgggaacacacagaugggaggaugcgucuucagg

SEQ ID NO: 4102606 - RNA, 55 nt, Human
ccugaacagucugaaaggagacacaauguuaaaguccuugagcaggcugcccagg

SEQ ID NO: 4102607 - RNA, 118 nt, Human
ccugaacccugugucccuucuggccacgugaaagccaugcuccuuccccucugggccggcccggggacgcucggggcaggguaugaggcaagagaaagggacccaagaaaggggcagg

SEQ ID NO: 4102608 - RNA, 65 nt, Human
ccugaacucuaaauagagcagugaacucaaagucaaagcauucagguuuuauucguagguucagg

SEQ ID NO: 4102609 - RNA, 73 nt, Human
ccugaacugagcuuuaucaaaacaguaacugaacuuugaaacgaaacaagagugcugaauugaaagcuccagg

SEQ ID NO: 4102610 - RNA, 56 nt, Human
ccugaagaugcuguggccugguagagcuuuguacacccucccaagcuucucucagg

SEQ ID NO: 4102611 - RNA, 97 nt, Human
ccugaagcugguaauuuucacagaggacaggcaguuuuccagaucagauaugugcuuguguuugucuuugcccugcucgaagaugguuagaaacagg

SEQ ID NO: 4102612 - RNA, 62 nt, Human
ccugaaguccucuuagcuucucagaaaacagaugcagaggcuacagauacagaggcuacagg

SEQ ID NO: 4102613 - RNA, 68 nt, Human
ccugaaguccugucauugcuuugccaaguucuuucuccagccauugguaaacuugacagagaaucagg

SEQ ID NO: 4102614 - RNA, 77 nt, Human
ccugaaugcuggaggcacucucgacaaggguggguacugucugggcccacaccugcuugggugugccucugcauggg

SEQ ID NO: 4102615 - RNA, 84 nt, Human
ccugacacauggaagacauuggguaaauagcugcugaauuaauucauucagcaacuauuuaucaaauuccuacuuugugccagg

SEQ ID NO: 4102616 - RNA, 70 nt, Human
ccugacacccaggccugagagacaggaguagcccucugcccgcuucugugcccagcccuggaugcaaagg

SEQ ID NO: 4102617 - RNA, 73 nt, Human
ccugacagagaaaaaucugccucugauggaaucauuaaguuaaccauccauuuguaccauuucuuuguacagg

SEQ ID NO: 4102618 - RNA, 103 nt, Human
ccugaccaaagccugcuuugccagugugaguggaguucuuggaauaaaacucuauguggcuccuuacucaucagcaacugaagcagagaugaagcuuuucagg

SEQ ID NO: 4102619 - RNA, 56 nt, Human
ccugacccuggcugccgcggucugggcucggccgaccguccggcugucggggcagg

SEQ ID NO: 4102620 - RNA, 73 nt, Human
ccugaccucuugccucaguccaaaccuggcuuccuugaucucagcuuuauuuguucugaagcaaguagggagg

SEQ ID NO: 4102621 - RNA, 111 nt, Human
ccugaccuucucccuggugccccuuuagccccugcagagacuucugccuuucccuaggauacaugguugcuggggguggcagagcuagaaccaggguggugggaaggcagg

SEQ ID NO: 4102622 - RNA, 62 nt, Human
ccugacuaaugagcccaggugacucauacacccggggccuggaugagucugacugggucagg

SEQ ID NO: 4102623 - RNA, 68 nt, Human
ccugacuagcugggacuacagacgcgugccaccacaccuggcuaauuuuuguauuuuuaguagacagg

SEQ ID NO: 4102624 - RNA, 59 nt, Human
cccauuuguccaaaguauaaaacuaggcauuaguuuuaaaauauaugagacagaguggg

SEQ ID NO: 4102625 - RNA, 56 nt, Human
cccauuuuggaacgaguagccaggcugucccugccaccccggaccccgaagugugg

SEQ ID NO: 4102626 - RNA, 76 nt, Human
ccccaaaugugccaacaguagucccaucgcaacauuaugugggcauuacaguucuacacauccuuuucuguugggg

SEQ ID NO: 4102627 - RNA, 63 nt, Human
ccccaaauuaugucacuuucaaggucagcgggcucauuuccuucugccuggacaaaugugggg

SEQ ID NO: 4102628 - RNA, 59 nt, Human
ccccaagcaugcaaucuauccuuaggaagacuuccuggaaauuaugcucaccuuugggg

SEQ ID NO: 4102629 - RNA, 77 nt, Human
ccccacagaauuuuccuuugauucccagaugucguaagagggacaucacuugagaaccaaugggacuugugaugggg

SEQ ID NO: 4102630 - RNA, 79 nt, Human
ccccacagauugagcuuuuucacuuuggaugggagaauagacucuuugaugacagaggaggcaagguuaaaauguaggg

SEQ ID NO: 4102631 - RNA, 92 nt, Human
ccccacauuccuugcaaauugcgaggcagggaagcugcaaaagccggggagccccgggcugggccgucgcccuccuugcucugcaaaagggg

SEQ ID NO: 4102632 - RNA, 56 nt, Human
ccccacccuccaggcccgcgaaucuuggaucuccggcagcaucuggagggaugggg

SEQ ID NO: 4102633 - RNA, 61 nt, Human
ccccaccugcggaaccagccagcugccccuggggccuuugcagcuggcccacagguguggg

SEQ ID NO: 4102634 - RNA, 76 nt, Human
ccccacggccagcgugcccuccguguucauagagcccaggaagaggugggcuggggcucugcgcuaggcggugggg

SEQ ID NO: 4102635 - RNA, 99 nt, Human
ccccagaaagacaauacugcaugaucucacuuauuugugaaaucuaaaaaaagucaaacuuauagaaacagaggucaggcauuuuuugcuuucuugggg

SEQ ID NO: 4102636 - RNA, 59 nt, Human
ccccagaaggggacagaggguagagauauccagaaggucuccaccagccucuccugggg

SEQ ID NO: 4102637 - RNA, 66 nt, Human
ccccagaauauuuguaauuacuguugaugauucauuuauuagcauuucaguacacauguugagggg

SEQ ID NO: 4102638 - RNA, 57 nt, Human
ccccagagaagguggagcuugugugggcaguggcacucagggaaggccuucuggagg

SEQ ID NO: 4102639 - RNA, 66 nt, Human
ccccagagccuagcacuuaggaacugccaucgaucauuuagccaggcccugcacuaggcccugggg

SEQ ID NO: 4102640 - RNA, 113 nt, Human
ccccagcaccuccagccacccugauucagggacaucgcagagauugguguuugacgcuacggcagcagaggcgcagacucuugaguguuggagggugucuggagggccugggg

SEQ ID NO: 4102641 - RNA, 108 nt, Human
ccccagcacucucccagugcaccccuccuccaccuucccaagcugccugaugggaccagccaaugaaagggugcagggacaggugugcagaacugggaggcucugggg

SEQ ID NO: 4102642 - RNA, 60 nt, Human
ccccaggacacauggaccaagucacugcggccguacuuggcccugaaucuguccuggagg

SEQ ID NO: 4102643 - RNA, 55 nt, Human
ccccaggcuaggaccgauuucccugugucuuggggaaauauuucugaccuguggg

SEQ ID NO: 4102644 - RNA, 78 nt, Human
ccccaggcugguaaggggccugcccggaggccgucuggaguuuccucguucucacuguggcucucgccagccugcggg

SEQ ID NO: 4102645 - RNA, 68 nt, Human
ccccagggaagcuuugcuuacuguccuaugucuauaccccuuggguugucucugagcuucucuugggg

SEQ ID NO: 4102646 - RNA, 66 nt, Human
ccccagugcuccugauguacccuugcccucuuauguaggcugggugaugauuugggaguggugggg

SEQ ID NO: 4102647 - RNA, 63 nt, Human
ccccagugucuucagaguaaaucuuuacaacugagaguuuguagcugaaggcaacuaaagcgg

SEQ ID NO: 4102648 - RNA, 104 nt, Human
ccccaucacgggauugucgacuucaucaaauccacaagaccccuuuucacugugaaguaauauagucacagguucuugggauuagaggaugaacaucucugggg

SEQ ID NO: 4102649 - RNA, 95 nt, Human
ccccaucgugacauccaguccaggcuuucaggacagcgagcccgguuuccaggcaggugcuugucgaaggccuggcuggcuguaccgacaggcgg

SEQ ID NO: 4102650 - RNA, 58 nt, Human
ccccaugauggcucugggaccuugggaucacagccccucucugggcccuccugugggg

SEQ ID NO: 4102651 - RNA, 61 nt, Human
ccccaugugaagaaacugaacggcuuuuaugcagguaaaagccaguucuuuuauauugggg

SEQ ID NO: 4102652 - RNA, 77 nt, Human
ccccauuucuuauuuucauggcuucugcucaguguacccaagauagucacugggagucaugaggaaggaggugccgg

SEQ ID NO: 4102653 - RNA, 60 nt, Human
ccauuuauugaugcuacuucuauagauacauuuuacugagguacagcaccagugaauagg

SEQ ID NO: 4102654 - RNA, 56 nt, Human
ccauuucacucuuccugaaggacccggcaggcggguggaggaggggugggaaaugg

SEQ ID NO: 4102655 - RNA, 79 nt, Human
ccauuuccaacuucugaccucaagaacugucaagaugacacaauuggcagugauuuguuucagcagcaauaggaaaugg

SEQ ID NO: 4102656 - RNA, 69 nt, Human
ccauuucucagaaaagcaagcuuucugguugauuaggaacaggaaaacaaaaugcuuuucuggaacagg

SEQ ID NO: 4102657 - RNA, 61 nt, Human
ccauuucuucauguauugcauuguguccuuaggaaggagaauguaauuggcauguuagugg

SEQ ID NO: 4102658 - RNA, 128 nt, Human
ccauuucuugaccaccaggacuccaacuguggcaggggucuuuaggaacgucgggagugaguacaacacagcccuuguacccaggagcuuacaauggaguuggagacaugagucacagauagaaaugg

SEQ ID NO: 4102659 - RNA, 94 nt, Human
ccauuucuuugacuaugcaguugucaugguuucuagacuuuuuagcacacaucuuuagaaacucacguuaucauugccucuuguuaaauuaugg

SEQ ID NO: 4102660 - RNA, 79 nt, Human
ccauuucuuuuggcacagcuucccagacuuacaagaugucuugaagugacugaauggaguuaguguucggcaggacugg

SEQ ID NO: 4102661 - RNA, 65 nt, Human
ccauuugccauuggcaggccucuuguauuagucccuuauaggaacaauggcaugcuagcaaaugg

SEQ ID NO: 4102662 - RNA, 59 nt, Human
ccauuuggugggucuaguugggauuacacucuucagcucucuuccagauccacuugagg

SEQ ID NO: 4102663 - RNA, 61 nt, Human
ccauuugucauuucucaauuacuggucacaacaagaggccacuggagaaaguggcaggugg

SEQ ID NO: 4102664 - RNA, 55 nt, Human
ccauuuguuuucgcuaccauggcagaguugaacaacuguaguggaaaccuuaugg

SEQ ID NO: 4102665 - RNA, 66 nt, Human
ccauuuugagcuuagggaaguuacacucugagaagcccaggguaaaacugagaccagcuaaagugg

SEQ ID NO: 4102666 - RNA, 92 nt, Human
cccaaaaugguguguugaaguccuagaacuccugguacccgugaaggggacuuuauuuggaaauagggcuuuguaaauaucauuaagauggg

SEQ ID NO: 4102667 - RNA, 91 nt, Human
cccaaaccaugcuucacuuucaccaucugaguagagagaaguacaagccucugugucccucugcucagaggguggggcaccuuuguuuggg

SEQ ID NO: 4102668 - RNA, 58 nt, Human
cccaaagcaggcuugucaaauugccauggcuuaggucaaagcaaaagacuucuuuggg

SEQ ID NO: 4102669 - RNA, 79 nt, Human
cccaaaguaaacagggcugggauaaccgaggcugacagcagagaguuuuccuuggcugugcugcccuuugcccuuuggg

SEQ ID NO: 4102670 - RNA, 63 nt, Human
cccaaauacuaaauaugaagaauacgguguuggugcaucacuuauucauaaguuuagugaggg

SEQ ID NO: 4102671 - RNA, 63 nt, Human
cccaaauugcauuuuaaagguagaugccucucaugagacauuugcaucagugagcgauguggg

SEQ ID NO: 4102672 - RNA, 56 nt, Human
cccaacuuugagugaaguguaggguauuuauuuaggcuuccuaucuuagagcuggg

SEQ ID NO: 4102673 - RNA, 56 nt, Human
cccaagaucuaggacagaaagacucaugcaguaacuccugccuuacagaucugggg

SEQ ID NO: 4102674 - RNA, 58 nt, Human
cccaagaucuuucgugcacuaaaugucugguguuuguaauacaaugaacaauuuuggg

SEQ ID NO: 4102675 - RNA, 92 nt, Human
cccaagcaguuugucagggacacagguaucucaaaugauucucugcgguugagaaucacugccuuagguguuacugguagcgcgugcaaggg

SEQ ID NO: 4102676 - RNA, 89 nt, Human
cccaagccaacaucuucccucccugggaccucugccugcaagaagaagcgcguugcgaggugagguuugggaggugucagcugucuggg

SEQ ID NO: 4102677 - RNA, 83 nt, Human
cccaagcuuccugcguuaguuuggggaugcaguuaccugcugaggaaaaugccucccaaacagcacaagaaaaggaagguggg

SEQ ID NO: 4102678 - RNA, 59 nt, Human
cccaaggaagggagugagaccuccacucccagugggggaccuggccacccauccuuggg

SEQ ID NO: 4102679 - RNA, 59 nt, Human
cccaaggaauaggaucccaggaauuuaccucauguuuauaauccuauaaucuucuuggg

SEQ ID NO: 4102680 - RNA, 59 nt, Human
cccaaggaguccugaagcuguuccuagauuuuuuucucccuucucuggauuccguuggg

SEQ ID NO: 4102681 - RNA, 58 nt, Human
cccaaucagaacgcucgaucuucggcucucguccaaugaacgcgcguauuggggaggg

SEQ ID NO: 4102682 - RNA, 98 nt, Human
cccaaucauacuggguguuuaaaccauuuccugacaaucuuuaaauuugcaaauuagaaaugucaaugcuggucuugaaugagcccgauaaggauggg

SEQ ID NO: 4102683 - RNA, 67 nt, Human
cccacacacuggcugcugccaaaagcuccgucuucagggagccgcguggggauggccgggugcuggg

SEQ ID NO: 4102684 - RNA, 121 nt, Human
cccacaccaugucccugcccagccuucucuacuccugaugcaugucccccauggaaaggauguucugugcacgcaggaggcaaugagggagggugaggcagcccagaacccaugguguggg

SEQ ID NO: 4102685 - RNA, 55 nt, Human
cccacagaaucugugacuccaagaaaacguuucuuuggucccacuagauuugggg

SEQ ID NO: 4102686 - RNA, 80 nt, Human
cccacagccugacuugaugaaugaccugggugguggguuuaugagucaacguaggggauuuauggggaagaaggcguggg

SEQ ID NO: 4102687 - RNA, 59 nt, Human
cccacaggcuagggguagggcaguuggaauugauccaugccuucuagcuagacuguggg

SEQ ID NO: 4102688 - RNA, 76 nt, Human
cccacagguguccauccagggucaccaugacacagcgugcacagaagagcuuuggaaugacagagaugccaguggg

SEQ ID NO: 4102689 - RNA, 59 nt, Human
cccacagucuagcuagaaggcauggaucaauuccaacugcccuaccccuagccuguggg

SEQ ID NO: 4102690 - RNA, 59 nt, Human
cccacauagcagaggacugagcagagaagucauuauucugucaggaacuggugucuggg

SEQ ID NO: 4102691 - RNA, 73 nt, Human
cccacaucuguaaaguuaggcauuuggggugcuccaucgugagccuccuuccugcucuaacauucagcguggg

SEQ ID NO: 4102692 - RNA, 129 nt, Human
cccaccaccaaaguccuccucuuccucccucuccaucugccucuugacagaucguggcugugccgugacucagccgucucauacaucuucaggucuggaggggagguuuggaugacaucuccgguuggg

SEQ ID NO: 4102693 - RNA, 75 nt, Human
cccaccagcucugucccuaguagagguggaaagaggaggcccugccauccuugaggaagggcaagagccuggggg

SEQ ID NO: 4102694 - RNA, 90 nt, Human
cccacccaguaggcgaugcuucagggcagacuuugggccuagcaggcagcugggucagaaucucccugugcagggcaaacuggucagggg

SEQ ID NO: 4102695 - RNA, 64 nt, Human
cccacccccugcagcaugacacugccauccugcucaucagguacugcagcugcaggaggguggg

SEQ ID NO: 4102696 - RNA, 71 nt, Human
cccaccccucucgcgugugccuuuccgcuccacuguucgccggugagcuagguggcgcgagagcggagggg

SEQ ID NO: 4102697 - RNA, 70 nt, Human
cccaccgucauuccagaggggauucccggccgccgcuggggccgcggauuuucccgcuggcuacguaggg

SEQ ID NO: 4102698 - RNA, 64 nt, Human
cccaccucacugucuguacuagcugauuagguccaaaucagccaauuacagaacaugauuuggg

SEQ ID NO: 4102699 - RNA, 96 nt, Human
cccaccucccugccucucuguuuggugggagugauuuugaugcacuaaaaaacaaggaggccucuauccagagagacagagucggggcaguguggg

SEQ ID NO: 4102700 - RNA, 64 nt, Human
ccugaagaaaauuccacgagaacucagugccucugggguucaggucuucuggauuuccuuuagg

SEQ ID NO: 4102701 - RNA, 77 nt, Human
ccugaaguauuuucugagauggguggggagcucaggaggaacgggccucccuccaaccuuuucagacaucccucagg

SEQ ID NO: 4102702 - RNA, 67 nt, Human
ccugaauacauuugaaaguucuucugacacuacugauccgguguguuuacugcuuuguguacuuagg

SEQ ID NO: 4102703 - RNA, 58 nt, Human
ccugaaucugccucucuacugcugcugcuugaaauaaguacaaagaaugagguucagg

SEQ ID NO: 4102704 - RNA, 58 nt, Human
ccugaauuguccaauaucagaaagcccuaacaggauguuuugacauauacaguucagg

SEQ ID NO: 4102705 - RNA, 59 nt, Human
ccugaauuucaguuucccauuaagucuguuuguuugaucccuggaaauugaaauguagg

SEQ ID NO: 4102706 - RNA, 63 nt, Human
ccugacaaccagcacugcuggggccugcgugcuccaggcaggcauccaaggcugggcugcggg

SEQ ID NO: 4102707 - RNA, 128 nt, Human
ccugacaauagcuggcuuuucuuccagcuccgggagcaucuuuucuggcagguggaaauguaauaucacguggucagaaggaagggcuccuacuuggauggugagacuaggaucuaguaauugccagg

SEQ ID NO: 4102708 - RNA, 128 nt, Human
ccugacacaugauaaauugcuuuauaguuguugauuaaguguugguaauuacaaugaucauaauuuauaguauucuugugaaagcuaagcaaaugagcaacuaacuguaauguaaacaauguagaagg

SEQ ID NO: 4102709 - RNA, 62 nt, Human
ccugacagccaucugcaagguuggauacugacgcuuuccugacuguggcuaaugguguuagg

SEQ ID NO: 4102710 - RNA, 74 nt, Human
ccugacccuuagcugaguccuuuggaaaguagaaacauuauguacauucaaaauuagguuaguugugggugagg

SEQ ID NO: 4102711 - RNA, 57 nt, Human
ccugaccuguuacauauauuaucuaauuuaauauucacaguaaguguagcagguagg

SEQ ID NO: 4102712 - RNA, 84 nt, Human
ccugacucucugggagcuccuggcagugacagaggcacagauagacagugucacuucauugggaccagggcugugaugggcagg

SEQ ID NO: 4102713 - RNA, 75 nt, Human
ccugacuggccuuuuugugcauggcccagugguaagagacagcccuugcccuggaaccaucuacaguccagcagg

SEQ ID NO: 4102714 - RNA, 83 nt, Human
ccugagaagggcccugagaggugcugguggcugcagaugccugggugcccaggcugcgcccacuugcccuuugaggccucagg

SEQ ID NO: 4102715 - RNA, 84 nt, Human
ccugagaaggggacgggucacaggcuugucagcaugaggcucagcggggcuuagcccacucuggagccuguuccccuucccagg

SEQ ID NO: 4102716 - RNA, 69 nt, Human
ccugagacaugaaccaggcucccaagugaagcuccaaauuucaaagcaaagcaugggucaguuauuagg

SEQ ID NO: 4102717 - RNA, 73 nt, Human
ccugagaccuccauucucccugccaaagcugccuccgccuuuggggguagaggggugguagaaggguuuuagg

SEQ ID NO: 4102718 - RNA, 65 nt, Human
ccugauggaggagagaaauguuuucugugggaccuacaauguucgcauucucucugacacguagg

SEQ ID NO: 4102719 - RNA, 65 nt, Human
ccugauucauuuguggaagugauuguggagcuaugagcaccagagccuucccugaauaauucagg

SEQ ID NO: 4102720 - RNA, 63 nt, Human
ccugauuccugcuuucuucgucaucuaauaagcccagauuucuagaaggagagcugaguuagg

SEQ ID NO: 4102721 - RNA, 75 nt, Human
ccugcaaacagcuggaggucugugagcacugcguggagggagacagagcgcgcaaucucuccagcugcauguggg

SEQ ID NO: 4102722 - RNA, 70 nt, Human
ccugcaaaggggaaguagcaccagagguggguugccauucccaccccucaucaguugcuuccuacacagg

SEQ ID NO: 4102723 - RNA, 80 nt, Human
ccugcacaugcucacacaagucgaaucuguaauaggacuuaaaacucuccugucccagcacuuugggagucugaggcagg

SEQ ID NO: 4102724 - RNA, 67 nt, Human
ccugcaccucugugcuuggaacugaaugugcccucaggaagcaacugucuaagguggagaggugggg

SEQ ID NO: 4102725 - RNA, 72 nt, Human
ccugcacuguggcugcagccuugguccugcccccagacccacacccaggauggggucugcagccuggugagg

SEQ ID NO: 4102726 - RNA, 68 nt, Human
ccugcagaggccuuucuacagugauaugccuguaagcuauccuggggguaggagggcacuucugcagg

SEQ ID NO: 4102727 - RNA, 57 nt, Human
ccugcagaugugggacagcuguuuguacuuagcaguuaagugucccugcaaugcagg

SEQ ID NO: 4102728 - RNA, 69 nt, Human
ccugcaggcugcaggccaguuccaguuaaagcccuuuacuagguaguggccuggucugcugcuuccagg

SEQ ID NO: 4102729 - RNA, 79 nt, Human
ccugcaguguaagugcuuaugugcaguggauagucauuauaaaaucugaggguugugcaagcacuguggcacucgcagg

SEQ ID NO: 4102730 - RNA, 72 nt, Human
ccugcaucacaggagagcugaugcuggugaucuguugaccacauuuuguaaaagcaucuugugucuugcagg

SEQ ID NO: 4102731 - RNA, 70 nt, Human
ccugcauggcugcaagaaccucuggaucacuaagaauuucauugaguccaggcauuccagccauuccagg

SEQ ID NO: 4102732 - RNA, 90 nt, Human
ccugccaaggauauuauagacagagucuucuguuuuugugggcugccaucucagaagcuuugucuagucuugauauauugccugguuagg

SEQ ID NO: 4102733 - RNA, 57 nt, Human
ccugccacugcugaauaagcaguucacaacacaguuugcaucuucaagguuggcagg

SEQ ID NO: 4102734 - RNA, 58 nt, Human
ccugcccagcuucaccucaggcugcuuccaacagugccaagugaggucccuuggcagg

SEQ ID NO: 4102735 - RNA, 61 nt, Human
ccugcccagcuucuuacuuuuaaaauauauuuuuuuaauucugcaggaaguggggugaagg

SEQ ID NO: 4102736 - RNA, 56 nt, Human
ccugcccaggcccuaaguuaggguucccauccauauaacaaagacuucuggucagg

SEQ ID NO: 4102737 - RNA, 56 nt, Human
ccugcccuaguuaaggccuuaguugggggcugccagcugccagggacugggcaugg

SEQ ID NO: 4102738 - RNA, 64 nt, Human
ccugcccucggccugcaggcuaaggcucugagccuguggccuggaaggggcugcucugggcagg

SEQ ID NO: 4102739 - RNA, 68 nt, Human
ccugcccugcucacugucgguauuccaauucaucuacacugauaacuuuggcgggcauggagggcagg

SEQ ID NO: 4102740 - RNA, 74 nt, Human
ccugccucacaagcagaagguggggucuuaucuuagcacuugcgcuaggucccagcaucuucugagcaggcagg

SEQ ID NO: 4102741 - RNA, 70 nt, Human
ccugccucgcaguuuccauccucgcagagccuggauaggaugccaggauauaagagugcgauuuggcagg

SEQ ID NO: 4102742 - RNA, 56 nt, Human
ccugccucuauaggaguccaccagaagacauauccuucugugccccuagaggcagg

SEQ ID NO: 4102743 - RNA, 100 nt, Human
ccugccucugccaggugggcucugagagugggugauucugaacuuccaagggccagggacacagcaucgucucgcugucagagcugcucagagagggagg

SEQ ID NO: 4102744 - RNA, 67 nt, Human
ccugccugagucuguacguuagccauaauugcaucacaagguuauauggcucauaaaacagagcagg

SEQ ID NO: 4102745 - RNA, 74 nt, Human
ccugccugucuuucuaucucuagauuuauucagucauuucugcucuaaguucugaagauaggaaaugguguagg

SEQ ID NO: 4102746 - RNA, 78 nt, Human
ccugccuguuccuggugcugcagguguaucauccuuaaauccaaaccacaugggcagagaguagaggcaacggguagg

SEQ ID NO: 4102747 - RNA, 81 nt, Human
ccugcgacagagagcuccgugccuggcugccagcaguaucugagcugauuggcagaaggaggcugggguuugcuguucagg

SEQ ID NO: 4102748 - RNA, 76 nt, Human
ccugcgcgggcccuggggauguggacgcgggggcucuucccugccgccuacgcacuccggggcaugcccgcgcggg

SEQ ID NO: 4102749 - RNA, 62 nt, Human
ccugcgcuuccuggccucugagcacgcccugcugcugcuguucagcaaugggauggugcagg

SEQ ID NO: 4102750 - RNA, 57 nt, Human
ccugcgucuggccuugcuccaaguacgugaugcuugagcagcuaaaggugaugcggg

SEQ ID NO: 4102751 - RNA, 85 nt, Human
ccugcgugugcacuaaagucaucauuucuuuucaaauccaccaaguguuuugaauaaauaauggucaacuuggcugucacuuagg

SEQ ID NO: 4102752 - RNA, 74 nt, Human
ccugcuaauugugucccuggagcuucugugcggacugaggacugcacaguccuacagagaucagagugagaagg

SEQ ID NO: 4102753 - RNA, 73 nt, Human
ccugcuagagauugcuucugaacucagcauguggccaauuauggccaaugagauggaagagucuggaagcagg

SEQ ID NO: 4102754 - RNA, 61 nt, Human
ccugcucccagguguggccgggccagcaggggccugccugccagacgcaccagggggccgg

SEQ ID NO: 4102755 - RNA, 91 nt, Human
ccugcucccgccccagcagcacacugugguuuguacggcacuguggccacguccaaaccacacugugguguuagagcgagggugggggagg

SEQ ID NO: 4102756 - RNA, 57 nt, Human
ccugcuccucugagguagccacacacugagaucugggucaccacuucagaggagagg

SEQ ID NO: 4102757 - RNA, 63 nt, Human
ccugcuccugcuucccuccccucuggucuggcugagaaaaagguccagaguuggcagagcagg

SEQ ID NO: 4102758 - RNA, 77 nt, Human
ccugcuccuguaagucuggcuuauagcuuucuuucauaacugaaggaaaugcuaaauuucagcuacagguuaguagg

SEQ ID NO: 4102759 - RNA, 68 nt, Human
ccugcucugauagcaaaggacaauagucagugauuuucacacugacucugaugguugauagagcuagg

SEQ ID NO: 4102760 - RNA, 79 nt, Human
ccugcucuggggcaggaggcagaggaugcccagugagcauucagcggaccccggguugcccugccucaggccagcacgg

SEQ ID NO: 4102761 - RNA, 78 nt, Human
ccugcugcagcuuggcacucggggacccuggaugcuuucaugaaggacaggaaagccgagugccauaggaggcauggg

SEQ ID NO: 4102762 - RNA, 68 nt, Human
ccugcugcucucccuuucuauaaggcaagugugagaacaggcuugcaggcaggggaugagcagccugg

SEQ ID NO: 4102763 - RNA, 63 nt, Human
ccugcuggacguggaggaggggcugagccuugggcugcauucucugcacccaccucuaguagg

SEQ ID NO: 4102764 - RNA, 109 nt, Human
ccugcuggacugggaggcacggcucccuuugauuccuggcacugcagugguugauugguaaguggauauugagugcacaggaucguacaccaucccaauguccaccagg

SEQ ID NO: 4102765 - RNA, 83 nt, Human
ccugcuggaggcggagccgucuggcugaccccagugccugggcucagccaugaccuccaccugccucuccuuguaaugcucgg

SEQ ID NO: 4102766 - RNA, 61 nt, Human
ccugcuggagguuggagcaugcagauacagaucuccaguucauggcccucucaaaggcagg

SEQ ID NO: 4102767 - RNA, 91 nt, Human
ccugcuguguaccaggcaccaggcugggcuccggagauaaagugauggauuuuauaccgacucugccugugagugcuuucauuuagcaugg

SEQ ID NO: 4102768 - RNA, 62 nt, Human
ccugcuucaccaccagaagggcaccaacaggagugauucagagcaugguggcuggagucagg

SEQ ID NO: 4102769 - RNA, 73 nt, Human
ccugcuucugucucuagggaaagguuuugcccugauccaugacagagacuauuaccuaaaagauacaaguggg

SEQ ID NO: 4102770 - RNA, 56 nt, Human
ccugcuucuuggcugccccugccggaaacacgcagggcccaagccuggacagcagg

SEQ ID NO: 4102771 - RNA, 61 nt, Human
ccugcuuggcugucauaagguccuggggaacucccaguacugaucccuggcagcccacagg

SEQ ID NO: 4102772 - RNA, 91 nt, Human
ccugcuuuaaagcauaaacaagaauuauuucuaguuaacagaauuacuguugauaugcaaaugguucugcauaaauggcuguaagugcagg

SEQ ID NO: 4102773 - RNA, 72 nt, Human
ccugcuuuagucagauuuagauguagcaagugauuaucacuuauuauugcuauuaaucugacacaaaggagg

SEQ ID NO: 4102774 - RNA, 83 nt, Human
ccugcuuugcucaggggucucccccauuguagggcucacagccuggcccccagagggguguagagaucacugagccaaccagg

SEQ ID NO: 4102775 - RNA, 77 nt, Human
ccugcuuuguccuuaagcggugucuacuccagggagggcucaacccacucuggacacuggcauggggucagagcagg

SEQ ID NO: 4102776 - RNA, 92 nt, Human
ccuacucugaagguuuguugguuugggucuccaaaagucaguauaaguuguuguuaaaugaggccagacugaaaccaacaccucauauuugg

SEQ ID NO: 4102777 - RNA, 58 nt, Human
ccuacugaaaaaucuccucuuguaacuuguuaguaacagcuguugaaauuucaguggg

SEQ ID NO: 4102778 - RNA, 60 nt, Human
ccuacugucuuaguuuggguuuccucucucccaagagcagaaccugagugaagacuuggg

SEQ ID NO: 4102779 - RNA, 73 nt, Human
ccuacuugauguuuaugcaaacaugugaguuaggcgucaguaacaacucaagguaugcaugaggucaccgagg

SEQ ID NO: 4102780 - RNA, 80 nt, Human
ccuacuugcaucauuuauagacugugaaauuuaggcaaguuauuuaacuucucugggucucaguuuguacauguaaaagg

SEQ ID NO: 4102781 - RNA, 58 nt, Human
ccuagacaugagaaacccaccagagucugagaaacucacgugaccagcucaugucagg

SEQ ID NO: 4102782 - RNA, 62 nt, Human
ccuagaccagcugguccuguccugggucaucucguuguccccaguuucuagcugguauaagg

SEQ ID NO: 4102783 - RNA, 56 nt, Human
ccuagacuagaggcagggagcccuauauucuaguugucauccugccacuggcuagg

SEQ ID NO: 4102784 - RNA, 58 nt, Human
ccuagauuaauuuucugaccuuuacaacugcaaggucucugcagaaaguaagucaggg

SEQ ID NO: 4102785 - RNA, 67 nt, Human
ccuagauuauaucaaaugcaagcacagccuucaaucagcucaagcaaguguuugguguaaauaaagg

SEQ ID NO: 4102786 - RNA, 60 nt, Human
ccuagcagcaccuuucuaaucugacgucaauagggugaguugaggauagguguuucuggg

SEQ ID NO: 4102787 - RNA, 74 nt, Human
ccuagcauuuacauccaagaguaccagaaucuaguuccaaauacuggagggccaucuugggugugauggucagg

SEQ ID NO: 4102788 - RNA, 64 nt, Human
ccuaggaaaagcaguacagcgugguaguuagaccagcacagcuucugggaucaggcugccuagg

SEQ ID NO: 4102789 - RNA, 59 nt, Human
ccuaggaagauucaguagcuggcggcaccaugacagcuggcagcuggaaucaucugagg

SEQ ID NO: 4102790 - RNA, 130 nt, Human
ccuaggauuguuguaaaaauuaaguuuauauaauauaucaguaucuauguauuuguguagguauccacacaucuagauaaauagagagguauagauagguuaguguuuagcuuaacguaacaguucaagg

SEQ ID NO: 4102791 - RNA, 75 nt, Human
ccuaggauuuuagaguaccuaaguguuggguuuucucaauauuagcaaauggguagacugauagcaaagacuagg

SEQ ID NO: 4102792 - RNA, 100 nt, Human
ccuaggcagccagauucugaaugccugcagagccagagaaauaauguuucucugggcacauuuuccaggacauuuuuagaaugccauaugacugccaagg

SEQ ID NO: 4102793 - RNA, 73 nt, Human
ccuaggcagcgcuuggcugugcuuugcccaguuucccuccaggcuuuuucuagguagccaaguccugccuggg

SEQ ID NO: 4102794 - RNA, 56 nt, Human
ccuagggauguguuagccagaugggccugggaggucucggguuggcuuaucccagg

SEQ ID NO: 4102795 - RNA, 61 nt, Human
ccuaggggaggggaucaugugcugcacaaaccauguguguauauuguucugucucuucagg

SEQ ID NO: 4102796 - RNA, 57 nt, Human
ccuaggggccucuaggcucagcacaaaaaguaccgcucaguccuguuagccuuuggg

SEQ ID NO: 4102797 - RNA, 61 nt, Human
ccuagucaggugcaccugcauucagcagcuccucauuccagcaugcaucugcauugacagg

SEQ ID NO: 4102798 - RNA, 65 nt, Human
ccuagugacagcaugaucaaggagcccagucauuugggaggccccaucauugcugccagccuggg

SEQ ID NO: 4102799 - RNA, 111 nt, Human
ccuaguuuuaauucgaggggaaaaggaaacguuaaaccauauguaauuaugaggucaauugcccugaguuuggacguuuuuauaauacuaaugaagguuaaagaggcuggg

SEQ ID NO: 4102800 - RNA, 57 nt, Human
ccuauagugcuaacagugcugcuauuaggaaaauggcaguaaaggugacaauauagg

SEQ ID NO: 4102801 - RNA, 74 nt, Human
ccuauaugcauauggcuucauuuaauucuugcaacagcucuugauaggguuagauaagguuauggauaucuagg

SEQ ID NO: 4102802 - RNA, 75 nt, Human
ccuaucaugaguugaaaagcaauuuguccaauauuucaacugcuggggagaauucuuuauuagcuuuuggauagg

SEQ ID NO: 4102803 - RNA, 81 nt, Human
ccuaucugugggauugcaauggucuuuuucugaaucuaggcaaugcuaccuucugaaauucgacuauccaauccagcuagg

SEQ ID NO: 4102804 - RNA, 127 nt, Human
ccuaugcuaugccuccguuucucuacuaagggcagaauagagaagauggcuugggucaucagcccuuucuacuuuccuauuugaggcuaugagaggagaaaaguacaggcauaccagagcaauuagg

SEQ ID NO: 4102805 - RNA, 64 nt, Human
ccuauggaguggcaugguagaguggagccuauaggguggcacacugccacauucacucuucagg

SEQ ID NO: 4102806 - RNA, 87 nt, Human
ccuauucugugaguccagucucuuuccaagcccauguaucuacauauugcaggaacauagagacugcccacucagggcaacaaaagg

SEQ ID NO: 4102807 - RNA, 81 nt, Human
ccucaaacauuaugagcccacuggugaauccccagcuccaccucuguacccccauucaccagugggcugauaguccccagg

SEQ ID NO: 4102808 - RNA, 63 nt, Human
ccuuauuuggaaauagguugcuguagacuuaauuagcuaaaguacagccacauccaaguaggg

SEQ ID NO: 4102809 - RNA, 70 nt, Human
ccuucacaccaucuuuaccagggggauacuacuauuaucuguuuuuauugguggagaaaugcugagaagg

SEQ ID NO: 4102810 - RNA, 63 nt, Human
ccuucacucucagcauaaugaaugugacacugccuacauccauccugugggagaguuaaaagg

SEQ ID NO: 4102811 - RNA, 72 nt, Human
ccuucaggcauggaacauuuauuaacugaaaaugcugaagcaaaugccaggaaauuuauguucuacuuaagg

SEQ ID NO: 4102812 - RNA, 84 nt, Human
ccuucaggccaggguggacuagagccccgagaauugugccugagugucugcaagcaggauuuggccuuucgcaugguaugaugg

SEQ ID NO: 4102813 - RNA, 109 nt, Human
ccuucauguccaaccuacuuugugacauucuguuuauuucagaacaggguuuacucaaaaugcccugugccagagaggcaggagucaccucugcagguaucacaugugg

SEQ ID NO: 4102814 - RNA, 58 nt, Human
ccuuccacauggugauuugauuauaagccaaaggcaucccuucuccaguguggugagg

SEQ ID NO: 4102815 - RNA, 72 nt, Human
ccuuccacuguuugauuucucucaguuagggagaugagaugacuuuacugaaauaaugaaacacauggaugg

SEQ ID NO: 4102816 - RNA, 60 nt, Human
ccuuccagauguaagagcugauaguaagggauugcacaucauucuccaaucuggagcagg

SEQ ID NO: 4102817 - RNA, 71 nt, Human
ccuuccagcuucuagggaaggcagucacacaugugacucuugggaagugugacugugcuguggagggaggg

SEQ ID NO: 4102818 - RNA, 56 nt, Human
ccuuccagggcagggugcgcaugggcagccccuccuuccugucuuguccuggaggg

SEQ ID NO: 4102819 - RNA, 55 nt, Human
ccuuccauuuucuuugcaggguagauuggacucuacuccucaguuccaugggagg

SEQ ID NO: 4102820 - RNA, 63 nt, Human
ccuuccccacugucugggacauguggucugacaaagugccugaguugugggcagaggacaagg

SEQ ID NO: 4102821 - RNA, 67 nt, Human
ccuucccucuuguugcugugagauaccuccauuggcuuucagaaugauuucagcgagcaggggcugg

SEQ ID NO: 4102822 - RNA, 55 nt, Human
ccuucccugaucacgugucaggaguuuuguaaccccaaggacauuucaggguugg

SEQ ID NO: 4102823 - RNA, 103 nt, Human
ccuucccugccgggccaccuguguuccugccuggcucugguccugggcccuccccgcugccucaugcugagccacaggcagugcacuggcucccaggagaagg

SEQ ID NO: 4102824 - RNA, 74 nt, Human
ccuuccgaccugccaugcaguuagucccucacuaguaguuugugcuaaugaguacuuccugaugagcugggagg

SEQ ID NO: 4102825 - RNA, 60 nt, Human
ccuuccuauaaagaggagucagggucaucugagugaaagaggcaggcuuuauauggaggg

SEQ ID NO: 4102826 - RNA, 111 nt, Human
ccuuccuaugccagcugauccccuaggcccuaggcuuccaucauaucacugagcaaagcacagggcaguuugagugggggucagaggccuggggggucuuuggcuggaagg

SEQ ID NO: 4102827 - RNA, 85 nt, Human
ccuuccuccaagcucuccagcaauauguccuugcucccugcauaagcugucagagcagacaauugccuggauggaugauggaugg

SEQ ID NO: 4102828 - RNA, 72 nt, Human
ccuuccuggagucacaucagagaggugggagcugcccacccuggguucugauguggaagcucccagggaagg

SEQ ID NO: 4102829 - RNA, 75 nt, Human
ccuuccuuaagucaucccauaacagugcuggacuaccaaaguccaagccaccacacagggaugacauaagugagg

SEQ ID NO: 4102830 - RNA, 60 nt, Human
ccuuccuuucucuuuugcguuugcaucaauucccagagaagaauguuuaagagaaaaagg

SEQ ID NO: 4102831 - RNA, 57 nt, Human
ccuucgccuauggccgaucagucuugucugucugcgagcugcccagaguagggaagg

SEQ ID NO: 4102832 - RNA, 60 nt, Human
ccuucuaaguagguggaggaaccuucuauuuguccguucuacccacacugcucuagaagg

SEQ ID NO: 4102833 - RNA, 61 nt, Human
ccuucuagagauguucuucuucagguggagccucaccuuuggaaauaaacacucugccugg

SEQ ID NO: 4102834 - RNA, 63 nt, Human
ccuucucaagcuacuaccuuggaucugggacuuacuauugaucaugguccuagauugauuagg

SEQ ID NO: 4102835 - RNA, 57 nt, Human
ccuucucccucugagaggaaccuggagaggcccggguucugcugagguaggagaggg

SEQ ID NO: 4102836 - RNA, 88 nt, Human
ccuucuccucagauuccucuauagccccuggccuguccauuuuguggcuccuuaacuaccaggucagagguagaugagaugaagaagg

SEQ ID NO: 4102837 - RNA, 98 nt, Human
ccuucuccuuucucaguccuuccagccccuccugagccaagccuuuuuaccauggcuagcuucugaggggcugggcaauacuggguggggaggcaagg

SEQ ID NO: 4102838 - RNA, 64 nt, Human
ccuucucuucuguucugugacucccuggaaggcccacaguucacagcaaaguggggaccaaagg

SEQ ID NO: 4102839 - RNA, 56 nt, Human
ccuucuggaagcucuaagggagaaucuguuuccuuccacuuuccagcuucuaaagg

SEQ ID NO: 4102840 - RNA, 59 nt, Human
ccuucuggauggguuccgugggcaaauggcauucuggagcacaaaggacccaccggcgg

SEQ ID NO: 4102841 - RNA, 85 nt, Human
ccuucuguucauucauguagcggucuagggcuugcaccucaaagauguggcugcagucuuccagcugcacaaagcgggcaucagg

SEQ ID NO: 4102842 - RNA, 91 nt, Human
ccuucuuauccuaccuauagguacaauuacaagaccuaaacuaauccauuaugguucuucucaagagugcuguagguggugacuauugagg

SEQ ID NO: 4102843 - RNA, 55 nt, Human
ccuucuuuagaaggcugaaagcuuugccucuucccagucuucccccagaagaggg

SEQ ID NO: 4102844 - RNA, 69 nt, Human
ccuugaagagaagaugagggacaacaauaaccuuuguuacugacuucuauuccuguccucucuuucagg

SEQ ID NO: 4102845 - RNA, 73 nt, Human
ccuugaagagcaccauucaauagccaggauuaauuaaguucuaaguucugcuaugaaaaaagugcugaagagg

SEQ ID NO: 4102846 - RNA, 95 nt, Human
ccuugacuccaggcuuggucuugcagcucgcuuugacuaacugacagaaguggcagggugccaguugcgagucuaggcuuuaaaagguuucaagg

SEQ ID NO: 4102847 - RNA, 97 nt, Human
ccuugaugagucuguaagaucuucucuuuaguagaaacacuauagacccaauauuuagcuggcucuugcuuacgaagguuaaacagauuauacaggg

SEQ ID NO: 4102848 - RNA, 62 nt, Human
ccuugaugcaaggguugccuuuccagccaggcugucuugccccgguaggcaauccugcaagg

SEQ ID NO: 4102849 - RNA, 87 nt, Human
ccuugcacauucuccagguaaccagagcaagagagcaacaggcuuacccuuaccuaggcugccuccugcugggcuggagagcagagg

SEQ ID NO: 4102850 - RNA, 55 nt, Human
ccuugcaugagugugccccuuuuauauguagcaugagggaagugcgccaucaggg

SEQ ID NO: 4102851 - RNA, 129 nt, Human
ccuugcccaguguuucuauaaaauaagggccuuuugcaucugauuuaaguaggaagcugauuccugagccccucagaucugcugaaucagauagcuaagggggcccuggaaucugcauuuuagcaagcg

SEQ ID NO: 4102852 - RNA, 61 nt, Human
ccuccacgccaggcugggguuagauccuaguuccccaaaauagccccagcugcgucugagg

SEQ ID NO: 4102853 - RNA, 76 nt, Human
ccuccacuagguuucagaggugccgggaagucugagccuucgcccuccugcucucccuccauguccaccuaggagg

SEQ ID NO: 4102854 - RNA, 59 nt, Human
ccuccaggaacuugagagacaccaccuaugauugagugugucugugagauccuuagagg

SEQ ID NO: 4102855 - RNA, 75 nt, Human
ccuccauauuagucauucugcucagagucaacauuucauuugauugcuggcaucagugacaauaucuauuggugg

SEQ ID NO: 4102856 - RNA, 59 nt, Human
ccuccaucuucucagucucuuggaucuaccccaaggugucaaacuagaagauguguagg

SEQ ID NO: 4102857 - RNA, 73 nt, Human
ccuccauucucccaggcucagacuggcuuguuuggacuccagcauccacagccucagccugcagagaaauagg

SEQ ID NO: 4102858 - RNA, 64 nt, Human
ccuccauuuguguccgucccaguucugugcugcuacagcuggaggcaguuggggcagaaggagg

SEQ ID NO: 4102859 - RNA, 69 nt, Human
ccucccaaaauucaugucaaaauccuaacccccaaggugaugguauuaggagguggagccuuugggagg

SEQ ID NO: 4102860 - RNA, 82 nt, Human
ccucccaaagugcugagaugacaggugugagccacuacacugggucccauuuucaugucauuccauuucagauucaaggagg

SEQ ID NO: 4102861 - RNA, 73 nt, Human
ccucccaaguacagauuccuccacugccagccuuaggcgguuagggugugaucuuacgaaaagaauuggcagg

SEQ ID NO: 4102862 - RNA, 90 nt, Human
ccucccaccuugaaaugguccuucguggugcaguucugcuuacgggguagacuuuguugccuuccacagaggacaguuagggugggcagg

SEQ ID NO: 4102863 - RNA, 70 nt, Human
ccucccaggaguccagagaagggacaccucucuuccaagugagggucccgucccucugcacccugugagg

SEQ ID NO: 4102864 - RNA, 57 nt, Human
ccuccccacagcccaggagacuucacuaauagaugaagauccuggggucuggggagg

SEQ ID NO: 4102865 - RNA, 64 nt, Human
ccuccccagugugaaccucaccacccuccccaaugugaagggauggcaaguuaaccugaggagg

SEQ ID NO: 4102866 - RNA, 108 nt, Human
ccuccccuaucuaaccacugcucccugacagggucuccucuagaucugcucccugcacugagcacaggaagcugacugcuggcaggggaggagguggcagaggggagg

SEQ ID NO: 4102867 - RNA, 83 nt, Human
ccuccccucucuccccaagcagcagccugaaguacgucagcaguaauugugugcauggcucggcugugcagggaggguggagg

SEQ ID NO: 4102868 - RNA, 83 nt, Human
ccuccccugugcugucaugcugggcguggaagagccggccuagcuggaggccccgcaccacaugguagagcaggagcuggggg

SEQ ID NO: 4102869 - RNA, 56 nt, Human
ccucccggaucaugucccgcacaaaccugguguguuuggucagacguccggggcgg

SEQ ID NO: 4102870 - RNA, 78 nt, Human
ccucccgucucuauuucuuucucuguuuuauuaucucauucuuggcugugagguaaacaggagaaaaugagaaggugg

SEQ ID NO: 4102871 - RNA, 55 nt, Human
ccucccuagguccuauugcccuccagauaauaucaugaagggggaaccugggagg

SEQ ID NO: 4102872 - RNA, 57 nt, Human
ccucccucccugcagaagccacauggcacaaccugggcccuugacaggaguggaugg

SEQ ID NO: 4102873 - RNA, 89 nt, Human
ccuuuagugguuguggcagugaaccaaggcuccaaacaugcuugcaccaggugacuuggucucuuguguuccugucauucaccaggagg

SEQ ID NO: 4102874 - RNA, 83 nt, Human
ccuuuaucccucuuaguuuguaaaaauaauuuuugaguuuugucaugauaauauuucagacuuggagauauuuggaguggagg

SEQ ID NO: 4102875 - RNA, 94 nt, Human
ccuuuaugcaaaagaagaauuauaggugcagcagcuaacaauuauucauaaauguuugugcugcugacuuaagauauuuucuacaagugaaugg

SEQ ID NO: 4102876 - RNA, 79 nt, Human
ccuuuaugguaacagcuccagcuugaguccugagugcaugcucugcggucuggggucaccuggggugcuuaccaguagg

SEQ ID NO: 4102877 - RNA, 86 nt, Human
ccuuuauuauugcuacagcugaucauuuugaagaaugugacucacaccuucaaguaugugggcugaaaauuuauagcauagagagg

SEQ ID NO: 4102878 - RNA, 83 nt, Human
ccuuuauugcaucauuaauugccaaccuuguuggaccaguacucugaugacuacucucucacagcuuggcugauaaauaaagg

SEQ ID NO: 4102879 - RNA, 62 nt, Human
ccuuucagaaagguuaaucuggauuuacuaggaaagaaaaugcagcugacuuuccugaaugg

SEQ ID NO: 4102880 - RNA, 89 nt, Human
ccuuucauggcaaccaguucccuaauguguagaagauguguaaaccucauguucuguuuuaugguagggaaaaaaccaugucagagagg

SEQ ID NO: 4102881 - RNA, 123 nt, Human
ccuuuccucagagcuguuuaugcuuauuuuuaaaaaauugucacagaagcuugacuuauguggucauacagcagguuacaguggcacagagauaacagcauauaguagacccugagagagagg

SEQ ID NO: 4102882 - RNA, 85 nt, Human
ccuuuccuggggcaagcagugaggacagcacugaguggcuuaaaugaguguuuaucccagcugccgcccgccccagcuaggaagg

SEQ ID NO: 4102883 - RNA, 124 nt, Human
ccuuucgucucacccuccagcacuaaagggcucaauucacuuguguuaccaagguuuggugacugcggaguuaccaagguuuggugacugcagagucuaaggggagccuggcagagaugaaggg

SEQ ID NO: 4102884 - RNA, 83 nt, Human
ccuuucuccuggcccagcuuucauuccuugcugacucaggaauuggcagcguucagcugggagcugggccugggcagggaagg

SEQ ID NO: 4102885 - RNA, 130 nt, Human
ccuuucucugguggcuaaugaugcugagcaucuuucugugugcuuacugguguucagaagaugacugcugaacaaagacauggaggaggaugagggaggcagccaugcaguuaccuaggagcauuucagg

SEQ ID NO: 4102886 - RNA, 59 nt, Human
ccuuucuggaaagcaagauacauuaaaaccuuaaaauguuauuguccuuuccaaaaggg

SEQ ID NO: 4102887 - RNA, 112 nt, Human
ccuuucuuucuagaaaaggcaguagcuaaaaggggauuuaagguaagaagaaggguuuuguuuuguuuuguuuagguuuguuuuuaaaauacugcuguuuuuguuggagagg

SEQ ID NO: 4102888 - RNA, 82 nt, Human
ccuuugaaagcuacauuuucacuuaaggaauuucaugauccaagggcauaaaguguauaagugaagaauuggguuuugaugg

SEQ ID NO: 4102889 - RNA, 110 nt, Human
ccuuugaaguuauuuauuggacuguguuaaacauguucagugacaguuauugagguuuccuucaguucacaauugaaacauguuacgcauucccauacauggagaagagg

SEQ ID NO: 4102890 - RNA, 71 nt, Human
ccuuugacauguccaggugguccuguuguuggcaucccuggcugcacuggaccccaggauauggaaaaagg

SEQ ID NO: 4102891 - RNA, 71 nt, Human
ccuuugauagauguuuguguuaucuccauuuuuugaaagauagggaaacugaggcauaaaguuuucagagg

SEQ ID NO: 4102892 - RNA, 129 nt, Human
ccuuugaucauggaaaauucauauaaggugaauaaauaaccagugggagugcuuacaaauaauuauucugguacucaaaauggugguuaugcgcuuuguggguuuuauuuuuuacuacuucaaaauagg

SEQ ID NO: 4102893 - RNA, 56 nt, Human
ccuuugcccuggaccguccucccuaguggcucuggaaagaggaaacaaggcagagg

SEQ ID NO: 4102894 - RNA, 56 nt, Human
ccuuuggcauuuugaggaugcgucugucaaggcuuuuguccccuaaauaccaaagg

SEQ ID NO: 4102895 - RNA, 64 nt, Human
ccuuugggcagugauuaguucaugaggguggaacccuuauaaauggaauuagugcccuuauagg

SEQ ID NO: 4102896 - RNA, 55 nt, Human
ccuuuggggcuuuacuguggaagcauaacuuagucacaguauaaccucauauagg

SEQ ID NO: 4102897 - RNA, 130 nt, Human
ccuuugggggcauauugcagauuguauauaugggagaacguguuaugcauguguaugcagcuuucuugcauguauaugugcacaugugcuucuguauggcuugauccucaauagccugcuucuuuaaagg

SEQ ID NO: 4102898 - RNA, 72 nt, Human
ccuuugggguccacaacagccggcuguccccagacuuguguccagggaagauaguguugagggcccucaagg

SEQ ID NO: 4102899 - RNA, 73 nt, Human
ccuuuggugguuuucagagauccagagcgaccaugucaggaauguugagauauaucuuugaaaccagaaaagg

SEQ ID NO: 4102900 - RNA, 61 nt, Human
ccuuugguguagaugagagagcgugugugaguguaugauacacaucuaucucuacacaagg

SEQ ID NO: 4102901 - RNA, 78 nt, Human
ccuuuguaagaugugaagacugcagaucucuuuucaucacugagauucacagaauaaaguuuuccauauuuauuaagg

SEQ ID NO: 4102902 - RNA, 65 nt, Human
ccuuuguagauuuucucuccaguaugaauuuucuuauguuuacuagacugagaaucagcugaagg

SEQ ID NO: 4102903 - RNA, 74 nt, Human
ccuuuguccuagagauccgggaggggaggugugcgcccugcccuuuaaaguuguggucaugucuaggaggaagg

SEQ ID NO: 4102904 - RNA, 81 nt, Human
ccuuugucugacuuugaucucuuggcuccaaagucuucaaagcuauccuugacuuuugccugagauccgagucugcugggg

SEQ ID NO: 4102905 - RNA, 68 nt, Human
ccuuugugucaugcccugggguccagguuugcagcuuaaggugcucacuccccaggguaggcuagggg

SEQ ID NO: 4102906 - RNA, 75 nt, Human
ccuuuuagguuaaugggcuucuuuugguccaugacuaacacaaugaagaaagaguuagcucaauaacuugaaagg

SEQ ID NO: 4102907 - RNA, 58 nt, Human
ccuuuuaugaacuugagcagguuucaaugaccugaauuuccacgacaaguucaaaagg

SEQ ID NO: 4102908 - RNA, 61 nt, Human
ccuuuuauguacuugguuccagccuaggugaugagugcaaggugcuaaguacugugaaggg

SEQ ID NO: 4102909 - RNA, 59 nt, Human
ccuuuuccaagccaaggaaguguucuggcuccuggacucugcccuguggaggggaaagg

SEQ ID NO: 4102910 - RNA, 66 nt, Human
ccuuuuccuucauucuucuugucuuauccuuacugauagcauaacagguaagagugaggguucugg

SEQ ID NO: 4102911 - RNA, 55 nt, Human
ccuuuuggaaaguugucacuuuagaugaucucuaauuuagguauuuuccagaagg

SEQ ID NO: 4102912 - RNA, 100 nt, Human
ccuuuuguacaguggguuuguguaaugaauagcuuuacugggcuuuccucuguuuguuuguuuagcaaugcuucauuauuuaaacuucugcacugaaagg

SEQ ID NO: 4102913 - RNA, 74 nt, Human
ccuuuuucucguuauauaggaauuuagcaguucauucugaauguuggcugcuggcuauuuaaagaagaaagugg

SEQ ID NO: 4102914 - RNA, 63 nt, Human
ccuuuuucucucauugcaggcagcaucugaagcagacguagaaacugcacugagaaaaggagg

SEQ ID NO: 4102915 - RNA, 56 nt, Human
ccuuuuucugaguuguagcuucacgaguaucaugggccacugacugaagaaagagg

SEQ ID NO: 4102916 - RNA, 58 nt, Human
ccuuuuuguucuucccaacucuucaagccagguggacagagagucggggggacauagg

SEQ ID NO: 4102917 - RNA, 88 nt, Human
ccuuuuuucuguucugucacacacugguacuuuggcauuuguucagugccaaacaaaguucugccaggcuguggcagcaaaggacugg

SEQ ID NO: 4102918 - RNA, 87 nt, Human
ccuuuuuuuuuccuuuuucaucucuggaugucauugccuggaacuuuugcaggcuucugauaccaugagagaaaguaggcuagaagg

SEQ ID NO: 4102919 - RNA, 101 nt, Human
cgaaauucuauuaggcuggugcaaaaguaauugcaguuucugccacugaaaguaauggcaagaaccgcaauuacuuuugcaccugccuaaguagcuccucg

SEQ ID NO: 4102920 - RNA, 58 nt, Human
cgaacauuuuucaaagaugugugaauuuauaauuuauuauguggaugaaagauguucg

SEQ ID NO: 4102921 - RNA, 63 nt, Human
cgaagcagguuuucuucuauauuuggguagaagccaucccuaauuauggaauaauuugcaacg

SEQ ID NO: 4102922 - RNA, 67 nt, Human
cgaauaguuauuacuuggaauuuuucacaccuagcaguggugcugauguuucaaguauagcuuuuug

SEQ ID NO: 4102923 - RNA, 74 nt, Human
cgaaugaagaaauggacaucuuuauggccuugagcaaaucuuucaacuuguguaugacuccguuuccucauccg

SEQ ID NO: 4102924 - RNA, 55 nt, Human
cgacucaggaggacaaggagguucugaaaaccucgaaugccuuccugaggccucg

SEQ ID NO: 4102925 - RNA, 91 nt, Human
cccuauucuuucuuuacauagauggggugucaugucaggaaaagugauauuucucacaugagucacuaucuuaauguggacaugauuaggg

SEQ ID NO: 4102926 - RNA, 59 nt, Human
cccuauuuccaaauaaggucacauucugaggcucuaguuagaugugaauuuggggaggg

SEQ ID NO: 4102927 - RNA, 88 nt, Human
cccucacucacacguaagccccaugagaacagggacuugguuuuguacacggcuucauucccagacccuuucuuggcaugugguaggg

SEQ ID NO: 4102928 - RNA, 79 nt, Human
cccucacucagcucugagcacugugcggcuggggcugugcuugccucaccggcacucaggcucacuggguugcugaggg

SEQ ID NO: 4102929 - RNA, 89 nt, Human
cccucagauucucaaagaagagccucaucuaucagggcuacugaaagguaagguacucagcccaggugagggguucgaaaucuagaggg

SEQ ID NO: 4102930 - RNA, 119 nt, Human
ccuggggcccuggagaacagacagcucugacucagagaauaucuagaaggagugcagaccugggcauccuaagggauuguuuuuucagucugguugaagugguccaguagcaucccagg

SEQ ID NO: 4102931 - RNA, 65 nt, Human
ccuggggcuccuccuggcaggaggccuggccagccccgagcccuugagccuggaggagcucucgg

SEQ ID NO: 4102932 - RNA, 114 nt, Human
ccuggggcuggaaugcuggggguucuggaagcugggcagcacccuuugacuccaauauagagugggcaagugcccuaggcuuuccccuccagccuaacuguugucuaccccagg

SEQ ID NO: 4102933 - RNA, 130 nt, Human
ccugggucagugcucuaagugaauacuguuguguguucugagugacugugaacuguuucugauccuccuuucugauagagaugaaaagaacacaguccccagaucaaaggcugcacagcauguaccuggg

SEQ ID NO: 4102934 - RNA, 78 nt, Human
ccugggugcuuaaucuguuugucucucuccugacccacgguggcccaggugggaccagagggagaggaacagccuggg

SEQ ID NO: 4102935 - RNA, 79 nt, Human
ccuggguguauucauuggccugaucaacacaaugaccaaaucuggucacagugcaggaucaguuaaugacuguccuagg

SEQ ID NO: 4102936 - RNA, 72 nt, Human
ccuggucccuuuuaugugcuggagcaccacccuaaaaacuguuggcuggcuacaucacagagaauucccagg

SEQ ID NO: 4102937 - RNA, 118 nt, Human
ccuggucugagggcucuugaggcugaggagguuaacaucugcauccacccacucaacauuucugcuggagugucugugucuggggugcagccuccuggcuaagagacccuggcucagg

SEQ ID NO: 4102938 - RNA, 59 nt, Human
ccuggugacuauucauugcccauguuugugaauuaucagaaagcagaauucuugccagg

SEQ ID NO: 4102939 - RNA, 68 nt, Human
ccuggugauacuguugguagaaaguuaaagcuuugaaacgauuugaaaaucuacaaaguggcaucagg

SEQ ID NO: 4102940 - RNA, 57 nt, Human
ccuggugucugcucccucacagcuuguugaggccugugucccuugcacacacccagg

SEQ ID NO: 4102941 - RNA, 90 nt, Human
ccugguuagccggaccuuccuucuuugcuccggguuccuccagaaccacgugacccaggccagagaggggagguguggaagauaauaagg

SEQ ID NO: 4102942 - RNA, 72 nt, Human
ccugguuuagugugaguaauugagucugucuucauuccugaugacuauccuuuguucauuccaauagccagg

SEQ ID NO: 4102943 - RNA, 62 nt, Human
ccuguaaguccucccggaagaccaguucacagcucauuggaagaucaaccaggauugacagg

SEQ ID NO: 4102944 - RNA, 68 nt, Human
ccuguacaagucaucauagaaguuccccauaguugugccaguacugugcugaagguggguuguacagg

SEQ ID NO: 4102945 - RNA, 67 nt, Human
ccuguacuuucucucucuccucugucacuggcucauuccaugugacagagagaugggaaagggcagg

SEQ ID NO: 4102946 - RNA, 94 nt, Human
ccuguaguagagguuguuagcucuuugcuugaagauauacuacuuccuugccuaagggagacacgcugcaggcauaaguuagcacccugcuugg

SEQ ID NO: 4102947 - RNA, 79 nt, Human
ccuguauacucuuugauuuaauuauuucaccuuuaggaauuuauccuuaggaaaucauuagcaaagauaugucugcagg

SEQ ID NO: 4102948 - RNA, 68 nt, Human
ccuguaugaguguguguguggguaugugcauguaugugugcacgugugagcauucacaugcauguugg

SEQ ID NO: 4102949 - RNA, 57 nt, Human
ccuguauuauuuguaugugcugcuaauuaugcuugguuuacaugcucuugguucagg

SEQ ID NO: 4102950 - RNA, 60 nt, Human
ccugucacccacccagccugucaccggagccgccugacagacaucugggugggggacagg

SEQ ID NO: 4102951 - RNA, 124 nt, Human
ccugucacuacgccaggcuauuuuuuuuuuuuucauggagacgaggucuugcuauguugcccaggcuggucucaaacuccugggcucaagaagucuucccuccucagccucccaaaguguuggg

SEQ ID NO: 4102952 - RNA, 85 nt, Human
ccugucacuaguggguuccugcucagagcgucuugugugauguuucaucuugaugcuuugacagguuaacaaccuucucaucagg

SEQ ID NO: 4102953 - RNA, 72 nt, Human
ccugucauugagaaguuugugaaaggaaguaaacagaaguguugggauggucacacauuucucaaguguagg

SEQ ID NO: 4102954 - RNA, 65 nt, Human
ccuguccaaggaagggacaucucggcauuguugggcugcucagaaugucuguucuuucuggcagg

SEQ ID NO: 4102955 - RNA, 57 nt, Human
ccuguccccaggggugucauacagguccuggaagccugccaucucugugggaccagg

SEQ ID NO: 4102956 - RNA, 71 nt, Human
ccuguccccucacaaugccacugucuaauuauccaucuucccucccggaccguaggcugccugggggcagg

SEQ ID NO: 4102957 - RNA, 84 nt, Human
ccuguccuaccacuuucuucaucugcaaaauggggaucaugauaguaccagcuugcaggguuaaaguaagguagugggugcagg

SEQ ID NO: 4102958 - RNA, 61 nt, Human
ccuguccugcaucugcuuuauucuaaaauggguccugugaccuggcaugaugauggauggg

SEQ ID NO: 4102959 - RNA, 59 nt, Human
ccugucuagaagggugccgaucuuaguccuggaucaggaucggccuuuuuuuaagcagg

SEQ ID NO: 4102960 - RNA, 66 nt, Human
ccugucuaugucuuugucccacucccagagucugacuuuacugauggaacagagauagagcauugg

SEQ ID NO: 4102961 - RNA, 60 nt, Human
ccugucugaaagaaucucagccugaacugcuggggauuugaggcugucauuucuggcagg

SEQ ID NO: 4102962 - RNA, 63 nt, Human
ccugucugcaugaucccugccagccgguaucagguugaggcagggaacuuugcagcuugcggg

SEQ ID NO: 4102963 - RNA, 68 nt, Human
ccugucugcccucaacccagaggcagugaaaggaagaagccacggccuugggauggggggcgugcggg

SEQ ID NO: 4102964 - RNA, 56 nt, Human
ccugucuguuaccuccaagaccauucuaauagaggucauauggaaggagcaguugg

SEQ ID NO: 4102965 - RNA, 67 nt, Human
ccugucuuccauuucccuuuagccugagaauccuucaaucugaugugaggacuaaggcucagacagg

SEQ ID NO: 4102966 - RNA, 55 nt, Human
ccugucuugucuuucagcauguucagaauaccuguggcugcugugggcagagagg

SEQ ID NO: 4102967 - RNA, 73 nt, Human
ccugugaacucagucucucuugcuacaguuauuccaagguggugaaaagaggggugaguugacuguucacagg

SEQ ID NO: 4102968 - RNA, 92 nt, Human
ccugugaagaagcuggcccaccaugggaagagagacuaauugguaucuccauagcuuggacuauuuuuuccacuggaucugcaguuucuggg

SEQ ID NO: 4102969 - RNA, 55 nt, Human
ccugugaggucuugcaugugaaauggcucacauauucauggcagccacccacagg

SEQ ID NO: 4102970 - RNA, 84 nt, Human
ccugugcaugguuacuugggucccaccuuucucucagguuagaaacucaagcauccugagcugggacucaguagcaagaacagg

SEQ ID NO: 4102971 - RNA, 57 nt, Human
ccugugcccugccaggcuggugccuggaugcucuagggcccagaggagggcagcagg

SEQ ID NO: 4102972 - RNA, 56 nt, Human
ccugugccuuccuuaggcaccuguuguggacucagguggccucgguggugcacagg

SEQ ID NO: 4102973 - RNA, 58 nt, Human
ccugugcuucaaauuguaucuucuugccaggccugguagacagcuuuaaagacacagg

SEQ ID NO: 4102974 - RNA, 66 nt, Human
ccuguggcccagugguuacaacagaaugauuaacagucaauucuuugcaucucuggguggcucagg

SEQ ID NO: 4102975 - RNA, 56 nt, Human
ccuguguaaaagugguugaaaugugcacauaugcaugcaaacacuauugcauuugg

SEQ ID NO: 4102976 - RNA, 71 nt, Human
ccuguguacccucugcccuacagcucagcacaaaucauagugcugcccugucugcagcaggacccaccagg

SEQ ID NO: 4102977 - RNA, 58 nt, Human
ccuguguccauguucuaauuuggcauugcucauagucaaacauauugugagacacagg

SEQ ID NO: 4102978 - RNA, 92 nt, Human
ccugugugccucccugggagggucagaagggccugguucugggcacagggccacuggguccugcuggcccuuccccauuggugguuuuaagg

SEQ ID NO: 4102979 - RNA, 76 nt, Human
ccugugugugccucgucuacugagugccaggguuagugccccacuugccaggugagaggacugaggcucacacagg

SEQ ID NO: 4102980 - RNA, 106 nt, Human
ccugugugugcgugugugugugcaugugugugugugcgugugucucugugugcauguguaugcauaugugugcacacguguaggugugugugcaugcacgcgcagg

SEQ ID NO: 4102981 - RNA, 110 nt, Human
ccugugugugguggccauggugggcaaaggaugcaggggcagcagagccugguggagacugcaaggauuuguggcucugagucugcccuuggcuagccaugagacacagg

SEQ ID NO: 4102982 - RNA, 72 nt, Human
ccuguuacauuucuggaucaugcauugcuugucccaauugggacaguaaccucaugguugcagagauacagg

SEQ ID NO: 4102983 - RNA, 72 nt, Human
ccuguuagcuguuucuugagaguauuacccuucaugagccuaguuaaagaggguauuucagaagcuggcagg

SEQ ID NO: 4102984 - RNA, 89 nt, Human
ccuguucagcggccugcgccugagccugcugucgcuggacccgguggaguuacgggugcugcggaacagcggcucggccgccgagcagg

SEQ ID NO: 4102985 - RNA, 56 nt, Human
ccuguuccauugguuggaagcaagucacaggugcuauccacacucaaggggagggg

SEQ ID NO: 4102986 - RNA, 62 nt, Human
ccuguuccuccuaccccaggccccaccuaggugcuggggaggccugggcaagggggucuggg

SEQ ID NO: 4102987 - RNA, 60 nt, Human
ccuguucucucuuuuuggaccgaccgaaccagugugucgcuguucacggaggaggauggg

SEQ ID NO: 4102988 - RNA, 55 nt, Human
ccuguugagagagcucacugaggucccagcacagaacucagcacuuuuacacagg

SEQ ID NO: 4102989 - RNA, 82 nt, Human
ccuguugagugccucgugagccccugccuguguuccugccguucggguaugagaacacagcggggcuuacccggugugcagg

SEQ ID NO: 4102990 - RNA, 60 nt, Human
ccuguuucacacucuaucauaauugccuccuuacuggucugugagcuuugugaaagcagg

SEQ ID NO: 4102991 - RNA, 55 nt, Human
ccuguuucuccuuguucaucuuucuucuuuauuaaguguacaaggauuaugcagg

SEQ ID NO: 4102992 - RNA, 76 nt, Human
ccuguuugaguuagaagggcagggagaggccagugcuuggcucuguccuccaccugcuuucaggagcuggggcggg

SEQ ID NO: 4102993 - RNA, 129 nt, Human
ccuguuugcaaaaugauauuucaguaggaagagggccagagucuguguagauacuaagacuuacuguuuauggaguaaucuuuacaacuuugguccaaacucuugugagguagguuuuuacagaugagg

SEQ ID NO: 4102994 - RNA, 60 nt, Human
ccuuaaaaagauaggcuuugauaagcacuuaccacuggguuucagaccuaucuuugaagg

SEQ ID NO: 4102995 - RNA, 93 nt, Human
ccuuaaaacaaaauuuagagaaaugcaagacauaaauaaucuuuuuaacaaaauggguuacagccuuggauuucuuuuuagaauuuugugugg

SEQ ID NO: 4102996 - RNA, 77 nt, Human
ccuuaaaacuuggauauggugagagccugaagugaacaaaguacagaugcuggagcuaccuuaucagagugguaagg

SEQ ID NO: 4102997 - RNA, 62 nt, Human
ccuuaaaugagauguucagauauuugguuacugcauugaauaauaucaacuuucauuuaagg

SEQ ID NO: 4102998 - RNA, 56 nt, Human
ccuuaaucacccccuuaaaggcucuaucucgaaacagucacauuggggguuuaggg

SEQ ID NO: 4102999 - RNA, 63 nt, Human
ccuuaauccagcacucgcugauuuuaggauuaguaaaucuugguuuaggaugcuggggagagg

SEQ ID NO: 4103000 - RNA, 63 nt, Human
cgcacccgccaccugcccgcggacugcggcgcagcggucccaggaagugcggcggcggcggcg

SEQ ID NO: 4103001 - RNA, 77 nt, Human
cgcacuccaccucugaagguuucuguuacugucuuuucaagagaaucuaguuucagacuuugaguucuguggcugug

SEQ ID NO: 4103002 - RNA, 64 nt, Human
cgcacugacccuuugagguugugugggguguggucagugcccuccugccugagggucaagugug

SEQ ID NO: 4103003 - RNA, 66 nt, Human
cgcagaacguggugcagcgugugguggcucugccccuggucagggccacgugcaccgcggucugcg

SEQ ID NO: 4103004 - RNA, 69 nt, Human
cgcagaagagguugucuagucccuuccaggacucaugggagcccacgacucuauagccauucuucuccg

SEQ ID NO: 4103005 - RNA, 80 nt, Human
cgcagcacgugcucgcggcgcccgaagcccuugccacacucccagcaggcaaagggccgcgcucccgagugcgucuugcg

SEQ ID NO: 4103006 - RNA, 65 nt, Human
cgcagccccgcacagcaggggaacccaggucuuccuucccucccuuagggcugggugggugugug

SEQ ID NO: 4103007 - RNA, 89 nt, Human
cgcagcugagccaauugcugggcagaaggaagagccaccugggacguuacuuccagguggauccaauucugcuuagggcacucacugcg

SEQ ID NO: 4103008 - RNA, 56 nt, Human
cgcagcugccuugucagccguuugaucuccaaccggcgaggacaagaggaguugug

SEQ ID NO: 4103009 - RNA, 69 nt, Human
cgcaggcaagagaguacaguuaauaucugaagacccuaaaagauaugcccuguggaauuuuaccaugcg

SEQ ID NO: 4103010 - RNA, 71 nt, Human
cgcaggcagcgcucguggccuggccagggagagaggagagucgugaugcugggagugcaggcugccuugug

SEQ ID NO: 4103011 - RNA, 59 nt, Human
cgcaggcucgguucacagagcagauuccaugguggccuccuuugcauaccuagccugug

SEQ ID NO: 4103012 - RNA, 64 nt, Human
cgcaggcuucucaauagguuugaaguggacaagaucuaugaaagccaaguggagaagacuggug

SEQ ID NO: 4103013 - RNA, 69 nt, Human
cgcagugacccugagggugcuggguuucuguuugagggagaagaaacuccugagccccuagguauugug

SEQ ID NO: 4103014 - RNA, 64 nt, Human
cgcaguggaggccacauuacuugguggguggcuugcuugccaccuguuugggcaaaccacugug

SEQ ID NO: 4103015 - RNA, 82 nt, Human
cgcaucaggcagcuuucagucauuuuguuugccaaaggcagcuuccuguggccaugacauggaggcuuugaggcuuugugug

SEQ ID NO: 4103016 - RNA, 84 nt, Human
cgcaucugccccugggcuggucuggcuuagucaggagggcagcccuuggcccagggcacagacacaugccugggaaggaaagcg

SEQ ID NO: 4103017 - RNA, 84 nt, Human
cgcaugcauacucguacagguccacggcgcccaggggugagggcaccucgaagaagggccucugggccagcggggacugcagcg

SEQ ID NO: 4103018 - RNA, 60 nt, Human
cgccaccauagaggaaguccuggaggucuuguucuucaggauccccuugaugggcuggug

SEQ ID NO: 4103019 - RNA, 68 nt, Human
cgccacucagcccacccacuggacugcagcagaggagucggcugccagccagggugggauccaaggcg

SEQ ID NO: 4103020 - RNA, 76 nt, Human
cgccagcccagccuacucugccauagcagggcugaccuagaaucucuggacagaguguaugagggcugggaaggug

SEQ ID NO: 4103021 - RNA, 69 nt, Human
cgccaggagcagcaggaggaggaggcagcgacaagguaagagaagcgguuucuuguucuucucuuggcg

SEQ ID NO: 4103022 - RNA, 72 nt, Human
cgccagucccaagagccgccagaccuucgcacgcgcagcgcgcgcugugggagggaaggcgcggcccuggcg

SEQ ID NO: 4103023 - RNA, 70 nt, Human
cgccaucuccacaugcccacagccucuggucauucaugagggcugauaaaugcgcaugguggggugggcg

SEQ ID NO: 4103024 - RNA, 58 nt, Human
cgcccagguccugccuugguuacccugcacugcuggcagcguauggcagggccgggug

SEQ ID NO: 4103025 - RNA, 60 nt, Human
cgccccagggcugugaggagcggcugacgcccuuugcugucuucccgaggcccuggagug

SEQ ID NO: 4103026 - RNA, 130 nt, Human
cgcccccgccccgccgcgcuuccuccuccgcuccagaguccccagcggcgcgggccgagguuccuggcccgccccgggcaggggcgcgggccggggaggggccgaggugcagcccggggguggcgggaug

SEQ ID NO: 4103027 - RNA, 70 nt, Human
cgccccugcagcgcggcuggaacugggacgccgggcugggggccgugcccaggggccagcugccgggacg

SEQ ID NO: 4103028 - RNA, 74 nt, Human
cgcccguguggaugcgcuggugcugcaugagguuggagcuccagcugaagcgcuugccgcacuccaagcaggcg

SEQ ID NO: 4103029 - RNA, 91 nt, Human
cgcccuccagcagcuuccuguaggcguccagggccaguuccuguacucacgcagcugcugagccauguccugcuuggcuagcugcagggcg

SEQ ID NO: 4103030 - RNA, 65 nt, Human
cgcccuucugugcuucacaguugccaccaaagcaaguucaugguuucucagcauggaauguggcg

SEQ ID NO: 4103031 - RNA, 59 nt, Human
cgccgccccccuucccuaccuuuuaaugaauuaaaggacaggaaggcagaggggcugug

SEQ ID NO: 4103032 - RNA, 58 nt, Human
cgccgccgcuucccuccuccggggccgcucgcucccaggaaaguggaggcggcuggcg

SEQ ID NO: 4103033 - RNA, 67 nt, Human
cgccgcugggauauguccaguucuaccuaccuguaacacaaguaugaacaaacacaucccagcagug

SEQ ID NO: 4103034 - RNA, 58 nt, Human
cgccggcccagcgcagguccugcccugccuuggcccuccguggccugcgcugggugcg

SEQ ID NO: 4103035 - RNA, 71 nt, Human
cgccgggcucggggagcugcagagcucgaaggaaccacgagguggcgcgcuagcacugcguucgcccggcg

SEQ ID NO: 4103036 - RNA, 93 nt, Human
cgccggugugugaacuacaggggguggcaggcggcugcuccgcuguggaaccugcugcccugugccacccugcugccuagucacaggccggcg

SEQ ID NO: 4103037 - RNA, 64 nt, Human
cgccuacuucccuggcucuucuacaucgucaucuuccgacaacgacgagggcagcggaggggcg

SEQ ID NO: 4103038 - RNA, 71 nt, Human
cgccucccgcgggccccuccauccaucaccggggcggcggcgcccgggucuggggaggggcgaggggggcg

SEQ ID NO: 4103039 - RNA, 61 nt, Human
cgccuccucguacagcagacugaaguccuggggacaggcgcacaggguguugaugugggug

SEQ ID NO: 4103040 - RNA, 59 nt, Human
cgccucucaccuccaggagcugcuggccuccacggaaagcauccgccuggaggugggcg

SEQ ID NO: 4103041 - RNA, 69 nt, Human
cgccugaaucauguucugagcacacaagaugagaaugagagaaugugauggccaggaaagaaucaggcg

SEQ ID NO: 4103042 - RNA, 73 nt, Human
cgccugagagaugagaccucucacugagguguguuguccucucacugaggugugugguccucucacuuaggug

SEQ ID NO: 4103043 - RNA, 88 nt, Human
cgccugcgggagcgaagggggcgggucagggggcugcgggcgcccucgggcagcacaguuucuggcccgccgcuuccugcugcaggug

SEQ ID NO: 4103044 - RNA, 87 nt, Human
cgcgcgggagcugggcagaggcaggauaagaacugcggaugaggccgagcgcagcucuuacccuccccuuacccuccgcuccccgcg

SEQ ID NO: 4103045 - RNA, 61 nt, Human
cgcgcugcagacagcggaggccugggccauauuccaggagcagaccguaguccugcaggug

SEQ ID NO: 4103046 - RNA, 77 nt, Human
cgcggccggaagcgcaggacuggcucacggccguccagguaggcggccagugccucgccgcgcuccugcaggccgcg

SEQ ID NO: 4103047 - RNA, 81 nt, Human
cgcucaagguucccucucuggaagccuuccucaacccaaacaaaaggaggcucagggacggggccccuucuccucugagcg

SEQ ID NO: 4103048 - RNA, 71 nt, Human
cgcucauggaagaguagugcuuucagagaugagcaaaagcuacauuuacagagccuucucugcagggagug

SEQ ID NO: 4103049 - RNA, 114 nt, Human
cgcuccuuggggacauucaucgaggaggaggcagugucgguggcaggauguggaagccacacaccuggaugcuggccuugccuuggcuccuuuucggcuguggucucuugagcg

SEQ ID NO: 4103050 - RNA, 74 nt, Human
cgcugagcuuuguggcccgcgccgcgaccagccaacgugaucucugacuggucuguccgcaggucaccuucgcg

SEQ ID NO: 4103051 - RNA, 96 nt, Human
cgcugccugcaguaaauugcugaugccugaacuugaauaucaggaucaccugaaguucuacaagccucagguuccucaguucagucugcgggcacg

SEQ ID NO: 4103052 - RNA, 80 nt, Human
cgcugcugcuucugggaggccuuugugucugugccuguaacaugggccaugauucucugccuuccccaugggcugcugug

SEQ ID NO: 4103053 - RNA, 94 nt, Human
cgcuggcagguucaggcucaggagugagaugcgaucacuugucgagaaacugagaagucacguguguuucauccaugagacugugaugcgagug

SEQ ID NO: 4103054 - RNA, 96 nt, Human
cgcuggcugagugcaagcuggagguccgaggugagggcguggccauccccaacacuggcugacccuugcucgggcccugugccagccuggccggug

SEQ ID NO: 4103055 - RNA, 80 nt, Human
cgcuguccguucucugcuccuuugccacgcugagcgagcuagcuguggccagaugugagcggugugcaggacggacagug

SEQ ID NO: 4103056 - RNA, 65 nt, Human
cgcuuucugcagcugccagugauuucagcuucccaagguauggacuugcagcugccagaugagcg

SEQ ID NO: 4103057 - RNA, 73 nt, Human
cgcuuuggcuccagaguccaugccguuaaccacuucugugcauuuauugagcaacucuggggcucucagagug

SEQ ID NO: 4103058 - RNA, 80 nt, Human
cggaaaaggcuuacugugcauuauucuuaccuuucuuugaucuuuuuuagggaaugcugggagaaauguuggccuuuccg

SEQ ID NO: 4103059 - RNA, 67 nt, Human
cggaagagaauuucucucuuuuuaugcaggacucgaaccugggaaaaugugagggaaaaucuuucug

SEQ ID NO: 4103060 - RNA, 61 nt, Human
cggaagagcgcucccggccccagacuucccauuggauaauuggcagcaagaggcucuucug

SEQ ID NO: 4103061 - RNA, 58 nt, Human
cggaaggguuuaagcaggagagugcuaugaggcagucuauuuuggaaagaucccucug

SEQ ID NO: 4103062 - RNA, 59 nt, Human
cggacaggcuccuggagcuccuccauuaacuaggagcaaaaugauuccagagcuuuccg

SEQ ID NO: 4103063 - RNA, 77 nt, Human
cggacgcugagcccccgcccacccucccccgggcccaacaaaggaaggggguguccaggggguaucccagcucuccg

SEQ ID NO: 4103064 - RNA, 79 nt, Human
cggacggaggugucuuugcggcccgccgcgcccuggcugccuccggggcggcggggagccggggagagcgcuucugccg

SEQ ID NO: 4103065 - RNA, 76 nt, Human
cggagacaggguggggauggugagcuuagcccagggccuuccugacgaggagaaguccccuccccauccugcugug

SEQ ID NO: 4103066 - RNA, 66 nt, Human
cggagagcugugucucauccgccucuggcuggggcuggcacagagggcaugggucacgauucuccg

SEQ ID NO: 4103067 - RNA, 57 nt, Human
cggagcaggaacagaucccuuggagacaccuuaucuucaaaauuguucuaagcucug

SEQ ID NO: 4103068 - RNA, 68 nt, Human
cggagcaguaauuagauucuccagaaaacauuggacuucaguuuccuggaagugcuuuuauagcuuug

SEQ ID NO: 4103069 - RNA, 68 nt, Human
cggagcauaaugaugcucuccaucacccgagacagguggccugcacagggauauggggagcugcucug

SEQ ID NO: 4103070 - RNA, 61 nt, Human
cggagcgcugggggacucugcagcgcgcaggugaccacgcagagacagccccagcgcgaug

SEQ ID NO: 4103071 - RNA, 58 nt, Human
cggaggaauuggcagcuccguggcgggccuggcacccacagagcugccaauuccugug

SEQ ID NO: 4103072 - RNA, 106 nt, Human
cggaggcgcggcgaguggaucgcggcgcggugggugcggggagccgaggcgggcggcccccgccgccgggagcgcucgccggccuuggccgccgccgccgccuccg

SEQ ID NO: 4103073 - RNA, 85 nt, Human
cggagggcucccuuccaugcagagaacugaaguacaucucacagagaagccuuugagcucaguuacugcauagaaugaaccuccg

SEQ ID NO: 4103074 - RNA, 59 nt, Human
cggagucuggcguaaguguuccuccucugcacgccucugaggacauuugcaaaggucug

SEQ ID NO: 4103075 - RNA, 84 nt, Human
cggagugauuuuaugcauauguacccauguucuguguaugcguuuuuaaaguagaaauggaaccacgucauauacaucacucug

SEQ ID NO: 4103076 - RNA, 78 nt, Human
ccuuccaaccuucagacacuuauugagcaaguacuaagaaugggcacugcagguaagugcugucaguuaagagggagg

SEQ ID NO: 4103077 - RNA, 59 nt, Human
ccuuccaauaaauugcuucuugaccaagcugagucaaaaugagcuuuguuauugaaagg

SEQ ID NO: 4103078 - RNA, 92 nt, Human
ccuuccagcuaaauagacaauucuagccaacauugagucacucaguaagucuccaguguguguguuugcugagauugucuagcaguugaggg

SEQ ID NO: 4103079 - RNA, 72 nt, Human
ccuuccaggacugugagugccuagaaaguggaaaccucauucuauucaucuucauagucacagugcuugugg

SEQ ID NO: 4103080 - RNA, 59 nt, Human
ccuuccaggagucucugcaggugagaugagaacguggccagaggcagguccugggacgg

SEQ ID NO: 4103081 - RNA, 72 nt, Human
ccuuccaggccgggcaggaaacaccauaaagccaccaugcuuccuugggguguugucgcuggguuuugaggg

SEQ ID NO: 4103082 - RNA, 63 nt, Human
ccuuccccacacccacagccuggcccaagcacgcagggcagcaggcuucgcucugugggcagg

SEQ ID NO: 4103083 - RNA, 66 nt, Human
ccuucccugcccuggcagccuaccauggggugggcacucccuaugccuguccuagggcaguacagg

SEQ ID NO: 4103084 - RNA, 64 nt, Human
ccuucccuguuccggcauaacaagaagacaaacaucuugacugugcacaucugacgggugaagg

SEQ ID NO: 4103085 - RNA, 60 nt, Human
ccuuccucacacucccccauucgacagaauucugcuuuguaaagggagcugugaggacgg

SEQ ID NO: 4103086 - RNA, 85 nt, Human
ccuaggagaggggcagugcacccgggcccugggugauggggggaucagggcccccaagaagaggugccacucccgcuucgccggg

SEQ ID NO: 4103087 - RNA, 55 nt, Human
ccuaggagauaguuauuuggcaguugcugcuauuguggagugguuguuuucuagg

SEQ ID NO: 4103088 - RNA, 89 nt, Human
ccuaggcaguguaucgagugugugacuucacuuuagccucacagcaguucugagugcuacucaguguuguuaccauuuugcugaugagg

SEQ ID NO: 4103089 - RNA, 82 nt, Human
ccuagggguguucucugcccugagccugcucugccugagugagggcugggccacagacucaaggcaggccacgcccuccagg

SEQ ID NO: 4103090 - RNA, 83 nt, Human
ccuagucuugguuaaauaacuuuuacaaauugucaucaucaucaugauuaucauguuguaaugagguauuacucuacgcuagg

SEQ ID NO: 4103091 - RNA, 74 nt, Human
ccuauaaaucauucaagcccauaugugugcaugcauaugacacaucaaaugccauauaugguugauuuucuagg

SEQ ID NO: 4103092 - RNA, 82 nt, Human
ccuauagagcaggacaggucuuuggucaaggguauucgaguagcuaugcuccccugcuagaaccuccaacaugcucucaagg

SEQ ID NO: 4103093 - RNA, 80 nt, Human
ccuauauauaucgggacauaaaugaaguuugacuaugguguuccauggggaaaauauuggugucuggaagucagaguggg

SEQ ID NO: 4103094 - RNA, 75 nt, Human
ccuauaucuuuaucucuaaaugucauucuucaguaaaggaaaccauggcucauuggagauguaguggauucuagg

SEQ ID NO: 4103095 - RNA, 63 nt, Human
ccuaucacccauccuggaugagauucugcagauucagagcugagaucuuggugggcaggcagg

SEQ ID NO: 4103096 - RNA, 59 nt, Human
ccuaucuaguuaguaauuaacauauuagguuugggugccuaauauguuaauuagguagg

SEQ ID NO: 4103097 - RNA, 69 nt, Human
ccuaucucuuguuuuccugaagccucccuggcuccgggguguucugcuaggggaagggagagaaugagg

SEQ ID NO: 4103098 - RNA, 65 nt, Human
ccuaucuuuagacauacagaauuuccagaaaaaauagucuggaagucuguguuuuuaacaaaugg

SEQ ID NO: 4103099 - RNA, 56 nt, Human
ccuauggcuccugcccuggaguuguucauaagaccuuccaggcagacagcuauggg

SEQ ID NO: 4103100 - RNA, 81 nt, Human
ccuauguauggccugggcuuucaaaaccagccuggcagacugccaggccugggacgggagccgugacaggcugguuauugg

SEQ ID NO: 4103101 - RNA, 73 nt, Human
ccuauuacaugguuuuaccaauucacccggaggcauagcuuuuguucucuggaugauaugugaacuugauagg

SEQ ID NO: 4103102 - RNA, 127 nt, Human
ccuauuauuaacaucuugcauuagugugguacauguguuacaauuaaugaaauaauauugauacauuauuguuaacuauagcaucugguuuacacuaagguucacucugcauuguacauucuguggg

SEQ ID NO: 4103103 - RNA, 63 nt, Human
ccuauuccaguucaugggugauaucuuaaugaggauucuuuacaucauguaacuggauauagg

SEQ ID NO: 4103104 - RNA, 75 nt, Human
ccuauuccuuacacuuccauuuauucuuguccagaugacuaauuaggagaaaaaugaggaagauagaggaguggg

SEQ ID NO: 4103105 - RNA, 73 nt, Human
ccuauucuuggugcagaugcaggucacugggcacauccccaauuccuggguucugccacaaagcuggaguagg

SEQ ID NO: 4103106 - RNA, 56 nt, Human
ccuauuuccagauucugcuuguuggcaacauggucauuccaagcauuggaauuagg

SEQ ID NO: 4103107 - RNA, 99 nt, Human
ccuauuuuuuuuuuucccuuaggacaacaggcagacgucagaaagaugugggauuuuucugaguuuuccugauuggccuaaagcaaugaagaggagagg

SEQ ID NO: 4103108 - RNA, 56 nt, Human
ccucaaaaaugcagguacuccauaauaacauucaaggaaaauugcguauuuugagg

SEQ ID NO: 4103109 - RNA, 58 nt, Human
ccucaacaguggcauaguaagugucagggcuagccacucacugugcaaauguugaugg

SEQ ID NO: 4103110 - RNA, 94 nt, Human
ccucaacauuguuuugagacaaccagugaguauuuguaacagagaugagagaguuucgcuugccaccuuacugacgguuacagaaaaugugagg

SEQ ID NO: 4103111 - RNA, 77 nt, Human
ccucaacuaaaagacgagaacaugaagucuccaagaguuaaaugacuuacacacaguccucagucaguuuggugggg

SEQ ID NO: 4103112 - RNA, 57 nt, Human
ccucaagaaggcauccccagucccuagaugcugagcucagggaaugcuuccuuuagg

SEQ ID NO: 4103113 - RNA, 90 nt, Human
ccucaauuuggauaucaauaucuguggccauacaauuuagaugugaaaagcaaaaauuguaggaucacaugaccuauauucaaauguagg

SEQ ID NO: 4103114 - RNA, 85 nt, Human
ccucacauuuccugcuucccugaugucaagaagaggucuugggaccuuucacgguaucagacaucuaggggcagagggguagagg

SEQ ID NO: 4103115 - RNA, 71 nt, Human
ccucaccacagagccuguccagcccacccgaggcgcucccugccucuggccagcucaggcugugugugggg

SEQ ID NO: 4103116 - RNA, 110 nt, Human
ccucacccuccacauugucucucauccuccaggacacuaacccaggcuucuacacauggugggagcagcguuccaggugaugagaucagcagcugggagaccuggugagg

SEQ ID NO: 4103117 - RNA, 59 nt, Human
ccucaccuauagagagaagaagaaaccguccacuucucaguguuguucugcagaugagg

SEQ ID NO: 4103118 - RNA, 60 nt, Human
ccucaccugccaaauggggaugcugagggcaccucgcucucuggagugggaggugucagg

SEQ ID NO: 4103119 - RNA, 65 nt, Human
ccucacuaauuggaacacuuuuugccucugccagugcuaggaaagagggacccagcuugguuggg

SEQ ID NO: 4103120 - RNA, 62 nt, Human
ccucacugcauuugcuucuccacuguuucaggagaaacucagucauaaagcgaaugcagagg

SEQ ID NO: 4103121 - RNA, 93 nt, Human
ccucacugccugugggugguagggugcugaccuguucucucaagaauggccagggaagaaaauccaucgcugccagcucuagugcccgugagg

SEQ ID NO: 4103122 - RNA, 66 nt, Human
ccucacuguuccucauccuccaaaacacauacuguuauuacgggagccagagggaugcaguugagg

SEQ ID NO: 4103123 - RNA, 56 nt, Human
ccucagagaggaggaagaacuucuuuuguaacaaguauuugcugccaucuuugagg

SEQ ID NO: 4103124 - RNA, 58 nt, Human
ccucagagcagcacccagaugacgaagucaccauucugagaugcugcugguuuugggg

SEQ ID NO: 4103125 - RNA, 55 nt, Human
ccucagagguguggcaucucugcaacccuagcagguggccaugccggcucugagg

SEQ ID NO: 4103126 - RNA, 66 nt, Human
ccucagagguuuucauucuguaggccagugugaggcuugcgaaguucugaaugaacucucugaagg

SEQ ID NO: 4103127 - RNA, 58 nt, Human
ccucagccagaaaguauguuagggagagucuucuccuucuucuucuuuuuugcugagg

SEQ ID NO: 4103128 - RNA, 56 nt, Human
ccucagccucugaggcaggcuggacagcagaauggagucuucuccagaggcugggg

SEQ ID NO: 4103129 - RNA, 117 nt, Human
ccucagcgagugcauugagugauauuggugugaggugggggcagcugggguggcuccaaggcacaguggcccugccagcuguucccacccaaaaccaucaccaugaaggagcugagg

SEQ ID NO: 4103130 - RNA, 55 nt, Human
ccucagcugagccucagcgucugugcugagcugcauaaggccugggaagcugagg

SEQ ID NO: 4103131 - RNA, 91 nt, Human
ccucagcugugacuccagcagcaucuucuaaguaaggcucucagaagcaugaagccugcaagauggcuggucacuuguaaagcaaaugagg

SEQ ID NO: 4103132 - RNA, 65 nt, Human
ccucaggaaaugaauaaauggcuauuuggaguccuggcucccuuugugcuuuuauauuccugagg

SEQ ID NO: 4103133 - RNA, 60 nt, Human
ccucaggcagcugccuucagcuggaugggaaacuucacuucaaccaggcagcuccugggg

SEQ ID NO: 4103134 - RNA, 63 nt, Human
ccucaggcaggaaacugucccgagcucccuuuggggagagccagacagugcuucugagugagg

SEQ ID NO: 4103135 - RNA, 60 nt, Human
ccucagggaaugggaggcuggguauuuauccaacaacuuccugcaccccauugcuugagg

SEQ ID NO: 4103136 - RNA, 88 nt, Human
ccucaguacuuggcucucaaccacuuuguaaucuuaccaacaauccccaguaaagccagaguguguuagagacaacagcuuacuaagg

SEQ ID NO: 4103137 - RNA, 70 nt, Human
ccucagucugucugaucugccagggagcucuggaguauaagucaaaccugagagauggacugacuugggg

SEQ ID NO: 4103138 - RNA, 67 nt, Human
ccucaguuucucugucuguuacauugggauccccacucccucucagugugaauucaggagccuaagg

SEQ ID NO: 4103139 - RNA, 66 nt, Human
ccucaguuucuucaucagaaaaugaagcuaauaguaagcuuuacaugagaugaggacaacuagagg

SEQ ID NO: 4103140 - RNA, 128 nt, Human
ccucauaagccagcacacaccuccagggauuuuacauugcagcuggucaggguaauucuaauucaaggaaucacuccacgggcuccagagguguccucccggugucuuuaaaagccguggccacgagg

SEQ ID NO: 4103141 - RNA, 72 nt, Human
ccucauagagugauguaagguaugugaagugccuggccacaguuuacccucaacaaauucacucuauaaagg

SEQ ID NO: 4103142 - RNA, 60 nt, Human
ccucauauacucuuggcagguaugcaaauuaguacaagagguuaaaagaguaauuugagg

SEQ ID NO: 4103143 - RNA, 75 nt, Human
ccucaucagggucugaaacugaucacagcauccugccaugcuguuucaagugaagucagacauucugcauucugg

SEQ ID NO: 4103144 - RNA, 73 nt, Human
ccucaucguguccgccaucuuggggcgacggccagaaguccagggcuaggagccucagccggcggacgccagg

SEQ ID NO: 4103145 - RNA, 91 nt, Human
ccucauggaccacggagcccagcagaaaguccagccucuggcacagcuccccaagguuggccaagcugcuggcccugugagcaccaucagg

SEQ ID NO: 4103146 - RNA, 60 nt, Human
ccucauuacaucacccuguuuuauaaaaugaguugucacuggaaagugcauguaaugagg

SEQ ID NO: 4103147 - RNA, 96 nt, Human
ccucauucuugggggacugccucugucaccccagcauggggggacccuggaaagcuuggcagggacaggggccggcgucuccgggggcaggugagg

SEQ ID NO: 4103148 - RNA, 70 nt, Human
ccucauuggccaaaguacaaaucucaggagagagaaauugagcaguuugaaucaauggccagaagugagg

SEQ ID NO: 4103149 - RNA, 70 nt, Human
ccucauugggcugaucuguggaagaagacaagcagaaaaagaagagucaacucugcagaggaguuugagg

SEQ ID NO: 4103150 - RNA, 60 nt, Human
ccucauuuacacuaugggaacuacacuauaaguguaguuguuacuuagugucaaauuggg

SEQ ID NO: 4103151 - RNA, 84 nt, Human
ccucauuuuaagaguuuugauuuaaucauaccugcaaagucucuuuugucuuguaaguuaaauucacagauuccagggaugagg

SEQ ID NO: 4103152 - RNA, 72 nt, Human
ccucccaaagugcugggauuacaggugugagccaccaugcccagccuuauuaccugcacuuugaagaagagg

SEQ ID NO: 4103153 - RNA, 71 nt, Human
ccucccacucuccucucucucuuucugucucucucccugcuaagaaagugggaacaauggagaguguuagg

SEQ ID NO: 4103154 - RNA, 91 nt, Human
ccucccagagauuuuguauguugaaauccuaaccuccaaugugauaguauuuggaauggggacuuugggacauaauuagguuuaggggagg

SEQ ID NO: 4103155 - RNA, 74 nt, Human
ccucccagcuaagaggucacuugguuugggcuucauuaggacugagacuuuguugaguucuuucugggacuugg

SEQ ID NO: 4103156 - RNA, 103 nt, Human
ccucccaggaaaaggaaaggguuuucccagagcuguccucaaggagcuggagucgcuugguggaguuucagccucugggugcccuggcuugcccuuggcgagg

SEQ ID NO: 4103157 - RNA, 72 nt, Human
ccucccaguaaucacuguguauugcauuaugcaagucagcaaauucugcucacuuuaauauacaugaggagg

SEQ ID NO: 4103158 - RNA, 120 nt, Human
ccucccaguucuguucuuccuucuuacuuucaccaggcuccucaugaucuuguuucuggugaaaucaagccaaaaccaagggcagcuuugaagauagaacaaggaauagagcuucauagg

SEQ ID NO: 4103159 - RNA, 56 nt, Human
ccuccccgugucugucugcaccaggagcaccugggacugggaaggucaaggggagg

SEQ ID NO: 4103160 - RNA, 94 nt, Human
ccucccgccacucgccggcggcggccggugugcggcugcgacaauguggccauuguuugggagcugcaaaccaggccggcgcgcaggugggagg

SEQ ID NO: 4103161 - RNA, 65 nt, Human
ccucccucagagaccguggugcagugauuucauguuuuucauauaucaauuuuuuuugggggggg

SEQ ID NO: 4103162 - RNA, 56 nt, Human
ccucccuccauugccaucgucugaucaaggggcugggcagggcgacacgggggagg

SEQ ID NO: 4103163 - RNA, 68 nt, Human
ccucccugggugcugggauugcaggcgugagccaccgcgcccccgguccaauuuaguaaccagaaagg

SEQ ID NO: 4103164 - RNA, 59 nt, Human
ccucccugguggcucuggucuagccccugguuuaauccuaggauuggggcuaggggagg

SEQ ID NO: 4103165 - RNA, 64 nt, Human
ccucccuuccuccugcagcagggguucuggaaaaagcccagggcugccagggaggugguggagg

SEQ ID NO: 4103166 - RNA, 72 nt, Human
ccucccuucucuuuccuuucacccccauuucaaaauccaauuugacaaaggcugagaggaaaagaaacgagg

SEQ ID NO: 4103167 - RNA, 73 nt, Human
ccuccggcaucacagagcucccuuccacugggggugaagcacucucccagcagcagcuuagugguccccaagg

SEQ ID NO: 4103168 - RNA, 64 nt, Human
ccuccguaaauacaaugucaaguaaauaaaguaugaucuuaauugacagaaaguuuacgagggg

SEQ ID NO: 4103169 - RNA, 130 nt, Human
ccuccguuucuuuccuugguuuucuaaucucuccaaugggaauguuuuuauuugcuuuucucuuacaucguggaagcaguagaaugcauugcuuuucugaaggacuggaagaaggaaagggaaagggagg

SEQ ID NO: 4103170 - RNA, 59 nt, Human
ccuccuaggccagucagccccagccugaagugaagggagggcuuggcugccuggggagg

SEQ ID NO: 4103171 - RNA, 64 nt, Human
ccuccuccagcucucccugggggugucucagaggagucuccugguucagagagcugagaggagg

SEQ ID NO: 4103172 - RNA, 129 nt, Human
ccuccuccuccuccuccuccuccuccucuucgcuccaagggcgccuccguucccccagcccuuguggguggacggugcuuuuguuucucccgagcuguaaggaguaggggguggaugcuaguguggagg

SEQ ID NO: 4103173 - RNA, 83 nt, Human
ccuccucgggcagcagcaggcgcucggccgucuggaucucccuggaggugauggucgagcgcuuguuguaaugcgccaggcgg

SEQ ID NO: 4103174 - RNA, 130 nt, Human
ccuccucuccuucccaggggccagaccugcaucucgaucugaaggcuuuucuugccuccuccugcacccuaccccaagaaaucucuagcacaucgaaucccauguuagugucugcuucucaggacauuug

SEQ ID NO: 4103175 - RNA, 62 nt, Human
ccuccugaauccaggagaguaggguagccuaacccaaaucucaugaauucagaaaccagagg

SEQ ID NO: 4103176 - RNA, 105 nt, Human
ccuccugagaacuguuguuccaaagucugguuccaggacggguuuguggaaugagugccaauccagcccugugucugggagagaggccagggagcugcugggagg

SEQ ID NO: 4103177 - RNA, 56 nt, Human
ccuccugccuguuuaccuguacuuagucacagugcuguccaggacccagcaggagg

SEQ ID NO: 4103178 - RNA, 61 nt, Human
ccuccuggaaaaauucccuggccucagaaaguguaacaauggccuggcggauuucuggagg

SEQ ID NO: 4103179 - RNA, 63 nt, Human
ccuccuggcaguuccccuugucacuggcgccacccuaugagaaggugacugccuggcauuagg

SEQ ID NO: 4103180 - RNA, 61 nt, Human
ccuccuggggugaaggaugggaaggcuggagaccuuaaaggccagcccgacccccgggagg

SEQ ID NO: 4103181 - RNA, 73 nt, Human
ccuccuggugcugugggucagaauuacaguacaaccugucucagcugugucuucugcuuacagucucauaagg

SEQ ID NO: 4103182 - RNA, 59 nt, Human
ccuccuucuggggccuucugcucagaaccuggacaagagcugugggcucagaggggagg

SEQ ID NO: 4103183 - RNA, 60 nt, Human
ccuccuuugcauucuuuagaggucacauuggcugcuguagggagaaagaguugaaggagg

SEQ ID NO: 4103184 - RNA, 63 nt, Human
ccuccuuuucucagugcaguuucuacgucugcuucagaugcugccugcaaugagagaaaaagg

SEQ ID NO: 4103185 - RNA, 57 nt, Human
ccucggcaccccagcugcccugggccagugccacagagcaggaauaggguguugagg

SEQ ID NO: 4103186 - RNA, 81 nt, Human
ccucggcagccuggcccagcaggaagacauugaagcucaccaggagguggcagggagugucccugggggaagcugcugagg

SEQ ID NO: 4103187 - RNA, 82 nt, Human
ccucggcgcuuuauggccaagcauauacagauugaguuuucagaacauaauuugugcuugggucuuucugcgaugaccgagg

SEQ ID NO: 4103188 - RNA, 130 nt, Human
ccucgugguucccuugccaggaacaauguauguguuuuguggagucugucuuacccaaggccagaugcccuuggcugaacuccaggaugcauccugauccuguuuacaggcgaggaaggaccaagucugg

SEQ ID NO: 4103189 - RNA, 63 nt, Human
ccucuaaauuguuugaaguuggucccagcagcauaaaauggguuggccccaaaggguuggagg

SEQ ID NO: 4103190 - RNA, 84 nt, Human
ccucuaaccaguuggccucaguuuggguuuccaccuauugauggaaugaccuggaauguaugggaacccaaauccaaccagggg

SEQ ID NO: 4103191 - RNA, 67 nt, Human
ccucuacccuggucaugacaggcagcaaucacagaccacagacucucccugcugagccagugugagg

SEQ ID NO: 4103192 - RNA, 67 nt, Human
ccucuacucaggccuccuucuguccuuugugcuacaacaaugggcggaaacacagccuuguuagagg

SEQ ID NO: 4103193 - RNA, 72 nt, Human
ccucucaauggacacagggucaccugggggcugugggggaagccagccagaguggcugugugugaggagagg

SEQ ID NO: 4103194 - RNA, 81 nt, Human
ccucucacagagggaucugccaggacuugggugcacaggguguagggccuagguaccagcagagagccaggcucugagagg

SEQ ID NO: 4103195 - RNA, 62 nt, Human
ccucucagaaguuuaugucagaaguuggaaacucccaguucuaacauucuacuuuugacugg

SEQ ID NO: 4103196 - RNA, 62 nt, Human
ccucucagguccuuacugugcucccuccgcagaugagaaggagacgccagggccuggggagg

SEQ ID NO: 4103197 - RNA, 62 nt, Human
ccucucccugaccuggauuccaggccucucggaaaagggggccaggagggggcagggagagg

SEQ ID NO: 4103198 - RNA, 71 nt, Human
ccucuccugccugucccucaguccacaccgcagggccuuccagagccuguggcugaaggagggaggagagg

SEQ ID NO: 4103199 - RNA, 57 nt, Human
ccucucggcagcccaucuugucaggaaagaucagaucuaggacaggcagccgagggg

SEQ ID NO: 4103200 - RNA, 57 nt, Human
ccucucuagcucucucugcuucagaauucccagggaagcaacucugacuagaugagg

SEQ ID NO: 4103201 - RNA, 56 nt, Human
ccucucucuuuagaagcgucuggcuuuuggaacccagaaccaucaagggagacagg

SEQ ID NO: 4103202 - RNA, 70 nt, Human
ccucucugauucaugaaaaggcaguuuuucuuucccuugggaugcuguauuuauaugaaggcaugggagg

SEQ ID NO: 4103203 - RNA, 66 nt, Human
ccucucugcacccugugguccucuagaguagcuagcucugaggccccaagguggguacaaagcagg

SEQ ID NO: 4103204 - RNA, 83 nt, Human
ccucucugucagccgugcuaguaggagaccuagcucuuuggaauacaagcucagggcugcuuaccuggaauggcuacuggagg

SEQ ID NO: 4103205 - RNA, 69 nt, Human
ccucugagaggcugcccugccaucaagcucuugaaaaguuggcacagggagccccauuuuucucaaagg

SEQ ID NO: 4103206 - RNA, 72 nt, Human
ccucugaggugaacuuguguacuuuuuauugauugauuuuguuuucaagauaguuacaaguuuauucagagg

SEQ ID NO: 4103207 - RNA, 59 nt, Human
ccucugaguccucccugguugcucuuucuucucuggagugaccuggaaggacugggagg

SEQ ID NO: 4103208 - RNA, 58 nt, Human
ccucugcagaagaauuaaggacaggcucagugaggcugcccagcauccucugcagagg

SEQ ID NO: 4103209 - RNA, 78 nt, Human
ccucugcagaggagcugaaacuucucauauggaaccaguggguuuccuccccgaccuucaccuacccgucugcagagg

SEQ ID NO: 4103210 - RNA, 55 nt, Human
ccucugcaugugcaguaccgaguaccuauuacacauucaggacuguacugcaagg

SEQ ID NO: 4103211 - RNA, 75 nt, Human
ccucugcucagcaucccucugagauaggcagaaauuacuccauuuuacagaugaggauacugagguucaguaagg

SEQ ID NO: 4103212 - RNA, 60 nt, Human
ccucugcucuggcaaaguggacauucaggcccucuucuuccaugugccaaggggcagagg

SEQ ID NO: 4103213 - RNA, 76 nt, Human
ccucugcuggcucccugacagcauuuuguagcuguuuguaagugacaacuaaaggcuguugcagggaaacagaagg

SEQ ID NO: 4103214 - RNA, 130 nt, Human
ccucuggaucacuaguucaaaugcaaaaggccauaaaaagcuguuaucuucuggcggacucagugaaaguuuccaggcgauaucagcugccacaaauggcgcucgcgugacaaaugcucggugcacaggg

SEQ ID NO: 4103215 - RNA, 81 nt, Human
ccucugggaugucuugggagggaaggagcugaggaaggagcacagauuucuguccagcugacauucccuuccccacagggg

SEQ ID NO: 4103216 - RNA, 60 nt, Human
cgagggcugucagugacucacugcgugggccacccagggcauguggugcugaggcugucg

SEQ ID NO: 4103217 - RNA, 115 nt, Human
cgaggucagugaagauuuaaacaggggauacagugccucuuaagugucacccaguauagcugagugacacuucagaggcaaagucuaccuugucuuaauugcagucacaacccug

SEQ ID NO: 4103218 - RNA, 64 nt, Human
cgaguauguguaggaggaggacagggugggaccauagacuuugccaaaagcugcagguggaucg

SEQ ID NO: 4103219 - RNA, 62 nt, Human
cgaugaauucugaacccuguagauguuuuguucuacugggaggcacuauucaggaggcauug

SEQ ID NO: 4103220 - RNA, 68 nt, Human
cgaugccagcuagucacauauuagagauucuauauacaacauaucuguaaaagugagaaguuggaccg

SEQ ID NO: 4103221 - RNA, 71 nt, Human
cgauggauuugggcugcagcaauuauuaguguggcauuggccuauugguaguuuuguauuucucuccuuug

SEQ ID NO: 4103222 - RNA, 64 nt, Human
cgaugugaugugcaggcccacuucuuaccccagauagccucgggugcugccuguagucaugcug

SEQ ID NO: 4103223 - RNA, 96 nt, Human
cgauuuaagggauaauugcauggaguuucuuaguccuagagugauuuuuauauuccagagguagcuuguuuugauuaagccaugcuuuuuaaauug

SEQ ID NO: 4103224 - RNA, 69 nt, Human
cgcaagccagggaagaggccuaccucugucucagacuuggcggccaaggaaggcuuccuggaagaggug

SEQ ID NO: 4103225 - RNA, 130 nt, Human
cgcacauuuggggugagugcucagcccaggagcgcacauuuggggugagugcucagccccggagcgcacauuuggggugagugcucagccccggagcgcacauuuggggugagugcucagccccggagcg

SEQ ID NO: 4103226 - RNA, 60 nt, Human
cgcaccuucuuagugcucagggaguggacauccuagacugggagcaugagagaggcugug

SEQ ID NO: 4103227 - RNA, 129 nt, Human
cgcacguaggaccagcggccgugcaccagcaggaggcgcugcaggaagcagaacuggccgagcacgaagucgcuguucugaacugccugcaugcccuccuggcccgccagccccacgcccacguccgcg

SEQ ID NO: 4103228 - RNA, 61 nt, Human
cgcacuuggcuccugacaaugugacaccauguggcgauacaggcaggcauggccaaaugug

SEQ ID NO: 4103229 - RNA, 60 nt, Human
cgcaggcuggcgcggaguggcaggaaucccccgcgcaggggcgcucugccccggccugug

SEQ ID NO: 4103230 - RNA, 79 nt, Human
cgcaggcuucccuggggcccaucgagggcugaggauggccguccagcccacuccccagggccccccucggacagcugcg

SEQ ID NO: 4103231 - RNA, 58 nt, Human
cgcagucaaauuugaaaacuuugaggaugcagcacuggaagaaaaugguuuggcugug

SEQ ID NO: 4103232 - RNA, 61 nt, Human
cgcaguguauuucaauggcugaagugguuaccgcuuccagccaugcaugacaaucacugug

SEQ ID NO: 4103233 - RNA, 109 nt, Human
cgcaguugaaaagguuuguugcauucguuguugaaagguuaaaaguaguauugcuagguaaagcuaugcuuaauuuaucauguacucaaggggcucuuuuaggcugacg

SEQ ID NO: 4103234 - RNA, 64 nt, Human
cgcauggcugaggcagaggacugaaaacucagagcugagaacucugcucccuguucagccggug

SEQ ID NO: 4103235 - RNA, 77 nt, Human
cgcauugugaaguagccaaaacauuuuagguugugcuuuucacgucaauuuauuuggcaaugcuucaccauaaugug

SEQ ID NO: 4103236 - RNA, 118 nt, Human
cgccacuacccagccccugaaggcccagccccagccccaccagggccccugccaccagcccccaacaguggcacugggcccagugguguggcugggggucggagguuggggaagugcg

SEQ ID NO: 4103237 - RNA, 68 nt, Human
cgccacugcccaccccgacgucuacccuggcggagaagcuccugggcgacggggcgggcgggcaggug

SEQ ID NO: 4103238 - RNA, 79 nt, Human
cgccauuugaaauucauucuauaugcagagcuguuccauguugaaaaugauuucugugcaguaaauggugaugauggug

SEQ ID NO: 4103239 - RNA, 59 nt, Human
cgcccagacuccucggaccaaucagcggagcucccucuccgcagcgugugaggagggcg

SEQ ID NO: 4103240 - RNA, 68 nt, Human
cgcccgggcagccccgcacuggagcuggaacgaguccuggcagccggcuccgcgggagcucccgggcg

SEQ ID NO: 4103241 - RNA, 93 nt, Human
cgcccgggcuccagcuuuggcucuggcugggcuccagcuccuucagcugcaccagcuccaccagggccuugguugugaagauggagacccgcg

SEQ ID NO: 4103242 - RNA, 70 nt, Human
cgcccggguccgagccucuggaccccucgggcucccggcugggugucacggggcucgugugacggcggcg

SEQ ID NO: 4103243 - RNA, 73 nt, Human
cgccgagacagaauauugguuacuguugcugcaaccaugacagcaauaauuucuucaagcguucugcuaggug

SEQ ID NO: 4103244 - RNA, 118 nt, Human
cgccgaggugcuugugggacaggcccggggggccuuggaggagaaggacuuucagaaagcagaagggcugcugcuccgggcccagagaccaggccuggcccucaauuauuauaaggug

SEQ ID NO: 4103245 - RNA, 75 nt, Human
cgccucccuugguuucacacugcaugguguaguccaaggacugcacuggcauuucaguuugaacacuaagcggug

SEQ ID NO: 4103246 - RNA, 64 nt, Human
cgccuggccaccugggccugggucuugagggcaggccccagcuucaaccccgugguggucagcg

SEQ ID NO: 4103247 - RNA, 74 nt, Human
cgccuucugugugcccacguuuauuaaauuaccacagaugucgugugaacagaugggcgcaccccugagaggcg

SEQ ID NO: 4103248 - RNA, 55 nt, Human
cgccuuucuguguugcccuauuugguuucgcuaguucugccacagggagaaggug

SEQ ID NO: 4103249 - RNA, 72 nt, Human
cgcgaccccgcaacgccggcaccgaaagggccuuagaaacccucugguccaaggcucgguggcggggaagug

SEQ ID NO: 4103250 - RNA, 69 nt, Human
cgcgcucuuugauggcuucacuguccuggacacccccucagaucugugcugucucagagaaagcaagcg

SEQ ID NO: 4103251 - RNA, 66 nt, Human
cgcggcaucccaugguggucucugcccuccagaggcugccagucuaaugggaaacagcuugcugcg

SEQ ID NO: 4103252 - RNA, 74 nt, Human
cgcggcgcucgcgucacgugccccucggucgaccaaugauccccggcgggcgcggugacgucagaguagcggcg

SEQ ID NO: 4103253 - RNA, 77 nt, Human
cgcggcugcggcggcuucgcgcccgccccgggcagaacagguuccuuccaguuugggugugagcugcgcgcgcggcg

SEQ ID NO: 4103254 - RNA, 63 nt, Human
cgcgggaggccggagcgugaggacugagggccgcguggccauccuccuucuccggccaccccg

SEQ ID NO: 4103255 - RNA, 84 nt, Human
cgcguggaggucuuucucgcaagccuggccagcggcuuggguuugcugcacgcacagccccagcgcggcgggguccuccgggcg

SEQ ID NO: 4103256 - RNA, 67 nt, Human
cgcgugggugccucacccccuggcagcgccuccagggacgcugcuccgggaaagagcagccgccgcg

SEQ ID NO: 4103257 - RNA, 64 nt, Human
cgcgugucuggccugggccugccggugcaacagcaguugucgccaccgguccuaggccgcgccg

SEQ ID NO: 4103258 - RNA, 111 nt, Human
cgcuaagcaggucauaaaguaagaaguggcagagucaggguuuggaaaccagacaguuucacuccagaguuccuacucugaaccacuaagcuauccugccugaacauggug

SEQ ID NO: 4103259 - RNA, 86 nt, Human
cgcuauguuacuuccaauggaagcuuugcaaaggaauccgguugccuaaaaacguauucuuuuaagccccagggauuugcauggug

SEQ ID NO: 4103260 - RNA, 63 nt, Human
cgcucagccucucauguucucccccagcuaaaguaagcagcuggcccaggugagagguuggug

SEQ ID NO: 4103261 - RNA, 130 nt, Human
cgcuccacagggcauggaugggcaccugggggagaggccacggaguagcugaggccugggaagcccagaagccugggaugucuggcucaucucuccagguaaacccccaggcccagcccaggagccccag

SEQ ID NO: 4103262 - RNA, 125 nt, Human
cgcucgcuuauuuuuuguucuagucucucuugcuucaguuuuuauacggcuucuaaaacgcuucgcauuuacaauagugacugaggugcccagaggugacuuuaauuuuccauugagcugagacg

SEQ ID NO: 4103263 - RNA, 69 nt, Human
cgcucugauuucuucauucauuagauggauaucauauuggccucuacgaggauuugagaggugggagcg

SEQ ID NO: 4103264 - RNA, 69 nt, Human
cgcugcccaggauggcuggaggugcucuguccccuagagcacagcaucucccucuguccuggggcagug

SEQ ID NO: 4103265 - RNA, 70 nt, Human
cgcuggaauccacggcaacacugggcccagcuuuccucggugugcgggugcuguggaaggagcuccggug

SEQ ID NO: 4103266 - RNA, 61 nt, Human
cgcuggcagggcugaucugaagacuggcagcaacuccuuuuuauacuccacucugcaagcg

SEQ ID NO: 4103267 - RNA, 124 nt, Human
cgcuggccuuucugucucugaagcaguugcuuagcaaugugacaagaugccagacaguuggagacccaaguaaguguucacaugcuggggggaagcagagggauggcugaauauggggcuagug

SEQ ID NO: 4103268 - RNA, 98 nt, Human
cgcuggcucggagcuccuucaccaccaccugggcggggguguagucggagaaaaucucucccaggaucaccuggucaaggggcacccaggagucagcg

SEQ ID NO: 4103269 - RNA, 56 nt, Human
cgcuggggccugaacagucagcugaaucagccuccugcauuuugugccccacagug

SEQ ID NO: 4103270 - RNA, 59 nt, Human
cgcugggggaacagcgaggguguggagcaggagacacaggcccucugccucccucagcg

SEQ ID NO: 4103271 - RNA, 116 nt, Human
cgcuggugcugagcagaagcgggcagaaguggggucugcuuucaggacuucauuucccccacucguuccggccccgcaugcuccacgucugcccuuuggucugaguuaaaacugcg

SEQ ID NO: 4103272 - RNA, 63 nt, Human
cgcugugcccaucccagugggugcugaggaagcugaacggcagugcugacucugggcacagug

SEQ ID NO: 4103273 - RNA, 82 nt, Human
cgcugugucuucuguaagaugagguccccuccauuacccugggccagggaucucaaaacggaaggccgccaaccagucagcg

SEQ ID NO: 4103274 - RNA, 87 nt, Human
cgcuuaucagcagaucucaggagaguguucaguggaggcccugccggucugcacagcucaccucccugggaacugcucgccugagcg

SEQ ID NO: 4103275 - RNA, 61 nt, Human
cggaaauguugggacaaacacagucugaucucccaagaaagauuuugucucaauacuucug

SEQ ID NO: 4103276 - RNA, 69 nt, Human
cggaccuuaggauuuaggcuuuaacaucuccacaucaugagauucgaaaccuuuaggucuuuucuuccg

SEQ ID NO: 4103277 - RNA, 130 nt, Human
cggagagagugacagaacccaggacgagaucgggagacucaaggaaugacauagaaaggggagaggcauggggcguccucaagucauuccggagaccucugcccaucuuccaccaugagaacacccagag

SEQ ID NO: 4103278 - RNA, 55 nt, Human
cggagauauuuaagguucucuccauguaaggacauuagaaucuaaauuauuucug

SEQ ID NO: 4103279 - RNA, 80 nt, Human
cggagcagaaaugagagaaguccaaggugaaagagaacacauagauuauuacguggcuucuaaaguuucuuuuaguucug

SEQ ID NO: 4103280 - RNA, 69 nt, Human
cggagcuuccuggucagguacuuuuguaagcugcaguacuuacaaguaguaaauuauuaggugguacug

SEQ ID NO: 4103281 - RNA, 72 nt, Human
cggaggcgggaccaggggcggggcgaggcccucagccggcucccagggcacucacccucccuccccgccccg

SEQ ID NO: 4103282 - RNA, 76 nt, Human
cggagggaaggcggggcaagcacagcgagcgugcgcaauagcgcaguagcggcgcaugcccauuuggcuucccccg

SEQ ID NO: 4103283 - RNA, 65 nt, Human
ccucugggccaugcuacugcucuugaauauacuggaacgagacacuaaaagcugcccagaaaagg

SEQ ID NO: 4103284 - RNA, 79 nt, Human
ccucuggguagcaauaacagaaaacuuuccuuuuccuaagaucugggaaugugauuguuguuuuaauucugcucagggg

SEQ ID NO: 4103285 - RNA, 77 nt, Human
ccucugguaaauuuccccuuaucauacccaagauugugguuaacacaguguauguccugaggggagaagaccacagg

SEQ ID NO: 4103286 - RNA, 62 nt, Human
ccucugucuccugccagugccucugauaggccaaacccaauuagaaggcaggagacaaaagg

SEQ ID NO: 4103287 - RNA, 88 nt, Human
ccucugucugcuaucaggcagggugagcagcugucuguauggaugugcuuaucuugggcagcuugcucgcccccugugcacacccagg

SEQ ID NO: 4103288 - RNA, 80 nt, Human
ccucugugcagacauggggaagccccaggcccaaaugcuugcugaagggccuugcaggcauuccaugaaguugcacaagg

SEQ ID NO: 4103289 - RNA, 55 nt, Human
ccucugugggaccucagaggguccccuuccuuggaagcagacagguccagagagg

SEQ ID NO: 4103290 - RNA, 62 nt, Human
ccucugugucuugguuucaagauuuauuuaaaaaucauagaaugguaauuaggacacagggg

SEQ ID NO: 4103291 - RNA, 70 nt, Human
ccucugugugaaccuucggcucaguuagaagcuuccuccuugggaaggguuuggaaagccgagauagagg

SEQ ID NO: 4103292 - RNA, 88 nt, Human
ccucuguugauggugaaucauuuuacugggcaguuugggcuagguuaugccaugguagcaacaucucaguggcuuucaacaacagagg

SEQ ID NO: 4103293 - RNA, 87 nt, Human
ccucuuaaguggcucuggugguuauauuauugugcggugcuaugagucacugucuauuaauauaacuuacccagggcuuguaacagg

SEQ ID NO: 4103294 - RNA, 65 nt, Human
ccucuuacuaggcacugggcuaggacagguagaaugacaauaagacauguccccuaugcuuaagg

SEQ ID NO: 4103295 - RNA, 64 nt, Human
ccucuuacucgcccucauguaccaggaccuacugaucaggccccaugcugggcgcagugaaugg

SEQ ID NO: 4103296 - RNA, 62 nt, Human
ccucuucagacccuuagcugugauuaauguaaaaaggcacuugucaaaaggguuugaaaugg

SEQ ID NO: 4103297 - RNA, 62 nt, Human
ccucuucuuuguugagacagauauuuuacagagaguggaguaaaauuucugcugaggagagg

SEQ ID NO: 4103298 - RNA, 90 nt, Human
ccucuugcacacugaagcaugguuucugacgucaugcugacugcuucaauuugccaacauaacucugaggcugugcucucaggcaagggg

SEQ ID NO: 4103299 - RNA, 62 nt, Human
cggcagcuuguccuucaggagagcuuuauuaaacaaggcacucugagaaguacaagcucccg

SEQ ID NO: 4103300 - RNA, 87 nt, Human
cggcagggacuguggauuugggcagcaggagccugggucugaagcagaggcuuuccuuggugcgccugcugcagcucccgcuugccg

SEQ ID NO: 4103301 - RNA, 70 nt, Human
cggcaugcacggcccggccggguacccggcgcacggccccggaggccuggugugcgccgcgcagcugccg

SEQ ID NO: 4103302 - RNA, 74 nt, Human
cggccaaaagaagaggugaauagaagucaaucacuuuaguaggaagaucaaguuuaucucagaccuauugguug

SEQ ID NO: 4103303 - RNA, 80 nt, Human
cggcccagccguggauuggccuguggucugcguguugccagcagugcagaagcagagccgguggccucgguuuggaaccg

SEQ ID NO: 4103304 - RNA, 92 nt, Human
cggccccugaggggcgcuacuuugcggcgcggaggagcaucguggcggcgaugcgucccccguuggucguugagccugccucugauuggcug

SEQ ID NO: 4103305 - RNA, 64 nt, Human
cucauuccugccaaagcauguacugggcaccuacuguguaccagccucuguuggggguggugag

SEQ ID NO: 4103306 - RNA, 86 nt, Human
cucauuguuucaucucccuuggucacagauuccucgucuguagaagaugaugguuccuccuucaugggaugagaaaugcaacugag

SEQ ID NO: 4103307 - RNA, 56 nt, Human
cucauuguuucuggagggaucuguguuuuaggcaacagcguuaaggaaaggaugag

SEQ ID NO: 4103308 - RNA, 111 nt, Human
cucauuuagcaaagaauaguucuauaugcaaucuuccugcuaggccuguggccugguucaugguggaaugacaugcauuuggcaauuuuuuuugacuaugcuuuuagugag

SEQ ID NO: 4103309 - RNA, 127 nt, Human
cucauuugcugaggugaugggaguucaccaaugcaucccuucacagaugcgauguuuauauugaguacacauuuaucuucucugugcaggagaugcaaagucaaaucccuucaguuggccagauggg

SEQ ID NO: 4103310 - RNA, 77 nt, Human
cucauuugugcccuuauuagaugucaucaagagucuugugugccuccugcugccacauuuaaagaggggagagagag

SEQ ID NO: 4103311 - RNA, 85 nt, Human
cucauuuucagugccuguagaaugaaggacaacaggggagcaggccacaaaccugaacucccucugcuccuucccugaaagugag

SEQ ID NO: 4103312 - RNA, 69 nt, Human
cucauuuugcagccacaucugaccugacaugaacacauuaggugguagagccuggcuugcauugauggg

SEQ ID NO: 4103313 - RNA, 70 nt, Human
cuccaacagaaauguuuguuaauauugugagcuacaggcaaacaaugaagggagacacuugcuguuuggg

SEQ ID NO: 4103314 - RNA, 63 nt, Human
cuccaacgaggcugggguacaacuagaggcgguugucuccauugacccgaguccuucuugggg

SEQ ID NO: 4103315 - RNA, 62 nt, Human
cuccaagauggcaggaaucauaagcuggagacaucuaguuauuguugcugcuguugaugaag

SEQ ID NO: 4103316 - RNA, 91 nt, Human
cuccaaggguaaagguaaaucuguacauuuguguugugaauuuccuggagguucaaauugagaugguauaaauaccacauaacccaugggg

SEQ ID NO: 4103317 - RNA, 61 nt, Human
cuccaaguauguuaaaaucuaaccaucaaugugaugguauuaauaggugaauacuuuggag

SEQ ID NO: 4103318 - RNA, 57 nt, Human
cuccaagugguggaggccccagauggucugggucaggugcuuccagcacugcaggag

SEQ ID NO: 4103319 - RNA, 92 nt, Human
cuccaauauucagguagacauacagugcaguacauaugucagcaggccguguggcuguuucauguguuuuucagugauugaagaaguuggag

SEQ ID NO: 4103320 - RNA, 81 nt, Human
cuccacaacauucacugucuguacccaagacugucaugccuaccaacucuaaguuuuauaugacagcagggauuuuuggag

SEQ ID NO: 4103321 - RNA, 66 nt, Human
cuccacagggauucacccaaaagguugcccaggcauucuuuucuuccacuguguccucuguaggag

SEQ ID NO: 4103322 - RNA, 66 nt, Human
cuccaccugccagggaggcccccuuugcaugugcuccaagcagcugcuccuuuccugcaggcggag

SEQ ID NO: 4103323 - RNA, 60 nt, Human
cuccacuccagccauuuguccccagcccucccugugggccuugugugacuggaggaggag

SEQ ID NO: 4103324 - RNA, 123 nt, Human
cuccagaagugguugccugcaccuaacuggggucuguggaccuggccagauaauuccuaaacaugggccaggcuccgcauagaccccacuuucaguuuuucaucaucagagaccugucuggag

SEQ ID NO: 4103325 - RNA, 130 nt, Human
cuccagauggucccucccuggcccucuggugccggcugcugaguuggccaggagaccacuacgugcuucucccaaccagggccugcaccuguuuauuccacccaaguuggccaguuggggugccaggcug

SEQ ID NO: 4103326 - RNA, 71 nt, Human
cuccagcagagagucagcacauagacuggccaagcugcccccagaucuuuggugauaucucuuugguggag

SEQ ID NO: 4103327 - RNA, 69 nt, Human
cuccagcagcuuugccaagucagccuccgggccaucuggcuguccuuggccaaggcacuguuaacggag

SEQ ID NO: 4103328 - RNA, 85 nt, Human
cuccagcuccuuaauccggaucuccagcucgcagagcuccuccgggugggaggcagaggcgagccugggggucgaggggcagggg

SEQ ID NO: 4103329 - RNA, 60 nt, Human
cuccaggagcugugucuuucuuucaggauaacauagaaguuaagagcacagaaucuggag

SEQ ID NO: 4103330 - RNA, 89 nt, Human
cuccaggauaaagugccacagcuggaucugccucgagccaggggaugacucuggcuuguaggcccaauccgggaaggcaaacccugggg

SEQ ID NO: 4103331 - RNA, 86 nt, Human
cuccaggcauuuuuuacagauauuguacaguuauagaugcaaauacaaauguaauuauagacuucagugucuguugaugucuguag

SEQ ID NO: 4103332 - RNA, 80 nt, Human
cuccaggccaagauuaaguaauuuuuugugaagcaccaagagccacagcuggauaucauauuacuuaaucucuccuggag

SEQ ID NO: 4103333 - RNA, 77 nt, Human
cuccagggccgggaucugcaucuaaacccucuccaagagaaaggcacggguguuuaaugcagauguggguguuggag

SEQ ID NO: 4103334 - RNA, 129 nt, Human
cuccaggggaggguucuccaggggaggguucuccaggggaauguucuccaggggaggguucuccaggggaggguucuccaggggaggguucuccaggggaauguucuccaggggaggguucuccagggg

SEQ ID NO: 4103335 - RNA, 89 nt, Human
cuccagggugugaguccagcgggagaguguugaugagaauuauuuuaugagauauuuauacugcugaguuuaauaaaaucaaauuugag

SEQ ID NO: 4103336 - RNA, 62 nt, Human
cuccaggguuccccgauccacuuacugaucucaguccuggguuuacaggggauacucugcag

SEQ ID NO: 4103337 - RNA, 55 nt, Human
cuccagucuuguuuccuaccuaaugaguuagucagaauaggaacauugauuggag

SEQ ID NO: 4103338 - RNA, 56 nt, Human
cuccaugcuggccccugaaacuuucuuuguugagggacaggggaagaagcaaggag

SEQ ID NO: 4103339 - RNA, 91 nt, Human
cuccaugucaccaguucugguuaagacagacgggcuugucuucugccuccgagacuccuggaucuuagccagauucuggagugaguugggg

SEQ ID NO: 4103340 - RNA, 71 nt, Human
cucccaaagucaggcccaguguuugacaccugcaauauggcagaguggggacagggccuguccucagggag

SEQ ID NO: 4103341 - RNA, 73 nt, Human
cucccaaagugcugggauuacaggugugagccagcaagacugucuuguuucuuuaucauagcaucuuugugag

SEQ ID NO: 4103342 - RNA, 98 nt, Human
cucccaagccacaucgaugcuagggcagucugcucagcccugaguccuccggggagcaggggggcagagcugagcggcugcccggagcuuggcgggag

SEQ ID NO: 4103343 - RNA, 58 nt, Human
cucccaaguccuugaagaaacaguucugugugguagauuugcuucucaaagggcagag

SEQ ID NO: 4103344 - RNA, 58 nt, Human
cucccacacagcccgcucaccggaccccaccccguccgggccagauggcucuggggag

SEQ ID NO: 4103345 - RNA, 96 nt, Human
cucccacaccaguguggcagggucucuacgcacuagaggggcccccgagggaccucuccuggccacguuggagccaguucgucccgcugguuggag

SEQ ID NO: 4103346 - RNA, 98 nt, Human
cucccacauacgcuggugaaagggugguuuuauccucaggcaaagcuuccuggauucagugaaaaccccuuucgaacaucagauggcaugucacagag

SEQ ID NO: 4103347 - RNA, 129 nt, Human
cucccaccucccggccucagccgcccagccccccgguucuucugcccuaucucugagccaacuuucuacuguuugggagucaccugggaggacuggggaggcugugguggaggagaugggcaggaggag

SEQ ID NO: 4103348 - RNA, 62 nt, Human
cucccaccucuuugcuccaauaguaauuuguagccccucuauuagagcaguaauuguggcag

SEQ ID NO: 4103349 - RNA, 92 nt, Human
cucccaccugccacaaugcagcccacaccacucugcucauggacuaagagaccguugacaaguagggugggauuuguuuugugcggggggag

SEQ ID NO: 4103350 - RNA, 56 nt, Human
cucccaggugucccuucugccaccccagggcuuggcgacaucagggauccugagag

SEQ ID NO: 4103351 - RNA, 67 nt, Human
cucccagguugauucuuucccugacacaaaacagacacuaugggcaaagacaccugcagccuuggag

SEQ ID NO: 4103352 - RNA, 72 nt, Human
cucccaguuuguugcuccucugacuguggcuguggcuguggcugcggguggcaugggcaagaggacuggggg

SEQ ID NO: 4103353 - RNA, 75 nt, Human
cuccccacacaguccuggcucugucucggggucucugcagcucuguggggacccagaggggagucuggcagggag

SEQ ID NO: 4103354 - RNA, 77 nt, Human
cuccccagcucagggacaguagcuauguggccacauuuuccucauggcaggcauuagagauucccagagggguggag

SEQ ID NO: 4103355 - RNA, 58 nt, Human
cuccccaggaguuuuacuuugcagggaugucucucuccuucaauaugacccuggggag

SEQ ID NO: 4103356 - RNA, 72 nt, Human
cuccccagucccucucugugccuuucacagugcaacuguagccuaaugaaucuacaggagugaguggguggg

SEQ ID NO: 4103357 - RNA, 84 nt, Human
cuccccaugcauuucuuugaguuaguacaguccagagugggauauggcauuuuccguggaauucugacucaggagaugggggag

SEQ ID NO: 4103358 - RNA, 79 nt, Human
cucccccucuuccuccugggcacacucaccacguggagggugcuggcccuugaugcuggaguggcuggaggagcaggag

SEQ ID NO: 4103359 - RNA, 61 nt, Human
cucccccuggcagcuguuuggcuuggcgggggcccaucuggcaggcucagcagccaaggag

SEQ ID NO: 4103360 - RNA, 91 nt, Human
cuccccugccaggccguguggggcucccuggcagccugucauuacugcauuauggcaggauccuagccacagccccagcuccgguagggag

SEQ ID NO: 4103361 - RNA, 56 nt, Human
cuccccuucuugccagauccuuuggauucuugggacagcugagcaagaauggggag

SEQ ID NO: 4103362 - RNA, 63 nt, Human
cucccgagcugagcccugaguccuggcccacgauauagucauagcucaggugacagucaggag

SEQ ID NO: 4103363 - RNA, 68 nt, Human
cucccuaaaacagagcuacugcggcugacccacagaacuucaagcaauauagagcuuguuuuaggaag

SEQ ID NO: 4103364 - RNA, 55 nt, Human
cucccucucaccggagcccuggcggggcaggccgggccgagacggugggagggag

SEQ ID NO: 4103365 - RNA, 77 nt, Human
cucccucuggccuagcucucugcuugaaagcaucaccacacguuuuccaaaccagugcagugacuggggcaugggag

SEQ ID NO: 4103366 - RNA, 126 nt, Human
cucccugaacccuauugaguuuucuccauauuugagcaaguuaguuauucuugugagcuguguuuuaaaguagcagcaccagaaacaugacucugaagagggauagaacccuaggauucaaaggag

SEQ ID NO: 4103367 - RNA, 71 nt, Human
cucccugcggucucccacgaugccuggacacaaaacaucuaccugcgggugcugaggaagacagcagggag

SEQ ID NO: 4103368 - RNA, 63 nt, Human
cucccuggaggugagcuggcaccuggagagcaaggucagagccagccucccuccagaugggag

SEQ ID NO: 4103369 - RNA, 80 nt, Human
cucccuggucuuggccucuguggcucagccuugcucuggucugccugagugcaggggccaaggggcacagggccagugag

SEQ ID NO: 4103370 - RNA, 66 nt, Human
cucccuggucuuucccaucauucucuuauugacggaggcaacugguggaguggagaggcaggggag

SEQ ID NO: 4103371 - RNA, 92 nt, Human
cggcucaggcagugacaucaauuccaaagacagaagcagcugcuggcuucuucagcuguuuguuugauguguuugggggacuuugccugcug

SEQ ID NO: 4103372 - RNA, 81 nt, Human
cggcuccccaggugagcucgucuccgcgggacuggguccgggaaggccccaggaccgcgcggcugagcggccuggaggcug

SEQ ID NO: 4103373 - RNA, 66 nt, Human
cggcucugaaaccuuugccgauggggucccucgggagggacugagucgccagcagguguugacccg

SEQ ID NO: 4103374 - RNA, 106 nt, Human
cggcugcgacagcucucguguccuuugcagggggagcuuggcuacuccugccuugggcuuaggcagagcgcaguucucucucagaaagucuagagccucgcagcug

SEQ ID NO: 4103375 - RNA, 74 nt, Human
cggcuuaguuccuggcacucugagguccaccuccuuccugaggcuggugguuaccgugcuaaugagcuaggccg

SEQ ID NO: 4103376 - RNA, 57 nt, Human
cggcuucuucaucaggucagcauggguauaauucugucuaccaguugacuggagcug

SEQ ID NO: 4103377 - RNA, 81 nt, Human
cggcuuuggcaugauuguuugccagccccuggaaagggauuaccgcucucagggagggcgagucagcguguacuggaguug

SEQ ID NO: 4103378 - RNA, 115 nt, Human
cgggaaaggaauucugaucuguugaaauuugucuccucuguguguccugcacuaaaugcccaaaccccagcaugggacuuaaugcagagagggacacaggcagaguccaggccug

SEQ ID NO: 4103379 - RNA, 57 nt, Human
cgggaagccaucagucaaaaagccuguguggucacagaugcuuacuggugguuccug

SEQ ID NO: 4103380 - RNA, 66 nt, Human
cgggacacuagagagcaggcauucccguggccgcgggagagccgcguuccuggcuggccauucccg

SEQ ID NO: 4103381 - RNA, 72 nt, Human
cgggaccccaggggcgcgcgccccccaggcccggagaacgggcccagggccugagggcgacgccccuucccg

SEQ ID NO: 4103382 - RNA, 80 nt, Human
cgggagagccaggccuucucccucccucaacuucauggugcaggcaagggacauggggagcacagggugggggucucccg

SEQ ID NO: 4103383 - RNA, 69 nt, Human
cgggagccucugggucacacuggcuacuguguacuugugccacccuguguguucccggaguagcucccg

SEQ ID NO: 4103384 - RNA, 82 nt, Human
cgggagggacuguuaaccugggucuggccacagcugugcggagcggcuggguucggcugcaggccacacacccugugaccug

SEQ ID NO: 4103385 - RNA, 125 nt, Human
cgggagggagcccagccauguggaagacccuacaggaaggagcacaucgggagucaggccauguccccgccaugucuucuuccuucccugugggcagcgcuguaccacaggcugaugcucucccg

SEQ ID NO: 4103386 - RNA, 61 nt, Human
cgggaggguguacguguguguucccggguuguuaccuugcacacccacuuaugcccgcuug

SEQ ID NO: 4103387 - RNA, 55 nt, Human
cgggagucaagaccuaggaucccugaggaaaccagggcaucaaagcugacuccug

SEQ ID NO: 4103388 - RNA, 84 nt, Human
cgggauugccgccagccuccaguagcugaagagacgggaaacagaucguccccugcaguuucuggagggaauguggcccugccg

SEQ ID NO: 4103389 - RNA, 60 nt, Human
cgggcaccagcggccgcacugcccuggccgacccacguccuggcacggccccugggcccg

SEQ ID NO: 4103390 - RNA, 62 nt, Human
cgggccugggcccugcuuugacaggagugcuggucaccaugugaagguggguccaagggcug

SEQ ID NO: 4103391 - RNA, 62 nt, Human
cgggcuuacggccgagcuuaggaaacccagcucagaugugaaacccuaggcuuggcagcucg

SEQ ID NO: 4103392 - RNA, 74 nt, Human
cggggcacgugucuggggugcuggacaucauaucugugcaagugcaccuccucccagcuccugauugugccucg

SEQ ID NO: 4103393 - RNA, 63 nt, Human
cggggcauggagccaggggucagcuccgaggcagguaugugcugugcucccucuggcgccccg

SEQ ID NO: 4103394 - RNA, 76 nt, Human
cggggcgugacugcagaguggagccucggcugggucccaagcacccccugccccgccaccgcgcaccugugccccg

SEQ ID NO: 4103395 - RNA, 84 nt, Human
cggggcuaguggggagcccuguucaggccuccucacuuuaugaaggaugagaaggcccagaauagaauggccugcagugccuug

SEQ ID NO: 4103396 - RNA, 57 nt, Human
cggggcuggcacaggugaccacugcccuggcaucacccagcuguguccggcagccug

SEQ ID NO: 4103397 - RNA, 56 nt, Human
cgggggcagcaacgugccugaugacucuauuguuucaggaggcggugcugccuuug

SEQ ID NO: 4103398 - RNA, 56 nt, Human
cgggggcgucuggugagaccaugcccucacaccugcauucucugacaccgcccccg

SEQ ID NO: 4103399 - RNA, 67 nt, Human
cggggggaauggugggaggcgaacacggagcagcccccaagugacagagcaccccaucuuccuccug

SEQ ID NO: 4103400 - RNA, 62 nt, Human
cggggggacaagagggacgagacuuuccagacccuacucuggugggcccugcuugcucacug

SEQ ID NO: 4103401 - RNA, 75 nt, Human
cgggggggcucggcccucacacgcccggggucccgggggucccaggugcugaaggaggccgcagggcccgccgcg

SEQ ID NO: 4103402 - RNA, 68 nt, Human
cgggguggggauggaacagcugucugugcccuucaccaggagcaugcauuuccauucucacaucccug

SEQ ID NO: 4103403 - RNA, 69 nt, Human
cggguacacuggggcucugggagugaucucggacaaaggaaugcaccucucugagccucaguguuccug

SEQ ID NO: 4103404 - RNA, 123 nt, Human
cggguggcugagccggcgggcggggcggggcgugcaccagggccgcgggcgacuagcgcuguagcaguuggccucagggccccgccgcccgcgcgcccgcccgcccgcagggcggcgcacgcg

SEQ ID NO: 4103405 - RNA, 67 nt, Human
cggguggguguuggguggcguugggggagcugcgccucgcccagagccucgcccggagccucgcccg

SEQ ID NO: 4103406 - RNA, 56 nt, Human
cggucgucuggucuucugcuggcaucuccacaaacaugcccaggggcccgaugcug

SEQ ID NO: 4103407 - RNA, 81 nt, Human
cggucguuauagaacauucuuggguagcucuguaaggucaguuggcagaguacgaugaacucguggaauucucugcgaucg

SEQ ID NO: 4103408 - RNA, 60 nt, Human
cggugacuaugacgaggggacagaggccgagggagaggcuucugccacgucuggugacug

SEQ ID NO: 4103409 - RNA, 56 nt, Human
cggugagcacauucggaguggcuccuuccccacccacugcugacugggccucaccg

SEQ ID NO: 4103410 - RNA, 100 nt, Human
cggugaguuuuauaccuaacacaacuuuagucuggagggaaauggucucacaugaacuuucuuuccugcugaggauacguuaauaucaagacuuucacug

SEQ ID NO: 4103411 - RNA, 59 nt, Human
cggugccagcuacagaggccacauggcuucuaaugaggccaggcccaguuguagcuccg

SEQ ID NO: 4103412 - RNA, 77 nt, Human
cgguggcuuccuccugcagagccacgugccagcgccuagggggcgcucucgaugugcucagcagccccggagccucg

SEQ ID NO: 4103413 - RNA, 55 nt, Human
cggugggauucccagcgacuuccuuaggaguccgcgcuccaugggaguccccccg

SEQ ID NO: 4103414 - RNA, 94 nt, Human
cgguguaggguuuuguguggacacaagcuccggggcugcagcugucuugcccgauggggccuguagcuucugcuuuccaugcaagcuuacaucg

SEQ ID NO: 4103415 - RNA, 61 nt, Human
cgguguggguccaaccugugugugugcgagaccucccacacgagcccuggagccagcagug

SEQ ID NO: 4103416 - RNA, 60 nt, Human
cgguguggugugugaggaagcugagccauucagagcguggccuuccuccacagagcgcug

SEQ ID NO: 4103417 - RNA, 105 nt, Human
cgguugaggagcgcugguucgcugcagggcuggguccugucucauucaguauuuggugucaagugagggagguaucagacucugaaggaauccuccuaguaauug

SEQ ID NO: 4103418 - RNA, 66 nt, Human
cgguuuucuaaucuuaacguuccguggcuuaacauucagcacugagaacugaggauuugaauucug

SEQ ID NO: 4103419 - RNA, 63 nt, Human
cguaaugaaucaacauuaaugaucuuuccaaaugggggucaucuaacaauuugauucuuuaug

SEQ ID NO: 4103420 - RNA, 70 nt, Human
cguagaagcagaccacagaagccuugauagggcuuaaauuguccuuguaaguaauuuguggacuauuacg

SEQ ID NO: 4103421 - RNA, 81 nt, Human
cguagcaagaggaaaaucaaugucuuuuuaaagggauaccguauauguuaaaaaguaaauugacguuuuuucauggcuuug

SEQ ID NO: 4103422 - RNA, 55 nt, Human
cguagcagugcaggcaaaccauggccaaccccagcauugucucaguucugcuaug

SEQ ID NO: 4103423 - RNA, 56 nt, Human
cguauccuuguuucagagucugcuuuggaggaagccaaucuacaacaaaggauaug

SEQ ID NO: 4103424 - RNA, 79 nt, Human
cguaucuaguugucaacacauauuuauauaugcacauuaguagguggcaccuccaagucugugugugaugggagauaug

SEQ ID NO: 4103425 - RNA, 66 nt, Human
cguauuguagcuacaauagacguauuguagcuagacguauucuagacguauuguagcuacaauacg

SEQ ID NO: 4103426 - RNA, 62 nt, Human
cguauuugccucguauguuagcugucaucaaaugaaggcaguaucuguagagugcuuauaug

SEQ ID NO: 4103427 - RNA, 67 nt, Human
cgucagagaaggcugagucacggcuccuaucagcugacugucggccaggcuccaggcccuccugaug

SEQ ID NO: 4103428 - RNA, 68 nt, Human
cgucaguuagacagacugccuguaccacgcacuggccccaccaguguagacagacugccugacccacg

SEQ ID NO: 4103429 - RNA, 62 nt, Human
cguccagggacagccuugggguggcguccaaagagacgcgucggagguugucccuugggacg

SEQ ID NO: 4103430 - RNA, 70 nt, Human
cgucccggcagcuggccccugggcacggcccccagcccggcgucccaguuccagccgcgcugcaggggcg

SEQ ID NO: 4103431 - RNA, 67 nt, Human
cguccucagggcuugcaggagaaaguuucugauuaaggaaauggauccguggaaguugcugaggaug

SEQ ID NO: 4103432 - RNA, 102 nt, Human
cguccuccccuccccuccaggcagaucuggaucgccggcgccugggcuuagggaacuggggcuuggagcccgcgguccacgggcgcaggggcggggcgggcg

SEQ ID NO: 4103433 - RNA, 129 nt, Human
cguccucuuggccuccuuccagcaagccccuguuucagguucucacacgucuacacccuggccauugcugcuccagggcugagaggugcugcagggaaggaaggagggaggagggaagggcaggaggag

SEQ ID NO: 4103434 - RNA, 62 nt, Human
cguccuuacagagggucacagccaauccguaguccguguccugugucuccucugagagggcg

SEQ ID NO: 4103435 - RNA, 56 nt, Human
cgucggccuucaucuccggcaagagcacucgccugucugggaguuuggugcugccg

SEQ ID NO: 4103436 - RNA, 101 nt, Human
cgucggggucgggaaggacccggggcggggcuucccucucugccucagcuuccccgagacugcagagaguugggcugcgccaggggcuccccaccugggug

SEQ ID NO: 4103437 - RNA, 89 nt, Human
cgucgucucugauccucauggcuucucugugugagggagacauuauuguccccauuuugcagaugaggaaacugaggcucagagaugug

SEQ ID NO: 4103438 - RNA, 117 nt, Human
cgucuaauucacucagaauuuuuuaaaaagaaugcuuccuuugaaacugaaguucuuucuacuugguuucagcccaaaggugagcauuuuuuugagaagguuaaaucuuuucagaug

SEQ ID NO: 4103439 - RNA, 83 nt, Human
cgucucuccucccuuagcucacaagcuaaagcaaagagaaagcagacuguugcucuuggugaaggggcugggggucagagacg

SEQ ID NO: 4103440 - RNA, 85 nt, Human
cgucucuuuacaugcuaacaggaugacagcagacauugugugaaaucagucagucugagcacacuguuuacaugcuaacaggaug

SEQ ID NO: 4103441 - RNA, 100 nt, Human
cgugaagcuguuuugaaaaaucagguuguggaagcagauggcaacaugccuucuagauuuuugugcaccuuugggaguguuuauuaagacagaguucacg

SEQ ID NO: 4103442 - RNA, 63 nt, Human
cgugaccucauuuggaaacaggaucuuugcacauguaauuagucaaguuaagauaaggucaug

SEQ ID NO: 4103443 - RNA, 62 nt, Human
cgugagcugcucauucccagcacauggccagcgaggucauagcgagugacgaggagcacacg

SEQ ID NO: 4103444 - RNA, 69 nt, Human
cgugagguguaugcucaguggacggacuggagugguuuuggaauggcccuggcugaguuagauuuggcg

SEQ ID NO: 4103445 - RNA, 62 nt, Human
cgugauacuuggcacugcaaccacagucuugugaaccugugggagcagcaccaaggaccacg

SEQ ID NO: 4103446 - RNA, 61 nt, Human
cgugccauuguugcuguugaacccugcugaggucccugucuugcuccaggaacacuggccg

SEQ ID NO: 4103447 - RNA, 64 nt, Human
cgugccccggugaggaguucagccggccccuagguuccuggaacccaaccucacuugggguaug

SEQ ID NO: 4103448 - RNA, 66 nt, Human
cgugcccugcgcaagugcugcuacggcuacugcauugaccugcuggagcggcuggcggaggacacg

SEQ ID NO: 4103449 - RNA, 85 nt, Human
cgugccgcguacucuucaaacugacagaacaaaagagccaaauuccaaaauucuggucugaaugacuuguuaguugugcuggaug

SEQ ID NO: 4103450 - RNA, 71 nt, Human
cgugccugcacugugcgggcugcugaguucagaagggcucaggcaggaagccccugcacaggguaggugug

SEQ ID NO: 4103451 - RNA, 74 nt, Human
cguggagggagcggaauuuaaacuuccgggucagccucagugcagcuugggaaacguaguuccuaguccccacg

SEQ ID NO: 4103452 - RNA, 73 nt, Human
cguggcaauggagcagucccacucagcaucaauaugcccgugcagcagggaccucuaugugaagacugccaug

SEQ ID NO: 4103453 - RNA, 63 nt, Human
cguggccuuugagugagcucccaucccuggcuccuaggacgggacagcuaacacagagcuccg

SEQ ID NO: 4103454 - RNA, 63 nt, Human
cguggcugcugccugcuacgagggaagacugcaggaggugagcccacagggaggcagugcccg

SEQ ID NO: 4103455 - RNA, 55 nt, Human
cgugggcugcgcccaguucuucaccaaggcugacuacccgcagugccaguccaug

SEQ ID NO: 4103456 - RNA, 62 nt, Human
cguggggcaggcggguguccagaucggcaaugccugcugggaacuguacugccuugaacaug

SEQ ID NO: 4103457 - RNA, 67 nt, Human
cguggucgcaaacugauuuccaaguccguugucugaugcugcgagacacuauccguuuguuacagcg

SEQ ID NO: 4103458 - RNA, 76 nt, Human
cguguacuguuaugaguccucauauacuauuucaucaguuaggaaguuguaaauaaagaaucauaacagugacaug

SEQ ID NO: 4103459 - RNA, 84 nt, Human
cguguggauuucagagccauccgcggcugccggcuguuggggcggccaggaguggccugccagcagauggcgcugcgccgcacg

SEQ ID NO: 4103460 - RNA, 70 nt, Human
cguguguggguguguguguguuacuuuuaucaagauaaacgaggaaaagcucagcaucacagauaacacg

SEQ ID NO: 4103461 - RNA, 85 nt, Human
cguuaaacauggauucugaucacagaucguuucugcuaauuaaacaaauauuuuugcagagcugucucgguuuccgcuguugccg

SEQ ID NO: 4103462 - RNA, 79 nt, Human
cguucccaucuuuccccccuaccuuccccuuaggcacgucugagaaugguggaugugguggagaaagaagaugugaaug

SEQ ID NO: 4103463 - RNA, 56 nt, Human
cguucugguugggacgggcaggaaguuacggauccaagcugguaucagcuagagcg

SEQ ID NO: 4103464 - RNA, 102 nt, Human
cguugaaggagagcgaguggcggauggaguucugccagcgcugcugguucugccgguagaaggggaagagguccaugauccacugguagaucucgcucagcg

SEQ ID NO: 4103465 - RNA, 67 nt, Human
cguugaccuggagacuguggccuuggagcugaacgagaugauucagggcauacucuucaaggucacg

SEQ ID NO: 4103466 - RNA, 70 nt, Human
cguugcccucuccaggcgcuuaccaagcgcucggaaacgccccagggcgcuugcgcgugggaggcgcgcg

SEQ ID NO: 4103467 - RNA, 76 nt, Human
cguugggaguuugcauagacaauauuaaucuucacaaaccuucuguaagguagauguugucaugcccauuuuaaug

SEQ ID NO: 4103468 - RNA, 71 nt, Human
cguuucuggguuucuuuagccagagcgggcaccugcauaacuccugcguggggagaguuacccuggaagcg

SEQ ID NO: 4103469 - RNA, 69 nt, Human
cguuuggugagagacuuuggagccagacugccugaauucaaguccuggcuccccuacuucuuauugacg

SEQ ID NO: 4103470 - RNA, 72 nt, Human
cguuuugucuuuuugucuggcagaggucacuuuugacagugccuuuguguuucagcagaaauggauaaucug

SEQ ID NO: 4103471 - RNA, 58 nt, Human
cguuuuugugaauaagagaaugacagccauagaaauaaggcugacaguuccgagagcg

SEQ ID NO: 4103472 - RNA, 130 nt, Human
cuaaaaguucaaggggaaaaggaaggcaaagaaggacguuuauaugauugagcaucuugguuugaaagaaauuauauguuuaauuauauuauucccuuguccuuccaugaacccuaugaaguauuaauag

SEQ ID NO: 4103473 - RNA, 108 nt, Human
cuaaacaauauuuagaugugugcugcugaaaaacaaagucugcuaugaaguuuacuggcacuggcugaguugcuucagcaacugcaggccuucugaaguuuuggcugg

SEQ ID NO: 4103474 - RNA, 55 nt, Human
cuaaacaccccuuugacauuacgugcgccagcuccugaacacugggguguuucag

SEQ ID NO: 4103475 - RNA, 117 nt, Human
cuaaaccuggaguaaacuacaaaugauuccccagcagugguucucaaacuuuaguguacgucagaaucaccuggagguuuguuaaaccagauugcugggcugcaccuccagaguuag

SEQ ID NO: 4103476 - RNA, 120 nt, Human
cuaaagaguaugcgucacucuguaaguagaggcacccacauacuauucauugauucaacaaauuaauucaacaaauauguauugagugccaacugugcuaggcuuugaagcaacauuuag

SEQ ID NO: 4103477 - RNA, 73 nt, Human
cuaaaucuaguugaaaacaauaggaaagaggauacuuuucccucuaguauuuguucuaucaaccuagacuuag

SEQ ID NO: 4103478 - RNA, 64 nt, Human
cuaaaucucaucucaaauuguaauccccaccugucaaaggagggaccugguaggaggugauugg

SEQ ID NO: 4103479 - RNA, 83 nt, Human
cuaaauuaugcuaaagauuucaacauuugaaaugaaugaauuacaauagugauauuacucauaauguguugauagcauauuag

SEQ ID NO: 4103480 - RNA, 64 nt, Human
cuaacauaaccugguggccaagccuccauaauacucuggggccaggcucuugguuauguuuuag

SEQ ID NO: 4103481 - RNA, 122 nt, Human
cuaacauaguugcaucuugguacucaaagacagauuugaucuagacaaugcacuguaaggaauuccauucauucuuuagcauagugcugaacauuuugucucaucuuauaaugcaguguuag

SEQ ID NO: 4103482 - RNA, 123 nt, Human
cuaacauuuuuuagguacucauguuuuuaguuauuaggaauuuccauuuaacauuucuaauauauuuuccuuagcaaaguuuuguggugauuagguauagcuaaaauaauacagaaguguuag

SEQ ID NO: 4103483 - RNA, 114 nt, Human
cuaaccccaccauuaauaguauaaucacugggcguuugguacuagggcuaggcaaacauuuccuaguggcauauuauuucuagugguacauuauuucaugggagugaggguuag

SEQ ID NO: 4103484 - RNA, 63 nt, Human
cuaaccugcuaaccuacuaugauucugggaaggccuuccaacagaaaugggugguuggguuag

SEQ ID NO: 4103485 - RNA, 73 nt, Human
cuaaccugcuucugcccucacgguagcgugcacaaucuucaucgcauguccuggguggugguaggagcaguag

SEQ ID NO: 4103486 - RNA, 116 nt, Human
cuaacucagggugugggccugggcaacaaucaaggaaaccuguuuucuucucaucuaggccugaaacuagaggggaaaaaggucuuguuuguggcccaacccaacaucccaaguag

SEQ ID NO: 4103487 - RNA, 65 nt, Human
cuaacuuuuacagucauguugccaaagacccuccuagcuccagucagccugcuguagaaguuugg

SEQ ID NO: 4103488 - RNA, 61 nt, Human
cuaagaaggaaaaaaccugcuagcuguccaguguugaacagguauugauuuuucuucuagg

SEQ ID NO: 4103489 - RNA, 56 nt, Human
cuaagaccugugcucccaccaugguagacugccuuggugucaguuuuggucauuag

SEQ ID NO: 4103490 - RNA, 63 nt, Human
cuaagaggaaguacucuguuaugccguucccaaagcacuuuguucagaggcacuuucucuuag

SEQ ID NO: 4103491 - RNA, 83 nt, Human
cuaagaggucaacacagcagcauccuauuucacuccuacagcagccccaagggggaaguggugaccugcucaagaugucauag

SEQ ID NO: 4103492 - RNA, 56 nt, Human
cuaagagucuagaauaucucagaguuuucagaagaaauuuuguauucuaguucuag

SEQ ID NO: 4103493 - RNA, 71 nt, Human
cuaagaugcaggaaggcucacccaggugcugcccaccugggagguacccaggcacgccuugcugaucuggg

SEQ ID NO: 4103494 - RNA, 127 nt, Human
cuaagcacuccauuuccucacaauguccucugucauuagcagugccuugccugucuuccacaguauaagaagggccaggcauucuaacccauuugcagagaauaucuuugauuuacugaguacuaag

SEQ ID NO: 4103495 - RNA, 64 nt, Human
cuaagcaggaaggagcccagggcagagaucugggaucacucccauggcccacuuuauuguuugg

SEQ ID NO: 4103496 - RNA, 83 nt, Human
cuaaggacagagaaggcacuuaggauuuuaaucugagaugagauccaugggaagauuuugagugguuuagucucaugcuuugg

SEQ ID NO: 4103497 - RNA, 125 nt, Human
cuaaggauuugugcugccugcgaccccucucuccccagacucucuccauuuccuccgucagaaguugggguaccuugaggcugggguuagaguagggaggggacgcuggaggggcaaauccaggg

SEQ ID NO: 4103498 - RNA, 71 nt, Human
cuaaggccagagugauguaacauauauuuacuuuaaauguugaauagauuuuauuaauuaccuugccuugg

SEQ ID NO: 4103499 - RNA, 55 nt, Human
cuaagggcuugcuggagccagggcugacuucaucaccacccuuuagggcccuugg

SEQ ID NO: 4103500 - RNA, 83 nt, Human
cuaagguacuuggccuuuggccccagcugagcuccuugccaacaaccaaagccagcacggcgccauggagugagucaucuugg

SEQ ID NO: 4103501 - RNA, 78 nt, Human
ccugucccauggcucugcagcuaugaggcagcuuuccuagggugggucuccuggcugcagcuaagaccaggcaacagg

SEQ ID NO: 4103502 - RNA, 74 nt, Human
ccuguccuaagggaugcuggucaguguaccagaaguaaaacaaauuggcuucuauggcugcacaccaggacagg

SEQ ID NO: 4103503 - RNA, 57 nt, Human
ccuguccuguacuuugaggcccuggagauuuugagauaugcuugaagacaggacagg

SEQ ID NO: 4103504 - RNA, 82 nt, Human
ccugucugggucuuuaguucuccacuggucaaaugacggauuccagugggucagagagcuccagauguaccuccgcggcagg

SEQ ID NO: 4103505 - RNA, 62 nt, Human
ccugucuguccugaguucaaccagucaugaaaaaugacuuugguuggauaggacacagcagg

SEQ ID NO: 4103506 - RNA, 79 nt, Human
ccugucuuaaaagaagcagcuaaggacaaaguaaagugaaguaaucauuccuuuaaagaacugugcuuuucagggcagg

SEQ ID NO: 4103507 - RNA, 106 nt, Human
ccugucuuuuuuuuuuaguucagcacuuuguuuugcucauccagaaacagccccuuuuagugaggaugagcaggggagaggggaugcaagaaaaaucaguuacagg

SEQ ID NO: 4103508 - RNA, 77 nt, Human
ccugugaaaucugagucauuuauagcuaaccuugaauguauuguuauucacaauuagaaguagauaaauuucacagg

SEQ ID NO: 4103509 - RNA, 56 nt, Human
ccugugaaucuugauguuauuucuggaucauugcagaugccacauugaguuauggg

SEQ ID NO: 4103510 - RNA, 115 nt, Human
ccugugacuuaaguuuuauaugcuucauuucagccugguugauauuuacaaguauaccucauaauacagaagcaugccaggcagauaugugagcuuacagaauuuguaaucgagg

SEQ ID NO: 4103511 - RNA, 113 nt, Human
ccugugaguccuccuggauggcagagcccccugcccaggcccacacuugcauccuagugaggaccaaagcaggcccugggccaggggaggcagcuguccugguggauuccagg

SEQ ID NO: 4103512 - RNA, 94 nt, Human
ccugugccgcccuccugguggccuugugauuucacuggugacauguuuggaaagcccacgcagugcugagagauggcagggccuucagagcagg

SEQ ID NO: 4103513 - RNA, 85 nt, Human
ccugugcuccuggaauccauugcugugcugccagggcgaagcaauguugcugguggcaaugcugauaggaucagguagcaauugg

SEQ ID NO: 4103514 - RNA, 63 nt, Human
ccugugcucuugucugugacuaaccagugcuucucuugugggauuagucuucaggaucacagg

SEQ ID NO: 4103515 - RNA, 57 nt, Human
ccugugcuggacagggcugggcuuggaagcaugaaggccucaccaugucaagccagg

SEQ ID NO: 4103516 - RNA, 59 nt, Human
ccugugcuggcuuuauucucaggaagaguauuccugaguggugaaaaagcagcuucagg

SEQ ID NO: 4103517 - RNA, 78 nt, Human
ccugugcugggcagaguugguggagucaguugcccagacagggcaacguccacgucaggcucugggcuccuagcaagg

SEQ ID NO: 4103518 - RNA, 120 nt, Human
cucuugccuuggcaccuggguggcuugcugcccacaaccccgugucuaaaaauacaaaaauuagcugcgcauggugguggguaccaguaaucccagcuacuccggaggcugaggcaggag

SEQ ID NO: 4103519 - RNA, 56 nt, Human
cuccgucuuccucacucacucccauuuggcuaggcuuuuugaguagggaagaggag

SEQ ID NO: 4103520 - RNA, 66 nt, Human
cuccuacgcauggcaaauuuauaagucgagguagaguuagagacacaugcacaugcauacuaggag

SEQ ID NO: 4103521 - RNA, 59 nt, Human
cuccuacucagaagguuuagaaucucagggaugacauucagaagaaaugaguacaggag

SEQ ID NO: 4103522 - RNA, 72 nt, Human
cuccuacugggacauuauaagaaacauuauauauuaaaugcacuuaauaacuguccuucugaaagaugggag

SEQ ID NO: 4103523 - RNA, 110 nt, Human
cuccuagccagaacccuccaggaugcccaagccgagcucucuguuuccccuuccaaagccagguccagcaggagacugggcuuggcucucugauggauucaggacagggg

SEQ ID NO: 4103524 - RNA, 73 nt, Human
cuccuaggguguaauacauuagcaaaccaaagaaucaaagaucuuugcccuuguggaguuuacaugcuagggg

SEQ ID NO: 4103525 - RNA, 71 nt, Human
cuccucacuucccagacgggguggcagccgggcagaggcugcaaucucggcacuuugggaggccaaggcag

SEQ ID NO: 4103526 - RNA, 56 nt, Human
cuccucagcugggaggagucccuuccccaggggucucauucccucccugaccugag

SEQ ID NO: 4103527 - RNA, 87 nt, Human
cuccucaguccuccaaagucugacuagaaucucucccucccuucucagauugggagagggccauaguucuaaggacaggauugggag

SEQ ID NO: 4103528 - RNA, 71 nt, Human
cuccucccaaacuaugggugcauaggguggguguucaguuuaaggaggcucacuaggcauccugggaggag

SEQ ID NO: 4103529 - RNA, 86 nt, Human
cuccucccauaaccuuuggguuugcuccugggaaagcagaaaagacacagucccaucuccaaggagcagauccagaggacgaggag

SEQ ID NO: 4103530 - RNA, 79 nt, Human
cuccuccgggggacgcuggggagccucggggcacggcggaaaacgcagguggggggcuuccgagccugaccuggaggag

SEQ ID NO: 4103531 - RNA, 109 nt, Human
cuccuccuccucugcgggcccgggccucucagggacccagccagccucuuccuuuacgucuggggggcugagauccugagaggagggggcuccagcagcggaggccgag

SEQ ID NO: 4103532 - RNA, 68 nt, Human
cuccuccuggcagcuccuccccggcgggccuccccucaucucggcuggguagaggugccgggugugag

SEQ ID NO: 4103533 - RNA, 88 nt, Human
cuccucggccagggagaggagcacggccuuggguguguucuugaaaagggcugcccaguucugcugcugccccuuccucgcccagggg

SEQ ID NO: 4103534 - RNA, 72 nt, Human
cuccucuacacagcaggucuuguugcugcugacugacauguccugggagcacaugguccugcucuaggggag

SEQ ID NO: 4103535 - RNA, 62 nt, Human
cuccucuauuucuccuggcauugauacaaagcauuggcacuuuaagcuaggagagggaggag

SEQ ID NO: 4103536 - RNA, 56 nt, Human
cuccucuggaaauuccucugcccugugacugucuacagggggcaugaccagaggag

SEQ ID NO: 4103537 - RNA, 74 nt, Human
cuccucuggcucagcugucacuucuaaguuuugcuaagauagcuuacuuuaguacugauaguuacuagugugag

SEQ ID NO: 4103538 - RNA, 58 nt, Human
cuccucugucuggcccugagccagcccugggugggaguguugggagucagaugaggag

SEQ ID NO: 4103539 - RNA, 76 nt, Human
cuccucugugcuguugucugcucuuugagcuccaguugaggcaagggcucugaggcagaucgaugggcagacugag

SEQ ID NO: 4103540 - RNA, 81 nt, Human
cuccucuuuggucuguggcucuccaauggagggaggaauucuuagcugccaaaagggugggcuagauaggaagaagaggag

SEQ ID NO: 4103541 - RNA, 60 nt, Human
cuccugaccucaugauccaccugccuuggccucccaaagugcugggauuauaggcaugag

SEQ ID NO: 4103542 - RNA, 80 nt, Human
cuccugagagcagaggugggcagccugccccaccccuucuauagccaggcugaauccacacccucucuauaauucaggag

SEQ ID NO: 4103543 - RNA, 56 nt, Human
cuccugagcugcagccuugugucaccaaggauaaagcagggacaaagcuucaggag

SEQ ID NO: 4103544 - RNA, 78 nt, Human
cuccugagguguucuucaaggcucccagccugccuggugcugccuccagggauggaagacuugaagacccagcuggag

SEQ ID NO: 4103545 - RNA, 75 nt, Human
cuccugcaaugcaugaauuauaaauauauacaaauuuuacauguauuuaugauagcugcauuaaagaggcagagg

SEQ ID NO: 4103546 - RNA, 60 nt, Human
cuccugccaccgcgguguccugccccuauaggccugaguaggagauccccgggguagggg

SEQ ID NO: 4103547 - RNA, 61 nt, Human
cuccugcuuggugaaucucuuauagcacauugaugcgucuauaucugggaaccaaaggggg

SEQ ID NO: 4103548 - RNA, 58 nt, Human
cuccuggcuaugacuacauuucugaggaugcaagaagaaaagaguccugugugaggag

SEQ ID NO: 4103549 - RNA, 61 nt, Human
cuccuggcuccuggcucuggccaagggaguuggcuucccuguguccaugccaggaggggag

SEQ ID NO: 4103550 - RNA, 59 nt, Human
cuccuggcucucuguuuaguguuuggacguucaaagaucccuagacuaggcggcgggag

SEQ ID NO: 4103551 - RNA, 129 nt, Human
cuccugggcucagcuguaucucucuguucugggagccugggugcucuguguaaggggaacguauacccaagggccccccugcaagacgcccagccuugucugaggcugcagagaaagcgccaaagcccg

SEQ ID NO: 4103552 - RNA, 60 nt, Human
cuccuggggccauggaaggaacugguucuccccugagcuguucccucacguccugcggag

SEQ ID NO: 4103553 - RNA, 72 nt, Human
cuccuggggcucuuugaugugauuccugagcucccaagugagcccucaucacauccuaggagaaccacggag

SEQ ID NO: 4103554 - RNA, 75 nt, Human
cuccuggguguuuucaauguuggcacugcacacggaguuggccuggcuguuuucaauguugauggcaccagugag

SEQ ID NO: 4103555 - RNA, 56 nt, Human
cuccuggguucugggccgcagcgccucugcgaggucugcaggcuucgcucuaggag

SEQ ID NO: 4103556 - RNA, 69 nt, Human
cuccuguacaaucaggauaauaauagugccuauuucacaggguuuugugagccugguauacaguaagag

SEQ ID NO: 4103557 - RNA, 65 nt, Human
cuccugugacuaccacuaugccacugugugcaggucaccaugccagggccauagggagucuagag

SEQ ID NO: 4103558 - RNA, 58 nt, Human
cuccuguguucaagcgauucuccugcuucgguuuccugaguagcugggacuacagggg

SEQ ID NO: 4103559 - RNA, 72 nt, Human
cuccuguuuggguuccuuggagucuccuacacaauacacaguucagagaucugcaggaaugugugcagagag

SEQ ID NO: 4103560 - RNA, 118 nt, Human
cuccuuagcuauuaagaaaggcaguaacaucaacaggcugagcuggcccuugaaaugggagaagcuccuaacagcaucuggucagcuuagcugaugcaauugcaaggcuggccuggag

SEQ ID NO: 4103561 - RNA, 84 nt, Human
cuccuuagggcugggaugggaacugagaaucauuugagggcuuaauaagugauuuuggaggccccaguccccacccuaugggag

SEQ ID NO: 4103562 - RNA, 76 nt, Human
cuccuucacuuugcagcuggaggagccggcugagugcacgcugagugcauuggcaaugucccggcugcugagggag

SEQ ID NO: 4103563 - RNA, 75 nt, Human
cuccuucagagccuccaaauaagagucaagcauggucaacaucuugauuucagccuugugauaucugaagcagag

SEQ ID NO: 4103564 - RNA, 74 nt, Human
cuccuucccgucuuugcuaugccugcccucugcuggaggaacucaugaacggcagcugguuagaagggaaggag

SEQ ID NO: 4103565 - RNA, 71 nt, Human
cuccuucucagccagugugcaccuggagucagcuguguuuggccuuaagguguccaugguccagcagggag

SEQ ID NO: 4103566 - RNA, 67 nt, Human
cuccuucuccagucucaagacauugagucccaaggauggcccucuguuuucugagacagacggggag

SEQ ID NO: 4103567 - RNA, 77 nt, Human
cuccuucuccccaucucuccagacagcucucccuuucuucugagccuccgcagcuguccugugggagggagugggag

SEQ ID NO: 4103568 - RNA, 74 nt, Human
cuccuucuuuaucagaggaggcauuuaaacagaacuagguaaccuccuuucuggccuccuguggaagccaggag

SEQ ID NO: 4103569 - RNA, 61 nt, Human
cuccuugguuccccuagacuccuugucccauggcuaaggcauggcaggaauagggccagag

SEQ ID NO: 4103570 - RNA, 93 nt, Human
cuccuugugguaugcagaggccaaauugaucaucuuuaggcagagauuccuuagacaugaucgaugaggcuauccaucuagcguaacacugag

SEQ ID NO: 4103571 - RNA, 66 nt, Human
cuccuuuaucugaaacuuuugggaccagauauguuuuggaacucagaauuuuucaaaucuuagggg

SEQ ID NO: 4103572 - RNA, 61 nt, Human
cuccuuuccuagcagcugguccugggaacagaaggcugugacaaggcugcgggaaauggag

SEQ ID NO: 4103573 - RNA, 61 nt, Human
cuccuuugaucccaaaugaccccacccgacaugggucacagucauuucugaacagagugag

SEQ ID NO: 4103574 - RNA, 67 nt, Human
cucgaaagcuguuaauggcuugcagcugccuaugauaggaagucugcacaucuuagcuguuuuugag

SEQ ID NO: 4103575 - RNA, 85 nt, Human
cucgagggcugcuggaaaaaugcaggcacccagugggcugggccuaaagauguacauuuuucucccagugauagcagcucuuggg

SEQ ID NO: 4103576 - RNA, 78 nt, Human
cucgcaccuguagccccagcuacucggaagcugaggugggaugaucgcuugagccugggagguugaggcugcagugag

SEQ ID NO: 4103577 - RNA, 98 nt, Human
cucgcagcgaguuaacauuucuuagagacugagagucccuaagugaaaggucacuugcaugaccucugugccucaguuucaugugucgacuccgugag

SEQ ID NO: 4103578 - RNA, 57 nt, Human
cucgcauggcuuggagcaggaugagaugagaaguuuuauaugaaauuagucauggag

SEQ ID NO: 4103579 - RNA, 129 nt, Human
cucgcccagggguagcagugccuaggccaccugcagcauugacaucagcaaacugccagggaggagaguggaggcugcagaacagucaggugcaggcaggggcccagggaggaggcgagaccugagcag

SEQ ID NO: 4103580 - RNA, 87 nt, Human
cucgccccaacccgggucagagggccagaguccuggggucaccugugugucccccaccuugggguccuaagguccggguagggugag

SEQ ID NO: 4103581 - RNA, 61 nt, Human
cucgcuguguccagggccguguugucuugugucucggcaggacccgcacagcuggagugag

SEQ ID NO: 4103582 - RNA, 109 nt, Human
cucggccuccgcugcuggagcccccuccucucaggaucucagccccccagacguaaaggaagaggcuggcugggucccugagaggcccgggcccgcagaggaggaggag

SEQ ID NO: 4103583 - RNA, 99 nt, Human
cucggcucuuugggaggccaaggcaggcggcugggaggugguuguagcgagccgagaucacgccacugcacuccagccuuggcaccauugagcacugag

SEQ ID NO: 4103584 - RNA, 61 nt, Human
cucggcugcuuguuggagagugauuggcugaagacuucuuuagcuuccagcucaagcugag

SEQ ID NO: 4103585 - RNA, 59 nt, Human
cucggugccuguuaagugcuuugacccuccaauauuggucacuggcaagcagugcagag

SEQ ID NO: 4103586 - RNA, 56 nt, Human
cucgguggccucucaugcaagguagccacaggcucuggguucacugaggcucugag

SEQ ID NO: 4103587 - RNA, 66 nt, Human
cucguagacucaaggugguagaagguagaggugacuaaggcuuucuggagccugggggaacaugag

SEQ ID NO: 4103588 - RNA, 75 nt, Human
cucguagggcugcguagagcagguggggagggcaacuccacagcccuagucaccugugagcugcguagacaagag

SEQ ID NO: 4103589 - RNA, 59 nt, Human
cucuugcuucccaaggcgggggaacugaugguuuccuacaucaccagggggaguaaaag

SEQ ID NO: 4103590 - RNA, 80 nt, Human
cucuugggaagauuauucuuaacaugaaaaauaauaaauaaguauuagaaauuauuagugaauagucucagcucauagag

SEQ ID NO: 4103591 - RNA, 59 nt, Human
cucuugggugggcagugggccugggggagucucucuagaacuucuggugcccccaggag

SEQ ID NO: 4103592 - RNA, 57 nt, Human
cucuugguacucucuugaaggccuuucuagcaagacaggugugagagaugcucgggg

SEQ ID NO: 4103593 - RNA, 72 nt, Human
cucagaggcuucagaggaagugcggcccugcugacacuuugcuuuugggcuucuguccucuggaucugugag

SEQ ID NO: 4103594 - RNA, 75 nt, Human
cucagagggauggccaguggcagagaacagagaccuggcugagggcagguuucugcacugucacuggugaaugag

SEQ ID NO: 4103595 - RNA, 66 nt, Human
cucagagucauuuauuauguuuguaaaauacuuggcaguccuuugcaaauaaauaagugcucggag

SEQ ID NO: 4103596 - RNA, 79 nt, Human
cucagauguguuggauggaaaaauauucuacugggcuacaauauuuccaaaaguccuuccaggucuaauauccuuugag

SEQ ID NO: 4103597 - RNA, 59 nt, Human
cucagcaacccuagaacauuugccauucauaacggcaaauuuuaaucaguggugcugag

SEQ ID NO: 4103598 - RNA, 61 nt, Human
cucagcacagcugccucuggagugcgcaguggguggcagucccagccuaggcugugcuggg

SEQ ID NO: 4103599 - RNA, 72 nt, Human
cucagcagaugguagcaacugugguagaaaaugaagccauaucuacaugauguaccaucuaagacagcugag

SEQ ID NO: 4103600 - RNA, 129 nt, Human
cucagcagggcccacugaggcuuggugaagcgccggcagggcucaggggccccaagcugguccagggguaugguggcccucagccaggcccccgagucguugguggaggccucagugugguuggcaggg

SEQ ID NO: 4103601 - RNA, 56 nt, Human
cucagcccuccccggggaauaacucugccuuugggcuuccucaggggugggguggg

SEQ ID NO: 4103602 - RNA, 85 nt, Human
cucagcccugggagcuggaugucugugccaggcacacccguggcaacgggaggugaccagacagagucuagcccuaaggaagggg

SEQ ID NO: 4103603 - RNA, 78 nt, Human
cucagccucccaaagugcugagauuacaggugugagccaccacgcccggcuaaugguagcaauuuuuaagaggcugag

SEQ ID NO: 4103604 - RNA, 122 nt, Human
cucagccuuccuuacucccuuguauauugaaggcuuucuaaggaaaguaccugggauucuccaucugagggcuuucuuuggaauguucaguccacagguguggggcagaaggaagugcugag

SEQ ID NO: 4103605 - RNA, 64 nt, Human
cucagcugcuccaccuccgggucaggcaggugagccuggggcagagaggcugagagcaccugag

SEQ ID NO: 4103606 - RNA, 87 nt, Human
cucaggacaaacuuguucuguuccugaugauucuucuggaacuauagucaaugaaaucaucacgaacacaacagcguuuguucuggg

SEQ ID NO: 4103607 - RNA, 60 nt, Human
cucaggagucugugcaguuccacaugguuccacccaacuguggugacgggaauucuugag

SEQ ID NO: 4103608 - RNA, 64 nt, Human
cucaggaugcaggucacaggacucaugccacucacaguauccgccacuguugccugcuuccgag

SEQ ID NO: 4103609 - RNA, 55 nt, Human
cucaggcaaggcccgcauucuccacuccgugcccauguggacgcccugccuggag

SEQ ID NO: 4103610 - RNA, 59 nt, Human
cucaggcacuuuugucacagacgaauuuuuuguccacauugcugacaaggguggucgag

SEQ ID NO: 4103611 - RNA, 57 nt, Human
cucaggcaggcccuggccgcccagagugucucaggaggccacauuccccugcuugag

SEQ ID NO: 4103612 - RNA, 75 nt, Human
cucaggcucaggaagggugguccacagggaaauauaagucaaauaagccuuauggccccacccugaccgcuugag

SEQ ID NO: 4103613 - RNA, 57 nt, Human
cucaggcugugaugugauggcauuggcggagcccagucaaggcacugacagccugag

SEQ ID NO: 4103614 - RNA, 67 nt, Human
cucagggagggcugcaaugagacagagaauccugagauuguuccucaugugcagaucuucaccuggg

SEQ ID NO: 4103615 - RNA, 61 nt, Human
cucagggauggugaagcacccagcagcuggcaaacggcagggagcugccaccaccccuggg

SEQ ID NO: 4103616 - RNA, 61 nt, Human
cucagggauguuuguucuaagauauucauucagaaauuuacuuguuccaagcaugucugag

SEQ ID NO: 4103617 - RNA, 85 nt, Human
cucagggcucuggaccccuuccccuccgcccccgcagccucugccaggaggugggaguugggugggagacuuccagggcccuggg

SEQ ID NO: 4103618 - RNA, 62 nt, Human
cucaggggucauccgaugugguccuuuuuauuauuucauuggcuucacaugauuacccuggg

SEQ ID NO: 4103619 - RNA, 71 nt, Human
cucagggucaaagugaggagucagguuaaccucacagaggccccagcauggccccacuuuuucucccuggg

SEQ ID NO: 4103620 - RNA, 128 nt, Human
cucaggguuaguuaagcuuuuuauuuuuccuucugugaacuucacgauagccaaagcuauaaacaguagcuuugacauacgugagguuuuucagcagugggcuaccagaucagaaaucuaggauugag

SEQ ID NO: 4103621 - RNA, 89 nt, Human
cucagguaguuauaauagcuaacauugaguucuuacuaugugacagacacuuugcugaguacuuuauguuaguuauuuaaugcauauag

SEQ ID NO: 4103622 - RNA, 129 nt, Human
cucagguguauucauucauucugccaaccacuguugagcaccuaccuuguccagugccuccauggggcacuaagaauacagacagggauuagguguagaccuuguccuuaggcaacauguggauuugug

SEQ ID NO: 4103623 - RNA, 68 nt, Human
cucagguuauuaugagagcuccgauaguggucaccaugcugaacugucagggaucaugaaagcuugag

SEQ ID NO: 4103624 - RNA, 61 nt, Human
cucaguaaauaguggagaugugggcuuuacuugucagagugcauuccauguguuuccugag

SEQ ID NO: 4103625 - RNA, 61 nt, Human
cucaguaggcugacacuauucuacuuccaucuggaagacaaggaauguagcuuacucagag

SEQ ID NO: 4103626 - RNA, 83 nt, Human
cucaguauucaucccauguguuucacagcucacaucagucccguauaugagcucugagacacaaagggugcauauucacuggg

SEQ ID NO: 4103627 - RNA, 61 nt, Human
cucagucaccuggucacugcaggcuggucuuguugcuacuuggugaagucaggugauuaag

SEQ ID NO: 4103628 - RNA, 71 nt, Human
cucagucaggcugaaaggacuccaguuaugaacuuuacuucccucaaggugauguccacagcuugcaggag

SEQ ID NO: 4103629 - RNA, 80 nt, Human
cucagucuuucugccugcuccuaucugggcucauugcuuaaggaagugaacaaagguagugagcaucauagggugcugag

SEQ ID NO: 4103630 - RNA, 69 nt, Human
cucagugauuccucaagaauucuccauuuaauaaggauuaaaugagaaaacacagaggagguaccugag

SEQ ID NO: 4103631 - RNA, 78 nt, Human
cucagugccauagacuacgcucacacuagaccccagccuucuccugggcccugugugaagguagcucuuggcacuggg

SEQ ID NO: 4103632 - RNA, 120 nt, Human
cucagugcccuguuucagcccuuugcgaaccauuguuaccugucuugccucucuaacugguccauugaggacaggaauaaugucuuuugcuaauggcagucagagacaggcagaucuggg

SEQ ID NO: 4103633 - RNA, 87 nt, Human
cucagugguggcaucaauugacuucucucuucaacucucaacccuuaaggaauaaaaaagaggaaucagcugauggccaucucugag

SEQ ID NO: 4103634 - RNA, 106 nt, Human
cucagugucaaggcuuucuuguuugaguagcccaggcuuaguaaguggccuucagucucauugguuacacacagagcugggccugggagagggggaucuacaugag

SEQ ID NO: 4103635 - RNA, 125 nt, Human
cucaguuaaucuauaaaugguaucaggccauuaagauacaaguuaagagaaaggaggcuuaaacaccauccugcuuuacuugugcuugugcuuugguguacucagagacuucuuccuacccugag

SEQ ID NO: 4103636 - RNA, 58 nt, Human
cucaguuaggaugcuuccauagccagggaaaggcaauggucagaauuuuccagcugag

SEQ ID NO: 4103637 - RNA, 61 nt, Human
cucaguuuuaccuugcagcauauagagucccuaucagaaugggggccuugcagagacugag

SEQ ID NO: 4103638 - RNA, 72 nt, Human
cucauaaauauguauagagucuuuuaaauuaucuguugauggauaaggacucugauacauuuacauaaugag

SEQ ID NO: 4103639 - RNA, 56 nt, Human
cucauaacugugcucaggggagauggauuuaucguaacugagucaaagguuguggg

SEQ ID NO: 4103640 - RNA, 60 nt, Human
cucauagaagcaccagaagauaucacccagacaugguucuuuaaacugcugcucugugag

SEQ ID NO: 4103641 - RNA, 63 nt, Human
cucauagaguuguugugagaagaaaguuauuuaauacauguggcacuuacaacaauucaugag

SEQ ID NO: 4103642 - RNA, 102 nt, Human
cucauaggugaccuuggggugcagggcaggggaccgaggcaggcuuacccuggugcagucgcagacaugguccccuuuccucccgccaggacuguccuagag

SEQ ID NO: 4103643 - RNA, 55 nt, Human
cucauauaucuguaagguggauaauaucguuuaccaccacuuugcagauagugag

SEQ ID NO: 4103644 - RNA, 63 nt, Human
cucaucaguggauauagauuagcguggucauuagcauggcuuuauaaauccacugguuuagag

SEQ ID NO: 4103645 - RNA, 59 nt, Human
cucauccaccgcagccccucaguacccacacggccuggaaaauggaugcguggauggag

SEQ ID NO: 4103646 - RNA, 75 nt, Human
cucaucuaauuuuggaacagagacaagccaucucucuuauaagcugcccaaauuucugauccacaaauuaaugag

SEQ ID NO: 4103647 - RNA, 62 nt, Human
cucaucuggggaaaacuccauugcugagauuacucaguacaaguugccuaccuuaaguugag

SEQ ID NO: 4103648 - RNA, 57 nt, Human
cucaucuugaguccaggggaugauaagacaguaagucccguggagaaaaggaaugag

SEQ ID NO: 4103649 - RNA, 84 nt, Human
cucuaaacagcuuuguccugcaaaccugaacaaaaagaaauucagugugacugucaggacagaugcuccagaaacaguuuugag

SEQ ID NO: 4103650 - RNA, 102 nt, Human
cucuaaaucugcugcuguuuccugaggcacaauccuagaauugugaaaauuguugauccaauuuagaugagagagucuuauaaaacagcagcacauuuuaag

SEQ ID NO: 4103651 - RNA, 70 nt, Human
cucuaaaugauucugguugcuuuaagugcagugguucucacacuuuacugugcauuagaaucaccuggag

SEQ ID NO: 4103652 - RNA, 88 nt, Human
cucuaaggucucuuaagauugucagcuucagccucaagcuugaaggaggcuggagauggagacuggucuugaaaagaguccaggagag

SEQ ID NO: 4103653 - RNA, 69 nt, Human
cucuaagugucaguuaggcauuugccuuaauuuugaauaaaaugaaaaaugucuaauuuauuuugggag

SEQ ID NO: 4103654 - RNA, 82 nt, Human
cucuaauacuagaacaauucugaggccugcuuuguuagcaucaaucagcaagcagagcaaagcucagaaaugcuggacagag

SEQ ID NO: 4103655 - RNA, 63 nt, Human
cucuacagcugcugccccuggugcucccaggaagagucucggguacaggcagagguuggaggg

SEQ ID NO: 4103656 - RNA, 78 nt, Human
cucuacguuacugaugucauuagaaacagacugauuggguucguuaagcauuuggaucugagacagaguaagguggag

SEQ ID NO: 4103657 - RNA, 67 nt, Human
cucuacucccuguacuugccucucuuguagcccuuucacaugggacuguaaucugcagugagaagag

SEQ ID NO: 4103658 - RNA, 75 nt, Human
cucuacuuacagguguggaaauugaguaacagaaaaauuaacuugccaagauaacacagcuaguaaauaguagag

SEQ ID NO: 4103659 - RNA, 59 nt, Human
cucuagauuacuucugauaccuaauucaauguaaaugcugugucaguaguugucuaggg

SEQ ID NO: 4103660 - RNA, 86 nt, Human
cucuagcaugauagaaaacuugacagugagacaguuugagucgaaagauaagaaauguugucucugcagcaaugucauagcuggag

SEQ ID NO: 4103661 - RNA, 57 nt, Human
cucuaggagcugagaguagucccuuuugcuagcaaacugacaaucucaguccuauag

SEQ ID NO: 4103662 - RNA, 68 nt, Human
cucuaggauggaaggugguuuggggacuuacaucucucucuuuccuccugucuccuuccuauauugag

SEQ ID NO: 4103663 - RNA, 95 nt, Human
cucuagggugguggugccagggcuuaacuuuucaggaggccagacuauccuuggaguuucaugagauuaggacccugucuguccacuucuuggag

SEQ ID NO: 4103664 - RNA, 72 nt, Human
cucuaugaaauagagcuggguuaaacuuugucaccaacaauggguuucugucccagcucugccacuauagag

SEQ ID NO: 4103665 - RNA, 71 nt, Human
cucuaugacugagcagcacagggcgccaggggauguuugucugcacugcugcuguguugcugacuuaugag

SEQ ID NO: 4103666 - RNA, 64 nt, Human
cucuauggauugucuaacuggacaggcugggaccccaaacucuuccagcugcacaagcaugggg

SEQ ID NO: 4103667 - RNA, 79 nt, Human
cucuauuacuuuauauucuaucugccacaguugggcuggacaagaugggaaggcuggaagguagaagaugaggugggag

SEQ ID NO: 4103668 - RNA, 84 nt, Human
cucuauuggaccaugaucuugcccuuccucucugucugcuuauggcucagcagagaaaugggguaaucuuucaggaagguggag

SEQ ID NO: 4103669 - RNA, 71 nt, Human
cucucaaugaauggcuuacccuggauugugucuuuaugccguaggcauuaucacuguaaguauuuguggag

SEQ ID NO: 4103670 - RNA, 61 nt, Human
cucucacacuugcuuccccaguccagggcacccaggaguuugggguacgcaggucugggag

SEQ ID NO: 4103671 - RNA, 65 nt, Human
cucucaccuauucauuguagaacuaacaagaaguaauaagauuucuggaauguagucggugagag

SEQ ID NO: 4103672 - RNA, 84 nt, Human
cucucacuauccuggcucccgucugguggccaucccugagccaaucacuguggcagcagaggggugguauggaguggaaaagag

SEQ ID NO: 4103673 - RNA, 65 nt, Human
cucucagcagagcugugugggaagggccugaggcuucuagguccuccacauuccucuguuguggg

SEQ ID NO: 4103674 - RNA, 59 nt, Human
cucucaggagccacagcgggaguugcucacugagaagacuuucugugguuaccagggag

SEQ ID NO: 4103675 - RNA, 98 nt, Human
cucucaggccccuucuuuccucaagugucaccagcccccucacgcugucacguugcaccagcuuggcaggguugggccugguggcaugugucugggag

SEQ ID NO: 4103676 - RNA, 94 nt, Human
cucucagugucugccuugcuaugugagauggcucaagccauuagcccauucuggaguuuaguuuucccaucuacaaagcagggagacaucagag

SEQ ID NO: 4103677 - RNA, 98 nt, Human
cucuccaaggccaugugggagguuuucgaugagcccugaagcucuguggaguuucuggcaucugggggaggccucuguuuacauccaagccuugggag

SEQ ID NO: 4103678 - RNA, 65 nt, Human
cucuccacagaagaccaagaaagcuuccaucucucauggagaucuuuguuaucuuuugauaagag

SEQ ID NO: 4103679 - RNA, 57 nt, Human
cucuccaggcugggacaggaccugacccccuucuuccuguccucagauguggacgag

SEQ ID NO: 4103680 - RNA, 64 nt, Human
cucuccauacucaaagguuucugugccauauuaaucaucuuacagguuucucuuuuauggaggg

SEQ ID NO: 4103681 - RNA, 66 nt, Human
cucuccaucaggccgggcagcagcaaaggccuugucuauggggccagacuccuggcugauggugag

SEQ ID NO: 4103682 - RNA, 64 nt, Human
cucuccaugagcauuugaaauguacagcuacaaguugauaguguaugauuucaaauggcuagag

SEQ ID NO: 4103683 - RNA, 62 nt, Human
cucucccaacucagacucguuaucuccaucaugguggagggaccuugauggguuugggacag

SEQ ID NO: 4103684 - RNA, 58 nt, Human
cucuccucuugggaauaccuuucuagacguucuuuuggauugugaguaagaggaugag

SEQ ID NO: 4103685 - RNA, 67 nt, Human
cucuccugguguggaggacagggacuucuccauuccaucccuuucaaucuccuucacagcaggaagg

SEQ ID NO: 4103686 - RNA, 70 nt, Human
cucuccuucccagcaccucagucuggccaaacauguuuuucuggcuucugguagugcuggggagguggag

SEQ ID NO: 4103687 - RNA, 85 nt, Human
cucucuagagaugaaugaugcaaaagacacuguaguuaguuaugguucuagguagugacuuuucaucucaguucuacaaagagag

SEQ ID NO: 4103688 - RNA, 76 nt, Human
cucucuagaggaccauuucagaguuuuggccuuugcugauaggcagccuugggcugagccauuugaaccuugagag

SEQ ID NO: 4103689 - RNA, 70 nt, Human
cucucucaagcauuuugaugaaagcuacuauuuacuuuagggaagugaaaguguauuuauuaugagggag

SEQ ID NO: 4103690 - RNA, 65 nt, Human
cucucucccaggcugccuugaggaaugcagagaaaauacuccuggaaagcggaccuggggcagag

SEQ ID NO: 4103691 - RNA, 106 nt, Human
cucucucggggcuggccccggugcuggacggcugcagccguggacuccgggagcuccaggcauguggccaguacucauggcuccucuggggccagugucuggagag

SEQ ID NO: 4103692 - RNA, 56 nt, Human
cucucucuauuucuauuggcucuuuuucuguggagaacagugacuaauauagagag

SEQ ID NO: 4103693 - RNA, 76 nt, Human
cucucucugggcccaacagcacuggucccgcaagccucaggcccccuaagggcuggucggugcugcacagagagag

SEQ ID NO: 4103694 - RNA, 64 nt, Human
cucucugaggcaggccuguggguucugguguaaguggagauugggccuggaaagccuuagagag

SEQ ID NO: 4103695 - RNA, 56 nt, Human
cucucugaugucaggucgcugaauacaacuucaguggccuaaagcuucuagagcag

SEQ ID NO: 4103696 - RNA, 60 nt, Human
cucucugccucaagugaacuuuucaugcaaaguuguggacagagcauuugggacagagag

SEQ ID NO: 4103697 - RNA, 90 nt, Human
cucucugguuuuaguggaaaaacagagcuuuuuacauuaaugauaacuuauauacaauuguguuaaagggcuuuaacugaauccagggag

SEQ ID NO: 4103698 - RNA, 129 nt, Human
cucucugucuauuuugagauggaguuuugcucuuguugcccaggcuggaguacaauggugcaaucuuggcucauugcaacuucaaacuccuggguucaagcgauucuccugccucagccuccugaguag

SEQ ID NO: 4103699 - RNA, 90 nt, Human
cucucugucucuuuauguaugugugaguguguguguauauacacacauguacauacacauauguaacguguuuuuaauuaguucagagag

SEQ ID NO: 4103700 - RNA, 85 nt, Human
cucucugugaaaauagguguguagguguuugcccagagaaaagacugcgucaaauagacuuaagcaucuguacaaaaacagaggg

SEQ ID NO: 4103701 - RNA, 60 nt, Human
cucucuucgucgcuucauuugcuagcgucaaaauuggugagcugagguaaggcaagagag

SEQ ID NO: 4103702 - RNA, 83 nt, Human
cucucuuggaacuucugcuuuuacaggcagucacacaaauuuguccagcaugacuggggugcaggcaggaguggcugaggggg

SEQ ID NO: 4103703 - RNA, 76 nt, Human
cucugaaaguuugcauagauuaagcauucaaaguagauguauugaaaaaugguuaugucuauguaagcauacaggg

SEQ ID NO: 4103704 - RNA, 62 nt, Human
cucugacagguggcauuaucucauuaucccuauuuuucagaugaggaaccuggggcucagag

SEQ ID NO: 4103705 - RNA, 77 nt, Human
cucugacccucugggauucugaguuuauuuuuagcaccaacuuggugcaaauugcuaaggaucucaugugggcaggg

SEQ ID NO: 4103706 - RNA, 95 nt, Human
cucugacuauucaguggacaggaauguucaagucucauuccacugugaugcuucuccugaacaucccuguacuucccacagaacucuuacaggag

SEQ ID NO: 4103707 - RNA, 64 nt, Human
cucugacuuuaaauacaggaugaaaugacucuuaguuuuggcguaaugccuuuaagguuuagag

SEQ ID NO: 4103708 - RNA, 71 nt, Human
cucugagaagaagcuggggccagggccuuggucugaggggaaaggcccuuccaccaguccucgacucugag

SEQ ID NO: 4103709 - RNA, 57 nt, Human
cucugagaaggguaggcuccauuucauuuaggugugaaggguccuucccuuucagag

SEQ ID NO: 4103710 - RNA, 56 nt, Human
cucugagagagcuggugagcacccccaagccccuugcaucacucucucucucaggg

SEQ ID NO: 4103711 - RNA, 64 nt, Human
cucugagaugauaccuucuggaccguucagccuggguucauagacugguguucaucagucagag

SEQ ID NO: 4103712 - RNA, 55 nt, Human
cucugagcagcggugccgaaguccagcugggcaaugugugugcugacugccagag

SEQ ID NO: 4103713 - RNA, 70 nt, Human
cucugagcgauuaaggaggcauacugauuuagucuugaccucucaagacuaaggcuucuuuaagacagag

SEQ ID NO: 4103714 - RNA, 62 nt, Human
cucugagcugccacuaagaugguucaagucuuccugacccuacuuuaguaugagcuccaggg

SEQ ID NO: 4103715 - RNA, 70 nt, Human
cucugagguccuacagugacccucucuggcaagacaagaccccagaacauauuaagguaggaccccagag

SEQ ID NO: 4103716 - RNA, 68 nt, Human
cucugaguugaggcaggagagucaucaugcuauuuaaugacaaaugcuuucaguguuucaaaauggag

SEQ ID NO: 4103717 - RNA, 81 nt, Human
cucugcaaaggcacaguugaucacuauaggcuucaguuaaaccaacuguggcuucaaggugugucacuggccaguguuaag

SEQ ID NO: 4103718 - RNA, 74 nt, Human
cucugcaccuuguaggaggcaacugcggcagcaacagaaacagcaguguacauugcaaccaccagguggcagag

SEQ ID NO: 4103719 - RNA, 55 nt, Human
cucugcagagccuccagcccaggagagaaccagggcaaaggggacaucugcaugg

SEQ ID NO: 4103720 - RNA, 55 nt, Human
cugacaccacaacuagccauugaaugagccucucaggugcugugugugguaucag

SEQ ID NO: 4103721 - RNA, 56 nt, Human
cugacagagaagcuucugccuccauuucucuuccuggagcccagcuuauuugucag

SEQ ID NO: 4103722 - RNA, 62 nt, Human
cugacagccauguuuuagagaauuugaugacucuuuuaaacucuuuagaaagaggcugccag

SEQ ID NO: 4103723 - RNA, 129 nt, Human
cugacagcccugugucuuuucaaagucaauaaguggauuuuugugccucuaauggagagagccucuucugaggaggagcaaaaacucuagaagcuuugaucucuggaaauacaggauaaaagcucucag

SEQ ID NO: 4103724 - RNA, 82 nt, Human
cugacagcugucaaguuugcauuuguuuagaaccugaaguuaucugucaguugucuaugaaauucacugcuuuagcuuucag

SEQ ID NO: 4103725 - RNA, 61 nt, Human
cugacaguaacuaauguggagauuuuccuuaucauaaagggccugcacuagaugcuggcag

SEQ ID NO: 4103726 - RNA, 88 nt, Human
cugacauauggggagucugggcuagacuccuugagggugagaaacuaugugaagcaaggucuggccaauagacagccccaaaugccag

SEQ ID NO: 4103727 - RNA, 86 nt, Human
cugacaugcugaggugaugucaaauggguuucaugaagaggaauggauuuccaaguuuuuuugacagugaccugaguaaaacacag

SEQ ID NO: 4103728 - RNA, 95 nt, Human
cugacauugcugacagagcugcugugaggaugcuuagaagccaugaauauuuuuaaaugucacagucucgugagcaucugcugugugugugucag

SEQ ID NO: 4103729 - RNA, 69 nt, Human
cugaccacuggccugguggggaccacagcaaacuagagagcacauggcccaucucaaggucacccucag

SEQ ID NO: 4103730 - RNA, 74 nt, Human
cugacccuguggcucuguggcagaggcgccuucucacaacaccgccaugccuuggccccagugccucagggcag

SEQ ID NO: 4103731 - RNA, 107 nt, Human
cugacccuuccccucuggccucucugcgugguaggacucaguucucuuaccuguuaauugggggugagaauccuucucccaccagcugggaagaggguagggagcag

SEQ ID NO: 4103732 - RNA, 62 nt, Human
cugaccgagccgcccuccacgaugucccuccagagcgggcggucagggggcugcucggccag

SEQ ID NO: 4103733 - RNA, 76 nt, Human
cugaccgccuguuccugggaggcaugggcugggcuggcugcauaccucagccagaaccucuggggacagggcucag

SEQ ID NO: 4103734 - RNA, 59 nt, Human
cugaccugagugguacaaggcauuuucuuuuguuuuagaaaccuauugcuuuagguuag

SEQ ID NO: 4103735 - RNA, 57 nt, Human
cugaccuugugaucugcccaccuuggccucccaaagugcugagauuacaagcgugag

SEQ ID NO: 4103736 - RNA, 57 nt, Human
cugaccuugugaucuucccgccuuggccucccaaagugcugggauuacaggugucag

SEQ ID NO: 4103737 - RNA, 65 nt, Human
cugacgggacaggugaggcuggggcagugcuccuggcucccccaaagccucagccugccugcaag

SEQ ID NO: 4103738 - RNA, 90 nt, Human
cugacuagaugccaagugcccugaagugauagaaaauaggcuccuugccucaaagacuauauauuuuauuuggggacuuacacuauacag

SEQ ID NO: 4103739 - RNA, 128 nt, Human
cugacuauggcggcccuaaaaacaaacauacacccaggggguuagaugccuagauuaauuuuaguaacuuaagaaaagugauuugaagaaaguaguuuagacuucaacccuuugauguccacaguuag

SEQ ID NO: 4103740 - RNA, 84 nt, Human
cugacucaugggaaaauuggguuaauuuauggaguugauucauuacacaagucuagaaugugcaccaagcucccuugagaucag

SEQ ID NO: 4103741 - RNA, 56 nt, Human
cugacuccagguuuucucucaaguuuguagaauuuuacaaaugaaccugguuuuag

SEQ ID NO: 4103742 - RNA, 63 nt, Human
cggcgcagucagacgccaucugcuguacaccucugcgcagccauuggcugccuggugcguccg

SEQ ID NO: 4103743 - RNA, 58 nt, Human
cggcgccucugaggagcccgggcgcuucguggccuggcaguguuucuaaggggcuccg

SEQ ID NO: 4103744 - RNA, 57 nt, Human
cggcgcgcuggcuggccagccccggauaggcgccgccggcagccaaucagcgugccg

SEQ ID NO: 4103745 - RNA, 70 nt, Human
cggcgcucucuucuccuggcccgcagccgggagccaaggcccgggggugggcggggaaaggggagaaacg

SEQ ID NO: 4103746 - RNA, 60 nt, Human
cggcgcugguacaguggaagagggcuguccagcccuggaugucuuucauuucuagcucug

SEQ ID NO: 4103747 - RNA, 79 nt, Human
cggcggggcggagggcgacagggcgaccgcgcgcccucugccgggacgcccgcccugcccugccccgccgccgccgccg

SEQ ID NO: 4103748 - RNA, 70 nt, Human
cggcggugggggaaaggagcgguugcccacaaaccauccgagcacagggagccgcucagacccgacgccg

SEQ ID NO: 4103749 - RNA, 65 nt, Human
cggcucgggcacccugguucugguggcugugcugacccacacucuccuccgggcugcccgggcug

SEQ ID NO: 4103750 - RNA, 70 nt, Human
cggcucuggacccuggaguggcugcaggcggcauggggcugcaagccaggcgcugggcguccgggagccg

SEQ ID NO: 4103751 - RNA, 59 nt, Human
cggcugagcagugcugauggaacagguuauucuuucuucauacaccuuuugcugagcug

SEQ ID NO: 4103752 - RNA, 68 nt, Human
cggcuuauguacacacauauauuguaccaagcuggccaaugcaauauuuauguuuguacuuugagcug

SEQ ID NO: 4103753 - RNA, 89 nt, Human
cggcuugggcugagcuggguauauggcuuuaugcugcggcgaaugcugggagccuuuagcugaggcuguggacucaguuuggccaucug

SEQ ID NO: 4103754 - RNA, 85 nt, Human
cggcuugguguuuucagaugaggaaauggagccugaggaaugcuaacuuacagauuccggucaucucuccuuaacagccaaguug

SEQ ID NO: 4103755 - RNA, 59 nt, Human
cgggaaaguuucucacacaugcagagacuugagguucugaauguuaggaaacuuucuug

SEQ ID NO: 4103756 - RNA, 69 nt, Human
cgggagaggguggguacaccagcccucaggcccaggugcggcacugugggcggcuuucagccuuucccg

SEQ ID NO: 4103757 - RNA, 110 nt, Human
cgggagauucuccucucucccugcuuuggcaggcagcuccuggagaggugcagcucccggagaggugcaggucaguggcaguggguacagacaagcuggagaguuucuug

SEQ ID NO: 4103758 - RNA, 62 nt, Human
cgggagcugcaagauaaaagugauguguuggcugggcgcgguagcucaagcuuguaaucccg

SEQ ID NO: 4103759 - RNA, 55 nt, Human
cgggaggaaaggcgaggcucugcaucuagauuuaccucguucucuuuugucuccg

SEQ ID NO: 4103760 - RNA, 73 nt, Human
cgggaggucacgacugggaugccugugcuuuagaauguguuuacgggaagggaaaaccagcgugacuucacug

SEQ ID NO: 4103761 - RNA, 59 nt, Human
cgggcacagguggagcugcugaaccugaggcucaggccucaguucucugccugugcuug

SEQ ID NO: 4103762 - RNA, 58 nt, Human
cgggcagcugccaagugcaucgcagccuugaucagcucgcggccugaccugcugcccg

SEQ ID NO: 4103763 - RNA, 76 nt, Human
cgggccacccacacagccuccucuggcucacggugcaguggcugugggggcugcgggaggcugccugguaggccug

SEQ ID NO: 4103764 - RNA, 87 nt, Human
cgggcccgcccgcgcggccgggcagcggcguggccaugguggcggcggcucgcggccugcgcugcucccgacggcggcccgggcucg

SEQ ID NO: 4103765 - RNA, 81 nt, Human
cgggcucagaggggugggcacagcgcccaggagacaguaagugugagaugaggccucugugccauccaggcaugagcacug

SEQ ID NO: 4103766 - RNA, 80 nt, Human
cggggagcugccgggcgcgcggccugcaaaccugcgaccggcuggggugauacccgggcugugcaccauccaccucccug

SEQ ID NO: 4103767 - RNA, 62 nt, Human
cggggagcugcugaacacaagggucuccugcuggagacccugaauuccuguugcacucccug

SEQ ID NO: 4103768 - RNA, 70 nt, Human
cggggcacagggagccgcaguugcagaccccgcaggagcuaucucggugccugcgcucccuguagcuuug

SEQ ID NO: 4103769 - RNA, 67 nt, Human
cggggcauugaggaggaaacaauggccugugaagcuauugaaaucccuaccucagaggccagcccug

SEQ ID NO: 4103770 - RNA, 55 nt, Human
cggggcuccgaagagcucgguucagaucccggccgccugggcuccaggagccccg

SEQ ID NO: 4103771 - RNA, 100 nt, Human
cggggggcagaugggugcggcagcagggcccccgggugcgccggggcauaucucgacucugguugcggguucugcugcgccugucacccauggccuuccg

SEQ ID NO: 4103772 - RNA, 95 nt, Human
cgggggucggggcgcauuugccaggagacaucuggagcccggcccugcuucugucgggcuccaggguaccccuggauggcugcgcugugcccucg

SEQ ID NO: 4103773 - RNA, 95 nt, Human
cgggggucggggcgcauuugccaggggacaucuggagcccggcccugcuucugucgggcuccaggguaccccuggauggcugcgcugugcccucg

SEQ ID NO: 4103774 - RNA, 87 nt, Human
cggggugguaacugacaccaccaauauguucauauugggagaaaagccacuguuggauggaaugaugguguugccagaacuacucug

SEQ ID NO: 4103775 - RNA, 66 nt, Human
cgggguucauccaugcuguggccuggaucaccgcuuccuuccuuuuuguggcuggaugauacccug

SEQ ID NO: 4103776 - RNA, 58 nt, Human
cgggucucccagaauuaccccuccccauagccagggagggggucguccggaagaccug

SEQ ID NO: 4103777 - RNA, 61 nt, Human
cggguggccaagagauaaaauugugugcauguauccauacacucuaauucuuugguccuug

SEQ ID NO: 4103778 - RNA, 56 nt, Human
cgggugggcccgucguggagcgcacuucugcgccucuaaucucgggcguccaucug

SEQ ID NO: 4103779 - RNA, 70 nt, Human
cggguggggcuggcugguagugcaguagcgccagugucgacugcuugggcggccagcauggcggggcccg

SEQ ID NO: 4103780 - RNA, 72 nt, Human
cgggugggggaucgaggcguucccgaggcgaaugaggcuguuuuucaaaauccgggaggcgccccucgcccg

SEQ ID NO: 4103781 - RNA, 68 nt, Human
cucaucuuugaaaaguuggcuacuuuuucugacacaagccaagaaaagguauuuauuuuaaagguaag

SEQ ID NO: 4103782 - RNA, 70 nt, Human
cucaugagucugucagagucaucgugggagggagaaccuuuguaaaccugaagacaguuuuacucaugag

SEQ ID NO: 4103783 - RNA, 66 nt, Human
cucaugauggacaccuccugagguucugcuuggagcaggccucuagugcauccucaagaagcugag

SEQ ID NO: 4103784 - RNA, 67 nt, Human
cucaugcaagauuuucagcuaauggugcaguuuuuagugauugcacaaacagcaaguuuuaaaugug

SEQ ID NO: 4103785 - RNA, 95 nt, Human
cucaugcacucucuccucaggcacgagccugaugagacugaugacugugcaucgugcuccuggugaggcucugcagaaguagggggggcggugag

SEQ ID NO: 4103786 - RNA, 63 nt, Human
cucaugccacguuguuuuuucucucggcucugcucagagugaaguucaucgugcagcaaugag

SEQ ID NO: 4103787 - RNA, 90 nt, Human
cucaugccauuaacauucuggcacacaaguauuuccuuuccguauguguuccuuaggaaaggcaauaguaguuccgaguguaggcuugag

SEQ ID NO: 4103788 - RNA, 65 nt, Human
cucauggaaggaugcccugcaagucccucuugaguuucuuaagauguuuuggggcccuuucagag

SEQ ID NO: 4103789 - RNA, 75 nt, Human
cucaugguugaauaugacauuuuucugcuuuucccucuaagaaguuuuugagaauguuaauguugaaguaugcag

SEQ ID NO: 4103790 - RNA, 75 nt, Human
cucauuaguacaugcucaguaacuuucaguugucaaccaugucauugaaagguuuugagcagauauuagguugag

SEQ ID NO: 4103791 - RNA, 76 nt, Human
cucauucagguaggcauuugugaggaagccagggaacuccacccuggauucuuucauaaaagucacuucauaugag

SEQ ID NO: 4103792 - RNA, 67 nt, Human
cucauucaguuucuaaaugcuccucucaaugaaaccccaaagggagaggcacugaaacaggcauggg

SEQ ID NO: 4103793 - RNA, 58 nt, Human
cucauuccuggcgcacacaguucacuuugacaucgaggggcgcucugccaggaaagag

SEQ ID NO: 4103794 - RNA, 55 nt, Human
cucauugacagguggcccugcugaccccacaggccacaggaguacugucgguggg

SEQ ID NO: 4103795 - RNA, 78 nt, Human
cucauugagaaguuccaggacaagauguuucaggaugcuacaauuuugccaugauguuuauggaugcuuuuaaaugag

SEQ ID NO: 4103796 - RNA, 67 nt, Human
cucauugcaccccagucccagcuacaccuuuccugacuccaggaagcugaggcugugggugucagag

SEQ ID NO: 4103797 - RNA, 60 nt, Human
cucauuggguauagucugugggcaggacccccucuauucaguguuucugugcccaguggg

SEQ ID NO: 4103798 - RNA, 94 nt, Human
cucauuuaagggugcaggcuucuuuguggcagugagcuggguaaauggugauuacuuuucuuugauuugcuacauaagauuugccuccuguggg

SEQ ID NO: 4103799 - RNA, 70 nt, Human
cucauuuacacacagaggugugcuggagagcuaugggccagcucaugagcaugaggaugugguaggugag

SEQ ID NO: 4103800 - RNA, 79 nt, Human
cucauuuauuacucaguuugagggguagguguuauuucauaaaagaacaaacuaugacucaagaagacugacaagugag

SEQ ID NO: 4103801 - RNA, 66 nt, Human
cucauuucuaacuacugcugcagcauuuugguaaaaaccuguagcaguuuguuacacuggggugag

SEQ ID NO: 4103802 - RNA, 105 nt, Human
cucauuugauaccuuuaugaaaaccugaauuaugccaucacuuaugcauugguguauauagcuacccaucaaguagguccuuucaagauucugguagagaaugag

SEQ ID NO: 4103803 - RNA, 97 nt, Human
cucauuuuauaggaguucgaauuugccauuguuuccugcugagcugcuaugaggaguagcagcaaggaagcgaggaugggacucugugggagaugag

SEQ ID NO: 4103804 - RNA, 79 nt, Human
cuccaacucauuauggcaucugccagggacugaccuaucguucccucuggucuggacgccauauuguaugugucuggag

SEQ ID NO: 4103805 - RNA, 66 nt, Human
cuccacacccuugcuaacacuuguuauuuuccauuuuuuuuaaacaucauuuuagugggugugaag

SEQ ID NO: 4103806 - RNA, 67 nt, Human
cuccacaugaccuagauuaacauucugugaaaugcaaauuuuauaaaauguguuuuaggaaacgggg

SEQ ID NO: 4103807 - RNA, 60 nt, Human
cuccaccagagacugcauuucucugaaauaccaauucgugauaaaagcaguguuuggcag

SEQ ID NO: 4103808 - RNA, 80 nt, Human
cuccacccugcugggaaucccguucuucgccauggguaacuauccauccuugugguaaucggauucuuaccgguuugggg

SEQ ID NO: 4103809 - RNA, 129 nt, Human
cuccacccuucccugccccgcgcuccacccaaugggaagcugaccugcauggacagcaucaauggucucccuugcccucuggcuucugguuggguuuggcaaauaacgagcacugcagggcgacuggag

SEQ ID NO: 4103810 - RNA, 71 nt, Human
cuccaccguagugcuccaacauuagugugcuuuucuaaguggguaaguuacuguugcaguaugccaaggag

SEQ ID NO: 4103811 - RNA, 77 nt, Human
cuccaccuccuaccuacacacauauccucuugaguuuuccugcuuaauuuuucucauagugugugguauagguagag

SEQ ID NO: 4103812 - RNA, 71 nt, Human
cuccaccugccugccucaugcugccugcagcccccuccuuggaggccaucagccugggguaggggugugag

SEQ ID NO: 4103813 - RNA, 79 nt, Human
cuccaccugcgcaacccucccagaugggcuugagguugggguguggccgggacccgggcggggagggguagggguggag

SEQ ID NO: 4103814 - RNA, 106 nt, Human
cuccacugagcggcuccacugggcuguuuuaucacagaauaagaagucauuaagacaagucacuuaaaaccuaugagaaacagauauggccagcugaucuaaggag

SEQ ID NO: 4103815 - RNA, 82 nt, Human
cuccacuuuugauauguuucucuuggaccugacauagcaagagagaguuccagguucagcaggaggcaucccaagggugugg

SEQ ID NO: 4103816 - RNA, 55 nt, Human
cuccagaauuguccauuggaaacacgaguucaagugccucagggagauucaggag

SEQ ID NO: 4103817 - RNA, 57 nt, Human
cuccagagauacacggucuugcagccucacuggugguuuagguugugggcuuuggag

SEQ ID NO: 4103818 - RNA, 57 nt, Human
cugcuguggccagccaggucaaaggugaggguggccuggacuagguacucauggcag

SEQ ID NO: 4103819 - RNA, 67 nt, Human
cugcuguuagagaaugacgugcaagccuccagugccauuggaagagcaugcauuuucugagagucag

SEQ ID NO: 4103820 - RNA, 57 nt, Human
cugcuguuccaccucugaaugcugggccacgucuggccuggcuucgugcagcagcag

SEQ ID NO: 4103821 - RNA, 61 nt, Human
cugcuguugugcuuggaaaggggcccggggugccggaggccucucccaggcgcggcggcag

SEQ ID NO: 4103822 - RNA, 91 nt, Human
cugcuuaagguugcugauagugucaugagugauuuucuacggaccuucuuugaaagcugucacugcagacaaccucagucauccuggagag

SEQ ID NO: 4103823 - RNA, 67 nt, Human
cugcuuagcaugauuacaugaagccagguagaaauccacuuaccuauuuaugcaauuaugaaaacgg

SEQ ID NO: 4103824 - RNA, 64 nt, Human
cugcuuaggcagcaggaauuuaaauuuauacaaacacuguguaaauccauucccgcuguaacag

SEQ ID NO: 4103825 - RNA, 86 nt, Human
cugcuuagugcccuaccauaaaugccucauuuucucucacugaaaucccgaugucaguguuugaguuugcggcauugggcgggcag

SEQ ID NO: 4103826 - RNA, 58 nt, Human
cugcuucauagcccuggucucuccuaggauccugagaccuuuggggcugagaacguag

SEQ ID NO: 4103827 - RNA, 57 nt, Human
cugcuucucaccugcuacuggagcaugcucugccugcccccgucagaggugaugcag

SEQ ID NO: 4103828 - RNA, 75 nt, Human
cugcuucucagcugugagggcugcucugggugguaugacccagcaaugugaccccugacagcaggugugaagcag

SEQ ID NO: 4103829 - RNA, 83 nt, Human
cugcuucuuguaauaucacucaugagggucaaguucuucuaguucugauccuggaaauugugggaagauguugcaggagagag

SEQ ID NO: 4103830 - RNA, 118 nt, Human
cugcuugcgaaguuuggugccacaggguugaagagcauaaaguacaucaccucuuaguuucacuguccacuuucuccuucuucagcucuuuccugcaucuuaaccucuugcucuguag

SEQ ID NO: 4103831 - RNA, 59 nt, Human
cugcuugcugccuuccucucagaccaacuguuuagcaaugaaggaauggcuuuaaguag

SEQ ID NO: 4103832 - RNA, 73 nt, Human
cugcuuggcuuggggacagaucuggaggggcaggcgggcauggagcgugugccagagguccccugccaggagg

SEQ ID NO: 4103833 - RNA, 90 nt, Human
cugcuugugucucuuuuuucaucaggucuuugaugauacaacaaccacaguacaucaauaggguuugaaagcaagagcuacaagauacag

SEQ ID NO: 4103834 - RNA, 56 nt, Human
cugcuuuaacaaggcugaucagggaaacucauccugaucaggcgaccuuugagcag

SEQ ID NO: 4103835 - RNA, 55 nt, Human
cugcuuuaaucccugccuggaagagcucauccaugaccagguggaacugagguag

SEQ ID NO: 4103836 - RNA, 61 nt, Human
cugcuuuauauugagcuugaaaaacauccgauuucaugccccuuauucaacugugaagcag

SEQ ID NO: 4103837 - RNA, 78 nt, Human
cugcuuugcaucuaauguuagauuccuccaccuaggaguauuuuuccugggagaguauuucuuauuaaagaugagcag

SEQ ID NO: 4103838 - RNA, 129 nt, Human
cugcuuuggggucugcucugagaggccuggcugugugauggagcacagcagcuuuguuggcccccaccugggagcuggcagaagagcugguucaacuccgcagugguagggcagcccccagcucagcag

SEQ ID NO: 4103839 - RNA, 56 nt, Human
cugcuuuuccccucacagcauuugccaguuuguaagcugugcaggauugaaagcag

SEQ ID NO: 4103840 - RNA, 121 nt, Human
cugcuuuuuccuuuaaugaucagguuagcaccaugauggaagagcugcuucaggaaaaugauggcucuuguagcuaacaugugugagauauaauugaggggaguagauagauaagaagcag

SEQ ID NO: 4103841 - RNA, 76 nt, Human
cuggaaaauuuccuucaaaaugugcccccagauuuauuuagcgaauugcuggaccauagguuuguaaauuuuccag

SEQ ID NO: 4103842 - RNA, 74 nt, Human
cuggaaacuuaugucaaaaugguugagauuguuagggauuuagagaucaaaucauucaaccuuuucauuuccag

SEQ ID NO: 4103843 - RNA, 63 nt, Human
cuggaaagaagcuuuagauggcuauggcacucaaugcucauaggcuuucucauuucuuucugg

SEQ ID NO: 4103844 - RNA, 80 nt, Human
cuggaaagacucaggaaaugagaggcucucuuguucugacaaggcaggcugagagcucucauuuagggucaucacuccag

SEQ ID NO: 4103845 - RNA, 56 nt, Human
cuggaaagugcugagacaauugcuauuggcauuugacucuaaauuuacuuuuccag

SEQ ID NO: 4103846 - RNA, 75 nt, Human
cuggaaaguucuauguagauaaggcugcucucuaucacuaggaucuguguugucuagguggaaaguguuuuuuag

SEQ ID NO: 4103847 - RNA, 81 nt, Human
cuggaaauaacuguacacuggccccagggcggggcugcugaaaucuagcagcccucuccuugcuagacuguaaguguccag

SEQ ID NO: 4103848 - RNA, 59 nt, Human
cuggaaaucacuacuagucaauaccuagagcacuauauagguauacagaguauuucuag

SEQ ID NO: 4103849 - RNA, 82 nt, Human
cuggaaaugagaaagaggcaaggaagaauucuccccuagagccuuuugugggagaauggccuugcaaacaccuuaauuucag

SEQ ID NO: 4103850 - RNA, 77 nt, Human
cuggaacacagggcaaugcauuguaacucacugauguauccagauacauaaacuauguaauuugcucuauguaucag

SEQ ID NO: 4103851 - RNA, 74 nt, Human
cuggaacagggaaccacagcacagcuuccuaguugagaaucuucaggaagggcucagucugugcccugucccag

SEQ ID NO: 4103852 - RNA, 77 nt, Human
cuggaaccacauuccccagaguucucuuucuuguaugguucuguauggccaugagagacauucugugugaaauccag

SEQ ID NO: 4103853 - RNA, 110 nt, Human
cuggaacgaggaccaaacuuuuuaauuauggcuuugaaguaauguaauugugguuuuuaaugccucauucaucugcuugaaggauuauaugaguuuguucaaaguucugg

SEQ ID NO: 4103854 - RNA, 67 nt, Human
cuggaacgcauuucuaccaccggggccucccagcuucugcucagcuccuggcaggcagugugugugg

SEQ ID NO: 4103855 - RNA, 79 nt, Human
cuggaagaaaacuggagaguugugaccuaguuuaacaccaguaugaugaugaaaauugcagcucugagauuucuacuag

SEQ ID NO: 4103856 - RNA, 57 nt, Human
cuggaagagugacuuugcauuuacucuuuguuucugacugugaugucucuccuccag

SEQ ID NO: 4103857 - RNA, 80 nt, Human
cuggaagcugguuagaaaugcagaaucuuggacccaacccagacccguggaucagaaucuucauuuucaguggaucccag

SEQ ID NO: 4103858 - RNA, 78 nt, Human
cuggaaggcaaggagggaagccaccucucucuggaguucucagggacuaauggaggcucuccuggccuugucuuccgg

SEQ ID NO: 4103859 - RNA, 89 nt, Human
cuggaaggguagaauuguugucuagaucagcacaggaauuucuggacucccugugccaaaaucuaggcagucugaauggacuuguccag

SEQ ID NO: 4103860 - RNA, 55 nt, Human
cuggaaucaguuucuuggcaaguuuaaauguuaggcuggagagauuagauuucag

SEQ ID NO: 4103861 - RNA, 70 nt, Human
cuggaauguauguaucuuaagaugcuuucuugaaagacagguaaaaugaccuuagggacaugaauucuag

SEQ ID NO: 4103862 - RNA, 106 nt, Human
cuggaauguuuggugacugugaugcuuuucucagugaaguuuagaacauguuauugaacauuuuucucuuuccacugagauuucauagacauacagaaauauccag

SEQ ID NO: 4103863 - RNA, 85 nt, Human
cuggacaaaagaucucugagaaauuucuuugugaugugcgcauucaucucacagaguugaacuuucuuuugauugagcaguccgg

SEQ ID NO: 4103864 - RNA, 76 nt, Human
cuggacaaugagggagcugaccuuucugugcucaauaaaccaauugccacuagagaguagguucccuggugaccag

SEQ ID NO: 4103865 - RNA, 77 nt, Human
cuggacaccuacuuugugcagauuuuagaugcuugggacucagcagugaaagucucuguuauagagaaggaaaacag

SEQ ID NO: 4103866 - RNA, 75 nt, Human
cuggacaguguuuucaaugcuucucauuagccaaugaguaauaaauguacccaguuuugagaaguauauugccag

SEQ ID NO: 4103867 - RNA, 62 nt, Human
cuggacaguucacauucacuuuccuuguaccuagcagggaaacuuguuauuguauuuuccag

SEQ ID NO: 4103868 - RNA, 81 nt, Human
cuggacaguuuccacucuccagucaauuucaguucugagauucacuacugguauggccuggagaaugcagacccuguccag

SEQ ID NO: 4103869 - RNA, 66 nt, Human
cucucacuuuccuccuucauccuucuaaacucacccuaccaggaggugccaacugagagcugagag

SEQ ID NO: 4103870 - RNA, 61 nt, Human
cucucagacugaagggccugugggucugugggaaggcugcucaggagcccuggauuggggg

SEQ ID NO: 4103871 - RNA, 55 nt, Human
cucucagcaaggaaagaggcagggaacagguucuaccucacagcuuuguuaagag

SEQ ID NO: 4103872 - RNA, 78 nt, Human
cucucagcagcagccacuguguccagagaaacucacagcucgggacugagccucgggaugguggccugugcuugagag

SEQ ID NO: 4103873 - RNA, 115 nt, Human
cucucagcuaccuugucacuccaccaauuaagauuuucaacaucuggagcaagauuaagagauguauauccauuguugaccuguuccagaugcagaaaugaugguaguugcugag

SEQ ID NO: 4103874 - RNA, 107 nt, Human
cucucagcuaucccuguauagcuccaguccuguucauguucucucucaccagcaguacaucugugcugugaggauguuaaggggaugagugaagagggguuugagag

SEQ ID NO: 4103875 - RNA, 91 nt, Human
cucucaugacauuugaguuacuuaguacugaaugcauuuugugauguauucagaaaaugcauuucacuaauguuucccuaauucauggggg

SEQ ID NO: 4103876 - RNA, 57 nt, Human
cucucauguaguaucuguauggccucccagugcagucaguguugacuacaugcagag

SEQ ID NO: 4103877 - RNA, 130 nt, Human
cucuccaaagggaauaagagggcugcuuggaccagaagcuucuacacaggagaacccagaagcaaaacaaauaaagaauguggucccugcuaagagucuuuuggcauccaucagccuacugucuugagag

SEQ ID NO: 4103878 - RNA, 56 nt, Human
cucuccacucagcgucauguccuauuuucagaugcauggcagacacucguggaggg

SEQ ID NO: 4103879 - RNA, 58 nt, Human
cucuccaggagagcacuuugagauaugaaaagaccaugugugugugcuccuuguagag

SEQ ID NO: 4103880 - RNA, 71 nt, Human
cucuccaguccucaucucaaaacccaaggggcaguuuaaucugucucuguaguuugagagagcagggagag

SEQ ID NO: 4103881 - RNA, 63 nt, Human
cucuccaucugugugaccucccccauuugaggcugaaaauuuggggagaagggcugaugagag

SEQ ID NO: 4103882 - RNA, 56 nt, Human
cucucccauggcuuucccucaagagcaagaaauucuuugacaagagucaggaagag

SEQ ID NO: 4103883 - RNA, 82 nt, Human
cucuccccacgaaagaacaguguccugggacucggggugcggggcagccggguucgcuggagcuguucagugcggggaagag

SEQ ID NO: 4103884 - RNA, 78 nt, Human
cucucccccaguuucuuccucccccagagacccuaugaucuccuccauuuucacagaggaggaagcugaggcacaggg

SEQ ID NO: 4103885 - RNA, 56 nt, Human
cucucccuaugccucccaggagcaucugaugauggaacugcugggagaggggaggg

SEQ ID NO: 4103886 - RNA, 61 nt, Human
cucuccggaugccuuuguucaggguucucacugcacagccacacacagcaggcccggaggg

SEQ ID NO: 4103887 - RNA, 57 nt, Human
cucuccucaccaccagcagcagaccccaaauucagaggguuuggguagagaagagag

SEQ ID NO: 4103888 - RNA, 62 nt, Human
cucucgacagccuggcacaguggcauuccggugugugcuacccgugccuggcuggugaagag

SEQ ID NO: 4103889 - RNA, 87 nt, Human
cucucuacuaaaagauucaaggcuaaauucuguacugcauguaccaaguaaaauaugcaagcagauguggucaucuuggugugaaag

SEQ ID NO: 4103890 - RNA, 95 nt, Human
cucucuccuuguuuauguuccugugggguuaacccugacuagaaaagugcaggacauucugccaucacguguagagggaacaucggggaagagag

SEQ ID NO: 4103891 - RNA, 79 nt, Human
cucucucguuuucucccugcccaccgugugcacgugcgugcgcgcgcgggcgugcgagcguguggguuucucgggagag

SEQ ID NO: 4103892 - RNA, 106 nt, Human
cuaugagaaugcugggaaccaagaaacaagcccaaggaugggagguugaaaauguaaaauuagucuccagcuuaggguuuggguuguuucucuagcaccucaaugg

SEQ ID NO: 4103893 - RNA, 126 nt, Human
cuaugcaguccaacuuugggggacauucacacuauggccuucugaauggcuguguaugcucaacuccaaugggcaucauucagauagacugcaaugugaauuuauccccagaauugugcaacaugg

SEQ ID NO: 4103894 - RNA, 111 nt, Human
cuaugccacugaagggcauucaucacaucaugauguuuagugcuacuuuuccuaacgaaauacagaugcuugcucgugacuuuuuggaugaauauaucuuuuuggcuguag

SEQ ID NO: 4103895 - RNA, 63 nt, Human
cuaugccugacccucauccuauaccaaauaaauuaaauaaugguagaugggguccaggcauag

SEQ ID NO: 4103896 - RNA, 81 nt, Human
cuaugcuacucugaccaaagaguugcuuguauucggcccucuaguggaugagacguguaauuuuuaugguaaggugcagag

SEQ ID NO: 4103897 - RNA, 116 nt, Human
cuauggacuuuagcagaggaaugcagccaccagcagaaaaggggccagagggauaaauaccuggaccucacugucugcugguacaaucuguugcauggcauuuuggugaacuguag

SEQ ID NO: 4103898 - RNA, 77 nt, Human
cuauggcagucaauauuucaauaacccauuuucacuagaagauagggcauccuuuauugagauuugcaugacuaugg

SEQ ID NO: 4103899 - RNA, 82 nt, Human
cuauggcucaggggcugagagcagggacuugagccagacugaggcccaguccuggcccugccacucacugcugagucccuag

SEQ ID NO: 4103900 - RNA, 85 nt, Human
cuauggcuccaaggcuccggcccuggcgucugggcucggucggggacaguuuccacgcgaggcggagccuagcuggaggucacag

SEQ ID NO: 4103901 - RNA, 62 nt, Human
cuauggcugauuucauuuguuucccagaagaugagcugaagacacauaggagcagcuauugg

SEQ ID NO: 4103902 - RNA, 79 nt, Human
cuauggugccugagcuugggcuuuaggaccacacuguguggcuuuacuccuggaucuacucucaauugggcaacuaugg

SEQ ID NO: 4103903 - RNA, 100 nt, Human
cuaugguuuucuuccacauuaaaaaagccuuaauaagauguuuuucagcuaugauguucuuacauuacucaugaauuuaauuguuagaggaaugccauag

SEQ ID NO: 4103904 - RNA, 82 nt, Human
cuauguaaaauggcaagcugaacucagaagacaggguauucacgguccuauuuaguuucaggauucauuuccauuuccaugg

SEQ ID NO: 4103905 - RNA, 119 nt, Human
cuauguagaauuaaucuuuauucuuuaacugugccuagcagaguaucuugcaaauuagggaacguuuuuggaaacaagguaacuuugcaaggcuuggaagaugaguagaguuugcauag

SEQ ID NO: 4103906 - RNA, 84 nt, Human
cuauguagagugcuuucuguuuccuguaguacuugacuuggaugauaccagagauagaugcaggaaacagaggcucaaauaugg

SEQ ID NO: 4103907 - RNA, 72 nt, Human
cuauguugaaauccucacccccagaaugaugguaucagaaggugaggucuuugggaggugauucauuuaugg

SEQ ID NO: 4103908 - RNA, 70 nt, Human
cuauuaugcgguaacaguugugggauguuggucaacuuauuacaguuacugguacuguuaacuauaauag

SEQ ID NO: 4103909 - RNA, 91 nt, Human
cuauuauuuguucuugggagauauuguucuuuacauuuauacauuuacuuauauuuguuggaaggacagaucaccucaagaagaguaaaag

SEQ ID NO: 4103910 - RNA, 60 nt, Human
cuauucaagcagagacuagauagcugucaguaaaggaugcuagagagauuucugcuuuag

SEQ ID NO: 4103911 - RNA, 62 nt, Human
cuauucauuaauuuccaggcacugugcugggaaacagcauagagcaggaaguuaagagauag

SEQ ID NO: 4103912 - RNA, 122 nt, Human
cuauucuaucaaugcuacacauaauaggauuaacugauauugaaaaacaucagguuauauuuugauucuaugauguaagagauacacuugauuuuaauuaguuggcauuuagugauaaauag

SEQ ID NO: 4103913 - RNA, 95 nt, Human
cuauugcauucuucagcaaacuauuucuaggacaaaguacuaggaaucugacauaaaguacacuguuccugaaauuguuaugauagaugcuuugg

SEQ ID NO: 4103914 - RNA, 63 nt, Human
cuauugcucuuaggugccuagugcuugauauguggaagaugaucagcacauguaagaguaaag

SEQ ID NO: 4103915 - RNA, 55 nt, Human
cuauuguaguaagggaaagccaugcuggucaggcaggcuuuucugaguauaguag

SEQ ID NO: 4103916 - RNA, 82 nt, Human
cuauuguuauuauacagucauuuuggcugcugucuucauuauaacuaugcaagccaaguuggaagacugaauaaugaauuag

SEQ ID NO: 4103917 - RNA, 62 nt, Human
cuauuucccagggccugggauuugaguuuucccugcacucaaguccuuuucccuacaaauag

SEQ ID NO: 4103918 - RNA, 80 nt, Human
cuauuuguaaaguaagaggcuuguauucauugauuccugugguucuuuggaaugcuagcauucuauuaauuuauaacuag

SEQ ID NO: 4103919 - RNA, 65 nt, Human
cuauuugucucauaaguaaucugucacauucauuuuaaguugaaguguggauaugugacaggugg

SEQ ID NO: 4103920 - RNA, 57 nt, Human
cuauuuuaagaggccauuagguguccauugggaucaauuaauggccucuuggaaugg

SEQ ID NO: 4103921 - RNA, 82 nt, Human
cucaaaccaucaaggagccaaacauauugagagagauugaguuuucuuuccccuacauuugguuaaagacaugggcuuugag

SEQ ID NO: 4103922 - RNA, 67 nt, Human
cucaaaguagaugcaaacuuguguacaugacacagacacgugugcacacacucugcauauacuuggg

SEQ ID NO: 4103923 - RNA, 59 nt, Human
cucaaaguuuuugagaauuacaugacauaaugcauguaaauugcucaguaaacuuuugg

SEQ ID NO: 4103924 - RNA, 63 nt, Human
cucaaauauguggucagaaagccaggugcgugcccaggcauuuguaauaaccgcguaaguggg

SEQ ID NO: 4103925 - RNA, 93 nt, Human
cucaaaugcaagucaccuucuucaaaacaacacuggccuggauuccuagugcuuugagcguuugaaaagggguggcuuggcccauugauugag

SEQ ID NO: 4103926 - RNA, 57 nt, Human
cucaacauccccuucaugucaugauccuugcauggauuuuuucaaggggcugcugag

SEQ ID NO: 4103927 - RNA, 63 nt, Human
cuggacaucagugugccuggcuggguccuaguggacaaggccucugcuuaugcugaugacugg

SEQ ID NO: 4103928 - RNA, 62 nt, Human
cuggacgacgcccugccuggcugagcugcccugggagcugucaacacgggugugcgugcugg

SEQ ID NO: 4103929 - RNA, 70 nt, Human
cuggacugugucucuguguccuucuggggcuccaggacgucugggccaccuggacucagagccaggccag

SEQ ID NO: 4103930 - RNA, 62 nt, Human
cuggacuuuggcccaucugccagcucugagucagcuggcaggaaaaagggccagaggcucag

SEQ ID NO: 4103931 - RNA, 63 nt, Human
cuggagaacagagcuguuuagacuuuucugcaugaugagaacuuagcaguuguugauuuccag

SEQ ID NO: 4103932 - RNA, 62 nt, Human
cuggagacucugcaucugugacagcuauuaggcaguaauuaguugugacacagaauuaccag

SEQ ID NO: 4103933 - RNA, 73 nt, Human
cuggagaggcagcaggcugaggaggauuggaaucaucacccaaccgccugacccaccuguggcuuuuagucag

SEQ ID NO: 4103934 - RNA, 69 nt, Human
cuggagaucugguuaaaaugcagauucaguagguggggccugggagucugcauuucuaacaaaucccag

SEQ ID NO: 4103935 - RNA, 89 nt, Human
cuggagaugaccugagagaagcuugugccggccacucaugccacuguggccuucgaaaacccagcuguuucccgugucauacccuccag

SEQ ID NO: 4103936 - RNA, 61 nt, Human
cuggagccagccagggcccucugugcaggggccuacugcaagagcccaacgcugugcccag

SEQ ID NO: 4103937 - RNA, 55 nt, Human
cuggagccuagguugaccugggugaaggaaaauacccaacugcagugggcuccag

SEQ ID NO: 4103938 - RNA, 75 nt, Human
cuggagccugggaaguucaagaucaaggcacugacggaauuggugucuggggauggucuacuuucugguucauag

SEQ ID NO: 4103939 - RNA, 55 nt, Human
cuggagcuaauaauccaucugaauaugaagaaucagaaggauuucaucaguccag

SEQ ID NO: 4103940 - RNA, 66 nt, Human
cuggagcuggcccaggcuggccuccccugcagacaggccgcgucuagggccagcugcucaucccag

SEQ ID NO: 4103941 - RNA, 63 nt, Human
cuggagcuguuuuuucaggaaaucagucccuacugccucucuuccuggagcacagcuauccag

SEQ ID NO: 4103942 - RNA, 70 nt, Human
cuggaggaaucuggcuauuucuggucggggcgcgcccgcuggcccgggccaggguuggccaguccuccgg

SEQ ID NO: 4103943 - RNA, 79 nt, Human
cuggaggaccaggcaagcugaggcgggggccaaguggguaguucggggccaacccccaucagcggccaauggccucuag

SEQ ID NO: 4103944 - RNA, 66 nt, Human
cuggaggcauuaauuauuaccaguuuugaaaagaacuuugcuugguguguacauuuuugcuucugg

SEQ ID NO: 4103945 - RNA, 99 nt, Human
cuggagggauuuuuggaucccuggccacgaagcugcccaggguagcuggggccugggcgcuuucugggucagggcuggagaaggaggcauuuguuccag

SEQ ID NO: 4103946 - RNA, 67 nt, Human
cuggagucaggagccccuucugcgucucuucccuccccuucaagggcagugggcugcugcgcuccag

SEQ ID NO: 4103947 - RNA, 58 nt, Human
cuggaguggccggugcuguggcccacacauuagggagucugcucuggcucaccuccag

SEQ ID NO: 4103948 - RNA, 79 nt, Human
cuggaguugucuauccagagggcauuccaagcagaacuaguaauggcacugaagcuggaaagccugaggcaaagaccag

SEQ ID NO: 4103949 - RNA, 70 nt, Human
cuggauaauuuggguuguggaccccccugaaauaucgucuugaguuaucucuaucaccuaaauuaaacag

SEQ ID NO: 4103950 - RNA, 123 nt, Human
cuggauaauuuuagggugguaaagagagaaugcauguaggcacucuaaagccucgguggcuguucccugcugccgcuacaggagcugucacaugcuuuuauaacucugccuccuuaaguucag

SEQ ID NO: 4103951 - RNA, 68 nt, Human
cuggauagaagcugugaaauagauuacacagugguuggugguaugaguuccucagcuucaguguccag

SEQ ID NO: 4103952 - RNA, 57 nt, Human
cuggauauguugcaacauuucccacuaauuacuuggugacuggugucagauguccag

SEQ ID NO: 4103953 - RNA, 56 nt, Human
cuggauccaacagaguuggguucaaaucucagcugaauguaacacuauugggccag

SEQ ID NO: 4103954 - RNA, 96 nt, Human
cuggaucccugguguucagacaggcagcugggcugggagaucacugcaccuucccaugcagccugucugagauggcaucuuuucagggugaaccag

SEQ ID NO: 4103955 - RNA, 67 nt, Human
cuggaugacggaugcagauuagcucugguucuaaagaguuacaacugagugcauuuaguacaucuag

SEQ ID NO: 4103956 - RNA, 62 nt, Human
cuggaugcucacuucugcaggguucaaggauuugcauuaggaaacccugagaggugguccgg

SEQ ID NO: 4103957 - RNA, 84 nt, Human
cuggauggccacucccuguugucaccccaugaucugggugagauccaggauugcaggugcacaacugcccagagagagguccag

SEQ ID NO: 4103958 - RNA, 59 nt, Human
cuggaugugcuauauacagugcagcuaaugucugaggcugcugaaguguggcaaucuag

SEQ ID NO: 4103959 - RNA, 70 nt, Human
cuggauguugaggugcugugcaggaggcagaaugagcuuugcuucaaggccaagacaccuuaaggucaag

SEQ ID NO: 4103960 - RNA, 73 nt, Human
cuggauguugcggggcagaggcuuggauuaggaagccgugucgaggccuggugugccggaugcagcaucucag

SEQ ID NO: 4103961 - RNA, 59 nt, Human
cuggauuauagaacaugcauuugacuguaacauguuuaaaugcauguagaauaauagag

SEQ ID NO: 4103962 - RNA, 63 nt, Human
cuggauucggcugcagaaguacuuccggaugaguucccggcuggaggccgccugcagcuccag

SEQ ID NO: 4103963 - RNA, 90 nt, Human
cuggauugucaaaaaguagucauuucuguuuuacaugauuagcuaaaacagccgacucauggcuuuuuggaaacaacacucuuccuccag

SEQ ID NO: 4103964 - RNA, 129 nt, Human
cuggcaaacguguuccuucucucauaauucuuagcuucucuacagguguccaguguucuauggcugccccuacucuuugcagucucagccacacagaccuaugaaaagcugcuauucuggaguccccag

SEQ ID NO: 4103965 - RNA, 87 nt, Human
cuggcaagaguaaaaguacaaucuuucuguaaaggcaauuuggaaugugaaucaaaagccuuaaaauugugcuucucuuugauccag

SEQ ID NO: 4103966 - RNA, 61 nt, Human
cuggcaagaguugaagcuccaggauagaucugauccauuggagcuguaacuuucaugaaag

SEQ ID NO: 4103967 - RNA, 68 nt, Human
cuggcaaggcuggagguuuguugcggcuggauuucuaauagcuagggacagauaccagccaguggcag

SEQ ID NO: 4103968 - RNA, 97 nt, Human
cuggcaauuugggguugucugccaccuacagugcuugucagucacccucacucggugccaggccacaaggcuguuggucacaaaccaccccagccag

SEQ ID NO: 4103969 - RNA, 66 nt, Human
cuggcacacagaggcccucgggaaauguggaaugaaagaauaaacccagacagcccuugugcacag

SEQ ID NO: 4103970 - RNA, 67 nt, Human
cuggcagaccaggaaggguuucugggauaugucugucuccuaaaccauccugguaccaaccuguuag

SEQ ID NO: 4103971 - RNA, 75 nt, Human
cuggcagacccucuucuauuggugggaaccaugucucaugggcacucacaguuacaagggagucugaaacaccag

SEQ ID NO: 4103972 - RNA, 65 nt, Human
cuggcagauagccacgccugucaaggaaaguauacuccaagcggucaggcuggggcugcugccag

SEQ ID NO: 4103973 - RNA, 84 nt, Human
cuggcagccucucccucccuggggcuguagggaaugcuccccucacuggccagccaggggugggguucaaaugggggaagccag

SEQ ID NO: 4103974 - RNA, 57 nt, Human
cuggcaggaaggagacucagccccugcauggcggggcugguuguccuuugugcucag

SEQ ID NO: 4103975 - RNA, 63 nt, Human
cuggcagggaugguggagguugcaaguuggagguuggcuucacccaucaucuccucuaaccag

SEQ ID NO: 4103976 - RNA, 60 nt, Human
cuggcagggcucuuugggugcuggaugcagcaaauucuacaccuagggaugcucuuccag

SEQ ID NO: 4103977 - RNA, 67 nt, Human
cuggcagguggauggggacucccaggcuccccacgcuggguggcaucucccaucacgccugugccag

SEQ ID NO: 4103978 - RNA, 84 nt, Human
cuggcaucagacugcaucugaaacaugggucaacauaugugcaugacugagcauguuuccuuaggccugcagcucugcugccag

SEQ ID NO: 4103979 - RNA, 65 nt, Human
cuggcauggggcuuuccaagcuuaauuagcucauguuuguaaaguucuuaggaagcucaggccag

SEQ ID NO: 4103980 - RNA, 65 nt, Human
cuggcauuaaaagaucuguguuaacucaaggaagguggcuccauucccagguuugauugagccag

SEQ ID NO: 4103981 - RNA, 55 nt, Human
cuggccaaaaaaucacuuuuauaggcagcugagguagaguugugugauuugccag

SEQ ID NO: 4103982 - RNA, 63 nt, Human
cuggccaauccauuaauuuguuaauauuuauauuaaugaguuuaggauuuaugguuuggcuag

SEQ ID NO: 4103983 - RNA, 71 nt, Human
cuggccaggcccggcccgggcuggugcggcugcgcacugcagcccagcggagcgggcccgggaggagccgg

SEQ ID NO: 4103984 - RNA, 83 nt, Human
cuggccaggccggccuguugccagcugaaugggucccaggcuuggaaguacucaccccagcuggcagcccuggcccugcccag

SEQ ID NO: 4103985 - RNA, 64 nt, Human
cuggccaguccccagaaacaacgaggcucuguggacugggaagggcugcuggggguuggcacag

SEQ ID NO: 4103986 - RNA, 72 nt, Human
cuggccccagcagguauuagagagccugaaagauuaccucuguuucucuccccuacucuaaaucugcacuag

SEQ ID NO: 4103987 - RNA, 83 nt, Human
cuggcccuccccacugggccuccucuuuccuuaccucacugagagggagccggagggccacuggcaggaugauggggggccag

SEQ ID NO: 4103988 - RNA, 60 nt, Human
cuggcccugcagaacuagccugggcaucagagcccaccagaggugacugccagcggccag

SEQ ID NO: 4103989 - RNA, 97 nt, Human
cuggcccuuccugccauacccagcugcagucaucuucuagaaagcuucccccugcugcuucuggaaaucagcagagggugggcaagggggaagucag

SEQ ID NO: 4103990 - RNA, 89 nt, Human
cuggccuagacuucagguggggcagcugugggcaggggauggcuugucuuguccaucuaaguauccagccugacacaugacuaguucag

SEQ ID NO: 4103991 - RNA, 58 nt, Human
cuggccucacagaggcuaagccaugaaacauuuauguggagugguuuuuggagggcag

SEQ ID NO: 4103992 - RNA, 63 nt, Human
cuggccucugugggagcugagcaugggaagcuucacugagcaaaugcuuuguaccuuagguag

SEQ ID NO: 4103993 - RNA, 55 nt, Human
cuggccugaggccgccuucagaugccuucuuccuagugccauaacuucaggccag

SEQ ID NO: 4103994 - RNA, 101 nt, Human
cuggccugcagguaccauguggcuguggcauugccgaggcuggcgagcuccaagagcagcucagggcacugcgcagcaggcaugaggcccgcgagacccag

SEQ ID NO: 4103995 - RNA, 62 nt, Human
cuggccugugugccuuuaccgugcuugcgucuucaugcugagcauccagcagguacugccag

SEQ ID NO: 4103996 - RNA, 77 nt, Human
cuggccuuaaagauacggagaugaagacagcccagcucugguccucgggcagcucaccucugguccagggagggcag

SEQ ID NO: 4103997 - RNA, 56 nt, Human
cuggccuuuagccccagugucucuucaaaggaagagacgcuuuuauaaagacucag

SEQ ID NO: 4103998 - RNA, 63 nt, Human
cuggcgcauguguguucaaugucuguuaaacaggugaguagacaaaugaacaaauaugugaag

SEQ ID NO: 4103999 - RNA, 60 nt, Human
cugauuucaaauggugcuagauacaaagauggaaaaaucuaagccaccaugugaaaccag

SEQ ID NO: 4104000 - RNA, 67 nt, Human
cugauuugguaaguaugaaugcaguagacaaaaaucucuguucuuaaagcauucuugcuaaugucag

SEQ ID NO: 4104001 - RNA, 57 nt, Human
cugcaaaucaaguucuuauaaucccauucuccuaggggaaacuaauuugauuuguag

SEQ ID NO: 4104002 - RNA, 66 nt, Human
cugcaaaugaauaagacucugcuagaaauucaguagcuuaaugaauuuuuauggucuuauuugcag

SEQ ID NO: 4104003 - RNA, 68 nt, Human
cugcaaaugacugcagugugauacucccuugguuccauggagugucacuugaugcagggcauuugaag

SEQ ID NO: 4104004 - RNA, 65 nt, Human
cugcaacucuaguccagggcugucuccacugugaaacagcuuccugaugcaagagggcuuugcag

SEQ ID NO: 4104005 - RNA, 96 nt, Human
cugcaagcagccagggucagagacagggcuugguucugcuuccuggugaagcauggcuucggggugcugccucucccucccuguuugaaucugcag

SEQ ID NO: 4104006 - RNA, 67 nt, Human
cugcaagccaaugagagugaucugggaggaaacuaacacugccagcaccuugaucuuggacuuccag

SEQ ID NO: 4104007 - RNA, 60 nt, Human
cugcaagccagggagagaugccucaggagaaaccaaaccugcugcucuuugggcuuccag

SEQ ID NO: 4104008 - RNA, 61 nt, Human
cugcaaggaaaauguugcaugcugaccuaauagauaauagcacaaaguguuuuccuuguag

SEQ ID NO: 4104009 - RNA, 67 nt, Human
cugcaaggcaagaaaagaggucucaccagaaacagucucugcuagcaccuugcucuuggccuuccag

SEQ ID NO: 4104010 - RNA, 55 nt, Human
cugcaaggcuggggugagcuggcacccaaauuuagcucauacuccagucuagcag

SEQ ID NO: 4104011 - RNA, 100 nt, Human
cugcaagguuguuaugcugaauaggggucccaaagauauccauguacuaaucuuuggaaucuuugaauguuaccuuauacggcaaaaagggacuuggcag

SEQ ID NO: 4104012 - RNA, 55 nt, Human
cugcaccauccuucaugcucuggacccuggguccgugcaugacuucauggagcag

SEQ ID NO: 4104013 - RNA, 66 nt, Human
cugcacccccagggaugcuuucccaggacucuuucagucuuuuaugugagcauccacugaggucag

SEQ ID NO: 4104014 - RNA, 72 nt, Human
cugcacuaauugagaaugcaaucuacuauggcaccuauuugcugauuuuuggagcauuuuuaauuuauguag

SEQ ID NO: 4104015 - RNA, 61 nt, Human
cugcacucaguacuuuauguauaugaucuuauuagauccuuacaauagcacugagaagcag

SEQ ID NO: 4104016 - RNA, 68 nt, Human
cugcagaaagccaccuuacacaggagccaggaugcuaaaggcuguccaucagaaaggggcuuauguag

SEQ ID NO: 4104017 - RNA, 57 nt, Human
cugcagaauagaaauggcacagagaccugcugcugugcuggagagcuaguucugcag

SEQ ID NO: 4104018 - RNA, 73 nt, Human
cugcagaauggggccaaguggaucauuauuuucaccaguugaaggagucagauccggcauggugucauggcag

SEQ ID NO: 4104019 - RNA, 67 nt, Human
cugcagagcaugaggaggucugaugaugaguaaaacguccuggaaauagaccuguucaguuaaguag

SEQ ID NO: 4104020 - RNA, 93 nt, Human
cugcagagccaagcagaaagcagguucccauuucuacagcagccuuuaucgcacugcauuguaauugcuuguuuaccugcuggcucaccgcag

SEQ ID NO: 4104021 - RNA, 73 nt, Human
cugcagaggaggcgguauacacugcacacccucccaaguccaugcagugccccgugcuguccuccucccacag

SEQ ID NO: 4104022 - RNA, 55 nt, Human
cugcagaggcacuccgugugcugaaacagcugaaucacaagaggaguucccugag

SEQ ID NO: 4104023 - RNA, 62 nt, Human
cugcagaugcuccccaagccaggaccuggaugaacuugaaccaguuccaggcagcaacugag

SEQ ID NO: 4104024 - RNA, 58 nt, Human
cugcagaugguauuguucugguucucgagaaggaauccaagauaaaggcugucugggg

SEQ ID NO: 4104025 - RNA, 80 nt, Human
cugcagauguaauggaacuguggauggauguuugaacagauuccuauuguuaaacauugcuccacggguuacauagagag

SEQ ID NO: 4104026 - RNA, 126 nt, Human
cugcagcaugggguacccuccugguggcucugaacauggggaggagucaccggucauuuccaggcagggucccuccuuguuugugagccuuguucaugugccagaguggguccccucuugcagcag

SEQ ID NO: 4104027 - RNA, 68 nt, Human
cugcagccccuggagauggcuugguggagaauaucccuacaccagccagccacaguggcuccuagcag

SEQ ID NO: 4104028 - RNA, 69 nt, Human
cugcagccucgaccuccccaggcucaggugauccucccaccucagccucccgaguaguugagacuacag

SEQ ID NO: 4104029 - RNA, 62 nt, Human
cugcagcugcucauguuacuugugggaguggaauagccaggaguugcuaaaugcggcuucag

SEQ ID NO: 4104030 - RNA, 60 nt, Human
cugcaggauucucccaguuggacguucuguuaaauugcuccaugggaagcauccucgcgg

SEQ ID NO: 4104031 - RNA, 60 nt, Human
cugcaggcagcugaaaggugccuuagacugcuggggagacaagaaguagccugcuugcag

SEQ ID NO: 4104032 - RNA, 55 nt, Human
cugcaggcaucuaacugugggccagagagggccuggaccaggaugguggcugcag

SEQ ID NO: 4104033 - RNA, 67 nt, Human
cugcaggccuccccugcuggagcugcaggcugucccuucccugagccccggugagggaguccugugg

SEQ ID NO: 4104034 - RNA, 56 nt, Human
cugcaggcucccagggagggauucccagucagaagcccaccuuguuaguccugugg

SEQ ID NO: 4104035 - RNA, 65 nt, Human
cugcagguggccuccagggcauagguggggcaaacccuacccuguuggggcccuggggccuguag

SEQ ID NO: 4104036 - RNA, 59 nt, Human
cugcaggugucuccagggcaggucugcucccacagauuccgugaccaugacaccugcag

SEQ ID NO: 4104037 - RNA, 60 nt, Human
cugcagguuggccuucuccugguuuagcugcaacugaagcuucugguucaggucaagcag

SEQ ID NO: 4104038 - RNA, 60 nt, Human
cugcagucagcuuuuaagaucuucuaucaaaaauagcugauugguaaaagugauugacag

SEQ ID NO: 4104039 - RNA, 76 nt, Human
cugcagugcucagccacugaacuccuggcuauguagucagaaagacaucauguccagggcuuuagcggggcugcag

SEQ ID NO: 4104040 - RNA, 104 nt, Human
cugcagugucaugcucuguccugucuucaggaccuggaauuuuggggucugagugacaccagcauucacuggaccugcagagaagaacaaagcugaugcugcag

SEQ ID NO: 4104041 - RNA, 69 nt, Human
cugcauaaguggggcuauugagcccugauggccaccgggagccacaguagcagcuacuuuauggggcag

SEQ ID NO: 4104042 - RNA, 78 nt, Human
cugcauaucauacaaauauaugcauguguguauauuuauguguuguguguguacauacauguauguguguauuuacag

SEQ ID NO: 4104043 - RNA, 58 nt, Human
cugcaucacuggccaaggguguaaccaaauccucauccaauguggucaugugugucag

SEQ ID NO: 4104044 - RNA, 62 nt, Human
cugcaucagcuucacccagaguuguagaccuuacugcugucagcagcuacuuggagcagcag

SEQ ID NO: 4104045 - RNA, 59 nt, Human
cuguauuucuaggaugauggcuacuuaaaaugggguggcucaccuucagaauauaccag

SEQ ID NO: 4104046 - RNA, 88 nt, Human
cuguauuugcuuuuuaagaauggguuauggcugggagggaugugugaagcugcccccagagcauaacguaucuugaagguuaaaucag

SEQ ID NO: 4104047 - RNA, 130 nt, Human
cuguauuugugcugaccugggccuccuggccucgcugcugucgccgagcugcaugcugguccucaacgcccgcaacgacgaugcgcugcggcagcuggaggccgagcugggcgccgggcggucugacuug

SEQ ID NO: 4104048 - RNA, 76 nt, Human
cugucaaguugacaugugcugucucuuaaauuacucuucgguaugagaagcaaaguugcauguuuauuuuugucag

SEQ ID NO: 4104049 - RNA, 103 nt, Human
cugucaaugaccugggcaucugugaugagggccugguggcugugccggcugcucagcagauacgcagggcaugggcccugucugcaggugccauucgugacag

SEQ ID NO: 4104050 - RNA, 67 nt, Human
cugucaauguucuugguauauccuuucuggucuugccuuguagaagauagccagguacauugaagag

SEQ ID NO: 4104051 - RNA, 68 nt, Human
cugucacauccauuuugcaaguauuucagacuaacguuuaaaguaaacugggaagggaaguaggccag

SEQ ID NO: 4104052 - RNA, 67 nt, Human
cugucacccaggcugguaugcaguggcacgaucucggcucacugcaaccuccaccucccggguucag

SEQ ID NO: 4104053 - RNA, 63 nt, Human
cugucacugucacguucugaaacugucacuccauugacaccuucugagaacugagcagaccag

SEQ ID NO: 4104054 - RNA, 70 nt, Human
cugucagaggcugcacuugcucaugauguuuauuuuuauaccagcacagagcaaugcguguucucuaugg

SEQ ID NO: 4104055 - RNA, 66 nt, Human
cugucagauaagugguauuuuuagcuuuuaugugaaaccacuuuuuaaaguugaucauuuugacag

SEQ ID NO: 4104056 - RNA, 56 nt, Human
cugucagcaaaucagugucuggacagccagcugcagggccugagcauggcuggcag

SEQ ID NO: 4104057 - RNA, 64 nt, Human
cugucagcucccagucagagagaaagggccucuucagucugucucaggagacugggagaaacag

SEQ ID NO: 4104058 - RNA, 70 nt, Human
cugucaggaagaguuugaccugugccauccagaggcaccuaugcauggacagucagucaaaagaccacag

SEQ ID NO: 4104059 - RNA, 59 nt, Human
cugucaguaggcucccaucauuaaaagcagguuuacagagaggcagcauuacuuggcag

SEQ ID NO: 4104060 - RNA, 65 nt, Human
cugucaguguccuuauuucugucucucacuuuggggugagagauuaggauaagugauaucugcag

SEQ ID NO: 4104061 - RNA, 74 nt, Human
cugucauagccaaaggauucuauggagauauuaacaaacaaaugugaugugugcuggauggaauccuggaacag

SEQ ID NO: 4104062 - RNA, 130 nt, Human
cugucauugugccacuguauaccagucuggacuacagagcaagaccaucuuuaaaaaagccugcauauccaacuuuuugagauggagucuugcucugucaccaggcuggggugcaguggcaccaucucag

SEQ ID NO: 4104063 - RNA, 70 nt, Human
cugucauuuagacauuauguauuaaguucuuggucuaugccaggaaccuugcuagaugcugaggugaaag

SEQ ID NO: 4104064 - RNA, 105 nt, Human
cuguccaaagcuccugguucagcgaaugauggaagugaaugucucccugaggaauucuaccuggagucacuuucucuuccagugagacccugaguuuugagaugg

SEQ ID NO: 4104065 - RNA, 55 nt, Human
cuguccacguggggcuugauguagccgcgggcuuccagguccagcacgugcacgg

SEQ ID NO: 4104066 - RNA, 74 nt, Human
cuguccagugggauggccuggccagagcucugcucaguugaagcaucgcuccaggcccucccuacucuggagag

SEQ ID NO: 4104067 - RNA, 99 nt, Human
cugucccaagcagagaauucuucaaguacaaguguauuuggcuugauauaccugauuaugagggcaaauauuuuuguaaauuuucuaaugcugaaccag

SEQ ID NO: 4104068 - RNA, 57 nt, Human
cugucccauccuuacucuacccucuugcuucuggaagcagagaaagagaaggggcag

SEQ ID NO: 4104069 - RNA, 91 nt, Human
cuguccccguuguucuggaucauccagcuccugggggccaccgugugacccacggggccccuguggcuugaugcccacagcuaggaaacag

SEQ ID NO: 4104070 - RNA, 77 nt, Human
cuguccccucugcccuugcagggugacgacuggauaaucacagugaaugagcuccugccagggccagaggccagcag

SEQ ID NO: 4104071 - RNA, 126 nt, Human
cuguccccucuguuauggugcuugugucugugucuguucuuggcugugaaauggaaaaaauauuuucuucuuuuccuuaucucuacagagagucauagacucaucaugagccucucauaaugacag

SEQ ID NO: 4104072 - RNA, 82 nt, Human
cugucccuggaggcugaggccaugaggcucuaacccuaggaagaguuggcaaagcccugagccuaugagccucucagggcag

SEQ ID NO: 4104073 - RNA, 64 nt, Human
cuguccuagaaugugcagacuuagggggcucuccuguacuccugggucccgcacaucuguccag

SEQ ID NO: 4104074 - RNA, 88 nt, Human
cuguccucuaccaggaccuuaugaauugcccugaaaggugcugguuauaccugcaaaaggagagucuugagucacugguggagagcag

SEQ ID NO: 4104075 - RNA, 70 nt, Human
cuguccugaaagcauuaacuccacuucccuucccaguggaagaggugagaggaugugacuuuuggcucag

SEQ ID NO: 4104076 - RNA, 57 nt, Human
cuguccugauggugccacuggugugugauggcaucaccuguagcccaaucauggcag

SEQ ID NO: 4104077 - RNA, 63 nt, Human
cuguccugcaaauguguuuuaaaccaaagaaaucaucuuuggcaugggcuauuugcuuuauag

SEQ ID NO: 4104078 - RNA, 102 nt, Human
cugucgcugcugucugcaaccccaccgggccucccagagccgaggugacagccugggccucggggaagcccgugucucaugggcgguuguccagcugcucag

SEQ ID NO: 4104079 - RNA, 56 nt, Human
cugucggauaaggugaccccgagugucgccccacucuggguccgauguccugacag

SEQ ID NO: 4104080 - RNA, 55 nt, Human
cugucucaagacugcaggcacugaaacgugaccccggugucucaggcugaaacag

SEQ ID NO: 4104081 - RNA, 98 nt, Human
cugucuccuugcucuucccuagccccagauaucucacacacuccacuuuaauggauccgugugacuaucugggguuggauuuagucagagagaucugg

SEQ ID NO: 4104082 - RNA, 61 nt, Human
cugucucuagagguacucaaguguauuuuuaauaaugauugacuggaguacccuagagaag

SEQ ID NO: 4104083 - RNA, 71 nt, Human
cugucucugucucuguuuauccgagcagaaccuggaaggggcuggcaaggacuaggcaacagaugggacag

SEQ ID NO: 4104084 - RNA, 81 nt, Human
cugucugcacugcuuaguugguaaaugugucuguagcaugacuaucaucacaacugccaucugagcagcagagccagaugg

SEQ ID NO: 4104085 - RNA, 65 nt, Human
cugucugcccuggccagagcccccaggacugacugcccugggcacugccacgggcccauagauag

SEQ ID NO: 4104086 - RNA, 59 nt, Human
cugucuggccggcccagcuuccucuuuuaugagcucaugggcaaagccaggccaggcag

SEQ ID NO: 4104087 - RNA, 70 nt, Human
cugucugggaagccauguuucuaggaggucaaaauuguggugucugcagaagccauggccuugcucgcag

SEQ ID NO: 4104088 - RNA, 90 nt, Human
cugucugucauggugaauaccaaaccagaagcucgcaccacgggauucgaugccuugugccuggcuuguauucacaggcaaggcagacag

SEQ ID NO: 4104089 - RNA, 129 nt, Human
cugucugucccucgccuaccuggggcugcuuccuagagccggcagugaggcggagccugcaggaccuaguucaguucuuacagccacucugugaagcaggcuccaaggcagagggcugagggacaccag

SEQ ID NO: 4104090 - RNA, 64 nt, Human
cuggaucugucuuuuggaucccauauccaagacucuaccuacugggauccuugagauguccuag

SEQ ID NO: 4104091 - RNA, 60 nt, Human
cuggauggggcucaggcuguggaguuuuagugucaccccagccucugggucuucauccag

SEQ ID NO: 4104092 - RNA, 120 nt, Human
cuggauguaaauguaaaacuucgcgacuuuauaaaacuggcauuccuaggggaggggcuauuuauccuacaggucccugccuccuggcagugccaugguaugugugcauggauauaccag

SEQ ID NO: 4104093 - RNA, 57 nt, Human
cuggauguuuugcuaaggacucaauacaguugggugaaguggaaguagaacgaccag

SEQ ID NO: 4104094 - RNA, 91 nt, Human
cuggauuaaaauacuuugcugaaguauugugaauccuagcucuuaagagcugggagcauuuauuuuccguuaguuguuuuagauuauccag

SEQ ID NO: 4104095 - RNA, 64 nt, Human
cuggauucagcugaucagaaucacuuuuguaaauuauuugguucuucucaauuaguugauucag

SEQ ID NO: 4104096 - RNA, 84 nt, Human
cuggauuucggacccacagaaucuuuuuagauaauauauauuuaugugucaaguuguuaaguucugggguaauucguuaugcag

SEQ ID NO: 4104097 - RNA, 58 nt, Human
cuggcaaguacugggccagcucgccuccuggagcugguucccucccagagcucgccag

SEQ ID NO: 4104098 - RNA, 66 nt, Human
cuggcacaaguugucuccaugcagugaaugcacuauuaguuuaaacacugugggacaucuuacuag

SEQ ID NO: 4104099 - RNA, 61 nt, Human
cuggcagacuuaccaucagacaggaacaugggaggcuacugucugauggucggucuuucgg

SEQ ID NO: 4104100 - RNA, 95 nt, Human
cuggcagagcaaaguaagaauuggaauuaguaagaucguuuuaauaaaaacauuuguuuggcuucaauuacugaaauaacugcuuucucggccag

SEQ ID NO: 4104101 - RNA, 66 nt, Human
cuggcagccguggagggcaggggugcuccugggggcucggagaccucugcucccuucaugguccag

SEQ ID NO: 4104102 - RNA, 58 nt, Human
cuggcagcguguuuaugaacaucugcaugaaacugugcuuggcauaaacacguugcag

SEQ ID NO: 4104103 - RNA, 72 nt, Human
cuggcagcugugcuucauucuuucugaggaaguaaaaaccacaaggaaauagaaugaagcuacagaggcugg

SEQ ID NO: 4104104 - RNA, 101 nt, Human
cuggcaggguuggccagggcgcccggugcaguggagggcuugaggcacgaccacgugcagcaccgucccacuggcuacgggccccucuggacaccagccag

SEQ ID NO: 4104105 - RNA, 59 nt, Human
cuggcagugacauugcaggugcucacccccuuugcaaacuucccugcagugccugucgg

SEQ ID NO: 4104106 - RNA, 63 nt, Human
cuggcaugugauguucaguaccuagaagacucgguuuccuugguagagagaauauuuggcuag

SEQ ID NO: 4104107 - RNA, 76 nt, Human
cuggcauucccauuaaggaagccuauucucuccucaugaaauacaugggaugagaugcugccuuggccaaugccag

SEQ ID NO: 4104108 - RNA, 88 nt, Human
cuggccaaaaggaaagacaggacggaauuccugggaaguccuacagcugcugucuaccauagaguuccauugucuucuccucugcuag

SEQ ID NO: 4104109 - RNA, 55 nt, Human
cuggccacucccgcacaagacguuuucuuaucugucucuguguucaaggugccag

SEQ ID NO: 4104110 - RNA, 56 nt, Human
cuggccagacuacacaugugugccuuuaggucagguguccacucguggucugucag

SEQ ID NO: 4104111 - RNA, 89 nt, Human
cuggccagagugggaggcucucuccugggguggggcccggaagucugggccaggcuggggggagaugucucccugguuuucuuggccgg

SEQ ID NO: 4104112 - RNA, 69 nt, Human
cuggccaggauagcagcauuucuuccaaggauugucgcuugaccucucuuggacauguggcucugcuag

SEQ ID NO: 4104113 - RNA, 82 nt, Human
cuggccaggcaggagguggggagucccugcugagggagguugaaugcccccagagaaguguccuacagcuccugccugccag

SEQ ID NO: 4104114 - RNA, 60 nt, Human
cuggccaguugccuuccugggugaaauuacagcuuccaggcucagaggcugcugguccag

SEQ ID NO: 4104115 - RNA, 64 nt, Human
cuggcccuaugagccuccugaugcccuggagagugggggcuccaaaagaagcucuuggggcuag

SEQ ID NO: 4104116 - RNA, 65 nt, Human
cuggcccugggcaucuuucgugaccugcugauaaaaacggucaagguuaggcgccccaggcccag

SEQ ID NO: 4104117 - RNA, 59 nt, Human
cuggcccuguggccuaaggacucucucaaggaggucagcggagcaaucacagggcucag

SEQ ID NO: 4104118 - RNA, 78 nt, Human
cuggcccuucuaaccauacacauuguuuccgggaggcuaaauauaaccccucaggcagugguauggauggguggccag

SEQ ID NO: 4104119 - RNA, 94 nt, Human
cuccuuuggggguaucccuaggcagauggagaaguggcuuggugagcccugguggcgcugagcuccucuccucugccuggccuccgagagggag

SEQ ID NO: 4104120 - RNA, 60 nt, Human
cuccuuuguucuguguaucuuugugagaagggagagccugcaagggcauagaaaagggag

SEQ ID NO: 4104121 - RNA, 96 nt, Human
cuccuuuucuucccuuccuuccuugcggccccugccuaggagucucccuccugugcggcucugggcuguaaagagagacacggggcugggaagggg

SEQ ID NO: 4104122 - RNA, 62 nt, Human
cucgacaugguggugguuuaauucuggcgccaaacaccacaacuggagccacccugugcgag

SEQ ID NO: 4104123 - RNA, 96 nt, Human
cucgacugggggcgucucaccgucggacucggcaaggcuaugcagcgccagcucgccauggaaguccuugcggaaauccggguggcccaccucgag

SEQ ID NO: 4104124 - RNA, 70 nt, Human
cucgagggagguccaucccugcagagaaaagccagugcugccuaaacuuuugcauggaggcugccccgag

SEQ ID NO: 4104125 - RNA, 78 nt, Human
cucgcaccccucuucugugcucugcuguuggggccuuauaaauagcuccaaggacuggacacacagguuggagguggg

SEQ ID NO: 4104126 - RNA, 81 nt, Human
cucgcacuccaccucugaagguuucuguuacugucuuuucaagagaaucuaguuucagacuuugaguucuguggcuguggg

SEQ ID NO: 4104127 - RNA, 64 nt, Human
cucgcccuuagggccacugucacugcugggucacaggaaaccggcagggcccuugggggcaggg

SEQ ID NO: 4104128 - RNA, 62 nt, Human
cucgccucccuuagggcacacugaccuuugaauuuaaagucagccugcacucagggagcggg

SEQ ID NO: 4104129 - RNA, 66 nt, Human
cucgcgggcucugguccugaacugaagcagaaagccuugguucuggggagcagcagcagcagcgag

SEQ ID NO: 4104130 - RNA, 79 nt, Human
cucgcucacugagguagguccugccucccagacaauaaaucccucaaggucagcccaaagccugccucagcuagcugag

SEQ ID NO: 4104131 - RNA, 62 nt, Human
cucgcucauuacugccuggcccugcacgaggaacaagggauacagguguacagugagcugag

SEQ ID NO: 4104132 - RNA, 89 nt, Human
cucggacucucucacagcuuggcagaauuaguggaacagcaugugucuuuuaucuagaauuuugccauauagcucuggaguuaucuaag

SEQ ID NO: 4104133 - RNA, 127 nt, Human
cucgggcgggguccugugcugggcggugggcucaucccccgggugggcuccucccaggcgggguccugugcugggcggugggcucaucccccgggugggcuccucccaggcgggguccugugcuggg

SEQ ID NO: 4104134 - RNA, 78 nt, Human
cucggggacucaagauguaagguggggggcuccagccacugcaugugcugcugggcccugcccuugucuguccuugag

SEQ ID NO: 4104135 - RNA, 61 nt, Human
cucggggcguggcaguagcaugcugggagcugcagcugauggcugugccaugacccucgag

SEQ ID NO: 4104136 - RNA, 80 nt, Human
cucggguuccuugacaaaaauucuauugucaugacauuguucaguuuauacauggagaauuuuugccauugauuucuggg

SEQ ID NO: 4104137 - RNA, 60 nt, Human
cucgguggccacaugcgucugugaggcaggacacugccuggagcucaugugggcauuaag

SEQ ID NO: 4104138 - RNA, 79 nt, Human
cucgguguagagcgggcacuccauauccacacugcccaucugguaguggaggguguagcugcuggcaucauggucugag

SEQ ID NO: 4104139 - RNA, 56 nt, Human
cucgguguuucuuucagcaauuguuaguuucauuugcugagauaaagaaugcaggg

SEQ ID NO: 4104140 - RNA, 123 nt, Human
cucgguugccgcuucucucuucuacugucccagcugucucuguuuuuuaggcaacuuucuguggcuuuuucaagaguggagauuuggcuggagcaggauuagguaagaaaagagggaacggag

SEQ ID NO: 4104141 - RNA, 73 nt, Human
cucuaaaauccaguaugagguagggcuugggcaaaaacaaacaaaucuuaagacuauuuuuaacuguuuagag

SEQ ID NO: 4104142 - RNA, 89 nt, Human
cucuaaacaguccagcuuauacgugcuucuuuaagauacucacacaugucuuugaaggagcucaaugaugaugcucuacuuuuucaggg

SEQ ID NO: 4104143 - RNA, 82 nt, Human
cucuaaaggccuuuccacauuccuuacauucauaggguuuuucacccguaugaagucucugauguugaguaaguucuuggag

SEQ ID NO: 4104144 - RNA, 95 nt, Human
cucuaaauggugaggaaauaugggacuaagauguucauagaggcuggaauuaaauuuagaauuugacucuuagcccaggacucuaaccaugugag

SEQ ID NO: 4104145 - RNA, 109 nt, Human
cucuaacacauugucacugagugggcuagagcauuccaaacucuuucccugucguuucuccuuaagaugcagaccagacuuaggagcauagcccucagucgcaucagag

SEQ ID NO: 4104146 - RNA, 68 nt, Human
cucuacaggauaucacuucauuucuuuaacaaauaauugcauggaaaagagggagguggacugaaggg

SEQ ID NO: 4104147 - RNA, 90 nt, Human
cucuaccugccuggcaggacuguuguaagaaauaaaugaaaucauauauguaaaguauucauaaaaguaccugacagaguagaaaaagag

SEQ ID NO: 4104148 - RNA, 86 nt, Human
cugagggcuaggaaugauaagacaugaguagaggguuuuaaaaaugagcucuuuguuuuccacucuucaucaugccuagaucucag

SEQ ID NO: 4104149 - RNA, 60 nt, Human
cugagggcuuccuaagcucuggggugauguuuggacuuggagacaguggggagcuccuag

SEQ ID NO: 4104150 - RNA, 57 nt, Human
cugagggcuuccugauauggaaugaaggacaacuuacauuguggauggaguccuggg

SEQ ID NO: 4104151 - RNA, 56 nt, Human
cugaggggauaaagguuuggguuaaagauaaauaugaccuugccucuacccuacag

SEQ ID NO: 4104152 - RNA, 85 nt, Human
cugagggugggugggaugccucuggagaagugccugguccugaugaaccuccaccuccccauuaggucacccacucugcuuucag

SEQ ID NO: 4104153 - RNA, 101 nt, Human
cugagguaggagaaucgcuugagccugggaggcggagguugcagugagccaagauugcaccacugcauuccagccugggcgacagagagauccugucucag

SEQ ID NO: 4104154 - RNA, 68 nt, Human
cugaggugacaugaaggaauaauuguuuagacaucaaugaaaaaugucugucugcucauuuaccucag

SEQ ID NO: 4104155 - RNA, 61 nt, Human
cugaggugcuuggauguuuguaguaagagcuucuaacucugcugcuccacccggcucucag

SEQ ID NO: 4104156 - RNA, 55 nt, Human
cugagguuccugagaggcuuuagggguuucccagagguuccuuagggaccaccag

SEQ ID NO: 4104157 - RNA, 66 nt, Human
cugaguaagauacagaagcuccaacauuuugcuuaauuuguuccauguauucuguauucugcucag

SEQ ID NO: 4104158 - RNA, 56 nt, Human
cugaguacugagcccuggacgcuaggcugccuuaguccagaggaggacagacucag

SEQ ID NO: 4104159 - RNA, 79 nt, Human
cugaguagacuugauuugcgguuucguuauugauguugggcaaaaaaagaugacaaaagaguaaguaaugugcugccgg

SEQ ID NO: 4104160 - RNA, 130 nt, Human
cugaguagggaauaaauauaggauaaauuguuggcagaaagcuuucgaucggaugaauuuucucugagcgaaaagccaagcuuucucuaagucauuuuuacccacauagucuuuuucucuguaugcucag

SEQ ID NO: 4104161 - RNA, 65 nt, Human
cugagucaccucuggauguagcggaaugacacagcuuccucagacugcaaaugcaaggugaccag

SEQ ID NO: 4104162 - RNA, 68 nt, Human
cugagucacugcuuucuaagacaacacucugauuuuccuuggaguguguccauucaggcacugaccag

SEQ ID NO: 4104163 - RNA, 96 nt, Human
cugagucaguaacugaaugucuauguaugauauuuccaguaucaugauuaaaauggagccccgaaaugucauuauaaggccuaguuguggacuggg

SEQ ID NO: 4104164 - RNA, 82 nt, Human
cugaguccucccuccuggugagcaggggcuagaacagagguaguccugcaggccucugccucaucugggcacaagggcuuag

SEQ ID NO: 4104165 - RNA, 70 nt, Human
cugagugaaucugcccuggguuuuaugggaguccuagaaucagaacugcugucccaggguaguccauagg

SEQ ID NO: 4104166 - RNA, 70 nt, Human
cugagugacuuccauuucuggccucccuuccuuaucuguaaaauggguagguugaaauagguuaucuaag

SEQ ID NO: 4104167 - RNA, 55 nt, Human
cugagugaggggagcuugaugguguauauauauuccucucaaggaccucacugag

SEQ ID NO: 4104168 - RNA, 69 nt, Human
cugaguggaggcauugugacugcugaacuugcauuggaggugauucagcacaucgugucuugaaaucag

SEQ ID NO: 4104169 - RNA, 58 nt, Human
cugaguuuugcgagaaucguuagugauauagacacagcuagcauuccagaaaacucag

SEQ ID NO: 4104170 - RNA, 74 nt, Human
cugauaaauacuugucagaugaauaagaguuuaauguuuucuaaaauuuuaauuuugagcaaguauuugauuag

SEQ ID NO: 4104171 - RNA, 94 nt, Human
cugauacacaaugugugauauaugcauacaaugagauauuccuuggccuuaaaaaggaaugaaguacugaugcauacuacaagauggauaauag

SEQ ID NO: 4104172 - RNA, 102 nt, Human
cugauagucuuaaauauuuuuuagccauauauuucucuguucaaacuaaacgcauuguguggaaguucaauagaaaaauauauuaaagaagaggcgcuccag

SEQ ID NO: 4104173 - RNA, 74 nt, Human
cugauauguuaucagaguagccuuuaaucuucuagaaccaagacauuguuagagaaauucugguaauguaaaag

SEQ ID NO: 4104174 - RNA, 69 nt, Human
cugaucucuccagguucagucgauggaagaucucagagacacauuucauagacugggccugggaaccag

SEQ ID NO: 4104175 - RNA, 79 nt, Human
cugaucugcagugcagccacccucaaggcugaauccuuaagugaaggaccaagccaggcuucagggugacugugaucag

SEQ ID NO: 4104176 - RNA, 88 nt, Human
cugaucuggcauggaacuuuggguaaugcuucaauuuguuaaaaauaaauuuaaguuuugcauuaagguuuuccucagugcuuuucag

SEQ ID NO: 4104177 - RNA, 81 nt, Human
cugaucuucauuaauguuuccagucuaugaugguuucguguuaugguguccauggaucuggaaaugggaaaggagaugaag

SEQ ID NO: 4104178 - RNA, 96 nt, Human
cugaugacaucacuuggacccuuucacagcugcugggguaaacagaccccacacaagaagugauggaaggagccaguccaggcugauuggucucag

SEQ ID NO: 4104179 - RNA, 64 nt, Human
cugaugaggaaauugaggccuacgaagauuaaggaaguugcccaaggucugauuccagaaucag

SEQ ID NO: 4104180 - RNA, 56 nt, Human
cugaugaggucauggaagagugauacuauuuauucauuccacaaauacuuaucuag

SEQ ID NO: 4104181 - RNA, 62 nt, Human
cugaugaugaugaauauaauaacgaugacuaacauucagugaguauguauuuaucaugucag

SEQ ID NO: 4104182 - RNA, 80 nt, Human
cugaugcccaagagcagcaguguuggugggagcaucugcucuggggagcagagaggaggccaucaacacugugguauaag

SEQ ID NO: 4104183 - RNA, 83 nt, Human
cugaugccuuugccacagauuaggaucucuccuaagguccacccccguuucagagcuucucauuugacugguugaggucucag

SEQ ID NO: 4104184 - RNA, 80 nt, Human
cugaugcugauauugauguuucccguuaagagaaaaaucccguuuuuuaggcugacacaggaaauaccacucagcacugg

SEQ ID NO: 4104185 - RNA, 63 nt, Human
cugauguguugcaacugcugaugagacccuugaaaugaaguaucucuuaauugcucacauuag

SEQ ID NO: 4104186 - RNA, 70 nt, Human
cugauguuaacuuguucugccucuuuuggucagggucaacuuuaugggauggcagaggaaguagcagaag

SEQ ID NO: 4104187 - RNA, 68 nt, Human
cugauuaaaaacagguucugagaaauaucugcaaaacagaugguauauuuaaaucuguuuacagucag

SEQ ID NO: 4104188 - RNA, 125 nt, Human
cugauuaagguuuuauagaggaucuggggugggguuuuaggcugcugcaaauugaccuaagccaauuuggucaugcaaaacuauuaggcucuuuuugggaaacuucuguagccuccaguaauuag

SEQ ID NO: 4104189 - RNA, 78 nt, Human
cugauuaauauuuguaagguguuuaccgcaguuucuggcacaugauaagcacuauauaaguauuuguuaaauaauuag

SEQ ID NO: 4104190 - RNA, 89 nt, Human
cugauuagagacuggaggcugugugcaugagaccucccuaaagcagagguuucagaaaccugcacauuguuuaaacugguuacccucag

SEQ ID NO: 4104191 - RNA, 84 nt, Human
cugauucacuagccuuuacuuccacuuccuaguuucuaugucauaaaauaacuacuauagugggagggccauauggugaaugag

SEQ ID NO: 4104192 - RNA, 59 nt, Human
cugauucaguaggugugaacuuauucaggacaccugagaguuuguuucuaaugagugag

SEQ ID NO: 4104193 - RNA, 96 nt, Human
cugauucauaauccuggccuugccaugcauaagugcagcagauuugcuuaauacagcaaacccuggcugugacuuugcagguacccuuugagugag

SEQ ID NO: 4104194 - RNA, 79 nt, Human
cugauuccauauauuauuccuaagucccaacuacaugccaagcacugugguggguacuggggaaauaaaggaaaucuag

SEQ ID NO: 4104195 - RNA, 72 nt, Human
cugauucugaaauuuuaguuauagaaaauggaacagcuuucccauuucagguggaaguuuuagaugaaucag

SEQ ID NO: 4104196 - RNA, 57 nt, Human
cugauucuuugguuguggauuugcaaagcaauuugcaccaguuucucagagaaucag

SEQ ID NO: 4104197 - RNA, 66 nt, Human
cugauuggcauggcucacagcccuguccccaagcccuccccagacagagcaguccuugucaaucag

SEQ ID NO: 4104198 - RNA, 59 nt, Human
cugauuggcccaguuuaguguuggauugagucuugguccaauucaauugggucaggaag

SEQ ID NO: 4104199 - RNA, 79 nt, Human
cugauuguagcucacacuauuuaaggguaaggguugauccuguaugccugcuacaaaauggaauguguuuauaauucag

SEQ ID NO: 4104200 - RNA, 57 nt, Human
cugauuucuccagaguuucucucacuggcaguugacucuaguguuuuucuggagcag

SEQ ID NO: 4104201 - RNA, 69 nt, Human
cugcaaaaaaguacagugcaugguaaguguccaauaacuagcugcuguuaugauguuacuuucuuguag

SEQ ID NO: 4104202 - RNA, 70 nt, Human
cugcaaagacuuccuacacaguuaugccagagagagaauauauuagucauucuggccuguguggcugcag

SEQ ID NO: 4104203 - RNA, 66 nt, Human
cugcaaauucacuugccugcuuagcuucaagaguugaacugggaugguaggguaagugagaagcgg

SEQ ID NO: 4104204 - RNA, 82 nt, Human
cugcaaauucucucucuacagugccuccuggaggccuuucaagucuuuugaauuccagugguaguaaagaggucuuuuguag

SEQ ID NO: 4104205 - RNA, 76 nt, Human
cugcaagauugggaaaaggcuuggaaccuuucccuuuaggagggaaaugaagugagccuugucucuaaccuuucag

SEQ ID NO: 4104206 - RNA, 67 nt, Human
cugcaagccaaggagagaggucuugggagaaaccaaaccugccaacaccuugaucuuggacuuccag

SEQ ID NO: 4104207 - RNA, 76 nt, Human
cugcaagccaggaagagagagcccuccacagaaccugacugugcaggcagccucaucucagacuuuuggcuuccag

SEQ ID NO: 4104208 - RNA, 82 nt, Human
cugcaaggagcuggagaaaauccauguguaugaggggcugagcagcccuguguaccauucaguuuuuuccucuauuauggag

SEQ ID NO: 4104209 - RNA, 56 nt, Human
cugcaagggaucuucagguagcacucauugcugucaaucuggcucagauccugcag

SEQ ID NO: 4104210 - RNA, 67 nt, Human
cugcaaguccaagaucaagaagccagaaggguugguguccucuguggccucccuccuugguuugcag

SEQ ID NO: 4104211 - RNA, 102 nt, Human
cugcaauacaucagcugggagucaacccucacgagcaaacagauuaguucagcuuauaucccugaaacagcuuguuagguggggucuggcucugcugagcag

SEQ ID NO: 4104212 - RNA, 58 nt, Human
cugcaauagcaaguaguuguuagagagagacucgaaaccuagacuacuuacuaugugg

SEQ ID NO: 4104213 - RNA, 79 nt, Human
cugcacaauucguuuuucaucuguagugcaacaauccauauuugucucugaugcugccagggaaaauauacuagugcag

SEQ ID NO: 4104214 - RNA, 65 nt, Human
cugcacacauucuagccuuuugugacucauuccaaauuagcagcucacauuggcaaugugucuag

SEQ ID NO: 4104215 - RNA, 57 nt, Human
cugcacaugagagagaguagcugaagucuacugacuuuaaugaaauucucugugaag

SEQ ID NO: 4104216 - RNA, 77 nt, Human
cugcaccauccgauucaguguuuguguugaaagccaucuguuccuguggcuugugcauaagaagaccugagguguag

SEQ ID NO: 4104217 - RNA, 67 nt, Human
cugcaccccauuuucugucuuugguccugucuguuauugguuuauaaagucacccaaaggcaugcag

SEQ ID NO: 4104218 - RNA, 68 nt, Human
cugggaagaggcgcuccucacuuccuagaugggauggcggcugggaagaggcgcuccucacuuccuag

SEQ ID NO: 4104219 - RNA, 72 nt, Human
cugggacuacucacuuccccacaccccuuggaggcugaggccccagggucaguguguggagggucagcucag

SEQ ID NO: 4104220 - RNA, 80 nt, Human
cugggacucccuuucuugugggcagauggggccagauguucaggucaggcuucugccacgagagggaaguggggucccag

SEQ ID NO: 4104221 - RNA, 76 nt, Human
cugggacuugccucgagggcugccagaaacuugaguuuguccacucacaucacugcaucccguggagaagucccag

SEQ ID NO: 4104222 - RNA, 72 nt, Human
cugggagagcccccgccuugcugggccagggguaaaauaaggcuccugucugaaggcagggggaugguugag

SEQ ID NO: 4104223 - RNA, 68 nt, Human
cugggaggccuucagcaacuuuggaauguuuaaaguagaaauauguaaccaaggugaaguuguuccag

SEQ ID NO: 4104224 - RNA, 87 nt, Human
cugggagggcuguagugggagaggggcggggaggucaggaacugcccccaccacccagccagcuucucccugccaggccccucccag

SEQ ID NO: 4104225 - RNA, 84 nt, Human
cugggaggggacacagguccugcagggagaguaaacagccuggcuccaaugucaccuccuucaggagucuuccccaguuccuag

SEQ ID NO: 4104226 - RNA, 94 nt, Human
cugggagggugcagggcuccaggccccagcguuccgcguacaugaccugccggagcgggacacgggcgcuuggucacucugccccucgccccag

SEQ ID NO: 4104227 - RNA, 68 nt, Human
cugggagguggcccuugcucagccuuccacaccccucuuugugcaagucugagggcagccccucucag

SEQ ID NO: 4104228 - RNA, 60 nt, Human
cugggagucuggaauuuugguauguccuaggcagacagucccuacauuaccagcucccag

SEQ ID NO: 4104229 - RNA, 125 nt, Human
cugggagugagagaugggaaauagccugggaaggcagguuggugagaagacugcagaugcccuuaaacuguagacuggagcaguagcuuuguaucuucccugcucuccuuccucucaaggcucag

SEQ ID NO: 4104230 - RNA, 85 nt, Human
cugggagugguuguggcuacagacuggaggccccucaucugcgaggugagaggcuagaucagcucugugcuggagccccguccag

SEQ ID NO: 4104231 - RNA, 85 nt, Human
cugggauaaaguuaagguauuggcagggcugaguucuuucuggagccccugagccuccagaaccuguuuucuugcuuuuuuccag

SEQ ID NO: 4104232 - RNA, 61 nt, Human
cugggaugagcuaauguacucguaccagaauaugaggaucauucuauuagcuagcuuccag

SEQ ID NO: 4104233 - RNA, 66 nt, Human
cugggaugauagugcuaguauugcagcagcugcugcuacugcuacuauuagauuauuucaugccag

SEQ ID NO: 4104234 - RNA, 70 nt, Human
cugggcaaagauaugaauuauuuauccaguucuaacaacgaacuggcuugaaguagauucaaauccccag

SEQ ID NO: 4104235 - RNA, 72 nt, Human
cugggcaauauggugaaaccccaucucuacaaaaaauuagccaagcaugguggcgcguaccuguagucccag

SEQ ID NO: 4104236 - RNA, 64 nt, Human
cugggcaauuggauucuuaguaaaucuuguuggauuugauaaagacuaauucuuaauugcuuag

SEQ ID NO: 4104237 - RNA, 72 nt, Human
cugggcaccacugcugccuuguugcccuguggcugugaggugccauagugccaagucuucagcacgccccag

SEQ ID NO: 4104238 - RNA, 68 nt, Human
cugggcagcagcaaagccagacucgaggcaccuagaccugaguuuggagcacuguuagcugaauccag

SEQ ID NO: 4104239 - RNA, 90 nt, Human
cugggcaggguggggugcauggacgugacuuggccaagugguccuuucccagcugccacucccccuuccugccacccugccuuugcccag

SEQ ID NO: 4104240 - RNA, 57 nt, Human
cugggcaguuuacauuccuaccaccuggcuuggggccggaauguacaggccgcucgg

SEQ ID NO: 4104241 - RNA, 63 nt, Human
cugggcauggggcuggaaaggugggugggucuggcaccugaauaucccugaguuccagcccag

SEQ ID NO: 4104242 - RNA, 76 nt, Human
cugggccaacauagaggugagauuguggugcugcuggugguggcagaucuuacuccagcucuagauuggaagucag

SEQ ID NO: 4104243 - RNA, 61 nt, Human
cugggccaccgcugaccuggaguaggcugagacucuaguggccacucugcggaggccccag

SEQ ID NO: 4104244 - RNA, 82 nt, Human
cugggccacgggaagaacaaaaucuaauuugggcauuucauuuuaugaguugaucauuauuugguuuccuuuccugguucag

SEQ ID NO: 4104245 - RNA, 64 nt, Human
cugggcccuggagggcgccgcacaguccaggggauggcgugggccaaggcccccaagagcccgg

SEQ ID NO: 4104246 - RNA, 110 nt, Human
cugggccgggaaaggccugugcuggucuccgccgcucccugaucuagagccaugagaagcccguucaugggagcaagguggggcaccagccacuccugucucucucccag

SEQ ID NO: 4104247 - RNA, 62 nt, Human
cugggccuggguuccuccugggcaggggcugcaucccaggccucuggagccccagugcucag

SEQ ID NO: 4104248 - RNA, 68 nt, Human
cugggccuuaguuaucacacagcucuacauaaaucaagcaagagggcuggucaggaaacuaggcucag

SEQ ID NO: 4104249 - RNA, 67 nt, Human
cugggcucuggccagugaguuccucucuuagaaggaaaacuggagagagagcucauuagcugccugg

SEQ ID NO: 4104250 - RNA, 78 nt, Human
cugggcugcaauccucagggccucauggccggggugcccaaggcauggguucugaggcccugccaggugcugccacgg

SEQ ID NO: 4104251 - RNA, 59 nt, Human
cugggcugcuugcugaagggguggggcugacugacaaaacuuugguggggguagcccag

SEQ ID NO: 4104252 - RNA, 100 nt, Human
cugggcuggcgucuuuucccagacagggaccucgcuccagagcugaacaggguuguuucugggaggcugggucccguccgugacucagagccaggcccag

SEQ ID NO: 4104253 - RNA, 71 nt, Human
cugggcuguccagcaccugggcuccagcugccaaaggcaggcaggugagcaccaggcuguuggaagcccag

SEQ ID NO: 4104254 - RNA, 86 nt, Human
cugggcuuauguaugaaggaauugggcuuaugguugcggaaauaauuccaaagcaaauauuucuaauuccugaaauagguacuugg

SEQ ID NO: 4104255 - RNA, 55 nt, Human
cugggcuuucaggcccuaaggccagugggucccccuccucggggucugaagucag

SEQ ID NO: 4104256 - RNA, 124 nt, Human
cuggggaauuuccuugcccagagggaggagcuggggccaagcucaccuucugauggaguauguggguuucucgucccagaaggaggagcuuuucccaagcccagcuuuccagggccuuucccag

SEQ ID NO: 4104257 - RNA, 66 nt, Human
cuggggacaccaggaggacaggccccuacuuugcugagacuagaccugugcuuccuggcaccccag

SEQ ID NO: 4104258 - RNA, 58 nt, Human
cuggggacuuuuuggaauaagggagaaguugguuaccuuuuaacaaggauuucccuag

SEQ ID NO: 4104259 - RNA, 72 nt, Human
cuggggagcccgccaggugccuacuccgugcccggcccaaggggaggggcagcacccagccgguucucccag

SEQ ID NO: 4104260 - RNA, 58 nt, Human
cuggggcaugggccccuagaggcagggacuccgauccccacuccccagcugcccccag

SEQ ID NO: 4104261 - RNA, 64 nt, Human
cuggggccaaauuuggccaugagcauuuucacuuugggagaugucaggacaaguuggcaggcag

SEQ ID NO: 4104262 - RNA, 64 nt, Human
cuggggccaccuggguucgacugggccccacgggugguggcccagcgggauggguuggagccgg

SEQ ID NO: 4104263 - RNA, 55 nt, Human
cuggggccucugagcagcuuuccaggcucaagagaauggaaggaguggaccccag

SEQ ID NO: 4104264 - RNA, 77 nt, Human
cuggggccuuggccucauuagaugaaacucucccucuuccuaucaggcuggggaauuuuugaggaccagaaccucag

SEQ ID NO: 4104265 - RNA, 56 nt, Human
cuggggcugcagcgaucuucaucagucacuggugaccuugagugaaugagccucag

SEQ ID NO: 4104266 - RNA, 77 nt, Human
cuggggcuuuucuuuggggucuccagcauaggucgugcccauucauauuuguuuauggaucucccagaguccuccag

SEQ ID NO: 4104267 - RNA, 86 nt, Human
cugggggacuggaaggagccgagcucuuccccacucaggucuccuuuccgcuguccucugugggggcucugcugcuccuccuccgg

SEQ ID NO: 4104268 - RNA, 66 nt, Human
cuggaagcuuguuugccagucuguuguucacauuauacucaagaccauaggcagcaggcugcccag

SEQ ID NO: 4104269 - RNA, 75 nt, Human
cuggaaggauggaagggaaguagugcuccucauaucuagggagagauugaagauuaaaugcuuccuuccuucuag

SEQ ID NO: 4104270 - RNA, 70 nt, Human
cuggaagggagcacuguagagagacaagggcaaaaaucaggcagcgucucuagcaguagcccaaauccag

SEQ ID NO: 4104271 - RNA, 85 nt, Human
cuggaagggauaagaaauaggacucuaggggcuuuggaggagccuggcucuuccaauaccuagauuuuggacuucuagccuccag

SEQ ID NO: 4104272 - RNA, 64 nt, Human
cuggaagguucuuugugugccugaugcuguguuggcuacuguugggacgcaaaggacuuuuuag

SEQ ID NO: 4104273 - RNA, 75 nt, Human
cuggaaucuagggccuagaucacaggguuacugaagacagaguagagacuuggacucugggauucuggauuucgg

SEQ ID NO: 4104274 - RNA, 62 nt, Human
cuggaaugucagcuacaagagggcagggacuguggcuauuuuguucucugcuacauucucag

SEQ ID NO: 4104275 - RNA, 127 nt, Human
cuggacacuggaccuggcuggcaccacuaggggcccacccauggcugcuggcucggucccuggggcccugccccacuggcacuggucccaguagcuugggucccuaccagccaggugcucuguccag

SEQ ID NO: 4104276 - RNA, 98 nt, Human
cuggacagaaugugaaaugaggggauggagggugaagguggagguggagcugaccuggcuucugccuugcacuuugucagaccaaacguucugaccgg

SEQ ID NO: 4104277 - RNA, 60 nt, Human
cuggaccucagcuguggggaugcugccagcucgugacagccuccacuagcugcaggacag

SEQ ID NO: 4104278 - RNA, 56 nt, Human
cuggaccugguuguuuugagucaguucaguggcuuggcccugccgccuggguccag

SEQ ID NO: 4104279 - RNA, 59 nt, Human
cuggaccuucugccuccucaugcuguaauaugcauaagagguguccuagaaguauucag

SEQ ID NO: 4104280 - RNA, 83 nt, Human
cuggacgguuggucucuucuuggagauguuguaaagacaaauuuauuucccccaucuucaaagaagccuuggauuaauugcag

SEQ ID NO: 4104281 - RNA, 70 nt, Human
cuggacucaaagguuagacagcucugcauacagugaaaauuaugacacagagugggucugaggaggacag

SEQ ID NO: 4104282 - RNA, 76 nt, Human
cuggagccaggaaugucgucauaaacaugaagccccguaccagggcaucuuggcagggcaauguuccuagcugcag

SEQ ID NO: 4104283 - RNA, 68 nt, Human
cuggagcccaggaggucgaagcugcagugagcugugauuguaccacugcacuccagccugggugacag

SEQ ID NO: 4104284 - RNA, 104 nt, Human
cuggagccuggguucucugcaguggagacucuggucagugaauuccuaguuuccuaauagguagacuuggugaauauggucuccuuccagagcuuggggaucag

SEQ ID NO: 4104285 - RNA, 64 nt, Human
cuggagcugauacagcuggcuuuuagaaacuuuugacaaguaaccagggccuugugcagcacag

SEQ ID NO: 4104286 - RNA, 61 nt, Human
cuggaggaaaugguccugggguggcaggugggcagcuggccccaggucguggucuucccag

SEQ ID NO: 4104287 - RNA, 74 nt, Human
cuggaggaccaagugcacucuuagggccccacacugcgagagcacagggccaggagcugcacagggcucugcag

SEQ ID NO: 4104288 - RNA, 57 nt, Human
cuggaggagaauuuauggucgaauaaaaucugugcuuauuucccauuccuccuucag

SEQ ID NO: 4104289 - RNA, 61 nt, Human
cuggaggcacugcagggcuucugaaagcggcccaucccaggagccuggcaaacacccccag

SEQ ID NO: 4104290 - RNA, 56 nt, Human
cuggaggccccuaaacccaccucauugcuuuuggaaacccuggaaggggucuccgg

SEQ ID NO: 4104291 - RNA, 71 nt, Human
cuggaggcugggaaguccaagaucaaggcaccagcagauucagugucuggugugggcucucugcuucacag

SEQ ID NO: 4104292 - RNA, 56 nt, Human
cuggaggcuuuucugguaggcggccuuggggcuguccaccuccagagccuuaacag

SEQ ID NO: 4104293 - RNA, 87 nt, Human
cuggaggggcgcaggucaggcuguagggccccuggagcuggcucccuggcuugagagaaagggccacagucaccuucgccugcccag

SEQ ID NO: 4104294 - RNA, 58 nt, Human
cuggaggggcuggcaugguagccauuuugaucucugucauguguaauagccucugggg

SEQ ID NO: 4104295 - RNA, 73 nt, Human
cuggagggggcggccggggucggucuaguuccgguuacaaacuggacagaaaaggccacuggagucucgcuag

SEQ ID NO: 4104296 - RNA, 87 nt, Human
cuggagguaggucuacuaucagggacauuuagacacugauggucuuuacuaucuguggauaugaccuuccugguggacuuucucagg

SEQ ID NO: 4104297 - RNA, 58 nt, Human
cuggagguuggguccaggccaggauggagcccaggcuccuggcaucugggcccuccag

SEQ ID NO: 4104298 - RNA, 100 nt, Human
cuggaguauuuucuuggacuccuuguuuugucauuugugcuuuuauaaaauagaaaauuaugacauaugaguacaaguaaaaugaguuaguagaaaccag

SEQ ID NO: 4104299 - RNA, 97 nt, Human
cuggagucuacagauacuaugggagcuagaguuuguaggguagagcaucacugaucuauaggacaacuucaagacuccuaauaaaguaagacuggag

SEQ ID NO: 4104300 - RNA, 57 nt, Human
cuggagugacuuuguuccuuuuauccucuuugaaccccugcaaaguauucacuccag

SEQ ID NO: 4104301 - RNA, 88 nt, Human
cuggaguuccucucuuguaaaacaaacacccaaaggcaaggaaaaacaccguaaaguucuuuguauguauguuucaaaggaaugccag

SEQ ID NO: 4104302 - RNA, 82 nt, Human
cuggauaacccggcguagcuguccaggagugcagagauugggaaccagauccugggcucuuggcagcuucagcuuuaucugg

SEQ ID NO: 4104303 - RNA, 76 nt, Human
cuggauacaaaacuagagaaaauuugacugccgaggacucuucagggcauguauguuucuuuaauuuuacucacag

SEQ ID NO: 4104304 - RNA, 70 nt, Human
cuggaucagucuuuuggcuuacuuugaccagaaggaucuggugaaaagugaugccaggagucugguccag

SEQ ID NO: 4104305 - RNA, 124 nt, Human
cuggaucauucucucuuuuugaccagccugacuauggcugcagguguuuuucuuccuccccuguauaugauaaucucaccugggcagucauggauggguacauucaauuuggguagaaauccag

SEQ ID NO: 4104306 - RNA, 80 nt, Human
cuggauccaagcaagucacucuguggaagauuccaggcguuugaaaauagacuucacuuucgacaggaguugcuauccag

SEQ ID NO: 4104307 - RNA, 72 nt, Human
cuggaugauauuuugcaaauucuugucuagccuuugaaagaaagcaggcuauugauuuggaaguuuccccag

SEQ ID NO: 4104308 - RNA, 91 nt, Human
cuggauggcaaccugaaacccaaggccaugagcagcgagugugugugagcccagcauggauuagugcgguggccuugggaggcccuuccag

SEQ ID NO: 4104309 - RNA, 90 nt, Human
cuggauggcggcgucauucccgagauggagagcugaguggggccaggggagagggcagguucaguuccauuucagguggguugaguucag

SEQ ID NO: 4104310 - RNA, 56 nt, Human
cuguuaggacuccccagaagcugccagagaauugcugcacugaagagucuuaggag

SEQ ID NO: 4104311 - RNA, 56 nt, Human
cuguuagugaucaaagggagagguagucaucaaaacagcuccccuucacugaacag

SEQ ID NO: 4104312 - RNA, 73 nt, Human
cuguuauagugaagcccucuguauuaucuuaguaacuuguauuugcagaggaggaagagcuuuaaaauaacag

SEQ ID NO: 4104313 - RNA, 63 nt, Human
cuguuauuauguuuccagagccuuuccuaaccaaggaaggcuucauauuuaggcauaugacag

SEQ ID NO: 4104314 - RNA, 87 nt, Human
cuguuauuauugucaucagcauccagcauccuauagaaaaagagacacuuuuuucuacagguugauggguuuggugacuuguuucag

SEQ ID NO: 4104315 - RNA, 129 nt, Human
cuguucaagauucguuaaauggcagaaggaacuuuacagauaugauucaguugagaaucuuauaauagagagauuagccuggauuaugcaggugggcccuaaauguaaccauaaauuuacuuauaauag

SEQ ID NO: 4104316 - RNA, 57 nt, Human
cuguuccucuggcauauggagaaacuugagaugagcaucuuugugucagauggacag

SEQ ID NO: 4104317 - RNA, 68 nt, Human
cuguucuagcacacuuuuggcauguuugguucuuauagaagagccugugcuagcagugguaaguuuag

SEQ ID NO: 4104318 - RNA, 72 nt, Human
cuguucucuuuuccugcugagccaacugagggggagccuagccaggaggagcggcagauggagugggagcag

SEQ ID NO: 4104319 - RNA, 98 nt, Human
cuguucuuucuaucaguaguguuuugaaggggaaucuagguucccagagcaauuugauguucuggagagaucuuccacaacacaggcagagggaucag

SEQ ID NO: 4104320 - RNA, 70 nt, Human
cuguugaauaguauaccauggugugaauauccuuuaucaauuuucacacacauggauaguauuuuuucag

SEQ ID NO: 4104321 - RNA, 129 nt, Human
cuguugaauucuuuaucugaacaccaguuuucuauaugaacugagagagauggcaagaaauaaagaauugguacuuucuuaggcuguauaaaugagaggauugugcaaaucaugauagacaaaacccag

SEQ ID NO: 4104322 - RNA, 59 nt, Human
cuguugaauuucucguguguuccugggacccauuaggaauguaaaucuagauuuuacag

SEQ ID NO: 4104323 - RNA, 129 nt, Human
cuguugcacauccucaaggcuggugacagugcacacagauuucaggacucaaaacgauaauucguguaaagccguuguuguuaucuuuaggcugugacuagcugccagacuaugagaggugaccccgag

SEQ ID NO: 4104324 - RNA, 65 nt, Human
cuguugcagaggcuggcucgccggguuccagcuccgcugccugcggcucggcagucucugcgcag

SEQ ID NO: 4104325 - RNA, 68 nt, Human
cuguugcccaggcuggaaugcaguggcgugaugucaguucacugcaaccuccgccucccggguucaag

SEQ ID NO: 4104326 - RNA, 62 nt, Human
cuguugccuaaaugccuuuccuaccuaacaguagcuguucagugggugcauuggcccuacag

SEQ ID NO: 4104327 - RNA, 63 nt, Human
cuguuggggggaucugaggccauucugagacuccaggacuggcagcagcagcccuugggucag

SEQ ID NO: 4104328 - RNA, 66 nt, Human
cuguugguuaaagucaaucaugguauaauuccuuuucuguaggcagagcaugugacguaaccacag

SEQ ID NO: 4104329 - RNA, 66 nt, Human
cuguugucuugguaccucuuugaagugcaaaaacauuacaacuucaaaagcgguccaggaagaugg

SEQ ID NO: 4104330 - RNA, 82 nt, Human
cuguuguuaaaaccugcuuccccacugcucagccugccaucagccauccagcugcagagcaguggagaguaggucucaccag

SEQ ID NO: 4104331 - RNA, 118 nt, Human
cuguuguuaaauugcaggucauguuggugagucuggggcacacacacacagccugucuauuccacugcgggacuuguucugccagcacuucucagcuuugaccugcuaagugauucag

SEQ ID NO: 4104332 - RNA, 69 nt, Human
cuguuuagucaggaucaaauugaaguuaucagagaaagcucuuauaacccaaaugauucacuguuacag

SEQ ID NO: 4104333 - RNA, 65 nt, Human
cuguuuauaaaccaccaguuuagggcauuuuuauuaaugcagcccaaauggccucagauaagcag

SEQ ID NO: 4104334 - RNA, 58 nt, Human
cuguuuaucuaggaguugcagggccauucgggauggcugcaugcucauaggaaaauag

SEQ ID NO: 4104335 - RNA, 69 nt, Human
cuguuuaugaagcugugguuuagauguccucaagacuaggaugauacuuccagcuucaagauugaacag

SEQ ID NO: 4104336 - RNA, 56 nt, Human
cuguuucaauuugaggaucagccagaaguuaugaggugacaauucaggugaaacag

SEQ ID NO: 4104337 - RNA, 56 nt, Human
cuguuucaugaaugcaauuucaucggugucuggaaauugcacaguuuauggugcag

SEQ ID NO: 4104338 - RNA, 79 nt, Human
cuguuuccacaaugccaggggcaucacugguacuguauucuuggguaauggugcucccuggaguugugcagugggacag

SEQ ID NO: 4104339 - RNA, 115 nt, Human
cuguuuccccaucuguguuggggcaugguguguguguguguguguguguguguguguguguguguguguauguguauacacuauauaaucccaauggauuuucuagguaaaauag

SEQ ID NO: 4104340 - RNA, 65 nt, Human
cuguuuccucaccugugcaauugaagucaugguccccaucuucuggguguggagugaggacacag

SEQ ID NO: 4104341 - RNA, 99 nt, Human
cuguuuccuuaauaggccacuucccuccaaggauucagggaccauucaucaccguggugccuaguccccaggaggucaguggccugcugcggugcucag

SEQ ID NO: 4104342 - RNA, 95 nt, Human
cugagcaggcuucccucccuccugcauggaagcaguuuggcuccagggauggggcuggccagcugacagcagggcugggagggaagagggugagg

SEQ ID NO: 4104343 - RNA, 56 nt, Human
cugagcagggagacaacucuggugcagggucucacuagucuucaucccaugcucag

SEQ ID NO: 4104344 - RNA, 86 nt, Human
cugagcauguuaugcauauugugauggauuucaggguuaauauaccuccuuuuuccucaucacaauguacguuaaaaugugcaugg

SEQ ID NO: 4104345 - RNA, 70 nt, Human
cugagccagggugagagggcuuuguauuuggagagugaaaagaauacgguuguuuaggcuuuggacucag

SEQ ID NO: 4104346 - RNA, 71 nt, Human
cugagcccugaacaacagcaggaaaaaagagagcuuagguguucuuuucaugaugauuguugggggcugag

SEQ ID NO: 4104347 - RNA, 58 nt, Human
cugagcccuugucuuccuggucccucugcagaccugggauuggaagaaggagcugcag

SEQ ID NO: 4104348 - RNA, 83 nt, Human
cugagccucguacccucugcagcccuaaguugggacuacucacaccucccucccucugagagugcucagaggguacagcucag

SEQ ID NO: 4104349 - RNA, 63 nt, Human
cugagcuacauguguuugcuaacccugcaagauguuaucucugggccaggcacaugaagccag

SEQ ID NO: 4104350 - RNA, 62 nt, Human
cugagcucaggcugaaucauccuagcuuuucuauaaacaugagaagccagcugccagcucgg

SEQ ID NO: 4104351 - RNA, 68 nt, Human
cugagcucugcugcugagcacacuccuaugggaccuucugugggauucagcugggcggcauggcacag

SEQ ID NO: 4104352 - RNA, 86 nt, Human
cugagcugaggaguuugcaaccugcuguaggagcaaugcucaggcuucuuacaugcaggucagacugcauuucagcaauaacucag

SEQ ID NO: 4104353 - RNA, 60 nt, Human
cugagcuuccauggacgccaucugccauucagugucgguggugguggacaugaggcccgg

SEQ ID NO: 4104354 - RNA, 95 nt, Human
cugaggaaaauucuccaaacgucauacauggauuaaucccacucaaggauacuccuggauuugucuaggucaugacuuucaagcaguuuucucag

SEQ ID NO: 4104355 - RNA, 71 nt, Human
cugaggaaacacuuuaagugaggaggaucuuagcaaugaguagauuuucaucaaaauuaaagauuucuggg

SEQ ID NO: 4104356 - RNA, 99 nt, Human
cugaggaagaugagagcaagugguccaaggguugaguggaggugcugggaacggaaacccaccuuccaucuccuuggcuagugcacuuggagguugcag

SEQ ID NO: 4104357 - RNA, 98 nt, Human
cugaggaauagaaaguuugucucucuguauucuucguaaugccugaugcaggcauaagaacacagacacaaaguaaaauugguucuaugaauucucag

SEQ ID NO: 4104358 - RNA, 72 nt, Human
cugaggacagcauuccuaguuccaaaaagccccaagggggcacuguuuagacacuagggaugcaguggucag

SEQ ID NO: 4104359 - RNA, 62 nt, Human
cugaggacuacuacauuggacagcaugagucuaaggcuuugcuacucaaaguguggucccag

SEQ ID NO: 4104360 - RNA, 64 nt, Human
cugaggagaaaugggaugguuccugugagcagaaagacaaagaacugucucuguucuccauuag

SEQ ID NO: 4104361 - RNA, 63 nt, Human
cugaggaguuuggguuguucaaagcuauguagcuuccuguuugcaaagccugaaacucuucag

SEQ ID NO: 4104362 - RNA, 105 nt, Human
cugaggauuaagugaguaauaauagcuguaaagugcuuagaacauggugugaugugccauaaucauuguuaacauuacaguuauuauuauucuuuguauucucag

SEQ ID NO: 4104363 - RNA, 55 nt, Human
cugaggcacagugaacuucuccugccagguagggagaggcccacaggagcuucag

SEQ ID NO: 4104364 - RNA, 60 nt, Human
cugaggcagagaaugaguuuguggugcucaagaugaguggacagaguuccuccugcccag

SEQ ID NO: 4104365 - RNA, 107 nt, Human
cugaggcaggagaauugcuuuuaaaaacccagggggcagagguugcagugagccaaaaucaugccacugcacuucagccugggcgacagagcaagacuccaucucgg

SEQ ID NO: 4104366 - RNA, 99 nt, Human
cugaggcaggggaaucgcuugaacccaggaggcggagguuguggcgagaucaugccauugcacuccagccuggguaacaagagcgaaacuccgucucag

SEQ ID NO: 4104367 - RNA, 124 nt, Human
cugaggccaccugcugucauccuaggcuguucccccucccacccucucccgauauuugguggucugaggauagcuagagguagauggguuagaggcagugugagaaugcaguuggaggccucag

SEQ ID NO: 4104368 - RNA, 85 nt, Human
cuuacgaaucuugagccugguauaacguaaacacucagaaaacacuuuauuguuuacaguauaguaggacucaucccgucguggg

SEQ ID NO: 4104369 - RNA, 92 nt, Human
cuuacuacuguguaagugagagcaaggguugguuuucugacaaagacaucuauaugcagagagccagcucucucggcaagacauuuccuaag

SEQ ID NO: 4104370 - RNA, 98 nt, Human
cuuacugcuugcugauauuuauguaaaaagcccagccgcugagagggccacgauauugccaauuucagcucuacuuuuugcauuuaguaagauaaaag

SEQ ID NO: 4104371 - RNA, 83 nt, Human
cuuacugugguucucacugugccuuuucccaaacauuguagcuaauguugggaaguguguguacagugugaagacagagucag

SEQ ID NO: 4104372 - RNA, 71 nt, Human
cuuacuuugucucugugguacguuucaucccgaggcucuugggacagaggguugacagaguauggagggag

SEQ ID NO: 4104373 - RNA, 84 nt, Human
cuuagagaauuugacugggaccugucacucaggagucauuuuugauucccugugugugcuacaggcuuccaucuuaccucuaag

SEQ ID NO: 4104374 - RNA, 70 nt, Human
cuuagagccuacccagcaccuaggcugccuuuacuaucucugcaggucagacacagugcugggugcugag

SEQ ID NO: 4104375 - RNA, 91 nt, Human
cuuagaggacaggggcuggugucuuccuaguuuuguauucauucccaccuacaucauggaggacaguggacacuagucccuguccucaagg

SEQ ID NO: 4104376 - RNA, 68 nt, Human
cuuagcaggguuacgaugauuucauguguuuuucagaagacacugguucucuuaacccuauuguggag

SEQ ID NO: 4104377 - RNA, 105 nt, Human
cuuagcccugcaucuccaggcaggcaccgccuucccaggguccuguggcucugggcugugggccucaggaccugaagacaggcaggugcaggaugcaggacuggg

SEQ ID NO: 4104378 - RNA, 101 nt, Human
cuuagcucugcuuccuuauugacucuaaguuccucaaaugcagagauucuuuccaucuuugucauauugaaggugcuuaauaaauuugguguauaaauaag

SEQ ID NO: 4104379 - RNA, 84 nt, Human
cuuaggaaaugguauauaacuaccaagggagagauuuaauguaaaauuaauauacuucccauaguuugaauaaaauuucuagag

SEQ ID NO: 4104380 - RNA, 71 nt, Human
cuuaggaaugcguuuccugggucccaguuauaauuuaaaacccauggaucacuaggcagcgagugacugag

SEQ ID NO: 4104381 - RNA, 58 nt, Human
cuuaggcaaccaggucaaugcuggcacauuugccaagauggugacuacugguuccagg

SEQ ID NO: 4104382 - RNA, 62 nt, Human
cuuaggcagacugcugaugcaggaguacaaaacugcagagauaucaagcagucugauuuagg

SEQ ID NO: 4104383 - RNA, 58 nt, Human
cuuaggcaguuuaggaaagagacauugaucacaauuuuuccuuccuuucuguacugag

SEQ ID NO: 4104384 - RNA, 61 nt, Human
cuuaggccacucuccuuugucucaugugaugacaauucugagcugagugaguuggccuggg

SEQ ID NO: 4104385 - RNA, 79 nt, Human
cuuaggccagugcuucucuucacacccaacuccuccaguccugggucaagugguggagagaugaggacacaggaagaag

SEQ ID NO: 4104386 - RNA, 62 nt, Human
cuuagggacagggacuacagaaggagaggguaguccucucucuuguagucccugccccuaag

SEQ ID NO: 4104387 - RNA, 105 nt, Human
cuuaggggaaaggacuagaaauacaguagacaaucucaugaaaacgcugucugccucacuaagcuuuucaggacagacugcuacuguaucagucaugcucuucag

SEQ ID NO: 4104388 - RNA, 79 nt, Human
cuuagguaucugucuccaguguccaguggucuuucuacuccuccaugaggacuuuaucuggggugaaggauuaccugag

SEQ ID NO: 4104389 - RNA, 66 nt, Human
cuuaggugcccaccugcuuacucuguucccaaccccaacuccugaaguagcagguggcgucugcag

SEQ ID NO: 4104390 - RNA, 67 nt, Human
cuuagguuuaagguugaagaacagaauaauauucacauuuaaucucaaaucaaacuuugagcuuaag

SEQ ID NO: 4104391 - RNA, 91 nt, Human
cuuaguacuuucuuuacgguguuauuguaaagauucuaagaaauacaugaaaaguuuuuaguguagucaccguggguccauaaguacuaag

SEQ ID NO: 4104392 - RNA, 90 nt, Human
cuuaguaggacuguggugggaccuggcaauuugcaucucucacaagcucucaagugauggugaugcugcuggucuggaaccuccuuugag

SEQ ID NO: 4104393 - RNA, 129 nt, Human
cuuaguauauuagauuugagacuuaaaguuugaggauugaaauucaucuaguuagaauucuugacagguggcuuccauuuucuaaaaguaucuaaacauuggguuuuaagcucuuuuuucauacuucug

SEQ ID NO: 4104394 - RNA, 59 nt, Human
cuuagucucugcuggcaggggagcaggccagcuuugguuucucugcagcagaggcuggg

SEQ ID NO: 4104395 - RNA, 64 nt, Human
cuuaguguccucuauuaugacuuuauauagcuugaguauuuaaagcucauuggaggacuuuaag

SEQ ID NO: 4104396 - RNA, 62 nt, Human
cuuaguuucuguugcguucuguagcuuuuuugugaauaaagucugaaugaagcaaagcuaag

SEQ ID NO: 4104397 - RNA, 71 nt, Human
cuuauaagcuguaugaccuaaaucuugugugguuaccacgaaaacacgcagaucauauauccagcuguaag

SEQ ID NO: 4104398 - RNA, 130 nt, Human
cuuauaauuucccaauuuauuuagucaaggacacagaaaaauggagucaagaggaacacagcagaaacagauacagcauguuucagaguugucuucuugaccucugaggucuuuaacugggaacaugaag

SEQ ID NO: 4104399 - RNA, 69 nt, Human
cuuauauugucaggaagugaucaaguaugcaauuauuuuguguaauccuugcauuccuguuaguauaag

SEQ ID NO: 4104400 - RNA, 77 nt, Human
cuuauccuguaaacuuagugauguuccuccaucugcaagcacgcuugcaggaaaaccaacacgccuugcaggaaaag

SEQ ID NO: 4104401 - RNA, 65 nt, Human
cuuaucuccacauucuauuggcuauaacuagauacaagcuaagugcaagggaagguggaaauaag

SEQ ID NO: 4104402 - RNA, 67 nt, Human
cuuaucuuccucuucuggggugcaugcagguuggccaccuuagccaugcccuagaagaggaaggaag

SEQ ID NO: 4104403 - RNA, 55 nt, Human
cuuaugagggaggcuuuaagcagaucggugguuugcuuagagaccuccucaucag

SEQ ID NO: 4104404 - RNA, 92 nt, Human
cuuaugcgccuccugcccacaggaagacaccagcggugacuacaagaacgcccugcugagccuggugggcagcgaccccugaggcacagaag

SEQ ID NO: 4104405 - RNA, 129 nt, Human
cuuauguagcacuuagaacauaauuauuuguuuauaugugugccacucuuacugagaagugagcuccucugaguagcggcuauguguaacuuauccauuauuucuuauuacaguguuuagucaaaaaag

SEQ ID NO: 4104406 - RNA, 55 nt, Human
cuuaugucucuggaacugcugcuguugcaaacagcaguaacuucagaaacaucag

SEQ ID NO: 4104407 - RNA, 85 nt, Human
cuuauguguacauacaugguggaaugguuaagguaagcuaauuagcauacacaguagcucauuucucauuuuguuguguggugag

SEQ ID NO: 4104408 - RNA, 67 nt, Human
cuuauguguuaucagauaucucugcuguuuuuuuaaauguagaaugagagaucugaagaaccauuag

SEQ ID NO: 4104409 - RNA, 97 nt, Human
cuuauuaggccuucagucuaguauccuuccugacuuucagaaguggaagauacuuucaaagucaagaaggauacuagacuuaaguagucuagucuag

SEQ ID NO: 4104410 - RNA, 64 nt, Human
cuuauugaagaucuauuaugagucagguccaugcaugggcuuuacauuaauagacuuauuugag

SEQ ID NO: 4104411 - RNA, 58 nt, Human
cuuauuuccugacauggaaagauauuuccagcauuuuucuauguucuaagggaaaagg

SEQ ID NO: 4104412 - RNA, 92 nt, Human
cuucaaauauucuaaacacugugcuccccaggcuguaguucaaccugucaaagccacagcacuuauucagcacaguguagaagcguuucaag

SEQ ID NO: 4104413 - RNA, 64 nt, Human
cuucaaaucccccugaguuugauacuguguuacauaauggucucagaacauuaaggauuugaag

SEQ ID NO: 4104414 - RNA, 60 nt, Human
cuucaaauuuuucuauggagaaggcaguugugauugacuguuuacaaggagaauuugagg

SEQ ID NO: 4104415 - RNA, 80 nt, Human
cuucaacuagagagagcugugguggcucuaucccaacugcccuguucuuuccagagccugggcagcuccucuggcugggg

SEQ ID NO: 4104416 - RNA, 67 nt, Human
cuucaacucauguccaacuuucuuuaucuuugacaaagguaaagaaggagugagacuuggguugcag

SEQ ID NO: 4104417 - RNA, 62 nt, Human
cuucaaggaagccacguugggaggcuauaccauuaucccaaugaugcugccauugcucaaag

SEQ ID NO: 4104418 - RNA, 80 nt, Human
cuucacaaccuacucugagcgccuccgcaucugccagauguuuguugggaugcggagccccaagcuugaagagugugagg

SEQ ID NO: 4104419 - RNA, 61 nt, Human
cuucacaaucaccuuuucggaaacagcaaugacuucauccuacaagaggugguuggggaag

SEQ ID NO: 4104420 - RNA, 62 nt, Human
cuucacacccacuaggauggcuauaauaaaaaagucaaacaaauguuggugcggauguggag

SEQ ID NO: 4104421 - RNA, 59 nt, Human
cuucacacuguuuuucauagugguuguacuaguuuacauucccaccagcaguguagaag

SEQ ID NO: 4104422 - RNA, 55 nt, Human
cuucacagucuuuauuuccuccccucuaaaaugagagagaagaaguuaugugaag

SEQ ID NO: 4104423 - RNA, 75 nt, Human
cuucacauugaauggguuuuaauauuuuuaacacuucuacaagugucauggucuguaaggagcccuggagugaag

SEQ ID NO: 4104424 - RNA, 115 nt, Human
cuucacauuguuuaugaacuuaguaugccagcuuuuuaagugugguggggucugguauuccacacuuauaugucucugaaucccacccuugugcugaugcuaagaugaacugaag

SEQ ID NO: 4104425 - RNA, 130 nt, Human
cuucaccucagagagaguuuaaagucuuauuucagacuuagugaguucuaaguuuuguacaagacugagguacaucaacuguguccgagguaaaauuuucuuuuaacuuuccugaguauuuguguggaag

SEQ ID NO: 4104426 - RNA, 55 nt, Human
cuucaccucuaggcuauuaugagucuuugaagcuuugauauuucuggaaguggag

SEQ ID NO: 4104427 - RNA, 129 nt, Human
cuucaccuucaauaccugcacgcaucuccaucagucacugauggucuuucugguuuccucuuuuaucuaccacaugaaaagacuaucugauuauaauuugaugccugauaauuucuaaguuagguggag

SEQ ID NO: 4104428 - RNA, 59 nt, Human
cuucacggugccuacuugugucuaugcuugucucugcuuaaaacacaagcaccuugagg

SEQ ID NO: 4104429 - RNA, 68 nt, Human
cuucacuacugaaaagcuacgggaagacacaguuguucuaaacugaaguauuuuaaauguaguagaag

SEQ ID NO: 4104430 - RNA, 71 nt, Human
cuucacuuugaaauguguaagagagaguuucugcaaguguuuugugcagucuucuuacaaauuucaggaag

SEQ ID NO: 4104431 - RNA, 129 nt, Human
cuucacuuugauuuuuauuugucuguuuuuccacuuucauucuucagagcugcgcuuuuggccugaauuuucagugacaaauagaaaagcugaauggauggagacaaugacucuuuaauucaauguaag

SEQ ID NO: 4104432 - RNA, 64 nt, Human
cuucagaagucacacuguuaucugcuacuuggugcuguaguaagaaacugaauuauuucugagg

SEQ ID NO: 4104433 - RNA, 69 nt, Human
cuucagacaauuagcacaucacggggguguauauuuuacuccaaauaccagaugggcuaaugugagaag

SEQ ID NO: 4104434 - RNA, 97 nt, Human
cuucagaccuggccuuggggcuugggagggcucauggcucacucgugguccaagaccgccaugggcgcacaggccuggagcgcaguaggcuaugaag

SEQ ID NO: 4104435 - RNA, 59 nt, Human
cuuccugaagucaccuaguuuauuaauuaaugucagagcuaggaaucggacccaggaag

SEQ ID NO: 4104436 - RNA, 62 nt, Human
cuuccugcccacuuccugcuggaggauuccaacuggaagcaggccagaguuggggagaggag

SEQ ID NO: 4104437 - RNA, 88 nt, Human
cuuccugggccuggcauggccuguaagacggagaggucacuccagguccucucuccucucccuggcaggacccugugggcacaggaag

SEQ ID NO: 4104438 - RNA, 56 nt, Human
cuuccuuaacaagcaucauguagcugcauaaacuacagcaaugggcagugaggaag

SEQ ID NO: 4104439 - RNA, 63 nt, Human
cuuccuuaacugugugauguuaagggggaaaaaaaucuauaaaaugcacagcaguugaaagag

SEQ ID NO: 4104440 - RNA, 59 nt, Human
cuuccuuggcuucuggggugugcacacaagcacuggaccaaggaugaggcucaaggagg

SEQ ID NO: 4104441 - RNA, 77 nt, Human
cuuccuuucugcucugccucuggccucaggcccaggccccacuugggccucacucuagaaggcacaggaggaugaag

SEQ ID NO: 4104442 - RNA, 66 nt, Human
cuuccuuugaaggggaccugggcagcacaucuccacagaaacucuguaggguccuguucuuggaag

SEQ ID NO: 4104443 - RNA, 98 nt, Human
cuuccuuugucauguagacuaacagccuaaaauaaucaaauggaugcauuuaacacaucuauuuuaaauggcaguaaacguggauucagaguaaaaag

SEQ ID NO: 4104444 - RNA, 85 nt, Human
cuuccuuuuacaaccucacaaugggcaaugugaagacagcuguuuuuaaacaugaaaguuauucugaguuggcacuuuaggggag

SEQ ID NO: 4104445 - RNA, 64 nt, Human
cuucgaaucaaucuauaaauaucaguuuccuugcgcuauaggcaaagugauaauagauuuggag

SEQ ID NO: 4104446 - RNA, 72 nt, Human
cuucgaccuugcaacucauggucacauagguguuggaaaagaauguguuuaugaguuacguagggguugcag

SEQ ID NO: 4104447 - RNA, 113 nt, Human
cuucgaguuauuucauucuccuucucuuccccuuaguuuccuuuaagagugauaaaaauggaaaagggggcugagguggaggaaggagaccuuuuguccugaaaugaaugagg

SEQ ID NO: 4104448 - RNA, 59 nt, Human
cuucgauuuaauucuuaaccuuccuucauaggaacaauaggugaagauuuagaucaagg

SEQ ID NO: 4104449 - RNA, 72 nt, Human
cuucgcuuguuuauagaucaauauuuagaaacuuucucaguuucagagaaaaagaaugaucucaagcugaag

SEQ ID NO: 4104450 - RNA, 77 nt, Human
cuucuaaaugucaugcuuaccugugucauuaaagaauggugacacaaaggaaagcauaauccacucugcauaggaag

SEQ ID NO: 4104451 - RNA, 115 nt, Human
cuucuacuagaugggucagauccguucucugacuugaugcaauggccacugucccuucagucuggccccucagcaucugagucagugggaaugugaugggccccauauguagaag

SEQ ID NO: 4104452 - RNA, 108 nt, Human
cuucuagaugaaacugaguugugucucuccuggaagcacguguuugugguugagguguaauagguaggugguuuuaggcagagacaucuuuaguauuguauauaggag

SEQ ID NO: 4104453 - RNA, 55 nt, Human
cuucuaggggcucugggaggaaaucugugcaaggcucucuuccagcuucuggagg

SEQ ID NO: 4104454 - RNA, 81 nt, Human
cuucuagucacuguaauaaucugcuuauuuucgucugcuagagcaaugacaucacuuagcggaaugugcugcagacagaag

SEQ ID NO: 4104455 - RNA, 69 nt, Human
cuucuauauucuggauugagugacuggguuagugaugaugccauuuacugagauuagaagcacuggaag

SEQ ID NO: 4104456 - RNA, 56 nt, Human
cuucuauucuucugucaaauucagguauguccacagacugaacagaugaguugaag

SEQ ID NO: 4104457 - RNA, 84 nt, Human
cuucuauuuaagagaacguggaauguggcuccuuggucccauucagccuguaaggggauacuuccacuuucuuugggaaaggag

SEQ ID NO: 4104458 - RNA, 70 nt, Human
cuucuauuucagggagaauaaauuugcugcaaucuaugggcagcuaguuaauugaaaccugaggaagggg

SEQ ID NO: 4104459 - RNA, 74 nt, Human
cuucucacuggaaacccuacaagggugggaacgugccuuauuugccuguauccucagggucuagcagagagaag

SEQ ID NO: 4104460 - RNA, 60 nt, Human
cuucucaucuauucacauuaacugucugagaguugagcacgggaagugggagaugggagg

SEQ ID NO: 4104461 - RNA, 60 nt, Human
cuucucccaacauguggaggucagaugccuugugcugcccucaccucaugucgggaagag

SEQ ID NO: 4104462 - RNA, 82 nt, Human
cuucuccugacaccagcucuaauaccagugucuucccuccagagccugauuauagacacaguuugggauggguugggggaag

SEQ ID NO: 4104463 - RNA, 69 nt, Human
cuucuccuuuucugugucucggccucucuccagagggauaaggcugcuggggacgugggagaggagaag

SEQ ID NO: 4104464 - RNA, 95 nt, Human
cuucucuagaccacauucaugcacauaaggcauugaucuguaugcauuaagggaaaccauugagguguacaucagucaugguuuggucagagaag

SEQ ID NO: 4104465 - RNA, 68 nt, Human
cuucucucuaggcaguuuccucaguuugguguauuaaauugccugucaggaagcugcccagauaguag

SEQ ID NO: 4104466 - RNA, 69 nt, Human
cuucucugaacagcauggaaucauuuuuuaaacuuguuuacaacaaugaguuugauguaguuugagaag

SEQ ID NO: 4104467 - RNA, 77 nt, Human
cuucugaacaaagucugcacucagguggaggucaaguccgaaauggucuucacaggagguguagguccuucaaggag

SEQ ID NO: 4104468 - RNA, 68 nt, Human
cuucugacaacauaggagcugaagggaccuuggauguuggguaagcaguucccacugucugucacaag

SEQ ID NO: 4104469 - RNA, 116 nt, Human
cuucugcaggugguuggauuacauggucucaaagcugcugugaauuuacugagagaguuaaauuaucaaauuucaguuaccuuuacguucauguagaaucacuaucaucuuagaag

SEQ ID NO: 4104470 - RNA, 67 nt, Human
cuucugcauggugaggugggccacagugagaaaagugacccuuauggcucucucagugcugcagagg

SEQ ID NO: 4104471 - RNA, 57 nt, Human
cuucugccaucaagaugcucuggcuaucccuuuggcuuaaagaggaugaggcauaag

SEQ ID NO: 4104472 - RNA, 122 nt, Human
cuucugcuugccccucugucacugcaagccaugcaugcauguguggaguugcugggaggaccacaccuggcgccugcagagcagcaacugcgugcgcaaaguggccgagaggcugguaaggg

SEQ ID NO: 4104473 - RNA, 116 nt, Human
cuucuggaaauggaugugauguguauuucuugagacucgucuuccacaggcuuugaacuuugcagcuggugcagacaggggcuuaggaaaggacaagucugugucccugucagagg

SEQ ID NO: 4104474 - RNA, 65 nt, Human
cuucugggacuuguagucucggcgcuggucggggcccgcagccuccgcacugcgaguccuaggag

SEQ ID NO: 4104475 - RNA, 64 nt, Human
cuucuguacaguaauaaaaugagcuacaugagacagugaugugguuuuucaguugcuggagaag

SEQ ID NO: 4104476 - RNA, 56 nt, Human
cuucuguacauacgcgaauguuugggagaggguccacauaggcgaauguucgggag

SEQ ID NO: 4104477 - RNA, 58 nt, Human
cuucugugaggacuucucaaggacaucgucgcuggagaggucugaguccucggagaag

SEQ ID NO: 4104478 - RNA, 57 nt, Human
cuucugugcuaaaugcaaaaccuuuguaauuccggaugugagucuuuugcacaggag

SEQ ID NO: 4104479 - RNA, 55 nt, Human
cuucuguugcuugcaucucccacuaagcuauauagggaggucaaaugaugagaag

SEQ ID NO: 4104480 - RNA, 68 nt, Human
cuucuuaauucaacagucaguuaucucagaggguuucucucuagugucucuuccuguuugaaaggaag

SEQ ID NO: 4104481 - RNA, 58 nt, Human
cuucuucauguauugauagucuucuagcacaggaagauugucugaaugagugaagggg

SEQ ID NO: 4104482 - RNA, 62 nt, Human
cuucuucuacccuugccuguggcugcgguccugcugaaucuguaggugagggcagauagagg

SEQ ID NO: 4104483 - RNA, 70 nt, Human
cuucuuguuuaacuagagcaguguuggaaaaauaauuuaacagaaauuuuaguuagggggcuacgggagg

SEQ ID NO: 4104484 - RNA, 62 nt, Human
cuucuuucaauuucccaagaccauagauggaaagaccuuucuuuccuggggaaugauagaag

SEQ ID NO: 4104485 - RNA, 72 nt, Human
cuucuuuccacccaguugacuacaaaggggccagcucuucagccccuuguuggccaggccugggggaggaag

SEQ ID NO: 4104486 - RNA, 60 nt, Human
cuucuuucugccuauuuaugauccauucagcaucugacaggugucuaaggcagacagcag

SEQ ID NO: 4104487 - RNA, 84 nt, Human
cuucuuucuuaggucagguucccuagcagcaaagccugagacagacuuucuugugcuagggaaaaccuguaaggaagaaagagg

SEQ ID NO: 4104488 - RNA, 79 nt, Human
cuucuuuguguauuuccugaagguaaggacaaaguccaucuuguucccaggacauaacacaaaaucugauaaauagaag

SEQ ID NO: 4104489 - RNA, 65 nt, Human
cuugggcaggguauuguagaagacauuauacuacauuauauuauacaauagucccuguccgcaag

SEQ ID NO: 4104490 - RNA, 84 nt, Human
cuugggcauaaacuuucucuucuuguaaggacuggugauagcuuauuagggcuggaugcaaggaaagagacagaaaggcuagag

SEQ ID NO: 4104491 - RNA, 56 nt, Human
cuugggguaauuucaugccgaugaucacaggaucaugacaacuauauuauuccaag

SEQ ID NO: 4104492 - RNA, 55 nt, Human
cuuggggucuuccuccuccugagaucuccuuaggagggcuucaucagacccccag

SEQ ID NO: 4104493 - RNA, 69 nt, Human
cuuggguuuaugagggucauuccgugggccaguguguaacaguaggucuggaggcccgucagcccuaag

SEQ ID NO: 4104494 - RNA, 98 nt, Human
cuuggucaugauguucugcccuggaaaacguaucuuaucugagcagaagcuacugaguuaguuaguccaggugcagggcaagcauggaaaaguccaag

SEQ ID NO: 4104495 - RNA, 80 nt, Human
cugaggccagcuguggggccgagccugacucucccugucucucauucaggccaggcaaggccccuggauuggcagcuugg

SEQ ID NO: 4104496 - RNA, 105 nt, Human
cugaggcccagagaucucauggucacacaggcacucggggaacagaucuggaacuuggguccaggaguccuggguggcccccgugggaacaguuucaggguccag

SEQ ID NO: 4104497 - RNA, 68 nt, Human
cugaggccuaagacaugaaugaguugagcaagucauuauugcuucauucuugaaauccuaggccucag

SEQ ID NO: 4104498 - RNA, 88 nt, Human
cugagggaaaugccuuucuuuuccauauguauauagcuguuaucuuaauaaagcuguuauugcauugggauauuugcauugauuucag

SEQ ID NO: 4104499 - RNA, 67 nt, Human
cugaggggauacgguacacauugugggguaaauaagacguugcaguauuaguucuggucucuucuag

SEQ ID NO: 4104500 - RNA, 71 nt, Human
cugaggggguccagucagccuuccagguacauccugaacacagaagcagcuaggaucuucauuuucaucag

SEQ ID NO: 4104501 - RNA, 73 nt, Human
cugagguaggagggugaucagcaugguucaaucagcguccuagauccagcucucaccaauccuuuucauucag

SEQ ID NO: 4104502 - RNA, 86 nt, Human
cugaggucauguugacaagacuuuguuugagacuccaggcagauguauuugcaaacucucagagaagugaugagcaauugccucag

SEQ ID NO: 4104503 - RNA, 56 nt, Human
cugagguccacugaggcaacagggcuacacaacuccugccugggaagggcuuguag

SEQ ID NO: 4104504 - RNA, 62 nt, Human
cugagguggcgccucucuuuaauaccacagagaagguauuaaaggagucagagccaccaaag

SEQ ID NO: 4104505 - RNA, 74 nt, Human
cugagguucaauggaguggaguuaauauuagcacugucuucaguguuucuuggucuuuucuauuaaauauacag

SEQ ID NO: 4104506 - RNA, 69 nt, Human
cugagguuuuucugaacuuaaacugaucucuuaaaccaguuaguugagcaaggccagagaagcccucag

SEQ ID NO: 4104507 - RNA, 61 nt, Human
cugaguaacgaccucaucucugacguaucuaucuaccgucaaaggaggcaucguucugcag

SEQ ID NO: 4104508 - RNA, 59 nt, Human
cugaguacugugccugccgaaggccuggccaggggaggggcugugcaggccgggcugag

SEQ ID NO: 4104509 - RNA, 85 nt, Human
cugaguaucuaaacuuguucaauguugggaauagagaacaucucuuucccuuagaacauuaacaaagcaucaguuuaugacucag

SEQ ID NO: 4104510 - RNA, 72 nt, Human
cugagucacuguggggugcgaggcagugagaacucuucgucgcuggcuggaaagcaucccaagguggcugag

SEQ ID NO: 4104511 - RNA, 71 nt, Human
cugagucuggacuauucuggucuuuuugaugccucacauggggucuuaagaaugaauaaccaagauauuag

SEQ ID NO: 4104512 - RNA, 95 nt, Human
cugagucugucucccccaagcccuuccugcguggucaggcacagaucacugggccagguggauaagguuucuggacaacugggggauggguacgg

SEQ ID NO: 4104513 - RNA, 85 nt, Human
cugaguguagcguucccagagggcugcccugaguucgugacagccaggaggucaggcagcuccucaucaacggaccaaaccucag

SEQ ID NO: 4104514 - RNA, 62 nt, Human
cugagugucccagggaagaaggcagcacgggcucccuguguccugccacccugggcuuucag

SEQ ID NO: 4104515 - RNA, 101 nt, Human
cugagugugccuaaaggcaguagagguaugggauguuagcacuggcuuucaugccaggguggcuucagacugugcuucuguugcugugggcccauacucgg

SEQ ID NO: 4104516 - RNA, 91 nt, Human
cugaguuauucuauaucauggagauuaacauuccaagcuucauuuccauuuguggaaugguaaacuuccaugacuguuaaagguauuucag

SEQ ID NO: 4104517 - RNA, 81 nt, Human
cugaguucagcuguucuuccaguugggggacagauguguguuucucucccucagucccuggacaggcacaacugcucucag

SEQ ID NO: 4104518 - RNA, 81 nt, Human
cugaguugagggguggucagccccggugagcccuggugucucaucaugguuuccccauggcugucuccaccccucuuccag

SEQ ID NO: 4104519 - RNA, 55 nt, Human
cugaguuuucugggauucauuuaugggguucacccagugcuuuuuaagagcucag

SEQ ID NO: 4104520 - RNA, 59 nt, Human
cugauaauuguaacuuccuaaagagugguugugagguucuuaggaagucacaauuucag

SEQ ID NO: 4104521 - RNA, 83 nt, Human
cugauagaaggaaaugcacugaauauuccaaauguuucugcugcauuuuggauuuuucuguuuucugcauuuacccucuucag

SEQ ID NO: 4104522 - RNA, 66 nt, Human
cugauaggcuccuguuuguuuguuccugacagccuguuuccuguuacauaagcagagccuagcaag

SEQ ID NO: 4104523 - RNA, 93 nt, Human
cugauauaguucugauuacaaugggaaaagguuuuagugauugcgccaaaguaaaauauggaaagcucuuuuugauugcagacuauucauuag

SEQ ID NO: 4104524 - RNA, 57 nt, Human
cugauauuauugaagcuggaguugcacauucauuuugcuuuggcuuuuuuguaucag

SEQ ID NO: 4104525 - RNA, 65 nt, Human
cugauauuccagauaccuguaaacacucaugaguuccaaugaggugaaaggugcuggagcaucag

SEQ ID NO: 4104526 - RNA, 69 nt, Human
cugauauuucucuaugggacauuuuuggcugcccucccaaaggugucauuguuuauggagaaugaucag

SEQ ID NO: 4104527 - RNA, 58 nt, Human
cugaucaaugguguaacuuguccugugucacauaggcaaguuuggacccuugagucag

SEQ ID NO: 4104528 - RNA, 89 nt, Human
cugaucagugaaauuguguccugauuugacacaauuaaaccucugcuggccagauucugucacaggaccccauaauucauuguacuuag

SEQ ID NO: 4104529 - RNA, 90 nt, Human
cugaucauauaaagacugaguugaacauaugcaaucucucauuuaugcugcugcaagagaucugugugcuuaauucauuuucuauuccag

SEQ ID NO: 4104530 - RNA, 59 nt, Human
cugauccaugaaggugccugcggucauaaccauuccugacccagagcuccuggaugcag

SEQ ID NO: 4104531 - RNA, 65 nt, Human
cugaucccuacaguucacaguaucauaaauucacuguugucgauuuauaguuugaaggggauuag

SEQ ID NO: 4104532 - RNA, 86 nt, Human
cugaucuugaacuccugaccucaagugauccacucaccuuggccucccaagguaguuggauauuugagaucggaguucugagauag

SEQ ID NO: 4104533 - RNA, 71 nt, Human
cugaugagggaacugguucauaccccagcacaaccuggaaauacacgugugagcagguuugaccuaagcag

SEQ ID NO: 4104534 - RNA, 65 nt, Human
cugaugagucuuuguauuuacuucccauauccuaaauuucaugggggguauuuauaagauuuuag

SEQ ID NO: 4104535 - RNA, 67 nt, Human
cugaugauaucccuggcccugccaucagagaucaauuguugaagcagagugaaggugaauucaucag

SEQ ID NO: 4104536 - RNA, 61 nt, Human
cugaugcccagaccccacucccgaccacacuuagaauuucuggagauggggcugacaucag

SEQ ID NO: 4104537 - RNA, 116 nt, Human
cugauggaagugacgcuccuuacguccagcuccagcuuuugcaccaaggcacuggggucuaucuugguccuggcaaagauguugguguugacgaacggagguauaauucuuauuag

SEQ ID NO: 4104538 - RNA, 55 nt, Human
cugauggauuugcugaaugaaccucugugcucugguuugauucacaaggcaucgg

SEQ ID NO: 4104539 - RNA, 79 nt, Human
cugauuauaacaacacauuaugaagucaaugaccugcuucuugaagagcaucuguugaauauaauauuguuauauuugg

SEQ ID NO: 4104540 - RNA, 76 nt, Human
cugauucaaacacuguacaaucugcagggagaacuuauuaaaagggcuuugcagauuuguuuagugcucuguucag

SEQ ID NO: 4104541 - RNA, 63 nt, Human
cugauuccauccuaguuucucucauccaauaaugaaggggagcaaaagcugggaaggagacag

SEQ ID NO: 4104542 - RNA, 59 nt, Human
cugauucugucucucgggccuuucucucuccuucugccgggaagccugggagggaacag

SEQ ID NO: 4104543 - RNA, 76 nt, Human
cugauugcagaaacagauuguaaccugauagcccggcccaccuggcccgucgugugccaguuucuuugcagaucag

SEQ ID NO: 4104544 - RNA, 72 nt, Human
cugauuucaaggacuacuuuucaaucuuguagaugaagauuuuagaauuggagucugugugcuugguuucag

SEQ ID NO: 4104545 - RNA, 115 nt, Human
cugauuugcauuuugccuguuuuucucuggccucagucggucucuccugaggauauucucuaauggggagaccaucugaaggugauccagagacccugagcggggcccagaucag

SEQ ID NO: 4104546 - RNA, 60 nt, Human
cugauuugcuaaaugucacaucuccugcacagagguagguggggugaauggcauagucgg

SEQ ID NO: 4104547 - RNA, 120 nt, Human
cugauuuguguggucauccuuagcaccuuucuggauuugugaucgugcgugaugaaucuuauaaaugguucaauauuuccaugauucaaaaugaaagugcuaaggcaaacgcaaaagcag

SEQ ID NO: 4104548 - RNA, 62 nt, Human
cugauuuuguuucccccuggagucaggcucuuucucagccguuccaagggcagcagaaucag

SEQ ID NO: 4104549 - RNA, 64 nt, Human
cugcaacucucuccagaggcugcaaugcacuggcugugcagaaagccuagggugagaggggcag

SEQ ID NO: 4104550 - RNA, 73 nt, Human
cugcaagccaggaagaaggucacaccagacaccaaccaugcuggcaucuggaccuuagacuuccaggcuccag

SEQ ID NO: 4104551 - RNA, 66 nt, Human
cugcaaggcuggcugcacaggggcucacuuuuaugaaagcuggauuccagugcagucaccuuucag

SEQ ID NO: 4104552 - RNA, 82 nt, Human
cugcaagguccuguguuauuuuuuaugcuuucaaaccuaaccauguuaggucagguuuuuaggagugaccucagacuuucag

SEQ ID NO: 4104553 - RNA, 66 nt, Human
cugcacagagcggcaguucuuaucuucagacuucagucaaguuucauuacugugguuuauguguag

SEQ ID NO: 4104554 - RNA, 118 nt, Human
cugcacccuaagcucauuauccacaaggcugugcaaaauaauaaaucacuguuguuaggacgcaaaguuugguagugguuuguuauguagucguggauaacugcagcagggaucucag

SEQ ID NO: 4104555 - RNA, 68 nt, Human
cugcacugccagauauaaaaacuguguuacaaaauaacaguaauuaaaacagcgugaaucuggcacag

SEQ ID NO: 4104556 - RNA, 89 nt, Human
cugcacuguuggggcaaagaugugcugucuugccacucaucugcuguguggucuugggcaagcgcugcagucucugguucuaucugcag

SEQ ID NO: 4104557 - RNA, 55 nt, Human
cugcagaaaagauagaggauugcacuacgugaguguaguguauuuuuuucuguag

SEQ ID NO: 4104558 - RNA, 57 nt, Human
cugcagagcagccagucccccaaucccacaugaucucaggguugcccugcccugcag

SEQ ID NO: 4104559 - RNA, 61 nt, Human
cugcagagccugcucacgucucuguuucuaaguucauaacaugcugcucugggcuuugcgg

SEQ ID NO: 4104560 - RNA, 68 nt, Human
cugcagagcuaggcugagugaaugaagggcuaggugaggucugugaacugcugggcuuggguuuguag

SEQ ID NO: 4104561 - RNA, 78 nt, Human
cugcagcauaucacugaugacuauauaugacuagugcugacaucagugagcguuuauuuagcaucuacuaugugucag

SEQ ID NO: 4104562 - RNA, 79 nt, Human
cugcagccaaccaagcuggcuccauccuaggcaaaugaguagaugacagccagccaggauggagaccaugaauaugcag

SEQ ID NO: 4104563 - RNA, 80 nt, Human
cugcagccuaggugcagcugggccacagggacccggugaggguggggacugugcggggccagccugcagcccaggugcag

SEQ ID NO: 4104564 - RNA, 80 nt, Human
cuggugguuugaaucuuugaucuuuauugcuaagugaguaugagcuuggcaaguuggagcaagugaguucagaguagugg

SEQ ID NO: 4104565 - RNA, 62 nt, Human
cugguguccuucaggaugaaggaggcagcagaaaugcucccugacucaguuccugagaccag

SEQ ID NO: 4104566 - RNA, 67 nt, Human
cuggugucuucagcagucaucuggggcaacaaucccaccugcccauugugguuguugaggauaucag

SEQ ID NO: 4104567 - RNA, 66 nt, Human
cuggugugcaggagguaacauagcaaaauaauucauuuuuccuucugaugccccuugcaguucuag

SEQ ID NO: 4104568 - RNA, 59 nt, Human
cuggugugggagauauuuggaucaagcacauccuuguguccucuaaucucaccacccag

SEQ ID NO: 4104569 - RNA, 64 nt, Human
cugguguguauucuaauguuagcucuuacuugcugauugucagagcuuagggaauucacaugag

SEQ ID NO: 4104570 - RNA, 67 nt, Human
cugguguugauguugcaccauaguuuuauagguuucacuaugaagcacaggcauacacaaccuacag

SEQ ID NO: 4104571 - RNA, 79 nt, Human
cugguguugugcgggccuggggguuucucucggcccagccugcguacaagaggaaguaaucaggaccugcccaaaccag

SEQ ID NO: 4104572 - RNA, 65 nt, Human
cugguguuuaguauguauuuaauggacugaagcuaucaauucauauggauaugcuaguauauuag

SEQ ID NO: 4104573 - RNA, 71 nt, Human
cugguuaaugcuuggcagcucaugucaguguuuucaacacugcucuaguggguagagcauugauauaccag

SEQ ID NO: 4104574 - RNA, 55 nt, Human
cugguucaauggggcugagcccaggugaggguucagggcaguucccauugaccag

SEQ ID NO: 4104575 - RNA, 63 nt, Human
cugguugauguccucagugccagggguuugcuuuuaaagcuccaaacucaagacauuaauaag

SEQ ID NO: 4104576 - RNA, 70 nt, Human
cugguuguuuuggugacuggaaaacauacucugaguaagcauuucauuucaaucaccauaaagcaacugg

SEQ ID NO: 4104577 - RNA, 80 nt, Human
cugguuuagcuuccaaggaguucugucaugugagugcagugacucaggaaaaauguagugauaggauuuuuugaugccag

SEQ ID NO: 4104578 - RNA, 88 nt, Human
cugguuuccauuagaaauaugccuauaggaaucaaagagagaaccguacaguuuucuagaugcuuauaggcauauuaguaaugaucag

SEQ ID NO: 4104579 - RNA, 81 nt, Human
cugguuucucaugagguauucuugugcuguuaaugguacacauuagauauauuauggcuuaagaaugcuuuuguggacuag

SEQ ID NO: 4104580 - RNA, 80 nt, Human
cugguuugagguuuggauuccaugcucuccgggguuccugccaguccugguugugugaggguccaucacuguagaaucag

SEQ ID NO: 4104581 - RNA, 80 nt, Human
cugguuugguguugaauuuugucauuguugaauauaaauagauauucacaaaaugauauagauacauacaccuaugcugg

SEQ ID NO: 4104582 - RNA, 71 nt, Human
cugguuuuaagccacugaguucuggagcuguuuguuaugcagcauuauccagcagagguugauaauaccag

SEQ ID NO: 4104583 - RNA, 64 nt, Human
cugguuuuccaauguuuugacuggagggcaaaauuuuacuacuacucaucuuuuuggagaccag

SEQ ID NO: 4104584 - RNA, 57 nt, Human
cugguuuugucagaagcuuuauuucauugaugguuuacugcaucuacuuagagccag

SEQ ID NO: 4104585 - RNA, 89 nt, Human
cuguaaagugugugagcucgggucccagcguccccugccaacacacacagaucccaggacaggugcaaauuugacuucacacaucacag

SEQ ID NO: 4104586 - RNA, 59 nt, Human
cuguaacucaaccugugcuuuuacauccuacucuagaaaugcagggucgcagguuacag

SEQ ID NO: 4104587 - RNA, 106 nt, Human
cuguaacuuuagacccagauucaggcagugucccaggaagccaccugugagugugugcagcuucuaggaucugccccaauuuuaucuacaaagggucuaaaugcag

SEQ ID NO: 4104588 - RNA, 69 nt, Human
cuguaaugcuucucuggggagcacaugcgauugcuuacuucuuugugcccauuacacagaggcauucgg

SEQ ID NO: 4104589 - RNA, 83 nt, Human
cuuuuguuagguauguuaagguauuguuuauauguaauaaaauucacauuuuauagggacaguucuuggaguuuugacaaaag

SEQ ID NO: 4104590 - RNA, 112 nt, Human
cuuuuuauuuuaguaaaguucuugaacaaagguauaaguuaauauacagauaaaaaauaauaggaugaugucuuuauagcuuuguguacagcaggaaauauuacuuaaaaag

SEQ ID NO: 4104591 - RNA, 60 nt, Human
cuuuuucuuccccaugggacuguaaauaaguaaccugaacacacaauagggaagagaagg

SEQ ID NO: 4104592 - RNA, 71 nt, Human
cuuuuugaaaggggagaugucaugggcccugagaugacugagaggugcaggacucccuuuuuaucaagaag

SEQ ID NO: 4104593 - RNA, 57 nt, Human
cuuuuugucucuguccugaugaucaaaguccccaaggaaccagucagagacagaaag

SEQ ID NO: 4104594 - RNA, 65 nt, Human
cuuuuuucccuuccucuggauuuucucuuuaaccacagauagaggaaguuaugaagggagaauag

SEQ ID NO: 4104595 - RNA, 67 nt, Human
cuuuuuugguauuucuuucuuugacagagucacuacaauuauaucugucacagaaugccugaagaag

SEQ ID NO: 4104596 - RNA, 59 nt, Human
cuuuuuugucugugcucugacugaguguaaucuaagucaucauguacagagagcaaaag

SEQ ID NO: 4104597 - RNA, 65 nt, Human
cuuuuuuucccacauucauauuugacugcgcauuaugugaaaaauugaauuugggaaacauugag

SEQ ID NO: 4104598 - RNA, 86 nt, Human
gaaaaaaagcagauucuggaacuccaucucccugagauugucacucauggggucugcaggaaguuucaggaaucugcauuuucuuc

SEQ ID NO: 4104599 - RNA, 130 nt, Human
gaaaaaaagggaaugcaggagugauguuguaugcuauuuuacauaggaaugguaagggaaggccacccuauguaaaguagcaucuacccccuccucccacugcuacacuacucugucuuugcuuuuguuc

SEQ ID NO: 4104600 - RNA, 87 nt, Human
gaaaaaauagugcguccucuucauggugaccaucucuggaaaucaguaaggaauaggaacuaggaacgggguuugcacucuguuuuc

SEQ ID NO: 4104601 - RNA, 127 nt, Human
gaaaaacauuuucauuaaacuucagaaaguggcuaguacagaauaugcgucaguaaaagacaaaacaaaacaacggaugauguuaccaguacuuagagcuauaguuugcuuuuaaaaaauauuuuuc

SEQ ID NO: 4104602 - RNA, 99 nt, Human
gaaaaacuuugggagaauuaacacaaguuaccaaaaaagauucagggacagucucugaagcaaugaucuuuugguggcucagauucuucaauuuuuuuc

SEQ ID NO: 4104603 - RNA, 79 nt, Human
gaaaaagugucauggaaaauugcaauggcauuguuuugauuuaaugucauuggaaaaugucuugacaaucaacuuuuuc

SEQ ID NO: 4104604 - RNA, 93 nt, Human
gaaaaauaguuuaauuucuguagcuguguucauuuugcauauguuaaacggauguaacaugcacccagggcauugcuucagagacuauuuuuu

SEQ ID NO: 4104605 - RNA, 101 nt, Human
gaaaaaucauggguuaauacaauaaacauuuaugucagcauaucugugggucugaaauucaggagcugcuuaaaugguugguuuuggcucagagauuuuuc

SEQ ID NO: 4104606 - RNA, 119 nt, Human
gaaaaaugcauacaaaaaagcaaaguaagaacauuaagguaguaguagcaaaguauuaacaguagucuuauggugugauuacauugguaauguuuauuuguauacuuuauguauuuuuu

SEQ ID NO: 4104607 - RNA, 60 nt, Human
gaaaaauuaguguuuucuuacuggugucacugaggccagcugagaaaucauugauaauuc

SEQ ID NO: 4104608 - RNA, 68 nt, Human
gaaaaauuauccaggaggaacucauuuugcauuaauguugauauaaaguguaauucuccaggauuuuc

SEQ ID NO: 4104609 - RNA, 84 nt, Human
gaaaaauuugguuugcacuguguuuuuuaaaaacuucaaagguaauugccaguggaguuaaaaacaggaugcacaccuguuuuc

SEQ ID NO: 4104610 - RNA, 75 nt, Human
gaaaacaaacucaaauggaagaguguccuuguauauuaaugaacaaaauuuacuucugaaugugaguuuguuuuu

SEQ ID NO: 4104611 - RNA, 72 nt, Human
gaaaacaagagcuguauaauaaugaaaauagccuaaacuguuuucauuguuacuaugagcuaugugcuuuuc

SEQ ID NO: 4104612 - RNA, 120 nt, Human
gaaaacagugcuuuagaagaauuaaucuaguaaagacaaaugggauuauagggaacagaaacuguuaaagaaaaauauauccauuugucugcuaauuuuuuuuuaucagugccugauuuc

SEQ ID NO: 4104613 - RNA, 88 nt, Human
gaaaacccagcccucagccaagcucugugcuuaauuauuucugucagucaccugucagcagaaguggugcacucaccuuuggcuuuuc

SEQ ID NO: 4104614 - RNA, 88 nt, Human
gaaaaccuacaggaaucuggcugagggagacagugcggacuaauauuucauuucuccccacuccucccucugaggaauccaggacuuc

SEQ ID NO: 4104615 - RNA, 73 nt, Human
gaaaagaagggacuuugucagcuuuccaggaaagaagcugggacgccuuugacaaaguuuccuuagcuuuuuc

SEQ ID NO: 4104616 - RNA, 60 nt, Human
gaaaagacucuggagucagcuaggauucaggucaggacucagccccuccggaguuaccuc

SEQ ID NO: 4104617 - RNA, 87 nt, Human
gaaaagagucaguggaccacggugggcauugggggguggaaaaugccaacuuucuggguuaccauuugugguuuauuugcucuuuuu

SEQ ID NO: 4104618 - RNA, 79 nt, Human
gaaaagauaauuauuuauuuccaagacugaguuucagaaacucacuggaauuucacuggaaaagauaauuauuuguuuc

SEQ ID NO: 4104619 - RNA, 69 nt, Human
gaaaagauccagcuauuggcaagaagugguguuuggugagggcaucauagaaucaaaggcugguauuuc

SEQ ID NO: 4104620 - RNA, 71 nt, Human
gaaaagcaauggaaucaaggauugcaugugaaagcacugaguguggggccuggguuucagagcugcuuuuc

SEQ ID NO: 4104621 - RNA, 63 nt, Human
gaaaagcaggcucagagcagauuagcaaagacauuguuuguuaagcuguggagucugaacuuc

SEQ ID NO: 4104622 - RNA, 67 nt, Human
gaaaagcccugguuuuggcuucucuguuuuauaaagugaaaaagguugauccagauuaggguuuuuc

SEQ ID NO: 4104623 - RNA, 79 nt, Human
gaaaagcuucugaauugcugacuuuaauauuauauaagaaaaauuaugaaaauacaggacaguaauuuuggagcuuuuu

SEQ ID NO: 4104624 - RNA, 66 nt, Human
gaaaaggaaggguucuuucuguuuauaggcagccuauccucauauccaaaagacucucuccuaguc

SEQ ID NO: 4104625 - RNA, 62 nt, Human
gaaaaggagggaagugaguucucagcugccacaggcaggaggcugcucagcuuucccuuuuc

SEQ ID NO: 4104626 - RNA, 60 nt, Human
gaaaaggaggugauacauuccccauggucugacccacagacuuuaugaccuacccuuuuu

SEQ ID NO: 4104627 - RNA, 77 nt, Human
gaaaaguaaaugacauaagugcagaugcuacggcacaacuuagcauguaagcguccuguaaauguuaguuucuuuuc

SEQ ID NO: 4104628 - RNA, 70 nt, Human
gaaaagucauaucccuugacugccuaugcccuccccauaauaacagaauguagggagauaugcucuuuuc

SEQ ID NO: 4104629 - RNA, 77 nt, Human
gaaaagugauuagcucaaagccuucauuuuuuucucccaaccacauauaugacagaagugucugagcuguauuuuuc

SEQ ID NO: 4104630 - RNA, 77 nt, Human
gaaaauaaacaagggcuaacucuccacccagacaaugaguggcuuacuuaauggagauuuagcacuuacguauuuuc

SEQ ID NO: 4104631 - RNA, 75 nt, Human
gaaaauagaaaggaucuuggcugccucauaaaaagaaagucccuauaugcacaccuggguccuugucuuauuuuu

SEQ ID NO: 4104632 - RNA, 78 nt, Human
gaaaauagauacuacuuagauguagcaaauugguuccuuuuccuuugccucuuguauaccuuuauguaguuuauuuuc

SEQ ID NO: 4104633 - RNA, 62 nt, Human
gaaaauagcacuuauagauuuggucucuaguaccaagagagcugaauucaagugcuggcuuc

SEQ ID NO: 4104634 - RNA, 111 nt, Human
gaaaauauaggaugcccaguucacuuugaaucucagauaaccaaaugggacaggcuuauacuauaauaugaaacuuuggauaucugagauucaaacuuccuuucgauuuuc

SEQ ID NO: 4104635 - RNA, 87 nt, Human
gaaaauauucauccaucauuaguggcauuuuccuaaaauugaagcuuggauuccaauuuguuugaugauggaaagggugaauuuuuc

SEQ ID NO: 4104636 - RNA, 58 nt, Human
gaaaaucccagcagcuauguaugggaugguuacaccagacacugugcuaaggauuuuc

SEQ ID NO: 4104637 - RNA, 106 nt, Human
cuggaucaugaaaacaaagggugaguauaguucagaugcauuugaaggcauaggcagaaaaugcaucaugcuuuauugcuucugggcacgcuucccuucuuuccag

SEQ ID NO: 4104638 - RNA, 90 nt, Human
cuggaugagaagguguucaguccugcuggcuucaggagauucauuccugaauaccuugcuguagccacgcagugauggagcuccugacag

SEQ ID NO: 4104639 - RNA, 59 nt, Human
cuggaugcaucuuaucaaaaauuauaucuguauacaguguauacauaagguguaaccag

SEQ ID NO: 4104640 - RNA, 56 nt, Human
cuggaugcuuccucucugcuagccacuguucuuggcugcacauggcagccaucuag

SEQ ID NO: 4104641 - RNA, 109 nt, Human
cuggauuuggaugagcagagaggagucccuaucacaguucacuaaauuaaauaaaauuuugguugacauacagguauuuuuuucugucuuaacauuuaaaaaaauccag

SEQ ID NO: 4104642 - RNA, 56 nt, Human
cuggcaagcgugccacuccuaggccagcuccgggcuaggcuggcacuccuggccag

SEQ ID NO: 4104643 - RNA, 64 nt, Human
cuggcaagguuucgaguucccaaccacagcacccucagugaugguuuucagaagaccuuguuag

SEQ ID NO: 4104644 - RNA, 59 nt, Human
cuggcaaucuggcccuuugucagaguauugaaggagacagcaagaggaccagaugugag

SEQ ID NO: 4104645 - RNA, 73 nt, Human
cuggcaccauggcuggguucucgcucugcagggauaaucugccagcugguaggcaccuagcccugugggccag

SEQ ID NO: 4104646 - RNA, 86 nt, Human
cuggcacucaggcaguaagacuucaaacgacauuuauuuuaaacuuuauuugugacugucuuuaguuuuacugucuggagaaucag

SEQ ID NO: 4104647 - RNA, 71 nt, Human
cuggcacucauaggccaguucaccaggucugagcagagacagcaccaacugagcuccuugaggcaugccag

SEQ ID NO: 4104648 - RNA, 67 nt, Human
cuggcacuuccuggacacccagagcacaggcuaagccagcucugaaggugcuagagaaagcuguugg

SEQ ID NO: 4104649 - RNA, 56 nt, Human
cuggcagcagcuucuggaucgaucgacgcuccgacaggccgggaagcaguugcuag

SEQ ID NO: 4104650 - RNA, 60 nt, Human
cuggcagcaguuaugaaacaauguuacuuguucuuaguaaaguucaggcacuuuugccag

SEQ ID NO: 4104651 - RNA, 69 nt, Human
cuugguugaacagauaauuucuaaguuacuuuuccacuuaagguaauaugauuuuauuuggauaccagg

SEQ ID NO: 4104652 - RNA, 65 nt, Human
cuugguuuguuauuaagauccaugaaaaaccuaauguguuucacaaaugucuuuaacuugccagg

SEQ ID NO: 4104653 - RNA, 80 nt, Human
cuuguaaaauucuuucacuuagagccagaugcauaguagguacuauuagcuaaucugaaucugaaauugaauuuggcaag

SEQ ID NO: 4104654 - RNA, 81 nt, Human
cuuguacuguuuacucucagcuaucugagaauaacccuuuugaggguugcauuuuuagaggcucagcgucuucaguucuag

SEQ ID NO: 4104655 - RNA, 55 nt, Human
cuuguagaccccuggacucacgaccugauaggcgcaggggcccggggucugcgag

SEQ ID NO: 4104656 - RNA, 81 nt, Human
cuuguaggagaucaguugcucucaucagaagguggaggcuucucaugaggggcuuuaugugaguagcacugucccugggag

SEQ ID NO: 4104657 - RNA, 79 nt, Human
cuuguaggauaagcaguggagggaaaugggaaggggcacuggcauucaucauccauuguccucacauuagcccugugag

SEQ ID NO: 4104658 - RNA, 81 nt, Human
cuuguagucaaggccagagaggcaaauccuagcaucccuccugggaaugguauuggggaccuuucuggccacggcuuuggg

SEQ ID NO: 4104659 - RNA, 91 nt, Human
cuuguagucgccaccagcugcaacaccaucuccugcagcuccagcagcuucaccuggagggaggggugcucagcugucacgcugcugccag

SEQ ID NO: 4104660 - RNA, 69 nt, Human
cuuguaguucauugauaagaauguauagaauuccagaaauuacauuuauuuauccuucuggauugcaag

SEQ ID NO: 4104661 - RNA, 75 nt, Human
cuuguaguuuagcagaggcugucugacuuaacugggcccuuugguagaggaaagcagccacugccaaucuacagg

SEQ ID NO: 4104662 - RNA, 57 nt, Human
cuuguauugcaaacuggccaggcauuacuucuacugcguucuacugggcaaugcaag

SEQ ID NO: 4104663 - RNA, 92 nt, Human
cuugucccaggucagccaggcuggccucggcagcaggaacagcggguucaagccccugcuucucccugagauaguguggcacuuggggcaag

SEQ ID NO: 4104664 - RNA, 72 nt, Human
cuugucccugccuuuaggggccucucccucuccccaagaaaaguggucucacugaaguuuaccagguucaag

SEQ ID NO: 4104665 - RNA, 62 nt, Human
cuugucuaauucagugacuuugggccaguguaaaagaaauugccucagacaaguuagacagg

SEQ ID NO: 4104666 - RNA, 57 nt, Human
cuugucuaccuggcuccugagacagaaccagggccucugagacccagguggacacgg

SEQ ID NO: 4104667 - RNA, 108 nt, Human
cuugugagaugguuugguggugagaguggggaggcaggggaagugcgcagagagaccaucgcuucccucugcuccuugguccaugacacaacaucuauuucucagaag

SEQ ID NO: 4104668 - RNA, 84 nt, Human
cuugugcaaggauauuuagucuaguguuauuccuauaauaaauaacaaaaauuggaagccacuuaaauguuccuacagcagagg

SEQ ID NO: 4104669 - RNA, 99 nt, Human
cuugugccaagagccaggagcccagaugguagcccuagaauucagcugcucaccagaaguuguucugcuaauuugauggccuugucuguugggagcagg

SEQ ID NO: 4104670 - RNA, 74 nt, Human
cuugugcugcaguuucccugcuugaaaacguggucccucaugggagcguugcauggguacuggggacacacaag

SEQ ID NO: 4104671 - RNA, 92 nt, Human
cuugugcuucaugguuguuuuguugaagggaauuuaccucuguugcuguguguuggauauucugucuuuuuaaaauaauacuucaguaugag

SEQ ID NO: 4104672 - RNA, 104 nt, Human
cuuguggaagcuagcaccguggcagccacugcuucuggaggaauuuggccaaguguuuggugaaccuggggcuguugcugguaggcagugcuggcagucacaag

SEQ ID NO: 4104673 - RNA, 59 nt, Human
cuuguggagauauccaugucugccccacacauagggaaggcaacuugcaucucggcaag

SEQ ID NO: 4104674 - RNA, 68 nt, Human
cuuguggguggggcucccccuucugagucauagcaaaugccggcuggggcuguccccaugacuauagg

SEQ ID NO: 4104675 - RNA, 130 nt, Human
cuuguguaauuugacaaaugcaguccugucuguugcucagaagccacuugucugccagacucuaaggggcagcagugccgcaucuugugaccauucacacagcugacuguauguuuucaagguucacgag

SEQ ID NO: 4104676 - RNA, 83 nt, Human
cuugugugugugugcauauguguauuuaguucuauacaauguuaacauauguguagauuugcauauuuaccaccauagucaag

SEQ ID NO: 4104677 - RNA, 58 nt, Human
cuuguguucuuuucacuggcuguucccaaacugugggacaguuuuaaggagcacaugg

SEQ ID NO: 4104678 - RNA, 67 nt, Human
cuuguuaaaaugcagauuccaaugccguaggucuggcuggggcuagagagucugcauuucuagcaag

SEQ ID NO: 4104679 - RNA, 66 nt, Human
cuuguuaaauuagguaguguuuuuaaggauuuccuuguaugaauguauccuaauuuuuaaaacaag

SEQ ID NO: 4104680 - RNA, 69 nt, Human
cuuguugcccaggcuggaaugcaguggcgugaucucggcucacugaaaccuccgccucccgguuucaag

SEQ ID NO: 4104681 - RNA, 85 nt, Human
cuuguugugcaguggcauuugagagcgcaugcuuaaguugucaaaugcagauauuuaaugcaauuuucucaguccauucaacaag

SEQ ID NO: 4104682 - RNA, 79 nt, Human
cuuguuguuuucuuauugugcuaagggauuuauugagauucaucgaaaguccuuggagaauagaaaggaaaguaggaag

SEQ ID NO: 4104683 - RNA, 79 nt, Human
cuuguuuaucucuguagcccugguuuuguuuaccacuuaauaguauucaccucauugggcugcuggaagacugaacaag

SEQ ID NO: 4104684 - RNA, 64 nt, Human
cuuguuucuuagcgaugcuugauaaauggcuguugcuuauuugaugugcagauugagagagaag

SEQ ID NO: 4104685 - RNA, 58 nt, Human
cuuguuuucuucugcagucuauccaucugaauugaaggggaggguggaagaaagcaag

SEQ ID NO: 4104686 - RNA, 129 nt, Human
cuuuaaaaacuauugcugauaagaggaaaacaaaguuauuagugaguguucuguucuguguguuuuucccuuuagagucacaugagcacuaauuagggaaaaaucuuuuccuugaagcaguauuaaaug

SEQ ID NO: 4104687 - RNA, 64 nt, Human
cuuuaaaaccuuaauucugagcuccuuugggggacaagggaaacuagaagcaggguuauaauag

SEQ ID NO: 4104688 - RNA, 64 nt, Human
cuuuaaugcaugaaacuguacuguggacuaccaccucaguauguacucuuaucauguaguaagg

SEQ ID NO: 4104689 - RNA, 99 nt, Human
cuuuaauuuuuuucccccacugagauccuguaggcagcuaagaauguaugauagggccuuuuggaugcuuuaggacuugauguaggauaaagaaaaaag

SEQ ID NO: 4104690 - RNA, 57 nt, Human
cuuuacacauccuaaccaguguccaggaugauuccagcacaggggaggagugugaag

SEQ ID NO: 4104691 - RNA, 70 nt, Human
cuuuacagauaggaacuacucaguuuaacuguuucuuuuugagugaguuugguaguuugugucuuugaag

SEQ ID NO: 4104692 - RNA, 82 nt, Human
cuuuagaagaugaguagguagcauuaguaaucuuauagcaguuugcaaagauuaagauagaauuaauguugaauuucuaaag

SEQ ID NO: 4104693 - RNA, 71 nt, Human
cuuuaggaauccuugguuuuaagcaauagaaauagaguuuuucuagcuuaggcaaagaggaauuuauuagg

SEQ ID NO: 4104694 - RNA, 65 nt, Human
cuuuaggcaaagcuggaauccagggccuuguaguucccacccguuaguccugguuuugccuucag

SEQ ID NO: 4104695 - RNA, 83 nt, Human
cuuuaggcggcucaguuugaauagcauaggauuacauuugcuugucugcaggucaaaccucacuauuuagauugucacuaaag

SEQ ID NO: 4104696 - RNA, 60 nt, Human
cuuuaggucuguaauaaacuuuauugcuaagaguacaguuuaugaaacacagauuugagg

SEQ ID NO: 4104697 - RNA, 90 nt, Human
cuuuaguuaauaauaauguguuaguauugauuugucaauuguaacaaaugaagaaauauacaggacuaaugcaauuuguuaauaauagag

SEQ ID NO: 4104698 - RNA, 62 nt, Human
cuuuaguuauuuagacuacaguaaacuucuugugaguggucaugaauucuagaugacuggag

SEQ ID NO: 4104699 - RNA, 61 nt, Human
cuuuaguuuguaagagcaagaguccaucagcgggacauguaguugaauaugcaaacugaag

SEQ ID NO: 4104700 - RNA, 59 nt, Human
cuuuauaauguuuuccauggacugagcuauuuucagaacaauugggaaccauuaugcag

SEQ ID NO: 4104701 - RNA, 129 nt, Human
cuuuauacaaaaccaggucagcacacugugucuuggaggcugaugcugccucacagagaugacuccuuucuguagaaaacugcagccuuagcauccagggccagacucuuaccucaugcaaugauagag

SEQ ID NO: 4104702 - RNA, 64 nt, Human
cuuuaucuaggguaagaaaaccaggaaaagaggugggaaugguaagucuggacuacagaugaag

SEQ ID NO: 4104703 - RNA, 55 nt, Human
cuuuaugaaccuguucagcuugagacaauccuacaagccaaacuguuucaugggg

SEQ ID NO: 4104704 - RNA, 61 nt, Human
cuuuaugugcugggcauuaaggcaggggggauuucuguuuugaucugucuguauaaugagg

SEQ ID NO: 4104705 - RNA, 72 nt, Human
cuuuauucagaaauugucagugauaugauacagcuaauuaaggcaugcaugguguuaacaguuucauuagag

SEQ ID NO: 4104706 - RNA, 62 nt, Human
cuuuauucugcaaauugccuugaaagaaaugucaauuaaagaaaggcuguuuguuaauaaag

SEQ ID NO: 4104707 - RNA, 78 nt, Human
cuuuauugucuuccccugccaggugccuuugugcagugcgcaaacuucacaacuguacauggcagcucugcaauggag

SEQ ID NO: 4104708 - RNA, 66 nt, Human
cuuuauuugccuccagaagggcuagaagcaaaccccaucugcauucccaagggaggcaggauaagg

SEQ ID NO: 4104709 - RNA, 56 nt, Human
cuuucaaagaguaggagguuuuuuggucucagaaguucucacuagugcuuugagag

SEQ ID NO: 4104710 - RNA, 67 nt, Human
cuuucaaaugaagcagcaccauuuuagagcaaggaaacuggcuuuuguguguucuaucaccuggaag

SEQ ID NO: 4104711 - RNA, 97 nt, Human
cuuucacaggaucuugcugucagacagcagugguaaauccguuggaaauucagcacucucuguugccgacugucugggggccaaacuuuugugagag

SEQ ID NO: 4104712 - RNA, 67 nt, Human
cuuuccacuuggaggcccccugugcccugcagccucaggguaggccgugggucaccaggcuggagag

SEQ ID NO: 4104713 - RNA, 60 nt, Human
cuuuccagccagauuugcuggguuucugaacaguuuaacacaguuuucuuggcuggaggg

SEQ ID NO: 4104714 - RNA, 66 nt, Human
cuuuccaguuuuugucucuuguccugucuagggaaaaacaaagaggcauaaaauuuauaugggaag

SEQ ID NO: 4104715 - RNA, 55 nt, Human
cuuuccccaguauaucauugcccuagcaaauggacacauguaccuuuggggaagg

SEQ ID NO: 4104716 - RNA, 110 nt, Human
cuuuccucaccuguacagugaaggguuuucaaggucuucuccagaacaauauucuaagaaugcuuugcaaaauuaaauaugcauuuauugauaauuuacuauguggaaag

SEQ ID NO: 4104717 - RNA, 58 nt, Human
cuuuccuccacucccuaggcuuagaagccccacccuagccuuagagcugcuuggagag

SEQ ID NO: 4104718 - RNA, 66 nt, Human
cuuuccucugcuacuguuaaaccauuuggauuuucuuaagugguuucccccgguagugcuggagag

SEQ ID NO: 4104719 - RNA, 76 nt, Human
cuuuccugccugcaggcuggaccgugccccacuaggcaaacuguggcccugcuggacacgccugcugguggggagg

SEQ ID NO: 4104720 - RNA, 62 nt, Human
cuuuccugguuggggacgugguuguuuuagccugaauccaauuacaaccaagaacuggaagg

SEQ ID NO: 4104721 - RNA, 74 nt, Human
cuuuccugucuggucccuguagguauuugacuuagugaccucugaguuaaaaucauagcagugacuugggaaag

SEQ ID NO: 4104722 - RNA, 67 nt, Human
cuuuccuuuucauaugccccgcgucagaauucuuguuccuuuaucugaguggcagggaaauggaaag

SEQ ID NO: 4104723 - RNA, 63 nt, Human
cuuucuagccuauccacuuuucaaucacaaaagagcuuuggagggggaguuucaguuagaaag

SEQ ID NO: 4104724 - RNA, 56 nt, Human
cuuucuauagaagcggguuguagguaauuggacauacaaauuguuuauauaggaag

SEQ ID NO: 4104725 - RNA, 57 nt, Human
cuuucucaaugccggaaggcacgucauugcaucaugaugccuucuaggguuggaaag

SEQ ID NO: 4104726 - RNA, 61 nt, Human
cuuucucaguguuuaaaaagauuuccagagacuuaauucugggguucugauacagagaaag

SEQ ID NO: 4104727 - RNA, 60 nt, Human
cuuucucuagaccuguuuccucugcccucuguucaaagaggucuuuuggucugcagaagg

SEQ ID NO: 4104728 - RNA, 98 nt, Human
cuuucucugucuccuuugauuuuccuuauagcuagacccaccuaaaagugaaguuacauauguggauguuuauaugaagaauaaaggacacaagaaag

SEQ ID NO: 4104729 - RNA, 71 nt, Human
cuuucugagauuauaagauagagucauucacgucagugcucuggagauucuauguuguugauuauagaaag

SEQ ID NO: 4104730 - RNA, 117 nt, Human
cuuucugcacugaagaugcagccuguuucuagcacuguauguaguuccuaagauuccucaagauagaggucuuacccacagcaucuagaaagcaagacagggcaagaugcagccugg

SEQ ID NO: 4104731 - RNA, 130 nt, Human
cuuucuucuucuucuuguuauaauugugcuuuucccagccagucaugagguuucuggcugcuggguuucacagaugccuuggccaacaccuugcaaacuggcugaagugcccugucugacacggagaaag

SEQ ID NO: 4104732 - RNA, 97 nt, Human
cuuucuucuuuccauuccuuuuugcugauaagcagaauucaguucuacagguaguauggauauguuuauaguaugaaguuuggagauuauaggaaag

SEQ ID NO: 4104733 - RNA, 115 nt, Human
cuuucuuucucuuuuaguucuugacuauuucuauccuuccaauaauaucuauugccaauacuuaaaauacauucaaaggaaggauagauaggaaggaaggaaggaaggaaggaag

SEQ ID NO: 4104734 - RNA, 77 nt, Human
cuuucuuugccuuaauacuuagauaccaguguauacguaaguguauccugcuuugacuguuaagaaccauagggaag

SEQ ID NO: 4104735 - RNA, 75 nt, Human
cuuugaaaagcacaucucauugggugcacacauguuugcacacagacaugguuuauuuuaaugguguauucaaag

SEQ ID NO: 4104736 - RNA, 63 nt, Human
cuuugaaaguucuaaaacucuuugugagcugaaguugcaggaggauuuuguggagcuggugag

SEQ ID NO: 4104737 - RNA, 76 nt, Human
cuuugagauucugucuugaucacuuucucuucuugcucaaugagcucuaucugggaaauugucaacacucucaagg

SEQ ID NO: 4104738 - RNA, 79 nt, Human
cuuugagcaaccucauuucucagaaaaggaaucuucuuuauagaagauacaacucagaagugugguuacuuccucaagg

SEQ ID NO: 4104739 - RNA, 57 nt, Human
cuuugagucagauguuuugaaaguucuuuuccaacuuucaaauaucaugauucuagg

SEQ ID NO: 4104740 - RNA, 100 nt, Human
cuuugauauagcauugaccugucaucuccuuaauucugugcaauauguuuauaacauuuagcacuuguaacagagaaaggaauaggaacauauuuuaaag

SEQ ID NO: 4104741 - RNA, 55 nt, Human
cuuugcaauagaggcacacauguuuucaugaugccacuggauucugcuugcaaag

SEQ ID NO: 4104742 - RNA, 67 nt, Human
cuuugcaccauugcugggcuaguucccucaugguccuggggaaggaagccuaguaauggagucagag

SEQ ID NO: 4104743 - RNA, 101 nt, Human
cuuugcagugucacugagagaggcgugucuugccccuggcucuaauuugggagcuccuggcaaggucaugguggccccucuuguuugugauucuguuuaag

SEQ ID NO: 4104744 - RNA, 69 nt, Human
cuuugccacuuucuauguucaaagggugcuaguccacacuucuuugcaaacuauggagugugcuuaagg

SEQ ID NO: 4104745 - RNA, 63 nt, Human
cuuugccaggagcucaucugagggaagagacacagaccuucccuggagcuagucugagcgggg

SEQ ID NO: 4104746 - RNA, 77 nt, Human
cuuugcgagcugcucccuguauuccauccuaugucaguuacaaagaugaggaaaacagaccaaggagcucgacagag

SEQ ID NO: 4104747 - RNA, 62 nt, Human
cuuugcuaaacauaaaguucauacuggagagaaaucuuacaaauaugaagaauguggcaaag

SEQ ID NO: 4104748 - RNA, 60 nt, Human
cuuugcuacugugaauagugccacaauaaacauacgugugcaugauuuauaguagcaugg

SEQ ID NO: 4104749 - RNA, 63 nt, Human
cuuugcuaggagcucaucugagggaagagacacagaccuucccuggagcuagucugagcagag

SEQ ID NO: 4104750 - RNA, 78 nt, Human
cuuugcuauugugaauagugccgcaauaaacauacguguucaugugucuuuguagcagcaugauuuauaauccuuugg

SEQ ID NO: 4104751 - RNA, 63 nt, Human
cuuugcugaugcaugccaugugccaguugccaagcaacauacauaacacauucaucagcagag

SEQ ID NO: 4104752 - RNA, 115 nt, Human
cuuugcugccacugugucaguugggucuucuccaaguagaagcuaaguugcaaucgugugugcagguacucuacuggggagaaauaccugugaaugaaagccagaggaagcaagg

SEQ ID NO: 4104753 - RNA, 130 nt, Human
cuuugcuggucagauggcagaggcgggaacgugcaggaaucaggaugcugucaguuaccagaccgugcaagagcugguggacauggcccugacagguccugggcaagucagcccugucuggcucccaagg

SEQ ID NO: 4104754 - RNA, 70 nt, Human
cuuugcuuuaacugaaagugcuccugaauuuaaguguucauuugugaaggagcacuuucaguuuguaaag

SEQ ID NO: 4104755 - RNA, 78 nt, Human
cuuugcuuuucauagagaaggaguguccccaaggaaccugccuccaugccauggcacagcccucucuguggacaugag

SEQ ID NO: 4104756 - RNA, 58 nt, Human
cuuuggaacacaugggcaugguucuuaaccuagaccaggcagggaagugauuucaggg

SEQ ID NO: 4104757 - RNA, 69 nt, Human
cuuuggaaugucugcucuacucaggaggugaucuggugccagccucuugcagagaaggagacaaaaaag

SEQ ID NO: 4104758 - RNA, 84 nt, Human
cuuuggacaguccuguacaggccauaucuccaaguacuccaucugcuccugaaggauacgaccugaaaauaggacuuucuuugg

SEQ ID NO: 4104759 - RNA, 75 nt, Human
cuuuggaucacuguuccucugggaaaaaaacaggaagaaacuguagaguccagaaaauaauagugauggcuaaag

SEQ ID NO: 4104760 - RNA, 83 nt, Human
cuuuggaucgugccucagucauuggccuacacuuuaccuuuuccugaggcguagaugauugaagcaagaguagagauccagag

SEQ ID NO: 4104761 - RNA, 93 nt, Human
cuuuggauucaucauggagaauauaccaaaugcuuaaaagauucuuacuuugcuuauagcuuuggaugaucuuugauacugagaaucacaaag

SEQ ID NO: 4104762 - RNA, 58 nt, Human
cuuuggcugcuagaugguguuagaccaaagaacugguuucacguugucucaguuaagg

SEQ ID NO: 4104763 - RNA, 77 nt, Human
cuuuggcuuggagaauuuaagugacuuuguaacacuuucagucaugaaguccagugcuuuagauuccaaagccagag

SEQ ID NO: 4104764 - RNA, 92 nt, Human
cuuugggaaacgcuuugaagugauuaaccaugcucugcuuugcugcuucugggggagcagcaguguguggucauguuugaaguaggccaagg

SEQ ID NO: 4104765 - RNA, 55 nt, Human
cuuugggaagauugaacuugcuaccuuucucacggcuguucaucuuuuucuaaag

SEQ ID NO: 4104766 - RNA, 89 nt, Human
cuuugggacuugcguugggucagcgacaccacagcagguguucagccuugcgccuucaguagugucagcuguacacauacauccuagag

SEQ ID NO: 4104767 - RNA, 58 nt, Human
cuuugggcaaagggccaauucgggaugcguuucucucugauuuggagccaugccaaag

SEQ ID NO: 4104768 - RNA, 59 nt, Human
cuuugggcacugaaguaugggugaggugcucugauucaugauccuuccggugcccacag

SEQ ID NO: 4104769 - RNA, 67 nt, Human
cuuugggcuuauugauuacaaagcuucuucauuacuucuguggagcugcagaucaauaggcucacag

SEQ ID NO: 4104770 - RNA, 68 nt, Human
cuuugggcuuuggccaacucuucgcuaauacaguuugcuggccugagugaauagggccagaaccaaag

SEQ ID NO: 4104771 - RNA, 77 nt, Human
cuuuggggaauaccacuuugguauuucaauuuuagccacagcaaagucaggaagugcaaaaguugaaguucucaggg

SEQ ID NO: 4104772 - RNA, 90 nt, Human
cuuugguggugagggugugaaaugagggggugcacguggagggaaaaaagggacuccccucccucuuggcuucuaucccaccaacccggg

SEQ ID NO: 4104773 - RNA, 55 nt, Human
cuuugguucuguccuucccagaaaccugaaaguugaagccaagacaggaucaagg

SEQ ID NO: 4104774 - RNA, 80 nt, Human
cuuuguaaacugagcacuuuucaaagagagcuccaaauuccuacagagcugucuuuaagugagcuuugaucuuugcagag

SEQ ID NO: 4104775 - RNA, 58 nt, Human
cuuuguaaggauucucugcagggcuagaguucugaguccacagguccucuuugcaaag

SEQ ID NO: 4104776 - RNA, 62 nt, Human
cuuuguaggauaaaaggucgggucaacuuuucuccaggagcugaaauucuuuguccucagag

SEQ ID NO: 4104777 - RNA, 57 nt, Human
cuuuguaggccuggcggcccguggcgugcgggcggcuucuucgaggugucugcgagg

SEQ ID NO: 4104778 - RNA, 69 nt, Human
cuuuguauugggaugugcuuugaaucuugaaaaaugcuuuucacacuuggagcaacacuuauggcagag

SEQ ID NO: 4104779 - RNA, 75 nt, Human
cuuuguauuuacugauuuuaaacuuacuuaagccuuguuucaaaaaaggccuaagugguuaaauggcuuacaaag

SEQ ID NO: 4104780 - RNA, 90 nt, Human
gaaauccaaccuauuccuccagucuuucagaugucccuguauuucaugcagguaguacaugcuugaggcuacugaugaauaguuugcuuc

SEQ ID NO: 4104781 - RNA, 71 nt, Human
gaaaugaaccaaugcuggauaccaucugccauuguuaaaaggaagauucuaguccagugggccuucauuuc

SEQ ID NO: 4104782 - RNA, 76 nt, Human
gaaaugaaggcuuguuuguuccuucuuggccaaucaaaguagaagacucagaggaccaaaaggaaagcaacauuuu

SEQ ID NO: 4104783 - RNA, 83 nt, Human
gaaaugaaugaaaauuauaagaaacaaggcaaauuuugaggguaucauuuaucaugauaucuuguuuuucaugcauccauuuc

SEQ ID NO: 4104784 - RNA, 111 nt, Human
gaaaugaggccucauucaguuuccuaauuuccaagauucuuuuucagcacccagcugaauaaaguauguccugggaagagagaagaagaaagucuuaaugaggcccagcuc

SEQ ID NO: 4104785 - RNA, 61 nt, Human
gaaaugaugacaggauaaagaacaaugaucaaguuguagcuugaauucuugucauucaguc

SEQ ID NO: 4104786 - RNA, 82 nt, Human
gaaaugaccuugguuuaauuaccugcaucucaaugagugaaucuacauagaaagugaagguuaauuaaugaaggaucguuuc

SEQ ID NO: 4104787 - RNA, 61 nt, Human
gaaaugaguugauucagagacucuggucaucaucccagcgucacugccucuuaacuuuuuc

SEQ ID NO: 4104788 - RNA, 89 nt, Human
gaaaugauaauguguguaccauuuugaaacauuucaucauuuguuaaugugacaugaaaguccagauguguccauacagugguaauuuc

SEQ ID NO: 4104789 - RNA, 88 nt, Human
gaaaugaugucucuaguauaauauagcaaaagguaagcaauaugaaaccuacaucuuuugguagaaugauauuggaugugcaaauuuc

SEQ ID NO: 4104790 - RNA, 59 nt, Human
gaaaugcaccuugcugugagacuguggagauaaaacaggauuuaaaggcaaugcauuuu

SEQ ID NO: 4104791 - RNA, 85 nt, Human
gaaaugccaaguggaaccaaagccgaccuugcacuagcacgugauacuagucaaggaggugcuuggcuucacucugcugcauuuu

SEQ ID NO: 4104792 - RNA, 58 nt, Human
gaaaugcccucccacugaauguaccuugugacuugcaaaagugaugggauggcacuuc

SEQ ID NO: 4104793 - RNA, 63 nt, Human
gaaaugcugagguguguuuaauuuagaagucagauauuuugaaaugaaaaaucuuagcauuuu

SEQ ID NO: 4104794 - RNA, 86 nt, Human
gaaaugcuuucugaaaugcuggcuuuggagccaaaacuguauggauucagaguaacuuuggcaaguuuucagaauuucuacauuuu

SEQ ID NO: 4104795 - RNA, 83 nt, Human
gaaaugcuuugaguagaaauguaguguagagaaacauucugugucguuucagccuagucacugcauuucuauauggcuuuguc

SEQ ID NO: 4104796 - RNA, 60 nt, Human
gaaauggcaagaggccacuuaacagguuuagucaacccuccugaugaggccagccauuuc

SEQ ID NO: 4104797 - RNA, 66 nt, Human
gaaauggcauguggcuggguuuucauagcaccuuuacuuugaggcucagagcaccugcuccauuuc

SEQ ID NO: 4104798 - RNA, 129 nt, Human
gaaauggcugggcuacauaugauacccuguaagcguuaucaaacuggcuuauggaacuggaauggcaagaaguuauaagccucgaugguaagccugaguuauggggaggacauaucugccaccccaagc

SEQ ID NO: 4104799 - RNA, 67 nt, Human
gaagauauauucgacgugaaugaggcuuuuccuccuugagucucucuccugcacugaauuaugucuc

SEQ ID NO: 4104800 - RNA, 95 nt, Human
gaagauauuuccacaucucuuacauuuauaaggcuucucuguguaugaucucccaaaugcagaguaagggauaagguuugagaggaaauguuauc

SEQ ID NO: 4104801 - RNA, 73 nt, Human
gaagaugauuucuccauucccuucuccgagcagagcucuugaagaagaugggaguuaggagaagugaaucuuu

SEQ ID NO: 4104802 - RNA, 103 nt, Human
gaagauggaacuuuugauucuggaaauuuugaacaguuucuaaaagguuaaaaucaauggaaaaacugaaaaucucacagauguuguuaacagugaaugcuuc

SEQ ID NO: 4104803 - RNA, 64 nt, Human
gaagauggguauaacauagccauguuugccugcagaacuugaauaugagauauacuuauucuuu

SEQ ID NO: 4104804 - RNA, 71 nt, Human
gaagauucccugagggcaugaacauuccauaugccuguaaugauggaauauaccuucgggagaggaacuuc

SEQ ID NO: 4104805 - RNA, 71 nt, Human
gaagauugcgugaggauuuuguuacuguucaacuuugagagcuguuuguaacaagaaccucaugugacuuu

SEQ ID NO: 4104806 - RNA, 65 nt, Human
gaagauuuuagaaucuguguucaaaccuacugucuuuagugucucagaaacagauucuuaucauc

SEQ ID NO: 4104807 - RNA, 61 nt, Human
gaagauuuucuccuuuaaaugaucccaguacauaugcauggcucuuaaagaagaggaucuc

SEQ ID NO: 4104808 - RNA, 63 nt, Human
gaagcaaacuuucuguguuauuacugucucugacgagcagcauuaacacagaaagcuuccuuc

SEQ ID NO: 4104809 - RNA, 75 nt, Human
gaagcaaagcagccugcaguguggacagaaggacugaaccaaaaaguccacacugagagcucagcuuccggcuuu

SEQ ID NO: 4104810 - RNA, 76 nt, Human
gaagcaaagccaggcuguggggaacuugaacgcacaaaaagguguuuagacuuuacccuauguuugauguagcuuc

SEQ ID NO: 4104811 - RNA, 64 nt, Human
gaagcacauggcuauagcuauugccgaugaucuguaacguuguuuauagcucaggccaugcuuc

SEQ ID NO: 4104812 - RNA, 58 nt, Human
gaagcacauggcugugagcaacucggcauggcuucugcccuugugcagcuguggcuuc

SEQ ID NO: 4104813 - RNA, 129 nt, Human
gaagcaccucuggagugcagguccucagcuacugagcacagugcaaacccucgggaaaguacacgucuuguacauuucucaccugcaccugcgacggugguggaguuugccugacagcagaggugagac

SEQ ID NO: 4104814 - RNA, 97 nt, Human
gaagcacugcuguguauagugaaaauagagcaaacuuuaggggcaaacagcacuuuugaguuugagcccuggcucuuucacuuacugugugaucuuu

SEQ ID NO: 4104815 - RNA, 59 nt, Human
gaagcagcaugaagggagcuggguuuggggguguuggcugggcacugagggugcugcuc

SEQ ID NO: 4104816 - RNA, 55 nt, Human
gaagcagcugccagagaugucuaugcaaagggacguuucugggauucaggguuuc

SEQ ID NO: 4104817 - RNA, 84 nt, Human
gaagcagggcguucucauucuucagcuccucgaucuggcggacacgacggaggucaagggagcugagggccagcgccuugcauc

SEQ ID NO: 4104818 - RNA, 58 nt, Human
gaagcagguguugccuaaauugacaaggccagugaagccuggcagacacaccuucuuc

SEQ ID NO: 4104819 - RNA, 56 nt, Human
gaagcaguagcaacugugucuuccacuguucggaaaacaacaguuguuacuucuuu

SEQ ID NO: 4104820 - RNA, 57 nt, Human
gaagccaagugcaaaugccuuaaaaguaauucuaggcauagcuguuaauuugguuuc

SEQ ID NO: 4104821 - RNA, 69 nt, Human
gaagccacuauacucugacuuuucaggccucaaccuugacauuugcuguuuagcaguagagugugcuuc

SEQ ID NO: 4104822 - RNA, 72 nt, Human
gaagccacucaugaaaacucucccuccucgacaugcucagaggggcuuuaggggccagugaccaguggcuuc

SEQ ID NO: 4104823 - RNA, 72 nt, Human
gaagccacugugagugguuccaaagcuugcuuaauugcaagccacaagagggcagccaugucccagggcuuc

SEQ ID NO: 4104824 - RNA, 67 nt, Human
gaagccagucuuaggagaaacuacagaauuguaggccuuuucugucuuauucuccugacauuaauuc

SEQ ID NO: 4104825 - RNA, 82 nt, Human
gaagccauugagauacaugugugaccaaagagugaugagguggauauuucuuuguguccuauaugcauguucucauuacuuc

SEQ ID NO: 4104826 - RNA, 64 nt, Human
gaagccauuucuucauuucuaagauggacaugucuuuacauuuucugaaguugagauggacuuu

SEQ ID NO: 4104827 - RNA, 76 nt, Human
gaagcccugugcagggucagccaaagcugucucuaagccugcaucacagcucagcuuugcccuuugcccaaucuuc

SEQ ID NO: 4104828 - RNA, 78 nt, Human
gaagccggggaagaauauguauuuuuacaguuaaaggacauuuuugagguauauucacauauaucuuccuaacauuuc

SEQ ID NO: 4104829 - RNA, 77 nt, Human
gaagccuccgucccuguccucuguccucagcaggacacaucccuguccucugcuggaagggcaagaggccuggcuuc

SEQ ID NO: 4104830 - RNA, 78 nt, Human
gaagcgaccaugugcacgugucucuuagcgacaauaaccuugcuggucugauguggagacacuguuuuguguggcuuu

SEQ ID NO: 4104831 - RNA, 130 nt, Human
gaagcgcugggcugagaaaggccggugggugugacaguggacaugacucuccugccuucccugcaguuuugccugagcgcaugucuuuguuaugcucaccaacucaucagcuaggagcagggcuuggaau

SEQ ID NO: 4104832 - RNA, 75 nt, Human
gaagcguuugagauucugaauuucuaacaagcuccuagaagauggcaguguuacugguucaugaaucuuaccuuu

SEQ ID NO: 4104833 - RNA, 63 nt, Human
gaagcuaaaccacagcuaagaaucagauacucuuggugauucuuugaguugugguuugguuuc

SEQ ID NO: 4104834 - RNA, 59 nt, Human
gaagcuaaagcccuguccuuccgugucccugaauacuggagaagcaggugcuuuggguc

SEQ ID NO: 4104835 - RNA, 63 nt, Human
gaagcuagucaagaggcaugggacaggcuccucacagcccucagaaggugccacugacgcuuu

SEQ ID NO: 4104836 - RNA, 69 nt, Human
gaagcuaugaucucugggucuggagcuuugcccucuguacccaaggcucugcacucagagucauucuuc

SEQ ID NO: 4104837 - RNA, 57 nt, Human
gaagcucuuguugaaucuugucaugacacgcaugacuccugagauuacagagccuuc

SEQ ID NO: 4104838 - RNA, 55 nt, Human
gaagcugaugaggaccagauugccaugcuucucacaugccuuccucaucuccuuc

SEQ ID NO: 4104839 - RNA, 73 nt, Human
gaagcugcguguagccauacuuauccucacaucccauuagugagaauuuagucacauggccacaccuagcuuc

SEQ ID NO: 4104840 - RNA, 57 nt, Human
gaagcugcuggaaggaaaugcuuucuucuaucauaugucaccuaaaccagcaguuuc

SEQ ID NO: 4104841 - RNA, 62 nt, Human
gaagcuggaggauggacuggaagaacacgacuuguguuucgggccccaccccaccacguuuc

SEQ ID NO: 4104842 - RNA, 56 nt, Human
gaagcuucaccuugcugaaaaguuuaggcuggcaucauucagcaggcugaagcuuc

SEQ ID NO: 4104843 - RNA, 56 nt, Human
gaagcuucuggcauuucucaaagggaggggaagucugggagaggagccagaauuuu

SEQ ID NO: 4104844 - RNA, 92 nt, Human
gaagcuuguuacgguauuuucaauauaaacauuuuuaucaugaaaaauuuuaaacagacauaaaaaguagugagaauggcgcaacgaacuuc

SEQ ID NO: 4104845 - RNA, 75 nt, Human
gaagcuuguuuggaugaaauuaugaauuauauguguaccauagccaauuccaaauguuuucaauccaaaaguuuc

SEQ ID NO: 4104846 - RNA, 65 nt, Human
gaagcuuuauugcaagugaggcaauaaaaagggaagaaauccaauuacuuuaugugcagagcuuu

SEQ ID NO: 4104847 - RNA, 63 nt, Human
gaaggaaaacagaucugccugauggcugucauugaaaaaucucuuagguggucauuuuccuuc

SEQ ID NO: 4104848 - RNA, 84 nt, Human
gaaggaaagaaucguguguaguuugaaaacagcagaauuuuguccuacugcuuugauuuguuuuuagacaugauauuuauuuuc

SEQ ID NO: 4104849 - RNA, 75 nt, Human
gaaggaaagcacaguccauuugucauuuuugacauucaaaguccagaagguccuggugaccauggaguucccuuc

SEQ ID NO: 4104850 - RNA, 57 nt, Human
gaaggaaaucugugauuuaugcucuguaacuucugggugguacacaguaauuccuuc

SEQ ID NO: 4104851 - RNA, 61 nt, Human
gaaggaagacugguuuaaaugugcagauaucugcauauugacauugcugcuagcuucuuuc

SEQ ID NO: 4104852 - RNA, 77 nt, Human
gaaggaauaaagaaucugguucccccacuagaacacgagcuccuaugcuaauagggggaacuacauucuauuccuuu

SEQ ID NO: 4104853 - RNA, 58 nt, Human
gaaggaauuauuucaguuguagugugaacuugaacaguacaauaaguauaauucuuuc

SEQ ID NO: 4104854 - RNA, 55 nt, Human
gaaggacaagcaaaaccacaacaagcagaaaacuggaugugguggagcugccuuc

SEQ ID NO: 4104855 - RNA, 113 nt, Human
gaaggagaaauguuuuguaaccaaaggauaugggcaaauuggcuuuucagaguacaauauuuugacagacuacugccucuauugcugaguguucacaaauucauuucucaguc

SEQ ID NO: 4104856 - RNA, 64 nt, Human
gaaggagagggucaaggauaauaagcaauacuaauuuucuucuguuucuuauccccucuuguuc

SEQ ID NO: 4104857 - RNA, 80 nt, Human
gaaggagccagaugguucccgucugcugccuugagucaaugcacuuccucccacagacuggagcccuuuugcccuccuuc

SEQ ID NO: 4104858 - RNA, 82 nt, Human
gaaggaggaaugauggugccuagauuaugguugcuguugccagugauguuacaucuauaguagagcaauacauuccggcuuc

SEQ ID NO: 4104859 - RNA, 56 nt, Human
gaaggagggugcggaucugagcgcugaggcucucugaucgauuacgccuuuucuuu

SEQ ID NO: 4104860 - RNA, 100 nt, Human
gaaggauagaaagacuuuggaaggagggugugguccagcagauuucggcuuccucccagcccaucagugacuccuucuuccugcuccucccuuuccucuc

SEQ ID NO: 4104861 - RNA, 73 nt, Human
gaaggaugaagggcgagugagucuauggauaaugaaauaaucagugacugaaaccauuuucccaucauccuuu

SEQ ID NO: 4104862 - RNA, 104 nt, Human
cuguccugcuagcuuaauuuuaaguuugcauuguuugauaggugaauuauuuggaauaauucaguugacagcuaaugccuaaacugauuuggguuaaaauacag

SEQ ID NO: 4104863 - RNA, 59 nt, Human
cuguccugguacuuugagguucuggggauauagugauaaaugucaggguuuuaggagag

SEQ ID NO: 4104864 - RNA, 75 nt, Human
cuguccuucagaaaagugucaguugcuuagaauacagaaugaccucugauaagacagcugauuugaagucuucag

SEQ ID NO: 4104865 - RNA, 57 nt, Human
cuguccuuggcuaaagggaacugcuuuuucuaaggucauuccccuccccagggauag

SEQ ID NO: 4104866 - RNA, 61 nt, Human
gaaaugguguguauauguaaauggaccugaaaggcagugguucuucaauacauggcauuuc

SEQ ID NO: 4104867 - RNA, 74 nt, Human
gaaaugguugcuggaagagcauuugcauagggcauucucuuguucugagcucuugcucauuccuaccucauuuc

SEQ ID NO: 4104868 - RNA, 81 nt, Human
gaaauguaacagcaacaacaauggcaugcaaagaaugagaaaaucauuuauuagguaaaucuguuuuguacguuacauuuu

SEQ ID NO: 4104869 - RNA, 68 nt, Human
gaaauguaugucuucccccauugcaguucaguuacuuuggagaauaugggaggaagagaagauauuuu

SEQ ID NO: 4104870 - RNA, 83 nt, Human
gaaaugucaguagauuucaggagacaaaauggaaaggagccauugcuccaccaccuuuuccuggaagucuuacucuauauuuu

SEQ ID NO: 4104871 - RNA, 56 nt, Human
gaaaugucauagucuucaagccauuuuaggagaagggcugaaggcaaugacauuuc

SEQ ID NO: 4104872 - RNA, 56 nt, Human
gaaaugucauugccuucagcccuucuccuaaaauggcuugaagacuaugacauuuc

SEQ ID NO: 4104873 - RNA, 106 nt, Human
gaaaugugugcagauaaagaaaguaagcacccuucagcccagccuggaggaauagucuucaggcaaggugaagggugcaacuuccauuucccaaaccccguauuuc

SEQ ID NO: 4104874 - RNA, 111 nt, Human
gaaauguuucaccuucucaccacacucucagcuuuucaacuuacuguauacccauacacacugcagugagugcugguuguuguugaugauggcagugauggugaauauuuc

SEQ ID NO: 4104875 - RNA, 64 nt, Human
gaaauguuugggaggagucaacccucuggugccaaauuggaacacugauguuuccagaugucuc

SEQ ID NO: 4104876 - RNA, 85 nt, Human
gaaauuaauuugaggucaaguaaccacuggaagccuuuauauuuuccauuggugaaauauuugaaggucuuuuaaaguuuuguuc

SEQ ID NO: 4104877 - RNA, 84 nt, Human
gaaauucaggcaugugaaguaacuguccaggauccagugacaacaucauggugggccaggugcagugcuuuaguccucuaguuc

SEQ ID NO: 4104878 - RNA, 71 nt, Human
gaaauucaggggcuucuuccuggcuccuauuaauuaucagguugggugagugggaaaagcccagaaucuuc

SEQ ID NO: 4104879 - RNA, 55 nt, Human
gaaauuccucaugugccagucauuuugaagaauggcugccuagacuuggaauuuc

SEQ ID NO: 4104880 - RNA, 64 nt, Human
gaaauugccagaucuaguagaugcggcaccuuuuacugcuaugaguaguggguuuggugguuuc

SEQ ID NO: 4104881 - RNA, 75 nt, Human
gaaauugcgcacauuucuccguugcugcauuaauacuagaaagggagugaacugaacagagaaagugccaauuuc

SEQ ID NO: 4104882 - RNA, 56 nt, Human
gaaauugcuacuggaguuuauguauaugcucauuaaauuucaguguuugcaauuuc

SEQ ID NO: 4104883 - RNA, 55 nt, Human
gaaauugcugucaagucaccacaccuccugucuguggcucgauuuauagcauuuc

SEQ ID NO: 4104884 - RNA, 73 nt, Human
gaaauuggccauggugggaguauuuacaccacaggaauuggcaaaugcuacauacacaucagggcuuuauuuc

SEQ ID NO: 4104885 - RNA, 69 nt, Human
gaaauuguaaaggauugcgccaauucuuaacaucauugguuauucugcgaugcaauccugguauauuuc

SEQ ID NO: 4104886 - RNA, 56 nt, Human
gaaauuguguuagauaugguugugcauuuuaacaucuguucaucugacacagauuc

SEQ ID NO: 4104887 - RNA, 96 nt, Human
gaaauuuauucauauauggcccagugaggugugcaugaaagaaagaaucugguucuacauucauguauuaccucaagccauucauaugaaaaauuc

SEQ ID NO: 4104888 - RNA, 90 nt, Human
gaaauuucuagcgggcuuauuccuggguuccagcccagaucuauggaauucagagucucuggggcuggagccagggaacccgcauuuuuc

SEQ ID NO: 4104889 - RNA, 96 nt, Human
gaacaaacacaaggggauuuuaaauggcaguuuuacaaauuuguauuccugugaaaguuugugucagagcuguuaccaucucugcuuguucuguuu

SEQ ID NO: 4104890 - RNA, 66 nt, Human
gaacaaauuggagaaaucaggauugauuacguuaugugcucucuuugucuuccuccggguuuguuc

SEQ ID NO: 4104891 - RNA, 101 nt, Human
gaacaaggauucuaaaugauuaggguuacacuucuaaaaaaagcaggccuugucuuuuaugucuguguuuuguguuagagugcauuuagagauuuuuguuc

SEQ ID NO: 4104892 - RNA, 104 nt, Human
gaacaauuaauguggauaauucaaagacauuggacaauccagagguccucauuugaccuguguugcuauagucuaauguucuagauuuaauuuauaugguguuu

SEQ ID NO: 4104893 - RNA, 89 nt, Human
gaacacaacuuauuugacuuucugugguccucuugaaggugauuaaucaccaauuuuagagcaccaagaauugcacaauauuaauguuu

SEQ ID NO: 4104894 - RNA, 63 nt, Human
gaacacagugguuguuuggaggagcuccagaggaagugccucuccuuaccccauuguauguuc

SEQ ID NO: 4104895 - RNA, 62 nt, Human
gaacaccuacccccucugcagcacuacauuucaccaaacuccagaggguuucucagguguuu

SEQ ID NO: 4104896 - RNA, 55 nt, Human
gaacacgagucucaccuugaaucugagcucuaguaaagguccaaacucuguguuc

SEQ ID NO: 4104897 - RNA, 60 nt, Human
gaacacugagaggggaguggcaccuucccaggcugcccagcucagucucuugcccuguuc

SEQ ID NO: 4104898 - RNA, 56 nt, Human
gaacacuuagcauauaccaggcacuguucuaggcacugggaauaugcugaggguuc

SEQ ID NO: 4104899 - RNA, 56 nt, Human
gaacacuuuccugccuuucugauguaaucacuuugcgcaaacaguaggaaauguuc

SEQ ID NO: 4104900 - RNA, 61 nt, Human
gaacagaauugugcagauguacugcagcggugugucagugucugcuuaucaguucuuguuc

SEQ ID NO: 4104901 - RNA, 55 nt, Human
gaacagauaauuuaauuaaugcauuuucagaaugcaugugugaauuauuugacuc

SEQ ID NO: 4104902 - RNA, 127 nt, Human
gaacagcucaguucuggcacagaucuuagggggcgcaaggcagagccgccccuggggccugccccgccuaggccugcagacguguuuuccucagccccaccggagcucacugcgaggguagcuuuuc

SEQ ID NO: 4104903 - RNA, 84 nt, Human
gaacaggguuuugguuuaucuguggaucucuuuguugcucuccuaacagugaccacagaguaaaucaggucuguaaaccaguuc

SEQ ID NO: 4104904 - RNA, 62 nt, Human
gaacaugaugacaaagguauauuuuauuaucuccaaguaagguguauaucaauauuauguuu

SEQ ID NO: 4104905 - RNA, 66 nt, Human
gaacaugggccgggaaugacaugccugagucauugacaagggcccacaucuccugccuccauguuc

SEQ ID NO: 4104906 - RNA, 64 nt, Human
gaacaugguggaaucggcgugaaugggagaguaacaaucuccauucuacacguuccauuacuuc

SEQ ID NO: 4104907 - RNA, 62 nt, Human
gaacauuguuuucccuauauccaccuauauucauuguuggaauaagggagccaacaauguuu

SEQ ID NO: 4104908 - RNA, 77 nt, Human
gaaccacugccagcaaugugaccaugcugugucauucaagcacguggaaagcaggcuaaucuugcugaacaggguuu

SEQ ID NO: 4104909 - RNA, 87 nt, Human
gaaccaucagauaauauauuuguguuguuuuaagccacccuguuuguggaaauuguuacagcagcaauggaaagcaacacaaaguuc

SEQ ID NO: 4104910 - RNA, 55 nt, Human
gaaccaugagaaauugcuauuuuuaaagugaaauaguaguaauuuccuauggauc

SEQ ID NO: 4104911 - RNA, 66 nt, Human
gaaccauggacucugguuuggggagcugaucucuuggcucuaaagcagcaggaguucauaaaguuu

SEQ ID NO: 4104912 - RNA, 68 nt, Human
gaaccucuagagagucaggacagcauagcaguuaagaguagggcuucugaugucagacuucuggguuc

SEQ ID NO: 4104913 - RNA, 55 nt, Human
gaaccugagcgggcagcaagcgguuaaauauggcuucccuggaggguucagguuc

SEQ ID NO: 4104914 - RNA, 78 nt, Human
gaaccugauaauaaccagagagucuucuucauugagguccugacgcuacaauugacuuucuguuaucacuuagaguuc

SEQ ID NO: 4104915 - RNA, 83 nt, Human
gaaccuggguaaugaaacuggcauuugacugggacugccacucagaacccaaguuaaaauucagugcucacuacagcagcuuc

SEQ ID NO: 4104916 - RNA, 75 nt, Human
gaaccugggucucuggcgccaucugugcaaacggcugcuccuuucccacauguccuggcgcugagcccuggcuuc

SEQ ID NO: 4104917 - RNA, 77 nt, Human
gaacgaguuacaucaacuccacauggcugucagugugaacuuucuaaaacacacaucacugcugccggagacucguc

SEQ ID NO: 4104918 - RNA, 108 nt, Human
gaacgcaacaaaaauugaagaaauuaaggaaugcaacgaacuaugguaaaaacuguaaaagaaugguuacuguugcucaguuuagugugagcuucaagcuguggauuc

SEQ ID NO: 4104919 - RNA, 56 nt, Human
gaacguguggggcuuggacagcauagcuacuguugcuggcucugccccaccuguuc

SEQ ID NO: 4104920 - RNA, 115 nt, Human
gaacuaauuuuggauaugcugaaaguauuugguaauuuauuuugagagauuauuagauuuaacuuuaaggcuauaaauuaugacaauuaauuuuggcauauauauuuauuauuuc

SEQ ID NO: 4104921 - RNA, 90 nt, Human
gaacuauuuggucauggcacagauguucugauuauuacaggaauuguguccuuaauuaaauuuguacucuagugccaauucaaaaaguuu

SEQ ID NO: 4104922 - RNA, 106 nt, Human
gaacuauuuuugaaagcaaugauguagaguagaagagauauuuucacuagauucagaauauuucuguuuauuuguacaucacuguuaacauuuguaaaaguauuuc

SEQ ID NO: 4104923 - RNA, 86 nt, Human
gaacucagcccagggaaacauuguguucuacagauuuaaaaaccaaaaucuguuaagaacagaaauguugggcuugggcugauuuc

SEQ ID NO: 4104924 - RNA, 129 nt, Human
gaacucuugacuuuggucugcucccugccucauuuuucagucagugacuaagcaguuuuugaguuaauaaguaacucuuaggugacugauuaaaaauucuaggaggugacuuagaaaggagucuaaaac

SEQ ID NO: 4104925 - RNA, 71 nt, Human
gaacucuuggcagugcugcagugcccuuaaugcuggcauugguggccuugauggcaucugcacuggguauc

SEQ ID NO: 4104926 - RNA, 56 nt, Human
gaacugaaacuugguuuaaagcaggacuuaaacucuuuacuaaguuuguacgguuc

SEQ ID NO: 4104927 - RNA, 95 nt, Human
gaacugagcagaguacaccacauuggaacucauuagcccauagagcagaauguuuacacugccuguggucugugaucuaaacgguuguuugguuu

SEQ ID NO: 4104928 - RNA, 56 nt, Human
gaacugagguuuacuugaaggagaagaaauucugccuuugacuauagccucagauc

SEQ ID NO: 4104929 - RNA, 59 nt, Human
gaacugcauugugguauauguugggauugguccaauuccaaucacagggugcuuaguuc

SEQ ID NO: 4104930 - RNA, 79 nt, Human
gaacugcauuuauuggcauguaguagguaguagagaaguggaaauuauuagacuuauuauugucaguagcaugcgguuc

SEQ ID NO: 4104931 - RNA, 69 nt, Human
gaacugcggaggucggugcugcgggcugggcagacccagccagagcucacagcccaggccagcguguuc

SEQ ID NO: 4104932 - RNA, 74 nt, Human
gaacugcuuaguuuauggucuuuaguaggagaugcuuauuaacuacuaauugaugauaauguggcaaauaguuc

SEQ ID NO: 4104933 - RNA, 59 nt, Human
gaacugugucucauucaucauugucaccaaccaggaggacaguagcugacacacaguuu

SEQ ID NO: 4104934 - RNA, 58 nt, Human
gaacuguuugguuuucgaguaaaugcugcauauuagaggacuugaaagcagagaguuu

SEQ ID NO: 4104935 - RNA, 73 nt, Human
cuucaucugcaaaccugaggagagaggauuagcgccaugcaagguggcauccucucuucugagugccaagaag

SEQ ID NO: 4104936 - RNA, 75 nt, Human
cuucaugagccugcugcuuugagccuuuuauccucuuaaccccuggcugaggacaggcucagcagguguauaaag

SEQ ID NO: 4104937 - RNA, 67 nt, Human
cugucuuaucucugcuagccuucuucagggcagaaaccagcucugcagcaggacaggagggggacag

SEQ ID NO: 4104938 - RNA, 87 nt, Human
cugucuucccccacucaguaugagcuccgugagaacaggggccaaaccuguuuuuggucaacaguacaugcggugcauggaaggcag

SEQ ID NO: 4104939 - RNA, 75 nt, Human
cugucuuucagcuuuaacuauguguuaaagauuauagcgguuauuucucuaacacauaagcugagaccaugacgg

SEQ ID NO: 4104940 - RNA, 83 nt, Human
cugucuuugccugugucuucacucaagucucuugggacagccugagcugcugagauguggugguggagaggaaacagagaugg

SEQ ID NO: 4104941 - RNA, 61 nt, Human
cugugaaauaaugaauaugugcuguuuuacaccucuaaguuugcagcaauucguuauacag

SEQ ID NO: 4104942 - RNA, 63 nt, Human
cugugaagcuaguauuaacucagauuauucagaugagaucaaguuauuaaguagcuuucacag

SEQ ID NO: 4104943 - RNA, 112 nt, Human
cugugaaguauuguugccagucaacaagguuugcuuaucuuucuuccagcuaccuugcuaggacaucuaauuguagguauaacuuugugagugguccacuuauaugccacag

SEQ ID NO: 4104944 - RNA, 74 nt, Human
cugugaauacuggcuucaccuccccagguggcuucacggagcagacgagaagggagauggaguggauucagcag

SEQ ID NO: 4104945 - RNA, 55 nt, Human
cugugaauuaaguauuguuauccacgauuuacagauaauaaacuuaaggucacag

SEQ ID NO: 4104946 - RNA, 69 nt, Human
cugugaauugaauaugacuauguuuugcuccugaauuucaaauacagaugauagucauguuauucucgg

SEQ ID NO: 4104947 - RNA, 87 nt, Human
cugugacaucaguucuauuauuuaccuauuuuacaggugaggaaacuaaggcauuugagaugguaaauaacuuuccuuaggucacag

SEQ ID NO: 4104948 - RNA, 118 nt, Human
cugugaccacacccccuucccaauaucuacuugagcaggccugcagguauggccgggcugaggagucaagcucugcgggcuccaagauaauguuaaggaagaggaggaaggguaacag

SEQ ID NO: 4104949 - RNA, 57 nt, Human
cugugacuuccacuacugaucagcacauuaaaacaacugucagugccugaggcacag

SEQ ID NO: 4104950 - RNA, 78 nt, Human
cugugagaacccaucuugcugagauugucgcuggcagauuuacuuccagugugauuguugcaagaauuugucuaacag

SEQ ID NO: 4104951 - RNA, 61 nt, Human
cugugagcuggguggccaggacuacucccggagcgugauucauggugcauccaccucacag

SEQ ID NO: 4104952 - RNA, 55 nt, Human
cugugagggccagagucagggccagucaugguaaugggccugaaggcacuuccag

SEQ ID NO: 4104953 - RNA, 88 nt, Human
cugugagggcugggugggccaggcgucuaggcccuggagccaggaaguccagguaccguccacgucuggcccugacucacucuuuugg

SEQ ID NO: 4104954 - RNA, 83 nt, Human
cugugagucguauuugaagagacauuauugggcacuauuuuacucuauuuggaauauuuucuuccuaaauaugauuuccacag

SEQ ID NO: 4104955 - RNA, 56 nt, Human
cugugaguucauugugccaccucaggguaccuuguugcacaguuugggaaccaugg

SEQ ID NO: 4104956 - RNA, 68 nt, Human
cugugauacaguauuuaaagagcaacgauaaaagucuacacaugaugcucugguugugcauguagcag

SEQ ID NO: 4104957 - RNA, 82 nt, Human
cugugauggaacguguuuacacuucaagguuaagguuaguucucucuucucuucgcuuacuguguaaggaguuuuaugacag

SEQ ID NO: 4104958 - RNA, 63 nt, Human
cugugaugggcagaggcagcagaaaccuggauguccggguuggagcgcuuuugcuacacacag

SEQ ID NO: 4104959 - RNA, 66 nt, Human
cugugauuuuucaucuauuuuagacuauugauuaaugguaucuaagaaagauuaagaaauuugcag

SEQ ID NO: 4104960 - RNA, 108 nt, Human
cugugcacagcaccaagaguugacugagcccggacuugcuucugagcugcaacugggucugaagcaagcccaggcucagucaacucuuacugguuccacuucuagcag

SEQ ID NO: 4104961 - RNA, 68 nt, Human
cugugcaccagggacaaugcuagggguauacggcugugaccaccauagucacugucccuuucucauag

SEQ ID NO: 4104962 - RNA, 102 nt, Human
cugugcagaguaguguuccacacaauacuuaccaauguuuuuguguagguugcaaaucuccaagaccauggggcugaguauuuuggaaugaauaucuuacag

SEQ ID NO: 4104963 - RNA, 76 nt, Human
cugugcagcuccaauuucaagggaauaugaaauucagggacugaguagcucuggaucgcuuccaugaaacugucag

SEQ ID NO: 4104964 - RNA, 58 nt, Human
cugugcaggagcuucuggccugaccaggccgcgcagguggucaggucguuccugccgg

SEQ ID NO: 4104965 - RNA, 57 nt, Human
cugugcaugcuccacagcccauucauccuucugguggaggacuucagagugugccag

SEQ ID NO: 4104966 - RNA, 92 nt, Human
cugugccaccaggggccuguccaccucagagaccucucaggugcagcucagcugcauccacaggggguccugagucccuaggcccugcacag

SEQ ID NO: 4104967 - RNA, 98 nt, Human
cugugccagccugcuuaccucuagcucuuugcuugugacauuuucuccaacuagaacacagagcaauaacagggagaggaagagcguggcugauacag

SEQ ID NO: 4104968 - RNA, 65 nt, Human
cugugccaggcugucaauucacccagguaccucucugggacaaguggcuuggcagccugucaaag

SEQ ID NO: 4104969 - RNA, 55 nt, Human
cugugcccucuuugcuggccuuacagcuccagguaaggucacaguggugggccag

SEQ ID NO: 4104970 - RNA, 57 nt, Human
cugugccugcaggccacaucaaaggacgcccugaauguggcacagaugcaggagcag

SEQ ID NO: 4104971 - RNA, 60 nt, Human
cugugccuggggggcagagcugggcuguagccaaggcuguucuaucuacucagaguauag

SEQ ID NO: 4104972 - RNA, 82 nt, Human
cugugccuucagacugucaaguaucuuucuagcaacuaaaucccauuugaugggauccugaaagguagacaaaggaucacag

SEQ ID NO: 4104973 - RNA, 89 nt, Human
cugugcgacaguagauaagaugcuucguuuuucugagucucaguuuguucauuguaaaaugaguucaaagacagguauaggucgcagag

SEQ ID NO: 4104974 - RNA, 57 nt, Human
cugugcugcaauucauaauccgaggagguauuuuucuucuccuguuuugcaccacag

SEQ ID NO: 4104975 - RNA, 71 nt, Human
cugugcuggaggucacccuuagaacaugguaaugacaggcuauaguuaccauguccuggcuaccagcgcag

SEQ ID NO: 4104976 - RNA, 65 nt, Human
cugugcuggauucugaggcuacaaagagaaauaagauaccaucucaggccucuaaaaucucacag

SEQ ID NO: 4104977 - RNA, 63 nt, Human
cugugcuguuauacuuagcugguuaucugugcagaccacacuuugaccaugugauagguauag

SEQ ID NO: 4104978 - RNA, 71 nt, Human
cugugcuuuagcaagcauuccaggacauuuggcacagcucaaguccagcagugcuuguugaucuaagacag

SEQ ID NO: 4104979 - RNA, 75 nt, Human
cugugcuuugcauuguuuaaucaggaagucaacauauuacagagugaaauccuuuacaagcaugugcaaacacag

SEQ ID NO: 4104980 - RNA, 77 nt, Human
cuguggacaucccggguucaguucuuggcugcccaucuucuucuggcacagcugaagguaggaaccaggaguuauag

SEQ ID NO: 4104981 - RNA, 72 nt, Human
cuguggauccugcuugguucuuuuucugugaacucucggcccagaagcaagagccggagcuaguuuucacag

SEQ ID NO: 4104982 - RNA, 62 nt, Human
cuguggcagaggugacaccucuugguucuggauuuggcuggugggugugcuucuagugacag

SEQ ID NO: 4104983 - RNA, 75 nt, Human
cuguggcaggcaaguucauuuccaggcagcugagugucugccccgugcuggcaacugugugccccagugccacag

SEQ ID NO: 4104984 - RNA, 70 nt, Human
cuguggccaggcauucagauaagacacagcagggaugauaugucugcacucugaaugucuaagcccucag

SEQ ID NO: 4104985 - RNA, 56 nt, Human
cuguggcccugugaucuggcacuugggacccuccuggugugcccaagggguggcag

SEQ ID NO: 4104986 - RNA, 66 nt, Human
cuguggcucuccauugacauggaauggagccuuccuuauuuucauguaauuauggagagaaugcag

SEQ ID NO: 4104987 - RNA, 62 nt, Human
cuguggcugcgccaucgaaaacaccuagggggaaauugucuggauuuuauggccacccacag

SEQ ID NO: 4104988 - RNA, 64 nt, Human
cuguggcuggccugucugacauuugcucugggagaugagccagggucugcccaggccaccacgg

SEQ ID NO: 4104989 - RNA, 60 nt, Human
cuguggcuuuggggcggaggacucacucccuauugugucuugagccuuugaaugcuucag

SEQ ID NO: 4104990 - RNA, 55 nt, Human
cugugggaugaguggugagggaggugaagucucucccaggccauaaaacucagag

SEQ ID NO: 4104991 - RNA, 56 nt, Human
cugugggaugguuuugccagaauuccaagcacgacucgaucagauccaucccacag

SEQ ID NO: 4104992 - RNA, 90 nt, Human
cugugggcccacugucauuguacauguuauacaaguagauuccuucuuccacauuguauaauguguuacuguauggcuacugggcuucag

SEQ ID NO: 4104993 - RNA, 59 nt, Human
cuguggguuugggugguggaaguagcaacguaaaccuugcuauccuagaccauacacag

SEQ ID NO: 4104994 - RNA, 99 nt, Human
cugugguacugccaggggacaguguugccucuguugagccuuggcugcugugggaaguuguagguuccugacugaggccugaggugguggugcugucag

SEQ ID NO: 4104995 - RNA, 70 nt, Human
gaacuuccagccugagagucuccagaccuuggggagaauccgugucugggcucccauggcagagugguuc

SEQ ID NO: 4104996 - RNA, 122 nt, Human
gaacuucugccagagcucuucugaaucccccuggagcucuucugagugugcuacuauuuccuuaauggcacuucucacucagaucagcucuguugggaugacaaagaauucugcugagguuu

SEQ ID NO: 4104997 - RNA, 117 nt, Human
gaacuugagagaauuggucuuucuacaucuuaugaagagcaacuugaauaaguuuauuauagagcaguuuuauuucaugagacuguugauauguggcccuaagugucuauuauguuu

SEQ ID NO: 4104998 - RNA, 97 nt, Human
gaacuuguuaaaauacagauuucuggggcccucuuacagagauucugauugagcaagucuagggugggguccacaggcuuauauuuauaacaaguuc

SEQ ID NO: 4104999 - RNA, 111 nt, Human
gaacuuucccacagaacauaaauaaaaugcacgcuacccagcuagauuuugguguuagaaaucugugcugcaggagucugcauggcuuuuugaaaugaucugagaaaguuc

SEQ ID NO: 4105000 - RNA, 72 nt, Human
gaacuuugcuuguuauuuuugcccaagguaggcuuuuaauauccucugccaagaugacagguaagaaaguuu

SEQ ID NO: 4105001 - RNA, 79 nt, Human
gaacuuuugagcccuuuuaagggagacuagagaucuguaagaucuagucccugcccuugaagagcuuacaaucuaguuu

SEQ ID NO: 4105002 - RNA, 129 nt, Human
gaagaaaaauguugggcaagaaaaauaucaaguucuggguuuuguccugagcauuaagcaauugugggccucugugccauucacaaagugcacaagaugagaaccaggacuugacugaauauggaauuc

SEQ ID NO: 4105003 - RNA, 77 nt, Human
gaagaaacaacagguguuggagugugaaaaauuauuucaaaacauugacuauuuuuuauagauuccauuguuucuuu

SEQ ID NO: 4105004 - RNA, 74 nt, Human
gaagaaacaauggcagauaauuuuccagauuugagaaaggcauugauuuggaaacaugcugaccaugguuaauc

SEQ ID NO: 4105005 - RNA, 82 nt, Human
gaagaaagaagaaaugcauuugugcuccaaucacuauuuugaagauuuguuuaugagcacaguguguugugauuucauuuuc

SEQ ID NO: 4105006 - RNA, 85 nt, Human
gaagaaagaagagggaagagccagugggaaagucuuggacuccggaggcaaacucaccuggcucaaauccugguuuuauuucuuc

SEQ ID NO: 4105007 - RNA, 63 nt, Human
gaagaaagagaugugccaaauagccuuauggugccagggcuagaauccgcgucucuugacuuc

SEQ ID NO: 4105008 - RNA, 84 nt, Human
gaagaaauacuaaagaauauucaucuacauuuuucuucaaguucuuaagaaguuuguagcuggaugucuguacuggauuuguuu

SEQ ID NO: 4105009 - RNA, 128 nt, Human
gaagaaauaggacuggagcuggaggacaggcaccgggggcaugaaugaggauaggcggauuggggcugaguccugccuaugagacguuuugccuguuugaacuugagcgaaugcccuuccuuuucuuu

SEQ ID NO: 4105010 - RNA, 76 nt, Human
gaauauuaacacauuuuuucagauugaguguuaauuucuaugggaagucaaauaccauaauggaauguugauguuu

SEQ ID NO: 4105011 - RNA, 74 nt, Human
gaauauuagggcugcuuuguauucugcuaauuucaaaagauauguagcucaagugcaagcauucuauuguauuc

SEQ ID NO: 4105012 - RNA, 65 nt, Human
gaauauuccaggcagagggaauagcaagugcaaaggcacugagguggggucugcuuggaguguuc

SEQ ID NO: 4105013 - RNA, 55 nt, Human
gaauauuucuucucaacagggugacagccacuguuacuaagagaaguaaauauuu

SEQ ID NO: 4105014 - RNA, 80 nt, Human
gaaucaccugauuuccuuguccgcaaucccugggagacacucuucagggucugacugaauggaaaaggaagcagggaauc

SEQ ID NO: 4105015 - RNA, 91 nt, Human
gaaucacuuauaaaggccccagaguuuugauuuuuugcauugcugaugcagagauuuggcucuuaaagcucuuaucuuuuauacauuguuc

SEQ ID NO: 4105016 - RNA, 65 nt, Human
gaaucagaacuccuaccacagagagugauuucugaaucaaauuuuauagggagggguucuguuuc

SEQ ID NO: 4105017 - RNA, 58 nt, Human
gaaucaucaacucucccaguuugccccagacugaaggguuucuggggaugugggacuc

SEQ ID NO: 4105018 - RNA, 79 nt, Human
gaauccacagcuagugacugcuagagcaaggaugcaaauccaagcugauccaguuccaaagaucauuuacugugcuuuc

SEQ ID NO: 4105019 - RNA, 63 nt, Human
gaauccugucaucauaguacuugaagguuugaugauacuuggagaucauucugacuaggauuu

SEQ ID NO: 4105020 - RNA, 69 nt, Human
gaauccuuagcagggccgggccugggucacugggcuccgugcucccggcgcccacccugcuggggucuc

SEQ ID NO: 4105021 - RNA, 96 nt, Human
gaaucggccuagcuucugagcugacauuguacucuuagcguuguuuuuguaaaaaaugguauagguaguauauguacgcgaagacuugguuuauuc

SEQ ID NO: 4105022 - RNA, 63 nt, Human
gaaucuaugccucauauagaccagagauggagacguucuacccuaauguaaguguauggauuc

SEQ ID NO: 4105023 - RNA, 117 nt, Human
gaaucucuggggguggagcuuagguguccacauuuuaaacuuauggaccagguaaaucuaauucauacuaaaguguaagaugugagaaccacguuuuauccacucccaaagggguuu

SEQ ID NO: 4105024 - RNA, 78 nt, Human
gaaucugaccucccgccuuggcuccucagacauugccaaaguagauucugugagagucaaaguuaggaguuucuauuu

SEQ ID NO: 4105025 - RNA, 64 nt, Human
gaaucuuagaaagguuaaggaacuuggucaaagucauacacguuaauuagcaaagcugagauuc

SEQ ID NO: 4105026 - RNA, 68 nt, Human
gaaucuuuggggaccaauuuauagucucucuguuguguuucagucugagagaauugccuuagauguuc

SEQ ID NO: 4105027 - RNA, 87 nt, Human
gaaugaaauaauuggagagacuauguauuagcaauaugcguuuucacguaugcauaaggcauauagucacuuuuuucuagaucauuc

SEQ ID NO: 4105028 - RNA, 65 nt, Human
gaaugaaaugagauaauuuaagugccuggugcacaguaagcacucgguagaugucauuauuauuu

SEQ ID NO: 4105029 - RNA, 105 nt, Human
gaaugaauucagcacauggaauucauguucauauuuacauuuauagcuuacagaauuucuaugucauugaccccaagcugauaaacauaauuacaaaguucauuu

SEQ ID NO: 4105030 - RNA, 64 nt, Human
gaaugaccucagagcacccagaacagaauuuaucaggcccuucuacacaccucugaggacauuu

SEQ ID NO: 4105031 - RNA, 72 nt, Human
gaaugacuuucagcuucuacuguggggggauuauuaggaagacugacagcauagaauaagcugaagucacuc

SEQ ID NO: 4105032 - RNA, 90 nt, Human
gaaugagaagucucuggugaugcaggaaaaguaaaacuccauacucugcuuuucucuuuuucuguguauccaggcuuccuuuaauuauuu

SEQ ID NO: 4105033 - RNA, 58 nt, Human
gaaugagguugcauuuguuuguguaguuacuauacaaauuuauagaugcauuuuguuu

SEQ ID NO: 4105034 - RNA, 77 nt, Human
gaaugagucgaucugggggugcaauggucugcaguuagcuaauacgaaaauagaucuguuucccagcccuuuuauuc

SEQ ID NO: 4105035 - RNA, 117 nt, Human
gaaugaucucaucaagaaauguguuaucacuucaaauuuucagaagaaauggaagcaaaucaugaucacuugaaaauuugggagaaacugauaaagcaaguuugaaagaguccguuc

SEQ ID NO: 4105036 - RNA, 70 nt, Human
gaaugaugagggaggcaaggagaugcuauucauucucacaaauggagucucauuuuacuccuucucauuc

SEQ ID NO: 4105037 - RNA, 61 nt, Human
gaaugauuaacuaguugauacagacuuuaguauuugagucacuaucagcuuauaaugauuu

SEQ ID NO: 4105038 - RNA, 57 nt, Human
gaaugauuacagucacuguacuuuuauucuccagaagugcuaaguacuguaaucauc

SEQ ID NO: 4105039 - RNA, 101 nt, Human
gaaugauuuaagcaguuucugaugcauauuucccuuuacauguauuuuguaaaauuucugcaugcugaaggugaauugacaauagaaagcuaauauuuguc

SEQ ID NO: 4105040 - RNA, 66 nt, Human
gaaugcaggaaugcacaugccuucgauacacaaaccaaaaaugauacaaugugcaauuuuguauuu

SEQ ID NO: 4105041 - RNA, 57 nt, Human
gaaugcagugacggaggcuuacagucuuacaucgagaugccucaaaucagugcauuu

SEQ ID NO: 4105042 - RNA, 66 nt, Human
gaaugccccuguuugcuuggcagcaaccugucaugguaguuaggauugcuguaugcaggagcauuc

SEQ ID NO: 4105043 - RNA, 114 nt, Human
gaaugcggcauuuuugucauuccuccaacaggcuuuauguuuaaaguuaaauucccuuaggagcuuuuaacugaggcugucgaugggauagaaacaaucaguuaaugccauuuc

SEQ ID NO: 4105044 - RNA, 76 nt, Human
gaaugcucuguggucuuuaaauuugugccuguuuuuucuccaguccagcaaaauuugaggauugccuggggcucuc

SEQ ID NO: 4105045 - RNA, 59 nt, Human
gaaugcugguguucagaauuuuuuguguauugacauggauucugcaugccaugcuauuc

SEQ ID NO: 4105046 - RNA, 60 nt, Human
gaaugcuuaggcugguuacuguuccgcccacuuagagaagguaacaagcacucugcauuc

SEQ ID NO: 4105047 - RNA, 56 nt, Human
gaauggaugcuggacaaaaugcugggagggagaccuguuauuccaggcauucauuc

SEQ ID NO: 4105048 - RNA, 80 nt, Human
gaauggcacauggagaauguccaggccacuuauacauagauuuaaguaguuaggaacauucucucuugguuuaucuauuc

SEQ ID NO: 4105049 - RNA, 56 nt, Human
gaauggcauagcuuucuuuacaaacuuuaguaaauguaugggagagcuugucauuc

SEQ ID NO: 4105050 - RNA, 60 nt, Human
gaauggcuggguucuucuauagguauagguuuaacuuaaucagaaauugcccagcuguuu

SEQ ID NO: 4105051 - RNA, 62 nt, Human
gaauggcugucuggaccuuggaaaguaagagucugaaucuuuaucuagucagucagucauuc

SEQ ID NO: 4105052 - RNA, 62 nt, Human
gaaugggaaacucuaaacuugaguaaggcauuucaccuugcucuguucaguguaucuuguuu

SEQ ID NO: 4105053 - RNA, 75 nt, Human
gaaugggcuuggcaggcaccaacuuccuggggagccaacugggcagcuucccgggggugccaggagugcaaaauc

SEQ ID NO: 4105054 - RNA, 120 nt, Human
gaauggucgauaaaaauuuguggcuuuuauugaugaaaaauuuuccuucaguuucauaacuuguuauuggaaaugucaugcaaauuuuuagaacugcuaucaaauuugagaaaaccuuuc

SEQ ID NO: 4105055 - RNA, 89 nt, Human
gaaugguuuaguugcccuugauuuuauauauagugauccagucauaaaacuguaguuuauguguauaauuacaggaagacaauucauuu

SEQ ID NO: 4105056 - RNA, 77 nt, Human
gaaugguuucaaauuaaagucuuaagagacaugacaaccaaagcaaugcaucuucaagauuaaauuugagauugauc

SEQ ID NO: 4105057 - RNA, 113 nt, Human
cuucuccaaagugccggguuucucaagguuuugauuugcacguggcuuuccauuuuuaaacucccauggggaggcguggagacaacucuggggugagggcgagggugggggag

SEQ ID NO: 4105058 - RNA, 58 nt, Human
cuucuccguaggggccuugccugggacuacaacucccaggaugccgcaggcggagaag

SEQ ID NO: 4105059 - RNA, 96 nt, Human
cuucuccuccaagcaauggggcuugggaaauguguuucuggaccaccacccugugguaucuaggcauuuuccaagaggaaccagcuccuggagaag

SEQ ID NO: 4105060 - RNA, 70 nt, Human
cuucuccuccuuuuuucaacauaguccuauuuacuaucagacaaucaggcuggguauuaaagaggggaag

SEQ ID NO: 4105061 - RNA, 81 nt, Human
cuucuccuuauucagugcgggaacucagccgguuauauacaguuaacugguuccacaaaugcgcaaccugaagcagagagg

SEQ ID NO: 4105062 - RNA, 65 nt, Human
cuucuccuugccaaagcuuucucuuugagucccuauaaacuacuaguacuuuggcaggagggagg

SEQ ID NO: 4105063 - RNA, 57 nt, Human
cuucucggauuacacaccuucuggagugacuagucuccagggauguugaacugaaag

SEQ ID NO: 4105064 - RNA, 73 nt, Human
cuucucugccuggugaguuccucagcuuaaauguuaccucuauugugaugccuaacuccaccaggcagguaag

SEQ ID NO: 4105065 - RNA, 63 nt, Human
cuucucuggcuccucagcgcccaggaccucccugaugccgggguggggaaggggccggggaag

SEQ ID NO: 4105066 - RNA, 63 nt, Human
cuucucuuucucuuuuccauguucuagguuguuuuaguggccugguggugaaggguggaggag

SEQ ID NO: 4105067 - RNA, 61 nt, Human
cuucucuuuguguucacugcagugcuugguacauauggcauucaaugaaaacaaagugagg

SEQ ID NO: 4105068 - RNA, 56 nt, Human
cuucugacugucuuggcuucuggacuuuuccagggcuagaaauucugcaguggaag

SEQ ID NO: 4105069 - RNA, 70 nt, Human
cuucugagaggggcuaggagcagauuuuaguauauuaaggugucuacagagcuccaagccccuuuagagg

SEQ ID NO: 4105070 - RNA, 85 nt, Human
cuucugauaucugauagcauuuauuucuuugaaaaauggauaaaaaugaucuacaaaggcauagugaauguuuuggguauggaag

SEQ ID NO: 4105071 - RNA, 59 nt, Human
cuucugcagagcccugaaccugccaaugucgauuggaaaggucagcccagcucuggaag

SEQ ID NO: 4105072 - RNA, 68 nt, Human
cuucugcaggugccauagacgggccuggggggagcaugcccgccgguaguugagggcacuaguugaag

SEQ ID NO: 4105073 - RNA, 64 nt, Human
cuucugcccggagcuggcaaaggcugccacaaaugcaggacugguuaaaguuccgaggcagagg

SEQ ID NO: 4105074 - RNA, 74 nt, Human
cuucugccgucccugcaguacaggcaacagaaagucauacaaauugcaaagagggacuccagggaugacagaag

SEQ ID NO: 4105075 - RNA, 55 nt, Human
cuucuggaagcuguaggggaaauucuauuuuguugccuucuccagcuucuagaag

SEQ ID NO: 4105076 - RNA, 55 nt, Human
cuucuggaagcuuuuggagagaauccauuucuuugcuuuucucagcuucuagcgg

SEQ ID NO: 4105077 - RNA, 127 nt, Human
cuucuggagaaaacaagguggcauucuugaauaauuucuaucauuccuguuucacucaauguaaaggaaacucuaggacgaugggauaguugaccuuuauugugcuuucuucuaugcucucacgaag

SEQ ID NO: 4105078 - RNA, 71 nt, Human
cuucuggcuggggcacagucugaauguuucugaauccagcaaagaaugcagauuugccucagggcuugaag

SEQ ID NO: 4105079 - RNA, 75 nt, Human
cuucuggguagaagauuccucaggagaggaccugaaaucugugguugucauuucuguaucuucagugcccagcag

SEQ ID NO: 4105080 - RNA, 67 nt, Human
cuucugguucuuauaaguuaauauuuccaauuaggaacucucauuggcaacuuacuggaguuagagg

SEQ ID NO: 4105081 - RNA, 77 nt, Human
cuucugugacguaugugaggacagcgacguuccccuauaucaguucuggucuucaggcagcauugcaucagcgggag

SEQ ID NO: 4105082 - RNA, 59 nt, Human
cuucugugcgccucuauucccuacuuugucugauuuguggugaaggcuaagcacagagg

SEQ ID NO: 4105083 - RNA, 57 nt, Human
cuucuguggcugagaaggcagcugcuuuaucagucugcagcuucucugcaacaggag

SEQ ID NO: 4105084 - RNA, 55 nt, Human
cuucuguggcuggagaacuugucuaacuacacgagacagacaagcagccgcaaag

SEQ ID NO: 4105085 - RNA, 73 nt, Human
cuucugugugcuaguuuugucaguauuggugucaugaaauaauuauaaggacuugaauuagacauuuaagaag

SEQ ID NO: 4105086 - RNA, 79 nt, Human
gaauauaaacaguaggcuaaagcuauaucuuacccucaaaucugggugaaaugaucaguuugguuacugcuuuauauuu

SEQ ID NO: 4105087 - RNA, 73 nt, Human
gaauauagucuuaaguaguagacucuuguuuuaauuaauaaagcuacgaguuaaauagcuuaggauucauuuc

SEQ ID NO: 4105088 - RNA, 72 nt, Human
gaauauauagaaacccaggauuuguauuuguauuuaaauguaaauacaaaaggucugggucucuguaucuuu

SEQ ID NO: 4105089 - RNA, 69 nt, Human
gaauauaugaaguuacagguaagaaacugcccaaacagaaaguuuguuauuacuaauuuuaugcuguuc

SEQ ID NO: 4105090 - RNA, 73 nt, Human
gaauaucaugcuaaaauaucugaagauuaugcuauaagcaaaguaaacacagguguuuuguguaguuguguuu

SEQ ID NO: 4105091 - RNA, 80 nt, Human
gaauaucauguuacaguggcuuuuuaaacacuuaagaacguuucucuuauuuguaagcaucacugugaugugguuuuguc

SEQ ID NO: 4105092 - RNA, 64 nt, Human
gaauaucccaaagaugaaauaacugcuuagagaaacagcaaguucucugucacuggggguauuc

SEQ ID NO: 4105093 - RNA, 107 nt, Human
gaauaugaauggcaguaauuaggucucugaguuuaggaccaggcugagcaaaggaaaggaaguucaugucugggcuagugcucacaggcccugcacuuccuuuauuc

SEQ ID NO: 4105094 - RNA, 74 nt, Human
gaauauggagacuaugccagacugugagcuucuugaaggcaggaacaucaaagucugcaucaucuuuuauauuc

SEQ ID NO: 4105095 - RNA, 129 nt, Human
gaauaugguugguuuuggccuuagggagggcucuuuuuguaaguuugcuguuuauuaacuccacacguaaacaguguacuaaauaguaagaggaauccucugcuaauguucugccucaaaccuaaguuc

SEQ ID NO: 4105096 - RNA, 88 nt, Human
gaauaugugaguauauacaugugugagcgaagaugugagcacguaagcauaugugagugucucaauauguguguaaguucauauguuu

SEQ ID NO: 4105097 - RNA, 114 nt, Human
gaauaugugccuccaaagaugucauaaaaauguggguaacugagggugaagugugcauacauacacacaugcauuugccuuaugaaagugaucucuuaggagugucaaauguuc

SEQ ID NO: 4105098 - RNA, 74 nt, Human
gaauauugccucaguguagcaggcuucuuagcauucaauugcugcagaauuuccuucucauuauucuaauauuc

SEQ ID NO: 4105099 - RNA, 130 nt, Human
gaaucaacaaugacuuuuuggagugaaugaaaugguuuagcaaacaaaugaaaugguuuuagcaaacaaaacauuugucuuguuucucaacccucauuuauuguuuccuguucuuguuugaauuuuauuu

SEQ ID NO: 4105100 - RNA, 67 nt, Human
gaaucaacagguuugcugcuguuuuaggauuugccaauuguuaacauaguggcgcaucugcuguuuc

SEQ ID NO: 4105101 - RNA, 63 nt, Human
gaaucaaucaaucacccucuuuuuaguaaaaauccaaauggguuuugguggugguuuugguuc

SEQ ID NO: 4105102 - RNA, 65 nt, Human
gaaucacaaggcuuucaucuggcauaagcagaauuggcauaugccaauauaauacuuugagauuc

SEQ ID NO: 4105103 - RNA, 104 nt, Human
gaaucaccucaugacuagcggggcaggccucuaauucaccgcaggauuuccaguagguuggauugugggguugguguuugcacuccaaagaguuggcgugauuu

SEQ ID NO: 4105104 - RNA, 69 nt, Human
gaaucagacuacaaaugaccccugguccaugcccggccuguaacggggccauuuguaguuucugccguc

SEQ ID NO: 4105105 - RNA, 66 nt, Human
gaaucagagaagcugccaggcgagcuguuguguucaagagugcuuggccuuagcugcucuccaguc

SEQ ID NO: 4105106 - RNA, 71 nt, Human
gaaucagcagagguuuugcuccaugaucccuagucugggucauaaaagcccguggagccucugcuugauuc

SEQ ID NO: 4105107 - RNA, 58 nt, Human
gaaucaggaagggaaaauaguucggggaaugcccccacuguuuucuucauccuagguc

SEQ ID NO: 4105108 - RNA, 60 nt, Human
gaaucauagaacauuaauagaagugcucuccuaggucucuauucaaauguucuuugauuu

SEQ ID NO: 4105109 - RNA, 87 nt, Human
gaauccaaagaugaaguagacuagaggaucagcaagggcuccaaagaaagaguauuuggugaaucuauggucaggcuuuagugguuc

SEQ ID NO: 4105110 - RNA, 58 nt, Human
gaauccaagaguuugguaaagcaggaauacaaguuugcucugcugaguccuaggauuc

SEQ ID NO: 4105111 - RNA, 106 nt, Human
gaauccgaaacccggggugggacacagccaucuguguuuuaacaacccccuuuaaggcucguuaaagcacagauggcugcgucccacccaagguuucaugugauuc

SEQ ID NO: 4105112 - RNA, 57 nt, Human
gaauccuaauuugcugaaugcuuaguuuugccucaaugagcauccagucaugggauc

SEQ ID NO: 4105113 - RNA, 79 nt, Human
gaauccuagcucaacugauuuacuggaauucuugcugaaagcaggcuagagugaucagauaucagguguggggggauuc

SEQ ID NO: 4105114 - RNA, 84 nt, Human
gaaucgcuugaaccugagaggcggagguugcagugaagccaagauugcaccacugcacuccagccuggugaaggagugagauuc

SEQ ID NO: 4105115 - RNA, 60 nt, Human
gaaucucuuugucccugaguuucagaagcaaauagugaagcuuugggcagaagaggauuc

SEQ ID NO: 4105116 - RNA, 94 nt, Human
gaaucugcucauguucuguauauugagguuauaguuggcucaaauauauaaccaucugcuauuucuauauuauaaagaaaugaagugcagauuc

SEQ ID NO: 4105117 - RNA, 56 nt, Human
gaaucuggucguuggugucuaaaugugccuguuacuugugcccaauguccagguuc

SEQ ID NO: 4105118 - RNA, 106 nt, Human
gaaucuucuuaggaauauggcuuauauugaggaucuccugcuaauuguuuguccuggucuaauugguauguuuucucaauuaacguuauuuuuaagauacaaguuc

SEQ ID NO: 4105119 - RNA, 109 nt, Human
gaaucuuuuuagucuuugccagucugauaggggagaaguagcagcucauuguuguuuaauuugcauuucucucauuguuagcuagguugagcauuuuaaaaauauauuc

SEQ ID NO: 4105120 - RNA, 59 nt, Human
gaaugaacaaggauguucauccgguauauuauccugcaaguugagaaccauguucauuc

SEQ ID NO: 4105121 - RNA, 73 nt, Human
gaaugaacacagcccugcuggcaaugaugaguaaucauauucaucucagcugugcagggauggcucaguauuc

SEQ ID NO: 4105122 - RNA, 82 nt, Human
gaaugaagucgugacuuucaauugcaggccuguguucugcaaugagcuuaugggucccaaucugaaaugucaugcuuuuguc

SEQ ID NO: 4105123 - RNA, 118 nt, Human
gaaugaauauauaacagacuuugcagcuaaccaggauaucuugaggucggaggcugcuguuguuucuccaggcucccucaggaugcacuguugccagucagcguuacucauuuuauuc

SEQ ID NO: 4105124 - RNA, 86 nt, Human
gaaugaccagcaauuuuacucuuccucuuccaugacauuguuauuauuuugaaccuuaacaguauugaaagaggauguggucauuc

SEQ ID NO: 4105125 - RNA, 109 nt, Human
gaaugaccgguggaagccaaguauugcuggauccacaggaggguuuggaaaagcaggagaauguuugcuucaccccaccuuguugccaguuuuuguccaccaaucaauc

SEQ ID NO: 4105126 - RNA, 89 nt, Human
gaaugacuaccagguuacuuaguuugaugccugggaauuuggccuaaguaacaaaggauaacuugguuuagaucuaaagugggucauuu

SEQ ID NO: 4105127 - RNA, 62 nt, Human
gaaugagaggucagaacaggaaagugugugauaccaccacaccccuuuuugacuugucauuc

SEQ ID NO: 4105128 - RNA, 70 nt, Human
gaaugagcugcugcuguuccaccguuugcuauguugaaggugcuauuccuauacagcauucagcucauuu

SEQ ID NO: 4105129 - RNA, 73 nt, Human
gaaugagggucuugaggaucugaacuguauuuuugaauaugggauaccaaaggacccuauacaaaacuuauuc

SEQ ID NO: 4105130 - RNA, 95 nt, Human
gaaugagguguucugguuaauuuaauuuucugguugagguuuaacauaauuuaaucuuauuuuuuaaugacagagaaacuugaauagcuuuauuc

SEQ ID NO: 4105131 - RNA, 87 nt, Human
gaaugaguaauucaguauaugccagagagauagcuacacuuuauagauuuuguaguuccuuacauguacuguuaacaaugcuuauuu

SEQ ID NO: 4105132 - RNA, 56 nt, Human
gaaugaguacccaugcaagcugaaagaugagaauuucagcuguagagauuacauuc

SEQ ID NO: 4105133 - RNA, 77 nt, Human
gaaugagucauggugauuauuuccauuuuucuuuagucauuaaugaaacucgaaauaaucacauucguggcuuuguc

SEQ ID NO: 4105134 - RNA, 58 nt, Human
gaaugaguuaauauuugcuuggcaucauagugagcauucaguaaauguuagcucauuc

SEQ ID NO: 4105135 - RNA, 62 nt, Human
gaaugauuugguuguuuagauuugucaugacucauugacuauaaauagcaacagaauuauuu

SEQ ID NO: 4105136 - RNA, 56 nt, Human
gaaugcaaagcucucuauguuauuuccuaauggauguuuaacaucggcuaugcauc

SEQ ID NO: 4105137 - RNA, 63 nt, Human
gaaugcacacgugugugcaugcacugugagcuggugugugcaugugcacuggugugugcguuc

SEQ ID NO: 4105138 - RNA, 96 nt, Human
gaaugcagugauaaauauguauggaguucaugaauucuacaaugauugacaagcuguuuaugaacuacagauauaacuaacauccuuuuugcauuc

SEQ ID NO: 4105139 - RNA, 57 nt, Human
gaaugcauucuaaaguguuuuauaccuauauauuggguccucuuuuugaauguauuc

SEQ ID NO: 4105140 - RNA, 127 nt, Human
gaaugcucugaauugauuugguuguaguguagccuuaaaauugguagucacucaaaauucagggcagauggucuuuaguguuugcguguacuccugggcauuuaucaauuagaauucagcagcauuu

SEQ ID NO: 4105141 - RNA, 61 nt, Human
gaaugcuggaagccucaguagauuuggggaguccauaucaguuuggugcuuucagugauuc

SEQ ID NO: 4105142 - RNA, 60 nt, Human
gaaugcuguagacagacucuauuaagucccaaaucuuugggcaguuuuucuccagcauuc

SEQ ID NO: 4105143 - RNA, 78 nt, Human
gaauggaguagacccaugccucucuugagugucucuuuguuuauaauucucuuugagaguaauguuuuuacuguauuc

SEQ ID NO: 4105144 - RNA, 89 nt, Human
gaauggcaugaaccccggaggcggagcuugcagugagcagagauugcaccacugcacuccagccugggugacagagugagacuccguuu

SEQ ID NO: 4105145 - RNA, 85 nt, Human
gaauggcuuugguuccuuucuggaggcccaagggcagaauccacuuucuucccucucccaguuucuagaggcucacagccccuuc

SEQ ID NO: 4105146 - RNA, 65 nt, Human
gaauggggaggggagguggaggcuuccacuuaaaaauuuuccccuuuguuuucuccugcccauuc

SEQ ID NO: 4105147 - RNA, 72 nt, Human
cuuauguaacugccuaauacaugaugauagguacacaacaaaugauuacuuuaucaauguauuaugcauagg

SEQ ID NO: 4105148 - RNA, 67 nt, Human
cuuauguauaggggcugcagggagagguuaggcuguggcauugagcccugauagccccuaucaucag

SEQ ID NO: 4105149 - RNA, 81 nt, Human
cuuauguuuugaaacuuaauccccaaugcaacaauauuaaaagguauagauguggccuuugggagauuauuaagucaugag

SEQ ID NO: 4105150 - RNA, 65 nt, Human
cuuauuaauggaauccuaaugagucugcuggugcccagccugagcuauuggaucuaagaaauggg

SEQ ID NO: 4105151 - RNA, 61 nt, Human
cuuauuagaaagaaaagacaugguggguuuuuuccccuuuauucuuugcuuuucuaagagg

SEQ ID NO: 4105152 - RNA, 67 nt, Human
cuuauucacacugaaucucccaugccuuguauagcacuaggcacagaauggcauucaguguuuugag

SEQ ID NO: 4105153 - RNA, 57 nt, Human
cuuauucuacuccacaagcucuucauaggagaaauggaggcuuggaguggagaugag

SEQ ID NO: 4105154 - RNA, 123 nt, Human
cuuauugcaccauauuuuuauuucagcaucucuucacugccauaaauaagagaaaguagaauguuuacuuuucuguguggcagucaccaugcuagacauuuacaaccaguguaaaucauugag

SEQ ID NO: 4105155 - RNA, 59 nt, Human
cuuauugccucugcggagcuguacaucaaaauauuuuggugcccccuagagguaaucag

SEQ ID NO: 4105156 - RNA, 68 nt, Human
cuuauugugggcauugaaaacugaugcauguuauuaucaugaaaucaauugcaauguuuauucuuaag

SEQ ID NO: 4105157 - RNA, 65 nt, Human
cuuauuuccaccuucccuugcacuuagcuuguaucuaguuauagccaauagaauguggagauaag

SEQ ID NO: 4105158 - RNA, 74 nt, Human
gaauugaagauuacuacggaacaugaccugcaaucacagacccaguuuauggccuauaggaucugaagcaauuc

SEQ ID NO: 4105159 - RNA, 98 nt, Human
gaauugacuguuguaaaaugugcguggauagugguugauuguuucuuuggcagagucauuauuuaugcaauuauuuguaguacacacauuaacaauuc

SEQ ID NO: 4105160 - RNA, 64 nt, Human
gaauugcuacugaagagcuugccacauucaugacauuuguaaggcuucucuccaguaugcauuc

SEQ ID NO: 4105161 - RNA, 59 nt, Human
gaauugcugaugaccuaaugcagaauaguuucauuccugcauauggagguuagcaacuc

SEQ ID NO: 4105162 - RNA, 77 nt, Human
gaauugguuccuucugcgggucaucagggagaacguguuccacgccccucucauuggcuuguagauauggccaucuc

SEQ ID NO: 4105163 - RNA, 90 nt, Human
gaauuuaaugucauauaugguagggaaauuugcucaguuagaauggcuacagaauggguuuuucauugucuacauaugacauuuuaguuc

SEQ ID NO: 4105164 - RNA, 67 nt, Human
gaauuuaauuauagcauuggaguggccuuugacaaauggcugcuauaaauuuuaugguaccaaauuc

SEQ ID NO: 4105165 - RNA, 101 nt, Human
gaauuuaguauuccaguccaaauguuuuccugagcucuaggcaaaauaaauaaaaagaaaccaacacuuagaaacaucuuggcaacuggaagaaaaaauuc

SEQ ID NO: 4105166 - RNA, 72 nt, Human
gaauuuauuccuuuauggcuggaggacucaugguaguuugcuuuuucaaagcuaguaaagagaguaagauuc

SEQ ID NO: 4105167 - RNA, 129 nt, Human
gaauuucacaagggacucauaaggugaauaaacuaagcucuggcauugauuauggaaagcaguggcuguaugaugucaggguugcugugaucaguccagccagaaauucacuuuucagugccuugauuc

SEQ ID NO: 4105168 - RNA, 65 nt, Human
gaauuucagguaccugugggauccccaagggagaggucccuuuggauagggguagcugacaauuu

SEQ ID NO: 4105169 - RNA, 72 nt, Human
gaauuugaacccaugcugaugaacuucuacuugcggugaaccuuagcuagacuucaauucagcuuucaaauc

SEQ ID NO: 4105170 - RNA, 99 nt, Human
gaauuugaguauauugaacuuuuugaccccuguguaagauggagauaacaauaaauuuuugcaaggguguuuugagguguaaaucaauucacauaguuc

SEQ ID NO: 4105171 - RNA, 96 nt, Human
gaauuugauccuuuggcagagaaccugggcuuugugaaggucaguucucacaaccacuaagagaguuugagguuucugacuaaagcuucacuguuc

SEQ ID NO: 4105172 - RNA, 71 nt, Human
gaauuugcaaaauuauucccagcaugacagacuguuuucaggucugaaugugacuauuugauuuucaaauc

SEQ ID NO: 4105173 - RNA, 65 nt, Human
gaauuugguugcgguguacucuccuccgauaaaaggcaagagagggcaaacuuguagcuaacuuu

SEQ ID NO: 4105174 - RNA, 78 nt, Human
gaauuuguuacagcagcaacagacagcuaauacaaacuuuauuuguacuaaaugugaaaugcuauugugacaaauauc

SEQ ID NO: 4105175 - RNA, 61 nt, Human
gaauuuucauacaugagacuagaugcauauucuaugugcucaguuccaugaguggaguuuc

SEQ ID NO: 4105176 - RNA, 129 nt, Human
gaauuuuguuauagaagcccgaacgaaucaggacagagaucagaacuucucugauguauuggaauaaucuucagugaaacuggagucugagcuuguguccuggacuuagugucagggcugggacuuuuc

SEQ ID NO: 4105177 - RNA, 85 nt, Human
gacaaaauagugucuguccagaacguacaucuugggugcucaaacccgacagugugccgucugagacgccgacgcaagugaaguc

SEQ ID NO: 4105178 - RNA, 72 nt, Human
gacaaaaugaaaaugggugagauuuguauaguacauaaugucuaaaaugcagaucuacugguaaaucauguc

SEQ ID NO: 4105179 - RNA, 72 nt, Human
gacaaaauugaaacaaugagcuuuuacacacugaugguaaaaacagcaguuugaaaaacauuguuuuaaguc

SEQ ID NO: 4105180 - RNA, 129 nt, Human
gacaaacagaaucuggaaagaguuauuugcaaauguauuugggcaugaagaaggaagugggucacaaaauuaugaccccugcauauuuagucuaauacacauccucauuccagacaacuaacugugagc

SEQ ID NO: 4105181 - RNA, 80 nt, Human
gacaaacucugcucagaacauuuaaaaagugguugacuuagguccuaaauaucuuuuugaaauguuaacaggguuugcuc

SEQ ID NO: 4105182 - RNA, 60 nt, Human
gacaaacuucccagacaagcuccuuugugccucuacguggagaggguguggaaaguuauc

SEQ ID NO: 4105183 - RNA, 55 nt, Human
gacaaagggaguugggguggccugccaggucacugggcuccagcuccucauuguu

SEQ ID NO: 4105184 - RNA, 60 nt, Human
gacaaagugaauugcuucagcaguggguagauaacccacuguuuuucaguuaacuuuuuc

SEQ ID NO: 4105185 - RNA, 87 nt, Human
gacaaauaguccucaugauagacuuuuugagcugaauaacuuggcugagguuaugcuuuuagaauuuagcaugaggagaguuaauuc

SEQ ID NO: 4105186 - RNA, 62 nt, Human
gacaaaugagucucauacccggaggcauuccuugucucagaguuggucugagaucguuuuuc

SEQ ID NO: 4105187 - RNA, 72 nt, Human
gacaaauguacacaaugauaaauuauuaagcaaaaccuugagugguaauuuacgcauuucuguaacuauguc

SEQ ID NO: 4105188 - RNA, 60 nt, Human
gacaaauuaaugaauggaugaaucaauggaucgaucagucgguccaccagucaaucuguc

SEQ ID NO: 4105189 - RNA, 62 nt, Human
gacaaauuagcccaggaaaacagggcaggaaaaaacugucuuuacuucugcuuguuauuguc

SEQ ID NO: 4105190 - RNA, 87 nt, Human
gacaacggugauaucaagacauaagugcuaugacauuguuuagcauagaauaggugauaaacaacuuauguuauugagaauucuguc

SEQ ID NO: 4105191 - RNA, 70 nt, Human
gacaacucuggcuuaguaugcuccaaaucagcacaaaacagauauggguguuaauggugagagauauguc

SEQ ID NO: 4105192 - RNA, 67 nt, Human
gacaacugcaggcaguuaauaugaacuaaagcccuacaggaaaguucagacugccuucagcauuguc

SEQ ID NO: 4105193 - RNA, 81 nt, Human
gacaacuuuuaagaaaaauucacagucaauaggcucuuuucugagagccugugggagguucugugaguccucuauaguuuc

SEQ ID NO: 4105194 - RNA, 128 nt, Human
gacaacuuuuuuuuucccccaggauagugauccccaaaggacaaaaugaaaagcuagccgcuccccucccaaaagcuagcugcccaucuuuccuuuaggagcuaggacccugggauccugacgauguc

SEQ ID NO: 4105195 - RNA, 69 nt, Human
gacaagaacauuuguuucguuaugugaacuuugaucaugaguuuaauaacaugaacaaguaaucauguu

SEQ ID NO: 4105196 - RNA, 58 nt, Human
gacaagacugguuuauuuaagggcuuaguucuccuuuggaaauggagcuaaucuuguc

SEQ ID NO: 4105197 - RNA, 72 nt, Human
gacaagagaaugacaaggagaaccuaaauuuggagaaucacagggaccaggagcuccugcaugcuuccuguc

SEQ ID NO: 4105198 - RNA, 76 nt, Human
gacaagagucucccugggguaacauuagagggucagcaggccugcauuccuuaugaagacccuaggagagaauguu

SEQ ID NO: 4105199 - RNA, 62 nt, Human
gacaagcaaguagguauuugacaaauguuuaucaguuugauugguuaccuauuugugauuuc

SEQ ID NO: 4105200 - RNA, 74 nt, Human
gacaaggaaauacucagaaagcaaucuggugaggugacaaacuucagucuccaaugcucugugaauuuccaguc

SEQ ID NO: 4105201 - RNA, 55 nt, Human
gacaaggcagcuauugucuccauaguuucuauuaucuuaccacagcugucuuguu

SEQ ID NO: 4105202 - RNA, 67 nt, Human
gacaaggccuuaagaacaaaacuauuuggauccacugaaauaaauggucucuaagggucuucuaguc

SEQ ID NO: 4105203 - RNA, 61 nt, Human
gacaaguaaaggcaaauagagggauggcagacagcauuccuguaucugcuucuuacuaauc

SEQ ID NO: 4105204 - RNA, 69 nt, Human
gacaaguagguuauuuuuagcaaccaacauuaugaaggugacaaaaugagagaaauagccuuccuuguc

SEQ ID NO: 4105205 - RNA, 62 nt, Human
gacaagucacucuaucauuuucaacuuaacaagagagaaguggaaaggcugggagauuuguc

SEQ ID NO: 4105206 - RNA, 76 nt, Human
cuuccauugcccuauccauuucauuuuggaacccagauacuccaguuccaaaaugaaauggauagggcaauggaag

SEQ ID NO: 4105207 - RNA, 63 nt, Human
cuucccaagggcucugugugccuccccacggccccugcugugaugggaagagcccuugaguag

SEQ ID NO: 4105208 - RNA, 67 nt, Human
cuucccacuaguaucacagagcuggucuuaaacuuugaccauuugauuucucuguguuggugugaag

SEQ ID NO: 4105209 - RNA, 64 nt, Human
cuucccagacaauggaaagcccgaaucaacaauaacaauuuuugugggcagauuccauggggag

SEQ ID NO: 4105210 - RNA, 55 nt, Human
cuucccagaggagauuugcuuauauuugaguguaaugagcaaucuuucugggcag

SEQ ID NO: 4105211 - RNA, 70 nt, Human
cuucccaggcuggauuuugcaguucacgaacucuugagccaugcagaugggcugcgaucuccccgggaag

SEQ ID NO: 4105212 - RNA, 60 nt, Human
cuucccaggugcucuuagcaugugggcguaguccuaacaucugcaagcauccugaggggg

SEQ ID NO: 4105213 - RNA, 74 nt, Human
cuucccauccuuggaaauuugaagacuuuucugcuggcugguagagaauccucuacauguuuuuuugggggaag

SEQ ID NO: 4105214 - RNA, 62 nt, Human
cuucccauucuuuccauggaaccaggcuggacccaguauuccaggaccaggaagaggggaag

SEQ ID NO: 4105215 - RNA, 59 nt, Human
cuucccauuuaaggcacauaugucuuaccuuccuggcuguguucaucuuuaaagggaag

SEQ ID NO: 4105216 - RNA, 90 nt, Human
cuucccccaacccauccaugaggccagcaacgcuuguagagaucacucugggcuguaauguggcacugaugggcugggacauaagggaag

SEQ ID NO: 4105217 - RNA, 68 nt, Human
cuuccccuagcacccauagaggccgcuugguaacacagccaggugccaccucuggugcugucuggcag

SEQ ID NO: 4105218 - RNA, 63 nt, Human
cuuccccuugauaagcaggguugucagugcgucacugaggccagcacaugcucaucagggaag

SEQ ID NO: 4105219 - RNA, 124 nt, Human
cuucccuacacacuccaguauuugcaugcuaauuuuuuccuucaugacuuaagagccucugaagcucuuaauguucugguugaggauauguagccaccuagaacugaccagacauuuggagagg

SEQ ID NO: 4105220 - RNA, 90 nt, Human
cuucccugcgacccagagcaucacuguccucuccccgccaggaaaggggugcgggguggggagaggggaggagugggucuuggaggggag

SEQ ID NO: 4105221 - RNA, 70 nt, Human
cuucccuuaaacugcaaugauguauuuguccugucccaagaugagacaauauccuuuguaaccagggaag

SEQ ID NO: 4105222 - RNA, 128 nt, Human
cuuccgugugucgccgccguugccgccucagcuucagccucguuacuccugcgguucugugacugugcugcuggcguuaacggcgcgaggugaagggaggugacggagugugcccgcgcgcgcggggg

SEQ ID NO: 4105223 - RNA, 130 nt, Human
cuuccuacuguccauggcuuuugggcccauggguuuuccucccugccuuguguggccaggagccaggggaauaaaggagaaaugcccaugacugcuugaaaacuagccuugacaacggcaggucaggaag

SEQ ID NO: 4105224 - RNA, 110 nt, Human
cuuccuagaagcaaaagagccaggaaagcauugguaggauuugaacccagauaagugugacuccaaggccacaugcauuccacuuaguuuuacuugucuucaucaggaag

SEQ ID NO: 4105225 - RNA, 101 nt, Human
cuuccuagcuccccaaggauggauaacacuaacauauagucagugggaaagaaaucucagaaaauaacuguuaguuugucacugucaugggaaaugggaag

SEQ ID NO: 4105226 - RNA, 79 nt, Human
cuuccucacccacaccuccguauaucacuaagugagcaaggaugagagugauauauaaugaggugagggauguuggaag

SEQ ID NO: 4105227 - RNA, 55 nt, Human
cuuccucccggcccaugcucuggccucaggcuagggugugugugcuggguggagg

SEQ ID NO: 4105228 - RNA, 81 nt, Human
cuuccucggacuguguucagcaccuuaggugaagaaucaaucguucuaaaucacagaaaagcugagcaucagauggagaag

SEQ ID NO: 4105229 - RNA, 67 nt, Human
cuuccucuguguccugggcuucuagcacagagggucagaaugaaacaagcccaggacacagaggaag

SEQ ID NO: 4105230 - RNA, 87 nt, Human
cuuccugagucuuaauuucuucagcucuaaaauggagauaauaacauacaucccauggaguugacaugaagguuaacucaagugaag

SEQ ID NO: 4105231 - RNA, 59 nt, Human
gacgucuguuuccgauucucuuggguuugucccaggagugagcuuuggggucagauguc

SEQ ID NO: 4105232 - RNA, 80 nt, Human
gacgugaucccacaggguaacucaagugccuccuuugugguggccuuugugguggcccaguguggacggaucucauuguc

SEQ ID NO: 4105233 - RNA, 86 nt, Human
gacuaaacagagacaaacacugcaacuucugaggccacagcaguuacuaggcuagauaagaggaaguuuguagauguuucuuaguc

SEQ ID NO: 4105234 - RNA, 60 nt, Human
gacuacauuucauccagggagagcuaucuggauggcucugauuuaggaugcagguguguu

SEQ ID NO: 4105235 - RNA, 123 nt, Human
gacuagaauauuuacaaggaagguagaggccagcaccagagucaagaaaugcaguuuccgcagcuucucacugcuucuggcuguguuacuaccagagcuccuaggugucugucuguucugguc

SEQ ID NO: 4105236 - RNA, 59 nt, Human
gacuagcccuguaggcacuugaguuucaacccauauuuaaggccugcuuacugcuaguu

SEQ ID NO: 4105237 - RNA, 62 nt, Human
gacuaggagcacacauccaaaugcccgcagcauaccuggggcaguguggucgugccuuuguc

SEQ ID NO: 4105238 - RNA, 93 nt, Human
gacuauaagcuccaugaggacaggcaccuugucugucuugcucauugauuuugguggcagacacagugccugucacaugaggggagcucaguc

SEQ ID NO: 4105239 - RNA, 83 nt, Human
gacuaucuguacuuuauauaaaaggaucuguuugguuuuaaaaugaauucaguuucuguuuuaaauagcaguauaaaauaguc

SEQ ID NO: 4105240 - RNA, 112 nt, Human
gacuaugauuuguuugucuuuauaucugucccagcugcugagauagugcuugucacaucauagguauucaacucuuugcugaaugaaugaagacauuaacaagugaaaaguc

SEQ ID NO: 4105241 - RNA, 69 nt, Human
gacuaugguuuaguuagggcuuuucagauuugaaaaguguaucugagggaauuugacaaaauuauuuuc

SEQ ID NO: 4105242 - RNA, 66 nt, Human
gacuauuaaacagccuccccuuucacucucaaaaaugucugaguguggaugauagguugugugguu

SEQ ID NO: 4105243 - RNA, 76 nt, Human
gacuauucauuagauaauguuauuguaauuuucauuuucugauguuaaguuguacugauuuaucugagagaauguc

SEQ ID NO: 4105244 - RNA, 65 nt, Human
gacuauuccaagcacagcaacccagaagagccaaagcccuggaguugggaugugccuggaauguu

SEQ ID NO: 4105245 - RNA, 81 nt, Human
gacuauuccacaaugucucuauaucucauaagaugcuuuaccuaacugcagagucucuuccguggagaugcuuggguuguc

SEQ ID NO: 4105246 - RNA, 57 nt, Human
gacuauugcacacuucucucaccccgcucgugggucuuagaagggcuggcaggaguu

SEQ ID NO: 4105247 - RNA, 101 nt, Human
gacuauuggcucugagagcuuuuauuggauuugccagcaaacccugccauccuauguuggcaaaauuuaaagaagugauaauaaaauuggagcucaaaguc

SEQ ID NO: 4105248 - RNA, 58 nt, Human
gacuauuuaaaaagaacuacugcaguggggaguuugcaguaguggagagagaucaguc

SEQ ID NO: 4105249 - RNA, 71 nt, Human
gacuauuuaguuucagauuaguugacaaaguaacgaacaagcuuggggugaucuugaacuaaauaaacguc

SEQ ID NO: 4105250 - RNA, 73 nt, Human
gacuauuuucuaaucaugccacauguagggaccaucuuggggacaagacagcaucuguguggcaggaguaguu

SEQ ID NO: 4105251 - RNA, 63 nt, Human
gacucaacacagccauuccccuagaaguuacagcacuucuagggucaccuguguucagagauc

SEQ ID NO: 4105252 - RNA, 72 nt, Human
gacucaacgcagugagucuguaaaaggcucuaacauguaggagccuuugaccaguuuccuguuuucuguguc

SEQ ID NO: 4105253 - RNA, 59 nt, Human
gacucacuaccuaaaccagacuuccugcuucuaagucuugugcuggaggguagugaguc

SEQ ID NO: 4105254 - RNA, 60 nt, Human
gacucagagaguuaagugaauuacccaaggucacauaccuuguggcacaacugccugauc

SEQ ID NO: 4105255 - RNA, 66 nt, Human
gacucagcugguucaguuucugggccucgugugggcccccagcagcuuaaccacuucucucaaguc

SEQ ID NO: 4105256 - RNA, 67 nt, Human
gacucaguggcucaugccuguaaucuuagcacuuugggaggcugaggcaggcagaucacuugagguc

SEQ ID NO: 4105257 - RNA, 63 nt, Human
gacucaguucucuuaccugugcggaagaugcuaagaucugaucagcagaugaugaggcugguc

SEQ ID NO: 4105258 - RNA, 66 nt, Human
gacuccaaccugcaucauuaagguacaguuggcuccaguggauuagugcugaaaugaugggaaguc

SEQ ID NO: 4105259 - RNA, 74 nt, Human
gacuccacagguguacuguaccuuccgcaggugacaggaggacccuggcugaaggucagucacacugugggcuc

SEQ ID NO: 4105260 - RNA, 86 nt, Human
gacuccgcugcgcugaggccugguagccgagccccaggggccaccucuggcagcccgggaaaccaagccugagcccagccaugguc

SEQ ID NO: 4105261 - RNA, 101 nt, Human
gacuccuccauguacaccgcgacucacuuagaggcuggaggcucucuucucucaggccuuugcacgugcaguugcccugccuagagcaccuuuucuaaguc

SEQ ID NO: 4105262 - RNA, 78 nt, Human
gacucucacacuuuaguaugaagagguaggccacuucuguaagccugauuccugacuuuuugcugaagagacugaguu

SEQ ID NO: 4105263 - RNA, 90 nt, Human
gacucugacuucugguuguguuacguucuguggugccaaugagacaggaacagaaaggccuuuagagcaaacgccaccuacagcagaguc

SEQ ID NO: 4105264 - RNA, 83 nt, Human
gacucugaggguguuccugacuaggagggcuaagguuugugaucuaaccuuagcccuccuggucagugaggccaaagaaaguc

SEQ ID NO: 4105265 - RNA, 64 nt, Human
gacucugauuuaucugcguuccuuggacaccaacaggaauugcaggcagaucucaaucagaguu

SEQ ID NO: 4105266 - RNA, 88 nt, Human
gacucuggaauauuaacuaauuuucccaaggccuucuaucuaacaagggauggggccuguauuuaaaauucaguuuuauuccgaaguc

SEQ ID NO: 4105267 - RNA, 58 nt, Human
gacucuggaugagguccugucuguuuucaagaaagagacccuggaguucuucacuguu

SEQ ID NO: 4105268 - RNA, 58 nt, Human
gacucugggccccagguggagcugugcugccccuacagccugcagaaggcccaggguc

SEQ ID NO: 4105269 - RNA, 65 nt, Human
gacucuggggcagcuccaucuauuccaaagcaacaacuuuaugugauuauguuagucccaggcuc

SEQ ID NO: 4105270 - RNA, 55 nt, Human
gacucuguggcuguuaucuuuauaucuuuucuugagauauuaauagcucaguguc

SEQ ID NO: 4105271 - RNA, 79 nt, Human
gacucuugcccucugaugucugggggcuggauaacaacagaauuuauuauccaaaccuggacaugagugggaaaggguc

SEQ ID NO: 4105272 - RNA, 62 nt, Human
gacugaaacugggcccagucugaguugggccuagggcuuaguucagggcucaguuugcuguc

SEQ ID NO: 4105273 - RNA, 55 nt, Human
gacugaaauuauaccaagugguuaacguugggcaaauuacuuggcaaagucaguc

SEQ ID NO: 4105274 - RNA, 65 nt, Human
gacugaagcauuguuugaauaccauaauuucuuaccucagaaaaugguuuacaauguuuucaguu

SEQ ID NO: 4105275 - RNA, 109 nt, Human
gacugaauugugcaaaugaguagcgaugcacauuagaaaacaacauuauaaaaucagguaugugaaauccugagauguacuugcuuuauuuauuuuaacaagggcaguu

SEQ ID NO: 4105276 - RNA, 80 nt, Human
gacugaccuugguuggaauccugccucugcuacuuaaaagcuaagugacauugggcagguuuccuuaaucuccuucaguc

SEQ ID NO: 4105277 - RNA, 60 nt, Human
gacugacucccacagcuuuauuugcuccaagcaggugagcuuauacaugugaagucaguu

SEQ ID NO: 4105278 - RNA, 61 nt, Human
gacugagaaacaguacauuaccaggacuccauaaaaccguccuucauacugucuucugguc

SEQ ID NO: 4105279 - RNA, 73 nt, Human
gacugagcuuugagauucuuaugguagcucuuaacuccugggaaugaggugccaagggaagcuaagagccguc

SEQ ID NO: 4105280 - RNA, 57 nt, Human
gacugaggcagguuccucaaauugcaucugcaaguaggaaccuaagagccugcaguc

SEQ ID NO: 4105281 - RNA, 65 nt, Human
gacugaggcuuaaagcuagagacuuaaauguuauaaagauaaggcagcauaauuaggccacgguc

SEQ ID NO: 4105282 - RNA, 57 nt, Human
gacugaggugaccuaggacuaccucugccaaguagacugugugagggucccucaguc

SEQ ID NO: 4105283 - RNA, 65 nt, Human
gacugagucaggauuauaauccccaugggcuucauuauguccagauuucauuucuacuccuaguc

SEQ ID NO: 4105284 - RNA, 74 nt, Human
gacugauauaguuugugaaacacagcaguuguuuuuucaacccugcaaggcuccaaauuaccaagcucucaguc

SEQ ID NO: 4105285 - RNA, 82 nt, Human
gacugauggcagcagggcuugauuauguuacuuucuaauacuuccugaaaugcaugguauuuuuccuguuugcccauugguu

SEQ ID NO: 4105286 - RNA, 70 nt, Human
gacugcacuccagguuuuuucacugaaggggcaauacaccuuuaaugugagacaaaccuggcuuccaauc

SEQ ID NO: 4105287 - RNA, 55 nt, Human
gacugcaugauguuccagaggaguuuagucuuuaccuuuagauuucuaugcaguu

SEQ ID NO: 4105288 - RNA, 57 nt, Human
gacugccauaggcuuugcaguauaaugaaguauuauuucucaguaguaauggcaguc

SEQ ID NO: 4105289 - RNA, 70 nt, Human
gacugccccagcaucaccgccauuucugaugugaagacacccuccgcaguauguaggugcuguuucaguc

SEQ ID NO: 4105290 - RNA, 77 nt, Human
gacugccccagugccaggcaggugugcccugggcucugccgccacccuccacgcuugcuggcaacacugguaugguu

SEQ ID NO: 4105291 - RNA, 60 nt, Human
gacugccccaguucaaauccuagcugugcuacuuaccagcuguguggccuugggcaaguu

SEQ ID NO: 4105292 - RNA, 76 nt, Human
gacugcuacgcuuuaacgugagaagaagggccucuugauucccagccagcccuuugcauuugaaaccuggcagcuc

SEQ ID NO: 4105293 - RNA, 63 nt, Human
gacugcuacuagcuguaugcauuuguguguauugcugugagugcauguccaguaguuuauguc

SEQ ID NO: 4105294 - RNA, 83 nt, Human
gacugcuuuggugcuaguuguuuuucaguuuguuguaucuaaacuccauaagcuggaggauaacucacuucucuuaguauguc

SEQ ID NO: 4105295 - RNA, 124 nt, Human
gacugcuuuugccuaggaccugugagagguuccuguuagaacugcaggacgauucagcaucuuuaaguuucagaguuuugagaggaaucaucuaguguguacaggcuuaaaggcauggacaguc

SEQ ID NO: 4105296 - RNA, 75 nt, Human
gacuggcaugguucccuaagcauugcaauggcguucacacagugugccaggaggcggcuugggaaagugcugcuc

SEQ ID NO: 4105297 - RNA, 90 nt, Human
gacuggcugcaguuguuugugaggcagaacaaauuauaaaaugauuauggcuucagagauguauguuucuaaaugauugcuucgccaguc

SEQ ID NO: 4105298 - RNA, 86 nt, Human
gacuggcuucuauuguuuauuucuugcguuuuuguugcauuucguugcagauuuaagagauaaacaguggaaggcgcuuucaaguc

SEQ ID NO: 4105299 - RNA, 94 nt, Human
gacuggcuuuuucauuaaguagaugaaugugaauguuucuugacagcaaggacaauguuuccauguucaauuuacuaugaaaagaacgccaguc

SEQ ID NO: 4105300 - RNA, 71 nt, Human
gacugggggagaggugaaggcugcccuggguuggccccagcccuggggaggagcguucacccuuuccaguc

SEQ ID NO: 4105301 - RNA, 93 nt, Human
gacuggguguaguaauuuaggauguggcuauuuauugaacaggaaugaaagcugacuugggaguauaagcuauuucucuuauuauauccaguc

SEQ ID NO: 4105302 - RNA, 85 nt, Human
gacugguggaagcccugucggaacugcgaccucuggaggccccccgggcucugcacguucuggcguccugguccucccaccuguc

SEQ ID NO: 4105303 - RNA, 79 nt, Human
gacuggugguucuucaaggcuauuaauucugugaguuuggagcaaggcaucugguaaugggccuggggugcuauuaguc

SEQ ID NO: 4105304 - RNA, 95 nt, Human
gacugucuaucgagccccagcaaccuugauauuugcggaucucagacucaaguaagggcugcugggcagauguuguugcugggaguugggugguc

SEQ ID NO: 4105305 - RNA, 68 nt, Human
gacugugaggaggaggucuccuccgcagggggaguguacuccccggagcaguccuccccuucaggguu

SEQ ID NO: 4105306 - RNA, 69 nt, Human
gacucugcuugugucaggcaugcuaauuucucacuggccaaagcaagucacaugaccaagcccaguguc

SEQ ID NO: 4105307 - RNA, 58 nt, Human
gacucuggcugccuugugagcaucaacuauagagaaugaggauggaggcagacagguc

SEQ ID NO: 4105308 - RNA, 94 nt, Human
gacucugguaucucugagucacucuucccagcuuagcuuacuguccccacccugucucuaagcuguucuccagugacucaggagcccagauguu

SEQ ID NO: 4105309 - RNA, 76 nt, Human
gacucuuagaaaggaaaauaaucaacucacauaggaagcacuaaugugcaaauuauuuugccagacucugaggguc

SEQ ID NO: 4105310 - RNA, 111 nt, Human
gacucuugaugaaugucauagcaggguguuuuaauuuaauagauccagaauaacaucugguucuaauauuuuaaaagccaauuuauauggaaauuuauuuaauacacaguc

SEQ ID NO: 4105311 - RNA, 97 nt, Human
gacucuugggagggguuugcugggggaaagagacauugagaggcaagauuaaauagcucaguguuuaccccaaucaguuuacucccuacucuuuguc

SEQ ID NO: 4105312 - RNA, 77 nt, Human
gacucuuuuacugaaaguauacauuucugcacuuacauuucaagauguaguuaugucucuuucagaagauugugguc

SEQ ID NO: 4105313 - RNA, 59 nt, Human
gacugaaggucuaauuccugaguuugaucuuccuggcuuucaaggaaaggccucauguc

SEQ ID NO: 4105314 - RNA, 68 nt, Human
gacugaaucaauugugaagacuaugaugccccaaagagcagagcaugauaucucaucaaugguucauc

SEQ ID NO: 4105315 - RNA, 64 nt, Human
gacugacaaacagcagggacuugaauggaagaugcuucuuguuuugcccaaguuguauucgguc

SEQ ID NO: 4105316 - RNA, 64 nt, Human
gacugagaauaggcaucccgagguguuugucuuaacaauggaacccagagugucugucucaguc

SEQ ID NO: 4105317 - RNA, 92 nt, Human
gacugaggcauauuagauccuacgaucugaauagacuugcuaaggcuguuuggcuuucacaguucagaucaguuuagagugcuggaucaguc

SEQ ID NO: 4105318 - RNA, 82 nt, Human
gacugauguugcuauguguuaguaauggacuugcucacuacaauaauuaaaacaagaugccauuggcacaaguagcuucauc

SEQ ID NO: 4105319 - RNA, 65 nt, Human
gacugccugugaucagcugaguucaaguuucaucuuuuaaauuagccgaucauaggaaaugaguc

SEQ ID NO: 4105320 - RNA, 58 nt, Human
gacugccuugggggugaaagaggcuagcacuuaguuuaacgacauccccaaagugguc

SEQ ID NO: 4105321 - RNA, 72 nt, Human
gacugcgcuccucuagaagcugaccuggagauauggguucaucuucaggcaguuuauuggagaagugauguc

SEQ ID NO: 4105322 - RNA, 55 nt, Human
gacuggagucaaugagcagcaccugguggcagauguguuuugugugacccagcuc

SEQ ID NO: 4105323 - RNA, 63 nt, Human
gacuggagugccuccaggaaagcaggaagcaagacauguuuuuaaccugguaaguauuuaguc

SEQ ID NO: 4105324 - RNA, 66 nt, Human
gacuggauguuuaaucaacagaggaacaaagaaaauguuccaauuuugugugaaaauauuuaaguu

SEQ ID NO: 4105325 - RNA, 65 nt, Human
gacuggccucuuucuucccuuugacugggaaugggucaaaggcggugcaggaggaggaucugguc

SEQ ID NO: 4105326 - RNA, 79 nt, Human
gacuggcuucguuugccaauuucuuuguuuugcacuagaaagcauuucugcaacucaguuggcauauucaagcacaguc

SEQ ID NO: 4105327 - RNA, 126 nt, Human
gacuggcuuugcugcagcaccuuagccuaucuucacuaagagcauccuauguaugacuuauauccucaaaguugcucugugguccaagauggcugcuugagccaccugugugugacagcaccaguu

SEQ ID NO: 4105328 - RNA, 55 nt, Human
gacugggcuucucccccuggcagagggcuucucucugccacaugaggauuuaguc

SEQ ID NO: 4105329 - RNA, 73 nt, Human
gacugggggugcugggacggcagcucaggcaccaggcagggcacagcucaggucccagcucaggccccagguc

SEQ ID NO: 4105330 - RNA, 90 nt, Human
gacugggguggaaggccuggauuuagguugugagccaaauggaacuguuaauaucaaacccaagaaucaggcagcuuaucaccaucaguc

SEQ ID NO: 4105331 - RNA, 56 nt, Human
gacugggucccacagccugcuggggugagcccaggauggcuggagggccuuuuguc

SEQ ID NO: 4105332 - RNA, 63 nt, Human
gacuggguccucugcuuauggucucaaaaggcuacaaucgagcugucaucagggacugcaguc

SEQ ID NO: 4105333 - RNA, 79 nt, Human
gacuggguccuucaucuggagccuggucccacaucagugugacaagcaggcuccugaagaaauaaaugacaugcuaguc

SEQ ID NO: 4105334 - RNA, 77 nt, Human
gacugggugggaaggaugggaguggaggaaaaaaguuacuuuuaacuuaucacccauuuccuccuaaauccacuguc

SEQ ID NO: 4105335 - RNA, 59 nt, Human
gacuggguuccaucggaaaggaacuguuagauuuguguuccuaacucuggcaccuaguc

SEQ ID NO: 4105336 - RNA, 63 nt, Human
gacuguacaaauucauugaacuguacauuuaaauugugugcacuucauuguaaauuguaccuc

SEQ ID NO: 4105337 - RNA, 55 nt, Human
gacuguagcuuugcuacuuaaggugagguccucaggccaguaguauagcacaguc

SEQ ID NO: 4105338 - RNA, 85 nt, Human
gacuguaguaauuuguguucuugguuucauucuccuagcaugguugaaauggauaaucaugaacuuugaguuaggucuggcaguc

SEQ ID NO: 4105339 - RNA, 55 nt, Human
gacugucgguucugguuucacaugcacugugugaacacgcuucauacagaggguc

SEQ ID NO: 4105340 - RNA, 55 nt, Human
gacugucucugugaaugguaggguaacuguuucccugccacuguaggugacaguu

SEQ ID NO: 4105341 - RNA, 61 nt, Human
gacugugacuucugaagcaauagcugccuaaaaugaaggugcaggcuccagaauucuaguc

SEQ ID NO: 4105342 - RNA, 81 nt, Human
gacugugccucugggugaccaaggagcagccaagauagcagagagauggucguagccuuggaggauccaucaggggcaguc

SEQ ID NO: 4105343 - RNA, 60 nt, Human
gacuguggacucucaugauagagauaaacuuuuauuuucugucuuguuuaggccacuguu

SEQ ID NO: 4105344 - RNA, 55 nt, Human
gacuguggauagaacacugcagcuaguccugcagaugcucuccucauccccaguc

SEQ ID NO: 4105345 - RNA, 112 nt, Human
gacuguggcaaaacauuccuauaaaagccagugcagcuggaaauucaccuaucagaggguagaacaaccaaaauguauguguacuauaguguuguguauuuuuguuugaguc

SEQ ID NO: 4105346 - RNA, 59 nt, Human
gacugugggaagacuguagguuacucauuggugcaggcgcuuucagaagucucauaguu

SEQ ID NO: 4105347 - RNA, 69 nt, Human
gacuguuuacuccauuugcauguggcccuuccccuuaacuggagcucuaagcaaugcuguaguucaguc

SEQ ID NO: 4105348 - RNA, 65 nt, Human
gacuguuucaggagcauccugauuggccucagucucacgagguugaccagagaccugaaucaguu

SEQ ID NO: 4105349 - RNA, 63 nt, Human
gacuuaaauuucugguccaucuagugcauauuuuaguguaaguuguaacagaaauuuaauguc

SEQ ID NO: 4105350 - RNA, 66 nt, Human
gacuuagcuaugaaagggaagugaaggcauuggggaaaugugcacagacaacucuuucuagaaguc

SEQ ID NO: 4105351 - RNA, 67 nt, Human
gacuuaucuuugaugccagauguuacuuaugaagcaaugagugaucugucuuaaucauagauuaguc

SEQ ID NO: 4105352 - RNA, 111 nt, Human
gacuucccugaggaauuguacauggugcucugagagugcaugauagcacaugacuuucucccgugcuuaucaagcugcacucuucccauuugcgccuccacauucaugguc

SEQ ID NO: 4105353 - RNA, 58 nt, Human
gacuucugccucaggggaaggucuugguucaaauuugaucauucucucaguagagguu

SEQ ID NO: 4105354 - RNA, 65 nt, Human
gacuucuucaugucuuuuccaccucuuucauauaaucuaagggggauauggaccuuggaggaguc

SEQ ID NO: 4105355 - RNA, 71 nt, Human
gacuugacagguauuuuauagauaaguaaaccaaggguuuauagauaaggugaaauaaauuguugaaaguc

SEQ ID NO: 4105356 - RNA, 64 nt, Human
gacuugagacccuccccagagcacaucuucucagaacugcucuggggcccagggaucacagguc

SEQ ID NO: 4105357 - RNA, 68 nt, Human
gacuugagaugcgggagaaugugaaugagcauggaguccgugccacaggcaaucccugcacgcaaguu

SEQ ID NO: 4105358 - RNA, 94 nt, Human
gacuugauuuuuuccauuuuagugacauuuacgaaucuuaucccuuuguuuaauggaaaggggaaaugggagcaaguguuacaauugucagguc

SEQ ID NO: 4105359 - RNA, 74 nt, Human
gacuugcacugacuccaugaugaucaacucugcccaggaaguugucucagagggucaccaggaagugcacgguc

SEQ ID NO: 4105360 - RNA, 93 nt, Human
gacuugcuuucuagagccacauauuucccuucagggacuagcuacuuguucuucucagagaaaugugucaccaucuuuccagcagagccaguc

SEQ ID NO: 4105361 - RNA, 82 nt, Human
gaaaugaggacaaaauccaaacuucuuagcagaauuuacaacucccugcaaguucuggcuuuuguccuugcaaucucauuuc

SEQ ID NO: 4105362 - RNA, 59 nt, Human
gaaaugaguuaaugggcuaauggaugggggcauuuacccuuuugccuuuaauucauguc

SEQ ID NO: 4105363 - RNA, 77 nt, Human
gaaaugcaaauucuuaggcuccaucccagacucauagaaucaguaacucugugguugggcccaagaaucugcaucuu

SEQ ID NO: 4105364 - RNA, 77 nt, Human
gaaaugcagauuccugguuccuacaccaaaccuagugaauaagaaccucuggggaaaggcccaggaauaugcauuuu

SEQ ID NO: 4105365 - RNA, 104 nt, Human
gaaaugcaggauaucuguagaguuaacuaaauuaagagacaacaggguugaauuuuuuccccauuugcucauuaauguagaguaacacuuacgaugccucauuc

SEQ ID NO: 4105366 - RNA, 93 nt, Human
gaaauggaagcugcucucuuaggagcaagagaaguggaggguucuucuaaugucccugcuuucagugugcuccugagggcuaguuucuguuuc

SEQ ID NO: 4105367 - RNA, 77 nt, Human
gaaauggauuuccacaaguggcuggggaaagggagucucuuuuuagaaugucucuucuuugguccacugucucuuuc

SEQ ID NO: 4105368 - RNA, 61 nt, Human
gaaauggccaguagagcucagauaguuucucauuacaaagaaauucuuugguguccauuuc

SEQ ID NO: 4105369 - RNA, 73 nt, Human
gaaaugguuagaaucaaguugcucauaacucuggaaauuaaccaaaggccugcagcaaccuuggaagcauuuc

SEQ ID NO: 4105370 - RNA, 120 nt, Human
gaaauguaaagagaguugauuuugcucauuuuguaguuugaaagaagccagacucccaauacagcacacuaaaagcuuggcuuucgcuauagagcacggccaacucuagaauaaaauuuc

SEQ ID NO: 4105371 - RNA, 59 nt, Human
gaaauguagaaucucaguggggccccaccacacaccuacugaauuacagucugcauuuu

SEQ ID NO: 4105372 - RNA, 68 nt, Human
gaaaugucagguauuaauaaauggagaguaguaauguauuccauuaguguuaauaucucuauuauuuc

SEQ ID NO: 4105373 - RNA, 121 nt, Human
gaaaugucaguucucagaccacacuccaaucugcugugucagaaacucuggggaugucucacuugcauuccuugaaccacuggcuugguggguguggaauguuguucuuacucaucauuuc

SEQ ID NO: 4105374 - RNA, 102 nt, Human
gaaaugugaggacaugagauuuggguggggccacggguggaaugauaugguuuggcuguguccccacccaaaucucauccugaauuauaacucccacaauuc

SEQ ID NO: 4105375 - RNA, 59 nt, Human
gaaaugugugacaaguuucaauuucccgagaaggacauugauucuauuccacagauuuu

SEQ ID NO: 4105376 - RNA, 81 nt, Human
gaaauguguuguuagaagccaggauggagcagguuuugccaaacccugaguccuaguggcuuguaacagcacacauauuuc

SEQ ID NO: 4105377 - RNA, 86 nt, Human
gaaauuaauccucuggggcgugguccuggacccucagacaagaggagagguccucugcuaggugccccauaguauccuuuguuuuc

SEQ ID NO: 4105378 - RNA, 88 nt, Human
gaaauuaguucucagacaguaugauauaugaauacauuuuuuucucuguggauucauaaaaauaucaacuguaaagggagaugcuuuc

SEQ ID NO: 4105379 - RNA, 88 nt, Human
gaaauuaucaccccaacgacuguucacagauuagucgaugcaaauguuaaaaacguguuggcaagcuggaugagcagguuuguauuuu

SEQ ID NO: 4105380 - RNA, 59 nt, Human
gagaauggcuucacauggcauacaugcuguaaaaugcacgugcccugugggcuauuuuc

SEQ ID NO: 4105381 - RNA, 86 nt, Human
gagaauggggcaacagacuuuuauucuuuaagaccauaauauucaaagagugguccagggaucuuuagagucuuugagacauuuuu

SEQ ID NO: 4105382 - RNA, 76 nt, Human
gagaauuacagaggcuggguuuucagggacccaggacacugaaaucccuggaacugccaagccucaguaguuucuu

SEQ ID NO: 4105383 - RNA, 59 nt, Human
gagaauucauuugauccugaugcuggaaauauauccugcuuggaguagaaugcauucuu

SEQ ID NO: 4105384 - RNA, 87 nt, Human
gagaauugcuugaacccuggagguggagguugcagugagccgagauugcaccauugcacuccacccuaggcaacaagagcaaaacuc

SEQ ID NO: 4105385 - RNA, 68 nt, Human
gagaauuugucuugaauuuuaaacaacauuugauuccaaaauggggagauuuagcagacaaagcucuu

SEQ ID NO: 4105386 - RNA, 71 nt, Human
gagacaaagacaagcaucaaaucaggcagugcuuuuccaucacucauguuugguucucuuagucuugucuc

SEQ ID NO: 4105387 - RNA, 63 nt, Human
gagacaacccaagugaaagugcuacguaaauucuagaaugccguagacuuuuacuuauguuuc

SEQ ID NO: 4105388 - RNA, 67 nt, Human
gagacaagcacuucacuguccucugcguuuuacagaagaaaguagggcacagagaugugcuguacuc

SEQ ID NO: 4105389 - RNA, 66 nt, Human
gagacaaguuuuugauagacuagaaaauugucucuuaagguucuugucaggucaaaaaccuugcuc

SEQ ID NO: 4105390 - RNA, 118 nt, Human
gagacaauaguaauagagggauguucuuaagucaguaagaugcaauuaggaguacuaauagcucacauucuauggacuugggcauuacuaaaauuccuuauguugauauaaaauacuc

SEQ ID NO: 4105391 - RNA, 103 nt, Human
gagacacccccuggggggcaagaagcagcacagcaaugacucuauuccccgggauggaguggaaucauugcuguguugcuucuugccuuucccaccugggcuc

SEQ ID NO: 4105392 - RNA, 68 nt, Human
gagacagagaggggaagacucugacggagguuuuaacuguaugcaugccagucuuucccacucgucuu

SEQ ID NO: 4105393 - RNA, 100 nt, Human
gagacagagggaucacuugagcccagaaggucgaggcugcagugagcccaugacugcgccacugcacuccagccugggcaacagagugacacccugucuc

SEQ ID NO: 4105394 - RNA, 89 nt, Human
gagacagaucagcuggccaguuguccuggcuugggcagcuucucaggugcagccaggucgacagcaugaccagcccacgagcucgucuc

SEQ ID NO: 4105395 - RNA, 56 nt, Human
gagacagaucucggcuccaugcagcuuaaggcagaggugggugccgaguuugucuu

SEQ ID NO: 4105396 - RNA, 55 nt, Human
gagacagaugcugcuggagcauuugaaauaugaagugugcaguggccaucuucuc

SEQ ID NO: 4105397 - RNA, 71 nt, Human
gagacagcccagcgaagucuuacacauguuauuuggaaguauugugacaggcacgaaauugggcugguguc

SEQ ID NO: 4105398 - RNA, 63 nt, Human
gagacagcugcccagcuaggaagaaggucuaggagccagaccuuccccgugggcagccgucuu

SEQ ID NO: 4105399 - RNA, 63 nt, Human
gagacagggaggaaagagacugcuuuccucccacaaaagcaguuuccacaaccuccccugguc

SEQ ID NO: 4105400 - RNA, 57 nt, Human
gagacaggucugugugcacagugcucgcggcuguugacaugcgcaugcagacugcuu

SEQ ID NO: 4105401 - RNA, 69 nt, Human
gagacagguugaccuuuucugugccuuaguccccgcuccugcaagguggcaugaaaacagccugugcuc

SEQ ID NO: 4105402 - RNA, 60 nt, Human
gagacagugguugcagaagcucuaggaucagacucccugagcuggaaucuggcugugcuu

SEQ ID NO: 4105403 - RNA, 67 nt, Human
gagacaucuccaaggcaaccuguucagaccaaugacugaggaugaaacaggauaaugggggugucuc

SEQ ID NO: 4105404 - RNA, 117 nt, Human
gagacaugcugugggcaucaggacgggaguuaucuggccuguguugguggccccugggccuuguguggggagcagggcauagagcuagcuguacgcucuuggugacacaacugucuu

SEQ ID NO: 4105405 - RNA, 112 nt, Human
gagacauggccccagcaaugauggauucuaaaugugacucaccaucucauaagcaagcagucuauuagagggucaaggucccauaggagcauauuaugcaggcccuguccuc

SEQ ID NO: 4105406 - RNA, 75 nt, Human
gagaccacagccaccuugaugccuuuccaagaugucuuaucuuaggugcagaggcauuuugggugaagucauuuc

SEQ ID NO: 4105407 - RNA, 82 nt, Human
gagaccagcugggguugcacacauuuugagggugagaaaaugggugggccuccaagauugaacucaacccugcucugguauc

SEQ ID NO: 4105408 - RNA, 68 nt, Human
gagaccauccuggccaacgugguaaaaccccguaucuacuaucuugcuauguugcccaggguggccuc

SEQ ID NO: 4105409 - RNA, 78 nt, Human
gagacccaucccaagagauucuagccccguagauguguggcagggcucaggcucugggauucugauguaguuggucuc

SEQ ID NO: 4105410 - RNA, 78 nt, Human
gagaccccaacagugggcuuccagaacaucccaggaccauccuucuugcugucuucucugaggucccuggccacucuc

SEQ ID NO: 4105411 - RNA, 77 nt, Human
gagacgacagcuauauuguuuucuacuguauuccuagcacauggcauacagaaaacauaaguauauguuguugacuu

SEQ ID NO: 4105412 - RNA, 66 nt, Human
gagacgacugggugauagaagaaugcugaaugcuguguucguauccugcuucaugcccagaguuuu

SEQ ID NO: 4105413 - RNA, 108 nt, Human
gagacggagguggaagcagugauucuugucugagggcucacggcugucucuggaaauaagacccgagcagcugagcuuuuccguggaucacgucucccccuuccucuc

SEQ ID NO: 4105414 - RNA, 74 nt, Human
gagacgugggcaguggggucuucugccgaugcugauucuaccgccuugggcagcuggccuccucgcccacucuc

SEQ ID NO: 4105415 - RNA, 77 nt, Human
gagacuaaaaggccaccagaccgagaaguucuccaggccacccuguggccacggggauuguugaguugugggguuuc

SEQ ID NO: 4105416 - RNA, 59 nt, Human
gagacuccugggaccaugggcauauuuucuaauauugccaaguggagcucaggaaucuc

SEQ ID NO: 4105417 - RNA, 61 nt, Human
gagacucuugcuuuaauagcccucuuaggcagaagcuuuauauaauaaagcaggauuucuc

SEQ ID NO: 4105418 - RNA, 92 nt, Human
gagagaaaagggaguucucgcugauuagguuuuguuuguccaauaaaggacauuugacauuuaguaucagcuaggugcucuaacauucuuuu

SEQ ID NO: 4105419 - RNA, 65 nt, Human
gagagaaaagggggaauugauucuaguuguuuucagaugacuuuuuucuauuccuucuuucuuuc

SEQ ID NO: 4105420 - RNA, 68 nt, Human
gagagaaagggaacuggcaaagccacucauucucacugauucuguggguuugucauucuuuuugucuc

SEQ ID NO: 4105421 - RNA, 58 nt, Human
gagagaagaauguuccgaggccgagcggggaagcggccugguuugauuuucuucuuuc

SEQ ID NO: 4105422 - RNA, 86 nt, Human
gagagaagagcgaugcugugucagggaccacgucuccugcucugucgaauagagcagaugugucucugcacugucuguuuccucuc

SEQ ID NO: 4105423 - RNA, 57 nt, Human
gagagaaggguagcccauucuccccuggccccagaggacucagacuaucuuucucuc

SEQ ID NO: 4105424 - RNA, 89 nt, Human
cuuuccgcaccugcuccagcuugaagaugugcugguugaaguaauacugcagcugcucauuggcguaguugaugcagaacugcucaaag

SEQ ID NO: 4105425 - RNA, 82 nt, Human
cuuuccuccauggauuuucucacaaugcagaaggaacaaggauggauucuggcucugcauauggaacugccaugcaggaugg

SEQ ID NO: 4105426 - RNA, 56 nt, Human
cuuuccucccaacucaggcccuacucaugcuuagccgccugaggugggguggaagg

SEQ ID NO: 4105427 - RNA, 125 nt, Human
cuuuccugcugcuuguucgccgggagcccugagcuggagucuguggcuccucagccuccuugggacucugcagcuccggcccaggagugucugucuguggugauggcaucuuggcagcaggagag

SEQ ID NO: 4105428 - RNA, 73 nt, Human
cuuuccugcuguguccucacacagccuuuccucagcucauaggaggggaaauguaggaggagcagagggagag

SEQ ID NO: 4105429 - RNA, 83 nt, Human
cuuuccuuccuucuucccauuaguaaugaagugucucccuuauguuacuucauaccugcuagaaugggaagcuugaagguuag

SEQ ID NO: 4105430 - RNA, 55 nt, Human
cuuuccuucucgugguucucaccaaaaaacaggggagagagcacaggcaggaaag

SEQ ID NO: 4105431 - RNA, 120 nt, Human
cuuucgaugccuguucuuuagaguuauaaaggaaaggccuuugcauuugguuugucucuggaggcuuuucugguaucaaaugcaguaaagguuuuaaaugacucugaggcaagguggaag

SEQ ID NO: 4105432 - RNA, 81 nt, Human
cuuucuaggagucuggagcucuccagagccccguccccagcccugggcagcugggagugaagggcaccaggccccugaaag

SEQ ID NO: 4105433 - RNA, 62 nt, Human
cuuucuaguaggaaguagaucaaccugcccagaaaccuaggcccuucuacuccugaaggaag

SEQ ID NO: 4105434 - RNA, 81 nt, Human
cuuucucaucuccauuauagcaucaugccugccuuuucuacucauuaaggcuuguuggcugaauaaauggggaugcaagag

SEQ ID NO: 4105435 - RNA, 77 nt, Human
cuuucucuauaucaguguauuaaauuuugccucuccaaagcuguagaaugaaauagacuugcacuauauggacagag

SEQ ID NO: 4105436 - RNA, 56 nt, Human
cuuucugaucccugcaacccucuuuccucgagcugucagggcacagggacagaagg

SEQ ID NO: 4105437 - RNA, 55 nt, Human
cuuucuggaagaauguucucuuugcuuguccaagcccagagagaauuccaguagg

SEQ ID NO: 4105438 - RNA, 65 nt, Human
cuuucugguugcuguugcugugaugagauuggauuuauggggcagguggcagcagaaucagggag

SEQ ID NO: 4105439 - RNA, 56 nt, Human
cuuucuguagggauuucacaguuucugguuggcagaguaaggacccaagcaggaag

SEQ ID NO: 4105440 - RNA, 57 nt, Human
cuuucugugcugagcucugagauguggggagaugcccgacacccucagcccagaaag

SEQ ID NO: 4105441 - RNA, 67 nt, Human
cuuucuucuuagacguaucagguuccugcaggguaaagaccugacuaucugaaguuugagaggaaag

SEQ ID NO: 4105442 - RNA, 78 nt, Human
cuuucuugcuacagauuuugugaagaaguguuacucaaacuuuaggugacauuaacaccauaaguguguuaggggaag

SEQ ID NO: 4105443 - RNA, 86 nt, Human
cuuucuuugcaauuugacauugagagagcaccuuggaaggguuauuaugaagaccaagcuguucucuaaguuucaugcagagugag

SEQ ID NO: 4105444 - RNA, 65 nt, Human
cuuucuuuuccauguauucaccaggugucacccacacaucauccggugggcacaggagagcagag

SEQ ID NO: 4105445 - RNA, 121 nt, Human
cuuucuuuuuuuuaggaggugauuuagauuauuuaguucauaauuggaugaggagguucaacugugaauuuuaugauaccaagaaacacuauuuagaauauuuuaaauguuaaggagaaag

SEQ ID NO: 4105446 - RNA, 67 nt, Human
cuuugaaaguuuauggagucugcagaguauauuuguccuacgaugcaggagccuuggacuugaaaag

SEQ ID NO: 4105447 - RNA, 70 nt, Human
cuuugaacaauuugguauacaaacaccuuugauauuuagggcugaguuuggggauuaaauuguaaggaag

SEQ ID NO: 4105448 - RNA, 81 nt, Human
cuuugaauaaauagcuuaaacucuuugaaguuauaguuucucacuuauaaaacacaagaguugggcuagguugucacaagg

SEQ ID NO: 4105449 - RNA, 70 nt, Human
cuuugaaugaggcccugaccugggagaucuaggccucucuuggccuacccgugagggucuacaucugaag

SEQ ID NO: 4105450 - RNA, 79 nt, Human
cuuugacaucaucuggaaugucacagcaggaguauucuuugcaaacuagugcaaggguuggauuuauuccaugucaggg

SEQ ID NO: 4105451 - RNA, 79 nt, Human
cuuugacuccaucucucuuuguuagucucacucuuuccauuaauucucugugagagguaaagagacagaggagucaagg

SEQ ID NO: 4105452 - RNA, 58 nt, Human
cuuugagggacuuagcuagguuuagaaagacuuuuggagagcagcuaggcccuuuugg

SEQ ID NO: 4105453 - RNA, 74 nt, Human
cuuugagguuuuuugauuugguugaaacuaauaccaaaauuggaaaucuuuuauuacaccagguuaacucaaag

SEQ ID NO: 4105454 - RNA, 55 nt, Human
gagaguagggacugggcucugugucauauacgcaaagcagcagcaccugcauuuc

SEQ ID NO: 4105455 - RNA, 59 nt, Human
gagaguaguuaugaggcaagcagagcuuuguaagugccugagugcuuuggcuugcucuc

SEQ ID NO: 4105456 - RNA, 61 nt, Human
gagagucuaggaaccucauauaggugcaaucauaagugugucuuuuugagccugacuucuc

SEQ ID NO: 4105457 - RNA, 105 nt, Human
gagagucuguuuggccaauacugagucauguauucacuuagcuucugcugggaugcaaggguguauguaugauggguggucucagacuugcccaggcaggcucuc

SEQ ID NO: 4105458 - RNA, 61 nt, Human
gagagucuuaucucguuaaugaaugaaaaauagaaaucaauuauucugagaugagauucuu

SEQ ID NO: 4105459 - RNA, 61 nt, Human
gagaguggucccagaagccucuccaaaugcuccauccagagagucuucuggggccacuuuc

SEQ ID NO: 4105460 - RNA, 98 nt, Human
gagaguucauguauuuauguugucuuaagguuuucaaacuacuguaugaucguaaacacaguuuguaaacuugagcuagccauguacacuguacuuuu

SEQ ID NO: 4105461 - RNA, 84 nt, Human
gagaguucuuuauuacucccaggggaacuaucaaguagaaagaguuugcucugaagcuucuugggcaaauuugaagaugcuuuu

SEQ ID NO: 4105462 - RNA, 118 nt, Human
gagaguuuacaaacaaacacacagugugcagaaagcuuaggcaaguuggaggagaggaguguccccugcaauugccuaauuuucauacacaaauuacgugguuucccuguagaugguc

SEQ ID NO: 4105463 - RNA, 64 nt, Human
gagaguuuaggagacagguagagaggaggaaauuccagacccauuuaucuguuuccugcuuguc

SEQ ID NO: 4105464 - RNA, 66 nt, Human
gagauaaaguugcagugaaauaaggcucaggucauucaaggccuuagcggucauagcaaagauuuu

SEQ ID NO: 4105465 - RNA, 71 nt, Human
gagauaauguacacaucccagacucccaggaacuggaaggaggccauccugggagagugggacuguaucuc

SEQ ID NO: 4105466 - RNA, 82 nt, Human
gagauaauuaaaagauaacccaugaguaauuaugacccaacuaagcuuggguaacauucauuggguaguuauugauuaacuu

SEQ ID NO: 4105467 - RNA, 130 nt, Human
gagauaauucauuacaggggcauagcaagcauuauguuuaaauuuguagcuauguaauuaaaaucaacuuuuaauuggcuuugagaaguuugaguuaaugauuuugaauugcccauguuuguauuuuuuu

SEQ ID NO: 4105468 - RNA, 83 nt, Human
gagauacauuuucaaaccuaucuaagaaauagcccugauauugaaauggcuucuguggaauagguuugacagauguaagucuu

SEQ ID NO: 4105469 - RNA, 70 nt, Human
gagauagaggcuccugauccuggggucuggagaugguguagcuccugaccccucaggcugcuuagaccuc

SEQ ID NO: 4105470 - RNA, 57 nt, Human
gagauagaguuggcacaguccugcuuugagacagggcaauggaugugaugacuccuc

SEQ ID NO: 4105471 - RNA, 100 nt, Human
gagauagcgaccaggggcaagcuagacacagggguuugccaacuugaaauauggguucucucaaacuuuguguuugccuuauggccuggggcuuuuauuc

SEQ ID NO: 4105472 - RNA, 69 nt, Human
gagauaggaggauugcuuguggccaggaguucaagaccagccugggcaacauaguaaaaccuccaucuc

SEQ ID NO: 4105473 - RNA, 72 nt, Human
gagauauaucuccuaaaguuuccagaagaaucgaaucacugaccaucuuccugcuuuggugaggcuuauuuc

SEQ ID NO: 4105474 - RNA, 61 nt, Human
gagauauguuagaaagcuauugaacaggucacaaaacugaagugcugaaaaagcaugucuc

SEQ ID NO: 4105475 - RNA, 59 nt, Human
gagauauguuggcagcugguaugcacuucaucagagggcaaauuacugccacacauuuc

SEQ ID NO: 4105476 - RNA, 62 nt, Human
gagaucagcuggguggggcuaaagacugucagggagagcaacuuuauuccacugggcagcuc

SEQ ID NO: 4105477 - RNA, 93 nt, Human
gagaucauuagacccacauccguauuugacuauugcaccgggguaaaguuugguggcaggaaccagauaucagggaugggaggauaugauuuc

SEQ ID NO: 4105478 - RNA, 65 nt, Human
gagauccucaguggauuggaugaugccacccacacuggggaaggcuguccacuccacucggucuc

SEQ ID NO: 4105479 - RNA, 64 nt, Human
gagaucgccuguucacaccuguccagguaacacaucccaucuggacaggguaacuggugguuuu

SEQ ID NO: 4105480 - RNA, 77 nt, Human
gagaucucuaaucaccagcucuagcagccucauaggcuguauaucaccccaagcagcugagacucuuagagaugcuc

SEQ ID NO: 4105481 - RNA, 83 nt, Human
gagaucugcuuuagggacagcuucuagaggaauuggugacaaaacacagagacuuggagcaggcugaccagaguucaaaucuu

SEQ ID NO: 4105482 - RNA, 65 nt, Human
cuuuuaagcuguggcauuaauucuugauuaucagcugucaggucuuucauuacauggguuaaaag

SEQ ID NO: 4105483 - RNA, 74 nt, Human
cuuuuacuugacacaggggggcgcuagaagauggcuuguucgcuuucuuuucuguaacucagugucuagggaag

SEQ ID NO: 4105484 - RNA, 67 nt, Human
cuuuuagcuguuuccauggcaaccaacacccagaccauuuaguugcuagucaacugacagcuguaag

SEQ ID NO: 4105485 - RNA, 78 nt, Human
cuuuuaguucaaaggcaaagguuugugucauccuuaacugacaaacacuuacauugucucuugcugagcagcugagag

SEQ ID NO: 4105486 - RNA, 130 nt, Human
cuuuuauacuguaugaguaucauagucugucuucuguagccaguaacauauagaaguuaguuuuuguguugucuauguuuuugagguuaaagaaaacagaauacuaaauugcuauauacuaaucuauaag

SEQ ID NO: 4105487 - RNA, 105 nt, Human
cuuuuauacuugaaaaugacaggcuuaaaugcucauaucagucacaaauccaggauguacugucuuguuguaugugagcuuuguagagauuuuuaaaaauauaag

SEQ ID NO: 4105488 - RNA, 70 nt, Human
cuuuuaugguggucugaagugucugauuaaccaacccugagguuucccuuuccacuggaccucaugagag

SEQ ID NO: 4105489 - RNA, 70 nt, Human
cuuuuauugcugagcaguguuuaauuguaugguugcacuauauaauguuuauccauuugccagcugaaag

SEQ ID NO: 4105490 - RNA, 77 nt, Human
cuuuuauuuaagccaguuuccagauauuaacucugucccccaggaccaagugauaacugaagaggcccagaugcaag

SEQ ID NO: 4105491 - RNA, 98 nt, Human
cuuuucaauggcagcguauuauugcauagauuaugccauaugaugccagugcucuguuguggcauaauuuguugaaugaguucccugucaaugaaaag

SEQ ID NO: 4105492 - RNA, 67 nt, Human
cuuuucacugugauguuuaagagaauguaugaacaguuuacauuuuccuuagaaauacauugauggg

SEQ ID NO: 4105493 - RNA, 74 nt, Human
cuuuucagcuuuaggacucauaauaaacugggcacuguccaguuuaugagcagcgaguuccuauaguuugaaag

SEQ ID NO: 4105494 - RNA, 81 nt, Human
cuuuucaguucuuucacucaagaaggaucugcaacuugaauucagcagguuuggucuucaguggggccuggaaguggaagg

SEQ ID NO: 4105495 - RNA, 80 nt, Human
cuuuucauucaguaagacuuugaguguuuuugagccaggaaggcaagauguuagaggucaugcagaguccaagagagaag

SEQ ID NO: 4105496 - RNA, 63 nt, Human
cuuuuccaaggauguggucaauuggaauaacagcauuucucugauuacacuauuugggaauag

SEQ ID NO: 4105497 - RNA, 62 nt, Human
cuuuuccaguaccuugggacccagcagccaugcugugaaaaagcccaggcuacauggagagg

SEQ ID NO: 4105498 - RNA, 74 nt, Human
cuuuuccauuaacaccuguacguggcacgcaauagacacucaaugugugacgagugcauauguggauggauuag

SEQ ID NO: 4105499 - RNA, 125 nt, Human
cuuuuccugcacugucuucccuucugcuucuguaucuuucuucaagauuauauucucuucccuuagaucuuguuauaguaggaucaguucccaagcggauuugagagcaguuucucaccgagaag

SEQ ID NO: 4105500 - RNA, 115 nt, Human
cuuuucuccuugugcacuccuuauaaccccagggguaggaggauggugguauaaaacauacucacuguccaugcuugcuaacccaugguaaaaggcagugugguauagaggaagg

SEQ ID NO: 4105501 - RNA, 95 nt, Human
cuuuucugcgggacucuucugucuugcacaugaggagccaguucuggaaagaaaaguucugagugauguugagucagaauguccacccagaaaag

SEQ ID NO: 4105502 - RNA, 58 nt, Human
cuuuucugcugcuuauuccuagugucauuguuggcccuagggcuccaaagcugagaag

SEQ ID NO: 4105503 - RNA, 55 nt, Human
cuuuucuggaaucaucucuaacucagagcuccuagaaagagaguaucuagaaaag

SEQ ID NO: 4105504 - RNA, 57 nt, Human
cuuuucuucucugauuaaggcucacguccugugauuguugugguuggggaggguugg

SEQ ID NO: 4105505 - RNA, 85 nt, Human
cuuuucuuuggucacuauuguuuaugagaaauauuguuacagcuuuuucugguuagccaauaaugccaacaaguguucaggaaag

SEQ ID NO: 4105506 - RNA, 61 nt, Human
cuuuugacucuguccuuagcugcacucaucccccaguuugcagacaggauuggguuaauag

SEQ ID NO: 4105507 - RNA, 58 nt, Human
cuuuugcagcuucuaccacuguuucccuuggaaaccaaaguagcagcugccuacaaag

SEQ ID NO: 4105508 - RNA, 86 nt, Human
cuuuugcauaugaacugcucuuguguuuuggucaacugaucucacaccaggccugaagccaaaaccaagaacauucauuucaaaag

SEQ ID NO: 4105509 - RNA, 87 nt, Human
cuuuugcuucaauugcuucaacuguucaaugggcuaauaauaauaucugccucacagaacuguugcaaggauuaaaugagcuaagag

SEQ ID NO: 4105510 - RNA, 58 nt, Human
cuuuuggaaggguuucaguuagucuuuguagagguaacuggagcuacuucccaggaag

SEQ ID NO: 4105511 - RNA, 100 nt, Human
cuuuuggguccugauaacaugcaucagaauguuagagaagggaaaaaguuaaccacuggcucccucaaugacauuuugaaaaguucaguagauucaugag

SEQ ID NO: 4105512 - RNA, 78 nt, Human
cuuuuguauaacuuagccuuagggauugagguugcuggagucuagccuucaaguccacugagaagaguucugcaguag

SEQ ID NO: 4105513 - RNA, 70 nt, Human
cuuuuguaugcagcucuuuuacccuugaaucuguggauuauuuuuagauucuaaaggcugaauauagaag

SEQ ID NO: 4105514 - RNA, 129 nt, Human
cuuuuguccuguguagcuggaccccuccguggguuccagaggcccuguaagguguggagauggaggcuggccccgagccacagaugguggugggacccaggggugguaaaguuuaacagagacuaaaag

SEQ ID NO: 4105515 - RNA, 81 nt, Human
cuuuugucucgggcucguuuuucauugcuuacucagugugggcugaaugagcaauuaacagagucuaaaaugaggcuuagg

SEQ ID NO: 4105516 - RNA, 77 nt, Human
cuuuuguugcauugugauuacagagguguauuuucucuaugcuuagaaaaaacgcuaaucagcaaugcaaacauaag

SEQ ID NO: 4105517 - RNA, 61 nt, Human
cuuuuguuggaagcugaagugcggcagcucaccuugggagcauuacagcaguucaacuugg

SEQ ID NO: 4105518 - RNA, 84 nt, Human
cuuuuuauaggucucagauaugguuuuucaaguauucagaauguuuucuggcuuuucuugggacuuaugggagaggaugaaaag

SEQ ID NO: 4105519 - RNA, 64 nt, Human
cuuuuuggaaagacacacaguuuuaauucuuuaauugaaauuuggugaguuuuugccaugaaag

SEQ ID NO: 4105520 - RNA, 80 nt, Human
cuuuuugggaacccugugcagagaagugagcggcguuaccuuacagcugccacacagcuguaugagggaagcccaggagg

SEQ ID NO: 4105521 - RNA, 57 nt, Human
cuuuuuguguaugcuacaguugcacaauaguuguaugacuauagcauauucagaaag

SEQ ID NO: 4105522 - RNA, 74 nt, Human
cuuuuuucuugucaugcccuugguaacugcugggaauagcugcaguguaucaugguuggcagacacuaaguaag

SEQ ID NO: 4105523 - RNA, 61 nt, Human
cuuuuuuuauccuuuaguuuccugccuauaggaggugggcaggcaaugaggaugggaagag

SEQ ID NO: 4105524 - RNA, 77 nt, Human
gaaaaaaaaguuaaaguuaaucuuggaaguuaguuuuuucaagguuccaagugaaaguagcuuuguucuuucauuuc

SEQ ID NO: 4105525 - RNA, 130 nt, Human
gaaaaaaaaugcugcucuagcaguuugcagccaaacuggaagcacaggaucaguggaaucucuuagaaaaguauucuuuugaaauucuuguggucaauguaugcugaaacugagaaaggacagauacauc

SEQ ID NO: 4105526 - RNA, 61 nt, Human
gaaucucuccaguuccuguucauuuuacuuuagaauaagaggccaggaauggaugggauuu

SEQ ID NO: 4105527 - RNA, 63 nt, Human
gaaucugcuuuaaaacccucagcuggucagugaauuacugccaguuuaucuuuaguguagauc

SEQ ID NO: 4105528 - RNA, 75 nt, Human
gaaucugcuuucaaauucacuuaguacauuuacagaauccauuuccuugaggcugugugacugagagccuggcuc

SEQ ID NO: 4105529 - RNA, 59 nt, Human
gaaucuggucuaagugaggauagcugaaggcauucucaguuuacgcauggauaagauuu

SEQ ID NO: 4105530 - RNA, 72 nt, Human
gaaucugucuuuuaucagcuuaguuuauagggcacuagucaauaaccuaggaggguagagguaaaaagguuu

SEQ ID NO: 4105531 - RNA, 74 nt, Human
gaaucuuacacuguccaaucagggauuuuccuucucuuacccuggagaguggcugauguaggcaguggggauuu

SEQ ID NO: 4105532 - RNA, 59 nt, Human
gaaucuuagucuccuaacggcugcgauuuauuuauuuauaguuuuugagacugaguuuc

SEQ ID NO: 4105533 - RNA, 63 nt, Human
gaaucuuauccccaguccuuaauccuaaacagguuuaacaguuggauuuggggaaaaugguuc

SEQ ID NO: 4105534 - RNA, 86 nt, Human
gaaugaagacccagaccugagcccgguggggccucugggaacacuccuuucaaggccagcucacccuggcuccuuucuguucauuc

SEQ ID NO: 4105535 - RNA, 69 nt, Human
gaaugaaucuguaagugacaagguaccuggguucuaauccugucucugucagucacuuacagaacauuc

SEQ ID NO: 4105536 - RNA, 86 nt, Human
gaaugacaauugugugagacaauuggcuguggcauuuuuauaguaguaaaagcgaugaaaccaccuaaaugcuuauacauacauuu

SEQ ID NO: 4105537 - RNA, 61 nt, Human
gaaugacaugcuuuuuaauuauaguacccaaauuagguuuuaucuuuaagaggcugcauuu

SEQ ID NO: 4105538 - RNA, 90 nt, Human
gaaugaccuacuguggcuuaaaucaaauaguccuguaagggaaagaaucuugcacaugauagaugauuucucagucauauuggguuauuc

SEQ ID NO: 4105539 - RNA, 96 nt, Human
gaaugacgcuuaggaaaaugcuuagugaggaaugaauuuguucuucaaaaccagagcauacauuuaacauuuggaucauauuugugaguuucauuu

SEQ ID NO: 4105540 - RNA, 75 nt, Human
gaaugagggucugggcacuccuggggacagcugagugguaggacuccuggguccccagggggcagguccaucuuc

SEQ ID NO: 4105541 - RNA, 87 nt, Human
gaaugaguaauucaguauaugccagagagauagcuacaccuuauagauuuuguaguuccuuacauguacuguuaacaaugcuuauuu

SEQ ID NO: 4105542 - RNA, 81 nt, Human
gaaugaucuaguauuuuacccuauauuuaagcugaauuaccugucacaguuucauggauguugguagaaaacaugacauuc

SEQ ID NO: 4105543 - RNA, 62 nt, Human
gaaugcaaagaguugcuuaucaaagccuggcuugucauaagauuaacuuuuuguuucuauuc

SEQ ID NO: 4105544 - RNA, 59 nt, Human
gaaugcacagcguuccaugcuugaacucgaacugaucuucaagaaugagcuaugcauuc

SEQ ID NO: 4105545 - RNA, 77 nt, Human
gaaugcagcuucucagaggccucacuuccagccagggaaacuuaagaccugaaaggaauaaggcucuuuguguauuc

SEQ ID NO: 4105546 - RNA, 68 nt, Human
gaaugcuggaagggccugagccccagcgcaccacagcaccugacuccccugggccccauccagccuuc

SEQ ID NO: 4105547 - RNA, 71 nt, Human
gaaugcuugggcuugcuuccacccagggccugcccaccacuggcgacugucauuggcagccucaggcguuu

SEQ ID NO: 4105548 - RNA, 64 nt, Human
gaauggcaggacagauuuuguggauuaaugggcagauguugacgcacagagucuugcagcguuc

SEQ ID NO: 4105549 - RNA, 55 nt, Human
gaauggcugaaugucuuaaauucauagauuagauacccaaggaauucagcuauuc

SEQ ID NO: 4105550 - RNA, 87 nt, Human
gaauggcugcaaaagggcugauuagaguguuaaugaggaggccaaagagauuaccugcuguguggggcucuaacagcucagcuauuc

SEQ ID NO: 4105551 - RNA, 79 nt, Human
gaaugggcaugcuucuaguugaaagguuauuugacucuugaaguuauuuucucuuuucacugggccaugcaacuaucuc

SEQ ID NO: 4105552 - RNA, 129 nt, Human
gaaugggccauaaauacugaggaccauauuugcguguuuccaaagugagggguucugcguccuaucaaggagauguaaacuacugacuacacuaccgaugaugcuggcuuuuugcuccauugccuuuuc

SEQ ID NO: 4105553 - RNA, 83 nt, Human
gaaugguaagcauaauagcuaacacagagugcuuauuaugugugagaugguauucuaauagcuuuacauguguuaaaucauuu

SEQ ID NO: 4105554 - RNA, 75 nt, Human
gaaugguaagugcguauuuaauuuuguaaguaacugacaaacuauuuuccagagugacugugccacuuuacauuc

SEQ ID NO: 4105555 - RNA, 62 nt, Human
gaaugguauuuucuucagaguccuagcuuaggaugcugcaaagaccucugagaaugccaguc

SEQ ID NO: 4105556 - RNA, 123 nt, Human
gaauggucaaggcugaaugcacacugagguuuccaugugcucagcucagcagauucagguaugaccccuacagagcuuggacucugaacuggcacugacauucucuacgcucagcgaccauuu

SEQ ID NO: 4105557 - RNA, 66 nt, Human
gaauggugguuaagcacagaaucuggagccuggcugucugguucaaacacuggcuuagccaauuuc

SEQ ID NO: 4105558 - RNA, 59 nt, Human
gaaugguuaagccuauaucuugaagcgcuucuuucagauuuagacugccuuaaucauuc

SEQ ID NO: 4105559 - RNA, 83 nt, Human
gaaugguugagguaguuuuucaaguauuuggggcagaaaaacacacauuuaccucagauauuuggauaauugccuccacuuuc

SEQ ID NO: 4105560 - RNA, 70 nt, Human
gaauguaaagacagauaaaacagcaucagucuuuucuuuccuuugaugcaguugaccaugcuuuauauuu

SEQ ID NO: 4105561 - RNA, 77 nt, Human
gaauguaauccaucagaacgugagcuccuugugcuuccagugacaagcgggccacagugcugguggcauguugcuuc

SEQ ID NO: 4105562 - RNA, 56 nt, Human
gaauguacacugaaagccuaucaggagccaagcccugggcuaaguacuuuacauuc

SEQ ID NO: 4105563 - RNA, 83 nt, Human
gaauguauacuauuagauaaucucuaggcuucauguagucuaaaaaacacuauaguuggaguuggagguuauggauaacguuu

SEQ ID NO: 4105564 - RNA, 74 nt, Human
gaaugucacuguuguuauuguuauuauuccgcucuaauggaaugccaggauauauaucaauacagcaggacuuc

SEQ ID NO: 4105565 - RNA, 77 nt, Human
gaaugucuacauucugaauucguauccacaaaauuuuaagaaaauugaggaacaaaaugaaaagaauggagauauuc

SEQ ID NO: 4105566 - RNA, 60 nt, Human
gaaugucuauguaaccgagggguccccuccuccuuuuaaaacugugguuauuuagcauuu

SEQ ID NO: 4105567 - RNA, 65 nt, Human
gagagacauggagaggcaaaguuacacagcaaguuagugaaccaaaaccacacuccaugccucuu

SEQ ID NO: 4105568 - RNA, 56 nt, Human
gagagagagagagagagaauaaagugugauacacaggaaucuguuucuccuuucuu

SEQ ID NO: 4105569 - RNA, 55 nt, Human
gagagagaggccuggaagaucuuggaacaggaacauccagcccugcuucucucuu

SEQ ID NO: 4105570 - RNA, 106 nt, Human
gagagagauaauauagacucuuucaaugucaucugugaaugcauuaaucaaguucuuuaugugcuacagagcauugcaagguaauaagucuauugcaccuuucauc

SEQ ID NO: 4105571 - RNA, 69 nt, Human
gagagagcaggcuggcagggccagggacagucuucagaggccccuggcucaggcagcuuuguuucuguc

SEQ ID NO: 4105572 - RNA, 66 nt, Human
gagagaggccccgccaccacccgcccugugcuucgggguuggacacuagguaggagcggccuccuc

SEQ ID NO: 4105573 - RNA, 101 nt, Human
gagagaggcugguaggaggagagcugucguccagguggggucaucauucauauggaugcucccccuggcaggcuggccucucagcucccucacccucuguc

SEQ ID NO: 4105574 - RNA, 59 nt, Human
gagagaguaucugcugguucaccacacuucagauguugugucagcaacaauacuuucuc

SEQ ID NO: 4105575 - RNA, 85 nt, Human
gagagaguuuuaaagggaauagcucucaccacuacauucaacauaauuuuggauguuguguuugacuguuacccaaacucuccuc

SEQ ID NO: 4105576 - RNA, 74 nt, Human
gagagaucuguugcuucagaaguucugcuuguugaccagcagagggcagugaauuuugaagcucaguauuuuuc

SEQ ID NO: 4105577 - RNA, 77 nt, Human
gagagaugacuagaaauguauugguagcugagcugggaacaguuuucaacaugcuuuauuucuaaacauuccaucuu

SEQ ID NO: 4105578 - RNA, 68 nt, Human
gagagaugcuccacugugcguggccauaugucugcugcaaucuguggccuuauggauggagaacucuc

SEQ ID NO: 4105579 - RNA, 70 nt, Human
gagagauuaaaacugaagccuuggagugacagagggaauuuuuguccuaccugauuuucaguuuucuuuu

SEQ ID NO: 4105580 - RNA, 112 nt, Human
gagagauuuaucucagaagggcauugucucuaagugugaucuucauuuuuaugagcugagcuugaagucccugacauuuagaaaugauaguguguugaugugagguucuuuc

SEQ ID NO: 4105581 - RNA, 102 nt, Human
gagagcacacacagaauggaugggcauguguggaaguucagggaucuuuguuuuguucacuggcauuuccucagugcucagaauagugcauggugggcucuc

SEQ ID NO: 4105582 - RNA, 76 nt, Human
gagagcacauuuggggucaacagaauuuguacucagccuagagaagaagguagaggguuguugaaucaaugcuuuc

SEQ ID NO: 4105583 - RNA, 93 nt, Human
gagagccaacgaaggcgucgggcagguacuggggagugaagaugugauguagcucucacuccccacgcgccuacacaugacuguuggccucuc

SEQ ID NO: 4105584 - RNA, 86 nt, Human
gagagccauggccucagauuucaggggugggaggaaaaguuccaguucugcccuuugcccacucagaagcccugaggaaagcucuc

SEQ ID NO: 4105585 - RNA, 129 nt, Human
gagagcgagucaaagucauaauugcuagcauuuauuggauguuuaccacaugccgagcacuguucuaagugcuuuacacagaugaauauuucccaaacaguguaaaguagguacugugauuaugcucac

SEQ ID NO: 4105586 - RNA, 55 nt, Human
gagagcgugggcuuuagaguuuagcagacuuaggcuaggucuugacucuguucuu

SEQ ID NO: 4105587 - RNA, 89 nt, Human
gagagcugcaccagaccaccucucaggguuuccuaaugcaaauccuugaacccugcagaagugagcauccagagaggugggagcuacuc

SEQ ID NO: 4105588 - RNA, 58 nt, Human
gagagcugcauucucagacacacaagaacccaaacaguguuguuugguugccucucuc

SEQ ID NO: 4105589 - RNA, 58 nt, Human
gagagcuggcaguguuuacagguacugguaggguaaagagaacaauuuguuagcucuc

SEQ ID NO: 4105590 - RNA, 60 nt, Human
gagagcugggcuuugggugaagcuggggaacuggacgugacucauccagaggccacucuu

SEQ ID NO: 4105591 - RNA, 56 nt, Human
gagagcugugguuugaccaggcagcccccuaugccucuuccagacucaggcuucuc

SEQ ID NO: 4105592 - RNA, 78 nt, Human
gagagcuuagcagaaauguagaaugucgggcuccaucucggaccuacugaaucaaaaucugcauuuuagcaagaucuc

SEQ ID NO: 4105593 - RNA, 97 nt, Human
gagagcuuuaugguaaugcugaugucagccccaucuccagaaauucuaaguguggucgggaguggggucugggcaucagucguuuaaagaaacucuu

SEQ ID NO: 4105594 - RNA, 78 nt, Human
gagagcuuucuuggguuccaguucccagacucacaacuccuauucugucugcugcuacucagcccuggaaauguucuu

SEQ ID NO: 4105595 - RNA, 64 nt, Human
gagaggaaaaaagccuaggcuuuuuccuaaguuacuuaacuugggaaaccaaugggcuccuuuu

SEQ ID NO: 4105596 - RNA, 130 nt, Human
gagaggaaaucaguuaugggaauaugaugcugagguauaguauuuucuuaauuuacuuauuauuugaugcuuaagcucaguuauauauuucaacauucaacauuuaaaucuuaagcugguuuuuaucuac

SEQ ID NO: 4105597 - RNA, 93 nt, Human
gagaggaagggggagaaccaggaaugccaaccagugcaugguuuaaguuaacucuaaugccacuuagcuucaacguuuuccacccuuccuuuu

SEQ ID NO: 4105598 - RNA, 125 nt, Human
gagaggacaacaauuaugggagggagaucuuuuuacauccaguggucagggaaguugucuuugaucuugacagcucccaaaacacuggacauauuagucuuccucaaaaaguguuaguuccucuc

SEQ ID NO: 4105599 - RNA, 60 nt, Human
gaauuugggguuugugauuccuuagguuuacccccauaagggaacaaaacucuaaaauuc

SEQ ID NO: 4105600 - RNA, 79 nt, Human
gaauuuuaucucugggucccaggccugaugguaccuucaaccuuuagcugccuuuugccugggucuagagauaagagcc

SEQ ID NO: 4105601 - RNA, 110 nt, Human
gaauuuuccagauguuuaaguucugcuucccuuuugauuaaaaauuuacucuuuaaauucucucuucuuguauuuuacuaucaagagaagcgaagccacaucuuccauuc

SEQ ID NO: 4105602 - RNA, 67 nt, Human
gaauuuugggcuuaccgcuuauggauuuuggucccucagucuccguugacuuggaagcccugaauuc

SEQ ID NO: 4105603 - RNA, 106 nt, Human
gaauuuuguuuuuaauguaggcuuuuaaaugggcuuugauggaacuugguuccauagaaggaaucccagauaaggcuuuuuaaaagccgagcccagccauggauuc

SEQ ID NO: 4105604 - RNA, 75 nt, Human
gacaaaaaccagugucaggaucaguauauuucaguauauuaaaucugacuauacugugugcuguacaaaaauguc

SEQ ID NO: 4105605 - RNA, 77 nt, Human
gacaaaagauuaaaggggacugagcucuggaugcauccacuuaugcuuugccagacaguucccuuccuuguuuuguu

SEQ ID NO: 4105606 - RNA, 80 nt, Human
gacaaaauauauuuagcacuggauuaaucaaaguggggacuaucucaaggauuaaauauccaaguuuauuuauauuuguc

SEQ ID NO: 4105607 - RNA, 64 nt, Human
gacaaacccugcccuucccaagauggcggcggcggcagggcaaagggcgggguuagacgcuguc

SEQ ID NO: 4105608 - RNA, 82 nt, Human
gacaaagaaaaggauacuuugaagaaagggcccucgucuacuggggccucuggucaagcaaagagguuuguuuuucuauguc

SEQ ID NO: 4105609 - RNA, 74 nt, Human
gacaaagaaaugacugaagcaauugcagugucacagguaaccugcuguuagauuucagucacaugccuaauguc

SEQ ID NO: 4105610 - RNA, 116 nt, Human
gacaaagcccaguguucaggcuaaagcuuugagcauguuuccuuucucuuguagggcacacacaugguauuguucagaacagguuguaguaugauugaagcacuggguucuuuguc

SEQ ID NO: 4105611 - RNA, 74 nt, Human
gacaaaguaacugguccucggauguuguggaguugguaaauagcucuaauacaaggcaggaagcaguaacuguu

SEQ ID NO: 4105612 - RNA, 70 nt, Human
gacaaaugaauagggagugugaugucucuggccaagagccgugauuuguuccaugcuuuguugguuuguc

SEQ ID NO: 4105613 - RNA, 121 nt, Human
gacaaauggucuacuguguaaauuuuagaaagaggcagacaaaaguuggaaggccgguuaauuuuccccucuuucuccugcuucagcuuugucuccuuggguauccaguguccacaauguc

SEQ ID NO: 4105614 - RNA, 59 nt, Human
gacaacaggguaaggcaggccaugugaagagagacgcaguggauggcagauccuguguc

SEQ ID NO: 4105615 - RNA, 62 nt, Human
gacaacaguagucucaggaauaggcagaaacacuucugcuagcaaggugggacuacuguguc

SEQ ID NO: 4105616 - RNA, 102 nt, Human
gacaacucuaucauucaacuguaaacuuguucacugacuuccaccaaaccugucaguggaguuuaaggacagaugaggaugccacaguaaaccugaguuuuc

SEQ ID NO: 4105617 - RNA, 58 nt, Human
gacaacugccccauuuuaaaugagguaaccaaggcccagagagguugggugaguuguc

SEQ ID NO: 4105618 - RNA, 83 nt, Human
gacaagaaaaaugaguguauacuugcauauauauauaaauuuuuaugucacauugccgucugugcacuuguuugcuuuuuguc

SEQ ID NO: 4105619 - RNA, 67 nt, Human
gacaagacaauccuggacagucagcauuggauuuucaucuccagcugauugauuuaguauuucaugc

SEQ ID NO: 4105620 - RNA, 84 nt, Human
gacaagaugguuagugaauuccuaauaggaagaccuggugauacuaucucuuuccagauguugggggucagguagcuauagguc

SEQ ID NO: 4105621 - RNA, 93 nt, Human
gacaagccuuggggugagcaacgaggcccugagaaaaucccugcagccucuggcugcagcaccacguggcuuccuucguucccaaggcuuguc

SEQ ID NO: 4105622 - RNA, 113 nt, Human
gacaagcucucuuugauuuuccuugcacaggguggaagauggucacgcaagauccauauucauaugaccaucagucacauguagagaaggucucagcuagccuagcuuaaguc

SEQ ID NO: 4105623 - RNA, 68 nt, Human
gacaaggaaggaucucagaauuucucauuccuucucagggugacaauuguugugaauucuuccuuguc

SEQ ID NO: 4105624 - RNA, 71 nt, Human
gacaaggccaaugggcugacaagacaugcauauuucacuggcauaugccuugcaccuuuggcuuucuuguc

SEQ ID NO: 4105625 - RNA, 58 nt, Human
gacaagggugguauuuaacaacuggagucugguuuggcuccggguacccaccguuguc

SEQ ID NO: 4105626 - RNA, 78 nt, Human
gacaagguaugaaggcuuuaugugaccaaaagaagguucagggaguucuguuguacacaugggguuuucaccuuaguu

SEQ ID NO: 4105627 - RNA, 64 nt, Human
gacaaggucuggaugaugggugugcucauugcuauugaggcgucaccgcuccccagaccuccuc

SEQ ID NO: 4105628 - RNA, 78 nt, Human
gacaagugaaucaugucucagaguguucuagucuccaacauaauuaauagccaggagauuuuguacauagaauuuguc

SEQ ID NO: 4105629 - RNA, 68 nt, Human
gagaucaaagcagccauuagucuagagcugauuuuuuccaacuauaggcaaugcccugcugagaacuc

SEQ ID NO: 4105630 - RNA, 70 nt, Human
gagaucaauagcaugugugucuagugguuaucauaaaggacagcacagcucuugacaacagcaacuucuc

SEQ ID NO: 4105631 - RNA, 69 nt, Human
gagaucagggucccagccuggacugggucuugugagcauucucuuacagguugcaggcugugacuucuc

SEQ ID NO: 4105632 - RNA, 88 nt, Human
gagauccugcagaguggcccugugugcaggcugcacuggugccccuaaaagcaucuguggauccuggccagggcccuccuuggcccuc

SEQ ID NO: 4105633 - RNA, 75 nt, Human
gagaucuucaagguuuuagauaacuaaaccuuauacucagaggugugauguuaucuaaaaugguuugaugaucuu

SEQ ID NO: 4105634 - RNA, 125 nt, Human
gagaugaagggaggcugagagccgcugaggccagccucaucccuugauaguuuugcagaaguugagcugucuuuggagagggagaggaggacugagagcagcaggcuggaguccaucaaaaucuu

SEQ ID NO: 4105635 - RNA, 65 nt, Human
gagaugacagucacagcagaaacucggguuuucagcucagcauucuacuuugugaacuguaacuc

SEQ ID NO: 4105636 - RNA, 79 nt, Human
gagaugauccagaaacucaaagauuauuaagucacgucaccuguaaaugaauggcuuugaguauuuucuggaguuuuuu

SEQ ID NO: 4105637 - RNA, 62 nt, Human
gagaugauuggggucguuuuaggaaguauagcucucaaaggacccauaauuaaaaccuucuc

SEQ ID NO: 4105638 - RNA, 89 nt, Human
gagaugcaagauacuuuggcucaccuggagccuguugagucagccaaguguuuuaacaagguuucuggugaagacaagcuaucagucuc

SEQ ID NO: 4105639 - RNA, 66 nt, Human
gagaugccuuccuuucugcuuuuagguaaugaacauuuauuacuguggcaaagaagcaggcuccuc

SEQ ID NO: 4105640 - RNA, 87 nt, Human
gagauggaagggaguccucagauaccuggcagaucaacugugcuaguuauagcugucauguacugagcauacucucccauccuccuc

SEQ ID NO: 4105641 - RNA, 97 nt, Human
gagauggagacucgcucugugcccaggcuggagugcaguggcauaaucucgccucacugcaaccuccaccucaggguucaagugauucuccugccuc

SEQ ID NO: 4105642 - RNA, 99 nt, Human
gagauggagucccacucuguagcccaggcuggagggcaguggugcaaucucggcucaccgcaaacucugccuccuggguucaagcgauucuccugucuc

SEQ ID NO: 4105643 - RNA, 99 nt, Human
gagauggagucucauucugucacccaggcuggagugcaguggcgccaucucggcucacugcaaccuccaccuucaggguuaaagcgauuuuccugccuc

SEQ ID NO: 4105644 - RNA, 98 nt, Human
gagauggagucuugcugugucaccaggcuggagugcaguggcgcgaucuugacucaaugcaaccuccaccucccggguucaagcaauucuccugccuc

SEQ ID NO: 4105645 - RNA, 77 nt, Human
gagauggauuaaagauuaaaaugacaaaacugcuaguaaaacaagauauugucaucuuggucuggaauaagccuuuc

SEQ ID NO: 4105646 - RNA, 68 nt, Human
gagaugggaggaucccuugggccaaggaguuggaggccagccugggcaucacagggagacaccaucuc

SEQ ID NO: 4105647 - RNA, 80 nt, Human
gagauggggggcaagggcuggccgaggaguccugaggcagucacccccuccugcuuccuugucuuuagaccccaauucuc

SEQ ID NO: 4105648 - RNA, 67 nt, Human
gagauggggucuugcuauguuguccaggcuuaucucaaacacuggcuucaggcaauccucccaucuc

SEQ ID NO: 4105649 - RNA, 77 nt, Human
gagaugguggugaagagcacagugaggaacagccggcauuuaggaaguaccaucgcguagcuguugacccccauccc

SEQ ID NO: 4105650 - RNA, 59 nt, Human
gagaugucuucagauggcaagagaaagggcuaaaucuaaugcuugacugggggcuucuu

SEQ ID NO: 4105651 - RNA, 66 nt, Human
gagaugugacaggugugaugauuuaggcuuucccugcaggcaagggagacaucaugaccuuauuuc

SEQ ID NO: 4105652 - RNA, 81 nt, Human
gagauguuguagccauuuuuauuaaugcuggagaagagaugguguauucuuuagaauuauggaaagugagcaaaacguuuu

SEQ ID NO: 4105653 - RNA, 58 nt, Human
gagauuagaguuguuucauugugucugcagccucacuacuggucacuucucugaucuc

SEQ ID NO: 4105654 - RNA, 58 nt, Human
gagauuauauguaugugugcauauacuuauguguguauuuacacauucauaagauuuc

SEQ ID NO: 4105655 - RNA, 70 nt, Human
gagauucagaaaagggaacugucauacugaguuggaagaauuacagaaugcaguuccuuauuaggaacuc

SEQ ID NO: 4105656 - RNA, 102 nt, Human
gagauucagggaugugguagagucaauaaaagcuuuagauucagaccugggucugaaucccaaucuguuauugacaugcaaccuuaggcaaaucagauucuc

SEQ ID NO: 4105657 - RNA, 96 nt, Human
gagauucaugagggaaauagcccaggcuuugagauuggaaagguaacagggggcugccuuugcaacagaaagaccugacugauucuagaauggcuu

SEQ ID NO: 4105658 - RNA, 64 nt, Human
gagauucugggccucucugcagacuaagcaaucagaaacuuugcagguagggcccagcagucuu

SEQ ID NO: 4105659 - RNA, 69 nt, Human
gagauugcucugucaaagccuguggauaguuuggagauaauuugcuucaaacagguuucagagcaucuu

SEQ ID NO: 4105660 - RNA, 82 nt, Human
gagauuggagacuuggaugcuagcucucaaagcuuccaccuggaagucacacuuuaacaguuccauucaauuuucauugcuc

SEQ ID NO: 4105661 - RNA, 76 nt, Human
gagauugguaaagaaccagguuacaaauucuaaaccccacaccccugugaugauggaacagccuuugccaaaucuc

SEQ ID NO: 4105662 - RNA, 89 nt, Human
gagauugugggagucagguaucccuugcuguccagccacaggagguggacagaucuggacagaaagggcugcuguguccccagauucuc

SEQ ID NO: 4105663 - RNA, 104 nt, Human
gagauuguugaacagcugcuuucucuuacuauggagucgacauuaacauuaagcaaaaagguuggagcauaggaaugugagugaaagcauaauucuucaguuuc

SEQ ID NO: 4105664 - RNA, 77 nt, Human
gagauuuaucacuaaagugcaccccuuugagauauauuaaccagauguccagaaugccacuuugguccuuucaucuu

SEQ ID NO: 4105665 - RNA, 63 nt, Human
gagauuuguucugaaaacucaagucccgugaaacgguacucugaaaccccagaaucauauuuc

SEQ ID NO: 4105666 - RNA, 129 nt, Human
gagauuuuuuauauuaauguguguauuuuguaauguaugugguauguguauauauauguuuauuuuagacacauuugacuacauuuauauauucauagagauuuacauagaggcauuaaaaaaacaggc

SEQ ID NO: 4105667 - RNA, 106 nt, Human
gagcaaaagucucugugguggucuucuguaagagcuuagcuaaggaugugcugcauaguaugccuaaagacaggacucucugaagcuuaccacagagugauugcuu

SEQ ID NO: 4105668 - RNA, 90 nt, Human
gagcaaacaaaacaagggcugagcacagugagccaacagccuuuugcugacugugguuucacauggcucagccaagucuuaguccugcuc

SEQ ID NO: 4105669 - RNA, 71 nt, Human
gagcaaacaaaacugaugugacugugcugugaaaguucuuaaguaccgugugcaucuguuguaguuuguuc

SEQ ID NO: 4105670 - RNA, 82 nt, Human
gaggauaagguuauucuuguuaguggacacugccucuuauguagaaauuuccuaaccacagggugaaugugacauuaucuuc

SEQ ID NO: 4105671 - RNA, 61 nt, Human
gaggauacauugaggcaguagcuggaggucuagagauuucaucccaccucagugugcccuu

SEQ ID NO: 4105672 - RNA, 126 nt, Human
gaggaucaucacuaccacuggacaccagagcugaauccauggaaggugcugcuuaacuccagggaggcccuaucugccuugccugcagcgucuccagcaggaagcucucaguguaugauccaccuc

SEQ ID NO: 4105673 - RNA, 71 nt, Human
gaggaucugugcugcuugaaucuugggauaaaaauuaaaaggcaguguuccccugaaagcaucacaugcuc

SEQ ID NO: 4105674 - RNA, 67 nt, Human
gaggaucugugucugugcugcuuugguuucuaauccucucaguugcaagcacagcgcgguguuccuu

SEQ ID NO: 4105675 - RNA, 67 nt, Human
gaggaucuugcuguagaggauagaggaugaagucaaggacagcucuauccuuucaucagugaucuuu

SEQ ID NO: 4105676 - RNA, 58 nt, Human
gaggaugcuccauaaacacucugggaugacugcagaaugaguguucugaguacuccuc

SEQ ID NO: 4105677 - RNA, 69 nt, Human
gaggauggacagcucuuaugugggcauguuacaaaggccguacugacguaguagaguugcuucuuucuc

SEQ ID NO: 4105678 - RNA, 62 nt, Human
gaggaugggcuagaaaauaggagccaaagaggauggaauauuacacaucuagacccauuuuu

SEQ ID NO: 4105679 - RNA, 74 nt, Human
gaggaugguuugacauguauuagucaugcacagaauauuaucauaauuaaugcauuaauaauacagcuguccuu

SEQ ID NO: 4105680 - RNA, 62 nt, Human
gaggaugugauaguucucccaggcaagccuccagucaucugcuagggaugccaguacuucuc

SEQ ID NO: 4105681 - RNA, 112 nt, Human
gaggauuaauuuuuacuuuuucuuugagaucuauuguacaguguggugaauauaguaaauaacaguguauuguacauuucaaaguagcugagaguaaauuuugaauauucuc

SEQ ID NO: 4105682 - RNA, 94 nt, Human
gaggauucuuuauugggagagacuucugccuuagcaagaagcagccuagaaguuucuugccuggggcagaugguugauucugugugcaaucuuc

SEQ ID NO: 4105683 - RNA, 87 nt, Human
gaggcaacagcaaggccauuggaugcagucuuuauuuguccagguggccauaauuucaacacugcaaaucagccuugcugcuguuuc

SEQ ID NO: 4105684 - RNA, 76 nt, Human
gaggcaacauguaaaaagaagaaucuggagcuagcccugguucagauccucacuuucuuauuagaaauguagccuu

SEQ ID NO: 4105685 - RNA, 99 nt, Human
gaggcaagaggauugcuugagcccaggaggucgaagcugcagugagccaugaucucgccacugcacuccagccugggugacagagcaagacccugucuc

SEQ ID NO: 4105686 - RNA, 55 nt, Human
gaggcacauauauacagagcccagcauuugaacugggguucagagauguugccuu

SEQ ID NO: 4105687 - RNA, 102 nt, Human
gaggcacccaagccuugaaccuucucuuccagccgggcuugcaccugggagccaacugcugcaauccuggacugugaggacagaggaagaggcuggggccuc

SEQ ID NO: 4105688 - RNA, 56 nt, Human
gaggcaccugcuccuacuucugcuuagcgugugagcaguguggugaccagggucuc

SEQ ID NO: 4105689 - RNA, 99 nt, Human
gaggcacgagaaucgcuugaaccugagagguggagguugcagugagcugagaucgugccacugcacucuagccuuggugacacagcgagacucugucuc

SEQ ID NO: 4105690 - RNA, 58 nt, Human
gacaaguggagcuugggaugaguugcagucccuacuuguuuccuuagcugagcuuguc

SEQ ID NO: 4105691 - RNA, 87 nt, Human
gacaaguucugcugcugcuggaagaauuccaugcuggcauuaucagaaaugcagagucauugacuuccaggaguaauagauuuuugc

SEQ ID NO: 4105692 - RNA, 85 nt, Human
gacaauuugcuuuuuuugaguugccucuaagucccuggugauguuauuguauaaauaccaacaaggcaauaagagcucaauuguc

SEQ ID NO: 4105693 - RNA, 75 nt, Human
gacacaacuggagcucuguugcuguggcacaggaaggcucgauaagaucucccagccacagcauucuuuuguguc

SEQ ID NO: 4105694 - RNA, 74 nt, Human
gacacacgcuuuccaggccugccugguguuugcccagggagacugcaagcucucugcaggcagagcccacuguc

SEQ ID NO: 4105695 - RNA, 64 nt, Human
gacacagaaguacauaaaggaauuagccaugaauagaauggagaugaauauguguaccuguguu

SEQ ID NO: 4105696 - RNA, 57 nt, Human
gacacagaauuccccuccaaguggggcuugguauaauuuggaaggaguucugguguu

SEQ ID NO: 4105697 - RNA, 60 nt, Human
gacacagagggcaccagauaugggaaaguuucucucugagaccauguuugcuucuguuuc

SEQ ID NO: 4105698 - RNA, 77 nt, Human
gacacaggccucauuugggggucuccucaggcacuucccccuuggcuccugaggccagaacccgacccugcuguguc

SEQ ID NO: 4105699 - RNA, 91 nt, Human
gacacagugacagauauaaagucaagguuuagacuagagaaacucaagauuccuucuaguuagaaacuaugauagucugugaugauuuguc

SEQ ID NO: 4105700 - RNA, 65 nt, Human
gacacagugggucauagguacaauuuugcuccuuucacuccgggagucuuaggcacagcuguguc

SEQ ID NO: 4105701 - RNA, 55 nt, Human
gacacaguucccuaugagguaaaggaugagaagugcugaguaggcaaccuguguc

SEQ ID NO: 4105702 - RNA, 94 nt, Human
gacacaucauuaacacccugagcccauaguugacauuagguucacucuugguguuuuacauucuauggguuugaaaaauguauaaugacauguu

SEQ ID NO: 4105703 - RNA, 67 nt, Human
gacacaugugggcagauacacagacacggauacacacguucauaugucugugugcccacacacaguu

SEQ ID NO: 4105704 - RNA, 68 nt, Human
gacaccaguaaauauucaaaaggagcuaaucaguaaauauuagcuccuuuugaauauuuacugguguc

SEQ ID NO: 4105705 - RNA, 74 nt, Human
gacaccugcacuagaagucaguugaaaccagacucaucaucuuuccucuguauuuauucuucugguguuuuguu

SEQ ID NO: 4105706 - RNA, 86 nt, Human
gacaccuugccccuuaccugacauucugaguuuccuucagaaagcuucaaggaaacucaaagugucagguaaggggcaaacuuguc

SEQ ID NO: 4105707 - RNA, 57 nt, Human
gacaccuuugacccuuaccuggacaucgcccuggauauccaggcagcucagaguguc

SEQ ID NO: 4105708 - RNA, 56 nt, Human
gacacuccaugcaggcaugccguuugcucuuguaccacugggccugcaugguuguu

SEQ ID NO: 4105709 - RNA, 56 nt, Human
gacacucuuaauccuaucccugaaaccaauaugguaaggauaagguuggagugauc

SEQ ID NO: 4105710 - RNA, 77 nt, Human
gacacugaagcucagagaaauuauaggaauugcucaaggucacaugaaauuccaaucuuucucugagcuccaggguc

SEQ ID NO: 4105711 - RNA, 103 nt, Human
gacacugauguggucuguguguucguauuuaugucgcagaagggaacugcuuuucuggaauuucuugucacauaagucacaugcauacauaccacucucuguc

SEQ ID NO: 4105712 - RNA, 58 nt, Human
gacacugcucacuucuucccuuggauuuuccaagauuaacuuggagugggacagaguu

SEQ ID NO: 4105713 - RNA, 83 nt, Human
gacacugucucucaguaacugcacugauggugagugagacugugucccucaguaacugcacugacagugagugagacaguguc

SEQ ID NO: 4105714 - RNA, 61 nt, Human
gacacugugugacuucugagacuaggcuagaaaaggccaagcucaagcuacacacagaguc

SEQ ID NO: 4105715 - RNA, 77 nt, Human
gacacuguuuagacagcggcucugaaccaugcuauuugcaggcugaugguuagcuguuuguuucuuuguuuaguguc

SEQ ID NO: 4105716 - RNA, 76 nt, Human
gacacuuacauuacgaaugcugaggcaagaaagcagaguaucaccuuguucaaucucagcuaguaacguacauguc

SEQ ID NO: 4105717 - RNA, 69 nt, Human
gacagaaaagcauuucaugucuagaaagcacucuaaaaugcuucuuagacauaaacuguugccacuguc

SEQ ID NO: 4105718 - RNA, 104 nt, Human
gacagaacugaaugccauuucuucuuggguacuuucccgcugcuuuuaacauuugggugaccccagaagaggauccaaauuggcguuuuucaggucuaaagguc

SEQ ID NO: 4105719 - RNA, 73 nt, Human
gacagaaggaacccggucccagaccaaaagacgccuggcucugugguggcugcugcuuggucuucuuccaguc

SEQ ID NO: 4105720 - RNA, 72 nt, Human
gacagaaggggaucuaggauauuucaugaauaauaauaaauucauagacaugucugguucuaaaccaugguc

SEQ ID NO: 4105721 - RNA, 67 nt, Human
gacagaaguugaggcuggcucaaaggaaaaggggaaagcauuggccgaagccaguccaaguucuguc

SEQ ID NO: 4105722 - RNA, 80 nt, Human
gacagaaucaauagauuagguauuagauucuauugcuacuauaauuagaauguuaaugcagaaauuuaaaaaauucuguu

SEQ ID NO: 4105723 - RNA, 74 nt, Human
gacagaaugcaagacuggaggaccccugccuggaagaccccaucuucccacugcaccucccagcuucuucuauc

SEQ ID NO: 4105724 - RNA, 56 nt, Human
gacagacaggaggcauucagggaagacagagucccauugaguggccagaugcuguc

SEQ ID NO: 4105725 - RNA, 57 nt, Human
gacagacaugggacuucauacugacaccauuaaucaugauggggcccuguggcuguc

SEQ ID NO: 4105726 - RNA, 81 nt, Human
gacagagaauuuuguuugauuugaaauucuuggguaaaaaaaauucuuccuuuaauccucugcagacgcuguucuauuguc

SEQ ID NO: 4105727 - RNA, 119 nt, Human
gacagagcaagacuccaucuugugggggaaaagaagguguggaaagaugcucuacuccucagagcaucuuguucccaacuucuccucccagguuuuuugguuagucuuuuguuugcuuc

SEQ ID NO: 4105728 - RNA, 69 nt, Human
gacagagcuuuuuaaaggauuuuuaaaggauuguaagaucuaaccauccuuccuuugagaggcuccauc

SEQ ID NO: 4105729 - RNA, 68 nt, Human
gacagaggagaucuggugguugaaguaaucuuaauugccuaacuucagaaauacuaucagcuuuuguu

SEQ ID NO: 4105730 - RNA, 67 nt, Human
gacagaggcaggccuggcagguggcccugagcccccagggccugcuuuccgagccugcaggaagguc

SEQ ID NO: 4105731 - RNA, 84 nt, Human
gacagaggcuuaauuaaaaacuaaugaagugaagacgcugggcuuacccaguaugcaaauuauuucauuguauguuacccuguu

SEQ ID NO: 4105732 - RNA, 60 nt, Human
gacagagguguccuugaguccacagggccucugguccagcagccacgggacgccucuguc

SEQ ID NO: 4105733 - RNA, 81 nt, Human
gacagagguuagagagcuacugccuugcuguugccuccagccacaugcacucucacugugcucuucuacgugaccucucuc

SEQ ID NO: 4105734 - RNA, 59 nt, Human
gacagaucuugacuuugcagcagaacgaagguugugcucacucuaaauuaagauguguu

SEQ ID NO: 4105735 - RNA, 60 nt, Human
gacagaugaguuagaauaggcaggcagggucuugcagacugcuuugauagcuuauuuuuc

SEQ ID NO: 4105736 - RNA, 126 nt, Human
gacagcaaguugauuaccuuuuugugucucccuuuucaaacacaucgcugaagccaagaguaauugugcauucagcauugguaugaaaacccaugaucacguuaaaguaauuguagcuuuucauuc

SEQ ID NO: 4105737 - RNA, 85 nt, Human
gacagcaaucaauguugccaugguaauagccaauccgagccacccccugcugucugcugcccaggcaacauugacuucauguguc

SEQ ID NO: 4105738 - RNA, 60 nt, Human
gacagcaaugaguaacuccuugggccacucaacacccagacugacguuaucauugcaguc

SEQ ID NO: 4105739 - RNA, 56 nt, Human
gacagcagacaaaccauguuuuacuuugauucaguucagcgguggugccugcuguc

SEQ ID NO: 4105740 - RNA, 60 nt, Human
gacagcagcauaauacaugaacucauacauuuucauauguucaguaugcgucaugcuguu

SEQ ID NO: 4105741 - RNA, 58 nt, Human
gacagcaguccuuggcuucauccgagucucuggccuggggcucucagggucaugcuuc

SEQ ID NO: 4105742 - RNA, 55 nt, Human
gacagccaggcauagggaguaugauuuacugccugcauuuuguggcuggcuuguu

SEQ ID NO: 4105743 - RNA, 78 nt, Human
gacagcccugacaggaggggcaugaaagacgguggcucccucucugucccuccugucccuuccucucuggugucuguc

SEQ ID NO: 4105744 - RNA, 108 nt, Human
gacagccgcaggugggcgaugcgcagccucugcagcuaggggucuugagcugggagaggcuucuggaggagcugggcugauccaagcccaccucuaugugguuuuguc

SEQ ID NO: 4105745 - RNA, 62 nt, Human
gacugccacaggcauuucuguucaaccuugaagccuucgcuacaggagaccgccuggcaguc

SEQ ID NO: 4105746 - RNA, 93 nt, Human
gacuggaaauuuuacagaaucaaugagggagggagaacuuuauuuaggauauaaauuuuacuucccucaguguagcugauacucacucuaguu

SEQ ID NO: 4105747 - RNA, 80 nt, Human
gacuggauuuauagauaucauaauaauuaucuagauguacauagauguauagaacugugaucucuauaggauucaauguu

SEQ ID NO: 4105748 - RNA, 71 nt, Human
gacuggcaugcacccuucuugcuucaaguauuaauauucucuuuggguuugcaggguuugugcugugaguu

SEQ ID NO: 4105749 - RNA, 129 nt, Human
gacugggaacuauuuacaaaaacauuaagcugcauuggugaaaaggacuucugaggucaagucgcauuagggaaauaagagcuuauucagcguugacucaggggccuuaccuuucaggugugcaugugc

SEQ ID NO: 4105750 - RNA, 78 nt, Human
gacugggaccacagauuccuaaguggcaggaugaaauuccaaccgaguucugcuugacuccaaagucuguguucuuuc

SEQ ID NO: 4105751 - RNA, 58 nt, Human
gacuggggcagugacuuguagagcuucugguccuuugcaaauaccaugcuguccuguc

SEQ ID NO: 4105752 - RNA, 63 nt, Human
gacugguaguuccuauuggaaugaaaggaucauaaauccauucaugccaaacugaacacaguu

SEQ ID NO: 4105753 - RNA, 117 nt, Human
gacugguauauaaaauaaaguuguccauuucagacacccuuugucuucaaggaaagcugucuagguggcccauggguggcaaaggcgcugaaaggaaauggaaauugauaaucgguc

SEQ ID NO: 4105754 - RNA, 67 nt, Human
gacuguacucuucuagccaucugaaauacguuuucuagguagagauagauuguguaaggguacaguu

SEQ ID NO: 4105755 - RNA, 60 nt, Human
gacuguauauacagcucaaggaaguaagccauauuaucuuuugguagcuuaugugcaguu

SEQ ID NO: 4105756 - RNA, 78 nt, Human
gacuguuagguggaagcaacccuggcaggaggugccuuggaaucucacagccccuggaagggggcuuccccaaauguc

SEQ ID NO: 4105757 - RNA, 65 nt, Human
gacuguugaaucucaggggaguuacuggaguguccuaacuuccaguucuucugagaaucauuauc

SEQ ID NO: 4105758 - RNA, 62 nt, Human
gacuguuggguacuguuuucuccuggcuagggagccaccauugaaauacuuacccaacuguu

SEQ ID NO: 4105759 - RNA, 66 nt, Human
gacuuaaaagaccucagaguaggucucagcugugucauccacuagcuuggugccugucuggaaguc

SEQ ID NO: 4105760 - RNA, 60 nt, Human
gacuuaacagacauuauuuaccuccuuguucuaaaagagagguggggaugguuugugguc

SEQ ID NO: 4105761 - RNA, 58 nt, Human
gacuuaaguggugugauaagugccauuauuaugggaaaauucacacuauuucagaguc

SEQ ID NO: 4105762 - RNA, 114 nt, Human
gacuuaauguaacuucuucaguaaagcacaguaugagcauugggaaaaaucggagcuacucaauccaucacucaguucaaacuguauguuucacugaugagaaagcuauguguc

SEQ ID NO: 4105763 - RNA, 85 nt, Human
gacuuacuugucucacuuaauccucauguaaauaugcugaaguagacacugcuccucacaugccacagaugaggcaaauaugguc

SEQ ID NO: 4105764 - RNA, 74 nt, Human
gacuuagagaucggcaugggaggccacugccuggaaagccagaucucagggcugugcccaucuuccccugaguc

SEQ ID NO: 4105765 - RNA, 77 nt, Human
gacuuagcugaucguggcaguguuuuuuccagucuguuuaauuuuugacucugaaacaucaccauuuuaccuaauuc

SEQ ID NO: 4105766 - RNA, 80 nt, Human
gacuuagcuuggcagcucugcuccacaugaguuuauucuaagacucaggcuacaggggcagaagcuauucaagagaaguu

SEQ ID NO: 4105767 - RNA, 58 nt, Human
gacuuaggccaguugguggcccuggacacauuugcuccuuaaggcugaggccuggguc

SEQ ID NO: 4105768 - RNA, 117 nt, Human
gacuuaucaaagugcuuccuugugcacacauucuauggggcugacuuaaugaauguacaaaacccauucgcaauuagcaacacccauuugugugccaacaacucacaugcaaaaguc

SEQ ID NO: 4105769 - RNA, 78 nt, Human
gacuuauccaauaauucuucaaguguuuugcauugaagucauuugucuagaauacuugggaauggguuaauuuaaguc

SEQ ID NO: 4105770 - RNA, 65 nt, Human
gacuuauccagggaggguccuguggcuucauguuuauggaguugcuaggucucugccucaugguc

SEQ ID NO: 4105771 - RNA, 118 nt, Human
gacuuauuuucugauauugucugcauauguauguuuuuaagagucuggaaauagucuuaugacuuuccuaucaugcuuauuaauaaauaauacagcccagagaagaugaaaauggguu

SEQ ID NO: 4105772 - RNA, 91 nt, Human
gacuucacaucaacaguaugaagcugaaugauuuuaucuuuguaguauucaguaaaaccauuccugcuuucauggaguugaaguuaauguc

SEQ ID NO: 4105773 - RNA, 58 nt, Human
gacuuccaaguuagaacuugaacacuaggauuuaaaugaucaggacugacuugaaguc

SEQ ID NO: 4105774 - RNA, 108 nt, Human
gacuuccccuugccguuuccugcaaccuggccuguggcuuaaggucugugaggacacagacuugguguuuggcaggcaugcagaagauguaaagggcucacagagguc

SEQ ID NO: 4105775 - RNA, 60 nt, Human
gacuucuucagaucaggaugcagcaacauuuucaaacaggagaacauccugauaaagguc

SEQ ID NO: 4105776 - RNA, 63 nt, Human
gacuugaccuucuauuagcugagagauauuugucuauaucgugcuaacguuuaagguuauguc

SEQ ID NO: 4105777 - RNA, 130 nt, Human
gacuugcacucauugacuguuuucugaaaggaaauucuuuuaagauacuguuauggauaaagugaaugaguugucaaagcaugguuuugaaagacguuguuugagucuguuuugugaguaagacacuguc

SEQ ID NO: 4105778 - RNA, 68 nt, Human
gacuugcccuggcauugagggucacaaggcuacucauggacucaggccccaccuugcuauuccaaguc

SEQ ID NO: 4105779 - RNA, 82 nt, Human
gacuugcuuuggcuuuccuccccaaaucacacaacuaguuucccuuuguaacauuuggugagguagccauuguuagaaaguc

SEQ ID NO: 4105780 - RNA, 57 nt, Human
gacuugggucacaugaccuaccucaccauagggagagguauucucacugaccugguc

SEQ ID NO: 4105781 - RNA, 64 nt, Human
gacuuggguccggugcccauauagacauggcaggcaucaucuguccaggucuggacccugagcc

SEQ ID NO: 4105782 - RNA, 79 nt, Human
gacaaaauuggaagcaugaaggucacuugcaaaccaaauguuugcaagaaugacccaucuacccaaugaggauucuguc

SEQ ID NO: 4105783 - RNA, 97 nt, Human
gacaaaccugaagucaauuaugacaagaugacaucauggcuucugucucagguaacagcagccaugcacgucauuaugaugaucugacuugguuuuc

SEQ ID NO: 4105784 - RNA, 89 nt, Human
gacaaagauacaugagcagacuuucaaggagugaaggcacuuacauuggcuggacuuuuugcaggucauuugagcugguguauuuuuuc

SEQ ID NO: 4105785 - RNA, 57 nt, Human
gacaaagcgccugcucgcgggccccuucaccaucucccggagacgggcgucuuuguc

SEQ ID NO: 4105786 - RNA, 82 nt, Human
gacaaagcugcaagacugagccuugaagcuagauaguucuaggugacaaaagagaauuucuaguuccugggccagcuggguc

SEQ ID NO: 4105787 - RNA, 61 nt, Human
gacaaaggaauauucaaaacagucaucaguauggucgauuguacugaucauuucuguaguc

SEQ ID NO: 4105788 - RNA, 73 nt, Human
gacaaaggauaaaugaucuagauuuucuuccagaaggagguuugguuccauuugcugcuuucuuuucuuuguu

SEQ ID NO: 4105789 - RNA, 63 nt, Human
gacaaaggggcgcugcgguccucagccacacagccaggguggcggggauaacagccccuuguc

SEQ ID NO: 4105790 - RNA, 68 nt, Human
gacaaaguacucgaggaggaggagcaaaagaccuggaaaaggugcuuuaaucuccacgguucuaaguc

SEQ ID NO: 4105791 - RNA, 65 nt, Human
gacaaagugacaaggccugaagcuccugaagccaggugguccaggauugaagccuuuuaucuguc

SEQ ID NO: 4105792 - RNA, 66 nt, Human
gacaaauccagugaacuccagugggagauacauacuuccucccugcuggacgcauugguauuuuuc

SEQ ID NO: 4105793 - RNA, 62 nt, Human
gacaacagcuaguggucuagacuuugaaaugagauauuaaacaguuuuccuagcugucuguc

SEQ ID NO: 4105794 - RNA, 60 nt, Human
gacaacauacuguaccugguaaacuccucuuaccaggaguucuucuauauaguaugaguc

SEQ ID NO: 4105795 - RNA, 73 nt, Human
gacaacauggcgaaaccccaucuccacuaaaaauacaaaaauuagccagguguggugguguacgccuguaguc

SEQ ID NO: 4105796 - RNA, 108 nt, Human
gacaaccaaaaauguucuaaugauaaguuugucuuuguaaagauauucacucauagcccauucuauggucuuuggaaagacaaaguucaugucagauguugauuuguc

SEQ ID NO: 4105797 - RNA, 67 nt, Human
gacaaccagcuucccggcaggcacguccugucucagacacgggacccucaccggggugcuauguguc

SEQ ID NO: 4105798 - RNA, 98 nt, Human
gacaacuguuuuugcauuuuagagacgcauacugaaguauuuaggguaaaacgugugucaguaauauucuuuaaaauacucaagcaaaaaaaaaaguc

SEQ ID NO: 4105799 - RNA, 71 nt, Human
gacaaggcagaaagcuuaaaggguuuguucuuuuuuaucaaccacacuuuaaacuuuagaccugcuuuguu

SEQ ID NO: 4105800 - RNA, 92 nt, Human
gacaaggcggaggaccugggccuccacgggccaucacauauagcaggggcucagagugaugucuugggggcccaggccugugugaugguguc

SEQ ID NO: 4105801 - RNA, 71 nt, Human
gacaaguccugccaccuauaagccuccguuuccaugucuauacacugggguuccuagcucacgggacuguc

SEQ ID NO: 4105802 - RNA, 56 nt, Human
gacaauaaaaugaucuuacaguuucaguagaagguguaugguuaauuuuauguguc

SEQ ID NO: 4105803 - RNA, 86 nt, Human
gacaaugaaugaagucuugacaacuggcagauauauaaaucuguaugaaaagauuaguauauauucaucaguuaggcuauucuguc

SEQ ID NO: 4105804 - RNA, 59 nt, Human
gacaaugcagaaguacuuguucaucaugcuucagagggcagguagcucuucugauuguc

SEQ ID NO: 4105805 - RNA, 90 nt, Human
gacacaaauucuaauaacccaugugauauugaaaaucugacauagugaagauauauugcaaugcauauggcuugagggaauaggucaguc

SEQ ID NO: 4105806 - RNA, 64 nt, Human
gacacacacagcugugggccugacguggcagaaccaucugcuauaagcuccacgcuguagcugc

SEQ ID NO: 4105807 - RNA, 58 nt, Human
gacacagaaggucacauguucaucuugcaaacaaacaggcuaugugaauuucuguuuc

SEQ ID NO: 4105808 - RNA, 58 nt, Human
gacacaggaaaagcuccagccccccaggggguguggugaaggcuggggcccugcuguc

SEQ ID NO: 4105809 - RNA, 63 nt, Human
gacacaggaacucaagcucgcuugcuuguaaagugaauaaaauuguguucuuaugcaaguguc

SEQ ID NO: 4105810 - RNA, 106 nt, Human
gacacaggggcuuggcuguucuguuacagcagugggaaggagucagccaagcaggagaauggcugcgccuauuugcucuugagagaacaucaccagcugcuguguc

SEQ ID NO: 4105811 - RNA, 57 nt, Human
gacacaguagccagugcagugaugugucauaucccauucuuugcuuguuucuguguc

SEQ ID NO: 4105812 - RNA, 89 nt, Human
gacacauccagaggcguggaaggcuuugaccgaacagugggguccccaagccuuuuccaggucuguggccugccguucauauguguguc

SEQ ID NO: 4105813 - RNA, 59 nt, Human
gacacaugucagacggacacccuuucugcaguaagauucggugagagucugcuauuguc

SEQ ID NO: 4105814 - RNA, 69 nt, Human
gacaccaaaguaccucucagcugcuggugccaagacagagguagcaucuggccugguuacuuuuguguc

SEQ ID NO: 4105815 - RNA, 68 nt, Human
gacaccaguaaauauucaaaaggagcuaauauuuacugauuagcuccuuuugaauauuuacugguguc

SEQ ID NO: 4105816 - RNA, 62 nt, Human
gacaccauuaccuuucuauauugcagguccccauggucaugcaguuagcaggugcugguguc

SEQ ID NO: 4105817 - RNA, 74 nt, Human
gacacccagagucagacagccaugggcugaaaucccaguuccacuccuacuggcugaguggcucugagcaaguc

SEQ ID NO: 4105818 - RNA, 63 nt, Human
gacaccugagaaaaaugagucagguacaacuucuuccugccuauuucucauaguucaggucuu

SEQ ID NO: 4105819 - RNA, 91 nt, Human
gagaagcugcauagagagauggcaugaaaugcagcauaagguacguguucauucaacaugucaucuaagcucccuuugcaucaaacuuuuc

SEQ ID NO: 4105820 - RNA, 71 nt, Human
gagaaggacuuuugcaauggcuuucccaaaugacaagcacaaaaugggucagaauccauucagaccuucuc

SEQ ID NO: 4105821 - RNA, 79 nt, Human
gagaaggagcaacaggggaaugugcauguaguuuugauucauucaauauauaaugaguacuuuccauguguuuugucuu

SEQ ID NO: 4105822 - RNA, 56 nt, Human
gagaaggaguagcugaccugggguuagaacuugaguccuaggccaguauacuuuuc

SEQ ID NO: 4105823 - RNA, 74 nt, Human
gagaaggccaggaacccagugucuauucagcacuuugcugaauucccuauguccaucuugguucugguuuacuc

SEQ ID NO: 4105824 - RNA, 64 nt, Human
gagaaggcuuaaaacauggaauauguccuguauguacauauuccaaaauaguuaagcacuuucc

SEQ ID NO: 4105825 - RNA, 61 nt, Human
gagaagggcuugggagucaacacggccaggaguauuucagugucaggacaaagcccuucuu

SEQ ID NO: 4105826 - RNA, 83 nt, Human
gagaaguauucacaaucauaauguauguacauauaugcauuccauguuuucaaguuugcacauauuauguugguuggcuucuc

SEQ ID NO: 4105827 - RNA, 76 nt, Human
gagaaguauuuggcuaaaagacaagcuaggaaaagaauugucaaacugguuucuguuuuccgcacaaauauuucuu

SEQ ID NO: 4105828 - RNA, 55 nt, Human
gagaaguccguguaagcuguuuuaagacagagaacauuguucacaggggcuucuc

SEQ ID NO: 4105829 - RNA, 72 nt, Human
gagaaguggcugacaacuggguuaacaaccugcagcaucugguaggaguuaggcuacugucacccauuuauc

SEQ ID NO: 4105830 - RNA, 96 nt, Human
gagaaguuccagugacaugaugagaaugucuguacaacauguagcccaguacuugcugugugguguucucagaacaugcuuggucuuaaacuccuc

SEQ ID NO: 4105831 - RNA, 92 nt, Human
gagaauaguaaaaacaagcaauuuaacaauuuguguccauuuagugaauuaguugagugacuuuaguugaaucuuguuuucgugcuauuuuc

SEQ ID NO: 4105832 - RNA, 82 nt, Human
gagaauauuaucagaaaugccuuaaauuggaguuucacaauguauguucuaguuuguugagauauuuuugcaaaauguuuuc

SEQ ID NO: 4105833 - RNA, 58 nt, Human
gagaaucuacaggaaaccgaagagauuagacguucuaccaugauuuccugaaguucuu

SEQ ID NO: 4105834 - RNA, 81 nt, Human
gagaaugaagagauugguuauaagagauuucuggugugagaaccaaaaggaguuuuguauaacuaccuucaaaauauucuc

SEQ ID NO: 4105835 - RNA, 60 nt, Human
gagaaugaugauuuccaauuucauccaugucccuacaaaggagaugaacucaucauucuu

SEQ ID NO: 4105836 - RNA, 92 nt, Human
gagaauggcgugaaccugggaggcggagcuugcagugagccgagauugugccacugcacuccagccugggcgacagagugagacuccaucuc

SEQ ID NO: 4105837 - RNA, 101 nt, Human
gagaauggugugucacccucuggcaucauuuagcacaguguuuuuccaucagagguacucaauaaacaucuguugauugauguuacagucacauucgacuc

SEQ ID NO: 4105838 - RNA, 91 nt, Human
gagaauguaaguuugacauuuacuauuccugguuaaaucuguuauucuggcuaugacuucaugaauagucaagugugggagguauauuuuc

SEQ ID NO: 4105839 - RNA, 84 nt, Human
gagaauguaauuuaaauguuuaaaacucgugacuggcuaccagcaguuacggucucuugacauuuagacaacgcuuacuuucuu

SEQ ID NO: 4105840 - RNA, 61 nt, Human
gagaauguguaugauuaaugccucagggcucuuuucuucgcaaauucaacagcacauucuc

SEQ ID NO: 4105841 - RNA, 59 nt, Human
gagaauguuucugucugcccuuggccaucugagccacacaagagguagauaagauuuuc

SEQ ID NO: 4105842 - RNA, 86 nt, Human
gagaauugcuugaacccgggaggcggagguugcagugagccgagaucgugccauugcacuccagccuaggcgacagagcgagacuc

SEQ ID NO: 4105843 - RNA, 61 nt, Human
gacaguccuugcccaguaucuaguccccgucgccccgugcaggagacguagguaggacguc

SEQ ID NO: 4105844 - RNA, 63 nt, Human
gacagucuggccuaaaggguuaugguaccaacaucaaauauucuacuaaagccagauuuuguc

SEQ ID NO: 4105845 - RNA, 85 nt, Human
gacagugagauauaugagaauuacaaaugagucacauuacugaaaaaaauuugcucaguuugauaauuugaaauauguuuucuuc

SEQ ID NO: 4105846 - RNA, 80 nt, Human
gacagugcuuuguaguuucauuguguaaggcuuucacuucuuugguuaaauucauacaauaaacucauagguauuuuguu

SEQ ID NO: 4105847 - RNA, 55 nt, Human
gacaguggauucaucuagucaaccccguauaauuuugauaugugaaaacacuguu

SEQ ID NO: 4105848 - RNA, 70 nt, Human
gacagugugaacaucuaauaguacuauguuacucuuauggguuaauuccuuguuggauuucaugacuguu

SEQ ID NO: 4105849 - RNA, 62 nt, Human
gacaguuggcuucaaaggcagagaggguaagaaggagacgccaucagcuucaagccaacuuc

SEQ ID NO: 4105850 - RNA, 98 nt, Human
gacauauccaagacauccuagccagcaggaaugauauucgaggagaugagugauuucaacaccaaaugacaucauuuuuggcauguugugguaauguc

SEQ ID NO: 4105851 - RNA, 60 nt, Human
gacaucaacauaaagaaguccucaggugugugcuugggugauguguauuuguguugucuc

SEQ ID NO: 4105852 - RNA, 59 nt, Human
gacaucauggagaggacaaacagauuggcaagccuuuuuaugucuuuuccaaugcuguc

SEQ ID NO: 4105853 - RNA, 62 nt, Human
gacauccaggcugauccaugaagaaugaaugucuucagccucugugucucaaccuggcuguc

SEQ ID NO: 4105854 - RNA, 63 nt, Human
gacaucccagcagcuugcacagugcuggcggggcacgcuguaagugcucagcugaugguuguu

SEQ ID NO: 4105855 - RNA, 73 nt, Human
gacaucgccguguccgagaucuuugucagccagaaggaccuggugggcaucguucccuuggcuauggugaguc

SEQ ID NO: 4105856 - RNA, 84 nt, Human
gacaucuagaucagugcaguagaacuuuaguuaauuccaguuauaaaauagcuauuaauuaggguuuucauuggcuuaaauguu

SEQ ID NO: 4105857 - RNA, 68 nt, Human
gacaucuuggggccaccuugaauguuccucaacauuuucuaagaaucauucaagugcucuaaaauguu

SEQ ID NO: 4105858 - RNA, 56 nt, Human
gacaugcaaugcagugguaaguuacaacagggauugugaccagguaagugcauguc

SEQ ID NO: 4105859 - RNA, 73 nt, Human
gacaugccaaagauguuugauagaagcccugagaagacauaaaaaggguuuuuuauuacaguuuugguguguu

SEQ ID NO: 4105860 - RNA, 64 nt, Human
gacaugggcugcuucuccagcaccugcuuccaacaggguacuguggucagcagcaaccaguguc

SEQ ID NO: 4105861 - RNA, 76 nt, Human
gacauggggcuagaggcagggucuggauuugaucugauccucagcucuaagaccaggcccuugcaagucccaccuc

SEQ ID NO: 4105862 - RNA, 82 nt, Human
gacaugucuaaacuuucuucuugaguaaccagauuuucccuuacagucuuuugucacuuaagagaacucauaggcaaucguc

SEQ ID NO: 4105863 - RNA, 80 nt, Human
gacaugucugauauaguaugggaagaacuuuguaguagaaacauuucuauuaauggccccauuuuaugucucuacauguu

SEQ ID NO: 4105864 - RNA, 60 nt, Human
gacauguuuaauugaagguggcaagaagggcuagcucaguuaacauucaauuaaacaguc

SEQ ID NO: 4105865 - RNA, 59 nt, Human
gacauguuuacauuaggugauaucgcuggauaacaccagugauacccagugagcguguc

SEQ ID NO: 4105866 - RNA, 88 nt, Human
gacauuaaacaguacuucagaggcugcccaggaguucuaugaugaugagauggacccaccgggagcccuggaguaaugguucaguuuc

SEQ ID NO: 4105867 - RNA, 91 nt, Human
gacauuaacuucaacuccaugaaagcaggaaugguuuuacugaauacuacaaagauaaaaucauucagcuucauacuguugaugugaaguc

SEQ ID NO: 4105868 - RNA, 68 nt, Human
gacauuagagauucuuguuugaugauaugcuacacauccaauuuugacaaggauuuguuccuaauguu

SEQ ID NO: 4105869 - RNA, 58 nt, Human
gacauuaugagcaugccaaauuggggcaucuaaugccuagauucaaagcuuauaauuc

SEQ ID NO: 4105870 - RNA, 96 nt, Human
gacauucaaggguuaaacugguuucuaguaaauacugugcuuuaaaguaguacauacugugagcuguguuauuagaaaccugcuuguccuuguguc

SEQ ID NO: 4105871 - RNA, 75 nt, Human
gacauucuccuacuguguuuuccugcugaggcaucguuuuaacagaugcucagacuuaagaagaucagaguuguc

SEQ ID NO: 4105872 - RNA, 58 nt, Human
gacauuggcccaaaucuggggcagcuguaaugagagaaguccugggcugggccagguc

SEQ ID NO: 4105873 - RNA, 74 nt, Human
gacauuuaucaguaauuaccuaugacucgaaguuuccuucagugaugaguuacugauuauucuuaggaaguguc

SEQ ID NO: 4105874 - RNA, 57 nt, Human
gacauuuauuggauuuuacgagcuaguggaucugacucagaaagccgaucagauguu

SEQ ID NO: 4105875 - RNA, 92 nt, Human
gacauuuuauuggcuuaugguucugcaggcuguacaggaagcauaaguagcuucugcuucuggguaggccucaggaaacuuucaaucauguc

SEQ ID NO: 4105876 - RNA, 64 nt, Human
gacauuuuccaauugcagaucagauacaugugcacugcacauuggaaaugcauuggaaagaguu

SEQ ID NO: 4105877 - RNA, 97 nt, Human
gacauuuuggguuuuggaguuuuaucuguucugcuugauuuugaaacuuauuuucagaacuaaguucuuagaaugaauaacuugaacucagcuuguu

SEQ ID NO: 4105878 - RNA, 103 nt, Human
gacauuuuguauuguuuugauguguuuuuugagugugucuaagacagaaaacuuacauaacccuuuggaccagcuccucgggagacgagaaaccuuaaauguc

SEQ ID NO: 4105879 - RNA, 81 nt, Human
gaccaaacuacacaguucacacuuuugauaugugaacccaccacagauaguucaggucaauggugugacuaaguuugaguc

SEQ ID NO: 4105880 - RNA, 68 nt, Human
gaccaaucuuaccuuucucagaggucuauuuuauguuuagugggcuucuaagugaaaguguaaauguc

SEQ ID NO: 4105881 - RNA, 99 nt, Human
gaccaaugaaugcacauuaaguuuauuuucuuccuuagcugcuuguuaaucccuaauugcuagcagacagguaggaggauaaauuuuacagcuauuguc

SEQ ID NO: 4105882 - RNA, 106 nt, Human
gaccacaagacauauaaggcauuugacaguguuggggcaggcugaggaggugaggcuugucagucacucaagucacguuaaagaauuuaaaguuuauccugagguc

SEQ ID NO: 4105883 - RNA, 79 nt, Human
gaccacguuggcaccaggcugggcauaggccaugucaugggguaagauaaggcuccuguccuccuggagcuccaagguc

SEQ ID NO: 4105884 - RNA, 69 nt, Human
gaccacuggcuggagccccucaagagcagggcuuguucuuucucaugucaugguucccagcaccugguc

SEQ ID NO: 4105885 - RNA, 72 nt, Human
gaccagcaagcaccugcaccggucgccuuugguccuucgacaagguuucgggagcgggucuggaaggggguc

SEQ ID NO: 4105886 - RNA, 83 nt, Human
gaccagcuacaucagaauguuauggggggcucucagaacucagacugccagucccuaccucugagauucugguucagcagguc

SEQ ID NO: 4105887 - RNA, 84 nt, Human
gaccaggacauucaaguuucugcucaugggagguguauaccacaagcccccguggggccagcagaaagcuuucuguguaugguc

SEQ ID NO: 4105888 - RNA, 71 nt, Human
gaccaggcauguggcuggcacucuguccagugucccacaggggcuguggacuaugccagcagggccucguc

SEQ ID NO: 4105889 - RNA, 56 nt, Human
gaccaggcucugcugcuuucuaaucuuaugagcuugggaaagucauagagcuuguc

SEQ ID NO: 4105890 - RNA, 126 nt, Human
gaccagggccucuagcuuggaaauggaggccauuccugcccuggcucuccacuaguuuaauccuuuagauuggcaugucagguagacaccugaauccucccuuuuuauucgucccucacccugguc

SEQ ID NO: 4105891 - RNA, 84 nt, Human
gaccagguuugagaagauguaauguuaagccucaggccauccaauaccugaauuaacuuaccauauguacuuuucaaucuguuc

SEQ ID NO: 4105892 - RNA, 60 nt, Human
gaccauagauguauggguuuauuucugaacuuucaguucuaauccauuggucuauauguc

SEQ ID NO: 4105893 - RNA, 80 nt, Human
gagagacaugaaacccagccgugguccugaggcaggcaugugacagcugggaccagagcucgggcuucucaugcccucuc

SEQ ID NO: 4105894 - RNA, 62 nt, Human
gagagacccagacaccaugcaucugaugauaagcaucuucucuuggugccuuggagucucuc

SEQ ID NO: 4105895 - RNA, 80 nt, Human
gagagagacuguuagagguuccaggaaagucagaugcacuucaugcaauuagauuuuaggagauuuuacuguauucuuuc

SEQ ID NO: 4105896 - RNA, 83 nt, Human
gagagagagagagagagagagcuaauauuaagcuucaaaagugauaggcuuuaggguuuagcuuucucucccgacuuucuguu

SEQ ID NO: 4105897 - RNA, 79 nt, Human
gagagaggaaggcaucucuggacuuauuucccuaaaugugagcaaauaucuccaggaaagauaagucucuaaaucucuc

SEQ ID NO: 4105898 - RNA, 56 nt, Human
gagagaguuuuuacuggagggcaucuuagugaugggcugccccuuaagaguuucuc

SEQ ID NO: 4105899 - RNA, 78 nt, Human
gagagauaccaugaagauaagaccaggcuggaaaaaucaauuugcacagugucuggcuauuuucuuugcacuucuuuc

SEQ ID NO: 4105900 - RNA, 79 nt, Human
gagagauacugugggaagcaggauucagauguuuaaaaucaaaauuuucaacacugaccucuacccucaguuaagacuc

SEQ ID NO: 4105901 - RNA, 81 nt, Human
gagagaucauggucagcagaggagugucuugcccagcaauuaaauacuugggcauagaaauaacuucugucacuucuacuc

SEQ ID NO: 4105902 - RNA, 75 nt, Human
gagagaucugacugcugucuuuauuucacugcuaaauuaagguuaagcaaaacuaaagacacagacagcaaucuu

SEQ ID NO: 4105903 - RNA, 67 nt, Human
gagagaugaacacauuggaagccaagaaugguuuauggauuauauuugcuaaaugugugcaauccuc

SEQ ID NO: 4105904 - RNA, 71 nt, Human
gagagaugauggcucucuugaccuaggcacaaguuauacuugcugccuacauuucagugagccuuacucuc

SEQ ID NO: 4105905 - RNA, 59 nt, Human
gagagauuuggaacuguuucucagaagaaguagagaaagucaacaguuuccagauucuc

SEQ ID NO: 4105906 - RNA, 77 nt, Human
gagagcagacacggagcuuggcuggaccucacggaucacuaguccaugucacugcacaauguucuuccucuguucuu

SEQ ID NO: 4105907 - RNA, 72 nt, Human
gaggguggcccguguucgucuuucccagcuuuguggagguguagcugggccugugggcacacggacgcccuc

SEQ ID NO: 4105908 - RNA, 61 nt, Human
gaggguggccuuuagagcccaugaacuguaucuuucagcuuccuuuguucagaccaccuuc

SEQ ID NO: 4105909 - RNA, 68 nt, Human
gaggguggggaaggggcaggccuguuauuugacacuuucuguugggcuuggcccaggccucacuccuu

SEQ ID NO: 4105910 - RNA, 61 nt, Human
gagggugucuggaugcuagacuuauuuugagaaccuucugugcugaguauccagagucuuc

SEQ ID NO: 4105911 - RNA, 60 nt, Human
gaggguguuccuguaaaggcugcuguuauaaugauagcaccaaaacugaagaacaugcuc

SEQ ID NO: 4105912 - RNA, 83 nt, Human
gaggguuggaagaacacacauaagaaacuacaaagagcaucugcgagacggcuugugugaacugauggugugggccaaccuuc

SEQ ID NO: 4105913 - RNA, 89 nt, Human
gagguaacacuguagcugagggcaugcguucaggaguuaaucugcccaauucaaauucuggcuugacagccuucuagcugcaugaccuc

SEQ ID NO: 4105914 - RNA, 68 nt, Human
gagguaacauguauggagcauuuaccauaggccaagcacuguucuaagaacuucggacauguuaucuc

SEQ ID NO: 4105915 - RNA, 78 nt, Human
gagguaacccgaacuagggccaggaagcuaagguauuucuccacagcacccuguuuauccugaguucagggauacuuc

SEQ ID NO: 4105916 - RNA, 74 nt, Human
gagguaacuaggacugcagguguaaugcucuaguuaugcggaccucugcccacaguccaauaguugugcuccuc

SEQ ID NO: 4105917 - RNA, 70 nt, Human
gagguaagggcaggagagugaacagcacaucuggccugucuugugugauccuguccacagcccugaccuc

SEQ ID NO: 4105918 - RNA, 92 nt, Human
gagguaauacaugaaagagaauguaucaacaaauuguacagucuuuugagugacaauaugugcuagguauuuguuccauguaaaauuacuuc

SEQ ID NO: 4105919 - RNA, 70 nt, Human
gagguacuagucugcagcggggagggguguugggacccuggggcccucucuucugcagccuccaaaccuc

SEQ ID NO: 4105920 - RNA, 56 nt, Human
gagguagaauaagaaaagguaugagacuagaccaauuucauuccaaguucuaccuc

SEQ ID NO: 4105921 - RNA, 99 nt, Human
gagguaggagaaucucuggaaccuggaagguggagguugcagugagcugagaucaugccacugcacuccagccugggcgacagagcaagacuccaucuc

SEQ ID NO: 4105922 - RNA, 69 nt, Human
gagguaggauuuaggacuugggagugaagauugaacauguguguugacuuccaguuauaggaacucuuc

SEQ ID NO: 4105923 - RNA, 72 nt, Human
gagguagggagggacugccugauuagcacugugcccuugauaugccagcaucagguccagcuccugugccuc

SEQ ID NO: 4105924 - RNA, 99 nt, Human
gagguaggguuuugcucuguugcccaggcuggaguacaguggugugaucacaacucacugcggccucaaccucccaggcucaagcgauccucccaccuc

SEQ ID NO: 4105925 - RNA, 72 nt, Human
gagguaguauuuuaaagagacuguagauuuaagacuaauaaagucaguuaaacuuuguaaaguagauaccuc

SEQ ID NO: 4105926 - RNA, 80 nt, Human
gagguaugaauaugacauuugagcauacauguaaagaccuaaaggaagucuuuagagugaggugacuuagagucagccuu

SEQ ID NO: 4105927 - RNA, 69 nt, Human
gaggucagcaaguggaccauccugggguucaugauugucugauucccagaccucuccccuugcuauuuc

SEQ ID NO: 4105928 - RNA, 70 nt, Human
gaggucaggcaggagcucucaucgucagggccugcuggggcccuuccuugaagaguucuaacccugccuc

SEQ ID NO: 4105929 - RNA, 67 nt, Human
gaggucaucugcuucuucuggucagugccuuuuaaggcaaugauauugaagugaugaagacacccuc

SEQ ID NO: 4105930 - RNA, 77 nt, Human
gagguccugguuauaguucugacucccauuugcugucuagguagccaugagcagaucacuauaccucuuuggaccuc

SEQ ID NO: 4105931 - RNA, 56 nt, Human
gaggucgggaaagggggccccgcagcagccccuuggcuucccuucucccuugccuc

SEQ ID NO: 4105932 - RNA, 77 nt, Human
gaggucugggcuugggccugguuuuguuuuccacggcuugcgguguucagacacaggcucagcaggagccugaccuc

SEQ ID NO: 4105933 - RNA, 70 nt, Human
gaggucuguaaguaguuuaucacaauaaauaauucugacaaaugucgcuguuucugugguguauagccuc

SEQ ID NO: 4105934 - RNA, 60 nt, Human
gaggucuguggaaguaccacagugacuggagucaucauguuugauuuccacaguuuccuu

SEQ ID NO: 4105935 - RNA, 66 nt, Human
gaggucuugacucagucugggguggggcuggggacacccauaacccugcccauugagcaggacguc

SEQ ID NO: 4105936 - RNA, 78 nt, Human
gaggugaugggcaagaaggaugacacuggaugauuaaaauccaccaaaaaucuccagccuccuauuuacccuaacuuu

SEQ ID NO: 4105937 - RNA, 103 nt, Human
gaggugauguaagcaaagcaucagaacaguaccuagcacauaguaagugguuaucaucagcuugugugucugcuguauaugcugaacugcuugaguccaucuc

SEQ ID NO: 4105938 - RNA, 68 nt, Human
gaggugcucaaggguuucaauuguagccugucuguuuugugacaacaucagcugagaccuucacauuc

SEQ ID NO: 4105939 - RNA, 108 nt, Human
gaggugcuucgcugcagcucaacuccauggcuuucgcaucugcaaugaaaauaauaaacaagagaaguuauugcaggaggccccauggaaccgaccagcagagcucuc

SEQ ID NO: 4105940 - RNA, 98 nt, Human
gagguggaggauugcuugagcccaggagguggagauugcagugagcccugaucucgccacugcacuccagccuuggcaacacagcgagacuucgucuc

SEQ ID NO: 4105941 - RNA, 68 nt, Human
gagguggaguuggcacugagcugugauugcaucacugcacuccagccucagugacagagccagaccuu

SEQ ID NO: 4105942 - RNA, 60 nt, Human
gagguggcacugugaggagcacgcuggggugacaccuccaugguccucacaugccaucuu

SEQ ID NO: 4105943 - RNA, 55 nt, Human
gagguggcagaggccuggaccugccgucaaagguguguugauguuuccccaucuu

SEQ ID NO: 4105944 - RNA, 79 nt, Human
gagguggcauuaagauucugguuguagucacugaaggcccuaaaacggcccugguucuucagaaucugugagcuaucuc

SEQ ID NO: 4105945 - RNA, 98 nt, Human
gaggugggaggauugcuuguuccccggagguugaagcuacagugagccuugauugugucacugcacuccagccugggcaacagguaagacucugucuc

SEQ ID NO: 4105946 - RNA, 59 nt, Human
gaggugggagggcagucccuaacagccacggaugccuggcggggcgcucacuccaccuc

SEQ ID NO: 4105947 - RNA, 66 nt, Human
gagguggguggaucaugaggucaggaguucgagaccagccuggccaacauggugacaccccaucuc

SEQ ID NO: 4105948 - RNA, 67 nt, Human
gaggugguaauauucagaacaucaagcuuuaggauauuccuguggacaagugcugaauaacuacuuu

SEQ ID NO: 4105949 - RNA, 99 nt, Human
gaggugucagacugcagaaguugauuccaggcuuguauuugugucuguuaauuuugguuuuacagguacauacuugggauccacacagcacuuagccuc

SEQ ID NO: 4105950 - RNA, 99 nt, Human
gaggugucaguuguuugccugccgacgcucucaugugaacuaagagaauggaaccggacauucgugaagugcucaguaagcaaacaaaacgaagacuuc

SEQ ID NO: 4105951 - RNA, 59 nt, Human
gaggugucaugagggccugcucaucacuugcuuagugcauagacccuugggggcaucuc

SEQ ID NO: 4105952 - RNA, 61 nt, Human
gaggugucugcuguguucaaaggacaguggcacugaaaacucaggacucagagacacucuc

SEQ ID NO: 4105953 - RNA, 61 nt, Human
gagguguggguaauguuacagauagguugauccuggauauuuuguucauagcucacucuuu

SEQ ID NO: 4105954 - RNA, 70 nt, Human
gagguucugggcugugcccucagccuuuccuacauccugcaguggcccuugaagcagcuucaugaaccuc

SEQ ID NO: 4105955 - RNA, 65 nt, Human
gagguugauagaucccuucaaaguucuaaucucugguuuugaaacuugaagaggauauaucgcuc

SEQ ID NO: 4105956 - RNA, 59 nt, Human
gagguuguggcugagcuguguuuaggaaacuggugcacugagcaccagccacagauuuc

SEQ ID NO: 4105957 - RNA, 81 nt, Human
gaguaaagucuguugugcucuauagagaucuaaucgucagaucaagaugaugggguugauuguaagcucaacuucucucuc

SEQ ID NO: 4105958 - RNA, 88 nt, Human
gaguaacagaugcacagugaccaaucacugaaugauuuugaaagaaguaaugcgauuggucacugauuaugaugaacauuugucacuu

SEQ ID NO: 4105959 - RNA, 75 nt, Human
gaguaacuagggagcagcccugccacuccucaugugaugcaccaggagccagggaagcugcuuucuaggggauuc

SEQ ID NO: 4105960 - RNA, 68 nt, Human
gaguaagggugguagauccaguuuuggcaaccucagacgauggaugauuagacucugccacucuucuc

SEQ ID NO: 4105961 - RNA, 95 nt, Human
gaguaagucacuucccuccuuuaucaaaaagagaugcuauuuauacacuuucuuucucacuugguggaaugaggguaaaaugugaaguauuacuc

SEQ ID NO: 4105962 - RNA, 61 nt, Human
gaguaaugcucaaggucuguuucuaauaauuaguaguauuaugacccugggcaauucacuc

SEQ ID NO: 4105963 - RNA, 64 nt, Human
gaguaauuuucuugauuucuuaguuacuucaucauagcuuuucauaagaaacaggagaauucuc

SEQ ID NO: 4105964 - RNA, 76 nt, Human
gaguaccuagcaucuuugggaaucuuugugcaugacuaaaggcagaaguccugugugacuucccaaaugcuggcuc

SEQ ID NO: 4105965 - RNA, 107 nt, Human
gaguacgagauaaaauauaagauuaacaggaagacgugaguacaugguguaaagagucaggaaaaauggcuaccuuuccaccaacucacuucccuguuuucgugcuc

SEQ ID NO: 4105966 - RNA, 116 nt, Human
gaguagaaaagcccgacaaaugguaucuuaggugaucaaggucaacauuaauaauaauaaauaauuugauauuuugcacgcuugguaugauauaaugaaaauggcgcuuuccucuc

SEQ ID NO: 4105967 - RNA, 78 nt, Human
gaguagaacaggcugucagagcgggaaaguggcuuuaauacccugaaaagcaaaggaauccgccugucagcuuugcuc

SEQ ID NO: 4105968 - RNA, 77 nt, Human
gagaagaugcaugagaagaaaccauacugauauagucaucaacaccucagugugaauucauuuuagauaguuuucuc

SEQ ID NO: 4105969 - RNA, 57 nt, Human
gagaagcacaagauaagggaucaggauuucugccagguuccaaggucuaugcuucuu

SEQ ID NO: 4105970 - RNA, 90 nt, Human
gagaagccagcugcagcaaauguuaagugacuaguaacuaaugauaauaaaaguaauaaucacaauaacauuuauuguaggcuaacucuc

SEQ ID NO: 4105971 - RNA, 59 nt, Human
gagaaggauguggcucauagcugagggauucagccacaugcucagucacauccugacuc

SEQ ID NO: 4105972 - RNA, 101 nt, Human
gagaaggcugaugauggcuguccaguuucuagagaagaaaccucuccuuaagaggaaacccuuaucuuuagcuaacuggaugccaaaacgaaagguuucuu

SEQ ID NO: 4105973 - RNA, 64 nt, Human
gagaaggcuucuuuuccucugauaaaauucuguuuguccuucaggggaaagguuaugcuuuguu

SEQ ID NO: 4105974 - RNA, 56 nt, Human
gagaagggcuuuuucucccaccagucauaguuguauucugggaagaaauucuucuc

SEQ ID NO: 4105975 - RNA, 76 nt, Human
gagaagggguugaagaguagucucuaauauccagcaccaguuggccuuagguucccugccuccagaccuuauucuc

SEQ ID NO: 4105976 - RNA, 91 nt, Human
gagaaggguuauaaaucuggauguaacgaagguuucaccccagugguaauagaguuagagggugaaagguugcaucuuguucaaccuucuc

SEQ ID NO: 4105977 - RNA, 59 nt, Human
gagaagguggaccugaaggagcggguagagaaacuagagcuucaauucauccaccucuc

SEQ ID NO: 4105978 - RNA, 59 nt, Human
gagaagguggaugauggucuccagguaagagauaaugggugaaauuauucuuccuuuuc

SEQ ID NO: 4105979 - RNA, 107 nt, Human
gagaagucacagcuuaauuuaccgagcaccuaccuaccucaugccaugucauagaggaugacagaugcuguggggagguaaaaggaacucguuuugcagugcuuguc

SEQ ID NO: 4105980 - RNA, 67 nt, Human
gagaagugcacuugcuccuggaaaaaccauuauucaaaagcuuuugcagaaguaaggguaacuucuc

SEQ ID NO: 4105981 - RNA, 57 nt, Human
gagaaguuguugggugccauggccuuauguagggcuaaggcacaaauagcuuugcuc

SEQ ID NO: 4105982 - RNA, 102 nt, Human
gagaauacaggcagagccaauacugcugccugcaaauuauacucagugagauuauaaucucugcaauggcacagucuuugcuuugcucaguucuguauuuuc

SEQ ID NO: 4105983 - RNA, 90 nt, Human
gagaauagacagaucagcaggcauguuaaucaucuuaaaaagcucccuuuuaaggaugaugugauauauaaccguuagacauaucuucuc

SEQ ID NO: 4105984 - RNA, 72 nt, Human
gagaauaucaggaugcaaagcuguguuuuucucugaugaugaauaccuucuuccaguguccuaguauuucuc

SEQ ID NO: 4105985 - RNA, 65 nt, Human
gagaauaucuuggcaguuccugugaugguccaaaugugauugacagagacugccaagauauucuc

SEQ ID NO: 4105986 - RNA, 63 nt, Human
gagaaucuggguuuuggcuaucgaggaugaauuauuuaacuggucugaagccucagguuccuc

SEQ ID NO: 4105987 - RNA, 71 nt, Human
gagaaugagccauaucugguucccuaccuucauggaguguacaguucagggaggagaauggacuccuucuc

SEQ ID NO: 4105988 - RNA, 71 nt, Human
gagaaugaggcagcaucacuugucuccagcagauaugucugcuaagaaggucugaucugaucucaugucuu

SEQ ID NO: 4105989 - RNA, 84 nt, Human
gagaaugauaggcacugaccuucucagauugcucugaaaucucaagaagugcacuuugaaaagacaguagcucuagcgucucuc

SEQ ID NO: 4105990 - RNA, 88 nt, Human
gagaauguuaauaauuauugaagcuggaugaugaguauuugggggauuauuauacucuugucucaacuuuuguauguuugacauuuuc

SEQ ID NO: 4105991 - RNA, 80 nt, Human
gagaauguuuucaucaucaaaauagugaggucuauuuuaaauaguuuggcuaauuaggugcugauuaaauugcauugcuc

SEQ ID NO: 4105992 - RNA, 62 nt, Human
gagaauucaguuucuauggaguguucauucauaucaaugcugccaucucaacugcccuucuc

SEQ ID NO: 4105993 - RNA, 60 nt, Human
gagaauucuguucuucggguguguggugcuaagauuguugagcgcucccacagaggucuc

SEQ ID NO: 4105994 - RNA, 77 nt, Human
gagaauucuuucacagcuuccacuuaaggauuaauguuuaagaaauuugucuuucuaguggagcuggauuauucauc

SEQ ID NO: 4105995 - RNA, 87 nt, Human
gagaauugcuugaacccgggagguggagguugcagugagaugagaucaugcuacuguacuccagcucugggugacagagcaagacuu

SEQ ID NO: 4105996 - RNA, 97 nt, Human
gauauucuggcaugugggagggcacugagaacaggcugacuuggcugaaagccaggcaggaugccccggucuagugcuuucucccagcagauguguc

SEQ ID NO: 4105997 - RNA, 78 nt, Human
gauauugaaaauuuaauuuagccucauuuuugacauagauuuucuuguuaaaaaaagggauaaaaguuuuuugguguu

SEQ ID NO: 4105998 - RNA, 56 nt, Human
gauauuuauuaagugguugguauguaccagauagcaugcuaagcacuuuaaauguc

SEQ ID NO: 4105999 - RNA, 77 nt, Human
gauauuugcuaaaccugauagauuuucagaaucaugcuugccauaauucuauaagaugaucaaggucaguggacauc

SEQ ID NO: 4106000 - RNA, 67 nt, Human
gaucaaacauugaauuucagugcugugauagaaaauccuuuuacacgugcaaauucaauguauguuu

SEQ ID NO: 4106001 - RNA, 79 nt, Human
gaucaaauuuccuguaccauuauucacaugaucuuuuccaaggaaaggagugggaaaaggaaggagaaggaagaguguc

SEQ ID NO: 4106002 - RNA, 55 nt, Human
gaucaaggcaguagggccagcuguggacuggcagugaccuuggugccuuugacuc

SEQ ID NO: 4106003 - RNA, 64 nt, Human
gaucaaguucugggucacccugcccagacugcugcaguucuuuuaucagggccccagaauuauc

SEQ ID NO: 4106004 - RNA, 73 nt, Human
gaucacuacaaaaucugcacaugaagaucuuuaucuaucacagcaaaagugugcagagcuuguaacagugguu

SEQ ID NO: 4106005 - RNA, 64 nt, Human
gaucacucccagcacuguaauucuuuggcuauuggugccugagauggccagugcugggaugguc

SEQ ID NO: 4106006 - RNA, 57 nt, Human
gaucagaaugggacauauccugcaguacaauuagcagagaugggaaauauucugauu

SEQ ID NO: 4106007 - RNA, 97 nt, Human
gaucagacugggggagugugaggauugcucuggagaauuuuucaugcaugcucugaauaaucacuccagcguaauucacuccuccuucagcuagauc

SEQ ID NO: 4106008 - RNA, 90 nt, Human
gaucagagugccuccuuggaaaucucuggguaaaguucucucauuguuagaugaggaaacugaggcccagagaaguuaaggggucugauc

SEQ ID NO: 4106009 - RNA, 65 nt, Human
gaucagcaggaggugagcagcaggugagcaagcauuaccaucugagcuccgccuccugucagauc

SEQ ID NO: 4106010 - RNA, 67 nt, Human
gaucaggagauggccucagaccucacaaggcacuggaagaggucaaaaagcaaggcccucccucauu

SEQ ID NO: 4106011 - RNA, 60 nt, Human
gaucaggguguucuaaugaucuugaccuagcauggucagguucuggugagggcccuuuuc

SEQ ID NO: 4106012 - RNA, 60 nt, Human
gaucauauaaguuuggcuuuacuuagcacaagugcaauuugaacacagauuugucugauu

SEQ ID NO: 4106013 - RNA, 59 nt, Human
gaucaugcagacaagaagaaccaaggaacuuuguuccuggcuuccacuccucuguuauc

SEQ ID NO: 4106014 - RNA, 60 nt, Human
gaucaugcagaggugccacgaggcuuaauuuauuaauguuuguguuacacucugcagcuc

SEQ ID NO: 4106015 - RNA, 77 nt, Human
gaucaugucauuuucuccuaacucaaauuuaagaguuucuaauuugucuugggcugaaaugugcuugugacagaauc

SEQ ID NO: 4106016 - RNA, 55 nt, Human
gaucauuaacaaccuuacccuuaaaaaucaaaguaaugguaagaguugagugauc

SEQ ID NO: 4106017 - RNA, 109 nt, Human
gauccaauugcugaggaguacaggcgagguagcugucaguuuccucuggugucuucaacgaaagucacaggaaacaggcagccuuugaaccuggucuugagcgaugauc

SEQ ID NO: 4106018 - RNA, 98 nt, Human
gauccaccugccuuggccucccaaagugcugggauuacaggcuugagccaccaugcccagccuauccaagcgcuuuggaaggccaagguggguggauc

SEQ ID NO: 4106019 - RNA, 67 nt, Human
gauccacuugcucaguggcagggcugguauuuagagcugugcaggcagauguacugagggagggauc

SEQ ID NO: 4106020 - RNA, 79 nt, Human
gauccaucaguagggaaugugggaggcuguguggucacuccuaacccagccccucccacaaauuuccuuccaauggcuc

SEQ ID NO: 4106021 - RNA, 79 nt, Human
gauccccaguuccauuucugcagccacgagucacagcccaggugcgucugagcuuugugcugguagguggucugggauc

SEQ ID NO: 4106022 - RNA, 83 nt, Human
gaucccuuauaugcccucuuauuucuugcauaaacuccuuuguaguaguuaucuuugcaaagauaugagaagcuguaggauuc

SEQ ID NO: 4106023 - RNA, 60 nt, Human
gauccuacagcaaacacugugggccaauuuuuaacuuguugcauguuaugcuguaguauc

SEQ ID NO: 4106024 - RNA, 78 nt, Human
gauccugagcuggcccucgagagccaauuguacacauguucccaguucccugucaagggauccagugacaucagguuc

SEQ ID NO: 4106025 - RNA, 77 nt, Human
gauccugcagcugcaggcuucaggaagucuccuggggcuaucagauggcuccuucuuguagcagcagcugugggguc

SEQ ID NO: 4106026 - RNA, 66 nt, Human
gauccuuacaaccuucuccccaaaagcugcaaauacaaugagaacugauuugaagguugggggguu

SEQ ID NO: 4106027 - RNA, 72 nt, Human
gauccuucaaacuucaccucagagaggcuuccagauaacucaugccaaguuucucucagggacugauggauu

SEQ ID NO: 4106028 - RNA, 61 nt, Human
gaucgccugcucaugcuccucauuggccaaacccaacugggaggcaaagagcaaggaaguc

SEQ ID NO: 4106029 - RNA, 88 nt, Human
gaucuaggaaguaccugucucauuugccauuuuuauaccaaacagggcugagacuagagugaggcauguaaggugcucaucuuggguu

SEQ ID NO: 4106030 - RNA, 117 nt, Human
gaucuauauaauguauguuuaugucuauauagucaauaaucauuaggucaguagauauuuauuaaacagcuacuacauugaaauuacuguaaaggcauuguauaacuaauaaugauc

SEQ ID NO: 4106031 - RNA, 61 nt, Human
gaucucaagacucugaagucauugcaugagcaucccuucucggcaacaucagagugagauc

SEQ ID NO: 4106032 - RNA, 75 nt, Human
gaucucagacaaacuaaacauguagcuuuugugguuuucaagagaauccauugcaaacaguuugguuucuagguu

SEQ ID NO: 4106033 - RNA, 66 nt, Human
gaucuccuccuucugggccuggcaguggcugaggagcugcugagccgcacccaggagcugggcguu

SEQ ID NO: 4106034 - RNA, 73 nt, Human
gaucucuuacaaacugguuuucagggaccguuaacaccugcucacuggaagaacuccaguucugugugagauc

SEQ ID NO: 4106035 - RNA, 64 nt, Human
gaucugcucuaauaucagauagacugccuuuaaauggagugaguuucuguaauuagacgcauuc

SEQ ID NO: 4106036 - RNA, 66 nt, Human
gaucugggcgaugaucugguacuccuguccuaugcagggcucaucagaguaguuguugcccagauu

SEQ ID NO: 4106037 - RNA, 74 nt, Human
gaucugucccaggcugaaguacaguggcacgaucauagcucacugcagccucaaaggccugggcucaacggauc

SEQ ID NO: 4106038 - RNA, 62 nt, Human
gaucuguguccuuauaagagacaccagaguucucucuugaucuacuaugugaggacacaguc

SEQ ID NO: 4106039 - RNA, 127 nt, Human
gaucuuaggaggcaacgccuggcuugcaccgugggacauggagacguuugcagggcaggaauguuuggagcagauguucugugucucacaaaccaugccuuauagggggcuuguccuggcuaagauu

SEQ ID NO: 4106040 - RNA, 96 nt, Human
gaucuuaucaggcuuuguugacaacaaugauucccagucagaacacacugguacagucacacugguuguuuacagugagcauccauuugauugguc

SEQ ID NO: 4106041 - RNA, 67 nt, Human
gaucuugacaugagcauaaaucagucacgagcaaauguuaugugcuaucaaaugcucauuucagauu

SEQ ID NO: 4106042 - RNA, 90 nt, Human
gaucuuugggcaauugcccuuacuuugugugcuucuugguccaguaauggaauccacgagcaguagguaauuguagcagccucaacuauc

SEQ ID NO: 4106043 - RNA, 63 nt, Human
gaggucagauuuccuugcaguuuggaacuuccuuggaauuccauaguacuagaaacugaccuu

SEQ ID NO: 4106044 - RNA, 62 nt, Human
gaggucagucagaccaggguuugauuggaagcacaaugacuuuggacaaguggcuugaccuc

SEQ ID NO: 4106045 - RNA, 82 nt, Human
gaggucagucagguaaaugacauucuuaagucuugggcacugaccaucaagaaagauaagaaacauucucccuggugcccuc

SEQ ID NO: 4106046 - RNA, 55 nt, Human
gaggucauugaaguuauuuucuugccccugggcaagaggcacugacaggggccuu

SEQ ID NO: 4106047 - RNA, 81 nt, Human
gagguccaacuaaggcuaugaucuuuuucaugagguuuuucucagaucaaccaaugauggcaucuucacaaguuggacuuu

SEQ ID NO: 4106048 - RNA, 87 nt, Human
gagguccaggaucaugauuauucuuucuuuugugcuacuauuuagugacaaguuagguuuuaauccaaaagugugcucuggggccuc

SEQ ID NO: 4106049 - RNA, 56 nt, Human
gaggucucacuauguugcccaggcuggucucgaacuccugggcucaagugauccuc

SEQ ID NO: 4106050 - RNA, 61 nt, Human
gaggucugccuucaggagaguucuuaguaucaccccgccuccauuuugaccugcagacuuc

SEQ ID NO: 4106051 - RNA, 66 nt, Human
gaggucugugcgcuguugauagaaauccugcagacaugaugcugagcucugucagugcaucaccuc

SEQ ID NO: 4106052 - RNA, 62 nt, Human
gaggucuugcuggccaugcucaguauccggagaacucugcaguggauggccagcaggggcuc

SEQ ID NO: 4106053 - RNA, 78 nt, Human
gaggucuuuucugggaagccacaggguguggggcugagugaggaacagagcaccugccuggcuuccagaagagacuuu

SEQ ID NO: 4106054 - RNA, 130 nt, Human
gaggugaaaagggguagguaacucauguccucugagucuucagaagaucacaucaguguaggaugaacagggguaacauucguguuaucuucugagcacucagaagacaugaguuaccccuguucaucuc

SEQ ID NO: 4106055 - RNA, 57 nt, Human
gaggugaugguugcacaaugcuguuaguguacaaaaugccaugcgaucauacacuuc

SEQ ID NO: 4106056 - RNA, 65 nt, Human
gaggugcugggggguuugugggucucacuugcacaccugacuucacauuuaaccccucagaccuc

SEQ ID NO: 4106057 - RNA, 60 nt, Human
gaggugcuuacagucuuuuagggaacuaagcagaugguuaucuagaguaauaaguacuuu

SEQ ID NO: 4106058 - RNA, 59 nt, Human
gagguggaaggcaggaacaaauggugaagcuaaagaaggccaaguuucucuuccauuuc

SEQ ID NO: 4106059 - RNA, 60 nt, Human
gagguggccucaagcagucuucagcuacgugcuuaccugcccggcuguugaugccauuuc

SEQ ID NO: 4106060 - RNA, 65 nt, Human
gagguggcugggaguagggaaugcucccuuuaggcugcaaaggucaccucucccaugcuuaccuc

SEQ ID NO: 4106061 - RNA, 92 nt, Human
gagaauugcuugaaccugccagguggagguugcagugagccgaggucgcgccacugcacuccagccugggugacagagcaagacaccgucuc

SEQ ID NO: 4106062 - RNA, 68 nt, Human
gagacaaaguucuguagugcacugacuucuaucauacucagagucggagugucucagaacuuugccuc

SEQ ID NO: 4106063 - RNA, 90 nt, Human
gagacaauaaccauucauuugccuugagcaauauuuuuccuuugaucagggaguggagcaaaagagguagauggguagguauggggucuc

SEQ ID NO: 4106064 - RNA, 84 nt, Human
gagacacacugguuucaucucaguguacagggagucuaguuacuaaguggacgaagaacucccgcacauugagaucugguccuc

SEQ ID NO: 4106065 - RNA, 57 nt, Human
gagacacaggcacagaagaggcuggccaagcccagaggaaucuucuccuguguguuc

SEQ ID NO: 4106066 - RNA, 85 nt, Human
gagacacuggacuagaggacauuuagaaaaaacggucuaauagaucaaugguuuccaaaugcccaucuacacagaccagugucuu

SEQ ID NO: 4106067 - RNA, 77 nt, Human
gagacagaaagccaggcagccaagccaguguggggucucugaaauaacacugugcuagcugcuacuuucccugucuc

SEQ ID NO: 4106068 - RNA, 69 nt, Human
gagacagaaccuucgguuuggcugccauaaggccugugggagaggugggcagagccaggguuuuguuuu

SEQ ID NO: 4106069 - RNA, 64 nt, Human
gagacagacgcugccuggcccugcugccauuaauaugugucccagcccuguccaaugucugcuc

SEQ ID NO: 4106070 - RNA, 58 nt, Human
gagacagagagguacucaacauuugcagaaugaaugaaugagaaauggucucugucuu

SEQ ID NO: 4106071 - RNA, 72 nt, Human
gagacagcagacuuggcagugggaauggacaaacagggccauuuaccccuucuacccuggcaccugcuuuuc

SEQ ID NO: 4106072 - RNA, 65 nt, Human
gagacagcaggugcaggugcggccgcuuuagcccugagcaggcucugccgcugcuugcaggucuc

SEQ ID NO: 4106073 - RNA, 99 nt, Human
gagacaggagaaucaguugaacccgggaggcagagguugcagugagcccggauugugccacuguacuccagccugggggacaaagugagacuccaucuc

SEQ ID NO: 4106074 - RNA, 100 nt, Human
gagacaggagaaucgcuugaauuggggaggcggagguugcagugaaccaaggucgcgccauugcacuccagcccgagcaacaaaagcgaaacuccgucuc

SEQ ID NO: 4106075 - RNA, 129 nt, Human
gagacaggagagcaguacguuucugcacuugguggugucaggguugaagucugguugccuguugcuucgugagggugguuauuaguuucaccuggacuuccgcagugcagccugcugugcguuuuuccc

SEQ ID NO: 4106076 - RNA, 106 nt, Human
gagacaggaucucacucugucacucaggauggggugcaguggugugaucauagcucacagcucacugcagccucaaauuccugggcucaggugauccuccugccuc

SEQ ID NO: 4106077 - RNA, 56 nt, Human
gagacagggcugcugagagacagagagaccucugaucccauuggcaguccagucuc

SEQ ID NO: 4106078 - RNA, 68 nt, Human
gagacagggucuugcuacauugcccagguugaucucaagcuccuggcuucaagcaauccuccugccuc

SEQ ID NO: 4106079 - RNA, 55 nt, Human
gagacagugcuccguggguccagauagguacucuggagucuguggaugcuguuuc

SEQ ID NO: 4106080 - RNA, 67 nt, Human
gagacauggcaaaagcacuggucuuacauugccagaagaaauauaaagacuaaugcuugaaugucuu

SEQ ID NO: 4106081 - RNA, 61 nt, Human
gagaccaggggauggaucugcugaccuuagagaagagucauugcaggcauuccccugccuc

SEQ ID NO: 4106082 - RNA, 87 nt, Human
gagacccagggcaacugaaaagauucuacgcagacuggcuacagugagccccuaaagcgguuguguguguuuucagggcccucucuc

SEQ ID NO: 4106083 - RNA, 80 nt, Human
gagacccuagaaaugauugguugagcucugauuuauugauuaggaaagugcuugaacaguuuacaacuuuacuagggcuu

SEQ ID NO: 4106084 - RNA, 58 nt, Human
gagacccucuuccucccuacaggcucaucuguuggcaccucccuaggaagaaggucuc

SEQ ID NO: 4106085 - RNA, 91 nt, Human
gagaccggguuuuauaauuguaagaucucacuuuugugaauugcugauuagaauucacaaaaguuagauccauggugcagugccucuucuc

SEQ ID NO: 4106086 - RNA, 78 nt, Human
gagacgcccaucugggucugaagauaaugaugccaugaaauggaaaucuaaguuuuaggccacagucagggcagucuu

SEQ ID NO: 4106087 - RNA, 61 nt, Human
gagacgggguuugagacggguuucuccacguuggucaggcuggucuccaacccccgaucuc

SEQ ID NO: 4106088 - RNA, 66 nt, Human
gagacgggguuuuaccauguuggucacgcuggucucaaacuccugaccucaugauccgcccaccuc

SEQ ID NO: 4106089 - RNA, 92 nt, Human
gagacggugucucgcucuguggcccaggcuggagugcaguggcacaaucuuggcucacugcaagcuccgccucccagguucacaccauucuc

SEQ ID NO: 4106090 - RNA, 92 nt, Human
gagacggugucucgcucuuucacccaggcuggacugcaguggugcuaucuuggcucacugcaagcuccaccucccggguucacaccauucuc

SEQ ID NO: 4106091 - RNA, 71 nt, Human
gagacuaaagggaagggugauggagcugccuccagauaggcagacaaaccaguaaacccuuccucaguguc

SEQ ID NO: 4106092 - RNA, 95 nt, Human
gagacuaaugugugugugugugugagaguguguguguguguguguguauauauacacaucuuuuuaaauauuauaccagcuaagcgcaguggcuc

SEQ ID NO: 4106093 - RNA, 89 nt, Human
gagacucaggagagaugcccacuggaggagcuagcaugaaaaaaagagaaaauugcugccuuuagggggugcucagcccugaagugcuc

SEQ ID NO: 4106094 - RNA, 73 nt, Human
gagacucauaauagcugcucacuaaaaaguuuauggaugacugcaugggaguuaguuauacugugacaauuuc

SEQ ID NO: 4106095 - RNA, 69 nt, Human
gagacucuuuauuguuuguggcuaggaucugauauaagccauuuagcccagguuguaaagauuugucuu

SEQ ID NO: 4106096 - RNA, 78 nt, Human
gagacugagccagauguuccccuggaggccucuugggagccagcaagauggccuuucuggcacauuuccucucuucuc

SEQ ID NO: 4106097 - RNA, 78 nt, Human
gagacugaggcugcugugaauuuuuuaaaugccuuggguccagguuuuuauuagucacaguuagcugccaaauguuuc

SEQ ID NO: 4106098 - RNA, 64 nt, Human
gagacugagguuccagucugggguucccuuugggcaagucccuuucccacugggccucaguuuc

SEQ ID NO: 4106099 - RNA, 57 nt, Human
gagacuggcuaacagagguuccaugugugcucauugucaucgauguuagccaguuuc

SEQ ID NO: 4106100 - RNA, 98 nt, Human
gagacugggugguuuuggugccaggcugagcaugauuggagcuagagacugcugcuucacaggcaaguuaagccucauuguaccuacuaugcaguuuc

SEQ ID NO: 4106101 - RNA, 83 nt, Human
gagacuggucacggcggugcaggcucacccuggagcugagugauggucuucagcuccugggucugcucuuccacaucugucuc

SEQ ID NO: 4106102 - RNA, 64 nt, Human
gagacuucagagagaacccuaaaugagauaugauaguuauguuuuauuuuggucuuuauguuuu

SEQ ID NO: 4106103 - RNA, 66 nt, Human
gagacuugucugauugccauucucuauaugauaacuucauauaccugaaguugguaauuaaguuuc

SEQ ID NO: 4106104 - RNA, 83 nt, Human
gagagaaaagccccaggaaggcguuguuccucucaggcgggcgccagggaggcgcgcuccuuccggcccggcguccgucuuuc

SEQ ID NO: 4106105 - RNA, 100 nt, Human
gagagaaaauaacaguuugaaaguaguuuacuguuugauuuguuuguuuuauuguauuauuuuauuucaaauguaauuuauuguuuuauuguugucuuuc

SEQ ID NO: 4106106 - RNA, 59 nt, Human
gagagaaaugccagaacccagccgagcugcggcugguccacauccugguacgucuccuc

SEQ ID NO: 4106107 - RNA, 61 nt, Human
gagagaagcucuggacagugaagaagagcucguuuuggccacacucacuagagccccuuuc

SEQ ID NO: 4106108 - RNA, 56 nt, Human
gagagaagggggauaugagccugacauccagccccaugcauuccuccccuuuccuc

SEQ ID NO: 4106109 - RNA, 82 nt, Human
gagagaaucuuucggugaccagugaugcugaggagugugacuaauuuaaacucaugcaucugagcuggcuccugccucucuc

SEQ ID NO: 4106110 - RNA, 106 nt, Human
gagagaaugaagggaaauggggcaacagucagcaugagcaagggcugaccuauggugggucuuagccuuuacugugcucaguggccccacagcaccaucgucucuc

SEQ ID NO: 4106111 - RNA, 55 nt, Human
gagagaaugggacgggcucacaccaacuuguauagccccuuccaguucucagauc

SEQ ID NO: 4106112 - RNA, 86 nt, Human
gagagacaacaauggaauucugggagagaucugacaucagcagguucaucugaucucucucaggagagagaaguguuuguuuacuc

SEQ ID NO: 4106113 - RNA, 76 nt, Human
gagagacagcuggacagacacugaugacuuacuaaaccucccucuuggucccaggucccggggccagcugcugcuu

SEQ ID NO: 4106114 - RNA, 74 nt, Human
gagagacaggcaagcaaggggucuugaaaugaaaguuuguuuaacuucauggcaacuuguuaacucuuucucuc

SEQ ID NO: 4106115 - RNA, 66 nt, Human
gagagacauguccagaguguccuggaaagucuggaaaguccuugccuucccucggaaugugcucuc

SEQ ID NO: 4106116 - RNA, 56 nt, Human
gagagagaaccccgugcccuucauagcacagugccugggucaaauguucugcuuuc

SEQ ID NO: 4106117 - RNA, 118 nt, Human
gagagagcaauugagauugggacugacuaacaguugcuugcccugcagcauacuucagguaaauagcuuaaaaguagcuuaguguaacaaggggucauuucuuuuuucuuucucuuuc

SEQ ID NO: 4106118 - RNA, 69 nt, Human
gaggaugccaaagaaguaucaaagaugccagcacuaauauucuggcugcaggcagugcuucugcuucuu

SEQ ID NO: 4106119 - RNA, 55 nt, Human
gagagcuccuucaggaagcuucaaggucaggagccaucugcuaaggggagcuauc

SEQ ID NO: 4106120 - RNA, 69 nt, Human
gagagcugaggggccuggcacugggagcaagcacugggcugugcgucaccgagugccagcucugcuuuc

SEQ ID NO: 4106121 - RNA, 104 nt, Human
gagagcugcccagacaaugagcuguugggugaguacucggagugcuuuggagaugauccacacuccugaaguauuguuugaguaaaagcagugucugaguucuc

SEQ ID NO: 4106122 - RNA, 60 nt, Human
gagagcugggggacuguggaugucaucugaaauccaguuuuggcagucaucugagcuuuu

SEQ ID NO: 4106123 - RNA, 57 nt, Human
gagagcugucacauagagccagaacaauaaucugucugucucaguaugacagcacuc

SEQ ID NO: 4106124 - RNA, 110 nt, Human
gagaggaacaugcuucuggauuuaguuggcauuuugugacuacggcugcuaauugcuaaauggcuuggcugguuugacaaacugacaaugauccauguauuuaaacucuc

SEQ ID NO: 4106125 - RNA, 70 nt, Human
gagaggaaugaauuauuugauaauuuaaaaauuauucucuaugaagucagaugguuccaucauuuuucuu

SEQ ID NO: 4106126 - RNA, 62 nt, Human
gagaggacagucagcucaggguguugguucuacuuagucauugugagcuggcugagccucuc

SEQ ID NO: 4106127 - RNA, 56 nt, Human
gagaggagagaauaaagcccaaguggcaucuuuggggcuucuggucauuccucauc

SEQ ID NO: 4106128 - RNA, 63 nt, Human
gagaggcaccuucacaccugauucacagagaugucacugaggcucagagagagggugccacuu

SEQ ID NO: 4106129 - RNA, 63 nt, Human
gagaggcagggaguagcugaauucugguguucagguuuuuaaguucugccuccccagucucuc

SEQ ID NO: 4106130 - RNA, 55 nt, Human
gagaggccagcagugccuaucugucuugagagucaggagaaccuguggcucuuuc

SEQ ID NO: 4106131 - RNA, 88 nt, Human
gagaggcgaguaauauccugacauucagguguucaaugccagcugucagccucuggccccugccaguguuaggaaugauuccccuguc

SEQ ID NO: 4106132 - RNA, 86 nt, Human
gagaggcugggagauugauucaauuaagauuagcagagucggaaaaauggcauggguuaguuuugauuaguauugucuucucucuc

SEQ ID NO: 4106133 - RNA, 75 nt, Human
gagaggcugucuggaggcacuuucucaugaccucucgaguucugaugaguuauaaggccucuuaccccaccccuc

SEQ ID NO: 4106134 - RNA, 56 nt, Human
gagaggcuugugugaagaacaaguacacagcucacuguucuuccaauaaggcuuuc

SEQ ID NO: 4106135 - RNA, 73 nt, Human
gagagggacuggagaaagggaacuuacagagugauaacuggucucuccaauaacuuguuuuuuccucccuuuu

SEQ ID NO: 4106136 - RNA, 57 nt, Human
gagagggagugagacacaaaagaacaaagcuuggaguccuguucauuacuuccuuuu

SEQ ID NO: 4106137 - RNA, 55 nt, Human
gagaggggcacagcagcuguugcacaggcuggugcaagauucccugcuucuucuc

SEQ ID NO: 4106138 - RNA, 89 nt, Human
gagagguauuaaaauccugcuggccuccacuugcuccucuuccccguggagcaaggagcacugagccagcauggguauaucuggcuuuc

SEQ ID NO: 4106139 - RNA, 89 nt, Human
gagaggucaagaggcucauuaaaagucacacagcuggugaguauuaucauuacaaacaggcuguacuucuaaucaucucuuauccuuuc

SEQ ID NO: 4106140 - RNA, 57 nt, Human
gagagguccauuccccugucagaccagucuccgugccugcagggcucugcuucucuc

SEQ ID NO: 4106141 - RNA, 83 nt, Human
gagaggugaauaauuucaguagaaaaucuugauucuagucucaagagaugaaguuaagauuguuuuuaaccugaaggccucuu

SEQ ID NO: 4106142 - RNA, 56 nt, Human
gagaggugacaggacaggagcuggugaaccucaccuggacaccugcugucaucucc

SEQ ID NO: 4106143 - RNA, 59 nt, Human
gagaggugagucauuaccuagugaaaccagaagcccacaggucuccagcaucaccucuc

SEQ ID NO: 4106144 - RNA, 93 nt, Human
gagagguugggugcuuugcugaggguugcacagcaaaugaguggcagggcagaaucuguccccuagucugcuggccccaacacacaaccucuu

SEQ ID NO: 4106145 - RNA, 80 nt, Human
gagaguaauauaaauggcucaaauuaggcucuauuuggaugaugguccaacugagugauuuaagcuauuuuuaacgccuc

SEQ ID NO: 4106146 - RNA, 86 nt, Human
gagaguaggagguggggaggugacugaaugcuagcaagagaaugaggcaagauucauaccguuucuucuccaucacucugagucuu

SEQ ID NO: 4106147 - RNA, 125 nt, Human
gagaguccaccucagucaagaacuccuuccucugaaauggcuuggaaaaaucaauuugccuuccugucugagauuucuuggucacuuuucacggacauagguguccuugguaugcaguagcucuu

SEQ ID NO: 4106148 - RNA, 63 nt, Human
gagagucccugggucuguuccaucuaaacacuguugaagcaagagacagaucugagggaccuc

SEQ ID NO: 4106149 - RNA, 58 nt, Human
gagagugauuuuggucugaguuccaggcacugcuggugagcuccugaggguuacuuuc

SEQ ID NO: 4106150 - RNA, 81 nt, Human
gagagugggggaugcugaguuggaaacacacaauucagugugguuuucaaaugauuuugcguuuuccaaaaccugccucuc

SEQ ID NO: 4106151 - RNA, 66 nt, Human
gagaguuacauagugggacuggaggcuuugcaccaaaucuuuuaucacucccacugcuguagucuc

SEQ ID NO: 4106152 - RNA, 65 nt, Human
gagaguuaguuuggcugcagaaucgguaauauuagccucgugcguucugggccaugcugcuucuc

SEQ ID NO: 4106153 - RNA, 77 nt, Human
gagaguuguuguacaaacuaaaugaguuaauauauguaaucgauuagaaugcaauuuaguuucuaguaguggcucuu

SEQ ID NO: 4106154 - RNA, 62 nt, Human
gagauagaaguaaagacuugagauacugggauuauccauuaucacauggacuuugcuuucuu

SEQ ID NO: 4106155 - RNA, 71 nt, Human
gagauauaguuuuaaauccaaauugaggaaguguuauauuauuucaacacuuuuggaauuaguggugucuc

SEQ ID NO: 4106156 - RNA, 66 nt, Human
gagauauugcaggacaaugauggucccucugaaggcacuagggaagcaucucuguucugucuucuc

SEQ ID NO: 4106157 - RNA, 129 nt, Human
gagauccaguugauaagggaauugaaagaaauagaggacagcuggaucacacuaaugaaagccauuuaugacuccuaguugcugaagucucuguagcuuuuuagguuaacuucuucuacgucaggccuc

SEQ ID NO: 4106158 - RNA, 73 nt, Human
gagaucuacauuccaaaggaaacuggcuagggagaccuuuaagccgugccuacucuuuggaggagggacucuc

SEQ ID NO: 4106159 - RNA, 84 nt, Human
gagaucucagggcagauggaacuuccccgagagaaggaccucuuucucaggccucugggaaguccucugucaugcucaugucuc

SEQ ID NO: 4106160 - RNA, 125 nt, Human
gagaucugacugauagagacuuuucagauguuuugcccuuuaggagaacguggauccuuggggaucuucaaauuguuuugucuaauagggcagguuguguguuacacugugucaugccagguuuc

SEQ ID NO: 4106161 - RNA, 66 nt, Human
gagaucugagucauugcagauguggaggcagauaccaucuguuccaaggcgauggcgcagaaccuc

SEQ ID NO: 4106162 - RNA, 130 nt, Human
gagaugaaagcugcccaggauggggauuacagcagugcccgagcgcucuucauuaucgagacacuucuggaggugacggggccucguuguaaaaugccuauuuucccauauuuuccagucucaaaagcuc

SEQ ID NO: 4106163 - RNA, 76 nt, Human
gagaugauaaagccuugugcucauguccuuucacugcaucgcugggugucaauggaggugacaugaguguuuucuc

SEQ ID NO: 4106164 - RNA, 102 nt, Human
gagaugaugccacuccagguacuugaagacgcacugacucguuuuugucuuugcugaugcguguacagucuaucuuuuuuccaucucaagucuagccaucuc

SEQ ID NO: 4106165 - RNA, 77 nt, Human
gagaugcagaucaccacaugcucaccaagucccuggaguaaaggacuccagacucuggaguugucugaucucaucuc

SEQ ID NO: 4106166 - RNA, 60 nt, Human
gagaugcaggcuccaagcaagaagucaggagacuggggugcugggcagguguuugaucuc

SEQ ID NO: 4106167 - RNA, 60 nt, Human
gagaugccagcagaaauaaauacuugacuuuuaguacaagauucuuuuuugcugguccuc

SEQ ID NO: 4106168 - RNA, 55 nt, Human
gagaugcuauggcuauuccccugaagcagcaggguggagagagugacagcaucuu

SEQ ID NO: 4106169 - RNA, 92 nt, Human
gagauggagucucgcucugucguggaggcuggagugcaguggcgcgaucucugcucacugcaagcucccccuccuagguucacuccauucuc

SEQ ID NO: 4106170 - RNA, 99 nt, Human
gagauggagucucgcucuguugcucaggcuggugugcaguggugcgaucucagcucauugcaaccuccaccuccuggguucaagcgauucuucugccuc

SEQ ID NO: 4106171 - RNA, 79 nt, Human
gagauggauaacauagcauggccugugacacuuuguaagugcugcaaaaagucauauucuuguuccuucaauccauuuu

SEQ ID NO: 4106172 - RNA, 88 nt, Human
gagauggauaaggaguggggcauaucacagaaucccagaauaggagaugcagaaugucuuuggaaaugaccccgucuaagucuggcuu

SEQ ID NO: 4106173 - RNA, 63 nt, Human
gagauggccagugccaggacaacaguggggaagcugugucuuuuccuaagcucuggcagucuu

SEQ ID NO: 4106174 - RNA, 84 nt, Human
gagauggcgucucacccaggcuagagagcaguggcacgaucuuggcucacugcaaucuccgccuccuguguucaugcaauucuc

SEQ ID NO: 4106175 - RNA, 69 nt, Human
gagaugggaggaucacuugaggccaggaguucaagaccagccuggucaacagagugagacccccaucuc

SEQ ID NO: 4106176 - RNA, 75 nt, Human
gagaugggcuuccagacgaucauguaagaccacuacuugugagguuuuccaggagagucuagagaacuccaucuc

SEQ ID NO: 4106177 - RNA, 76 nt, Human
gagauguacaauguguauuaauuaacauuuuaggaguuguggauauuaacuuucauugauauauaguguauguuuc

SEQ ID NO: 4106178 - RNA, 75 nt, Human
gagauuaagacaagccucgcauuuguaagguuaacagggaagaugcaccuuuuaaagugaguuuguuuuguuuuc

SEQ ID NO: 4106179 - RNA, 106 nt, Human
gagauuaaguggcuuacccaaaguuucacaguuagcaugaggacuacuggggauucaaauucaagucugugacucauuggaucucacuuuuuaagccuuuaaucuc

SEQ ID NO: 4106180 - RNA, 73 nt, Human
gagauuaaucacagaaaugcccauucagccuuaauuauaaugauggucuggcuugcauuucugagauucccuc

SEQ ID NO: 4106181 - RNA, 111 nt, Human
gagauuacaugcuuuguuuuaauacuuuggucacuauuauuggcuuuguccuucuugauacaauucuaaaguacauauggcuaaauaguggaacaaugucuugucuugcuc

SEQ ID NO: 4106182 - RNA, 85 nt, Human
gagauuauggccuggguucuuggcacagcaggauucuaggguguuuguuuuucauuccugucccaagaaugcaccugauaaccuc

SEQ ID NO: 4106183 - RNA, 75 nt, Human
gagauugaagguguggaaaagccccacaggacucgcuaggcaaggcggcugucccuugucccaccuugcaguuuc

SEQ ID NO: 4106184 - RNA, 59 nt, Human
gagauugaguuuccuacugguccagcagaaggggcccagagcugauuaaacuuaaucuc

SEQ ID NO: 4106185 - RNA, 56 nt, Human
gagauugcgcaaccuccugggaaccauuucacuuccccagaagguuugccacuuuc

SEQ ID NO: 4106186 - RNA, 77 nt, Human
gagauuguuuuuguaucugucauauaguuuuaagugguugaaguuuauaggacuuucuucagaugagaugcaaucuc

SEQ ID NO: 4106187 - RNA, 56 nt, Human
gaugaggcuugauuugcccgagagggauuguuucccccuucuuacucaagcucauu

SEQ ID NO: 4106188 - RNA, 68 nt, Human
gaugaguacugugacaguugccagauggcaaauauucaauugcuguuggccuuucaucaguaaucauc

SEQ ID NO: 4106189 - RNA, 113 nt, Human
gaugaguauaguuugaaucuaugaggauauucacuguuaaguaugaaguaaggcagucucauuguugagcaaacagcuuaacaguguccucaagaauucaggcucuuuccauc

SEQ ID NO: 4106190 - RNA, 55 nt, Human
gaugagucauucacagucgugaaugccaaauaaucacagauauggaagacucauc

SEQ ID NO: 4106191 - RNA, 58 nt, Human
gagguugaggguggagacaucugcugucuuagaaguccagucuuggcucucaaccauc

SEQ ID NO: 4106192 - RNA, 110 nt, Human
gagguuggagaacugcuuuugcuacagggcuuugauguccaugaggagaagguauuucuccuuccugcagcacaaaccccuaaauggcaaaugcaaucgcucauaacuuc

SEQ ID NO: 4106193 - RNA, 72 nt, Human
gagguuggugcaaaaguaauugcgguuuugucauuuaaugguaaaaaccucaauuacuuuugcaccaaccuc

SEQ ID NO: 4106194 - RNA, 89 nt, Human
gagguuguguaacuuguacacggucacagggcuggggagauucaaaccccaaacccaucugucugucugcagaucacacacacuaccuc

SEQ ID NO: 4106195 - RNA, 55 nt, Human
gagguuucaccaugauuuuuagcugucucuacauagcuggaaugauagagaccuc

SEQ ID NO: 4106196 - RNA, 90 nt, Human
gagguuucuagcagaaguugcaaacuagggguuuccauuugcucuauuuaccuggaagucucuugcacuuacuuuuuucuagucugccuc

SEQ ID NO: 4106197 - RNA, 81 nt, Human
gagguuuugcuuccugggucuggagacuggagccaagcccuggguccaagccucccugacccagacaggagacagggccuc

SEQ ID NO: 4106198 - RNA, 58 nt, Human
gaguaaaaguuggauuacaaaggcauaugaagugccuugugguugcaacuauuugcuu

SEQ ID NO: 4106199 - RNA, 82 nt, Human
gaguaaacaacaaaugaauuccuugaucucccggugcucaaaggaagcaaggcucggucagggugauucccaguugguacuc

SEQ ID NO: 4106200 - RNA, 81 nt, Human
gaguaaagucugauuuaguuuagagggcaaagauuuauuaaagaaagucauuugcaaaccaacaagaugaagacgaugcuc

SEQ ID NO: 4106201 - RNA, 61 nt, Human
gaguaaaucgucauugcagcauacacugauuuauggcaauuuuuguuggaaugaugaacuc

SEQ ID NO: 4106202 - RNA, 107 nt, Human
gaguaaaucuuuccaaaaaccuagauuuuuguguaaaaugagccuaaagucaauuggcaugcuaggcauuuuaugggaauaaauugggugcuuugugaaguacacuc

SEQ ID NO: 4106203 - RNA, 70 nt, Human
gaguaacauaccaaaauucacaugacuauucuguuacagaucuggacuuugaauuuuggcuuguuugcuc

SEQ ID NO: 4106204 - RNA, 66 nt, Human
gaguaacauaguuugugcuucaucauugcuugcuaguuggaggagucacaaauucuguagaugcuc

SEQ ID NO: 4106205 - RNA, 72 nt, Human
gaguaacuaucauccugcugccuuuguuuauaauuuccuuaacuuagaaaucuaggccgggugcgguggcuc

SEQ ID NO: 4106206 - RNA, 121 nt, Human
gaguaagauggagaauuuccuugcuuuucccaagacuugccauuuagagguuaaaccugacccuaauuagagacugcaaugagugguagggaguggggcaaggaggucaaaagagggacuu

SEQ ID NO: 4106207 - RNA, 62 nt, Human
gaguaagggagcagaagcugugaaaugcuguauugcccuuucacagcgucuuucucuugcuu

SEQ ID NO: 4106208 - RNA, 68 nt, Human
gaguaaggucugacucuuugccacauagacauuaaccucugugaccuugggcaagucaguccuaacuu

SEQ ID NO: 4106209 - RNA, 60 nt, Human
gaguaauauucuguacuggaggcuguuaagaaacauagaugcaauagacagaauauauuc

SEQ ID NO: 4106210 - RNA, 82 nt, Human
gaguaaugguguugagucucucuucacauguccuuuggccauuuggauaucccauucugugaggugccuaauaccgugacuu

SEQ ID NO: 4106211 - RNA, 56 nt, Human
gaguacacagccccugaaggcaaugcuccauaaaugcccaggaucuggcgaugcuc

SEQ ID NO: 4106212 - RNA, 60 nt, Human
gaguacaccugugugccuggcaacauccagcucuguguuucugcuccauugaggugucuc

SEQ ID NO: 4106213 - RNA, 69 nt, Human
gaguacucaguggcaaguccgguauugaaguugggccugucuaacuacaaagcuuguacugugugacuc

SEQ ID NO: 4106214 - RNA, 129 nt, Human
gaguacuuacuuacuuuauagaauuauuuuuaguuccaaauuaauauacuauauguuagauauaccagucuaagacauuagaacauuaauauugggaguucaggguagaguuugugaccuauuguacuu

SEQ ID NO: 4106215 - RNA, 76 nt, Human
gaguagaaggaugagacaauacgaaggccagaagaggaauacuuuuuuccuagcgauuugucagcauucaguauuc

SEQ ID NO: 4106216 - RNA, 129 nt, Human
gaguagaucuuuugggaaauauauacggaaguggauuaaguuugacuaacuuuauguaagccacaucuagaagagaacaguuacaaagaguuuggucucuagauuuauuuguacccagcagaucaacuu

SEQ ID NO: 4106217 - RNA, 70 nt, Human
gaguagccauugacuuaaagcuuauucaggaaaaaccaccuuucaaauaagacuucgguuagugccacuc

SEQ ID NO: 4106218 - RNA, 71 nt, Human
gaguagcuggguugaggucaucuacgucugaaaucucucagaccacugugguaggugagaacccagcucuc

SEQ ID NO: 4106219 - RNA, 56 nt, Human
gaguagggguagggaauuugacagaccuagguuuaaauucugucugccgcuuacuu

SEQ ID NO: 4106220 - RNA, 83 nt, Human
gaguaguaaagucuaacacacuggcccccaguacugacagauuuccuguuauacagcauugcuagugauguagauuuacucuc

SEQ ID NO: 4106221 - RNA, 76 nt, Human
gaguaguagagagguguguccuagguaugcauuaauaaauagucuugcacacaguucgugcuuuucuauucugcuc

SEQ ID NO: 4106222 - RNA, 65 nt, Human
gaguagucacauugggaauguaaguuaucugcuccuacaacuuauuuuuccugcuggaucugcuc

SEQ ID NO: 4106223 - RNA, 65 nt, Human
gaguauaaguaauuucaagcaagaucccugauuauuucaaggcaaaauugaaguuauuuacauuc

SEQ ID NO: 4106224 - RNA, 56 nt, Human
gaguauagcauacugcugagcaauuucagagauggcuccagcaguaugcuauacuu

SEQ ID NO: 4106225 - RNA, 76 nt, Human
gaguaucaguggaagugauacguguuuauuuccagguuaagacuuggaaacacugcauguucaccccaccauucuc

SEQ ID NO: 4106226 - RNA, 88 nt, Human
gaguaugagguggaggucaggcaauauaggcuuugcaaaaggaggacuuaucuauugcuuucaguugcuuugagcuuuuucucugcuc

SEQ ID NO: 4106227 - RNA, 83 nt, Human
gaguaugguuaucaaaggaagcaaagguaacaguuauaaccaggggaccaacuccugaccuuaguuuccuugugacugaacuu

SEQ ID NO: 4106228 - RNA, 84 nt, Human
gaguauuuggauauaaugugggaagagcaguggcagcaguuggaucugauuugcuaccucuuccuaaucguauacuagaaacuu

SEQ ID NO: 4106229 - RNA, 75 nt, Human
gaguauuuuacagcuacuguccuauuuccaguccccuuccucuggacggcuaugggaugugcuguggaugcccuc

SEQ ID NO: 4106230 - RNA, 67 nt, Human
gagucaaaagaguaaagcaaagcacuugugucacaaaacgcuguuugcuuauugauuccucuggcuc

SEQ ID NO: 4106231 - RNA, 73 nt, Human
gagucaaggcacugaauauccaguaaaauaaaauagcuuucuuguacugucuccaguagccuaguuuugauuc

SEQ ID NO: 4106232 - RNA, 64 nt, Human
gagucaccaugauguaguaaaaagaucaagaucaagaccuuggaucugguuucaucauggacuu

SEQ ID NO: 4106233 - RNA, 75 nt, Human
gagucaccuuucccagaagccaggccauucucugguuccuccugcaggcucagaguggccuggcuaggguggagc

SEQ ID NO: 4106234 - RNA, 59 nt, Human
gagucagaagaaacuauuuacaggccagagaggugcagccugaugggucauucuggcuc

SEQ ID NO: 4106235 - RNA, 76 nt, Human
gagucagauuuggcuuccagccccagcucugcugaaucugagcagccagacccuggggaaagucacuuccuuucuc

SEQ ID NO: 4106236 - RNA, 93 nt, Human
gagucagcagggcauaggggaacuggcacagggcaggggccacgggagagauaacccagcccagagccaguucccgcuugcucguccugacuc

SEQ ID NO: 4106237 - RNA, 55 nt, Human
gagucagccuucugaggaccugggagcagugauguuucccaggcaaaggcuucuc

SEQ ID NO: 4106238 - RNA, 55 nt, Human
gagucagguuucugccuauagagagacacauuccugaaggcuuaacucugaccuc

SEQ ID NO: 4106239 - RNA, 60 nt, Human
gagucaguagucacccaguugcagagagcagaagauuucucacuggaauacaauugauuu

SEQ ID NO: 4106240 - RNA, 59 nt, Human
gagucagucuugagccaugcuggagaggaacaaguauucuuuagcaaaagggacugcuc

SEQ ID NO: 4106241 - RNA, 78 nt, Human
gagucauauucccaguggggaccucugggugacaauguagcacaugccucagaguugucccuaccaaggaauauuuuc

SEQ ID NO: 4106242 - RNA, 87 nt, Human
gagucaucccaggcuggcagggugguugagagaggugugucacuccucaccuccccucaccucuccugcuuccugcacccauggcuc

SEQ ID NO: 4106243 - RNA, 55 nt, Human
gagucauuguuggucccuccccucuguucugagauggcaggaccccaguggcauc

SEQ ID NO: 4106244 - RNA, 74 nt, Human
gagucauuuguaauuucuuaucuguguacacuagaugacaaacaucaaaacauaaaaggaagugacaaagauuc

SEQ ID NO: 4106245 - RNA, 76 nt, Human
gaguccagccaacaccuugauaguuaccugugaaagacccugaagcagaggacucaaucaagguaugcuuggauuc

SEQ ID NO: 4106246 - RNA, 62 nt, Human
gaguccaggagacaaagaugacugcugaaauucaucaccugcagccacuucucuccuuccuc

SEQ ID NO: 4106247 - RNA, 68 nt, Human
gaguccagugauguuccuggucucuccccagaaguacagacagguugggccacguuaacacuggacuu

SEQ ID NO: 4106248 - RNA, 55 nt, Human
gaguccaguucuuuccagcagugaccacaugguacccugggaugggcuuggacuu

SEQ ID NO: 4106249 - RNA, 57 nt, Human
gaguccauugagauuggaauuuuaaucaauucaagagauacugauucucaauggcuc

SEQ ID NO: 4106250 - RNA, 60 nt, Human
gagucccacccacucaguauagacuccaggauccaggaguccagagaagggaggggacuc

SEQ ID NO: 4106251 - RNA, 62 nt, Human
gagucccuagucgcaucuguggagaaugcagccauugagcugcggucccagugaagggucuc

SEQ ID NO: 4106252 - RNA, 84 nt, Human
gaugguggcagcagaacaugaaacccauugcgggguccuucuaagcacuggguuccaugugacugcgcgguucauaagcccauc

SEQ ID NO: 4106253 - RNA, 97 nt, Human
gauggugucagagaucaacugaauuacuggacaccuagcugguguucagagaauuggauaauucguugaugugaaaagaaaccucugauuugguguc

SEQ ID NO: 4106254 - RNA, 80 nt, Human
gauggugucaugaauauaugcauaugucaaaacuuaucaaauuguauacuuuaaacaugugcaguauaccuuaugccauu

SEQ ID NO: 4106255 - RNA, 58 nt, Human
gauggugucuucugaugguccugggcugguucaggugccacucucaugggcuaccauc

SEQ ID NO: 4106256 - RNA, 68 nt, Human
gaugguucagggcacccagggguuccaugcugccacagaaaccacccuggggcacuugaguccucauc

SEQ ID NO: 4106257 - RNA, 77 nt, Human
gaugguuguuugcugugacaccugugugaguguuaacaugaacagucaacagaguggccgcagcguguagcgccauu

SEQ ID NO: 4106258 - RNA, 87 nt, Human
gauguaaugaagcagcuuugccuuacgcuuuacccauggagccauuguuugcuacaaguuucugaagcaggccuacuucauugauuc

SEQ ID NO: 4106259 - RNA, 104 nt, Human
gauguacagaaggggaauugggguugaugccuugaauagaauggcuggaaaauucuaaaaguauacuuucaaaggagacaacccucaaaucucuucccuaaauc

SEQ ID NO: 4106260 - RNA, 98 nt, Human
gauguacagcuuuuagaaucagguugucugggugugaaugccagcuucccucuuucccagcuggcuaucccagccaagugaucugaccgcccugcauc

SEQ ID NO: 4106261 - RNA, 87 nt, Human
gauguacuauggccaccaucucuaaaacacagcagcacuacuuacuuuacugccaguaaguugacugagaugugguuuuaguucauc

SEQ ID NO: 4106262 - RNA, 58 nt, Human
gauguacugaccacgguuaccaagggagcaguuuccuuggcaauggccaacagucauc

SEQ ID NO: 4106263 - RNA, 83 nt, Human
gauguagaacuggugggcagauuuaagauauuuguauugcaauaguccagugagaagcugucuuagaucagugcaguagcauc

SEQ ID NO: 4106264 - RNA, 94 nt, Human
gauguagagaagaaggcagacugaaaagggaguuuagggccaaagcaaugacauugcaaugaguucccugaguuuucuuucugacucauauauc

SEQ ID NO: 4106265 - RNA, 81 nt, Human
gaggccagcucuacccuuggacuuccuaaguaaugagcuaacacacuccccuccugcuuagucuaguuggaguugagucuc

SEQ ID NO: 4106266 - RNA, 59 nt, Human
gaggccaggggccuggagaugaaggagaccagacgucgugcuguagagcccccgguuuc

SEQ ID NO: 4106267 - RNA, 81 nt, Human
gaggccagggugggggcaggugcuuuuagaaguugcucuauugggugagagcccugcuccuaucccagaaacaccagccuu

SEQ ID NO: 4106268 - RNA, 56 nt, Human
gaggccagugugcuguguuuucugaaauaggaaggaaacaaaccacagugagccuu

SEQ ID NO: 4106269 - RNA, 94 nt, Human
gaggcccaaagagggugugcagggaagggcaugcuauuggcaaagcgaugaagauggugaugcuuuucugauuugugccucccucuuugggccc

SEQ ID NO: 4106270 - RNA, 65 nt, Human
gaggcccaauuucuucacccgcaaauuaaagaauuugacuaaacgugggaggaaaaaugggcuuc

SEQ ID NO: 4106271 - RNA, 83 nt, Human
gaggcccagauucuaauucagagacucauucuggagcucaagcuuuuaacaaugauuuucugaaaccugucuuaccuggccuu

SEQ ID NO: 4106272 - RNA, 122 nt, Human
gaggcccaugcauaggauucaggcucaaucugaaacaggucugggcucagccucagucuguggcuggcagcccaguccagcucacugggcccgacguggccugcguccaugugcuuggcuuc

SEQ ID NO: 4106273 - RNA, 73 nt, Human
gaggccuaacagucaaaugucuaucuucuucucaucaccaagaagugaugcuacgacuuugacauagugucuc

SEQ ID NO: 4106274 - RNA, 76 nt, Human
gaggccuaagacuccuaaauagccguuggaaggguaguguuuuuccaagggaauguuuaugaguaacuagaggauc

SEQ ID NO: 4106275 - RNA, 59 nt, Human
gauaagcacauuuuccagcagcucuggagucauggcugcuuacaaaaacugugccaauc

SEQ ID NO: 4106276 - RNA, 94 nt, Human
gauaagcccccaauaaacaugggcuaauucuuugauuguuuugaggaaaagaaagacaaucugaaugugaauggcauauguuuauuagguuguc

SEQ ID NO: 4106277 - RNA, 72 nt, Human
gauaauaaauguguguuauuugaugcuguuaaguuugagguauacagcaacggaaaauacacauagggaauc

SEQ ID NO: 4106278 - RNA, 65 nt, Human
gauaaucuauuggucuccacuuguuuuagagacaacucucugagcuauguaagacuuggauuuuc

SEQ ID NO: 4106279 - RNA, 62 nt, Human
gauaaugagcuuuugaauacugauuuuauaugacacagggucauauuuaaaagcuuuuuauc

SEQ ID NO: 4106280 - RNA, 96 nt, Human
gauaaugaugaagaugacagugaggugcccagccugccccugggacugacaggagcuguugaauauacuucauuugcuucucuguauaaucuuguc

SEQ ID NO: 4106281 - RNA, 63 nt, Human
gauaauggccgggggcugaaugcugcugaacaguaaagagcauagaugccaaaggucauaauc

SEQ ID NO: 4106282 - RNA, 66 nt, Human
gauaauuuugagagucauuuaagguguuguguaccucugucguagcaccugucuuuuaaaaauauc

SEQ ID NO: 4106283 - RNA, 81 nt, Human
gauacaagggcaguggauguuugcugggcaguaggacaaauacucgagugcauuacuuuggcaaacuccugcccuuggauc

SEQ ID NO: 4106284 - RNA, 80 nt, Human
gauacacacucagaaacauuguuuaccugucccuuuugcaagcauaagaggacuugugaagauguacugccuguuccauc

SEQ ID NO: 4106285 - RNA, 65 nt, Human
gauacacuauuuuacugauacaaaucuaccagaaacaggagauuugugguuggagagauuguauc

SEQ ID NO: 4106286 - RNA, 75 nt, Human
gauacagaaggacaguaccacucaugagcucacauuugggcuggcucaaugaaugcagcacuguuuuucugcauc

SEQ ID NO: 4106287 - RNA, 90 nt, Human
gauacaggagacagcuaucaggcucagccacaggggaaggggaugcucucucuaaggugcugggucucaaacuugguuguacauuguauu

SEQ ID NO: 4106288 - RNA, 58 nt, Human
gauacaguguguuaacgagaaacauugcaaauauuuuuuccuuuggacaggcuguauu

SEQ ID NO: 4106289 - RNA, 120 nt, Human
gauacauaccugcaacugugacugucaacuugcuauuaaugacuaagcaaucaugaauagcaaguugcuauuaaacagucauuaauagcaaguugacaguuuuaggugcaaggauguauc

SEQ ID NO: 4106290 - RNA, 83 nt, Human
gauacaugagaugcacguuuauuugcuugugauuucuuuuucuugaaaucaggauccaccuugagccugauaucuacauuuuc

SEQ ID NO: 4106291 - RNA, 67 nt, Human
gauacauuucaaggaggacugggcagcugcacuugugagcggugacagaucucugugaaauauaauc

SEQ ID NO: 4106292 - RNA, 129 nt, Human
gauaccuauuccuugucaaauauuugaagguaugaaaguuaauuuugaaugucuuuuugccuuuuaauagagucaggaacauuguagaauugaaacuguauuauuuuuucuauuucccaccagggguuc

SEQ ID NO: 4106293 - RNA, 72 nt, Human
gauacguagcucuuugagauugguucuugucaucaacugacaugcccucaagauccauucaaauuauguauc

SEQ ID NO: 4106294 - RNA, 81 nt, Human
gauacguauuaugggcugcaaugcuucaguuguugagaugcagcacuuagcauuuguagagugccagcccucugcuguauc

SEQ ID NO: 4106295 - RNA, 55 nt, Human
gauacuaggcauggcugggcauccgacauucaggggagagcuagggccuagaauc

SEQ ID NO: 4106296 - RNA, 108 nt, Human
gauacugguuuguuuuauacuugcaucuaagguggauaacuucuccccuuaggggagaauggcuggaaguuauccaccuuagaugcaaguauaaaacagaccaauauc

SEQ ID NO: 4106297 - RNA, 75 nt, Human
gauacugugggauguugugauuagaaugucagcugauaaacauagcuagaaacuauagcaacaacuuaugguguc

SEQ ID NO: 4106298 - RNA, 90 nt, Human
gauacuuaacacguucauggucuguuaggagcuacuuuuguaugcuucacugaaagugccccagacaagaccccugaugugugugugguc

SEQ ID NO: 4106299 - RNA, 58 nt, Human
gauacuuuccauccaaaugcauuccuacugaaugcacacggacagaguggagagaguc

SEQ ID NO: 4106300 - RNA, 69 nt, Human
gauagaaagcugcagaucuuguguacuugucugagcucagcguuuaagugaugaucgucuuuuuuuauc

SEQ ID NO: 4106301 - RNA, 87 nt, Human
gauagaacccucugaagacucauuugagacgaugauggagcauaagaauccaucaucaaaacaaauggaguccuccgagggcucauc

SEQ ID NO: 4106302 - RNA, 86 nt, Human
gauagaagcagaggcagaggucaucucugggaguggggagggaguagcucaagccaaggccggcccucugaccugcugcuaauguu

SEQ ID NO: 4106303 - RNA, 81 nt, Human
gauagaagccagaaucagaugccuguggggucuaggguaaacccugccugcagaaaguaucuccagaauuuggcugaaauc

SEQ ID NO: 4106304 - RNA, 120 nt, Human
gauagaggcugggcauggucucucuuggcuuaauugugguucucugcuuacggagauguaccuggcaagcccaguauugagcuacaggccugagaugucuugcuuugcuagccuucuauu

SEQ ID NO: 4106305 - RNA, 59 nt, Human
gauagagggccgcuggagccugguugucacacacaauuaauaucccccgccguucuguc

SEQ ID NO: 4106306 - RNA, 90 nt, Human
gauagaguuggaaacuaguaaguggauuuaaagaaucucugugacuuauuccugagacuuuagauacgucuucuucuuuuggacuaaauc

SEQ ID NO: 4106307 - RNA, 70 nt, Human
gauagcaaaucgacuguagagacuuggcggcgguggcauugccccaggucgucagcagugugguauuauc

SEQ ID NO: 4106308 - RNA, 71 nt, Human
gauagcacaaagaugucaguuugaaauaacacuuucauaaaauguuuggucaauggcaucuuugaaauguc

SEQ ID NO: 4106309 - RNA, 83 nt, Human
gauagcagauuauuugcuuugguccuccaagcauaggcuguguugaggcuggaaggaacaaggaucagaaacaagcugcuguu

SEQ ID NO: 4106310 - RNA, 56 nt, Human
gauagcaggacuucuguuggaacagcuguuuguugauccagcugacauucucuuuc

SEQ ID NO: 4106311 - RNA, 56 nt, Human
gauagcauauaaguuauaaaacugggacaaacacuuaguuuuucagauauguuguc

SEQ ID NO: 4106312 - RNA, 125 nt, Human
gauagccacccaaacaaaguguugaaugauuaguuccacaaaaggucuaguuuaauguacauugaauagaucucugauuguuuuaaaaggggagaaucuuggaaauaucuuuguuaaugugcauc

SEQ ID NO: 4106313 - RNA, 101 nt, Human
gauagcuuguuagaaauacacauucuuggacuccacucuaggccgcucaaaucagaaauucugagggugggguccagcaaucuauguuucaacaagcuauc

SEQ ID NO: 4106314 - RNA, 110 nt, Human
gauagcuuuugcaaaauuuacauacccagcagccuccccaucagcugaauaagaauugcaauguggauguggcagaggcaaucagguaugugggguuagaagaagcuguc

SEQ ID NO: 4106315 - RNA, 65 nt, Human
gauaggcaagugugagggguucuuugauaugaauauucauggaaaagggucuuucauuuccuuuc

SEQ ID NO: 4106316 - RNA, 58 nt, Human
gauaggcagcugcuccagugcacgugugugcauucccugggcuuagcagcuccugguc

SEQ ID NO: 4106317 - RNA, 78 nt, Human
gauaggcauuuuagaauauagguaguuuacuuguuuauuuuguugguaaaucccuacaucuguguuuugauacuuauu

SEQ ID NO: 4106318 - RNA, 92 nt, Human
gauagggccucaauucauaauggaugauuaaauggaugaagagacaaauauuauccaagcuuucuguuuauccacucauccaugccucuauc

SEQ ID NO: 4106319 - RNA, 76 nt, Human
gauagguaaacuuccacguuugaucaugcagcuggaaaacuuaauagugaauuaaauguuggacguauacauuguc

SEQ ID NO: 4106320 - RNA, 55 nt, Human
gauagugaguugauuaggugauuggaaacaggcuucagcuuugcaacugcacauc

SEQ ID NO: 4106321 - RNA, 71 nt, Human
gauagugcuaugcuuggggauaugagacaacuagaauaauuguagcucacauuuaucaggcacuuacuauu

SEQ ID NO: 4106322 - RNA, 76 nt, Human
gauaguguuagaaucuuauuuuuaaaucuuccauagugcagucauuaggagauuuuugaugagguuuugaugaguc

SEQ ID NO: 4106323 - RNA, 68 nt, Human
gauaguuacaaaccaacaggcagcgucucguuuuuguuguuguuguuguuuguuuguuuguuuuaauc

SEQ ID NO: 4106324 - RNA, 106 nt, Human
gauaguuuaccucuuuagccuguuuuaacauuuguaaguuguucuuagccucacaagguuguacaaagauguuuaaagcauuuagcaaaguuccuggaaaacuguu

SEQ ID NO: 4106325 - RNA, 76 nt, Human
gauauaacagugaaaauaaggcugguucuuguuuuuauccacugaggcaaauacugaguuuauuuucaaagguauu

SEQ ID NO: 4106326 - RNA, 57 nt, Human
gauauaacgacuucccaggucuuuacaugucugagcugaaacuggaguccuuauauc

SEQ ID NO: 4106327 - RNA, 85 nt, Human
gauauagacagugggaaaagggcacacaaaggcagcauuugagcauagcuaacauuugcuucuugugccuggucuccuaaauauc

SEQ ID NO: 4106328 - RNA, 83 nt, Human
gauaucagugaacgaacaaaucuuaaaguaauucaaauguaugucaagcauugaaauagagaucugcuuguuugcuuaguguu

SEQ ID NO: 4106329 - RNA, 56 nt, Human
gauaucauaucagacaaccucuguaguaacccacuggugaauugugauaugauauu

SEQ ID NO: 4106330 - RNA, 67 nt, Human
gauaucccaggccuugaugggaguugggguugcauagagcacaauuuuucuuagguccuggcauauu

SEQ ID NO: 4106331 - RNA, 65 nt, Human
gauaucuguucaugaaacuuaacuguuggggcuuagacuucuacuguaaguuuuggagcuauauu

SEQ ID NO: 4106332 - RNA, 61 nt, Human
gauaucuucaauuuagaauggauuuaucugaacauaaccccaucauaaguugaggagcauc

SEQ ID NO: 4106333 - RNA, 65 nt, Human
gauaugaaaagagcugggaacuacaugacaagugucccauuguuucacagcuuuuauucugcauc

SEQ ID NO: 4106334 - RNA, 78 nt, Human
gauaugagaugcgcuagaaguauacucccaccuuugcucucuauuugagagcuacagcuguacucugcaggucauauu

SEQ ID NO: 4106335 - RNA, 73 nt, Human
gauaugagauuugggagggaacagggguggaaugauaugauuuggcucugugucuccacucaaaucucauauu

SEQ ID NO: 4106336 - RNA, 79 nt, Human
gauaugccaagcuuugcaccgguggcuggaggccuagcggggauuccaccggaaaucugguucuagagaaugguauauu

SEQ ID NO: 4106337 - RNA, 60 nt, Human
gagggcccacuaugucugagcaaagcccuucacacaguguacagcaccgaguaggcccuc

SEQ ID NO: 4106338 - RNA, 68 nt, Human
gagggcccuacugagaagucaucaaugguuaaauuucagccuugggggcauauugaguagugguccuc

SEQ ID NO: 4106339 - RNA, 77 nt, Human
gagggcgucugacccauuaccaucuccaagauuaagacacagcacuugaaguuacaugaugaggucauagcacccuc

SEQ ID NO: 4106340 - RNA, 100 nt, Human
gagggcguuugcacaugaaucauuuagcucugcauggagacccuguucucaacuuuuauuucuccuguaggucaggcugaguggaugcucaggaacccuc

SEQ ID NO: 4106341 - RNA, 70 nt, Human
gagggcuaaugauagcaagauaaacaacuaauguuuacagcuaggugcauauccaguuuuauuagcuauc

SEQ ID NO: 4106342 - RNA, 55 nt, Human
gagggcuccacacgggcccagcgcacaguaggugcuuggccaguguuaugcucuu

SEQ ID NO: 4106343 - RNA, 61 nt, Human
gagggcugugggagggccuggaauaugggugacugaacgcagccucuaagcacagccucuc

SEQ ID NO: 4106344 - RNA, 120 nt, Human
gagggcuuacagaucuguggcaagaguaggaagccagggucagaauuugggcagaaaaauaaucaagucaaugucccaggaacauucuggcuaggauucuaccaucagaacuggacucuc

SEQ ID NO: 4106345 - RNA, 79 nt, Human
gagggcuuuucauugaaucucgaggcuauagaagugccuuuuccgauguggauggcacugcuuuauucaugaggcucuc

SEQ ID NO: 4106346 - RNA, 75 nt, Human
gaggggaauuaggucauucccugagcagaugaauuugcuaucugaauuaucuggggaacagaccugauuuucuuc

SEQ ID NO: 4106347 - RNA, 69 nt, Human
gaggggacgugugggcugcacaggauucuggggggcugaccuaggaggggcagcagugcaaguccucuu

SEQ ID NO: 4106348 - RNA, 57 nt, Human
gaggggaggaucagggcugcgacucccagagcacugcagcaggguggucuacuucuc

SEQ ID NO: 4106349 - RNA, 57 nt, Human
gaggggcuggcuguggucccaucgacagugugugaggacagggagcugagcacccuc

SEQ ID NO: 4106350 - RNA, 62 nt, Human
gagggggagaccuccuggaccacugagcaauuaauucauuuacauuaggaaguuucuccguc

SEQ ID NO: 4106351 - RNA, 80 nt, Human
gagggggaggaguguacagguuuauuuuagaguccaggcuggaauuugcauugcuuuuuguggauccacaccucccccuc

SEQ ID NO: 4106352 - RNA, 55 nt, Human
gagggggauggaaaaguuggguugaagucagaauccaagaagagccuuucuccuc

SEQ ID NO: 4106353 - RNA, 65 nt, Human
gagggggcgaacagaagcaaggaucaaaacaaauuccauccuuauuucuuuuguuuucccuccuc

SEQ ID NO: 4106354 - RNA, 66 nt, Human
gagggggcugggauuugaacccagggcugcacaggugaggccuggguuguuuuuucuaaccuccuu

SEQ ID NO: 4106355 - RNA, 56 nt, Human
gagggguaugcaggcaggaggcuccaugugugaguuucaagucucuaggacuucuc

SEQ ID NO: 4106356 - RNA, 93 nt, Human
gaggggugacauggagggagaaguccagggugcgguccccacagcccguggccuccuacgcagcuugaggaugcauccugccucccuccccuu

SEQ ID NO: 4106357 - RNA, 105 nt, Human
gaggguauugcaggaggaaugagaauuauuagaggccagauuguugacagugauaaacagauauuuugguagcucucaaugaaccauuucucuuaucaugcccuu

SEQ ID NO: 4106358 - RNA, 84 nt, Human
gaggguccaggcugagggcggggaucccuggcuuugggaaacccuccucagacagggcuccccgcaccgcagcccuggccccuu

SEQ ID NO: 4106359 - RNA, 80 nt, Human
gagggucccuggcugugcugcaggcuuuggggcuuguguuuucuccauucauuuguugucagccuucuuuauggacucuu

SEQ ID NO: 4106360 - RNA, 59 nt, Human
gaggguccuggcuaagucugacaagugcuggcauacuuuggauucuguuaggcaccuuc

SEQ ID NO: 4106361 - RNA, 83 nt, Human
gagggugcaggugagcaggucaggaaguacauugggcagcugcaugcucagcuaauucaucaccugcuccucugcuuaaccuc

SEQ ID NO: 4106362 - RNA, 75 nt, Human
gaggguggagcucguguuugcucagggcaucccaggucugacguggggacugccuuccacagacacucgacccuu

SEQ ID NO: 4106363 - RNA, 88 nt, Human
gaggguggcaaauaggcaagguaaguaggagcagcccucgaccaucucagaucagcuucuucagccuaccuugaccucugccugucuc

SEQ ID NO: 4106364 - RNA, 84 nt, Human
gaggguggggcugggagggggugggaugggcagcagggaagcucucuccuaucgcccucuggcucuucucaggccgccuccuuc

SEQ ID NO: 4106365 - RNA, 86 nt, Human
gaggguggguagguggggcguggcagggcaggagguagcugcugaccaccugccuugacguaacgcaugacccaucuguuccccuc

SEQ ID NO: 4106366 - RNA, 58 nt, Human
gagggugucucacgugaaaguaaaucgcucauguuuguucuuuuuaaaagaugcccuu

SEQ ID NO: 4106367 - RNA, 127 nt, Human
gaggguucccugguagguucuucacugugaugucugcauauagaaaccauguccuguucuccuuuaugcccaccauaaaaggaagacucgcaggucuauggcugucauggcccucccuggcacccuu

SEQ ID NO: 4106368 - RNA, 81 nt, Human
gaggguugguuucagaggcuugaagcccaagccguuuccaccccauggccuggguuguucagcuguugucuuccguuccuc

SEQ ID NO: 4106369 - RNA, 110 nt, Human
gagguaaaucuuugaguuugaauuuguuuauguucccaagggauagaaagaacuaggaccaaugguuaguuaugaugggagacagauuuuugacucaaugugaagaccuc

SEQ ID NO: 4106370 - RNA, 63 nt, Human
gagguaaguaaccauuccauggcuacacaguggguccuuaauggagcugguacuagcuaccuc

SEQ ID NO: 4106371 - RNA, 61 nt, Human
gagguacagaguguuccaaugucugcuaccaggauggcacugaaauuggcaugcugaccuc

SEQ ID NO: 4106372 - RNA, 66 nt, Human
gagguagacccugaggcaaaggcuagaguuagugguuuggcuccaguuugugccuucagcuacuuc

SEQ ID NO: 4106373 - RNA, 97 nt, Human
gagguaggagaauggcgugaacccgaggcggagcgugcagugagccgagaucgcgccacugcacuccagccugggugacagagcaagacuccaucuc

SEQ ID NO: 4106374 - RNA, 73 nt, Human
gagguaggagugcagaaugcacuuuccuggagucuagaauuucaaaauucuguaucuguacuauuccugccuc

SEQ ID NO: 4106375 - RNA, 128 nt, Human
gagguaugcaccccggaugccugaaggugggcaugagaguggugggugggggcgggugcccuucugaaacugcauucucuacacuccugcccugccuccucauucccuuuuggggaaaaaaauaucuc

SEQ ID NO: 4106376 - RNA, 68 nt, Human
gagguauugacuaugggauggcccaagucuucuagaucugacccuggccaccccuuaguccugaucuc

SEQ ID NO: 4106377 - RNA, 113 nt, Human
gagguauugggaaacuuauguagaugacaucugcuauuugugccugacuagagcaccuucuaacaucuugcaguagcagaacuuagguuuuucuuguaagcccccucuuccuc

SEQ ID NO: 4106378 - RNA, 56 nt, Human
gagguauuugauccucugcagugaaccauaaaaaacuagcgugggaucagaaucuu

SEQ ID NO: 4106379 - RNA, 78 nt, Human
gagguauuuucauggcagacuguaauaggagaauuauaaguaauuuucaaaccacaggucugcaagcaugcauaccuu

SEQ ID NO: 4106380 - RNA, 68 nt, Human
gaggucaaggcugcagugagcugugaucgcgccaaugcacuccagccucagugacagagcaagaccuu

SEQ ID NO: 4106381 - RNA, 89 nt, Human
gaggucacacagcaguugguuaggucaggauucagacugagacugaugcuccguuguccuuguuccuaaccccucugcugugcaacuuc

SEQ ID NO: 4106382 - RNA, 58 nt, Human
gaggucagaaggcaguuaaacaaacuccaacaagccuuuguuuuuaucuucugauuuc

SEQ ID NO: 4106383 - RNA, 103 nt, Human
gaggucagauugaggggagauuucaggagugcagcaguuuggagaucaaacgcacaugugaucuucugaucuggauuccuaacucuccccucuaguagaccuc

SEQ ID NO: 4106384 - RNA, 73 nt, Human
gaggucaugaccaugggaauaaaguuauuucaauaguugacucuuuugaaaaguuuguuacucacaugacuuc

SEQ ID NO: 4106385 - RNA, 69 nt, Human
gagguccagaaauucccauuucagauucugccaaaacauucuagcaggaaaggaaacaauuucaaccuc

SEQ ID NO: 4106386 - RNA, 57 nt, Human
gagguccagagcagguucagugguucaaacgugcucagcuccccuucucugggccuc

SEQ ID NO: 4106387 - RNA, 55 nt, Human
gaggucccccauggcugugacuuagaaaggucaagccaauuuuaugggagaccuc

SEQ ID NO: 4106388 - RNA, 56 nt, Human
gagguccucuguguccgcgggcucgggcgucuccgcagaguggccgcagaggccuc

SEQ ID NO: 4106389 - RNA, 56 nt, Human
gaggucucacuuuguuguccaugcuggucucaaacuccugggcucaaaggauccuc

SEQ ID NO: 4106390 - RNA, 64 nt, Human
gaggucuggggccagauggagggguggggacccacgcuucaguucccagcuggccugggaccuc

SEQ ID NO: 4106391 - RNA, 63 nt, Human
gaggugaagccuguagugaccagaagacaugaaaauucccugagcuucaucaggcuuuuccuc

SEQ ID NO: 4106392 - RNA, 64 nt, Human
gaggugacuuggcuuuuccaucucugcagcacaauugcugugugaccuuaggcaagucaacuuc

SEQ ID NO: 4106393 - RNA, 57 nt, Human
gaggugagcauugggcucagccagaaaugcuccugcccucccagugcucacugccuc

SEQ ID NO: 4106394 - RNA, 67 nt, Human
gaggugagggcccauuucuuaaagaggaugcuuguccagcggcgugaaugauggugcuccucaucuu

SEQ ID NO: 4106395 - RNA, 62 nt, Human
gaggugauggauauguuuauggcauagauuugaugaugguuucaugaauguguucuuaccuc

SEQ ID NO: 4106396 - RNA, 85 nt, Human
gaggugauucuuaaaauacuguggaguguugaaaaaauaucucagugugauuauggguuuuaacacucagcacuaucucuaccuc

SEQ ID NO: 4106397 - RNA, 87 nt, Human
gaggugcacugggcaccaccgggcggugggaggagggaccgucuccauugcucccacacuacucggaggcauucagaaaggcuccuc

SEQ ID NO: 4106398 - RNA, 84 nt, Human
gaggugcaggcacuugcugaggucacggcggccagacuggagcccagaacucugucugcaccuaagcacagugucccuuaccuc

SEQ ID NO: 4106399 - RNA, 90 nt, Human
gagguggaagucguaccuuuggggucaggcccuugagccacagccucuuucccaggccucucagggagccuggacuucaaggccugccuc

SEQ ID NO: 4106400 - RNA, 90 nt, Human
gagguggagucuacagaggcaggcaggcuuccuugaacugugguggacuccacccaguucaagcuuccuggcugcuuuguuuaccuacuc

SEQ ID NO: 4106401 - RNA, 68 nt, Human
gcaagugcaaggcuauucacauguauuaucuauauaauaaugcuucauuugcauagcuuuuuauaugc

SEQ ID NO: 4106402 - RNA, 124 nt, Human
gcaagugcagacagaagacauagaugccccaguacucuugccugccucaucuaggauaaagcaucuuccccaggagaggggacuggaugaggggaaagagacagguacuuccuguuccacuugu

SEQ ID NO: 4106403 - RNA, 56 nt, Human
gcaaguguggcuuaaaaguuuccagagagucagggaagauccaagcaggcacuugu

SEQ ID NO: 4106404 - RNA, 63 nt, Human
gcaaguuagaccauagaaagagcauccaacuuggagcuuggggcauauggugcuaccuucugc

SEQ ID NO: 4106405 - RNA, 79 nt, Human
gcaaguugugaaguuuuacuaggugaauuugcaaacuuacaugcaaauauccucccagaacuccuuucuccaacucugc

SEQ ID NO: 4106406 - RNA, 73 nt, Human
gcaaguuuccuaaucuucaacguggaacaaggaguuacuuaguuuucaaguggcgagauaaggaagcuucugc

SEQ ID NO: 4106407 - RNA, 58 nt, Human
gcaaguuuucauucguuagcauaaccuggguaaaguuuuuuguuaaaugaagauuugc

SEQ ID NO: 4106408 - RNA, 94 nt, Human
gcaaguuuuccugugagcauauguuuucagcucucuuaaguauaugccuaggaauggaauugcugaaucauauguuuaaccuuucgagaacugc

SEQ ID NO: 4106409 - RNA, 75 nt, Human
gcaauaaagaguuuuauguguauguuacuuuccagaaguuuggcaaaguuacuaucacaaugaaauuuccauugc

SEQ ID NO: 4106410 - RNA, 78 nt, Human
gcaauacacacagaggccaugggauuuccaacuggcugucaaaaaggaaaguucugagucccuggccugucugauugc

SEQ ID NO: 4106411 - RNA, 59 nt, Human
gaguaacagcauaaauuugugacuuguuguacuggauaauucaggaguuaguugugcuc

SEQ ID NO: 4106412 - RNA, 86 nt, Human
gaguaagaaacauaucagaaucuacaugcaauauuuuuagggggaaagccuuuguuuucauugauuguagagaugauuuuuugcuc

SEQ ID NO: 4106413 - RNA, 121 nt, Human
gaguaagacaugcugucugugucacaaacauacauuauagauauaaucuuucugaacacaugaauaucuguauauauguguaugugugugagauacuaguacaaauacagcuugcaguuuc

SEQ ID NO: 4106414 - RNA, 69 nt, Human
gaguaaggccaugcuugaguugaaggcucugaaaucuucagaccucacugaggucgugguuuauggcuc

SEQ ID NO: 4106415 - RNA, 62 nt, Human
gaguaaucauagcuaagcuccagagugccugggucaccuggcagucuggcgagcuaucacuc

SEQ ID NO: 4106416 - RNA, 85 nt, Human
gaguaaugcaauuaccauccuuggcucgcucucugugggauguucucacagaucaguggcaaaggguugguaggcuauuuuccuc

SEQ ID NO: 4106417 - RNA, 63 nt, Human
gaguacagaccugucucuuccuggaauuaaggugcccaggauggagggagggcuguuaaacuc

SEQ ID NO: 4106418 - RNA, 72 nt, Human
gaguacagagauagugaauaaauuuaugcucccauagaaauguguguaaauuuauuuacauaaauuugacuu

SEQ ID NO: 4106419 - RNA, 56 nt, Human
gaguacauguauagagauuaaccugaucaaagauuaguuuagccccacgugugcuu

SEQ ID NO: 4106420 - RNA, 76 nt, Human
gaguaccagcaggacccaggaauccugcaguucugggaucugucccuauaggguaguugugggcuugcugugucuc

SEQ ID NO: 4106421 - RNA, 104 nt, Human
gaguaccauugacauaaauaucuguguuuguccaaguucuccaaggagacagaacuauuaggagacacauauacagaaagagauuuauuuuaaaaaauuggcuc

SEQ ID NO: 4106422 - RNA, 85 nt, Human
gaguacgcaggccuccucccacggucucaggaagcccagacgccgcaggcuuccccgccguagaggagcugccggggcguaauuc

SEQ ID NO: 4106423 - RNA, 92 nt, Human
gaguacuugcaucaaguucacagcagcuugucuguucuuuaaguucacaaacugacuuaagggaaacuucauagcugcugcuguaaguacuu

SEQ ID NO: 4106424 - RNA, 86 nt, Human
gaguagaauucagggaggcucuuauuuguucaacaucccccagaugguaugugauggagugaggguuucuacuuaagucugaucuc

SEQ ID NO: 4106425 - RNA, 96 nt, Human
gaguagacacagaggagggcagucaggcucagccucucugaaagcgcuccaccccagagggcugccugucuguuucuuuuaugcaaaugucaguuc

SEQ ID NO: 4106426 - RNA, 90 nt, Human
gaguagaccaucccugcaagcaccacccucccaaccugucccugggacucaggacucacgagggaggugggcguggaggaggugcugcuu

SEQ ID NO: 4106427 - RNA, 60 nt, Human
gaguagagugcggugauuaagacuuugcauacuggagucagaccgacugggcucauauuc

SEQ ID NO: 4106428 - RNA, 81 nt, Human
gaguagcaaaauucuuccaagucuaaguuauaaaucucagaacucacugaaggauuugugaguuaacuuguuuuguuguuu

SEQ ID NO: 4106429 - RNA, 63 nt, Human
gaguagcagccacagaggacccaagcccaagucuuggccugaguuaaguuagugcuauugcuc

SEQ ID NO: 4106430 - RNA, 57 nt, Human
gaguagcauucuagaguaugcuaggagaaucuaaguaacaacuggacaauguugcuc

SEQ ID NO: 4106431 - RNA, 68 nt, Human
gaguagcauuugcaggcuauaauggaaacaguuccaacuguguucaaucccuagucucagagccacuc

SEQ ID NO: 4106432 - RNA, 72 nt, Human
gaguagccucagcugggugaguguucugcaacuauagugcuugcaaacgacuuucaccuaaguuaccuacuc

SEQ ID NO: 4106433 - RNA, 92 nt, Human
gaguagcuaugacaaugaggaguuuuaagagugagaaaacacaaugucuaugagaacauggacuucucuuuuagaggcuccaugagcuacuc

SEQ ID NO: 4106434 - RNA, 56 nt, Human
gaguagcuguuuucaguuuggguuuuuuccaccaaagcgacuuuaaaacacugcuc

SEQ ID NO: 4106435 - RNA, 72 nt, Human
gaguaggaagagcucaggacuggggcugggggucaggagacccaaguucaaguccuggcucugccacugcuc

SEQ ID NO: 4106436 - RNA, 85 nt, Human
gaguaggagaaagguauuuagugugaaagcuauguaaaaagucuaacacaugguuguugcucaauacauguccauucuccuccuu

SEQ ID NO: 4106437 - RNA, 62 nt, Human
gaguaggauggugcagaguuggugagauucacuccgggugugagaucugccugcacccucuc

SEQ ID NO: 4106438 - RNA, 58 nt, Human
gaguaggcaguggauuuaugguaaaugacagaguguuugcaaauuuuccugacuacuc

SEQ ID NO: 4106439 - RNA, 97 nt, Human
gaguaggucgaggaaggggaggccugcgcuuucgggagggaagccgcuggggcuagucuggcugaagcugggcacuuccuuuuuucccucgauacuu

SEQ ID NO: 4106440 - RNA, 80 nt, Human
gaguaggucucaguagucaagcuacaggagccuuccuuaucuucaagaggcagcugagcauggcuaccuuugcucugcuc

SEQ ID NO: 4106441 - RNA, 87 nt, Human
gaguaguaacaguaaugaaagcuuucuucuaguuguacaguaaagucuauuuugcuagcaggaggaggagucacugugaaauugcuc

SEQ ID NO: 4106442 - RNA, 117 nt, Human
gaguagugagggacugcuggggccccaggaguaaagugcccagggaaagcgggcuucugcgguuuaaccaucccagaaucccugucccucuuuuggggagccaucccucaccugcuc

SEQ ID NO: 4106443 - RNA, 81 nt, Human
gaguagugccacucuggguccugccauucacugggagggagaccucaggagggaccaggucagggcucugacuggacacuc

SEQ ID NO: 4106444 - RNA, 86 nt, Human
gaguaguugaacugaaguauuucgagccagcauguuagaauuuuugggauggggauaugugacuugacaaagcuucccaggugcuu

SEQ ID NO: 4106445 - RNA, 83 nt, Human
gaguaguuguugggauuaacuuuuuacuuagagcuaaauaacuuuggaugaguauuuuaaguucucaaucccucgauucccuc

SEQ ID NO: 4106446 - RNA, 71 nt, Human
gaguaguuguuuucuggauaucuauuccucauacuaccaugaauagaagucucucaagaaacauacugcuu

SEQ ID NO: 4106447 - RNA, 58 nt, Human
gaguauauauagacaugucacacuaaugguggagaugugugacuaucugcuugugcuu

SEQ ID NO: 4106448 - RNA, 60 nt, Human
gaguaucucauuuuccacgagaaguuggaaaaccugacuuuucaugugaugugacauuuc

SEQ ID NO: 4106449 - RNA, 66 nt, Human
gaguauggugagucuuucuccugcccuggggauuuccuccagacuacaggagaaacucacucacuc

SEQ ID NO: 4106450 - RNA, 55 nt, Human
gaguauguguuucuggguuuagucuuccuagaggacaaucuagaaauauguguuc

SEQ ID NO: 4106451 - RNA, 80 nt, Human
gaguauguugguaauugagagaauuaaauuacugugugauuacuauacuaaauaguuuaauuccucauugggacauauuc

SEQ ID NO: 4106452 - RNA, 57 nt, Human
gaguauugggauuaugggugugagcuacuacagcuccuggccccagaucccaaucuc

SEQ ID NO: 4106453 - RNA, 90 nt, Human
gaguauuuccagaguucccugggacucagacauggaagucauaggacuauaucuaggaacccugagauuacccagggaccucaaaugcuu

SEQ ID NO: 4106454 - RNA, 64 nt, Human
gagucaaaugcaauguuuucaggugaaccugagacuacagaauggcauuguuuuuguggaacuc

SEQ ID NO: 4106455 - RNA, 62 nt, Human
gagucaagcugcccuacccgaggcacucuccaaggggagagaaacuccuaggccagcgacuc

SEQ ID NO: 4106456 - RNA, 69 nt, Human
gagucaaggcagagucuaucuuggaaguuuaauucauugaaccuuuauuagauguagacuuucuuacuc

SEQ ID NO: 4106457 - RNA, 61 nt, Human
gagucacacagcuuggaguuaugguucaaacuuggaucaccuggcucugaguuugguauuc

SEQ ID NO: 4106458 - RNA, 76 nt, Human
gagucacauagcucugguuucuugacuauggauaggauauaaagucaucuuaaagggagacuagugcuauguuuuc

SEQ ID NO: 4106459 - RNA, 69 nt, Human
gagucaccuuggccgcugucccggaggggagcgcugggagcgcggcgccgggacgcggcggagucauuc

SEQ ID NO: 4106460 - RNA, 77 nt, Human
gaugcuguguuacugagauccggccccuggaggaguuuucuuuuacaauuuccccuaugccauuucacacagacauu

SEQ ID NO: 4106461 - RNA, 70 nt, Human
gaugcuuuccaaaguguugaguucaguccagggcagcuucccuguucuguuaauuaaacuuugggacauu

SEQ ID NO: 4106462 - RNA, 61 nt, Human
gauggaaaaacagaagcugaauuuauacuacucagaauugucaggggcuguguuuuccauc

SEQ ID NO: 4106463 - RNA, 64 nt, Human
gauggaaagagcauggaauggagauccaggaauccuggguuucagucuaugcuuugaacucauu

SEQ ID NO: 4106464 - RNA, 73 nt, Human
gauggacuuacuugggcacacaucuuaagugucuuugugacaccucuggucugugucauaggcugaguugauc

SEQ ID NO: 4106465 - RNA, 72 nt, Human
gauggagacugaaugaggggugaucugggacccucccacgggaccccaggaagccauauuuauuucuucauc

SEQ ID NO: 4106466 - RNA, 65 nt, Human
gauggagagaaggcccagugaggcgugcaggacuggaguucagugccgugcugggucgcugcauu

SEQ ID NO: 4106467 - RNA, 73 nt, Human
gauggagagcgcaaggggccaagccugaguucagggaaaggcugagccaggcuacuccuugcugacagccauc

SEQ ID NO: 4106468 - RNA, 55 nt, Human
gauggaggcugucuugugcacuauaguauauuuagcagcauuuuuagccucuguc

SEQ ID NO: 4106469 - RNA, 67 nt, Human
gauggaguaugaggccauggucugcccucagcagauggggcaucugacaaggccacauauucucuuc

SEQ ID NO: 4106470 - RNA, 71 nt, Human
gauggaguguccuggagugcuugggggaaggggccgcuuccugcuacaauggcuauuuuggggccugaauc

SEQ ID NO: 4106471 - RNA, 71 nt, Human
gauggauauaccaaggcacugaaaaauuguguguagaauaacgcuacaacuaauuuucugggcuuuccauu

SEQ ID NO: 4106472 - RNA, 60 nt, Human
gauggauaugcuguuagaugaacuggagccaaaugcuguguauacuaacauauaucuguu

SEQ ID NO: 4106473 - RNA, 69 nt, Human
gauggaugccuuaaggcgagauacuuaagucacaccaacuucaguuucuucaucuguaaggaugcuguu

SEQ ID NO: 4106474 - RNA, 58 nt, Human
gauggauggacagguggauagguggauugguagaucaucuguuucuuugcuauauauu

SEQ ID NO: 4106475 - RNA, 55 nt, Human
gauggcaaugcuagaaauuuaggagcuacagcuccucucuaacaugaaugcuauc

SEQ ID NO: 4106476 - RNA, 86 nt, Human
gauggcaggauggagguggguaucaugagagauuacuaacauuuguucauuucuugcuaugcgccacgcacuuaacgccuguuauc

SEQ ID NO: 4106477 - RNA, 85 nt, Human
gauggcaguuuuuauccugccgaguacagccauagaaaauugagaucauuucucugcuguguuggcagcugagaaaauggccauu

SEQ ID NO: 4106478 - RNA, 83 nt, Human
gauggccaaggucaggggcuccuuugaccacuuagaaucagaucuggucucagcuggaguccuuggucccuccucugaccauc

SEQ ID NO: 4106479 - RNA, 55 nt, Human
gauggccaaguacauggcugggguguugaaggucucaaauaugaucugggucauc

SEQ ID NO: 4106480 - RNA, 58 nt, Human
gauggccuuguuuucucccuucucucuauuuaaugacuuuugaggaguugaggcuauu

SEQ ID NO: 4106481 - RNA, 71 nt, Human
gauggcgggggaggagcugcaggcggcagagaguaaucaagcacucauuuacgcgccuccuuccuuucguc

SEQ ID NO: 4106482 - RNA, 60 nt, Human
gauggcgguggccaccuccuuggagcacuuaacacccagaccgacguggccauuguaguc

SEQ ID NO: 4106483 - RNA, 91 nt, Human
gauggcgucauuguacaauccucacauuccaugagcuucuggcuuuccauaaacaaggcaagaacagacaugggagugggcacaggcuauu

SEQ ID NO: 4106484 - RNA, 62 nt, Human
gauggcucacucccuugauuauuggcagaaauucuugguuccucagaugggagugagccauc

SEQ ID NO: 4106485 - RNA, 92 nt, Human
gauggcucagcguaggaaggugagcguggucuucugugggugcacagcagaaagauaggucaccccaggagguccgggcuccccuccccauc

SEQ ID NO: 4106486 - RNA, 77 nt, Human
gauggcugaugaagcacggugaagaucuggccucagaugguucugugggagaugcuucuuguguuuauuugguuguc

SEQ ID NO: 4106487 - RNA, 66 nt, Human
gaucaccugugaaacuggacagcacuuggguuugaacccuaguggugacauuucacaagcuguauc

SEQ ID NO: 4106488 - RNA, 89 nt, Human
gaucaccuuuaaaugaauccugacuaaugguauuagaggagagauggugagaauugguuggauuuacaacauaguuugaagguagaauc

SEQ ID NO: 4106489 - RNA, 79 nt, Human
gaucagaugggaacauauauaugggcucuuucaggugcauugaggcaucagaaauguuuauauguggugucaacugguu

SEQ ID NO: 4106490 - RNA, 57 nt, Human
gaucaggacauagcuauaggcuuauuugagcccaggccuuaagcuacuucccugcuc

SEQ ID NO: 4106491 - RNA, 64 nt, Human
gaucagggaguggauauguuuagcaaaguugccugcuguugcuaggauucauucuauacuaauc

SEQ ID NO: 4106492 - RNA, 79 nt, Human
gaggcaggggaucuugacguccucgauggggaacuuauagucauagguaaucuccucauugacguuaaugugcugcuuc

SEQ ID NO: 4106493 - RNA, 68 nt, Human
gaggcagguggaucaccugaggucaggaauucaagaccagccuggccaacauggugaaaccccgucuc

SEQ ID NO: 4106494 - RNA, 68 nt, Human
gaggcagguggaucaccugaggucaggaguucaagaccagccuagccaacauggugaaaccccgucuc

SEQ ID NO: 4106495 - RNA, 56 nt, Human
gaggcaguuccugagugacaaggcuauuuguguauccugcauauaaaaauugccuc

SEQ ID NO: 4106496 - RNA, 80 nt, Human
gaggcauaagcugcagaugugccuguggauggcagcuucugacagcuguuccuggacacuaucagcagacaaauguacuc

SEQ ID NO: 4106497 - RNA, 107 nt, Human
gaggcaugagaaucacuugaaccugggaggcagaaguugcagugagcagagaucacagcacugcagcacugcacuucagccugggugacagagugagacucugucuu

SEQ ID NO: 4106498 - RNA, 75 nt, Human
gaggcauuagcggcauucugcauaggcuauauuuguucagccacauugaauaacuuacucuaugcuuaguaccuc

SEQ ID NO: 4106499 - RNA, 63 nt, Human
gaggccaaguuggagaccagguuuagaagagaaaaacuuucacuugacuccuaauuuguacuc

SEQ ID NO: 4106500 - RNA, 92 nt, Human
gaggccacacauugcagagaggagagcccagggcaggggagauagagaucugaguccuaguucugguucugucacucuuacugugugaccuu

SEQ ID NO: 4106501 - RNA, 57 nt, Human
gaggccacgugcuuauguuucugaaugcuagcagccagccugugagcccgugaccuc

SEQ ID NO: 4106502 - RNA, 55 nt, Human
gaggccacuuccuacuggaggagacccuggaagucucccuggaggugguggcguc

SEQ ID NO: 4106503 - RNA, 62 nt, Human
gaggccagaaugagcugaaugccauccuuuggccuccacagcucaguucagcuccugguguc

SEQ ID NO: 4106504 - RNA, 59 nt, Human
gaggccaggacucugaacagggcucaggaaaggccacagggcccugagagcuuggguuc

SEQ ID NO: 4106505 - RNA, 57 nt, Human
gaggcccaaauuuccacaaacacauagaauguguaaauugaaggaaauuugugcuuu

SEQ ID NO: 4106506 - RNA, 70 nt, Human
gaggcccagaaucugguggacgugaagauuccaguucuaucuugugggcagggacacauccccaggccuc

SEQ ID NO: 4106507 - RNA, 55 nt, Human
gaggcccaguguggcuuccuggaguugugaacagcuccuggccucccuggggcuc

SEQ ID NO: 4106508 - RNA, 96 nt, Human
gaggccccagucccagcuucccccaugcagccugcccucggcccuuucuauccauggagcuuccaaacagccuuugcauggagccugggauuccuc

SEQ ID NO: 4106509 - RNA, 58 nt, Human
gaggccccucucucugugcuugggccacuggcuuuuaaauaggaaagggaggggcuuu

SEQ ID NO: 4106510 - RNA, 58 nt, Human
gaggcccuaaaagacugugcuggcagcuccaggaaaagcucagugcuuucauugccuc

SEQ ID NO: 4106511 - RNA, 75 nt, Human
gaggcccugcuggacuuggagagauacaagcccuaaacagggggcuuucuucauacucaagcauccagcugccuu

SEQ ID NO: 4106512 - RNA, 108 nt, Human
gaggccgaccugaaagagguggauccccaaagcagugauccuuaaaggaacaucucaaaagagacauccaacuggggguuauugcuuuuaguaucuuuuucauaccuc

SEQ ID NO: 4106513 - RNA, 66 nt, Human
gaggccggcucugcccugcugauccccguggcccaacuuuucggggggcuagcuagaccgagucuc

SEQ ID NO: 4106514 - RNA, 55 nt, Human
gaggccuagucugccugcucaccucaucuucaauguagagagcagccugggccuu

SEQ ID NO: 4106515 - RNA, 87 nt, Human
gaggccucagagaaauccuggccuagcugggcucagaggagccccgccucccugagagcuaaaccugggcuaggacccugaaaccuc

SEQ ID NO: 4106516 - RNA, 58 nt, Human
gaggccucggguuuuccacaggagucuuuauuacaguguaaauccaagcucaggccuc

SEQ ID NO: 4106517 - RNA, 79 nt, Human
gaggccugcugccugcugacauucuuuauauuucauagcggggucuggagggguuuagagggacacaugcucaggcuuc

SEQ ID NO: 4106518 - RNA, 56 nt, Human
gaggccuggcaugaaugggaaccgaugaaguuccucagugugugacccauggccuc

SEQ ID NO: 4106519 - RNA, 63 nt, Human
gaggccuggggagcaugaauuagaacagcccauagggacucuggaucggguuccucaggucuu

SEQ ID NO: 4106520 - RNA, 58 nt, Human
gaggccuggguuggaggugcauuucuuuggauuugcauuaauuuuugccagguuccuc

SEQ ID NO: 4106521 - RNA, 58 nt, Human
gaggccuuagagcuuuucuagauuuaaaauaugagccaugggaaagucuaagugccuc

SEQ ID NO: 4106522 - RNA, 56 nt, Human
gaggcgagaagcuggagaugguaugagguuggcucuccucuuuacucccuugccuu

SEQ ID NO: 4106523 - RNA, 72 nt, Human
gaggcggaggcugcagugagccaagaucgugccauugcacuccagucugggaacaaagcgaaacucugccuc

SEQ ID NO: 4106524 - RNA, 99 nt, Human
gaggcgggaagaucacuugagcccaggaggucaaggcugcagugagcugugauugugccacugcacuccagccuggguaacagagugagacucugucuc

SEQ ID NO: 4106525 - RNA, 98 nt, Human
gaggcgggagaauugcuugaaccugacaggcggaggcugcagugagccaagaucgugccacugcacuccagccuggcaacagagcgagacucugucuc

SEQ ID NO: 4106526 - RNA, 68 nt, Human
gaggcgggagagcgcgcuagggccgagcccacgacccggggccgcuccgcgcuucuccugggacccuc

SEQ ID NO: 4106527 - RNA, 66 nt, Human
gaggcgggcgaaucaugaggucaagagagcgagaccauccuggccaacauggugaaaccccgucuc

SEQ ID NO: 4106528 - RNA, 68 nt, Human
gaggcgggcggaucacgugaggccagaaguuugagaccagccuggccaacauggugaaaccccgucuc

SEQ ID NO: 4106529 - RNA, 80 nt, Human
gaggcggggccuuuucuggaacugucugcguucggguaaucuccccccagaaugcauugcuucugauggggcgccgccuu

SEQ ID NO: 4106530 - RNA, 68 nt, Human
gaggcggguggaucaccugaggucaggaguuugaaaccagccugaccaacauggugaaaccuugucuc

SEQ ID NO: 4106531 - RNA, 68 nt, Human
gaggcggguguaucaccugagguuaggaguucgagacaagacuaggcaacauggugaaaccccgucuc

SEQ ID NO: 4106532 - RNA, 85 nt, Human
gaggcguggggggaugggaaccagggcaugcaggacuguggcagagugcuccucugccaccugugcagccuccauucugggucuc

SEQ ID NO: 4106533 - RNA, 80 nt, Human
gaggcguucgggugcagcacuggggggauucggagcuggacagcccagccacguugccacccgggugacccugagcccuc

SEQ ID NO: 4106534 - RNA, 76 nt, Human
gaggcuaacuuuauacacaaugacuuaagaugucaaggaaaaauuagcuuugauucaaauauuguguaugauccuc

SEQ ID NO: 4106535 - RNA, 75 nt, Human
gaggcuaagaaucuuuuaggggauccugaggguuggugcuuucugcaaaauaccucuaaaaggccuuguggcuuc

SEQ ID NO: 4106536 - RNA, 71 nt, Human
gaggcuaccacagucugccauuagaugguuuuuuaucccuccaucuaagucuuuggaguguggaaagccuu

SEQ ID NO: 4106537 - RNA, 57 nt, Human
gaggcucacgacgggacgaacucaacucaaagaccaguucuguugacugugggcauc

SEQ ID NO: 4106538 - RNA, 55 nt, Human
gaggcucaguuauuuuagccuggggauuuugccuggggaaaaauguaugugccuc

SEQ ID NO: 4106539 - RNA, 81 nt, Human
gaggcucaguuuacaugucuggugaaugagaagaaucaaccuaaguauucauuuauagggcauugaaaacuggcgagccuc

SEQ ID NO: 4106540 - RNA, 129 nt, Human
gaggcuccuuacucuguguguuuaaacaaauuguugcugggauucugcauugcucacaaagauuuuaccaaaauuguuuugauuugauucagauuuggcaauguguaaauuucacuuugagguucccuc

SEQ ID NO: 4106541 - RNA, 85 nt, Human
gaggcucggcaguagggauguccugagacuuggcucggcacugccccaccuccagccaccucuuugucucugccgccucugccuu

SEQ ID NO: 4106542 - RNA, 55 nt, Human
gaggcucucucucugcucgcuggaacggcagcuagaaaacugggaggagagcuuc

SEQ ID NO: 4106543 - RNA, 83 nt, Human
gaggcugcucacugucaucugguagaugaugggauggaaagaacacgucugauuugaaagccaggcugauaugccagugccuc

SEQ ID NO: 4106544 - RNA, 59 nt, Human
gaggcuggcauguggcagcugguucaguggcaacccucagcccagcccagugcccacuc

SEQ ID NO: 4106545 - RNA, 57 nt, Human
gaggcuggggucugccuuucuggaagcuucccugccaccucuugcagcuccagccuc

SEQ ID NO: 4106546 - RNA, 68 nt, Human
gaggcuggucagcccuaagaucccuuuuaacuacaauaaccugggauucuaacuggcuugacaguuuc

SEQ ID NO: 4106547 - RNA, 60 nt, Human
gaggcugguuuucaguuacugaguuggaggggucccugagacagaacugagaacagucuc

SEQ ID NO: 4106548 - RNA, 58 nt, Human
gaggcuuggccaaagugggcgcuucugguucagaaggccuaacuugggggcaauucuu

SEQ ID NO: 4106549 - RNA, 56 nt, Human
gaggcuuuugcuguguuuuccagaguaauuauuuacucugccuuagggggagccuc

SEQ ID NO: 4106550 - RNA, 69 nt, Human
gaggcuuuuuggauccagagaaacuggucagauagggcaggccugaccuacucuggcuuccaaagcauc

SEQ ID NO: 4106551 - RNA, 64 nt, Human
gagggaaagcuccccgaaacccaccucugagguggccaaggagaaugggcaaggggagccucuc

SEQ ID NO: 4106552 - RNA, 99 nt, Human
gagggacaaguggagcugaaguacagucaccccaggagccucugcggauccaugaggagcucuggaggugggagggacuguccuuuggacuuguuccuc

SEQ ID NO: 4106553 - RNA, 57 nt, Human
gagggacagaacugccuugauuccuggugaguuuccaguucauggcuuuagucccuc

SEQ ID NO: 4106554 - RNA, 70 nt, Human
gagggacauacagcccucucccuggugcccucaggcggcagggggaacgggcugucucugcuguccccuc

SEQ ID NO: 4106555 - RNA, 56 nt, Human
gagggacccaggcaccaggcagugaguguggcacugauggcccaccuuggucucuc

SEQ ID NO: 4106556 - RNA, 86 nt, Human
gagggacuaaagaacguugaaugguuaauuuguauucagugcuaucccugcauacagucuucauauuaaguuuuuguugggacuuu

SEQ ID NO: 4106557 - RNA, 69 nt, Human
gagggagagaaggucacuaaggacccacagaugccaaccuugugguguuccggagggccucucucucuc

SEQ ID NO: 4106558 - RNA, 83 nt, Human
gagggagcaggggaccaugaacuuguaugccagacucagggccugggugcccagcucugggcugacaugcucccugcuugcuu

SEQ ID NO: 4106559 - RNA, 96 nt, Human
gagggagccgccuuggccccgccguccugccaugccagcaugcccgucgcccacgggccggcggucggcggcgcgggguuggggauggcgccgcuc

SEQ ID NO: 4106560 - RNA, 69 nt, Human
gagggagcgccuuugccuaccaggccggagaacccuguucuucagucgccuuggcaggggcagccccuc

SEQ ID NO: 4106561 - RNA, 55 nt, Human
gagggaggaauccauccuuuaccaaauaaguggccccaggacacauucuucccuc

SEQ ID NO: 4106562 - RNA, 71 nt, Human
gagggaggccagggaugcaaugagagguggggaggaggggcucacauucuccugaguucccaggucuacuc

SEQ ID NO: 4106563 - RNA, 65 nt, Human
gagggaggcucagagggacuuucaagauacuuuauuucaguuccucuuuugggcucugaccccuc

SEQ ID NO: 4106564 - RNA, 121 nt, Human
gagggcacauguauaauugauuauuagcuaaaggcuauuuuuagauguuugccuauuaccacugaaugcacagauauuuuuaaacauuugagaagccgugcauauauauauauaugcuuuu

SEQ ID NO: 4106565 - RNA, 63 nt, Human
gagggcacugcuuuccuuucaaaauguaggguucaaauccgaugaagggguggcagugugcuu

SEQ ID NO: 4106566 - RNA, 66 nt, Human
gagggcagagcugguguguccuggcaugggggcccgugugcacagagcuccaguguuuuugcccuc

SEQ ID NO: 4106567 - RNA, 81 nt, Human
gagggcagagggaguucuuaaugaugagcaaagcuuuucauuuggaauacugagccacagugagagcuccugaaugucuuc

SEQ ID NO: 4106568 - RNA, 130 nt, Human
gagggcaggauugcucccugguucccaggaacuuuguucacaggguuguuguagugacuuccuuuagucuuugcuucuacucugucagcagaguucugcagcugugggcuucucccaauucagagcccuc

SEQ ID NO: 4106569 - RNA, 57 nt, Human
gagggccucuaccucgagggagugggguguagauuuuuccuggaggugaagguucuc

SEQ ID NO: 4106570 - RNA, 98 nt, Human
gagggccuggccugucugggggaggcuggugacuccugguuccaaugugcucagcucugagccagaggccagccugccucagacggggcauuuccuuc

SEQ ID NO: 4106571 - RNA, 79 nt, Human
gagggcgcgugccaggugccugcgggccgcggcgcaccgagagccuucacgaagcugggcagccuggccgcugccacuc

SEQ ID NO: 4106572 - RNA, 91 nt, Human
gagggcguggcuuucugguaccgugucagaaacccaagcuaucgcgcugagguuccauucuugaucacgugcucaguuuuagcuaccuuuc

SEQ ID NO: 4106573 - RNA, 81 nt, Human
gagggcuacucugugcauuucaggaccugaacauccugucuaauuguguaucauuccaggaguguacaguuccccauccuc

SEQ ID NO: 4106574 - RNA, 57 nt, Human
gagggcuccauuccccgugcccgguguuuccucuggccggauuggcaugcagccuuc

SEQ ID NO: 4106575 - RNA, 80 nt, Human
gaggggaaggguuugaaaaggcagucucauggauaauugauuguauucagugacuuugucccuuucaaauccaacucuuc

SEQ ID NO: 4106576 - RNA, 57 nt, Human
gaggggacaggaguagcauacuucagggcaccaggugcccugagauuccuccuuuuc

SEQ ID NO: 4106577 - RNA, 57 nt, Human
gaggggagaggcuuauggaucaagucccauauucuugcugcuguaaucucucuccuu

SEQ ID NO: 4106578 - RNA, 61 nt, Human
gaggggagggagaagagaaguaagagauaagagcuaucucuaaaugcucucccauccccuu

SEQ ID NO: 4106579 - RNA, 82 nt, Human
gaggggcagaggugccagaugcacagcugaauugagcagagcuauuucagauguucagucuguuccuacacuucugcuccuc

SEQ ID NO: 4106580 - RNA, 66 nt, Human
gaggggccgaaucaguguguaaaguggcugccuaggcuggggcagcacugggugcugaaguccuuu

SEQ ID NO: 4106581 - RNA, 60 nt, Human
gaggggcuccuuugugcugcguccacugcaucugcggcagacauugcaugguggccucuu

SEQ ID NO: 4106582 - RNA, 55 nt, Human
gagggggaaagucccuggagucaggcuguggccuuucucccccagcuucccccuu

SEQ ID NO: 4106583 - RNA, 79 nt, Human
gagggggcggguuccugggggccaggccagggcagcauguggggcuuuccuggaggguccccagcagagaagcccucuc

SEQ ID NO: 4106584 - RNA, 62 nt, Human
gagggggcgugcaaggcuccgccggcccccccgcagcccgcgcccgacuugggcgcccccuc

SEQ ID NO: 4106585 - RNA, 95 nt, Human
gagggggcucaugguauuuuagacaggggcaaaauaagggagauugagaaaaacaucugucuuggccuccugcugcugcuauaacgaauucucuc

SEQ ID NO: 4106586 - RNA, 69 nt, Human
gagggggcucugucaaccaggggacacuaguggggacagguguguagcuccuggcugcagggccuccuc

SEQ ID NO: 4106587 - RNA, 68 nt, Human
gagggggguggaucaccugaggucaggaguucgcaaccagccugaccaacauggugacacccugucuc

SEQ ID NO: 4106588 - RNA, 56 nt, Human
gaggggguagcccugcaggcgcuggcuucugccugcuggcuuccagcugcucccuc

SEQ ID NO: 4106589 - RNA, 55 nt, Human
gagggggucuccuaucauggaagaacugccuuguuugccuuuuggggauccccuu

SEQ ID NO: 4106590 - RNA, 82 nt, Human
gagggggugcccacagcaggaagcuggagggaaaucucacuguuguccccuggucucucucuaucucauccucugcccccuu

SEQ ID NO: 4106591 - RNA, 59 nt, Human
gagggggugguggccuuaggagcugaacuuagaucuucugcuccaaauacuuuucccuu

SEQ ID NO: 4106592 - RNA, 62 nt, Human
gaggggugaguggauaaacaaaaauguggucuauccacacaguggaguauuacucagccuuc

SEQ ID NO: 4106593 - RNA, 57 nt, Human
gagggguguggagccaucaguuagcaaauauaggggaacuggagcugcacaccuuuc

SEQ ID NO: 4106594 - RNA, 71 nt, Human
gagggguguguguguguguguguguguguguguguguauguauauguauaugugugcacgcacagccucuu

SEQ ID NO: 4106595 - RNA, 61 nt, Human
gagggguucccuuccugagauacuauuccuuuucaccugucuuagaaguggcuauuuccuc

SEQ ID NO: 4106596 - RNA, 68 nt, Human
gaggguaaagaagggccagcuggacaccugggucccucuaucugcuucugaggcccaucugcaucuuc

SEQ ID NO: 4106597 - RNA, 64 nt, Human
gaggguaauauugcuggaaaauggugugaucaaauugauuucucaguaaucucagcaauuccuc

SEQ ID NO: 4106598 - RNA, 81 nt, Human
gagggucagacuucuacagaggacacaaagaucuuuugaaccaucgaaggcaucaaucuccccucuggaauccagcuccuc

SEQ ID NO: 4106599 - RNA, 91 nt, Human
gagggucaguguuugaucucugcucuggugcugggcaggggcuuaggaguugagccaaaggcaccagagacacuuggcagaaauggcucuc

SEQ ID NO: 4106600 - RNA, 61 nt, Human
gaggguccaacugaggcugaacugagcgugaacuacauucagcggccuaggcagugcccuc

SEQ ID NO: 4106601 - RNA, 57 nt, Human
gagggucucuuaaugccagggguuugagaccagccugggcaacauagugagacccuc

SEQ ID NO: 4106602 - RNA, 86 nt, Human
gagggucuugcagagauaugugugcaucaagcaggaauaagaagcacuuaccugagcccagugcagcauauucugaacagauguuc

SEQ ID NO: 4106603 - RNA, 110 nt, Human
gagggugagugauauuuauugagcaccuacuguauuccaggaacuguguagacagucucaugugcaaaucuggaugugcugggugucuguacacauugucauucaucuuc

SEQ ID NO: 4106604 - RNA, 84 nt, Human
gagggugcccguaggauuaacugggaagggugaaauaucugauaauuuuucagucauuacggacuaguacuaccaaggccccuu

SEQ ID NO: 4106605 - RNA, 63 nt, Human
gaggguggcauagauugcgggguggaugccuggucugggcuucaccugugcacucuaccccuc

SEQ ID NO: 4106606 - RNA, 63 nt, Human
gagggugggggcaagcaggggagcuggguuccaaccagcuuguuaaacagccuccacugccuc

SEQ ID NO: 4106607 - RNA, 56 nt, Human
gaggguggguuucuugcacgucggccuuucuucuggucagcguguccccgcgucuc

SEQ ID NO: 4106608 - RNA, 61 nt, Human
gagggugugcuguguacuuggcaaugggaaaacaaccaugaacaagacaaagcccaucuuc

SEQ ID NO: 4106609 - RNA, 62 nt, Human
gaggguguggaaguuaguaagagggaccuggugaagguccaaaggggcaguguccagcccuc

SEQ ID NO: 4106610 - RNA, 72 nt, Human
gaggguuagaggauggagaugaggaaaauuagaaacccucuugucuacucacaucucuguuuucuaaaucuc

SEQ ID NO: 4106611 - RNA, 84 nt, Human
gagguaaugagagcuaacauugauucagugccugcuauguuuugcacuguuagguacuuuacauguuaucucauguaauaccuc

SEQ ID NO: 4106612 - RNA, 83 nt, Human
gagguagaagucuauuugcuguccgagcaacagguguuccgaagguucccucuugcucuggcaaguaaagauuuuguuuccuc

SEQ ID NO: 4106613 - RNA, 56 nt, Human
gagguagagaugugaaucagacaaguccuuaaaugcaugauucaucuaacugccuc

SEQ ID NO: 4106614 - RNA, 99 nt, Human
gagguagaugaccuauuccaagacuucaagaagagcuucuauuaaguauggguaucuucuaugaaucauuggaacagggcacacaaggucagcuaucuc

SEQ ID NO: 4106615 - RNA, 63 nt, Human
gagguagcgugcagggcccgaagugcgcuguuucguaagguacccucccugcacccuacucuc

SEQ ID NO: 4106616 - RNA, 68 nt, Human
gagguagcucagggucaucuugcaugggaaaggagcuugccaagaggguugcccugagcguguuccuc

SEQ ID NO: 4106617 - RNA, 99 nt, Human
gagguaggagaaucgcuugaacuugggaggcagagguugcagugagcugagaucaugccacugcgcucuagccugggagacagagagagacuccaucuc

SEQ ID NO: 4106618 - RNA, 69 nt, Human
gagguaggagacuuucuggcagaucagccaggccaccuucacacuguccagucagaacgucauuaccuc

SEQ ID NO: 4106619 - RNA, 55 nt, Human
gagguaggcugugaaagggggugggaacacaccuucuggaaccacugucuuccuu

SEQ ID NO: 4106620 - RNA, 60 nt, Human
gagguaguaagcagagugggguuaaaagcuguauuuccugacucuguaccugucugccuu

SEQ ID NO: 4106621 - RNA, 73 nt, Human
gagguaguuccuuccucuacuaugugaggacucagugagaaggugccauccaugaacgaggaagugggcccuc

SEQ ID NO: 4106622 - RNA, 78 nt, Human
gaggucacacagcaaugggcagaguggggacaggaaccaguguguccugccagcuuucccccaccacugaauggcuuc

SEQ ID NO: 4106623 - RNA, 78 nt, Human
gaggucagaaaaggagagcauuguucuuuucagcccaguagagauaguggaguucaaucaccucuccuuucugagcuc

SEQ ID NO: 4106624 - RNA, 61 nt, Human
gaggucaggcuugcagcagggucggcuggcuguguuugggugugcugugagccguggccuc

SEQ ID NO: 4106625 - RNA, 56 nt, Human
gaggucauguggcaggcagccagugugccucaagggccccugccugcucugaucuc

SEQ ID NO: 4106626 - RNA, 73 nt, Human
gcaaguuucaaacggugcagcaguuuguucagcuuccacugaagggagcauagaaagcuauacugaaauaugc

SEQ ID NO: 4106627 - RNA, 103 nt, Human
gcaauaaaacagguuuaugcaggaggaugcauagugaagcugacagaagugacauuugcugucagaaccuucaggugcuuuucaaagcucacccuuaccuugc

SEQ ID NO: 4106628 - RNA, 129 nt, Human
gcaauaaaacugggucuugaagugaugaagacaaguaggaaugguugaaguuguccaaaacauuuuauguuaucuuuaguuaugauucucugcucuucauuuuuauaaagccauuaauauuuuuguugc

SEQ ID NO: 4106629 - RNA, 100 nt, Human
gcaauaaaguguaauuaaauaauaguuggggugcaguuacauuuuaagucagaaacuugaaauguaguccugccuucacuguguuuugcaaaauuauugc

SEQ ID NO: 4106630 - RNA, 62 nt, Human
gcaauaaauaggucccuguagcaucauuuuaaauggcuguguaggauccuguuguauuuugc

SEQ ID NO: 4106631 - RNA, 119 nt, Human
gcaauaaauauuauuaggcuagugccccucuguacauauucaagcacuucuagaagauaaguuccuggaagcagcauuaaugaguuagcgguggcuacauaugccguggugauagcugc

SEQ ID NO: 4106632 - RNA, 103 nt, Human
gcaauaacguauauguguguugugugugcaugcauagacaccacacaauacauauguguguguugugugugcaugcauagacaccgugcaguaacauaggugc

SEQ ID NO: 4106633 - RNA, 56 nt, Human
gcaauaaguuuucucuucugucaagauagugcuaauggaagggaagucuugguugu

SEQ ID NO: 4106634 - RNA, 59 nt, Human
gcaauaauuuuuacaugaaauaaugacuguuucaguuauucagcagugggauuuguugu

SEQ ID NO: 4106635 - RNA, 66 nt, Human
gcaauacaguugaagagauugaugguucuuaugaauuguuugccuuuucuuuucaauggcuguagc

SEQ ID NO: 4106636 - RNA, 86 nt, Human
gcaauauggaggucauugcugacuucaaccccucuucccuuucugccaugaguggaaggaagcagccagagacccucaccagaugc

SEQ ID NO: 4106637 - RNA, 70 nt, Human
gcaauauuguguuauuuuucuaaguaucuauuuuuguuguggauaagaaaauuguaauaacuguuauugc

SEQ ID NO: 4106638 - RNA, 65 nt, Human
gcaaucaaugauuuauauuuguaaaguggguagaaacaguccuagaacaauaacucauugauugc

SEQ ID NO: 4106639 - RNA, 109 nt, Human
gaugcuugggacuuuuaaccaugacuucauugcucuugaauauggguuucaugcaucugguugcuuggcuguuuucagaaaguagggguaacagucccaucaauguauc

SEQ ID NO: 4106640 - RNA, 76 nt, Human
gaugcuuucaucuggaauuuauguuauaggaauuauguauuuuuuauuaagauuuuuaauuucagguaaaaguauu

SEQ ID NO: 4106641 - RNA, 101 nt, Human
gaugcuuuggagucuuguguguaccuugccaauguauagagauagcugugugugucucaccacaccaugagcuuccuauauagggucacuucuaauucauc

SEQ ID NO: 4106642 - RNA, 72 nt, Human
gauggaacaggugugggcagaauugaaucuuuaaacauguuaacuguuuaugcucaucucauuugucccuuc

SEQ ID NO: 4106643 - RNA, 72 nt, Human
gauggaauaaggcagaaauagggaaagugucagacccaagacaacuuuccucuccaucucugcuuggccauu

SEQ ID NO: 4106644 - RNA, 58 nt, Human
gauggaauaugaauuacaguauaugagcaaggcuauuauauugugauagguguuaauc

SEQ ID NO: 4106645 - RNA, 102 nt, Human
gauggagaaggcucuggcucauuuccuccugagaggcccccgguagagcaguccacugggcuucugaaggcuccucaggaaagugcacaguuuguauuuguu

SEQ ID NO: 4106646 - RNA, 55 nt, Human
gauggaggaaaaguuggaaugcagccucuggugcuguuugagcgaucccucuauc

SEQ ID NO: 4106647 - RNA, 96 nt, Human
gauggaggagucugaacuguugaagugugagcuugcaaugguaugauuuauuuuccccaauugcugcuuucauuuauacaguguaggcccucuguc

SEQ ID NO: 4106648 - RNA, 55 nt, Human
gauggaguggggacugcaguggaacaaagacagaugauucauucaccacuucauc

SEQ ID NO: 4106649 - RNA, 92 nt, Human
gauggagugugguucaggagguuuggauucaguuauauuauuuucauaugacuuaccauuuuaacuuccuuagggaaucacuuaaauuaguc

SEQ ID NO: 4106650 - RNA, 119 nt, Human
gauggaucaaccagagaaccaggcgauguaaagaucacgucccaggacucgguggcugggccugagccaaggggacagugacacauuucuucacugcugcacuggccuugggaucuguc

SEQ ID NO: 4106651 - RNA, 55 nt, Human
gauggcagauggcuggagcaggucucccggagaugagugacaucauuaugcuauc

SEQ ID NO: 4106652 - RNA, 67 nt, Human
gauggccaagguguucugauaugccaggcacacucagcacgaggcacgacaaagacacuuugccauu

SEQ ID NO: 4106653 - RNA, 89 nt, Human
gauggccauccuuguucuuccucagcagggcugccugaguaucuuugagaaaugcccaaggguccucuugaggaaggggaucguccauu

SEQ ID NO: 4106654 - RNA, 78 nt, Human
gauggccauugcugguguaagccccuguuuuggagccauuugcuccucagcaguaaacguccggaacauggguccauc

SEQ ID NO: 4106655 - RNA, 80 nt, Human
gauggcccaagaggcuugguggugggagagcuuucuggaacugcacuggcucuagguucucacccuccucucuggccauc

SEQ ID NO: 4106656 - RNA, 121 nt, Human
gauggcccucuccccuggcacuuugaaucuccagcagcaaugaacagucuguaccugcauccuggccucagcugugauuccugcuguccagccuucugaagugcccuugguugguuccauu

SEQ ID NO: 4106657 - RNA, 58 nt, Human
gauggccucauggcugcaggcccacuucuagucggcuuagcaacuccugaggcucguc

SEQ ID NO: 4106658 - RNA, 56 nt, Human
gauggccuggggagaauuuucucaugaagggauaagaaaauagccccaggcucauu

SEQ ID NO: 4106659 - RNA, 57 nt, Human
gauggcuaacauagaaaauuacagcaauacaaagguaauugaagauguggagccauu

SEQ ID NO: 4106660 - RNA, 78 nt, Human
gauggcuacagugcagagugucuguggacugaaguaauaaccugagcuccuuggccaucgagacucauguacaucauc

SEQ ID NO: 4106661 - RNA, 61 nt, Human
gauggcucagauguuggcugugcagacuccuauggccauagccuagcugugugaggccauc

SEQ ID NO: 4106662 - RNA, 70 nt, Human
gauggcucugccaccuuucccuaagagguccagaagaaaucuuuuacuuggaaugggaggcagaggcauu

SEQ ID NO: 4106663 - RNA, 68 nt, Human
gauggcuucccaguugccaaacuccaaccauccccaagucuuuggagucauuggccugggugacuuuc

SEQ ID NO: 4106664 - RNA, 71 nt, Human
gaugggaaacaaaccuucccuauacgucuucaucuuauuaucacugaagaguguguguguuuauuccuauu

SEQ ID NO: 4106665 - RNA, 58 nt, Human
gaugggaaggaauauagaauuccuuucagacagaaaccuuuuaugucaccuuccuguc

SEQ ID NO: 4106666 - RNA, 82 nt, Human
gaugggacagugcuccacgcuuggcaagacuuuugguaucuaugacuccuugggcucuaaaugccagugacacugucugguc

SEQ ID NO: 4106667 - RNA, 82 nt, Human
gaugggagaucuuaacuguucucacaguggcugguagagaggccuuggguucagcuuuugucagaaauuguaagaauucauc

SEQ ID NO: 4106668 - RNA, 116 nt, Human
gaugggaguggcucucaguggaaggggagcuggaaaggggaugguaugggaagaaggggaucuuuuccugaagcccagcugucuccagccaggcuccucuccaaagucaugccauc

SEQ ID NO: 4106669 - RNA, 68 nt, Human
gaugggcauaggaagaaaccuugacccuuuugaaacugaacuguaaagcaucuuuuccuagcuccauc

SEQ ID NO: 4106670 - RNA, 108 nt, Human
gaugggcgugaugagucagugaugucugccaggguccugggaacagagaguugggcccauggaccagguagguuccaucccugcuuucuuuuguaguuaaagcucauu

SEQ ID NO: 4106671 - RNA, 77 nt, Human
gauggggagacugagacccagugggggccugaucugucuaaagccacacacagacagccgcugguguccgccccauc

SEQ ID NO: 4106672 - RNA, 108 nt, Human
gauggggaugcuguauccagagagaggagagagaugacuuuagggagaggugguguacccucugagaggcacacuuugagaacuacuuucucugcgcaaguuuucauc

SEQ ID NO: 4106673 - RNA, 72 nt, Human
gauggggcugcugugccaugacccugugggcucacgggcagugcuugugggccucaugcccagccacccauc

SEQ ID NO: 4106674 - RNA, 87 nt, Human
gauggguauucuacucugaaugugcauguaaaucaaugcauuacuuuuguagaggauaagucugcauauucagugugaccucucauu

SEQ ID NO: 4106675 - RNA, 70 nt, Human
gaugggugaucaauguuuugauagcccagagacacaauguuccuucugcguuaugaacuugucaccccuc

SEQ ID NO: 4106676 - RNA, 72 nt, Human
gauggguguuucucugucaguauggaaaggccccaccagcaaggugggccagccuacugcuagaccccuauc

SEQ ID NO: 4106677 - RNA, 58 nt, Human
gaugguacauaguuuaaauaaggcagacuuauaucuugucuaugaucugugugcuauu

SEQ ID NO: 4106678 - RNA, 76 nt, Human
gauggucacaccuguucucaucccauucagugucuuuauugcacucaggaguaguucagcagcuguucagaccauu

SEQ ID NO: 4106679 - RNA, 92 nt, Human
gaugguccaguucacagccacaucagguaauaggcucuuuuuaagaaacuugacaugcuuguuuuccuugaagugcacuugaacugucuuuc

SEQ ID NO: 4106680 - RNA, 55 nt, Human
gauggucuuugucucugauaagaaguucaccagcaucuuagggauaaugacuguc

SEQ ID NO: 4106681 - RNA, 55 nt, Human
gaugguggaaauaaacauccaauucugcacagaguuuuguuuguuucucacuuuu

SEQ ID NO: 4106682 - RNA, 55 nt, Human
gauggugucuuuuaauuccagggagguuucugugagcugaaucagagauauuauu

SEQ ID NO: 4106683 - RNA, 58 nt, Human
gauggugugaggcaauuguagcuuugaauuagguuagaguggccuacucacacucauu

SEQ ID NO: 4106684 - RNA, 56 nt, Human
gcacagccuugcccugugcccugggcccuguucuuuggcugcugguuuggcucugu

SEQ ID NO: 4106685 - RNA, 76 nt, Human
gcacagcuugaauaguucuuuuaucugcuugguaccaaagccaaaauccugguauacaagagcaauuuaggggugu

SEQ ID NO: 4106686 - RNA, 72 nt, Human
gcacagcuuuuccacggugguacuggggagaggccuggccugcuccagggccuccaguggggaggaaguugc

SEQ ID NO: 4106687 - RNA, 61 nt, Human
gcacaggaagcaagccuggggccccaccccugucuggcccagaagcacugcucuccugagu

SEQ ID NO: 4106688 - RNA, 83 nt, Human
gcacaggaguaugcgcccagcagcugggaaggaggcugaccucagacgguggccuguggaucccagcucugucauuuccuggc

SEQ ID NO: 4106689 - RNA, 83 nt, Human
gcacaggcucagaaaggucaagaaacuugcucacggucucacagcuggugaguagguugucagacuccaaagaugugugcugc

SEQ ID NO: 4106690 - RNA, 71 nt, Human
gcacaggcucuaaguaaauagcuuaaagaauuuaugagcaucacuuucugcauuuauguauagcuuguugu

SEQ ID NO: 4106691 - RNA, 67 nt, Human
gcacagggaccuuggaagcuggaaugacacuuuggaguuguuccauuuggaacaagagucucugagc

SEQ ID NO: 4106692 - RNA, 70 nt, Human
gcacaguaagucaacaaacaugggggcggagguacaagacugaauacucccauguuuguuguugcugugc

SEQ ID NO: 4106693 - RNA, 69 nt, Human
gcacaguaggucagcaugagagcucaucucacuuccaguuuuacuccaccaugcugccuccauugaugc

SEQ ID NO: 4106694 - RNA, 56 nt, Human
gcacagucucgaagccaagcuccagcacgcuggggcacucggccgugaacucgugc

SEQ ID NO: 4106695 - RNA, 63 nt, Human
gcacagucuugagcaucagccagaccaguguucacauccuggaucugccucuuaggucugugu

SEQ ID NO: 4106696 - RNA, 86 nt, Human
gcacagugaggacuugaagcaggauggcuugcaggaggcugugagaguuggagccucauggucauuccuuuggagccucagugagc

SEQ ID NO: 4106697 - RNA, 75 nt, Human
gcacagugaguuacucugguucucauuuagacacacuaaauucuaaauaccacaugcauagcucauuuuaugugc

SEQ ID NO: 4106698 - RNA, 57 nt, Human
gcacaguuagccuauccugguucaacuccugaaugaaggauuuacuauuaacugugu

SEQ ID NO: 4106699 - RNA, 61 nt, Human
gcacaguuuaugaucucagugaaauguuauagaaccauugcaaugauuauaaagauugugc

SEQ ID NO: 4106700 - RNA, 83 nt, Human
gcacauaauaggcauucaacaaauguuugugguugaugauacugcuacuagcagcuacuguugauugaacaccuauugugugc

SEQ ID NO: 4106701 - RNA, 60 nt, Human
gcacauacccacugucaagcacaguaacugucauuuagcaggugcucaguacguauuugu

SEQ ID NO: 4106702 - RNA, 69 nt, Human
gcacaugacacuauuuuguucuauuuuuggugauguuaacauuggucucuugguuaaaauagugucugc

SEQ ID NO: 4106703 - RNA, 55 nt, Human
gcacaugcaguuuacgucacugaccacuguuggucaaaacaaucauuggaugugc

SEQ ID NO: 4106704 - RNA, 74 nt, Human
gcacaugcuauauguauauguuuccauuuuauaaaauucuaggaaaugcaaauuaacauauaguagauuagugu

SEQ ID NO: 4106705 - RNA, 56 nt, Human
gcacaugucuuauucacuguuauguccuguuggauacacagugccuaacacagugc

SEQ ID NO: 4106706 - RNA, 75 nt, Human
gcacauucauccauagcuugaucuguucccuuggagcaaggaaggggaacugaggaacgaacugggaaaaugugc

SEQ ID NO: 4106707 - RNA, 61 nt, Human
gcacauucuagaagagcuucacuugucacucuauacaggaaugaucuguuuuagaauuugu

SEQ ID NO: 4106708 - RNA, 58 nt, Human
gcacauuuagagguuagcaugguauuuugcagauaccuugaguuagcacugaauuugc

SEQ ID NO: 4106709 - RNA, 58 nt, Human
gcacauuugacaccugggcauugguagauuuaaagagcuccaggugauuguaaugugu

SEQ ID NO: 4106710 - RNA, 58 nt, Human
gcacauuuuuacugccaacuuaaaaccauuuuuugaaguauggaauguagaagugagc

SEQ ID NO: 4106711 - RNA, 126 nt, Human
gcacauuuuuguucccuucuggcaguuaauuggucuguguuuucugcaggugauuugugugggucagauuuucugcacuguggcugcugacaaacaugaucaugccaagcaggccacaaaaguggu

SEQ ID NO: 4106712 - RNA, 70 nt, Human
gcaccaagauugagaaacucuggguuagaaucuucuucgcugacuuugaccacucuuucucagccuuugc

SEQ ID NO: 4106713 - RNA, 79 nt, Human
gcaccaccacacccagccauguucaguucucuagaguauauaccuagaaauggaauugcugggucauauggugaacugu

SEQ ID NO: 4106714 - RNA, 63 nt, Human
gcaccacuagaguagagaugguuuuuuggcuuacuauuccauuuccagugucuaggauggugu

SEQ ID NO: 4106715 - RNA, 77 nt, Human
gcaccagcaucaccuggaggccugcuggaaacgccuaacuucagguccuaccccaggccuucugaguuggaaucugc

SEQ ID NO: 4106716 - RNA, 56 nt, Human
gcaccagccugagccucuugcagcacagagcagcuggaagagagaagugcuggagc

SEQ ID NO: 4106717 - RNA, 59 nt, Human
gcaccagcucuccaccagguuucuagcccugggcacacagagaugggugaggcaggugc

SEQ ID NO: 4106718 - RNA, 79 nt, Human
gcaccaggccuggcugggcagccacaggcccaggaagaaagcagggccgcagcgugggguccggcacuggggccugggc

SEQ ID NO: 4106719 - RNA, 72 nt, Human
gcaccaguguggaauauacucagaacaggcuccucugagggauggggagcucugguauuucuuuaauccugc

SEQ ID NO: 4106720 - RNA, 68 nt, Human
gcaccaugacagugaggagaacggagcacaguuccuuccgugccuccugccggcgcugcucaaggugu

SEQ ID NO: 4106721 - RNA, 77 nt, Human
gcaccaugagggaagacucaggucaugauuucaaggacauucauuccuucagagaugacaccugguguuuccucugc

SEQ ID NO: 4106722 - RNA, 81 nt, Human
gcaccauuugucuagaagucugguugcaaagcgcuggcggcugcaagugcuuauaccaaagacucuuagcuccaguggugu

SEQ ID NO: 4106723 - RNA, 76 nt, Human
gcaccauuuguuagcugugcuuuagccuucuguggagauuacgacuggaaaggcuugagacauugaugacugguuc

SEQ ID NO: 4106724 - RNA, 56 nt, Human
gcacccaggcuugggcagcaacugcugugugccauuguugugcugggcuuggcugc

SEQ ID NO: 4106725 - RNA, 69 nt, Human
gcacccauugugugcagcucugcccucaucuacccaucucuggcuauggagcuacaugcagugggucgc

SEQ ID NO: 4106726 - RNA, 98 nt, Human
gcaccccuuccucaagaugacugacauuuauuagaaaacuaucauaguaacuauccacacaaugacuaugaggugaauggugucccuggaagcugugc

SEQ ID NO: 4106727 - RNA, 84 nt, Human
gcacccggaacuugauccugcuggguacuacuguaugaggcgugauucagaggugucccagcagaggggcgagggagcuggggu

SEQ ID NO: 4106728 - RNA, 61 nt, Human
gcacccucgggcccgcggacaaaggguuaacgcguuggcagugacugcgggccccggaugu

SEQ ID NO: 4106729 - RNA, 60 nt, Human
gcacccuuuuaagcagaagaaaagcaagcaucauuuacauuucugccugcuuguaggggc

SEQ ID NO: 4106730 - RNA, 79 nt, Human
gcaccgacuggccucaggccucugccucauugguggucggguagcggccaguagggcgugggagccuggccaucccugc

SEQ ID NO: 4106731 - RNA, 58 nt, Human
gcaccucauuuugcagguagaagcauaaggaaugaugaugucaccaugugugaggagc

SEQ ID NO: 4106732 - RNA, 69 nt, Human
gcaccuccccacaugguagugaguauccuguccuaaaagcaacucaaaaaagccauuuggugggugugu

SEQ ID NO: 4106733 - RNA, 59 nt, Human
gcaccugccugggacugaagauacaagaaagauucaguuuaaaauuaugaggugggugu

SEQ ID NO: 4106734 - RNA, 55 nt, Human
gcaccuggcugcccagguggagagcacauugccccgccgcuuggcaguaaggugu

SEQ ID NO: 4106735 - RNA, 64 nt, Human
gcaccuggcugugaagccuggguuucuuccuccugggaugugcacugggcucucagcaaggugu

SEQ ID NO: 4106736 - RNA, 77 nt, Human
gcaccugggcaggccggacgcuggggacaauggcuaugcucuggcgcugcagcccggccucccgccugcccgccugc

SEQ ID NO: 4106737 - RNA, 92 nt, Human
gcaccuggggcuuugcaggguuuagcaccuguagcugcucucaugggcugggcugguguugagugccuguagcuuuuccguacauggggugu

SEQ ID NO: 4106738 - RNA, 80 nt, Human
gcaccugugauauagcugacgcuaaauaaauguugaauuugaaugaaaaugcacuacguugugucggcaguauucagguc

SEQ ID NO: 4106739 - RNA, 78 nt, Human
gcaccuguuuguguuuggacugcauuucaguggcuagcacaguuccuggggugccccggauaugugucaagcaggugc

SEQ ID NO: 4106740 - RNA, 91 nt, Human
gcaccuucucaugccaggccccacgcugggcaggggagccagagaugccacccucgcccaccuguggccccagccuggcuggagagugugu

SEQ ID NO: 4106741 - RNA, 103 nt, Human
gcaccuuguggugaugaagcaguucuggauauggauuuuggugacguguacacauucuaugugaucaaauugugcagaauuauacguccacacacaggagugc

SEQ ID NO: 4106742 - RNA, 77 nt, Human
gcacgaacgggaucuucuccgaguccugcagcagcugccagcggcggcccaggcgcuuggagaucucggcguugugc

SEQ ID NO: 4106743 - RNA, 65 nt, Human
gcacgaaggcagaugagaggagcaggcaggggcgagcccgccugggaacucugaucuccugcugc

SEQ ID NO: 4106744 - RNA, 59 nt, Human
gcacgcacccagccagcaucucagagcacuccugugugcugccugagcugggugcuggc

SEQ ID NO: 4106745 - RNA, 84 nt, Human
gcacgccaagcggggcuggggugcauccugggcaggggacugaaauguaccugucaggguuugccucagaagugccuggugagc

SEQ ID NO: 4106746 - RNA, 55 nt, Human
gcacgcgcgcgggcggggccuggcgcuccuccccggucccgcccacugagcgugc

SEQ ID NO: 4106747 - RNA, 93 nt, Human
gcacggagugggcuuccaggucacagagaaauguggcacaaacgguugcaaucuuuugaguuuccuuuuuuuugagaugaagucuccuuuugu

SEQ ID NO: 4106748 - RNA, 86 nt, Human
gcacgggaggauaaugcuaaccuguggacauugcuguugcuucagaggcaugcugcagugaaaucaggaagcaaucccaaccuggc

SEQ ID NO: 4106749 - RNA, 70 nt, Human
gcacgggagguggucgaggagggguacccugguuccagggguccccaaacaggcuugagcaucuaccugc

SEQ ID NO: 4106750 - RNA, 82 nt, Human
gcacgggcccuagaguuagcuucauauccagacucuaccacuugcuguaugucccugggcaaguuuacucuucucucugugc

SEQ ID NO: 4106751 - RNA, 86 nt, Human
gcacguggcgguggcgacgcaggcacgacguguugcggaaggccuugccacacuccccgcaggcguagggccgcucgccagagugc

SEQ ID NO: 4106752 - RNA, 66 nt, Human
gcacuaaacuaggcugggaagaaagauucucggggcagaauucugaaaucuuugccuuagcugugu

SEQ ID NO: 4106753 - RNA, 78 nt, Human
gcacuaaagccaggauugguucccaggcagguggagguagauuccauacaccagguuaccaaucacugcucuaguugc

SEQ ID NO: 4106754 - RNA, 115 nt, Human
gcacuaaauuuuucuccuuccucacagcuugggcuuuaucaugggucuggugccuccaaaauggaccuggccaugguacggagcagcgguggcaccugguggaagauucuggugc

SEQ ID NO: 4106755 - RNA, 84 nt, Human
gaugguuuuugaaggugggggagacuuggucaagacucaacucuugguucugucuguucucuacaggacuucaagaggcugauc

SEQ ID NO: 4106756 - RNA, 64 nt, Human
gauguaaaugaauuuugucuggaggaaauaaaacaauucuccuucaagaagguacauuuacauc

SEQ ID NO: 4106757 - RNA, 71 nt, Human
gauguaagacuccagguaggcacauugacauuuucuagacaugaauguuagagcccacgugguccaauauc

SEQ ID NO: 4106758 - RNA, 81 nt, Human
gauguaagauucaaggcuaaacuuucagaguaugugaugauuuggggcuugauuuacugcucuuuggccuugguuuguuuc

SEQ ID NO: 4106759 - RNA, 89 nt, Human
gauguaaucuuggugucuaaaaugcagagagagauuuugguguauaauggcacugguuugucuauugucauucagacacaagcugcauc

SEQ ID NO: 4106760 - RNA, 115 nt, Human
gauguacaggaaauggauauagugcuguggauacugagagauccuccagccuggaaguuggcugcccucaaaaugcaucucguuaccauagccuugucccuuuguucuugucauc

SEQ ID NO: 4106761 - RNA, 73 nt, Human
gauguacucugugacugauggaggcuuuugaguuaacacucugcaggaagcugacagggcacagguuacacuc

SEQ ID NO: 4106762 - RNA, 63 nt, Human
gauguagagcauuuggauuuaguagucccucuagagaaaugaccagaugcaaaugcagacauu

SEQ ID NO: 4106763 - RNA, 77 nt, Human
gauguagagggaagauuuuaaacaucaagagcaacacugauuugcacaaaccuguguagaucuuccucuucugcauc

SEQ ID NO: 4106764 - RNA, 59 nt, Human
gauguaggagugaauuaauucauccaaauuuauggcuagaauuauauaacuccaacauu

SEQ ID NO: 4106765 - RNA, 94 nt, Human
gauguauuauagguuggugcaaauguaauugcgguuuuugccauugaaaguaauggcaaaaaccgcauuuacguuugcacuaaccuaauauauu

SEQ ID NO: 4106766 - RNA, 62 nt, Human
gaugucacuuaaccuuucugagcuugaguauucugagcuacucauucuuguuaagugucauc

SEQ ID NO: 4106767 - RNA, 78 nt, Human
gaugucaucacauuuaugagcaccuuggcccagagcaugggcucugacaccagacagccauaguucaguccuggcauu

SEQ ID NO: 4106768 - RNA, 56 nt, Human
gaugucggugcaggagcugaaggugaguggagugcugccaagaauaugcccgacuc

SEQ ID NO: 4106769 - RNA, 82 nt, Human
gaugucuaaauguagguaaguucguagauuugcuugccuuuaugagaaggccugagucuuuagaauucuaacuuuuuacauc

SEQ ID NO: 4106770 - RNA, 57 nt, Human
gaugucuacugguacauguuaagugauuuccggaucacauauguagaaguggaauuc

SEQ ID NO: 4106771 - RNA, 98 nt, Human
gaugucucucagucuuaguuuccuuaucuguaaaauggauacaaugucaaguagcaaugacuuggaucugcagugggaauuaagucugauuaugcguc

SEQ ID NO: 4106772 - RNA, 57 nt, Human
gaugucugccaaagaaucaagcuucaugcugugcuugauucagaccugucagacuuc

SEQ ID NO: 4106773 - RNA, 78 nt, Human
gaugucugucacaggugcgggguaguagcuagcagauauuuguucuguguuugccauccuugcuccaggacaugcauu

SEQ ID NO: 4106774 - RNA, 61 nt, Human
gaugucuuagguaacauucuauugcagaucucugccuucggagcaguaacuugagaugauc

SEQ ID NO: 4106775 - RNA, 67 nt, Human
gaugucuuggucaacuugggcugccauaacaaauagcacagacuggggggcuuaaacaacagacauu

SEQ ID NO: 4106776 - RNA, 55 nt, Human
gaugucuuucugugugccuagagccuggaacaaugccuggcacguagaagccauu

SEQ ID NO: 4106777 - RNA, 57 nt, Human
gaugucuuuuuccaggcucuuuugcuuuauagcaauagacccaagaguaaaggcauc

SEQ ID NO: 4106778 - RNA, 99 nt, Human
gaugugaauucuuaugucuauuucugcaggaugcucugguggugcugugacaugccaccugcacccuccuccuucaggacagacguucucauucccauc

SEQ ID NO: 4106779 - RNA, 76 nt, Human
gaugugaccuuucuugucuucuugggauuuuccuguagucaaaaaaggaaggugucacugggacaggaaagacauc

SEQ ID NO: 4106780 - RNA, 66 nt, Human
gaugugagggauaauaugcgggguuuuuuguguuguacuuagccacugcauguuuauuugcgcauu

SEQ ID NO: 4106781 - RNA, 112 nt, Human
gaugugcuagaggaugaugaugauggugcugauaguaacaauaauaacuaugacauguauauagaguauuacaauuuacauugcacuuucagacacauuaucucuuucaauc

SEQ ID NO: 4106782 - RNA, 130 nt, Human
gauguggagaaacuggaacccucauacacugcugguggaauuguaaaauaguguggccgcuuuggaaaacagucuggccauucaucaacugauagccauagaguuaacauaugacacagaaauuccacac

SEQ ID NO: 4106783 - RNA, 77 nt, Human
gaugugguuuaaauaacaucucguagucaaaaaccauucauucccuaagacuauaucuccaguguuuaagccacauu

SEQ ID NO: 4106784 - RNA, 77 nt, Human
gaugugguuuauaggcuauuauaguucaucugacuuucacaauaaguacguguuaauggcuaugaacugauuacauc

SEQ ID NO: 4106785 - RNA, 60 nt, Human
gaugugucauuuggucaucugcuuacuggcauuggguuagaagaugucuauuugacuauc

SEQ ID NO: 4106786 - RNA, 72 nt, Human
gauguguggcugagggauguggauuuugguccccucugggacuccucagucacccucagcuuaucacauguc

SEQ ID NO: 4106787 - RNA, 59 nt, Human
gauguguggguacagaugauuguugcaaaaaacuuugaagcaaccaacacccgcaccuc

SEQ ID NO: 4106788 - RNA, 80 nt, Human
gauuuuaucaaaugggagcucuuuaccaggucaggacuauacuagaucugacuacaaaguagggagaaucauauaaaguu

SEQ ID NO: 4106789 - RNA, 78 nt, Human
gauuuuaucuuugguugcacugcagguguucagcucuccagauucgccacaucuguuaccaaccgauagucaagaauc

SEQ ID NO: 4106790 - RNA, 84 nt, Human
gauuuuauguuuuaaguacugaauuuugagcaaaugagagacugacugagaauucuuggugguuagaauaucuauaucaaaauc

SEQ ID NO: 4106791 - RNA, 79 nt, Human
gauuuucaugugacaguuaaaagaagucuaucuuagaaguuuaauuguaacuuagaaguuuaauuguauacugaaaauu

SEQ ID NO: 4106792 - RNA, 81 nt, Human
gauuuucgaaugcuuugaaguuuaacuugcuggacauuuuagcuuguguaaguuauauuaaaauuucagagcucagaaauc

SEQ ID NO: 4106793 - RNA, 67 nt, Human
gauuuucugauaggugaaauauucaaaauguagugaaccuacauaggguuguuaucuacacugaguc

SEQ ID NO: 4106794 - RNA, 127 nt, Human
gauuuugaguuggauuuuugcccuguaacuucgcuuucugaugagcuuaagaaaaaauaauuuuuaguuugucuuucuuucccuuauuauaaaugcuggagugaugcccuuaucagcucucaauauc

SEQ ID NO: 4106795 - RNA, 130 nt, Human
gauuuugcccaacuguaggccaauguaaauguuguaaguacaucuaagguaugucaggcuaagcuauagacguuugguagguuagauguauuaagugcauuuucaacuugugaauuauaguggguuuauc

SEQ ID NO: 4106796 - RNA, 80 nt, Human
gauuuugcuucucccagagaacagacagaugcaaugaagacacaucuuaucaauggguuuugcuuucucaagcuaaaguc

SEQ ID NO: 4106797 - RNA, 77 nt, Human
gauuuuuaauacacuucauguuuucaucuguggauguuaauuacagaauagcugacagcagaagaguauuuuagguu

SEQ ID NO: 4106798 - RNA, 55 nt, Human
gauuuuuaccuacucuacugcucaaaguugugagacccagggucaggugaaguuc

SEQ ID NO: 4106799 - RNA, 80 nt, Human
gauuuuucucucaguuuucccagaauaucuuccaagugugacauacgcacuucauguucuuggugaaaggccauaaaguc

SEQ ID NO: 4106800 - RNA, 97 nt, Human
gauuuuucuguauugcucgaaauaauuuagaauauagagccuaaaguuuacuaucuucucugacauuagauuaauuggaagcaagaacacagagauc

SEQ ID NO: 4106801 - RNA, 60 nt, Human
gauuuuucuugccaaaguguguucacaaagccaguuugcauaguuuggagugggaaaguc

SEQ ID NO: 4106802 - RNA, 64 nt, Human
gauuuuuguccucuggggauaagcacacccagggugaauucauucuccagagugggaggaaauc

SEQ ID NO: 4106803 - RNA, 83 nt, Human
gauuuuuucuggucacgugccauauuuccugauccauuguguuuggcaccaggaaacaacuuggcaugagccaguaagaaauc

SEQ ID NO: 4106804 - RNA, 76 nt, Human
gauuuuuuuaaauaguucagguuagugguuauagaaaaugcuguguucacccuagcacuuaacuccuuugagaauc

SEQ ID NO: 4106805 - RNA, 91 nt, Human
gauuuuuuuaaguuuuauuauugggagauuuuuuccuaggcaaguauguucucuaagucucuaaagaagccucccuaaaacuggaaaguuc

SEQ ID NO: 4106806 - RNA, 70 nt, Human
gauuuuuuucugaugcuuaauauuuucuuugaaauaagaaauagcaugggacagguacuagaaagggauc

SEQ ID NO: 4106807 - RNA, 121 nt, Human
gcaaaaacuggaaaaagauuuuuaacagaaagucagagaugccaaagauuaccuuccuuuuuauucagguaaacugguaggcaucauuugauuaauggagaauauuaaauucauuuugagc

SEQ ID NO: 4106808 - RNA, 72 nt, Human
gcaaaaaguccagagggcacacugaaggauucuuacaggaagcuuauagccugucuccuuuggcuaauuugc

SEQ ID NO: 4106809 - RNA, 96 nt, Human
gcaaaaauacaguaaucuuaagggaacaccauuuuaugugcagucugccauugacgcacauacaaugguguuauuuggcauaugacuguaauuugc

SEQ ID NO: 4106810 - RNA, 59 nt, Human
gcaaaaauucugagauccacugagagcuuggaugacucucagugaaucucagaauucgc

SEQ ID NO: 4106811 - RNA, 70 nt, Human
gcaaaacaccuucaugucugccuuuucaagugaugcucacagcucuauuugaucagccaggcaguuuugu

SEQ ID NO: 4106812 - RNA, 119 nt, Human
gcaaaacacuaaggaacugggagguugaaugacuucuuugacauagcacaacugguuaacauuugaacuagaaucuaugucaggaacucaugccuaguacguacuuucuguuucccugc

SEQ ID NO: 4106813 - RNA, 55 nt, Human
gcaaaacgcgcuggacaagaugcacaagcaaaaacuugucugcaguguuuauagc

SEQ ID NO: 4106814 - RNA, 76 nt, Human
gcaaaacucuuuuaucagacaacauguugggcaucacccaauuacuaucacauuugucuggcuagaaaguuuuugc

SEQ ID NO: 4106815 - RNA, 90 nt, Human
gcaaaagaaaagaaacacauucaagaugcauucacuuagccauuaucuuuuuuccuaaguuuuguuguguacugaguucauuucuauugc

SEQ ID NO: 4106816 - RNA, 58 nt, Human
gcaaaagagccagcuaccucaguuuccaaauaugucaaacaaaguacuggccuuuugu

SEQ ID NO: 4106817 - RNA, 86 nt, Human
gcaaaagcagcugcuuucagcaggagggaacugugguggagaaggccaggaucucucuccuguggagggcauugcuuugagaaugc

SEQ ID NO: 4106818 - RNA, 85 nt, Human
gcaaaagccagauauuauugaugauuuaguguguuggcugggcuguaacgaaacaucuaugaucauuaauugcuggugggagugc

SEQ ID NO: 4106819 - RNA, 56 nt, Human
gcaaaauauugacauuggcguggaagaugagcccaugcacuguuggauauauuugu

SEQ ID NO: 4106820 - RNA, 64 nt, Human
gcaaaaucauacacucacauaaacagauacgugugugugugugugugugugugugugugugugu

SEQ ID NO: 4106821 - RNA, 102 nt, Human
gcaaacucacuugagucacucgcuugaaauguaaucagucugagagauggggaauaaagacugagcugcaagucagggagguaucaggccaaagagggaggc

SEQ ID NO: 4106822 - RNA, 71 nt, Human
gcaaacugcaaacuugugagcuaaauaaauggucauuauuauuuuaagugucuaaguuuugggugguuugu

SEQ ID NO: 4106823 - RNA, 63 nt, Human
gcaaacuggcuaugggaaucuugcagccagauuguaagauaaagcuaaccuuacacaguuugc

SEQ ID NO: 4106824 - RNA, 55 nt, Human
gcaaagacaaauuagaacuccuuuucucaaggagacuucugguuauuguauuugu

SEQ ID NO: 4106825 - RNA, 62 nt, Human
gcaaagacagaggggucacagccugaaggagcagcauccuugccaacgcccucugucucagc

SEQ ID NO: 4106826 - RNA, 92 nt, Human
gcaaagacauuauaagguauaaggccuauuuuuaguagacacuauguaaacuuauacuagaaaauaggcagaugcauuguauuaaacuuugc

SEQ ID NO: 4106827 - RNA, 69 nt, Human
gcaaagaguuuuuucauauaauggcaguugcucaaccuccuguccuuauauuucuaugacucuaguugc

SEQ ID NO: 4106828 - RNA, 60 nt, Human
gcaaagcuggauaugugaugugauaauauauucuacaucaucaugcacucucagguuugc

SEQ ID NO: 4106829 - RNA, 78 nt, Human
gcaaaggacugcauguagcuaugagugaguugucuggacacaggguuuggaggacucugcaggcugcuccuucuuugu

SEQ ID NO: 4106830 - RNA, 102 nt, Human
gcaaaggaugaauuuaaauauuagaacaagugauaaaggggaggaagugugcuacacucagccaaucuuaucuuuauuuucuacuuuauuauucugcuuugc

SEQ ID NO: 4106831 - RNA, 74 nt, Human
gcaaagggcacuaaaugaugaagugcuucaaguuauuuuguaaguuaguggagaguuauuaucagcccuucugc

SEQ ID NO: 4106832 - RNA, 80 nt, Human
gcaaagguaauuuucauggauuucuucagagaagaguuauuuuugugaaucuuuucuagcaaauccaggaguacuggugc

SEQ ID NO: 4106833 - RNA, 85 nt, Human
gcaaaggucauagagugugagccuacaggccaaagcuguccacaaacauguuuugcuggcuucucaguauuuuaugacuuugagc

SEQ ID NO: 4106834 - RNA, 114 nt, Human
gcaaaggucuaacagggguauugauaucagaguggguuuuaaaaguguauuaacuauaaucuuacuuuuagccuauuugauucuacuuauuucagaacuauuaaugacguuugu

SEQ ID NO: 4106835 - RNA, 78 nt, Human
gcaaaguaaggaggcagucauuaucaggugccggcgugcacuggugcggcugagagugagugucuccguaaauuuugc

SEQ ID NO: 4106836 - RNA, 96 nt, Human
gcaaaguaucucaguuuuaaugaaugauuuuauguaaaugaauagacagccuauuauuucauauaauguuaucaauggauuggaguguugcuuugu

SEQ ID NO: 4106837 - RNA, 84 nt, Human
gcaaagucugauugggccaaacccugggaaauguaaauauauuuauucuuauuuuacuauuuggcaaagucuccugauaauugu

SEQ ID NO: 4106838 - RNA, 94 nt, Human
gcaaauaaauauauacuguucugugagguaaugugacagagauagugcguaacaaauguacauaugcucaucugcauucccuugcauuauuugc

SEQ ID NO: 4106839 - RNA, 79 nt, Human
gaguuuuagauuggaaagcaacuuuugagaguuguuuggaacucccuuagcuacuuuuauuugcuucuaauaaacacuc

SEQ ID NO: 4106840 - RNA, 80 nt, Human
gaguuuuagcucuuacauuuaggucuaugauaaauuucaaguugauuuuugcauauagugugagguaaggguccaagcuc

SEQ ID NO: 4106841 - RNA, 66 nt, Human
gaguuuucuaaacugugaaaugcuauccaaaugucaggaacuguuacauaguuauagaucuugcuc

SEQ ID NO: 4106842 - RNA, 100 nt, Human
gaguuuuuaguagggaccugcuuuugagcccagugcucagcuugaacagguuaauugagccuucugggacaaaucucagcauugguuauauuauuauuuc

SEQ ID NO: 4106843 - RNA, 74 nt, Human
gauaaaaaguuuugacucaguggacguacuagcuuguaaagguuaggaccugcugggauuacaaauaaaacauc

SEQ ID NO: 4106844 - RNA, 80 nt, Human
gauaaaacauaguucagagcagcagaccucugaaaaaagagaacugucacauugcuuuaaaagacuugaaauguauuauc

SEQ ID NO: 4106845 - RNA, 71 nt, Human
gauaaaauguguaucccagaggcacuauucagaaccuucugagcuauguuccucgaugcucaguuuuuauu

SEQ ID NO: 4106846 - RNA, 130 nt, Human
gauaaacaacgaaucccuuuuuaauguaugucccaugcaauaugugugauaaagaauaauuuuuuuagcauaauuaugucucagguauugaaugggaacacuguuacuaauacaagaucaguuguuuauc

SEQ ID NO: 4106847 - RNA, 110 nt, Human
gauaaacaggcacccccguccccagcagaaauagcaucagauagcaauuugggcaggggcuuuucucuguuuuguuguguuucugugcugaaauggggcccuguugaauc

SEQ ID NO: 4106848 - RNA, 74 nt, Human
gauaaagagauuuucuuucaugcaugcaggaaagauuccucuuuuaguguaagcauaaagaacauuuuugguuc

SEQ ID NO: 4106849 - RNA, 100 nt, Human
gauaaauauccggagggcacacuaaaauaguuuagcucucauuucagccaacagguuuugaagucagagcuugagcucuuccugcccccuuguguuuguu

SEQ ID NO: 4106850 - RNA, 77 nt, Human
gauaaaugaaauacuguaaaguuauuauuauuuuucagcugagcagaguaaucauuuuacaguguuagaaacuuguc

SEQ ID NO: 4106851 - RNA, 75 nt, Human
gauaaauuagguuacgcuaugggaacaaacucucaauguuaauaaaaguugauuuccuagcugacaugaaauauc

SEQ ID NO: 4106852 - RNA, 66 nt, Human
gauaaauugcaauuaacauaugucaacuguuuugaacagugccuggcauuuguuaaguguuuuauu

SEQ ID NO: 4106853 - RNA, 130 nt, Human
gauaacugacuacauauuuuauuuuuuaaugcagauguucagcauucuauaaauauggauucuuaaugacuugggacaaaaauauuagaauguaugaacaacugaagaauggaaugaguggcugcagagc

SEQ ID NO: 4106854 - RNA, 105 nt, Human
gauaagaaaacugaggugcagaagagauuaagugacugaccucuugccuaguugguagcaaagucaggauuugaacucaggucugucugcuucuguuuuucuguu

SEQ ID NO: 4106855 - RNA, 61 nt, Human
gauaagauuuccuuaauuagagcaagacacaccuaguaucuagagccuggaagucuugguc

SEQ ID NO: 4106856 - RNA, 82 nt, Human
gauaagauuugcacagaugagggugaugcuauggggucccccagagcaauuaauuuauucauuucuucaguaaauauuuauc

SEQ ID NO: 4106857 - RNA, 129 nt, Human
gauaagcacuucaggugauucuaaugaagguuuaaauaugaaaaucacugucuucccccacagaggacauuugacucuguucauauuauuaagcccagugcagauacacccugaagaaugcuuuauauc

SEQ ID NO: 4106858 - RNA, 70 nt, Human
gauaagcagguaagaauggcagaacacuggcuuauugucaaccaauguuuuuuuauauaccugaaguauu

SEQ ID NO: 4106859 - RNA, 95 nt, Human
gauaaggaaacgcacaaagaaguuagaugacuuguugaaaguaucuauuauuuaacauaggcagcaucucauuugacuucugcauuuucuuuauu

SEQ ID NO: 4106860 - RNA, 58 nt, Human
gauaaggcagucccuuaacaaggcucaguaucuggaucaaggucuuguacugcuuuuc

SEQ ID NO: 4106861 - RNA, 74 nt, Human
gauaaggguggguucauuauucuugggcguccuggcugugcugugacaccagagacugaugaggccaccccauc

SEQ ID NO: 4106862 - RNA, 72 nt, Human
gauaagguggcuuaagauuugcgauaccuaaugccagcuagguauuagguaucucaaaucuuaagccccauc

SEQ ID NO: 4106863 - RNA, 56 nt, Human
gauaauaggucugaaacuucuggaagccccuaggccagcagguggagccucuuguc

SEQ ID NO: 4106864 - RNA, 76 nt, Human
gauaauaugagcaagcagugaaguugaauguaauauauagguuaaguaauaauaucauuguuugcauaguguaauc

SEQ ID NO: 4106865 - RNA, 113 nt, Human
gauaauuaauacugaaagcuuagcacagugcauggcaaguggcauagaauagccaaaacggcugcuguuguuacugugugguuacugugcuuguucuugucgcuauugauuuc

SEQ ID NO: 4106866 - RNA, 102 nt, Human
gauaauucugccagacuguuggaaagaagggcugagcaaggucauaaugacauucacuguacuugugucccugcuuucccuagucuuuuugguaggauuauu

SEQ ID NO: 4106867 - RNA, 88 nt, Human
gauacaaucccaagguagccucuugaaaugaacauggauaauugcuccaauguuauuaucuagaggcaagaaccuugagaaauguguc

SEQ ID NO: 4106868 - RNA, 57 nt, Human
gauacacauuacuuucugucugaguagcguucucacccagacuugugaauguguguu

SEQ ID NO: 4106869 - RNA, 60 nt, Human
gauacagguaauaauaacagaaaaacaaaucuguuuuucagccaugaauuacacuguguc

SEQ ID NO: 4106870 - RNA, 127 nt, Human
gauacaugaaacuauuuaaaacggcuuuacgucucagaagaauuuaauccuucaaaguaauauaauuuugaauaaacgguuaauguucauuuuaagauggauuuuagaguuuguagucauauguauu

SEQ ID NO: 4106871 - RNA, 76 nt, Human
gauacaugggaagugcuggcccauagcugcuggcugaacaaggcuagucucuggaggucagggcugccacuguguc

SEQ ID NO: 4106872 - RNA, 61 nt, Human
gauaccagugaauuaggacaaaagggcuucaguucaagcacuuacuuccuaauucccuauc

SEQ ID NO: 4106873 - RNA, 55 nt, Human
gauaccucuaaauagcucacuaaguccuauaaggaucauggcugcugagagguuc

SEQ ID NO: 4106874 - RNA, 102 nt, Human
gauaccugaggaaaggucuguggucggagcugaguggguuuauugaucuuacuggaaaaugggcauuucagcuucucuccaaggaaccagcccagacguguc

SEQ ID NO: 4106875 - RNA, 88 nt, Human
gauacugcuacugucaaacagcugcuggauaaucaucccaaaggagaagggagagauguucauucagcauguucagcaguguggcuuc

SEQ ID NO: 4106876 - RNA, 104 nt, Human
gauacugcucugucugccucuuucacauuuaucuguucuuucuagccagcuauagaguuucucuagaaucccaaauggacugggaagucagaccuggcagcuuc

SEQ ID NO: 4106877 - RNA, 62 nt, Human
gauacuguaaguaucuaauuuaauccuuuugacagucagaggaaggagguccuaacaguauc

SEQ ID NO: 4106878 - RNA, 91 nt, Human
gauacuuaguuucucacuguaguucuuggccaagucacuacuuuucuggaguuccuugugccaugaacuguaugaaggacugaauacuauc

SEQ ID NO: 4106879 - RNA, 66 nt, Human
gauacuuucucauuuacccaagaacagggcuuucacaggcauggagagggugggagagaggguguu

SEQ ID NO: 4106880 - RNA, 58 nt, Human
gauagaaagguguugaaauccaucagggaagacuuccuggauaaaggcacuuuucauc

SEQ ID NO: 4106881 - RNA, 66 nt, Human
gauagaauuugcagccugcagauauaaccaucuacguucgucaucugaaggcugucaaugcguauc

SEQ ID NO: 4106882 - RNA, 74 nt, Human
gauagacccaaaagagcaguuuaaaaugcuuuaauuuuuuuaaaugugauacuguucuuuuuaaggguucuuuc

SEQ ID NO: 4106883 - RNA, 90 nt, Human
gauagagcaaagaauauuuagaugcauuuggauugcuucagggcucacagaugucugcacccauauggauuugaggauucuggcuuuguc

SEQ ID NO: 4106884 - RNA, 127 nt, Human
gauagauuugagguuugacuuucuacugccuguauuuuccaaaaaccacucaaguagauauuaacaaaagaacaguucuauguuaguaauacuggggcacuugguggaagcaaacaccaaaucuauu

SEQ ID NO: 4106885 - RNA, 67 nt, Human
gauagcagcucuggggucagacugacaacaaggggcuggaccccuuuucugccuccagcuguuuauc

SEQ ID NO: 4106886 - RNA, 71 nt, Human
gauagcauggccaggaagcuggggacugggauuccaacccaggcagucuggcuccugaguccaugcucuuc

SEQ ID NO: 4106887 - RNA, 95 nt, Human
gauagcauugacuucuagguuucugaguuuccuguuuaaaauuuaugaacaguauugguugaacucaagaaaguucuuuuaagaucaaugaaauc

SEQ ID NO: 4106888 - RNA, 77 nt, Human
gauagcauuuaaacaaauauuucagguagguacuucaaaugcauuugacauuuaucaaagaaaugguaagugcuguc

SEQ ID NO: 4106889 - RNA, 83 nt, Human
gauagccaauggccagggccaaaagagaugccuuuggaguagugcuagccaauaucucacuugagcuuugcuuuucuguuauc

SEQ ID NO: 4106890 - RNA, 60 nt, Human
gauagccuuaggaagauuguaguugaccaggaagcccaauuuguaucuuccaaaguuauu

SEQ ID NO: 4106891 - RNA, 82 nt, Human
gauaggagcucaugcugcaggcccaggcaggcaggugcucugaaugccuagaaaucugccuggguguggagcagagaggguu

SEQ ID NO: 4106892 - RNA, 69 nt, Human
gauaggagugccccagauucuagcagcaagacccuguuggcgaccucuggcuucuggggccucuguuuc

SEQ ID NO: 4106893 - RNA, 62 nt, Human
gauagggagacaggagaacacugaauuaagaaucaagaugcuuugcucugucucuagcuauu

SEQ ID NO: 4106894 - RNA, 59 nt, Human
gauagggucuuuacagaggugcuuauguuaaaauaaggccauuauggugggcccgaauc

SEQ ID NO: 4106895 - RNA, 86 nt, Human
gauaguaguauaggaacagggaggugggccaagguaagauaaauuaucagacaaugucucauauucguguuccauuucuauuuauc

SEQ ID NO: 4106896 - RNA, 91 nt, Human
gauagugacagcagcuuggggccaguagcaccuguguggacccagccucagguuccggggugugguaauggcagcaggcaguagcacuauc

SEQ ID NO: 4106897 - RNA, 58 nt, Human
gauauaacgacuucccaggucuuuuacaugucugagcugaaacuggaguccuuauauc

SEQ ID NO: 4106898 - RNA, 65 nt, Human
gauauaggcagaucugagaauauuagcuauuuaauauccuggcuggguaaucuuucugauauauc

SEQ ID NO: 4106899 - RNA, 55 nt, Human
gauauaggcucuuguuaaccuuuuauuuugagagguucuuuugagagguuaucuc

SEQ ID NO: 4106900 - RNA, 71 nt, Human
gauauaugcauuuuauagugcaaagcauuauuucacaguuauauagcgcuuuguaucuguuaaauguuuuc

SEQ ID NO: 4106901 - RNA, 69 nt, Human
gauaucaauguuauuucugaucuaguugugacauuuaaaguuccggcuucaugagaaaugacagauguu

SEQ ID NO: 4106902 - RNA, 89 nt, Human
gauaucauuguucuucauuguugucuuuaccuguauuucaauguauaugaaguggaggauuagcauaguuuaauaaauacaaugauguu

SEQ ID NO: 4106903 - RNA, 81 nt, Human
gauaucucagauaugcacaguuacaagaauaucaggugguagcugcacuugcugugaaauaauauugugcaauuuuauauc

SEQ ID NO: 4106904 - RNA, 78 nt, Human
gauaucuugcuuuuuauuauugcuugauacagaaaucauuuuacugaaacauugcaauaacaaagggccucugguauc

SEQ ID NO: 4106905 - RNA, 58 nt, Human
gcaaauaagaagcagaauguucuacccuaucaauaguaacaaucuguuuguugucugu

SEQ ID NO: 4106906 - RNA, 67 nt, Human
gcaaauaugugaggcaaaguuuauaggaguuaaauauuucuaagaauauugcucuuaaaagguuugu

SEQ ID NO: 4106907 - RNA, 55 nt, Human
gcaaaucaccaccuagcuggaugguaugaacugcuaaccacuauggaguguuugc

SEQ ID NO: 4106908 - RNA, 76 nt, Human
gcaaauccaaugaaagcaacugccuauaagaaaauacuuuacauuuuuguuauagguuuguuuuacaugaaagugu

SEQ ID NO: 4106909 - RNA, 78 nt, Human
gcaaaugaaucuugugagauuguucagaguuucuacuagaggaguacagcuguucauuucaccuuagagaauuauugc

SEQ ID NO: 4106910 - RNA, 74 nt, Human
gcaaaugaauguaaaauugccuacaagacagaauaggucagagaaggcaauuuuaugguucuuuuuucauuggc

SEQ ID NO: 4106911 - RNA, 126 nt, Human
gcaaaugagguccauuacaggagcauuccacaucuucuuaacuccaaagugugacacuuuuaggcacuauggaagauuuugagagauaaauuuggggcuugcuccaguacccuuuaaaucacaugc

SEQ ID NO: 4106912 - RNA, 56 nt, Human
gcaaaugcacugcauuuagauugauuuuugucuuagucaaacugggguacauuugu

SEQ ID NO: 4106913 - RNA, 76 nt, Human
gcaaauggcagauuuuuauugguaagauuuuauaacugauuaaguucuaccuccuagaaaaucuggagccaaaugu

SEQ ID NO: 4106914 - RNA, 60 nt, Human
gcaaaugugugugcaugugaauguguguguaaacacacacaggcauagccauacaugugu

SEQ ID NO: 4106915 - RNA, 60 nt, Human
gcaaauguuuuugaguguuuacuguguagcagucagaguaggcacuuaaccaauguuagc

SEQ ID NO: 4106916 - RNA, 64 nt, Human
gcaaauuagguuauguugguugauugcaguguucacagcuucuaacaugucccugauucuuugu

SEQ ID NO: 4106917 - RNA, 57 nt, Human
gcaaauucuuaacuggacuguggaagccaggguuuggcagcuggucucagagcuugc

SEQ ID NO: 4106918 - RNA, 80 nt, Human
gcaaauugcagaauguacauguaaguugguuuuauugaaguuauugccaauaaggccaaguucauauacaacuugcuugc

SEQ ID NO: 4106919 - RNA, 82 nt, Human
gcaaauugugaccaaggaaucuuagggucuaugugaguggucacaggagaacccacagauucucaagcugguuguaaagugu

SEQ ID NO: 4106920 - RNA, 77 nt, Human
gcaacaaggcagggggaggcucccagcuaauccagacuugaaucucagcugugggugggagcacccugucuggaggc

SEQ ID NO: 4106921 - RNA, 57 nt, Human
gcaacacaauaucccaguacaucauaagguuggaugcugaagggaaaguugugcugu

SEQ ID NO: 4106922 - RNA, 67 nt, Human
gcaacacccugguccugggcccaagccucauucugcugcggggcuggccagaguuggaggguguggc

SEQ ID NO: 4106923 - RNA, 63 nt, Human
gcaacagaaacuguagugcuucgaucugaccuggcggucugaaagcauuacaguuuauuaggc

SEQ ID NO: 4106924 - RNA, 85 nt, Human
gcaacagaaaguguacuguuggauguugcaguuuucuuuuccacaccaggaaaacuaaacuacaucucauggaugaggcuguugu

SEQ ID NO: 4106925 - RNA, 81 nt, Human
gcaacagagcaagcaugucagaagaacaaugagauauaggauuuguguuuuuuucuacccugacauuuugcuuccuguugc

SEQ ID NO: 4106926 - RNA, 69 nt, Human
gcaacagcaauagugugaugaaauuacuugccauuucuaugggugucaaugucacacgauugcuagugc

SEQ ID NO: 4106927 - RNA, 78 nt, Human
gcaacaggaaagauuauggcauugaaauacucauuuauacuuuuaugguaguucaaaaugguggucuuauuucugggc

SEQ ID NO: 4106928 - RNA, 109 nt, Human
gcaacaggacaagacuguacggcuaccagguugucuaauuccaaggggcacuuuaacauuauagucucugugaauggcgucaccugggguugugcagugcacugucugc

SEQ ID NO: 4106929 - RNA, 57 nt, Human
gcaacaguuggauuccagaggagcucuuucaucuucuuaagagaaucaacuguuugc

SEQ ID NO: 4106930 - RNA, 90 nt, Human
gcaacaugucacugucagcccacauguacagaagcaggcugggacacucccagccccagaucucucguacaugugggugcacacaguugc

SEQ ID NO: 4106931 - RNA, 80 nt, Human
gcaaccacuacaccaccuccgaggucagggucuuuggugucccagagguucuggagaacuuggaggugaguggcaucugc

SEQ ID NO: 4106932 - RNA, 81 nt, Human
gaucagugcccuuuuuguuugacuuuggaagagcaacacaaauaaauacaguagguuccauuuaaacaaagaacucugauc

SEQ ID NO: 4106933 - RNA, 57 nt, Human
gaucaucucaggcauggguacugcagucaagaguguagaaauacagcagggaugauc

SEQ ID NO: 4106934 - RNA, 60 nt, Human
gaucaucugggcuccuuguagugauggacacauuuucaugaggcaaggucuuagaugauu

SEQ ID NO: 4106935 - RNA, 63 nt, Human
gaucauuucaguccaguaaauacaggcuaucccaggauagcuuuuacagguccugcagugauc

SEQ ID NO: 4106936 - RNA, 118 nt, Human
gauccaauaggucuauagcuuggccccaaagucuggugauucugacugagacaggaggucucugaaccucacucugagaaacacuaaaccaugggguacuuguaggagcagacggauc

SEQ ID NO: 4106937 - RNA, 56 nt, Human
gauccaguucucagugcuuacaguaguuauccuauuguaaguaaagaaauaggauu

SEQ ID NO: 4106938 - RNA, 70 nt, Human
gaucccagccuccaaggccccaagguccacagcucugauucuggcaaaggcagauggaagaggcuggguc

SEQ ID NO: 4106939 - RNA, 83 nt, Human
gauccccuugaugacuugggcuugggcguggguuuagugagcacccgaaccuaccggguucagguuguuugaggccauggguc

SEQ ID NO: 4106940 - RNA, 84 nt, Human
gaucccgggaccugaaacuggaguccggguguuuauaagagcaaggcuaaauuucaguuauugaaacagguccaggcugggauc

SEQ ID NO: 4106941 - RNA, 63 nt, Human
gaucccucauguggauuuccauuggcuguuuagucacaaccacuggaagaugcugaggucauc

SEQ ID NO: 4106942 - RNA, 95 nt, Human
gauccuaaaugccuuugauucuuuuuugagagguaaguggguguuaaauuauacaugaaauuacuucuuacaaaagaaauauuuuauuaaaaauc

SEQ ID NO: 4106943 - RNA, 65 nt, Human
gauccuagaguucuagugacaacgggagggaaaaauuguaguagucccacuggaagauuaggguc

SEQ ID NO: 4106944 - RNA, 78 nt, Human
gauccugaacuaacacaugguucugucaggaaggucuucaucucccugaacacuacuaugaugcuggaguuugggguu

SEQ ID NO: 4106945 - RNA, 76 nt, Human
gauccugccuugcucauuccgugagaagauccuuguaccuuaagaaagcagagauacgggaagagcaagguggcuc

SEQ ID NO: 4106946 - RNA, 97 nt, Human
gauccugguuaugcuagcucucugcagcacuuaauguuucgugaaugcuacaugauaaauuagguguauguaaauagucuuuuagauagcugggauc

SEQ ID NO: 4106947 - RNA, 62 nt, Human
gauccugucuguggagucagcacagacagaaacuguucccuggcuccgaagacuccaggauc

SEQ ID NO: 4106948 - RNA, 55 nt, Human
gauccuguuucauggguuucuggguauaccccuugaaacaccagagucaggaguc

SEQ ID NO: 4106949 - RNA, 80 nt, Human
gauccuucucaaucagagcagugugacuuuaccacauuacuacuaggguuuucaucaagauuguucuggaggaaaggauu

SEQ ID NO: 4106950 - RNA, 74 nt, Human
gauccuuuauuuuaagauauuuggcuugagaaacuugcuuagcucacaggccaauuucuugucauuuagcgauu

SEQ ID NO: 4106951 - RNA, 56 nt, Human
gauccuuuccuauuuggagcugugggguuggggaagugacagggaaggauaggauu

SEQ ID NO: 4106952 - RNA, 69 nt, Human
gauccuuugcuacuuugcagcuagcuaggacccaaaugguccacugguauccacaguggggaagugauu

SEQ ID NO: 4106953 - RNA, 63 nt, Human
gaucgcauagcccugcaugauacuggaauguuccguggugagguauugcagaguuaugugcuc

SEQ ID NO: 4106954 - RNA, 83 nt, Human
gaucgcuauucaccaaguauauuugaacauguaaaugcuuaagaaauaagcauaaugcggauauaguuuggguuaauaggauu

SEQ ID NO: 4106955 - RNA, 79 nt, Human
gaucggggggguaagacaaagggguccuuggaugggggcaccugugagcagggaccccuuugucugagcuccccggguc

SEQ ID NO: 4106956 - RNA, 59 nt, Human
gaucuacccuuuguccuguguucuguugcugcuugcacagggcuguccagggcuagguc

SEQ ID NO: 4106957 - RNA, 55 nt, Human
gaucuaggcucggcucagaugugcuugucucaaagcagugaguuaaguuuagauc

SEQ ID NO: 4106958 - RNA, 66 nt, Human
gaucuaguagugucuuaaacaaggucaaagguaguuucuggccuuuggaaaguaagcagcuagauu

SEQ ID NO: 4106959 - RNA, 113 nt, Human
gaucuauagcaagcaaaucaucgguuuuuauucugcauguagguuugcucacuuaaccaaaguacugccaugucagaauaaacaagaacuaaaugguaaugauuguuaggauu

SEQ ID NO: 4106960 - RNA, 130 nt, Human
gaucucacuugauaaacuuuugauuauauuuccaguugucuuaucggagcacuuuguaaacggggugauuuauccauuuucugguugggaaaacuguaacucagaagaauuuaguaauucauuugagauc

SEQ ID NO: 4106961 - RNA, 58 nt, Human
gaucucagguccuuuaguguccagaaccucggcaacgggcucuuagaggauggggguc

SEQ ID NO: 4106962 - RNA, 130 nt, Human
gaucucauuuauccauuuuugccuuggcugcuugugcuuuggggguauuauucaagaaaucuuugcccagaucaauuuccuggagaguuuucccaaaguucuucuucuaguaguuucaugguuugagguc

SEQ ID NO: 4106963 - RNA, 66 nt, Human
gaucucuaaggucuugcugcucaaaauguuguccauggaccagcagcagcagcagcaccagggauu

SEQ ID NO: 4106964 - RNA, 87 nt, Human
gaucugaaagucauagguccauauuauuauuuuuaaacaaaucauacugauucauguaacaguuauaacaauguggccaugaggguc

SEQ ID NO: 4106965 - RNA, 63 nt, Human
gcaaguagaagagaugacaaaggagcauggggaugguugguauguauuccucaucucauuugu

SEQ ID NO: 4106966 - RNA, 78 nt, Human
gcaagugauugucacgucccuuaugccucuuuuggucaaaagcaauucauaacacagggacuugaccaauugucuugu

SEQ ID NO: 4106967 - RNA, 59 nt, Human
gcaagugcuugaggggaauaaaaagaaccuuaagguagguuccuacccucaagcaaugc

SEQ ID NO: 4106968 - RNA, 130 nt, Human
gcaaguggcuauuuggaguacaaaauuuaaggaggcacucacucucagggucacagagcucagagucggcacccucaggacccgaaagugagcaccuccuuaaauauuguacgccaggugucucgcuugc

SEQ ID NO: 4106969 - RNA, 123 nt, Human
gcaaguuaaccaaaaugcauuucuaagggauagaauuucaaggggugugagaaagucaaguguggaauuucaugccucuugagaaagaugcuuuuagcccuggaagccuuuucaguaccuugu

SEQ ID NO: 4106970 - RNA, 63 nt, Human
gcaaguuaaguaccauguucauuugccgggauuccucccugcaggauuucaugggcugacugc

SEQ ID NO: 4106971 - RNA, 85 nt, Human
gcaaguuacccaaaugagaaugucacaaaagcaaucaacgcaggacccagcuugagaggcuguugacauucuguguaauuauugc

SEQ ID NO: 4106972 - RNA, 75 nt, Human
gcaaguuaguggaggagccaaagugaaaaugcaauauccucacugcuaaucuuguacucuuuccauuguauuugc

SEQ ID NO: 4106973 - RNA, 85 nt, Human
gcaaguuuaggguauuuaacuauaaugaguuaacuuagugcugauaggauauucaugaccccaugguugauugaaaugagcuugc

SEQ ID NO: 4106974 - RNA, 87 nt, Human
gcaaguuucaccaagccgaugaaauugaucuugaacuuuuggugagagaaaggaagaaaggucauuuuagaagugaguggaaugugc

SEQ ID NO: 4106975 - RNA, 118 nt, Human
gcaaguuugugucuucuuuuucuucuucuuucuucucuuuuaauaagacuaauaacuagaggucuuaguuaaaauaauggagauguugaaaguggauuugaaaaugcacgguagcugc

SEQ ID NO: 4106976 - RNA, 58 nt, Human
gcaaguuuguuuugaguguuaaauaagauaauccuuuaaacauuuagaauguacuugc

SEQ ID NO: 4106977 - RNA, 57 nt, Human
gcaaguuuuguuaucuuagauaucugacucucagaauaucuuuuagagcaagcuugu

SEQ ID NO: 4106978 - RNA, 85 nt, Human
gcaauaaugccagccgauauugugaauuuuagagaguaugcugaguaauuuuuggccuuucuacaauuuuuggcaugagcaaugc

SEQ ID NO: 4106979 - RNA, 97 nt, Human
gcaauacaaauuuaaaagaacuguaauuuuuacauaguaagcuagcuaaaguuguuuuaaagcuguuaacaaugugagggugcaguggacagguugu

SEQ ID NO: 4106980 - RNA, 57 nt, Human
gcaauaguggcaaugguaguaaggucaccaucccuuuucuauuggcgucacuguugu

SEQ ID NO: 4106981 - RNA, 108 nt, Human
gcaauauuugucugguuucuuuuucuuuaaaugaauucucuguaguuccaguuucccuacugcaugcaaugugaagaaagcuaugggaacgcaggcucaacucaaugc

SEQ ID NO: 4106982 - RNA, 66 nt, Human
gcaaucccagaucugaaugucaccuuuugucccacuguccagggucagcuucagcccuaggauugc

SEQ ID NO: 4106983 - RNA, 77 nt, Human
gcaaucucagccuaugaugcuguuauuaucuauacuuuuaagaauauauuuagcaguguuaaacuugcugaaguugc

SEQ ID NO: 4106984 - RNA, 97 nt, Human
gcaaugaagccuggagagucucaaggcaggaaacugaucagucauauggcucaccucuuuuguuuccugucucucaggggccacuuuucuucauugc

SEQ ID NO: 4106985 - RNA, 61 nt, Human
gcaaugacagagcugugcggcugguauucggaaccauccucacaguguucgugucagaugc

SEQ ID NO: 4106986 - RNA, 87 nt, Human
gcaaugagaaugaagcugcucacagggauucaugcuguagaagacaggccaggacccuggagggcaucugagaucaucacucauugc

SEQ ID NO: 4106987 - RNA, 108 nt, Human
gcaaugagaaugcuagccuggcaguggugaagaagaggccucagauaugugagacugagaauuccucaauuuacuucccacuguucagcagagagcacccuucugugc

SEQ ID NO: 4106988 - RNA, 61 nt, Human
gcaaugaggagugguagggauaagcgggcacuuuucugcccuccugccacaccucaguugc

SEQ ID NO: 4106989 - RNA, 68 nt, Human
gcaaugaguaagauaggcaauguguuagucuacucauauaacaucaugccauaacuaacuuaacaugc

SEQ ID NO: 4106990 - RNA, 61 nt, Human
gcaaugcaccugaacuccaucagcugaugcuucuccagcugcugagccaggcugauguugu

SEQ ID NO: 4106991 - RNA, 62 nt, Human
gcaaugcuggaacuugacaauuuaggauaagucaaaauccuuagagacaagaccaguuuggc

SEQ ID NO: 4106992 - RNA, 61 nt, Human
gcaauggaguuuuuaaguuucuguuauggucuguacaggggacagagacugagacacuugc

SEQ ID NO: 4106993 - RNA, 61 nt, Human
gcaaugggaaaagaguaugauuuagcucccacuuucuggaucacaucuacuuuuucuaugc

SEQ ID NO: 4106994 - RNA, 86 nt, Human
gcaaugggcaggguguguccugggaacucacaguccagggcugggcagggcugggcuggauucccuggagccccuugugcccuugc

SEQ ID NO: 4106995 - RNA, 55 nt, Human
gcaauggggagcucaccaccuguuuugaagccaggcagguuugggcucuucuugu

SEQ ID NO: 4106996 - RNA, 74 nt, Human
gcaauguccacaccugggucagugugacagucgguuccuugcuguccuuccuggcuggggugugugcaccuggc

SEQ ID NO: 4106997 - RNA, 130 nt, Human
gcaaugugaugcacacagaaaugaagaaugaccauuuagaaacuguuuuuaacaguuugacauuguugugucauccaugugugauaacauuuuucuaguaauucuuguauuuacaaaaguaucacaucgc

SEQ ID NO: 4106998 - RNA, 55 nt, Human
gcaaugugcccgucucucugcagccagucaagugcaaagaaaucugggucauugu

SEQ ID NO: 4106999 - RNA, 129 nt, Human
gcaauguugaucaguuaaacaguaaguuaucguaaacaucuuguacugcacauuuuacccuaaucggguggagucaacaaauauguaagugauaucucuguuuauauauugucaauaguauuuauuugc

SEQ ID NO: 4107000 - RNA, 69 nt, Human
gcaauuaaccagaccuugauucaaucguggcucuacuauugacugucugcaaggccuggaucuaguugc

SEQ ID NO: 4107001 - RNA, 78 nt, Human
gcaauuacuccuuuggucaccuccacucuuauucucauuagcaauugaaguaagggccaguggagagggaaaaauugu

SEQ ID NO: 4107002 - RNA, 84 nt, Human
gcaauuccaggccauuaaugagaucaagaaucccaacucugaaauaaagcagugauuuuaugucauugguagcuagauuuuugc

SEQ ID NO: 4107003 - RNA, 58 nt, Human
gcaauucucaggaauuucaucuguggcuuuugcaagcuauauaugagcugagauuugu

SEQ ID NO: 4107004 - RNA, 62 nt, Human
gccagcuuugguguucauuaaacauggucuugcugcaucaacuccagggcuccaagcugagu

SEQ ID NO: 4107005 - RNA, 66 nt, Human
gccaggaaaaugugacaguguuugacagaugcucagcugggcuuuccccaggcauugcauucuggc

SEQ ID NO: 4107006 - RNA, 55 nt, Human
gccaggaaauucaugccagaucuacugaaagaaaaggcaagaugaaauucuuggc

SEQ ID NO: 4107007 - RNA, 89 nt, Human
gccaggaccaggagcucagagcccuuggcuccccagggcgggaagacgguuauuuaccaaggcaggaccaggagcucagagcccucggc

SEQ ID NO: 4107008 - RNA, 64 nt, Human
gccaggacugccuguaucucuucuuccuggugacagggagacaguucagauaguuucuuuuggc

SEQ ID NO: 4107009 - RNA, 62 nt, Human
gccaggagaaugcuagcagaggauucggaucaaaggagcuguucuguagguuuucuuauggu

SEQ ID NO: 4107010 - RNA, 61 nt, Human
gccaggagagcauugcacagaggcccgugucuuuuuuguucauugcuuuccccaucauggc

SEQ ID NO: 4107011 - RNA, 91 nt, Human
gccaggauggucuagaucuccucaccuugugauccgcccaccuuggccucccaaagugcugggauuacaggggugagccacugugccuggc

SEQ ID NO: 4107012 - RNA, 91 nt, Human
gccaggauggucucgaucuccugaccucgugauccacccgccuuggccucccaaaguguugggauuacaggcaugagccaccguaccuggc

SEQ ID NO: 4107013 - RNA, 64 nt, Human
gccaggcagccuuuauggaaaggccuggcauuugcuuugugaaggucacauggagguugaaggc

SEQ ID NO: 4107014 - RNA, 55 nt, Human
gccaggcagcuagcaaccccugugagggggcaggcacagcuggacucugccuggc

SEQ ID NO: 4107015 - RNA, 60 nt, Human
gccaggcaggccacgcuguguugacgcugcacucagcacguggguguuggcucugccggu

SEQ ID NO: 4107016 - RNA, 58 nt, Human
gccaggcauggggcugcagucaggucuccagacccgcgcugugcccucugccccccgc

SEQ ID NO: 4107017 - RNA, 77 nt, Human
gccaggcccagaggcuuccugccaccugagaggagccauugaagaccuccuuggguggucagagcuuagggaaaggc

SEQ ID NO: 4107018 - RNA, 93 nt, Human
gccaggccugagcagguccuuucugggcaggaagugccaagugugggucucucuuugcucugcccacgucuugcccagaagcucaguuuuggc

SEQ ID NO: 4107019 - RNA, 57 nt, Human
gccaggccugcaagugcugguggagcuguucccacuggccugggcuuaggggcuggc

SEQ ID NO: 4107020 - RNA, 55 nt, Human
gccaggcucuucccacacaguacuagacuucacugccucugugggccuuccuggc

SEQ ID NO: 4107021 - RNA, 56 nt, Human
gccaggcugggccaggccugcagggucacgacuggagggugugggcccggccaggc

SEQ ID NO: 4107022 - RNA, 68 nt, Human
gccaggcuggguaaaggcugcuuuucuaggacuggacucgugauagaagacuuuauagcccagcuggc

SEQ ID NO: 4107023 - RNA, 80 nt, Human
gccaggcugggugguacugggggcccacaggggaggccaacggcuggccugcuggaggagccucagggccucccagaggc

SEQ ID NO: 4107024 - RNA, 57 nt, Human
gccaggcugguuauuuaaugaguuuuaugauacauuaaaucuuccagaccucacggc

SEQ ID NO: 4107025 - RNA, 66 nt, Human
gccaggcuuauucccugcugucuauccagagccuagaacagggcuggcacacaguggaugccuggu

SEQ ID NO: 4107026 - RNA, 68 nt, Human
gccaggcuugagcaaaucagaaguuuagaugcuaauguauuugagcuucagugaugcuuucugcaugc

SEQ ID NO: 4107027 - RNA, 58 nt, Human
gccaggcuuuuucugggucggagaacuggaguucugccuggauuuuggaaagcuuggu

SEQ ID NO: 4107028 - RNA, 95 nt, Human
gccagggaaagcuucucaaggagggugaccuauuagcagaaauuugaauaauaagaaagagucagcuucagaaauuugggaagagcauuccaggc

SEQ ID NO: 4107029 - RNA, 65 nt, Human
gccagggacacucccuccuggugucaauuccagacaccuggcacacacuggggaguguccugggu

SEQ ID NO: 4107030 - RNA, 57 nt, Human
gccagggacuuugcauuguuuaugauuauauacuuaauacccaaaagaguuccuggc

SEQ ID NO: 4107031 - RNA, 78 nt, Human
gccagggagucuuggcagagccccagccuuggagccaaucagaccaggguucaaagcuuggcucugccaccuucuagc

SEQ ID NO: 4107032 - RNA, 55 nt, Human
gccagggccagucagaucugaucaaagccuaaaagaucaucucacagggccuggc

SEQ ID NO: 4107033 - RNA, 56 nt, Human
gccaggggagggucgucuaguccuuaagcauaaacacuggcugucuuccuacuggu

SEQ ID NO: 4107034 - RNA, 68 nt, Human
gccaggggccggggucugccgcggccaccgggggagagggagcaucuggcagacccugccuccgacgu

SEQ ID NO: 4107035 - RNA, 125 nt, Human
gccaggggggugaaacgcaguaggcagugaaagggaagauggggggagagucugcaagccaaugggcagaauuuuugauuaucuacucguuuagaucaucugucucacugcuucccuccauuggu

SEQ ID NO: 4107036 - RNA, 58 nt, Human
gccaggguugccaaugggggcagggccgcggaaggagcuguuuguguggggccuuggc

SEQ ID NO: 4107037 - RNA, 108 nt, Human
gccagguaagaucaagugaggaggcugaaccuuaggaagcacacaguaaauauucacacuucuaauggauagugcuuuaguucagcuuucuucauuccucugccuagc

SEQ ID NO: 4107038 - RNA, 78 nt, Human
gccagguacagcagggcacaguuauggaggugggguaccauggcagggcaccacccugguuacugugccaggccuggc

SEQ ID NO: 4107039 - RNA, 55 nt, Human
gccagguccaggguggagcgcucacacacagcagcccccaucuuuaggaccaggc

SEQ ID NO: 4107040 - RNA, 55 nt, Human
gccaggugcauauuagaagcauuuuccucaauaauguauuaaaaauguauuuggc

SEQ ID NO: 4107041 - RNA, 74 nt, Human
gccagguuagugcaguugguuagaauguggcaauauguccauaauuauuucccaugugaaucaauuggcuuggc

SEQ ID NO: 4107042 - RNA, 81 nt, Human
gccagguucucccaggcaggucagugaagaaggaggagcaggugcucacucggcucacgaacugcuugguuggccucuggc

SEQ ID NO: 4107043 - RNA, 85 nt, Human
gccaguaaucuuuuauccuguacaagagccaucuggauguagcaaacugcaguucacucuuuugcaggguaagggcucagcuggc

SEQ ID NO: 4107044 - RNA, 113 nt, Human
gccaguaaugucuuuaauggacagauaacuuucuuugcagugagccagagcuucaauuugcuuccucacggugcaacaggaauggcaucucauuaaaauugaacauuaagggc

SEQ ID NO: 4107045 - RNA, 67 nt, Human
gccaguacuggaaggcuggaagucaggacaggaguacaucugacucuggggcuuccagaaagcuggc

SEQ ID NO: 4107046 - RNA, 122 nt, Human
gccagucccagccagaguguaaagacguuuagagaggcuaugagguucugugugcaggguacugcaucaugagaagccauacccuagugaaaccuuugccacuuugcugagcuggacauggc

SEQ ID NO: 4107047 - RNA, 55 nt, Human
gccagugacacugaacaagucacucauuuccaggagcuucaguuuccucacuggu

SEQ ID NO: 4107048 - RNA, 61 nt, Human
gccagugcagaggugcaagcauguuugagacagcugauaguuaccucuguccagaacuggc

SEQ ID NO: 4107049 - RNA, 89 nt, Human
gccagugccaaggaacuggaauauuuguaggaugaaaccauauccugacggguuagucuucauguauauccaacuguuccuuguuuggc

SEQ ID NO: 4107050 - RNA, 87 nt, Human
gccaguggggcccuguggucacaaggcagauaauaaggagguugccucuuuggucuguggcuugggucugaaaggguccuacugugc

SEQ ID NO: 4107051 - RNA, 80 nt, Human
gccagugggugaaugcaggaacagcaccaggagcuagagcccaacucuggccugugggcugucuccggguccucagaggc

SEQ ID NO: 4107052 - RNA, 68 nt, Human
gccagugucugugcaacuccuuccacagacagagggcugucuguggucagagggcacugaacacuggc

SEQ ID NO: 4107053 - RNA, 61 nt, Human
gccagugugcaagaaaacagaaaauagcauaaaucacaauccguacaacuugcauauuggc

SEQ ID NO: 4107054 - RNA, 66 nt, Human
gccauagcugugauguagaggucaggaagcucuacugcugcuggcuuagauaucacugccacaggc

SEQ ID NO: 4107055 - RNA, 78 nt, Human
gauuugucuuucuaggacuuaccagaauuuguaaacuuauuuauucccuaccauguaaguucuaugagaagagaaauc

SEQ ID NO: 4107056 - RNA, 69 nt, Human
gauuugugcagggcaguuuguuucggcaugguacucugccacauggugauauauuugccugcagagauc

SEQ ID NO: 4107057 - RNA, 129 nt, Human
gauuuguucaucaguugaaaguuacucgggucacaucugaaggcggcucuaggucacccuagaggccuaggcuggcugucuucaggucagggggcugaguugccauucaaagacucaaaggagugaauc

SEQ ID NO: 4107058 - RNA, 59 nt, Human
gauuuuaucugcagcaugacuucuggauaaucucugcaagaagccaugccaguaaaauu

SEQ ID NO: 4107059 - RNA, 85 nt, Human
gauuuuauuacuuaccugagcuucauucguuggggcaacaucccuuggaagucugcugcucaggaguuuuggaguaaugagcguc

SEQ ID NO: 4107060 - RNA, 55 nt, Human
gauuuuauuagcccaaacuuugaggcuuuuauugccuuuacugggaaauagaauc

SEQ ID NO: 4107061 - RNA, 123 nt, Human
gauuuuauuuauaugguuuaaacaauaacauggcucauaaacucaguucaguucugaauuguagagacuagagguguaguuugggaauuguguguuugugacuguuaagcugauguuaaaauc

SEQ ID NO: 4107062 - RNA, 99 nt, Human
gauuuucagaguugacuacagauagccaauuaaguacauagucauaccauuguuuggugauaacaaauauauuuggucuuaucuguagaugcuagaauc

SEQ ID NO: 4107063 - RNA, 60 nt, Human
gauuuucauuauagcuaguuucaaagugcuugaauugggauuaguuacuuagugagaguc

SEQ ID NO: 4107064 - RNA, 76 nt, Human
gauuuuccaugauuaaucuguucaucaguucguacauauuuacuaaaugagaggugucaggguagucaugaugaac

SEQ ID NO: 4107065 - RNA, 85 nt, Human
gauuuucccuggacuaacaguaaaguaaguuagcuuagguuuaauuggaauggggcugucuuacuugauugaacuaaugaaaauu

SEQ ID NO: 4107066 - RNA, 71 nt, Human
gauuuuccugagggcauuuuggugacuaaauccagggauuuagacucagguaccuuucaggaauacaaguc

SEQ ID NO: 4107067 - RNA, 81 nt, Human
gauuuucuaagcuuggaguuuggcguauuaaucaaaguaucaucuuugcuguaccaaagauuccugagguuccagaaacuc

SEQ ID NO: 4107068 - RNA, 117 nt, Human
gauuuucuucagucaaaaaaaagauacagguguuuuggaggaugauuuaagacaauacuuuugccuggucaucucuuucucagccucaccuuuguacuuuuguaccugaagagacuc

SEQ ID NO: 4107069 - RNA, 73 nt, Human
gauuuugaggccaugccuccugaucaguuuuauaucugaaucaagaacugaguuauggguaugccuugagauu

SEQ ID NO: 4107070 - RNA, 67 nt, Human
gauuuugcuuauauuuauugggcuuagagucaaaccacauucucugugcucuaaaguaugggugauc

SEQ ID NO: 4107071 - RNA, 93 nt, Human
gauuuuggaaaguguuguuuucauugagcaccugaguaacaaagacuugucugccagaccugacucaguagaaucugagauuguuccaaaauu

SEQ ID NO: 4107072 - RNA, 67 nt, Human
gauuuuucuuuaguugcuaaugagguuggucccuucuacccaaucuucaagggaagaaagaguaguc

SEQ ID NO: 4107073 - RNA, 129 nt, Human
gauuuuuggaauugucacaacugagaaacauugcuggugguguauggucugcaaguguaaagauguuccuugugaauugcuugcauccaacauuaagggcugguuuuuaccuuuuauuuuccaauccuc

SEQ ID NO: 4107074 - RNA, 95 nt, Human
gcaaaaauuauauauauggcuaaccauauaucaagacaacucaucuuaugacuugauucauggacaggccagguguauggagauacaauuuuagc

SEQ ID NO: 4107075 - RNA, 55 nt, Human
gcaaaaauuccagggacgacucccauuggcaggagcccgucucugaaauuuucgc

SEQ ID NO: 4107076 - RNA, 78 nt, Human
gcaaaaauuuugccaaauugaauuacauaauucaucuagcagauuugaugaguuccuggaugcaauuugcaaauuugc

SEQ ID NO: 4107077 - RNA, 108 nt, Human
gcaaaacucaacagcuuauuucuuggaggagauagggagagaaugucuuuuaauuauuugucuccaccaucaucuuaccaaaucauauuuaaccucuugacccguugu

SEQ ID NO: 4107078 - RNA, 82 nt, Human
gcaaaacucaguaucacuuuugagagugagaagacagccugucuucuuaauuucagcaggauaccacguaacuaauuuuugc

SEQ ID NO: 4107079 - RNA, 81 nt, Human
gcaaaagagaaagcugauggcuugcuggcugacagauaaaagcaccaugucuguauccagucugucuucagcuucuuuugu

SEQ ID NO: 4107080 - RNA, 59 nt, Human
gcaaaagugaugcuguuuaacuucugaaucauuaagaaagaugcagcuuccacuuuugc

SEQ ID NO: 4107081 - RNA, 69 nt, Human
gcaaaaucagaaaggugggcaagcagaugacauaguuaaucuauuguccaaucuuucaccuguuuuugc

SEQ ID NO: 4107082 - RNA, 75 nt, Human
gcaaaauuagaguucuauuucuaacauguuaucuaaugcugauggguguaugugaaauagaaaucuuauguaugc

SEQ ID NO: 4107083 - RNA, 78 nt, Human
gcaaaauuuagcuauguauaaccaaaguacaauguccugggaccacuugugcucuguguuauuuaaggcucaagcugc

SEQ ID NO: 4107084 - RNA, 63 nt, Human
gcaaacaccagcuccugcagaacacaagccuuaauuaauuuccagcaggaaaugagugauugc

SEQ ID NO: 4107085 - RNA, 71 nt, Human
gcaaacagaacugaauugguuauacugggcucccagcugaaggggaaaggcccacagucagucuaccuugc

SEQ ID NO: 4107086 - RNA, 85 nt, Human
gcaaacagcggggaguguggugaacaggagcacccuagguuccucuaaaggguguggcuucgaccacacuucaaaccuaguuugc

SEQ ID NO: 4107087 - RNA, 63 nt, Human
gcaaacaggaauugaugggaguccucugacauuuugaggauaucccuacacaucacugcaggc

SEQ ID NO: 4107088 - RNA, 58 nt, Human
gcaaacauaauaugaagacacuguaaagauugugucucaguuucauacuguguauugc

SEQ ID NO: 4107089 - RNA, 81 nt, Human
gcaaacauguauacauaguaccacauuugacauggaacagacauucuuuuaagugguagcuaguauucgguaauuguuugc

SEQ ID NO: 4107090 - RNA, 62 nt, Human
gcaaaccuguccuuuugucuccuuaggcauuuucuugaagugggauugcuggaugggcaugc

SEQ ID NO: 4107091 - RNA, 96 nt, Human
gcaaacucuguccuucacgaggaaagccaggguccaggccugccuucuagaggcaggucuguaaguuggccucucucugugaagucaugauucugc

SEQ ID NO: 4107092 - RNA, 62 nt, Human
gcaaagaaauugggucuguguuuaauuuugauguuucaaauuuugagcuuccaagucuuugu

SEQ ID NO: 4107093 - RNA, 67 nt, Human
gcaaagacacagggacgugcucugccucaugcaaaugagcuguucuaaaagcgucccuguguccugc

SEQ ID NO: 4107094 - RNA, 102 nt, Human
gcaaagaggagaggguguagccccugcuggcagauuggggucagcagugccugucggcuaggagcuugcugauguaucugcauggcuugcccuuuccccugc

SEQ ID NO: 4107095 - RNA, 129 nt, Human
gcaaagcaaacaguauuugauuggucauaguggagcaguagccuuauuuggaucauuucaguggaaagucccuaguuagagguuaguugacaguuucugcuugguuaagcuuaaauuuuguuuuacugu

SEQ ID NO: 4107096 - RNA, 108 nt, Human
gcaaagccaugguacucagaggcagcugcucaccccaugcucucagccuccuccucuucccagcauguauuccaaaugggugacaucuuuucuggcagauggcucugc

SEQ ID NO: 4107097 - RNA, 59 nt, Human
gcaaaggcuuagacacagaacuguuguuacugauacuucugcaaaugcuaagcuuuggc

SEQ ID NO: 4107098 - RNA, 60 nt, Human
gcaaagggaaaguggcagggucaucgggcuuuugucucuuccacugcccuucucuuucgc

SEQ ID NO: 4107099 - RNA, 85 nt, Human
gcaaaggguuuucaguggaugguuugucuugccuuuuuucccgcugggaucuucaggcauucaguacccucaugcugcccucugc

SEQ ID NO: 4107100 - RNA, 72 nt, Human
gcaaaguagcauuugaaauacagaaucuguuuuguuccaggacagaaucuauauucaguuauuuaccuuugu

SEQ ID NO: 4107101 - RNA, 59 nt, Human
gcaaagucacuucgugagcacugacuguaccagaauaaucagcaugcucuguggcuggc

SEQ ID NO: 4107102 - RNA, 78 nt, Human
gcaaagugcucugcugcagggagguuccuuguucugaccccaggacgcuucaaggacucccuuucagcuaaguucugc

SEQ ID NO: 4107103 - RNA, 65 nt, Human
gcaaagugugcacaucuuuggaguagucaaagagacacacuuccagaacagguacauuuuuaugc

SEQ ID NO: 4107104 - RNA, 61 nt, Human
gcaaaguuacagaugggguugcaauaaacagguguggauucaacuucgugugugugugugu

SEQ ID NO: 4107105 - RNA, 77 nt, Human
gcaaauauagcaguggauaauggaguugaucuguagcuagccuauagcaacugccuuuacuauauuuuaauaugugc

SEQ ID NO: 4107106 - RNA, 130 nt, Human
gcaaaugaagguugagggcccaggaaucugccuuuuucaggcucccugcaggccagugagaaaccucagcuucagggucgcagagccugcagaggccaagaggcugaggccagaggucccccaaagcagc

SEQ ID NO: 4107107 - RNA, 72 nt, Human
gcaaaugcaaacaagcugccugaagauucuuucaagauucuuuaguccagcucugugcuccuugcauuuugc

SEQ ID NO: 4107108 - RNA, 57 nt, Human
gcaaaugcaggaaauuaugcuuuuuauuucuaugaugagcucauuccugcauuuugc

SEQ ID NO: 4107109 - RNA, 55 nt, Human
gcaaauggaguggcuggacuuuguaauaaauuaaaagucugguugauuccuuugc

SEQ ID NO: 4107110 - RNA, 83 nt, Human
gcaaauuccagcgaagaagccaugcugucccaggcucuagggaugcgcggagcacugagggaggguuucuucugaggaagagc

SEQ ID NO: 4107111 - RNA, 69 nt, Human
gcaaauuccaguuuaaagaaggaugggaguugggaguccacuaauucaagcauccucuucaaauuuugc

SEQ ID NO: 4107112 - RNA, 60 nt, Human
gcaaauugauuuugugcuuuccuacguugaugauguaaagaaagacgcagaguuaaaggc

SEQ ID NO: 4107113 - RNA, 82 nt, Human
gcaaauuguuaugaagacugaaauagugcacaccaagugcuuuaggaaugugcuugguauauuuuuaguccucaauaauugc

SEQ ID NO: 4107114 - RNA, 83 nt, Human
gcaaauuguuuucuuucuaugucccuuuuauuuccaguugaauaagaauucuuugggcucagagagggaggagagcaaaaugu

SEQ ID NO: 4107115 - RNA, 105 nt, Human
gcaaauuuucugaguaugguguaauauucagcuauugaguugaagaguguuguucacuguaacuacuaguuuugaauauaauaugaauaaucagcaugaaauagc

SEQ ID NO: 4107116 - RNA, 86 nt, Human
gcaacaaaauagaucccuacauugaacuaugaguucaguuagcugggaagcugauuuucagugcugggggucauagauuuuauugc

SEQ ID NO: 4107117 - RNA, 77 nt, Human
gcaacaaggcagggggaggcucccagcuaauccagacuugaaucucagcugugggugggagcgcccugucuggaggc

SEQ ID NO: 4107118 - RNA, 65 nt, Human
gcaacaaguguaaacaugcauugguauuuacaaugucccaggugcugugcuaugcacuuguaugu

SEQ ID NO: 4107119 - RNA, 91 nt, Human
gcaacagacuugcucauugcuucucucuuauguaauguauguaaaugcauuucaugccguggaaguccugugcauucaaagcuuuuguugc

SEQ ID NO: 4107120 - RNA, 55 nt, Human
gcaacagcccagguucuguguggagucauugaaugaacuggagcuugggcuuugc

SEQ ID NO: 4107121 - RNA, 64 nt, Human
gcaacagugaggugaauaugcucccuuguucggguccaacaggagacauacugccucaucuugc

SEQ ID NO: 4107122 - RNA, 97 nt, Human
gcagaggauccagaggcagcagugauaagauaggacagaggaaaacuuucugaacucuauuccugcuucuccucauuccugccucucauuccugugu

SEQ ID NO: 4107123 - RNA, 70 nt, Human
gcagagggaaggaagccaggggcuggggagccggccacacaacugcccagugccuauccuucuccugugc

SEQ ID NO: 4107124 - RNA, 67 nt, Human
gcagagggcagagcacugaauugggaguaaagacacuuggucuggauuucugccucuaccucucugc

SEQ ID NO: 4107125 - RNA, 70 nt, Human
gcagagggcccagcacugaacugaaccugaggagacuugcguauuccucagucuccgugcucaccuuugu

SEQ ID NO: 4107126 - RNA, 55 nt, Human
gcagagggcuggacgcagguuggaaggucucaccucccacagcgccagcuccugu

SEQ ID NO: 4107127 - RNA, 55 nt, Human
gcagaggggguacuucggcccugggucuacccucuggcucccagcucuccuuugc

SEQ ID NO: 4107128 - RNA, 60 nt, Human
gcagaggguggggcaugccaguuuccugagcuaaaaggaaauauaugcaaugcuuucugc

SEQ ID NO: 4107129 - RNA, 81 nt, Human
gcagagguagauguuugacuuuguguuuuguguaaaaauucuuucuggguuaacagagaacauagaaguagcuaccuaggu

SEQ ID NO: 4107130 - RNA, 71 nt, Human
gcagaggucuggggaagucagggcaucaggcugagagagcccucugcagucuuguuuccccaggcuggggc

SEQ ID NO: 4107131 - RNA, 60 nt, Human
gcagaggugaccagcagcagggaauuucugcaauauuuucucucugcuguccacauuugc

SEQ ID NO: 4107132 - RNA, 97 nt, Human
gcagaggugcugagcugugauagggacgggggucagguggggcuuugcccacuggcccccacaccugucagggaaaaaucuucguuucacucucugu

SEQ ID NO: 4107133 - RNA, 105 nt, Human
gcagagguuaaguaacacgcugaggacacaggcuucagagaggggugaagcuggccuuugaagcuagguuguccaucucuagaagccacacccuuaagccucugc

SEQ ID NO: 4107134 - RNA, 78 nt, Human
gcagagguuccugcacagagagucccgggugccccuaaguggggcccugaaucucucucugucagucuuuccaucugu

SEQ ID NO: 4107135 - RNA, 81 nt, Human
gcagaguaaaugguauucaugugucuauucagugaaucaacaaauacguacugagcaccugcuaaaugacaguuacugugc

SEQ ID NO: 4107136 - RNA, 72 nt, Human
gcagaguaggcaggcucuuggccuuaugagcacaggacuguuccucagacccccagagcugcuaacagcugc

SEQ ID NO: 4107137 - RNA, 69 nt, Human
gcagaguggguggggcaauuccaaagggacuuuuccauuuucccuccugggcugcacuccauuuucugc

SEQ ID NO: 4107138 - RNA, 92 nt, Human
gcagagugucuguugaguuucaaaaggcuuaaauaagggaucucacuacuucauaaaucuaaagcucaacaggcacuauuuuucauauuugc

SEQ ID NO: 4107139 - RNA, 66 nt, Human
gcagauaaaugugaaaugagcaguuauguuguaaguaagacaugcuuuguuccaucauuugugggc

SEQ ID NO: 4107140 - RNA, 88 nt, Human
gcagauacugagggcugggcuggcggggacgggugugaggagccauucacuccucuacuuaccacucagccagccagcaagugccugu

SEQ ID NO: 4107141 - RNA, 63 nt, Human
gcagaucuucugaacuggaguaucugggaagagagcucccaaauauucuuuuuuaguaagugc

SEQ ID NO: 4107142 - RNA, 56 nt, Human
gcagaugagugagauagacuuccuugcugacuuggaaguuuuauguugccauuugu

SEQ ID NO: 4107143 - RNA, 75 nt, Human
gcagauggagcagcuguugccccuggugagggcacuguccccacccuugcacagggcaccaguuggccaucuugu

SEQ ID NO: 4107144 - RNA, 67 nt, Human
gcagauggcugggcucguccgcagaguuucugcuucaguaggacugcgguggggcccagucauuugu

SEQ ID NO: 4107145 - RNA, 61 nt, Human
gcagauggugggggaggaguacauacggacgaauuugaaucacaauuuccucacuauaugc

SEQ ID NO: 4107146 - RNA, 75 nt, Human
gcagaugugaucaggaaauuauuuauuaauauuggcuuuaaaauuuuguaaugaauaaacuugagagucaucugc

SEQ ID NO: 4107147 - RNA, 80 nt, Human
gcagauguuggcuccagggcaccagcgucccccuggcaugcacgcggggaccagcuggguccuguuguccggggaccugc

SEQ ID NO: 4107148 - RNA, 61 nt, Human
gcagauuauaagcuucuuuuauucaguuuaucaacugguugaagaaaagcuaguauggugc

SEQ ID NO: 4107149 - RNA, 107 nt, Human
gcagauucauuccuuuuuguucuuugauugcaaauuauuuuagucccuucagguauuauaugacaaguggauguaauagauuguagaauaauucugagugaaauugu

SEQ ID NO: 4107150 - RNA, 70 nt, Human
gcagauuccaggucccguuccccagagauucugacucaauaaagucugaguaugagguccuagaaucugc

SEQ ID NO: 4107151 - RNA, 83 nt, Human
gcagauuccuggcagcagagcucaacauagauaccaaaaauaaaugaaagugguuugcugugacugcuggccagcaaugaugc

SEQ ID NO: 4107152 - RNA, 69 nt, Human
gcccaauuucagcuuucuguuuuauggaucuguccccgaggcugcaugacaguuuugcugaaauugagc

SEQ ID NO: 4107153 - RNA, 70 nt, Human
gcccacaagauggucacauaagugcagcugcugugguuuugcugcagguuucugugaucguuuuguaggu

SEQ ID NO: 4107154 - RNA, 72 nt, Human
gcccacacaugguuccgcaggaugcaggagggucuuucccaggaguggguuuuguguagccagugagugggc

SEQ ID NO: 4107155 - RNA, 66 nt, Human
gcccacauccaggcaccacaaccagcucugugggaggaguggcaggugugggcuugggggaugggc

SEQ ID NO: 4107156 - RNA, 82 nt, Human
gcccacgcccgaccuugggcugaacccugcagcugagggugucccucucagccccacggggucagccaaggaggcccugggu

SEQ ID NO: 4107157 - RNA, 87 nt, Human
gcccacuggcaaacuugcauguuauuuuuauaggcacugggaacucuuaguaauuuuaaacaagggaaacauguaauuagcaguggc

SEQ ID NO: 4107158 - RNA, 100 nt, Human
gcccacuugucugcaggaacagcugggccuuguccccucagcuguggcugggagccugccgcggacugcacaauccuggcuguguccuggggacccuggc

SEQ ID NO: 4107159 - RNA, 130 nt, Human
gcccagaaagagugcugaauuuuugcugcauaugcuuaaaaacgcagagaguaaugcugaacuuaaggguuuagauguagauucucuggucauugagcauauccaagugaacaaggcaccuaagaugcgc

SEQ ID NO: 4107160 - RNA, 72 nt, Human
gcccagaaagcagggcagaccuccagccuauuaggucauuucugauuugggauucguccuacuauauguggc

SEQ ID NO: 4107161 - RNA, 69 nt, Human
gcccagaccaagcucuaaggcggugaggagcacauuucugcccugccaggccagugagcuuccuggugc

SEQ ID NO: 4107162 - RNA, 67 nt, Human
gcccagagaaugaaacccaccagacuuuuuccaucuacaaagaagcugaauguaauguucuuugggu

SEQ ID NO: 4107163 - RNA, 60 nt, Human
gcccagagacuggagugcaguggcgcgaucuccgcucacugcaagcucagccucccgggu

SEQ ID NO: 4107164 - RNA, 70 nt, Human
gcccagagagcacagguggugggagggugucaacaaacgucacagcccccagcuggcuuuccaagugggc

SEQ ID NO: 4107165 - RNA, 81 nt, Human
gcccagagaggaggggcacagugaguggccaccuagagaggugaccagagaaaggcacuggaaggucccaccuuacugggc

SEQ ID NO: 4107166 - RNA, 69 nt, Human
gcccagagcaucuugaaggcaggcuuuauuacuuauuuggcucugcugguaagaugccucugguaaggc

SEQ ID NO: 4107167 - RNA, 130 nt, Human
gcccagaggaugcugggcgaggccaagugaggcaggucuggccucgggcacccccauccccuggccuggauggcaccccucugccaggcagcccgcggcucucguuccagaccaaugucauccgcacggc

SEQ ID NO: 4107168 - RNA, 71 nt, Human
gcccagcaagaaguggagcaggagcuucagccaaauggaaugaggcaggaugcuugcacaggucuugaggc

SEQ ID NO: 4107169 - RNA, 60 nt, Human
gcccagcacuccucucugacauuugaucuaaaucuccugaagucauaggggaggcugggc

SEQ ID NO: 4107170 - RNA, 104 nt, Human
gcccagcagcagcuuccucagcaguguucaggccucugugggagggagggaccacgcagccucuccuuccugcagaucugagaugccaugguuugcuguugggc

SEQ ID NO: 4107171 - RNA, 81 nt, Human
gcccagcagcucugauuuccuuauucugucaccagucagaucucuucccugaagugacagagucggggcaagcugugaggc

SEQ ID NO: 4107172 - RNA, 57 nt, Human
gcccagccccuggguggacguguugggggugaccccucguuuucccaggguugaggc

SEQ ID NO: 4107173 - RNA, 61 nt, Human
gcccagcccugccauucucuggagcucagccagauugagcgggugccaggcagggcugggc

SEQ ID NO: 4107174 - RNA, 89 nt, Human
gcccagccugaauugcuuacccuuaaacauguuuauuuuuacugccaggccuuaaugagucaguaauggauaugucauuuuagcugagu

SEQ ID NO: 4107175 - RNA, 71 nt, Human
gcccagccuggcuccaggaggcucccgcgucugccaugcaggcguucuuccuuuugggaggaggcaugggc

SEQ ID NO: 4107176 - RNA, 79 nt, Human
gcccagcgcucaguuucuccaaacgcaggcugaggcucgaccagcccagaccugaggagcacugagccagucccugggu

SEQ ID NO: 4107177 - RNA, 58 nt, Human
gcccaggaauuggaggcugcagugagcuguguucacgccacuguacuccagccugggc

SEQ ID NO: 4107178 - RNA, 58 nt, Human
gcccaggaggcagagguuguagugagcugaaaucacaccacugcacuccagccucggc

SEQ ID NO: 4107179 - RNA, 58 nt, Human
gcccaggagguggagguugcagugagccgugaucacaccacugcacuccagccugggc

SEQ ID NO: 4107180 - RNA, 58 nt, Human
gcccaggaguucaaggcugcagugagcuaggaucgugccacugcacucuacccugggc

SEQ ID NO: 4107181 - RNA, 55 nt, Human
gcagcgguggaccaggggcggccccgaccccgcgugcccaggggccaaccgcugc

SEQ ID NO: 4107182 - RNA, 56 nt, Human
gcagcggugggcagggcuagggccccuggcuaccggggcauccuuucccacccugc

SEQ ID NO: 4107183 - RNA, 56 nt, Human
gcagcuaccacccaggaaggaccaugaaaauguuugcugaaugaauggaugguugc

SEQ ID NO: 4107184 - RNA, 63 nt, Human
gcagcuagaugguucaugccagagaggaacauaacuccucaucugauaaaucacucuuacugc

SEQ ID NO: 4107185 - RNA, 76 nt, Human
gcagcuauaagacuggggaucccagcuucuuauuguuugucagcaacuagaagccauucucaguuccugaggcugc

SEQ ID NO: 4107186 - RNA, 59 nt, Human
gcagcuaugccuccccugugucuuuuaugccugucgguauguccggacagaggcucugc

SEQ ID NO: 4107187 - RNA, 91 nt, Human
gcagcucaggcaauccuucaaggggcugacagcuggaggcucugccugcucccuccuagcacaguuuucauugcaggguuaucugggcugu

SEQ ID NO: 4107188 - RNA, 85 nt, Human
gcagcucaugggguagaagcaaugucugcugguggaaagagcagagguuuagaaucagaagauuugacugugaccccaagccugc

SEQ ID NO: 4107189 - RNA, 57 nt, Human
gcagcucauuccucaaucuaggagaaauuuuucuaccuugccccaggaaagagcugc

SEQ ID NO: 4107190 - RNA, 85 nt, Human
gcagcuccacagaccacuucagccagcuggggaugcggaggagaacagaguggccuccucccccgagcuguguuuguggggcugu

SEQ ID NO: 4107191 - RNA, 79 nt, Human
gcagcuccaccuccuccagggaggucugcaggacuggguucaauggcagugaugaggaccucuuuggccggugggcggc

SEQ ID NO: 4107192 - RNA, 94 nt, Human
gcagcuccaggaggaauuugcggaaggggguccucuggagacggugacgccccaccucuuugccuucuccucuucuguggauucccugagcugu

SEQ ID NO: 4107193 - RNA, 64 nt, Human
gcagcucccaagcagagaggucaacuaauaagagauagucucuucccuuuuuuaugcuagcugu

SEQ ID NO: 4107194 - RNA, 61 nt, Human
gcagcucccuggcugcaaaugaauccaucggauacagaaguuuugaggugaguggaguugc

SEQ ID NO: 4107195 - RNA, 58 nt, Human
gcagcuccuccugggcuggagacuaggugugcaccacucccccucuggguggggcugu

SEQ ID NO: 4107196 - RNA, 86 nt, Human
gcagcucguuuguaacuugggcaaguuauuucauuggaacaauguaggcagucauauuggaguaaguugaggagcaaccgaguggc

SEQ ID NO: 4107197 - RNA, 63 nt, Human
gcagcucuacaaagugugcccaugcugaggcuugagccugcagaggguacuuuuuguucaugu

SEQ ID NO: 4107198 - RNA, 76 nt, Human
gcagcucuguuuuccauggcauuucccuucuuguccaagucugggacuuagggacccauagagagaccaguguggc

SEQ ID NO: 4107199 - RNA, 56 nt, Human
gcagcucuuggugcucuuuucaccuuaguuuuggguggaaugaggcugagcagugc

SEQ ID NO: 4107200 - RNA, 57 nt, Human
gcagcucuuuucuuaaagagauggaauccauuuuccuacuccuugaaucagggcugc

SEQ ID NO: 4107201 - RNA, 73 nt, Human
gcagcugagucugagguucuuugcagaauuaaauucuugauuuaaagauucaaaagccaagacuuugaguugc

SEQ ID NO: 4107202 - RNA, 76 nt, Human
gcagcugcagcuguuuucugagugcaugugagacuuccagaaauaguguauuccugaauaaacaggugucagcugu

SEQ ID NO: 4107203 - RNA, 71 nt, Human
gcagcuggcuucacugcucaagugauuauccugaaccauccaggccaaaucccuguuggcagugccccugu

SEQ ID NO: 4107204 - RNA, 66 nt, Human
gcagcugggcucaucaucugugcauuucacaauaaaauuuuaugaugcauccagacacccagcugc

SEQ ID NO: 4107205 - RNA, 67 nt, Human
gcagcuggucuggccuagaguaccugccuucaauucacuagcuccuucuuggccaucaagacucugc

SEQ ID NO: 4107206 - RNA, 83 nt, Human
gcagcuggugacauuauccuggccgugaauggaagguccacggaaggccucaucuuccaggugccgggggucaugggcaaugc

SEQ ID NO: 4107207 - RNA, 58 nt, Human
gcagcugucgcuaggagcugugacucagagccagagcagugacuccucgcgaagcugu

SEQ ID NO: 4107208 - RNA, 98 nt, Human
gcagcugugacacugauguauuuuauauuggauauuacuugucaguaaguucacuuacaagcagcuacauaucacagaagaggcaugguuucaccugc

SEQ ID NO: 4107209 - RNA, 91 nt, Human
gcagcugugcagaagccaugcuuccuggcccugccagagaucaacaguaggccuuguugaacuccuggagggcccaccgcuucucaguugc

SEQ ID NO: 4107210 - RNA, 55 nt, Human
gcagcuguguguaaauuuuuugucaggaauaaauaagugguuuacauccagcugu

SEQ ID NO: 4107211 - RNA, 66 nt, Human
gcagcuucagacuggagcagaggaagauguaggucaucugacuuuuuugugugugaagcauaaugc

SEQ ID NO: 4107212 - RNA, 87 nt, Human
gcagcuucccuugcccauguguguccaugugacuaaguucuggccaauggaaugugagugauaaugauacauacagagggaggcugc

SEQ ID NO: 4107213 - RNA, 64 nt, Human
gcagcuuccugaguguggacagcaagccaggaggccugggggaaugccguccucagggaucugu

SEQ ID NO: 4107214 - RNA, 81 nt, Human
gcagcuugaacgggggcaggucuggaacuuugauguaggaaaaaccacaauucacuuuucaaaccuucuccuggaaggugc

SEQ ID NO: 4107215 - RNA, 61 nt, Human
gcagcuuugaagacuuauuugcaucuugguucuugguguuuucuggauaaguugagguugc

SEQ ID NO: 4107216 - RNA, 57 nt, Human
gcagcuuuuuagaaucuagggcaaaagguuugcuggacuggguucaagagagaaugc

SEQ ID NO: 4107217 - RNA, 57 nt, Human
gcaggaaagguugagacuuugcucuuaaagaucuagcagcuccaagaucuucccugc

SEQ ID NO: 4107218 - RNA, 106 nt, Human
gcaggaaaugacccugaggaaagccacuugaugucauucuuugaauguucugcugucagcucccaaaacugucaggaaugaggucguaagugucuccuucagcugc

SEQ ID NO: 4107219 - RNA, 55 nt, Human
gcaggaacuugggugaagucagcgcucaguuuugauuuuaucuuugaaguuccgc

SEQ ID NO: 4107220 - RNA, 72 nt, Human
gcaggaagcuggcauguguuuggcuccuguuguguaacaggcacuuugacaugccaucucuauacuuucugc

SEQ ID NO: 4107221 - RNA, 62 nt, Human
gcaggaagguggagcagguggggacugcaguugcaggaccucucuguguggccucuccaugu

SEQ ID NO: 4107222 - RNA, 86 nt, Human
gcaggacaggggccuggggugagacuccugggaagcacaugggcaacauuagcuuccaggucauucucacccugcccucuucaugc

SEQ ID NO: 4107223 - RNA, 83 nt, Human
gcaggaccaaauucuucuuccuccacagggcccaccaggcugguagggcagauucgguggaguuugaggagagcuguuucugu

SEQ ID NO: 4107224 - RNA, 65 nt, Human
gcaggaccauauuacuuuggugacaguucuuauauaugaacuauugcuuagagcaauggggaugc

SEQ ID NO: 4107225 - RNA, 77 nt, Human
gcaggacugaauuccuucuggaugugcuaaggaagaaucuauuaauuugccuuuuccaguuccuagaagccaccugc

SEQ ID NO: 4107226 - RNA, 59 nt, Human
gcaggagaaaugaagauugggugaaggcguccuucuuccaggcacgcauuucuucuagc

SEQ ID NO: 4107227 - RNA, 92 nt, Human
gcaggagaauugcuugaacccaggaggcagaaguugcagugagccaaagaucgcaucauugcacuccagccugggugacagagcgagacugc

SEQ ID NO: 4107228 - RNA, 56 nt, Human
gcagagauggcugccucugagucacccucccuccuugacucaucugccaccucugu

SEQ ID NO: 4107229 - RNA, 55 nt, Human
gcagagaugugggagaugcuucugcaggaagcacacugguaucuccucacucugc

SEQ ID NO: 4107230 - RNA, 64 nt, Human
gcagagauuucagguuggggcagaaggcggugguaagccuucuccuggaacacuggagaggugc

SEQ ID NO: 4107231 - RNA, 113 nt, Human
gcagagauuugcuuucaucacaccauauuggcauccucucccuccuccuugcgguaagccaaggggacugaaugccagucuauggaagaugguuuucaagaagcagugucugu

SEQ ID NO: 4107232 - RNA, 76 nt, Human
gcagagcaaggauggcuuugugcaccaugauuuucacuuccaaauuucaaacagggcugucccaaaccuugccugc

SEQ ID NO: 4107233 - RNA, 80 nt, Human
gcagagcaauuacacccagcauuggcuaagagaggacucuguucaucucgccuaucuggagugaaccuguugcuauaggc

SEQ ID NO: 4107234 - RNA, 74 nt, Human
gcagagcacagugaucuugcugauuuaggagacagagaucugaguccagguaggccaagacagcuauaauuugc

SEQ ID NO: 4107235 - RNA, 84 nt, Human
gcagagcagcguggaggccuguuccuuccugggcacgcggcacagccagggugaggcccgagggggaaaggugcaugacucugc

SEQ ID NO: 4107236 - RNA, 59 nt, Human
gcagagcaggcagaccaaggaguucaucuucucagagcugcuguccaaccugcacucgc

SEQ ID NO: 4107237 - RNA, 71 nt, Human
gcagagcauaguagguaagccauggucuuuggagacaagaaagccaaaguucauaccuaccauuugccugc

SEQ ID NO: 4107238 - RNA, 60 nt, Human
gcagagcaugacuuaaucuagaaaccuuaucuuccagaauuaguuaagcauguaaucugc

SEQ ID NO: 4107239 - RNA, 59 nt, Human
gcagagccugggggucugcggaucaugguaggagccccucagguccccuaagacucugc

SEQ ID NO: 4107240 - RNA, 75 nt, Human
gcagagcucaagaaauauggucaggagaagggcugucaugacgcuugcuugauuaugaucauaaaacugcucugc

SEQ ID NO: 4107241 - RNA, 60 nt, Human
gcagagcugggucuguauccaagccucuggcuccugcuacagcauagauagcagcucugc

SEQ ID NO: 4107242 - RNA, 79 nt, Human
gcagagcuuguggaguacacuugucacccuuaagacuguucucaaauggccugggacaguuguccuccacucuaucugc

SEQ ID NO: 4107243 - RNA, 84 nt, Human
gcagaggacagcccaucccaccucaaucugaagcuccggaaugacugggaacaggaaaggagggaugcuagggauagucccugu

SEQ ID NO: 4107244 - RNA, 69 nt, Human
gcagaggagggcuugcuggauggggcgcaaguagcuugaggcccuguggacccaggaacucuucucugc

SEQ ID NO: 4107245 - RNA, 56 nt, Human
gcagaggccugaagguggcgggagcucuguguauccuccugcugcccacccucugc

SEQ ID NO: 4107246 - RNA, 93 nt, Human
gcagaggugucucagccaaagucauauggcuauuuagugggaggaacaagggcucuucucccaggcucuuaugugacuugcaagacauccugc

SEQ ID NO: 4107247 - RNA, 60 nt, Human
gcagaggugugggaggggccacagggccugcccucuucggccacagcccagcacuuuugu

SEQ ID NO: 4107248 - RNA, 100 nt, Human
gcagaguauuuugguugaacuacaaaaaucaacauuuagugauauauccuaaguggacugucuuugauauuuguuuucuuuuagcacaaugaauuucugu

SEQ ID NO: 4107249 - RNA, 102 nt, Human
gcagagucccagggauucauccaaaggccugggaggccucucuuccugcugccgaugcggaugaagacaggccccuugcugcugcaugcgccgugguucugc

SEQ ID NO: 4107250 - RNA, 59 nt, Human
gcagagucugggcagccuccauccacuggcuugcacaacugcugcccagggcucuacgc

SEQ ID NO: 4107251 - RNA, 63 nt, Human
gcagagucuuuagaagguguuugugguacaagaagagaggcaauaaauucugagaggcucugc

SEQ ID NO: 4107252 - RNA, 56 nt, Human
gcagagugguuucagaguugagaguaaauuaagucucuugauucuugcuacauugc

SEQ ID NO: 4107253 - RNA, 78 nt, Human
gcagaguguguguggggucauacgaugacucuugauaauuagucaaagagacagagccauguuucuacacaacuuagc

SEQ ID NO: 4107254 - RNA, 68 nt, Human
gcagaguucugggccccgcccuagacuggaugaaucagaauaucuggggacggggcccagcaaucugc

SEQ ID NO: 4107255 - RNA, 113 nt, Human
gcagaguuggguuaaggaaucauuacacaugaaguauccuaguuaccagaaaaaggucacuggacugaagcaggaaacuucuuguuuugguucuuuaagguauucuacucagc

SEQ ID NO: 4107256 - RNA, 63 nt, Human
gcagaguuuaauuaaguguugugagcagccuagugagaaacacacuuuaaauuaaaccucugu

SEQ ID NO: 4107257 - RNA, 73 nt, Human
gcagauaagcucacuguaagaacugauguaguaaaaucuucacaguuauugaagugagcucuaaauucacugu

SEQ ID NO: 4107258 - RNA, 63 nt, Human
gcagauaugcaacaucugguagaaaucccucggauucucuuggauguaggcauaggcuuuugc

SEQ ID NO: 4107259 - RNA, 56 nt, Human
gcagaucagagaaugugcugggaauaacguaaucugcauucaaauccugauccugc

SEQ ID NO: 4107260 - RNA, 80 nt, Human
gcagaucccggugcagcugaaggcuggccagcugcaguguauccgcuuagcccagucuguaucaggcacccacguucugc

SEQ ID NO: 4107261 - RNA, 57 nt, Human
gcagaucugcaccaugggccaaguuucucagaaaauacauggcuuccugcgggcugc

SEQ ID NO: 4107262 - RNA, 92 nt, Human
gcagaucuucccuggggcugagggauggccgcugcccaaguaccugggcuccuguggcagauuccucgucagcaccagcaccagaccgcugc

SEQ ID NO: 4107263 - RNA, 93 nt, Human
gcagaugaaauaagaggacagauguuuggugugguuuucagggccuuauaaaacuuccucucccccucagaugucucuccauuauuuacuugc

SEQ ID NO: 4107264 - RNA, 61 nt, Human
gcagaugaggaagcuaaugcugagaagaaccucaucaacaaguugguuucucauauccugc

SEQ ID NO: 4107265 - RNA, 60 nt, Human
gcagaugauuccuguaggaugucuuuaagcaaugaugcgcaccugcuggaaucagucugu

SEQ ID NO: 4107266 - RNA, 59 nt, Human
gcagaugcagaacucaguggguuuucauucaauaugcauuuacugaguaucugccuugu

SEQ ID NO: 4107267 - RNA, 70 nt, Human
gcagaugcuggagugauacucagaaugugggucauguucuagaauuccauauuuuaagcauuccggaagc

SEQ ID NO: 4107268 - RNA, 60 nt, Human
gcagaugcuguggugauagaaguuccugaccuagauaaggauaucauauaugguuucugc

SEQ ID NO: 4107269 - RNA, 61 nt, Human
gcagaugcuuggcacugacaguauuugucucauuguggaauggucagggcuaaugucaugc

SEQ ID NO: 4107270 - RNA, 68 nt, Human
gcagauggcucagcccauggaagaaaacuuucucaagaugcuuuucuuccaggccugggcucaggagc

SEQ ID NO: 4107271 - RNA, 65 nt, Human
gcagauuaagaaguaugccucauguauggugaacauuaaaucgaugcugacuucuuguuaucugu

SEQ ID NO: 4107272 - RNA, 80 nt, Human
gcagauugcauuucauugggcaggaaaguugcuuggucucucggggcuauuuggccaagcugcccacaggugcccacugc

SEQ ID NO: 4107273 - RNA, 80 nt, Human
gccccucgcacaccgugggugauguacuggaggccaagaugcggcauggcuucucuggcauccccaucacugagacgggc

SEQ ID NO: 4107274 - RNA, 68 nt, Human
gccccugaaaaucccagauuguguuguuuccuguacuaggaaacauugauauugggaaagaaaggggu

SEQ ID NO: 4107275 - RNA, 97 nt, Human
gccccugagaauaugggaaggaaaaguauccacagcucaggaggaagggauagcauuggccucauggagggagugcucuucccauagagcaggaggc

SEQ ID NO: 4107276 - RNA, 79 nt, Human
gccccugagucaaguccagugaggcugaauggccacucauccugcauuaaucucagccagggcucuggccucagugggu

SEQ ID NO: 4107277 - RNA, 76 nt, Human
gccccugaugucuuucucacagccaguucauauccucugauuguggaguugcugagacagaacacacucacagggc

SEQ ID NO: 4107278 - RNA, 59 nt, Human
gccccugccuuugaaccuggagauccugaccaugaucuccuggugcugcuaucaggggu

SEQ ID NO: 4107279 - RNA, 62 nt, Human
gccccuggagauccuggcgcgcggggggcggcgacugcuccugccguggucgggacuggggc

SEQ ID NO: 4107280 - RNA, 55 nt, Human
gccccuuaaagacauaggaucagggagauggaaucaucucucagccgucuggggc

SEQ ID NO: 4107281 - RNA, 126 nt, Human
gccccuuccccacccccacacacucagagccucaccauugcugucuggcucaagacuggggccugcagaguuuuuuucuauaaagggccagauaguagauauuugagguuuugugggccaaggggc

SEQ ID NO: 4107282 - RNA, 101 nt, Human
gccccuuccuaagcagcugaaacacaugcacaacaguucuuuccaucuaggcuggauaagggccagugggcaguagcagcugaaguaggucacaagguggc

SEQ ID NO: 4107283 - RNA, 88 nt, Human
gccccuugggauagaguggcuugcucagcuagcagaauaguuuaucuagcuccuggugagccuacucuuuccucccaccuuggggagc

SEQ ID NO: 4107284 - RNA, 97 nt, Human
gccccuugggggaaucacauuuuguugugcguuuguuugguuuugaucaacucuaaacacuauguaagcaagaaccuugucuggcuuucucacuggc

SEQ ID NO: 4107285 - RNA, 64 nt, Human
gccccuugucuccaggccccaaaggcaucuggccaggcugggggaggcuuguggaggcaggggu

SEQ ID NO: 4107286 - RNA, 69 nt, Human
gccccuuuaggcucucuagaaacugugccuuccuuucuaggaaggagaacacaguagaaagaccugggu

SEQ ID NO: 4107287 - RNA, 69 nt, Human
gccccuuuccucuccaccaggaggucuucugguucccagggugcccucugcuggaggaggcuaggcagc

SEQ ID NO: 4107288 - RNA, 75 nt, Human
gcccgaccaguugggcuggaccgcgaccccugagcacugccagggagccuggugugucagccgcugcuagcgggc

SEQ ID NO: 4107289 - RNA, 66 nt, Human
gcccgagcacagaacuaaaugcugguagugagagucgaccucucucaucaggguucugugaugggu

SEQ ID NO: 4107290 - RNA, 72 nt, Human
gcccgaggcgccccgcgcguugucccgcagguugcuugcugcgaccggagguggcguccggggacuucgggc

SEQ ID NO: 4107291 - RNA, 65 nt, Human
gcccgagguccagagagauaaagugacuuuccccaaauuuuagaguuuucuguuccucuaagggc

SEQ ID NO: 4107292 - RNA, 80 nt, Human
gcccgauaccagcugcaggcagaggaguccaggcagaaagugagcugugugugugggcugcugcagcuaaggugaggugc

SEQ ID NO: 4107293 - RNA, 97 nt, Human
gcccgccccuaggggaggcagagggaagccccgaggaggcacccggcccgcuggggcgcgcugcccggggcuuuagggcuuuuucuugugggccggc

SEQ ID NO: 4107294 - RNA, 72 nt, Human
gcccgcuucacagcccggcuuccccgguugcuaggcagauuucgccucgcacacuuccggguugaggcgcgu

SEQ ID NO: 4107295 - RNA, 129 nt, Human
gcccggcggcccucaagcugggcacccaacagcugaucccuaagagccuggcuguggccagcaaggcaaagaccccagcccgccaccagagcuucggggcggcuguacuuagcagggaggccgcccggc

SEQ ID NO: 4107296 - RNA, 78 nt, Human
gcccgggccuuguaggcugggcauucuggccaggccaggggcacugguuccccaggugccuaguggaaggccuguggu

SEQ ID NO: 4107297 - RNA, 66 nt, Human
gcccggggaggcucuugagaggggaguaggcuacuccaggcugcauuccagggagccuccuagggc

SEQ ID NO: 4107298 - RNA, 55 nt, Human
gcccgugguugggaaaggcaguaucauauaugcagucuuucuaccucuauguggc

SEQ ID NO: 4107299 - RNA, 59 nt, Human
gcccgugugcagagugggagcugggccaaaaggaagccaauuacaucugcaacacuggu

SEQ ID NO: 4107300 - RNA, 83 nt, Human
gcccuaagccuggguggcccaugcauccugugcagccgucuuggcucucuccucgcggcugguguuagucacuccuggcgggu

SEQ ID NO: 4107301 - RNA, 82 nt, Human
gcccuaaucccaaugugccuguguuuggaguuaagaccuauaaggaggaaauuaagacuaaaugaggucauaaggauggggu

SEQ ID NO: 4107302 - RNA, 101 nt, Human
gcccuacuacagacaaaaaucacuguguccuuuguguaucuauaguaguuugaauuuccagauacagugcauagaggcaugauacuuuggucuucuggggc

SEQ ID NO: 4107303 - RNA, 58 nt, Human
gcccuacugugugcucuuuaugagacacuuacuucacauucaauuacacagauagggu

SEQ ID NO: 4107304 - RNA, 92 nt, Human
gcccuagggugugccuucucccuaaccaaauccugaaauaagccaguauaccaaggaugugggguuagagggggucuggacuuccuuggggc

SEQ ID NO: 4107305 - RNA, 59 nt, Human
gcccucacaggcuaaauuuaugcagguugcugaugcuuugugugaaucagccugggagc

SEQ ID NO: 4107306 - RNA, 92 nt, Human
gcccucaguaccucagaauaugaccuaauuugggaauagggucaagguacauauaacuuguuaaaaugaggucauucuggaguaaggagggc

SEQ ID NO: 4107307 - RNA, 71 nt, Human
gcccuccauggugauccaggccagugcuucucaaaccuuagcaagaggggguuggaaucaccuggagaggu

SEQ ID NO: 4107308 - RNA, 61 nt, Human
gcccuccccacuugcuccaccuuccucccaggacgaaaccugagccagaguggggacaagc

SEQ ID NO: 4107309 - RNA, 82 nt, Human
gcccuccccccagguuuggucuccuuugucaaggccccgcugccucagugguggccagguggcuguccuggcgugggagggc

SEQ ID NO: 4107310 - RNA, 63 nt, Human
gcccucccugaagaaguuacucuugugcagagauaugaaggaaagagacucuucuggaagagc

SEQ ID NO: 4107311 - RNA, 61 nt, Human
gcccuccugcaggggcuucuggccuggaugguggcaaucaaggggccauggcaggggaggc

SEQ ID NO: 4107312 - RNA, 66 nt, Human
gcccucgccagcuguccuuccuggugggcgccgagggaaggcgguccaggauggcuggcaagcggc

SEQ ID NO: 4107313 - RNA, 79 nt, Human
gcccucucagcucucccuggauccaucgggucccgagugggauugcccacugggcuccaaggaccuggaggaagagggc

SEQ ID NO: 4107314 - RNA, 58 nt, Human
gcccucugaugcucaccgaggacaacuguggccuugucuggauuguuacacagagggc

SEQ ID NO: 4107315 - RNA, 58 nt, Human
gcccucugccacaggacgccagccucggccucagagcugccggcugcugcagagaggu

SEQ ID NO: 4107316 - RNA, 69 nt, Human
gcccucugccuguaacuuucugaagcaguaguuuuucacgugugccugacaguguuacgggaggggagu

SEQ ID NO: 4107317 - RNA, 67 nt, Human
gcccucuggaggccuaaggaaguggcagcucuuuaaauccccaguggccacuccgcccccagagggc

SEQ ID NO: 4107318 - RNA, 57 nt, Human
gcccucuggggaagcagccagcuggggagugcucucggccugugaccccgggagggc

SEQ ID NO: 4107319 - RNA, 58 nt, Human
gcccugagagcagcuuccugcuuaggccaacuuuagcacaaggugcugccugcaaggc

SEQ ID NO: 4107320 - RNA, 58 nt, Human
gcccugaggcaaaagaacagucacugcaaguucaaggcugccauaaugucucggaggu

SEQ ID NO: 4107321 - RNA, 65 nt, Human
gcccugaggcaguaggagcuuuucuuguuuauggaagggaaaggaggccagcgugccuggggugc

SEQ ID NO: 4107322 - RNA, 77 nt, Human
gcccugaguucuggggaaccccaaaagcuccugauccgggagcugaccugcagguuccccuaaccccacucaugggc

SEQ ID NO: 4107323 - RNA, 86 nt, Human
gcccugcaggcucucugcugccagaugacgagugaagaugaaaguccugaugucuauugucugugugcacagagcuuuggaguggc

SEQ ID NO: 4107324 - RNA, 65 nt, Human
gcccugcagugcucugccuauaauggaauagaagccacuuccaccaaggagaacacucaguaagc

SEQ ID NO: 4107325 - RNA, 55 nt, Human
gcccugccagaugugcuucaguuucucaaugcuaaacugcuucccaucuuagggc

SEQ ID NO: 4107326 - RNA, 58 nt, Human
gcccugccaugguagacuuccaggggaaacaucucuguggcuguuuuccugugcgggc

SEQ ID NO: 4107327 - RNA, 70 nt, Human
gcccugcccucuugggacccugcacuugggccacggggacccagcuccagccaccggggggugccagggc

SEQ ID NO: 4107328 - RNA, 74 nt, Human
gcccugcgcuggcucccggggaucgagcaccgcgagagguugggcgcccggggccgcgggggugggcguugggc

SEQ ID NO: 4107329 - RNA, 90 nt, Human
gcccugcggcuucaggcaucugcugcccuucuggaaccugugaccuccaggacagcggcaggcagaucuucagccccagagguccagggc

SEQ ID NO: 4107330 - RNA, 60 nt, Human
gcccugcucaccugccucuucuccuuccugucugggagggggcuccuuggugugcagagc

SEQ ID NO: 4107331 - RNA, 62 nt, Human
gcccugcucuuuugcccacccaccugaccuccuguuguuuguguuggccaaagugccagugc

SEQ ID NO: 4107332 - RNA, 57 nt, Human
gcccuggaaaggaaccugggcuuacuuuuccacgccagcccaguccuuguccugggc

SEQ ID NO: 4107333 - RNA, 60 nt, Human
gcccuggagccagggcuggcucugaugggcuccagggcuggcucugaugggcuccagggc

SEQ ID NO: 4107334 - RNA, 69 nt, Human
gcccuggaggcagaaauaggacuugugauucaccuucaguuuaaaagcgcuaauuucugccuucugggu

SEQ ID NO: 4107335 - RNA, 58 nt, Human
gcccuggagggccagcgacuggagggugagugauucccaggucuggaaccaccagggc

SEQ ID NO: 4107336 - RNA, 66 nt, Human
gcccuggaggucaagacugcagugagccgugauugcaccacugcacuccagucugggcaacagagc

SEQ ID NO: 4107337 - RNA, 88 nt, Human
gcccuggcacccaggacaaggucccagccccucuuggcccagcagagcgagggaccaggagaacugaggccacucuggggcccagggc

SEQ ID NO: 4107338 - RNA, 76 nt, Human
gcccugggaagggcagaaagggacgcuuuguauuaguaggacaaagcugugacuuuuagccuuucaaaaugagagc

SEQ ID NO: 4107339 - RNA, 61 nt, Human
gcccugggaauggucucucagcuguggccccuucugggucccacaggggccuuuccagggu

SEQ ID NO: 4107340 - RNA, 110 nt, Human
gcccugggccaggcuugggugggguuuguggugcaggcaguccaggugggcaucgucccagaugcucugcugguaccaguggccgucaccuaugaccugguuccggaugc

SEQ ID NO: 4107341 - RNA, 57 nt, Human
gcccuggggccucaggccuuuuccuagcagucugcuaggcuccugaggacuccaugc

SEQ ID NO: 4107342 - RNA, 57 nt, Human
gcccugucagcaccuaauucagcuucccauggagaaaggccucccuguugacagggc

SEQ ID NO: 4107343 - RNA, 61 nt, Human
gcccugucaugucagugucuguguguggccucccagcccaaccagaaauugacagagaggc

SEQ ID NO: 4107344 - RNA, 88 nt, Human
gcauggcuucuguacuguaaaaauugguuuggaagcucagggaucacaggacccuggagugccggaaucaagauacaaccugccuugu

SEQ ID NO: 4107345 - RNA, 130 nt, Human
gcauggcuuugaggcuagaaucaugagcaaucucucauaaacaagucuguuaugcaccuggagauacucaagauuugccucuguuagcauggccacuuagagauuacucuguucuacuucagagacccuc

SEQ ID NO: 4107346 - RNA, 89 nt, Human
gcaugggaacuguuuagggugguaagaggaucaaggcggugcacaaagagauguguguagugauuuucuuccaaccaguuuucccaagc

SEQ ID NO: 4107347 - RNA, 56 nt, Human
gcaugggagccaacucugaggguggugagauugccaagccucacagacuuccaugu

SEQ ID NO: 4107348 - RNA, 58 nt, Human
gcaugggaggacagucugggcuguugaagucgguguggauugauagcucuuccggugc

SEQ ID NO: 4107349 - RNA, 74 nt, Human
gcaugggaggcagcccuguggagaggcccacguuagugagcuuggaaguggauuuucuacggccugccaccagc

SEQ ID NO: 4107350 - RNA, 69 nt, Human
gcauggggaguaguuagcuaggugccaaggggaggggaaaguauuccaggcaaaaggaacugcuugugc

SEQ ID NO: 4107351 - RNA, 74 nt, Human
gcaugggucaccagcagucuggaugcccuucuuccucaagguggcugguccaggcugcagccugcugccccugc

SEQ ID NO: 4107352 - RNA, 69 nt, Human
gcaugguggagaggggagucugugagugcuccuccagccucugugcacagcuuccuacuuugcugcugc

SEQ ID NO: 4107353 - RNA, 63 nt, Human
gcaugguggcagcugggacagaggugggugcucagccgccguugucacuguugccacugcugc

SEQ ID NO: 4107354 - RNA, 86 nt, Human
gcauguacacauuugauguuucugucaccuagggcugcauaucaaagcaucccaaggcauauggcugaaaccaacauguauuuugc

SEQ ID NO: 4107355 - RNA, 130 nt, Human
gcauguauccaggagacagaagcacucagcaucccagucccuccuuccacuccugcucugagguugcagugaagcaggguuuggggauuggcacccagcaugaugacugugugucucuggauguacaugu

SEQ ID NO: 4107356 - RNA, 60 nt, Human
gcauguaugcugaucaaucuggggacauaauuuucaugauaggcugguuaguguaucugu

SEQ ID NO: 4107357 - RNA, 57 nt, Human
gcaugucaugucauguaggaauggcauacacagaaccacuccuacgugaaggacugc

SEQ ID NO: 4107358 - RNA, 69 nt, Human
gcaugucugugcuugguauaauaagccuauuaaaaggaaguggucugucuauaccugauacagaguugc

SEQ ID NO: 4107359 - RNA, 58 nt, Human
gcaugugggagggucuucccacacugacacacccucaaggguauacccccucauaugc

SEQ ID NO: 4107360 - RNA, 74 nt, Human
gcauguggugcucucagaaguaacuuguccaugaucacaaaccaguaaguggcaauuuaauuuugaacacaugu

SEQ ID NO: 4107361 - RNA, 66 nt, Human
gcauguggugggcuggccacucggggcugcaguuccaauuuccaaugucuccaguucuucacaagc

SEQ ID NO: 4107362 - RNA, 84 nt, Human
gcaugugguuccuggcuuccugcucuugucaaguaacuaguggccugauuggagcuggcagccccuuugggaaccgcugagugc

SEQ ID NO: 4107363 - RNA, 69 nt, Human
gcauguguaagauucuaagaguuaaugcagagacuuaucuuuauugaugaaagggauuuuggauauugc

SEQ ID NO: 4107364 - RNA, 60 nt, Human
gcaugugugcguguguauguguguguguguguguucccgugugugugcaugcgcacgugu

SEQ ID NO: 4107365 - RNA, 55 nt, Human
gcaugugugcugcacuuuguugugccugaaguacccaaaguacaaguaaacaugu

SEQ ID NO: 4107366 - RNA, 63 nt, Human
gcaugugugcugugcaugcacauauguguuguacaugcacauauguguuguacaugcaugugu

SEQ ID NO: 4107367 - RNA, 57 nt, Human
gcaugugugggguuaugguguauaugggaaaucuuuguacauuucacuccauugugc

SEQ ID NO: 4107368 - RNA, 91 nt, Human
gcauguguguguauaaguguguagaguaagagaucuuccagaaauauaacuuuucuuuucccuuuagcacuuguuuucuguguacaugugc

SEQ ID NO: 4107369 - RNA, 72 nt, Human
gcauguguuucuuuucaaaauugcucugaaaaauauuaguuauuucaagcagcgugaaaaacgacagagugu

SEQ ID NO: 4107370 - RNA, 129 nt, Human
gcauguucaauauccuagcauauggaccagugguugagguuccaugguauaggccauugggggcagcugcauagcuccucccuguaccauuccucugcuccauuuuauuauguauugcguuggacuugu

SEQ ID NO: 4107371 - RNA, 87 nt, Human
gcauguucauucauucauucauuccucauuauuuacugaggacuuaacaagugccaagcauggggaggaaugaugugaugauuaugu

SEQ ID NO: 4107372 - RNA, 66 nt, Human
gcauguucucucagacauccaaagucuuuugcugauagucugagacuuugagcucuuagagaaggc

SEQ ID NO: 4107373 - RNA, 83 nt, Human
gcauguugaaucuucucuuucugcugggcuggaaggauuaucuuacugugcuucccauguucugggaggagaaauacaacagc

SEQ ID NO: 4107374 - RNA, 79 nt, Human
gcauguugcagcuuucccacgcaguggaugagaacgaagguuacgaccauugugugggaggcgucuguguagcaauugc

SEQ ID NO: 4107375 - RNA, 76 nt, Human
gcauuaaaagcuugguuaccaguuggaacguggagagaacucuguauaguuaguuucauaaucauguccuuaaugc

SEQ ID NO: 4107376 - RNA, 77 nt, Human
gcauuaaacuaggauuuaggagcuggcuaacguuaaccaauagaaaugaagccacuuuccagaaucacauuuaaugu

SEQ ID NO: 4107377 - RNA, 61 nt, Human
gcauuacacauagacauucguucaauauccuuuuccugugugugugugugugugugugugu

SEQ ID NO: 4107378 - RNA, 67 nt, Human
gcauuacacauagacauucguucaauauccuuuuccugugugugugugugugugugugugugugugu

SEQ ID NO: 4107379 - RNA, 71 nt, Human
gcauuacauagucaaggugucucauuucuaacaaauaccagaaauuacacuuguaaauggcauguaugugu

SEQ ID NO: 4107380 - RNA, 79 nt, Human
gccguggccguggggggccgucgucccugguugggggucuuggcccagaggcuggcggccgccccgagcagguccaggc

SEQ ID NO: 4107381 - RNA, 55 nt, Human
gccgugucauccaagaccagugugguugugggcacauuagcuuggagacaguggc

SEQ ID NO: 4107382 - RNA, 77 nt, Human
gccguguccugcaggccaggaauggguccggagcaguuuccacaucuuucccacaguccgggcuggcaggacagagc

SEQ ID NO: 4107383 - RNA, 80 nt, Human
gccguuacuuggccauuauuuggcugcagaguccacugagcuacacaggcacccugcagagggaugggggcaguacaggc

SEQ ID NO: 4107384 - RNA, 66 nt, Human
gccguucugauucuaggcguuccucucaguccuugagugagugaauaucuaagucagcauuagggc

SEQ ID NO: 4107385 - RNA, 70 nt, Human
gccguuuguagauaggguccuuauaaagcuuagugagcuuaagcuggguacacguugucacaaaucaggc

SEQ ID NO: 4107386 - RNA, 61 nt, Human
gccuaaaacgcucucaguaauauuccugagucaucccucagggcugggcuugguguuaggc

SEQ ID NO: 4107387 - RNA, 58 nt, Human
gccuaaaacugcaugcaugcauguuuuauauuuuuauguacaguguauguauuuaggc

SEQ ID NO: 4107388 - RNA, 58 nt, Human
gccuaaagguuuuacuagaugguucuauuugcagccaucacuugagaaucuauuaggu

SEQ ID NO: 4107389 - RNA, 112 nt, Human
gccuaacuuggaguuucuugcagagaaggaaacggcaaaacugcuuaguuggcccaaauccaaacugacaagccuuuucuccuuuuuaaguauuucccaauugcuguuaggc

SEQ ID NO: 4107390 - RNA, 55 nt, Human
gccuaacuuggcuuuguucacccuggcucaggcugaagcaacuggacaaguuggc

SEQ ID NO: 4107391 - RNA, 55 nt, Human
gccuaagacugaggcuuuugucuaacaguaagacacuuaccacucagucuuuggc

SEQ ID NO: 4107392 - RNA, 85 nt, Human
gccuaagcuuuguuaagauucagccaaauuguucauccauugcaggugagagaguaaauugguucaguuaccuuagaacucuggc

SEQ ID NO: 4107393 - RNA, 65 nt, Human
gccuaaucuauuuuauuacauccagagagacuuuuauaaucucuggaagugauguucauaguggu

SEQ ID NO: 4107394 - RNA, 57 nt, Human
gccuacauaucuaagacaagccagaugagauugguggacauucuggaugugcuaggu

SEQ ID NO: 4107395 - RNA, 58 nt, Human
gccuacauuucccaguugaauguaauuaauuuggcaaaaaucacuggguguauguggc

SEQ ID NO: 4107396 - RNA, 85 nt, Human
gccuaccucauaagauuacagugagaaauaaaaugcuuuauuaacauuguuagugucugugcuguuguuuaaaagaggguugggu

SEQ ID NO: 4107397 - RNA, 84 nt, Human
gccuacuagauauguaugaggaguauguauuuuccacacauuuucccaggacacgaaugcuuuuccucuguaaauauuuguagc

SEQ ID NO: 4107398 - RNA, 108 nt, Human
gccuacucugucuuuguggugcugguugugcauuuaugaagaaguucuuauuuuggaagaacuucuugcucaugaguauaaagcacauucuucguuuuaaaaguaggc

SEQ ID NO: 4107399 - RNA, 94 nt, Human
gccuagaagguagauaauuaagguguucaaacuaugacuucagcuaccaggaaguguugauccaagugguuuguauaucucucucuuucuaugu

SEQ ID NO: 4107400 - RNA, 94 nt, Human
gccuagaauuauaauacaauauaacacaucguaauaucggauauuauaccacguuuaccucccauuaggauguguauauuguguuaggcugugc

SEQ ID NO: 4107401 - RNA, 81 nt, Human
gccuagcuugcucuuaggguccugccuacagagacagaaguauucucucuguccuuacagggcucuagggguugguccagc

SEQ ID NO: 4107402 - RNA, 64 nt, Human
gccuaggcuucccgcucacaugcccccgcgacgcggcgggcgggccggguuggggaggcugggc

SEQ ID NO: 4107403 - RNA, 70 nt, Human
gccuagguuuggaccugauguuuagucuuguuccacaugguggcaagaaggcuucagguagcuccagggu

SEQ ID NO: 4107404 - RNA, 85 nt, Human
gccuagucaucucuuucuccacacuuucucucccaggccuaagaagguuuacaguccccaggugaggauaaggacaugucuaggu

SEQ ID NO: 4107405 - RNA, 66 nt, Human
gccuagucuugcugugcuaugaguuugccuggauugccauuacuuauaggccaaguagacuguggu

SEQ ID NO: 4107406 - RNA, 82 nt, Human
gccuagugaaaagcccauggggagauggggaggccagcuuguuuucauaugcuaggcuucaaaaucucccugcugacuuggc

SEQ ID NO: 4107407 - RNA, 76 nt, Human
gccuagugaugcacucuugaguuagcaaguggggugacaccacucugaaagcaaaacuagagaaagcagcaugggc

SEQ ID NO: 4107408 - RNA, 58 nt, Human
gccuaguucacaguagguuuucagacaguguuugaauaaaugagcagugaauuaaggu

SEQ ID NO: 4107409 - RNA, 84 nt, Human
gccuauaugggaaguucaggugggaauugagcaacaaaaggccaucucacuaucugaaacuuaggaacguaugaaauaaagggc

SEQ ID NO: 4107410 - RNA, 86 nt, Human
gccuaucacaucagauagaaggauagauuucuagauagaagaaauuugggcccaucuguuaucuagaaauuucuuuuguugaaggc

SEQ ID NO: 4107411 - RNA, 60 nt, Human
gccuauggaugacaaauauucuucucagauucuagcaguagaguuacugucauccuaggu

SEQ ID NO: 4107412 - RNA, 74 nt, Human
gccuauuaaagagcuuggagcaaguuaguaguaccucaugacauauguuugugcuccagccucuuugauagugu

SEQ ID NO: 4107413 - RNA, 63 nt, Human
gccuauuuaaaauaagccccaguggaugcaaugagucuuccauggagugaauuuucaauaggc

SEQ ID NO: 4107414 - RNA, 76 nt, Human
gccucaaauggaauuaugcaaccaaugaccacgacuuucccagacgcuguucacaggcugcauaaugacgaagggc

SEQ ID NO: 4107415 - RNA, 72 nt, Human
gccucaagacagggagcagaggugagaaguucauugcauacuguuuucuuagcucccugcuuuccacggggc

SEQ ID NO: 4107416 - RNA, 80 nt, Human
gccucacacagagucccagaucuacaggagggagggguugcuccugacugggggauccuggaagacuucauggagggggc

SEQ ID NO: 4107417 - RNA, 82 nt, Human
gccucaccauaccccucagagguaccagcagccucugggcagugcccaguucuccaaggucugagccucugcucugggaggc

SEQ ID NO: 4107418 - RNA, 78 nt, Human
gccucacccagaccuuucccccagguguguggugcuuaccuguccacagacuggagugagagaaauaaguuuggaggc

SEQ ID NO: 4107419 - RNA, 74 nt, Human
gccucacuaggcaucugugaggguagauuggcucaauuccuacugguaucccuacccauaggugcuuagguggc

SEQ ID NO: 4107420 - RNA, 66 nt, Human
gccucaggcuugugagccuucagaggggcaaagcaaugccuagagcugcucucccaggucugaggu

SEQ ID NO: 4107421 - RNA, 55 nt, Human
gccucagggauaggaugagcauggcagugagcacaagugaugucccccaugaggu

SEQ ID NO: 4107422 - RNA, 57 nt, Human
gccucaguaaccuuaggggauaaauaacccauguuuuccagaugucgauacuggggc

SEQ ID NO: 4107423 - RNA, 59 nt, Human
gccucaguguucucaucuguaugucgagcacugcacagaaucggaucaugcgcugaggc

SEQ ID NO: 4107424 - RNA, 99 nt, Human
gccucaguuuccucaucuguaacauaaaaaaggcuuaacuggaaauucucuaacauccuuuccagcuuugagauuuuauggaacaauguagacucaugc

SEQ ID NO: 4107425 - RNA, 96 nt, Human
gccucaguuuucacucugucaauauguaauaacugaaucugucuuuguggugaggauucagugaguuaacauauuugaagugcuuaaaaaugaggc

SEQ ID NO: 4107426 - RNA, 55 nt, Human
gccucaugacugccaucaaucuuaaagcggaaauugcugaggugcaguaagaggc

SEQ ID NO: 4107427 - RNA, 70 nt, Human
gccucaugugguagagggcagaugggcaaaaagggaugaacucccuuugucuaaguucuuucauagaggc

SEQ ID NO: 4107428 - RNA, 59 nt, Human
gccucauuuauccaucugugaggggacuggcucagcuccucgcaggagggagaugaugc

SEQ ID NO: 4107429 - RNA, 73 nt, Human
gccuccaccuccccagcacuaccagaagccagaaaaacauguuuggccagacugaggugcugggaaggagagc

SEQ ID NO: 4107430 - RNA, 73 nt, Human
gccuccagcucagaggaugcuccuuuauguugauuugacaggaauuccacauaaucacccuccgggcugcagc

SEQ ID NO: 4107431 - RNA, 71 nt, Human
gccuccaguguggucaaaggggaauguucaccaaaggagugauaggaguuugguuugggccagauggaggu

SEQ ID NO: 4107432 - RNA, 97 nt, Human
gccuccauaggagagugugugauguaaagaacuggggauguagcaguucaguuacugcaauuccucagcuuuuauuucacuugccuuuuagaugggc

SEQ ID NO: 4107433 - RNA, 108 nt, Human
gccuccauggcccagcuuagcucucaggacagaaggcugccaggguccucugugggaugcuggcucaacuuccuucuccuccccucagcuaagcuggaccacggaugc

SEQ ID NO: 4107434 - RNA, 75 nt, Human
gccucccaaagugcuaggauuacaggcguuagccauggcacccggcugaauuuuaguaauuugaauuauagaggc

SEQ ID NO: 4107435 - RNA, 69 nt, Human
gccucccaaagugcugggauucaggcaugagccaccgcacucaucccuuaucugguauuuuuuagaggc

SEQ ID NO: 4107436 - RNA, 85 nt, Human
gccucccagcaggaaaccugucugauuauggagacugccaauagcaaguuucaguuaacccagacuaauugggcugcugggaggc

SEQ ID NO: 4107437 - RNA, 95 nt, Human
gccucccuuuuaaaauaaugaaacaaacauuguuuaaguuaaauuguuacuugguuccuccccacaguguuacuugauaguguauguuacgaggu

SEQ ID NO: 4107438 - RNA, 75 nt, Human
gccuccuccugggagcucggcgcccucaggugcucccugagaugccagcaccugaacgaccugcuccagggaggc

SEQ ID NO: 4107439 - RNA, 104 nt, Human
gccuccucgaauguugaugaucagacucccguugaugacggugcauccucggagcuccugggcagacgucaccgagucgauggucuucucgccuucuaggaggu

SEQ ID NO: 4107440 - RNA, 70 nt, Human
gccuccucucuuaaaucauauuacuauccuguacaucagcagagucaguauugaauugaaauagggaggc

SEQ ID NO: 4107441 - RNA, 66 nt, Human
gccuccucugucacuuguaugucuauaauucaucaacuaaauggcuuugguggcggggauggaggu

SEQ ID NO: 4107442 - RNA, 59 nt, Human
gccuccucugugauuuugugagccagagcucccugcuugaaugcucuuuccggaggggu

SEQ ID NO: 4107443 - RNA, 74 nt, Human
gccuccucuuuucuguuccuuugagcuggccagcaccagcaaggccuacagagaggggcccaauaugaugaggc

SEQ ID NO: 4107444 - RNA, 62 nt, Human
gccuccugccgcugcugaccacucaucauccaauguguccuggaugagguagcagcuggugc

SEQ ID NO: 4107445 - RNA, 80 nt, Human
gccuccugcucugcugugccgccagggccuccccuagcgcgccuucuggagaggcuuugugcggauacggggcuggaggc

SEQ ID NO: 4107446 - RNA, 56 nt, Human
gccuccuguuaugccaugugccgccucugaaggccaacggggcagaccagagaggc

SEQ ID NO: 4107447 - RNA, 56 nt, Human
gccuccuucagucugcguggcuguguuguuaucaaggcuauguggaaugaaggugu

SEQ ID NO: 4107448 - RNA, 64 nt, Human
gccuccuuccacagcucacacuggucugaccccuucucaugccagugauugccuggaaggaggu

SEQ ID NO: 4107449 - RNA, 65 nt, Human
gccuccuucuccucgggaggccaggaggacccgggucacuuugccaauucugcggagggggaagu

SEQ ID NO: 4107450 - RNA, 64 nt, Human
gccuccuuucucugcagcuuggcauucacccccaggggcuuccagcugcaggagaaacagaggc

SEQ ID NO: 4107451 - RNA, 57 nt, Human
gccucggccccggccccgggguuucuuggcgccaucggugggcguggaggccgaggc

SEQ ID NO: 4107452 - RNA, 60 nt, Human
gccucgguuucuucaucuuucacauucuuggaggguugcugagaugaauagagaccucgc

SEQ ID NO: 4107453 - RNA, 74 nt, Human
gccucguguaacucaaauacuuauguuacuuggugaaggcaacacauuaguacaaguauuagaguuauucuggc

SEQ ID NO: 4107454 - RNA, 57 nt, Human
gccucuaccagauaacaagccagaccacccaucacuggcuugucauguaucugaggc

SEQ ID NO: 4107455 - RNA, 75 nt, Human
gccucuaggucagugcagcucccucaccugcuugauguaaaucucaaguuguaccuaagcugcgaucuaagaggc

SEQ ID NO: 4107456 - RNA, 62 nt, Human
gcagcugccaguccccuuccaggcccugucaugggauggagcagggcaucacugugcggcgc

SEQ ID NO: 4107457 - RNA, 75 nt, Human
gcagcugccaugacauguccugcuggccagccucagaaaggucuugggugaggacagggcugacuuggcagcugc

SEQ ID NO: 4107458 - RNA, 55 nt, Human
gcagcugcgaagaagucuaucucccauauggcuuuuaggacacuuugcaguaugc

SEQ ID NO: 4107459 - RNA, 87 nt, Human
gcagcuggaaggucuuggcuguggauuuugguuugucuacacuccuuuuuauauuagagaaaacuugucacagcucucacacguugu

SEQ ID NO: 4107460 - RNA, 77 nt, Human
gcagcuggaaguccaagaucaaggugucaggaggguugguuccuucugaggccccuccuugacuugcagacagcugu

SEQ ID NO: 4107461 - RNA, 58 nt, Human
gcagcuggacccacacggcuuaccagacuuuucugcaaguuguguguuuuccaccugu

SEQ ID NO: 4107462 - RNA, 79 nt, Human
gcagcuggccaugggcauucucuuaggugaugagccccugacccauaggcccucucauuccagaggcauuggccaucuc

SEQ ID NO: 4107463 - RNA, 89 nt, Human
gcagcugggggcugugucagugaaccaggcugcgucccugaguacuuccaguagguggggguguccuggugcacacagcucaagggugc

SEQ ID NO: 4107464 - RNA, 72 nt, Human
gcagcuggugauggccuaagaaggucuguguaaaggaaaacacaugucucccuguuugcuacgcuaucuugc

SEQ ID NO: 4107465 - RNA, 73 nt, Human
gcagcuguagcuuuguguccugauuuagcugaccuaaaauucaugcacucccagaucacagagcauuggcugc

SEQ ID NO: 4107466 - RNA, 66 nt, Human
gcagcugucuucuaccuucaaccuccagcucccauccugaaggccugugguagugagacguucugc

SEQ ID NO: 4107467 - RNA, 56 nt, Human
gcagcugucuuuucuaaauauuaagcacucacuugguuacauagggcagauggcgc

SEQ ID NO: 4107468 - RNA, 64 nt, Human
gcagcuguugaaugcccugugcuggguuggggacacaucauugcuuccagggcucagucacugc

SEQ ID NO: 4107469 - RNA, 78 nt, Human
gcagcuucuugagggaauccucacaucaaucuuuaaaauaaauagugaugaugccccgauuuuccaucuggaaacugc

SEQ ID NO: 4107470 - RNA, 57 nt, Human
gcagcuuggggacaugaaaagacuuguaguuugaugcuuucuuauguccguaggugc

SEQ ID NO: 4107471 - RNA, 73 nt, Human
gcagcuuuccuuauucaaugcuggaaauguuguucuuauugaacaggcacuugcauugaugaggucuuguugc

SEQ ID NO: 4107472 - RNA, 57 nt, Human
gcagcuuucuacuuccuacagcuuuugggguggaggaaaacggggugagggagcugc

SEQ ID NO: 4107473 - RNA, 80 nt, Human
gcagcuuugugaaauguuucaaaauagucggggcuauucguccuauccuguauuauuuuucaauuuuacaguuuucuugc

SEQ ID NO: 4107474 - RNA, 79 nt, Human
gcaggaaaagcguaugaaugcaggguucugggcuagagaagugacuucccuucuuggggucuuguguugccuuuccugu

SEQ ID NO: 4107475 - RNA, 100 nt, Human
gcaggaaaaucagguucggggccagacagacuugaguuugaggcucagcaaugccgcuucugagcugugugguccugggcaaguaacuugaccucccugc

SEQ ID NO: 4107476 - RNA, 122 nt, Human
gcaggaaauaaucagaagggggaaguugcagguuucagcgauucuuucagggaaccaggaauuccuggaaucccgcaauggaggauucaagccaaggacgugggacuuugccacccaccugc

SEQ ID NO: 4107477 - RNA, 69 nt, Human
gcaggaaauguuaggggagagaugcaaguguacuacugauuuuuauaacucuuuugugacaagccuagc

SEQ ID NO: 4107478 - RNA, 58 nt, Human
gcaggaacccggccgcccuggcuucaaccaagccacagaauugcacgugggguucugc

SEQ ID NO: 4107479 - RNA, 75 nt, Human
gcaggaagucuucccaguucugcuugagggggcccuuccaaaguacucccagagggccuguucuagaacuccugu

SEQ ID NO: 4107480 - RNA, 85 nt, Human
gcaggaaugagugcuggaggcaguggaggugccugacgaagguccagcaggacggacagccccagugucuguagaucaggccugc

SEQ ID NO: 4107481 - RNA, 74 nt, Human
gcaggacagcaggaugcuuagacaggagggcauuugcaaucccccucagcuccuccacagcauccugcuccugc

SEQ ID NO: 4107482 - RNA, 78 nt, Human
gcaggacuguguuucuuucuggaggcucuaagggauaaucuuuuuucuugccuuuuccagcuuccaggagcugccugc

SEQ ID NO: 4107483 - RNA, 63 nt, Human
gcaggagagcugguauaugaagacaugaauucagauauucuguuuccauuuucaguacucugu

SEQ ID NO: 4107484 - RNA, 72 nt, Human
gcaggagcagagggaguauuagagcuuggaugcucauuucuaaaccucucugagguucccucaacuaccugu

SEQ ID NO: 4107485 - RNA, 68 nt, Human
gcaggagcccagaguccucagcucuucccagcuaacccucugcggcuugggaccugugguguuccugu

SEQ ID NO: 4107486 - RNA, 69 nt, Human
gcaggaggauaugauuccuagauuccugaaggaaaacucuuuuguuuagaggaacuggaaucagccugc

SEQ ID NO: 4107487 - RNA, 129 nt, Human
gcaggaggcaggagaccaugaggucagcaggagaaugggagccagccuuuccuugggggccaggagcgaggaaccugggcuuccauccuagucugcuuguccucccugggccucagucuacccaccugu

SEQ ID NO: 4107488 - RNA, 68 nt, Human
gcaggaggcuugugugcaaguuaucugagcucugacugagcagaugaagaugccacuaagaccagagc

SEQ ID NO: 4107489 - RNA, 74 nt, Human
gcaggagggugggaagcaguuuuauuuauuuauguauuuauuuauuuauuugagauggagucucgcucuguugc

SEQ ID NO: 4107490 - RNA, 57 nt, Human
gcaggaggugagcagcaggcgggcaaagagcauuacugccugagcuccgccuccugu

SEQ ID NO: 4107491 - RNA, 109 nt, Human
gcaggagguuccagccucuucuggccggcuacccucagaccccugcugagcuucaccauccuugggggacaggcuaggcugaaggugguggcuggggcuguccaccugc

SEQ ID NO: 4107492 - RNA, 79 nt, Human
gcaggagugccaggagguacugguuuagauagagcagccauuaagggccucacugagcagugguucuugagcgcagagc

SEQ ID NO: 4107493 - RNA, 58 nt, Human
gcaggaugggagcuucacuuugucucaguuguucuggcaaagagaagccucaccuugu

SEQ ID NO: 4107494 - RNA, 81 nt, Human
gcaggauuauaugcucauuuuauugagaaugaccuuaagcagauuagguaguucucaaguuugaaugagcuuuaauuuggc

SEQ ID NO: 4107495 - RNA, 114 nt, Human
gcaggauuucuaugaauauucauuacugcacgugggacauauauauuuuaucagaucugggcuuaaacauagagguaccuuugugcagaaagaauaauucaacauggacucugc

SEQ ID NO: 4107496 - RNA, 77 nt, Human
gcaggauuuuauuguuuuaaaaauccaugacuacuggaaauaguaaugaauggaauguuaaaccucaaugauccugu

SEQ ID NO: 4107497 - RNA, 97 nt, Human
gcaggcacaagagucuucaucugguuaggucucuccuuggccugaaaugcuggcccaggcuuuugaggacaaagcccaggugcuggucucugccugc

SEQ ID NO: 4107498 - RNA, 82 nt, Human
gcaggcaccauguuucugaccacccucuucauccguacucacauaccugcuagacaguggaucgggaugcacugguggcugc

SEQ ID NO: 4107499 - RNA, 57 nt, Human
gcaggcaggcacuacucaacaugguacaaugugugcuuguuccuaucugccuccugc

SEQ ID NO: 4107500 - RNA, 58 nt, Human
gcaggcauaugauggaacugggauuuaacuaaaggucuuucuuaauucaagugcuugu

SEQ ID NO: 4107501 - RNA, 61 nt, Human
gcaggccagcugugcagaugggcugugaggaggcaccugcccaggugagcagcaggucugc

SEQ ID NO: 4107502 - RNA, 83 nt, Human
gcaggcuaugagugucuuuaugagcagcuugauuuauuuguaucagauuauauaagcugucaggagguuaccuuuuggucugu

SEQ ID NO: 4107503 - RNA, 57 nt, Human
gcaggcuccaggccggccccuugaaucucaccgcgaggaaggcacccugcugccugc

SEQ ID NO: 4107504 - RNA, 59 nt, Human
gcaggcuccugagaggcagaggcugcgggagugcagcucuucaguccucgggagugugc

SEQ ID NO: 4107505 - RNA, 84 nt, Human
gcaggcugcacggcagcucucagcgguuggaguuagguucuguagcucuuccaggcuagaguuguugcacacuuguggcucugc

SEQ ID NO: 4107506 - RNA, 85 nt, Human
gcaggcugcucugaauauuucgauagaccuaacaauugcuucucaagguugcuguuuuacaucugguggguuuugagcaggcugc

SEQ ID NO: 4107507 - RNA, 95 nt, Human
gcaggcuuguuugaggacuugacaagcugauucuaaaauuuauuaucccaaauauuaauaauuuuaaagaaggcuagagaacuuaagcuaccugc

SEQ ID NO: 4107508 - RNA, 72 nt, Human
gcagggaacagcauaucugaaggguuucuacaaagaauuacauccucaggguaggcuauguauuccuagagc

SEQ ID NO: 4107509 - RNA, 89 nt, Human
gcagggaagccgauuuggaacuuaaacaagcucccaaguugugaucagucgagcuuggcaagcacuguuugagagaguagguguccugc

SEQ ID NO: 4107510 - RNA, 56 nt, Human
gcagggaaggggacggaaccaggcuucgcccccugugugugucucuggucucuugc

SEQ ID NO: 4107511 - RNA, 76 nt, Human
gcagggagcaguuaucgaagaaucaggucaaguggggguuugcuggcauuaccuguguuucuguaguggucauugc

SEQ ID NO: 4107512 - RNA, 60 nt, Human
gcagggaggacgagauaccugggucccccuuccggacaagacaccucucuccaucccugc

SEQ ID NO: 4107513 - RNA, 80 nt, Human
gcagggagguuaggugggugacuuccauggggguucuuucuuguccugccauguguacacccacuuccauuuccuacugc

SEQ ID NO: 4107514 - RNA, 69 nt, Human
gcagggauaguagaauguucuaugucaauguguguguguucacgcauugugaaccuuucucaugccugc

SEQ ID NO: 4107515 - RNA, 62 nt, Human
gcagggcagccacaggcccccucaggauauagggaggaggccaauggaaggggcugcccugc

SEQ ID NO: 4107516 - RNA, 61 nt, Human
gcagggcagcucacugugguucauucaacucaauuugauuccgcagcuaguauguuggugc

SEQ ID NO: 4107517 - RNA, 111 nt, Human
gcagggcaugguagcugccgccuguaaucccagcuucucaggagucugaggcaggagaauugcuugaaccugggaggcggagguuguagugagccaagaucgugccacugc

SEQ ID NO: 4107518 - RNA, 61 nt, Human
gcagggccaggucugggauuugaugcaggggccgagcaccugcuuccagaggaggccccgu

SEQ ID NO: 4107519 - RNA, 103 nt, Human
gcagggccgguuccaggcccagacggggugagggagucccacaccugagacagauggccuugccccaucugggaaucccuggagguugugccgagucccuagc

SEQ ID NO: 4107520 - RNA, 57 nt, Human
gcagggcucaacaggacaccccugccagagcaggagggccuccucggugggcccugu

SEQ ID NO: 4107521 - RNA, 64 nt, Human
gcagggcuccaggcucacagcaucccaggaaggcuucagggaacaggugggcuuugggccaggc

SEQ ID NO: 4107522 - RNA, 82 nt, Human
gcagggcuguauuucugucuggaagcucuaggggagaauccauguccuugguuuuuccggcuucuagggaaaugcuuccugc

SEQ ID NO: 4107523 - RNA, 64 nt, Human
gcagggcuugcaggugcugaauuuggacucccacugagcccauuugcggcuucugucaccuugc

SEQ ID NO: 4107524 - RNA, 75 nt, Human
gcagggcuuuucucuucaaaagucuaauccuuauaacaaguaguggagaggauguggagaaauuggaaacccugc

SEQ ID NO: 4107525 - RNA, 63 nt, Human
gcaggggagaggcggcccagagcuuugucuggccuggaccagccuccgccuucacuccccugc

SEQ ID NO: 4107526 - RNA, 82 nt, Human
gcaggggcagcugaggccacgagugaagggccugcucauggguagcccacgcccccuccucagggcccucagcagcccuugc

SEQ ID NO: 4107527 - RNA, 56 nt, Human
gcaggggccaaggguccagaccucccucuaggcagguccauuucuaagcacccugc

SEQ ID NO: 4107528 - RNA, 71 nt, Human
gcaggggcggcuggguuuccaggggcggcagagccaccaagagcgauggaaacccacccccgagucccugc

SEQ ID NO: 4107529 - RNA, 99 nt, Human
gcaggggugcucaggggcugcuccccuuuuauuaaugacagcgguuucucucaaggaaguguagugcccuccccuuugggauaguugccugaccccugu

SEQ ID NO: 4107530 - RNA, 74 nt, Human
gcaucuugucaccacuggcugaaacaccagcaauaaacaucagcugaacagccagcagggugacgggugggugc

SEQ ID NO: 4107531 - RNA, 60 nt, Human
gcaucuuguucacugcuguauuugcaguacccagaacuguucauggcagaugauaagugc

SEQ ID NO: 4107532 - RNA, 83 nt, Human
gcaucuuucuccuguuauuuaucugagcauuuaucacucauuauugugaugcucagcucaaauaucaugguuucugagagugc

SEQ ID NO: 4107533 - RNA, 69 nt, Human
gcaugaaauucagcaggugaguacagggcugaaagaugcuccuaauauuuaccaguuuggagauuaugu

SEQ ID NO: 4107534 - RNA, 67 nt, Human
gcaugaaguucauucccuccagcuguggcuaccucaauaugguggcuggaggguuagugagauaagc

SEQ ID NO: 4107535 - RNA, 120 nt, Human
gcaugacaguagccaugagaagucaccuuagaccugagcaggagcuaaugauggugaauuacuguccccaccacugcgggagcuccugcacccagccuugagcagaucucaucuucgugc

SEQ ID NO: 4107536 - RNA, 56 nt, Human
gcaugacagucgaaagguuaacuucugagaaguuacaacuuuccugugucaaaugc

SEQ ID NO: 4107537 - RNA, 101 nt, Human
gcaugacuuucaagaagaaucauuguaaaguucuguauuugguucaaagaaaaucaacaacacaaauucacagggauuccugacuuggcagcaguucaugu

SEQ ID NO: 4107538 - RNA, 130 nt, Human
gcaugagaauccucuggaaggcuugcugaaacagauggcugggcccgauccucagaguuucugguugagcaggucugaggcgaggccugagaacugguauuucuaagaagcuuccaggcgauggugaugc

SEQ ID NO: 4107539 - RNA, 71 nt, Human
gcaugagaccagugaguaggccuuagauuggauguguccacauauccucugagucgcucccuggauccagc

SEQ ID NO: 4107540 - RNA, 81 nt, Human
gcaugagaggaaauguugagguagagaaaggaaaugagaaaaguuucauuuucauuguuuugcuucagcuugcucuaaagc

SEQ ID NO: 4107541 - RNA, 74 nt, Human
gcaugagcagcugucugggccaggccuggccgaagagccauucaucccugcacuccagccaguaaaugcucagc

SEQ ID NO: 4107542 - RNA, 67 nt, Human
gcaugagcuuuguggguaaagagagcucaccaaauucagccuccagcagcacacacagcucaguagc

SEQ ID NO: 4107543 - RNA, 55 nt, Human
gcaugaguaauucacaaaacagaugaauuggauccucucauuugugaagcucagc

SEQ ID NO: 4107544 - RNA, 84 nt, Human
gcaugauaacauaaagcagacugauuugcaucacuugguauugucagcccuguguguuugaguuuguucucuuauuuaauaugu

SEQ ID NO: 4107545 - RNA, 67 nt, Human
gcaugauacagguaauaauaacagaaaaacaaaucuguuuuucagccaugaauuacacugugucugu

SEQ ID NO: 4107546 - RNA, 69 nt, Human
gcaugauucagucuuuuaaaggccuagaaccacacacuuaacuaggaauauuugauaucugaauuaugc

SEQ ID NO: 4107547 - RNA, 94 nt, Human
gcaugcaauuaggcagaaaugagcuuagguucagguugggccaucugugaauggaacauucuugggcaaguuacuaaaucucucuaauucgugu

SEQ ID NO: 4107548 - RNA, 78 nt, Human
gcaugcacauuuguucaucucuugccaaaguuugacccacugguuauucuaaagguaagagaggauccaguuugcagc

SEQ ID NO: 4107549 - RNA, 58 nt, Human
gcaugcagacagucugagaccacagggccacucuuuccacaggacaaugucugcaugc

SEQ ID NO: 4107550 - RNA, 75 nt, Human
gcaugcagugauuugaggauuauugcucacgguaagaaaaacaugaguaauauauugucuucaaagaaccuaugc

SEQ ID NO: 4107551 - RNA, 75 nt, Human
gcaugcauccuuucuaagauacugcaacuuuugugaaauaagugaaaguuaccucguuuuggaaaggaaaguagc

SEQ ID NO: 4107552 - RNA, 100 nt, Human
gcaugcaugugugugcgugugugugcaugcacguaucugcgugugugcgugucugcaugcacgugugugcgugcgugugcgugcacguuugugugcgugu

SEQ ID NO: 4107553 - RNA, 59 nt, Human
gcaugccaugugugaggagaggagugucugagccugaaguucucuaucaaauauggugc

SEQ ID NO: 4107554 - RNA, 77 nt, Human
gcaugcccauuuugagagcugcugagacuguccugguauuucucagggccuucaggauaggucucuucagggccugc

SEQ ID NO: 4107555 - RNA, 59 nt, Human
gcaugccugccuggugggcguggccuggaagcccggguagcaccggcagugguaggugc

SEQ ID NO: 4107556 - RNA, 69 nt, Human
gcaugcuaaaaugaaugacugagguuucauuaauaagauuagugucuuuagcaaguuuagucagcaugu

SEQ ID NO: 4107557 - RNA, 96 nt, Human
gcauggaaaggcagcagaguauggaaaaugaaaugagaugggcaaaagguuaaguacaugggaguuuauuauucuguucucucuacuuuuuuaugu

SEQ ID NO: 4107558 - RNA, 57 nt, Human
gcauggaauucccuuaugggccccaaacucuggauugcacucugagggaguccaugu

SEQ ID NO: 4107559 - RNA, 58 nt, Human
gcauggagaagugggaacagguccuuccaggcagccuggcucuuccuucucaucaugu

SEQ ID NO: 4107560 - RNA, 66 nt, Human
gcauggaugaaggcgaggaugaggggcuaggacuaggaggugccucagcuuccuuacaucuaaugc

SEQ ID NO: 4107561 - RNA, 63 nt, Human
gcccuagacugugugcuguggggagaggaagucccuaucuucuuggcuguucauggucagggu

SEQ ID NO: 4107562 - RNA, 93 nt, Human
gcccuagauaggcagcaguggccuuacagaugcugacagaugaucugauuagaugcacaguugcuggguggcgucuggggccagucuauuggc

SEQ ID NO: 4107563 - RNA, 102 nt, Human
gcccuauuguuccaagagccccagagcagggagaggugcagggagggagguuucagcucccucugagugacagccuccucucaaucugggcucacagagggc

SEQ ID NO: 4107564 - RNA, 71 nt, Human
gcccucaccacugcccuggggguugccaucuggaggagccuggggauaaggguaacccagggaggcugggc

SEQ ID NO: 4107565 - RNA, 98 nt, Human
gcccucagagcugaguggcaggcucuggcguccaauggagcgggcggauggagacuucugcaccaaugggcgugggggaggcggugccgcgggggggc

SEQ ID NO: 4107566 - RNA, 57 nt, Human
gcccucagaguuccccacagugacauauagcuguggggaaaauuaucuaugaggagc

SEQ ID NO: 4107567 - RNA, 70 nt, Human
gcccucagcuccuucccuggugggcucugagcaccgcgccucucccaagggguaagggagcugugagggu

SEQ ID NO: 4107568 - RNA, 74 nt, Human
gcccuccugagcuagcacguguuugccugguucacaccuguccccauauugggucugcagcuagccaggggggc

SEQ ID NO: 4107569 - RNA, 60 nt, Human
gcccucggcgcuuugcgacacuggccccuguccccagaacccgcacagccugccaggcgc

SEQ ID NO: 4107570 - RNA, 76 nt, Human
gcccucguccuugcugccgccuuccucucugggcucccccaccucagagccccuugugggcgcacagcacguuggc

SEQ ID NO: 4107571 - RNA, 75 nt, Human
gcccucuacaaugaauuccagaugcuuguauuuaaaucugacaugaucugaaugcuguguugggacagggugggc

SEQ ID NO: 4107572 - RNA, 61 nt, Human
gcccucugcacagcucugagcaggagugucugaucuggcagcgaccugcugugcagggggc

SEQ ID NO: 4107573 - RNA, 89 nt, Human
gcccucugccucuggaccccugccuuggcccuaguucauggcuccucucuguuggacugggauggccgaggcuauagcccaggcggggc

SEQ ID NO: 4107574 - RNA, 58 nt, Human
gcccucuggccagagaaaggccaguucaggcugucagcuucuccuggccagaagaagc

SEQ ID NO: 4107575 - RNA, 59 nt, Human
gcccucuggugggugagccccgggcugggugagcccuggggugggugagccgggguggu

SEQ ID NO: 4107576 - RNA, 90 nt, Human
gcccucuuacaguuguucuaucagcaugaaaagaauauacccuaaccagcuuucauguucuaggaagauaagaaacagguguaagagagc

SEQ ID NO: 4107577 - RNA, 71 nt, Human
gcccucuucagcugacagcaauuccuagagagaacucagaugagugcuuucagcugcucgaggaggagggc

SEQ ID NO: 4107578 - RNA, 83 nt, Human
gcccucuuccacccccaggagcuccagggacacugccaggcagcuugauccccaggacuagggggugggagugcaaacauggc

SEQ ID NO: 4107579 - RNA, 92 nt, Human
gcccugaggcuggggagacugggacauauaccugcucacuuccagugacagaaugugacucucagaugugaccuuucccacaccugcagggu

SEQ ID NO: 4107580 - RNA, 55 nt, Human
gcccugcaaggccuggccgcagccccuccucgcuguccuccaggaccugcagggc

SEQ ID NO: 4107581 - RNA, 56 nt, Human
gcccugcacgaucaauucugucauuaaccccauaguacagaugaggaugcggaggc

SEQ ID NO: 4107582 - RNA, 65 nt, Human
gcccugcacuaccucucaccaagugugccucagccccuggcagguucugaggauggugccugggc

SEQ ID NO: 4107583 - RNA, 59 nt, Human
gcccugccuccagggaccccucagguguucugagcccagaggguuccauggagcauggu

SEQ ID NO: 4107584 - RNA, 64 nt, Human
gcccugccugucugcugggagggcccgcauggagccucuugcccagcugcagacaagggagggu

SEQ ID NO: 4107585 - RNA, 76 nt, Human
gcccugcgagcuuggaggggugcgcgguccgcgcaaaagugcgcgccggggcugcacgccucucagcuugcggggc

SEQ ID NO: 4107586 - RNA, 126 nt, Human
gcccugcuuacuggaguugcgggguagggucuggucucccacuguccugcucagccauucucugggcccucugaggcuggaugggaugccuccccaccccgucauuguccuguucugagucagggu

SEQ ID NO: 4107587 - RNA, 97 nt, Human
gcccugcuuccucagaagagcuggcaacgcuagaugccacucccacauagcaacaauuagagggagcccagucauagcugcccuucugggacagggc

SEQ ID NO: 4107588 - RNA, 95 nt, Human
gcccuggagaguucugaacacaagagcuacuugaucagauuuauaucucuaaagggaucauucuagcuguuguguugagaauagacuaugagggu

SEQ ID NO: 4107589 - RNA, 79 nt, Human
gcccuggaguccaggcagcaucagucugcuguauucuaccagucacagcagucacaggcuagcacagauucaauagggu

SEQ ID NO: 4107590 - RNA, 62 nt, Human
gcccuggaguucgacugaguugaaugcugacucugcuauuuacaaacucugugacuuugggc

SEQ ID NO: 4107591 - RNA, 62 nt, Human
gcccuggauggcaggagccaucaccaguggccacgaaucccugcuauaaauguacccagggc

SEQ ID NO: 4107592 - RNA, 58 nt, Human
gcccuggcccacgugcaguccaugugguguggcugugaggaccagguggggcgguggc

SEQ ID NO: 4107593 - RNA, 83 nt, Human
gcccuggcccuuuccuggcuggcgguuuugguguggcugacuaccuaccaccuugggcgcccaggaaagaagggggccagggc

SEQ ID NO: 4107594 - RNA, 74 nt, Human
gcccuggccgccuggggccgggugaauccgccggccagugcggguauaaauuacccgggcccgcgcggccgagc

SEQ ID NO: 4107595 - RNA, 71 nt, Human
gcccuggccuggccauagggcccugguagccucuaggcggcuggacagaaguggcugggcagguccugggc

SEQ ID NO: 4107596 - RNA, 84 nt, Human
gcccuggcuagggagcuccgagucccggccgccugguccuuucauucugggcuucuucgagauucucgagggcuuccagccggc

SEQ ID NO: 4107597 - RNA, 83 nt, Human
gcccugggcucccagccuucgccagucugaaaaagggccaugaagaaucagacaacucuggaggcuggcugcuggccuggggu

SEQ ID NO: 4107598 - RNA, 59 nt, Human
gcccugggcucccugcuccacagccacaccgagcugaggcaggggugaggcccaggugc

SEQ ID NO: 4107599 - RNA, 86 nt, Human
gcccuggugcugagaacuccagguucccggucccugcggggaccccagggcucaccacugggauccuggcagagcggcccuggggu

SEQ ID NO: 4107600 - RNA, 66 nt, Human
gcccuggugugcccagcaugggcuccugggugcaacacugggagauugcuuagggcacaaggaggc

SEQ ID NO: 4107601 - RNA, 62 nt, Human
gcccugguuuuggcauuuaugaucauugaguauaguauuuaagcuaaugucauaauuagggu

SEQ ID NO: 4107602 - RNA, 114 nt, Human
gcccuguauccccucaccauuuauauucauagugcauccuggccugcugaacauagcacagaacacuggugagucccuguaguugguggugagugugggugugcauggaagggc

SEQ ID NO: 4107603 - RNA, 65 nt, Human
gcccuguaucuauagugguuuauaagagcaauuuuaauuucuugcauacacuauauguacagugu

SEQ ID NO: 4107604 - RNA, 79 nt, Human
gcggacuucccguaauuguuaugucucaaugccauugggaccacuaauaguguuugaagcaugauagcaaauugucugu

SEQ ID NO: 4107605 - RNA, 64 nt, Human
gcggagauuguugguuucccacugcaccuccaugaagucagagucgccgacagucaacaucugc

SEQ ID NO: 4107606 - RNA, 60 nt, Human
gcggaggcaggcaggcagcagguggcgccaugggccgggcuuguuuccuggcuguucugc

SEQ ID NO: 4107607 - RNA, 55 nt, Human
gcggaggcgcggggcguggcacacgggcagccccgcccaggccuggcgucuccgc

SEQ ID NO: 4107608 - RNA, 67 nt, Human
gcggcaagacagaccuuacaagggacucagggccaagcccuggcccagacucugcucuuauccacgc

SEQ ID NO: 4107609 - RNA, 60 nt, Human
gcggcaccaucagacuucugggcaggcaagauuaccugugacucugucugauggucucgc

SEQ ID NO: 4107610 - RNA, 58 nt, Human
gcggcagccucugaugauggccguagguaucuccuacuccauucuggaggcucccugc

SEQ ID NO: 4107611 - RNA, 105 nt, Human
gcggcauucauguauuauuauuauuuuuuuccaagccacuuuuuagaauucaguccugcuuuucagcuuagcuggaucccugugggagugguaugaugagacugc

SEQ ID NO: 4107612 - RNA, 55 nt, Human
gcggcauuccacucugggcccuuugaagccuuugggccacaagcggaggagccgc

SEQ ID NO: 4107613 - RNA, 68 nt, Human
gcggcccaccuccugggggacagcggcagggccccaggguccccaccuucugccucagggaggucugc

SEQ ID NO: 4107614 - RNA, 55 nt, Human
gcggccgcggcugcccugagccagcagcagagccugcaggagcggcugcggcugc

SEQ ID NO: 4107615 - RNA, 65 nt, Human
gcggccugggcuguaccugugcgcggcguccuuucugcgcugagccagggcaccccggagccugc

SEQ ID NO: 4107616 - RNA, 75 nt, Human
gcggcgcacgaaaggucaccgcgguggcauuccucuccgcgcuguuuacgugacuuaauguacucgcugcgccgc

SEQ ID NO: 4107617 - RNA, 97 nt, Human
gcggcuagcauuucuugagcacuuacugucaggccccguggagggagcugguaugcugggucuuggccagggggcuuggugaggccaugauggcggu

SEQ ID NO: 4107618 - RNA, 65 nt, Human
gcggcucaucccagauggcuguggggucaaguacauccccauucguggcccucuggauaaguggu

SEQ ID NO: 4107619 - RNA, 65 nt, Human
gcggcugaggaaaggcuggaagggaggcucucccuugccugccuuuucucauuauuucuagcugu

SEQ ID NO: 4107620 - RNA, 57 nt, Human
gcggcugccgagacaagccggugcgcaucaccaugcgcggccuggcuucggagccgc

SEQ ID NO: 4107621 - RNA, 102 nt, Human
gcauggcaaggucaccuugggcacagagaggccucccucaccaugacccgcuguuagagacaaggaggucuggggggcccucccaggccugaccugccaugc

SEQ ID NO: 4107622 - RNA, 57 nt, Human
gcauggcaauaugaugcacuguuugcgggaguccugcgagggcacauuguuccgugc

SEQ ID NO: 4107623 - RNA, 70 nt, Human
gcauggcauuuauucagcucagucgguuagacuugaacucuaguuggccuaaugaaggaauuaguuaugc

SEQ ID NO: 4107624 - RNA, 57 nt, Human
gcauggccauggcacuauggacaccaguccgguccugaguccagucccaaggccagc

SEQ ID NO: 4107625 - RNA, 126 nt, Human
gcaugggaaaugagagacccuggaggauuuauucuggcagcagcaucaguggcuccauaaccuauucuaggaguggcagagguugacugcagugauguccuguguccauuucugaaguagucaugc

SEQ ID NO: 4107626 - RNA, 58 nt, Human
gcaugggcaggguggccggugcucagcagcagcacugggccuggccucccaguccagc

SEQ ID NO: 4107627 - RNA, 57 nt, Human
gcaugguaaaagauauacugugcauuucccugugccagaacuugucucuuugccugu

SEQ ID NO: 4107628 - RNA, 93 nt, Human
gcaugguccacucauucucaguaucagccagcccuggggcuucccggaggccaugccgacuugagagccaggccugagugguagccagggugc

SEQ ID NO: 4107629 - RNA, 122 nt, Human
gcaugguccugggaucaucagcaucaguguuugcaugggagcuuguuagaaaugcugagucucaggcccuagcuagaccuggugaaucugaauguuauaugauccccaggucauugcuaugc

SEQ ID NO: 4107630 - RNA, 84 nt, Human
gcauggugacucugugucagcugggugugcauggguacccugcauuguugaccaguugugcauuugagcuaauauuuaccaugc

SEQ ID NO: 4107631 - RNA, 55 nt, Human
gcauggugguagugaaaagaauaacgaguguauuuuucuucacuuugccccaugu

SEQ ID NO: 4107632 - RNA, 90 nt, Human
gcaugguguuccauuccuuggaccacucuuuaagaaggacaaagucaaauaggccuucauucaaagaggcauccaagagggaaaguaugc

SEQ ID NO: 4107633 - RNA, 87 nt, Human
gcaugguuaaagaaagccauucaucuaauguccugugaacuuuauaagugguuaaguaguucaugugaguagcugcuuucaccaugc

SEQ ID NO: 4107634 - RNA, 59 nt, Human
gcaugguuuacagaacuccuagcaugcuuuggcaugcaugucuucuguugaaugcaugc

SEQ ID NO: 4107635 - RNA, 56 nt, Human
gcaugguuuaggaacuaaggauuauuucaguaauaauccuauuucugaaaaccugc

SEQ ID NO: 4107636 - RNA, 104 nt, Human
gcauguaaaucaccuggggaucuuguuaaaaugcagauucuaauucauuauuucuggggcuugagaaucugcauuucuaacaaguucccagguaaugcuguugc

SEQ ID NO: 4107637 - RNA, 58 nt, Human
gcauguaccagaauauucuuccauuuuaaggcugaauaauauuccucugugugcgugu

SEQ ID NO: 4107638 - RNA, 79 nt, Human
gcauguagcaaggacuguuucuaaaaccauguaggcuaaaaugucauacuacaaggcaguuaaaaugguuaauaugugu

SEQ ID NO: 4107639 - RNA, 73 nt, Human
gcauguaggaaaauguacgggaguagaauuagagaaggaaaaaucacuagucaugacccgauguuacuacagc

SEQ ID NO: 4107640 - RNA, 62 nt, Human
gcauguccaggucagcagcagggaccugaauuccaggacucucagcucugccuggaacuugu

SEQ ID NO: 4107641 - RNA, 62 nt, Human
gcaugucuguguacacaugcacacagcaugucugaaugugugucuguguauacacggcaugu

SEQ ID NO: 4107642 - RNA, 90 nt, Human
gcaugugaacacccaguuuucugauugaagagccuauccuuuccccaucacguauuuuggaugcucuugucaaaaauuaguugacuaugu

SEQ ID NO: 4107643 - RNA, 66 nt, Human
gcaugugacuauauagagcauaaaguccauugguguaaacuuucugcaaaauaaauagugacgugc

SEQ ID NO: 4107644 - RNA, 79 nt, Human
gcaugugcucguggcugaaucauuugugcauccaaagcugaggucccuggcugcuguugauuuaguccaaugcauaugu

SEQ ID NO: 4107645 - RNA, 57 nt, Human
gcaugugggaacacuuaggcacuaauaauuuaaguaaguugccuaaagccacacagc

SEQ ID NO: 4107646 - RNA, 74 nt, Human
gcaugugugcgccucgguguguagugaggggcguagcuucccacagcgccuggcagcgugccgagcugcgcugc

SEQ ID NO: 4107647 - RNA, 68 nt, Human
gcauguuagaaaacuacauuucuuuaugggaaugucauucauccuagcuugucaguucucuaaaaugc

SEQ ID NO: 4107648 - RNA, 65 nt, Human
gcauguuuaagugaaaacuucaaaggaauuccaaguuugaagucagacacugcuuuggaauaugc

SEQ ID NO: 4107649 - RNA, 78 nt, Human
gcauguuuccuugugaaccugagugagcuucuuucaauuauuuacauaggagagaaauuccuaagguacacaagaugc

SEQ ID NO: 4107650 - RNA, 129 nt, Human
gcauuaaauggccacaaaguucccuuccaauguugagguuuugugagauacgagguuugcaaauguucgcugucugcaucucuagagcuuggcucaaaguugguuccuaaauguucuguguucacgugu

SEQ ID NO: 4107651 - RNA, 57 nt, Human
gcauuaauacuccuguucaaggaugaggguuuucuucuaaaagcagguguauagugu

SEQ ID NO: 4107652 - RNA, 64 nt, Human
gcauuaauacuggagcguuacaguaacaauaagagcuaacuuuuacugagaccucacagugugc

SEQ ID NO: 4107653 - RNA, 55 nt, Human
gcauuacaggcuguaagaugcaguaaccuauauuguaagguauucucuguugugc

SEQ ID NO: 4107654 - RNA, 87 nt, Human
gcauuagauuuucaaaaggagccacaaucuagaucccuugcaugugcaguucacaauaggguuugugcuccuaugagaaucuaaugc

SEQ ID NO: 4107655 - RNA, 59 nt, Human
gcauuaggacagagaugucaagaggcauucccaccccucuuauauuccuuuccugcugc

SEQ ID NO: 4107656 - RNA, 79 nt, Human
gcauuauugaggcgauaggauuacuggguggcuauaaacacaucugcugcacagcugacauuuaucuucuacaaugagc

SEQ ID NO: 4107657 - RNA, 80 nt, Human
gcauucagaaggagagcugucagcguagcaccgaauucaagaccaaggcgugcuaccugagcugacagcuuuuugaaagc

SEQ ID NO: 4107658 - RNA, 70 nt, Human
gcauuccauuguguaaggauaucggaggaugcaaguccccaagaccuccccgacacugcugguggagugc

SEQ ID NO: 4107659 - RNA, 78 nt, Human
gcauuccuggaggguuggcagaugaacacaacuggaaauacuuccaguaaaucucacugucaugucuagauggaaugc

SEQ ID NO: 4107660 - RNA, 73 nt, Human
gcauucuagagcauauggguuguguaauuggaugguucacccaaucccaucaccaucugcucuccagauaagc

SEQ ID NO: 4107661 - RNA, 64 nt, Human
gcauucuggaggcuggcuuccccuggcucauaaaaguggccaaagcucagcccugcauggaugc

SEQ ID NO: 4107662 - RNA, 70 nt, Human
gcauucuguggggacgggcuuuuggaagacuucuaugcucuugaugaaagcacaaguucuaacaggaggu

SEQ ID NO: 4107663 - RNA, 76 nt, Human
gcauucuuaagaaagcccacccagaagauguuaauuaagaaauauugauauuuucccaggguuuucucauuaaugu

SEQ ID NO: 4107664 - RNA, 55 nt, Human
gcauucuucacaguauuccuccuugaucuauccgaaggagaggcuggagggaugc

SEQ ID NO: 4107665 - RNA, 98 nt, Human
gcauucuuccucagcagcagaaccagaaaggaauaauagaauuggccaaaaaaucauuuuuuuaaaguugccuuucucuuccuguagagagaaaaugu

SEQ ID NO: 4107666 - RNA, 80 nt, Human
gcauucuuuagguuuaggagugaaggugaacauugagguuagcucgguuucaccuugaauaugucuuaaauccccuaugc

SEQ ID NO: 4107667 - RNA, 60 nt, Human
gcauugaguccacucugucuuuugaaacacuucauuuugccagugaguggauuuucaugc

SEQ ID NO: 4107668 - RNA, 60 nt, Human
gcauugccucaggcaccuggcagguuuugugaagcuggcaugucaccugagaaucagugc

SEQ ID NO: 4107669 - RNA, 62 nt, Human
gcauuggagaacagaggcucaucauuacauuuuauguacugaauagcccuucugucuccugu

SEQ ID NO: 4107670 - RNA, 64 nt, Human
gcauugggcggggaccucggcugcagcccuccagcuccccacagucgacugugcccucccgagc

SEQ ID NO: 4107671 - RNA, 90 nt, Human
gcauuguaggcagaacuuaaugauuucaugcauguugcaucauuuuaucauuucaacaagguaagaaacauuggcuucauuuuauaaugu

SEQ ID NO: 4107672 - RNA, 79 nt, Human
gcauuguauagauagaccacaguuuguuguccaucagcauucaccuauugauggacagugugucuguuuccacuuuugc

SEQ ID NO: 4107673 - RNA, 70 nt, Human
gcauugucccugucaugcgggugaagcccaccgaggucgucacucucuaagcaugacagacagacagugc

SEQ ID NO: 4107674 - RNA, 76 nt, Human
gcauuguuuccucugaugggaauccccuaguguuuuucaaccaacaaaugccuauuuguuccuucaggggcacugc

SEQ ID NO: 4107675 - RNA, 55 nt, Human
gcauuuacuauaugucaagcuuacuuguaggugaugaaaguucaguagugaaugu

SEQ ID NO: 4107676 - RNA, 57 nt, Human
gcauuuauaggaagaauguaagauuggguugucaguaaguauucuguccuaugaagc

SEQ ID NO: 4107677 - RNA, 79 nt, Human
gcauuuauuuccauauuguccauggcugcuuuggucuaacagcagacuugaguagcagagacaagaccaaaugaauugc

SEQ ID NO: 4107678 - RNA, 95 nt, Human
gcauuucaugcccacaacuuagacaacacagguucugcaaaggaaaugguuuuucuugcguauuuguguguguauguuguaggagaaauugaugu

SEQ ID NO: 4107679 - RNA, 61 nt, Human
gcauuuccccugcgagagcugcuggagacucuucagagcugcccaugcaaggggguuaugc

SEQ ID NO: 4107680 - RNA, 85 nt, Human
gccucccaggaacaucuaaagccaguuugucucuuuaaaguugagguuaacuuugaucauuugguuaaggugauuucugccaggu

SEQ ID NO: 4107681 - RNA, 76 nt, Human
gcauuuugagcaucuuuucauaguaucuauugguuucaguaucugugagacccuggagaaugaaagugcucaaggc

SEQ ID NO: 4107682 - RNA, 58 nt, Human
gcauuuuguaagcaguguuuuuacagggguggaauugucucuguuuguuugcauaugu

SEQ ID NO: 4107683 - RNA, 129 nt, Human
gcauuuuguuuccuuuuugggccaucuuuauuucucuaauggugaugauuagaguugccuuuaugaauguaguuuagcucaucaguauauagggucacugauacuccuaagaggguucauauaguaugu

SEQ ID NO: 4107684 - RNA, 92 nt, Human
gccaaaauaaauuauucucauguguuucuugguaauguucuuucuaacuuaacaggaaggaaggaaagaaaacaugaucuaauuuaauuggc

SEQ ID NO: 4107685 - RNA, 56 nt, Human
gccaaacuacaaguuaaauuuucagacuagauugagaacuugucuuccuguuuggc

SEQ ID NO: 4107686 - RNA, 83 nt, Human
gccaaacugcuccagagcagagacuagguuggcuuacauucaagguaagaaagccagucucucucccuggagauguuucaggc

SEQ ID NO: 4107687 - RNA, 95 nt, Human
gccaaacuucagaguuuucacauuuuuuauauaccaagguggguuaaagcagccucuuuguauaaggaauauuuuugaaacuguugacauuuggc

SEQ ID NO: 4107688 - RNA, 122 nt, Human
gccaaagaaauucucuccugagugccuuaccauaccuaaauaauaagaucuguuggccuugcaacagauacagauuuuauuauucagguaugguaaggccaacagaucuaggaacaauuggc

SEQ ID NO: 4107689 - RNA, 106 nt, Human
gccaaagacacggcuccaggcccugccuggagcccaggccuggugucugugagcagaagcagaggccaggcagcccaagguggggcagaggcgccguggaaguggc

SEQ ID NO: 4107690 - RNA, 63 nt, Human
gccaaagcagucuugccucugccauucuuuuuucacucaaagcagaggccucaugcucugugc

SEQ ID NO: 4107691 - RNA, 106 nt, Human
gccaaaggcucaagacaugaagauucuuuugacugcccgagccucccaguucucaggagccauccugcugaggcucugggugucacuguuucauggaaaugcaggc

SEQ ID NO: 4107692 - RNA, 55 nt, Human
gccaaaguaccuagcccucugcucacccuucuguggcauccgagguaucuuuggu

SEQ ID NO: 4107693 - RNA, 76 nt, Human
gccaaauauagucccauuuugagguauuuggagguucaaugucaacaaauaaauuuuggaagggacacaauuuggc

SEQ ID NO: 4107694 - RNA, 68 nt, Human
gccaaauaugcaggagaccaauuggaugguguaauuugcaaacccauuauuuauuucugucauauggc

SEQ ID NO: 4107695 - RNA, 76 nt, Human
gccaaaucucucugagcccugcuuuuucaccucuguaaaaugaggggguuaggugagcuacagaguuccuuuuggc

SEQ ID NO: 4107696 - RNA, 111 nt, Human
gccaaaugcaauuaagucgccuuuuacugcagggcauuguaacucuuuguucauuuuggaaguguugaauuaaagagaggacuuguuuugcagacuuaauauuaauaaggu

SEQ ID NO: 4107697 - RNA, 66 nt, Human
gccaacaacagugcagggaugcuucuuggacacucuaacuggagccccucugccacugugucaggc

SEQ ID NO: 4107698 - RNA, 64 nt, Human
gccaaccucaguggcaagagcauuccucauucugaauagugccugugaaaacccugggguuggc

SEQ ID NO: 4107699 - RNA, 63 nt, Human
gccaacuuaauccauuuuaauucauugugaaaccugcagugcaaaugagauggauucaagggu

SEQ ID NO: 4107700 - RNA, 88 nt, Human
gccaagaauaggaaaaccaaagugugaauuaugaaguagucuguauguauauggcuuuuuauucaucuuacagauugguccuguuggc

SEQ ID NO: 4107701 - RNA, 83 nt, Human
gccaagaccccagcagccacagcagaucugagucagggcccuccccuuuccuuugcucucuugguggcuguccugggauuggc

SEQ ID NO: 4107702 - RNA, 61 nt, Human
gccaagauuuagcuuaccucguuacugacuuuuuguuucaggucggugcuaaguuuugagu

SEQ ID NO: 4107703 - RNA, 63 nt, Human
gccaagccuguagacacaagcuucccacccccucuuucaaagccucccucuucagguuugugc

SEQ ID NO: 4107704 - RNA, 60 nt, Human
gccaagcuguuuuucagagacguaaugcagacacguguuugaucacuuuagcuauuuggc

SEQ ID NO: 4107705 - RNA, 55 nt, Human
gccaagcuuauaugaugcuugagguccccuucuacgguaagcauggaagcuaggc

SEQ ID NO: 4107706 - RNA, 65 nt, Human
gccaaggagcugcaggcacuuguuuaucuucuggugcguacgaguguguauggcuccccaguggc

SEQ ID NO: 4107707 - RNA, 56 nt, Human
gccaaggccugcagcaccucauacucgaccugguggugcaugcucucggccuuggc

SEQ ID NO: 4107708 - RNA, 81 nt, Human
gccaaggcuggggcugggcgugcccuagucaugaccccaguacacuggggaagcugagaggcagccagacccucccuuggc

SEQ ID NO: 4107709 - RNA, 63 nt, Human
gccaagggggcgcuccugcgcuacuucaggcucauagagcccaacugcaggagugaccccggc

SEQ ID NO: 4107710 - RNA, 99 nt, Human
gccaagguguccaaaaagccucacuuccuccagaagcuguaggggaggauccauugccuggucucuuccagcuucuagaggaugcccacauuccuuggc

SEQ ID NO: 4107711 - RNA, 81 nt, Human
gccaaguauuguacauuuuacuuuguuugaaugcuggauauauuuguauucuuauagucuugaggugugcugauauggggu

SEQ ID NO: 4107712 - RNA, 65 nt, Human
gccaagucuugugcaucucuucaugaccagagccuggcacacaggagugcucaagaaacauuggu

SEQ ID NO: 4107713 - RNA, 58 nt, Human
gccaagugcaguagaaagacccagugagguaagaacuaagucauucauuaaacuuggc

SEQ ID NO: 4107714 - RNA, 71 nt, Human
gccaagugccuagcacagcaccuggguauggugugugcuccuuccaggagugugugcuaaugggcgccagc

SEQ ID NO: 4107715 - RNA, 58 nt, Human
gccaauaacugccauuugcuuuucugaauccauaguugcauuaaaagcaguuguuggu

SEQ ID NO: 4107716 - RNA, 70 nt, Human
gccaauacacuuuauagaagaaaaagaggauuauugccuccuggcgaauuucuuuugaauaguguguggu

SEQ ID NO: 4107717 - RNA, 114 nt, Human
gccaauaggacccuccagaucccugcccagcaggcuggacuucagucccaaggugauaacuagaacaagggggccgagccuagucuguccagcagcggguggaggagccgcggu

SEQ ID NO: 4107718 - RNA, 75 nt, Human
gccaauaucagaaucauuucaucccuaucacgugccuuucuuguuguauggauuuucaaugaacuucugccuggc

SEQ ID NO: 4107719 - RNA, 66 nt, Human
gccaauauucagcaagcugagugcccauuuguuuuaagaugaggaacagacuugcuggauaagggu

SEQ ID NO: 4107720 - RNA, 75 nt, Human
gccaaucacaaccucuucuccauaaucaacacucuuuaccugaaggcaggcuugauauggggggacugugagagc

SEQ ID NO: 4107721 - RNA, 111 nt, Human
gccacaaaagcuaguuuuucagcuguugagaugguuucagagugguccugcuuauuuaaaauaaacugugaccucucaaucagugccaguggaugaacuguuuguuguugc

SEQ ID NO: 4107722 - RNA, 65 nt, Human
gccacaaguggucagaggaggaauaggacaugagguuuuauguucucauucucaggcccaguggc

SEQ ID NO: 4107723 - RNA, 65 nt, Human
gccacacagagccagggaauacagugaaaagagguccuggagcugacuucuugggucuguuuggu

SEQ ID NO: 4107724 - RNA, 69 nt, Human
gccacacagcauauucauucagugagacuaggacgucuacauuuucuuuccagcuaaugaguugugggu

SEQ ID NO: 4107725 - RNA, 86 nt, Human
gccacagagugugcagaagacacaagacauugccuacaauccaaaggcauguuuaugccauuucugccaucuguuuuuggaccggc

SEQ ID NO: 4107726 - RNA, 63 nt, Human
gccacagcaacaauaaugcagccauauuauuagguaucacuacuguuuuguucugcugugagc

SEQ ID NO: 4107727 - RNA, 71 nt, Human
gccacagccccgcggcaggaaacauuccaggagcaccuguuuccugaggacccugucaggggcucccgggc

SEQ ID NO: 4107728 - RNA, 119 nt, Human
gccacagcugcuuugcucauuauuucugaugaauggacaucaccuggcgucuccggugauggcgccagcucaggacccaggugugaccugcacaacaaagaaaagcaagauagcuuugc

SEQ ID NO: 4107729 - RNA, 55 nt, Human
gccacagcuuagaucacagccuggugaguaaacacagguugaagagagguguggu

SEQ ID NO: 4107730 - RNA, 99 nt, Human
gccacaggaugauaauggugguuaagagcagggacuuuaagugggauggauuuaaguucaagucccagcucuucacuuacucuuaguuugaccuuuggc

SEQ ID NO: 4107731 - RNA, 87 nt, Human
gccacagggcugacaagcaggaaguagucuguaagcaucagcugccauugcuguugucuagucuuccugcuguugugcccccguggc

SEQ ID NO: 4107732 - RNA, 56 nt, Human
gccacagugggcuggggccagagaggggaaguuccaggguccccaccuaguugugc

SEQ ID NO: 4107733 - RNA, 89 nt, Human
gccacaugugagcagcucaggguggucucuagaauaauucucauguucacaguggugagaccugcagcuguagucugcgagcauguggu

SEQ ID NO: 4107734 - RNA, 68 nt, Human
gccaccaaggccaggguggaguuuggggagcaggcagcuuccugcagucugcacucugccugccuggc

SEQ ID NO: 4107735 - RNA, 68 nt, Human
gccaccagggggugcaagguccagcauccuaaaucauguccucaacuuugcaggccuuuucuuguggu

SEQ ID NO: 4107736 - RNA, 66 nt, Human
gccaccauuuacugagcaccuacugcaggccaggcccugugccagcauggugccagugaguccagc

SEQ ID NO: 4107737 - RNA, 62 nt, Human
gccaccccaucgguagcccacccccuuccccgaggcuaagggaggcaugccgugguaguggc

SEQ ID NO: 4107738 - RNA, 76 nt, Human
gccacccugggccacccuggaccacccugggcugugaugacacagagucuggguauagggugugccuugguuuggu

SEQ ID NO: 4107739 - RNA, 74 nt, Human
gccaccuagugacuccuuuacguguaaucccuuggaacuaucacagacuagaccaaggaauccuggaaaguggu

SEQ ID NO: 4107740 - RNA, 84 nt, Human
gccaccucacugcaugggcaccagucucuagguggugaugggacaguggcaaccagggauggagcuugcagagcaugaaguggu

SEQ ID NO: 4107741 - RNA, 61 nt, Human
gccaccucuucccacugcccaugggcaggccaaccaguccugggugcagcaggaaaauggc

SEQ ID NO: 4107742 - RNA, 78 nt, Human
gccaccugccugaaguugagcugaugccuucaagaucuguuuccccaaggcccuucugcuguuagguagccagugagc

SEQ ID NO: 4107743 - RNA, 102 nt, Human
gccaccuggggccuggccaggccgcauacccucuggugaggcuuccaacuucuggggcauacagagaggauguggcauccagucagaagcccugguuaaggc

SEQ ID NO: 4107744 - RNA, 86 nt, Human
gccacgcccauuugcuuucauauugccuaugacugcuuuugaaauauaacagcagaauuaagucauugcaauagagacgguguggc

SEQ ID NO: 4107745 - RNA, 103 nt, Human
gccacgccugggcuccgcgcccagggcugcucauauugcuggucuccaggggaccuggcgucagugcuuuugagaagcuccuggagugaguccgauguguggu

SEQ ID NO: 4107746 - RNA, 93 nt, Human
gccacuauguaaagcaauauuccugauuaacgaccuuucaaucaauucaacaauuuugaguuuuaguuggucaugaauaauuacaugguuugc

SEQ ID NO: 4107747 - RNA, 60 nt, Human
gccacucaugggaggugugcaauucuuaaaucgauguguacuaccugaacauuaguaggc

SEQ ID NO: 4107748 - RNA, 74 nt, Human
gccacucuacguuuaauaacuuucaaaucucuagguguaaauggggaaauggauguugaguuaaauguuccugc

SEQ ID NO: 4107749 - RNA, 81 nt, Human
gcggcuggaagcgggaggccaguccuggccgggcugggcgacccgaauggagccagggccggcgcuggucccagcggccgc

SEQ ID NO: 4107750 - RNA, 73 nt, Human
gcgggaccagagccucucagccccuugggguccuccccuccccggucccaucucaggguugaagguucucugu

SEQ ID NO: 4107751 - RNA, 98 nt, Human
gcgggagaaacgccggaaggggcacggaccccagggagagcgcggaggcggccacgcggguccuuccuccaccugggcccaggcacuuccggucucgu

SEQ ID NO: 4107752 - RNA, 59 nt, Human
gcgggaggcacgaggcgcgcagugcgugugugcgcgugugcgcggcgcgcgugccccgc

SEQ ID NO: 4107753 - RNA, 70 nt, Human
gcgggagggggcucugccaaccuguccccaucccuuuguuccuuuggacagcucugagcaccccuccagc

SEQ ID NO: 4107754 - RNA, 55 nt, Human
gcgggaggggugugcggagcgcugggcugugcuccggcaacuucacuccucccgc

SEQ ID NO: 4107755 - RNA, 89 nt, Human
gcgggccaggagccggcugggccagcugaagugccgccccggcgggggccgggccgggccgcgcucaggauggcacagcugcggcccgc

SEQ ID NO: 4107756 - RNA, 96 nt, Human
gcgggcgcgcggaacugggaauuuggcgcuuggagcugcggccccgcgcuucgcaguccgggagcucgugcgcccaggugcccugacgcugcccgc

SEQ ID NO: 4107757 - RNA, 68 nt, Human
gcgggcgggcgguuccgcagcugcggggcacaaugagcgcucccagugcgcaggcgccaccugucagc

SEQ ID NO: 4107758 - RNA, 80 nt, Human
gcggggcugggucguggccagcuucgccccugggucugaagaccucugggcggcccaggccaaccuugcccugccgccgc

SEQ ID NO: 4107759 - RNA, 99 nt, Human
gcgggggaaauccaguuggcauuaaggaagggggcuccggcauuccuuggcaugcaguggcagcuagcuguuuucaugcucaucugugauuauccuggu

SEQ ID NO: 4107760 - RNA, 56 nt, Human
gcgggugcacaguucugcagugagaucuuuuuuuaagagguggaacagcaauucgu

SEQ ID NO: 4107761 - RNA, 64 nt, Human
gcggguuucauuucauuaugaaggcuuuccuugugccaguuucuaggaugcugaugagacccgu

SEQ ID NO: 4107762 - RNA, 63 nt, Human
gcggguuucgguggaacaguucccugguaacuuaaguguggguuugauucccucuaaacucgc

SEQ ID NO: 4107763 - RNA, 75 nt, Human
gcgguauuaagugcugucguggaacugggcugcuguccuacugcaguacugucuuccugauggcaaggauaccgc

SEQ ID NO: 4107764 - RNA, 69 nt, Human
gcggucggcagaggggcucugcucaucacaggcuaucaaggaugacagcagaccccucccuucugccgc

SEQ ID NO: 4107765 - RNA, 59 nt, Human
gcggucggcgaagcugaggggcugcagcccgguuccaggcucuggcuccgcgugaccgc

SEQ ID NO: 4107766 - RNA, 63 nt, Human
gcgguggacagaauaggaauugaauaggcaugaugcgccuuugugucuguguucugucauugc

SEQ ID NO: 4107767 - RNA, 59 nt, Human
gcgguggcagggagaagccauuggggauuugucuugcuggaaacucucucugccggagc

SEQ ID NO: 4107768 - RNA, 82 nt, Human
gcgguuagcugagagcucacuugaggaugugggcugggaaccuuauuucuucuccagugagcuacuuggacuuccucacggc

SEQ ID NO: 4107769 - RNA, 98 nt, Human
gcgucacucucgcccuccugcuuuccgcgcucucacccgcucccgccuccugagggcacgacuuguggaggagcgcgggcggcggggcgugagcgagc

SEQ ID NO: 4107770 - RNA, 69 nt, Human
gcguccccgcgguggcggccuccagcgccagucccacccggacggcgccagccgcgcgccgcagggcgc

SEQ ID NO: 4107771 - RNA, 60 nt, Human
gcgucguucucugccagggcguugguguagaacagcaaagccuggggagaguaaggaggc

SEQ ID NO: 4107772 - RNA, 55 nt, Human
gcgugcaacagccucuuccauuuuagguuccuauccugaaagacauguugccugc

SEQ ID NO: 4107773 - RNA, 68 nt, Human
gcgugcccacccuccuggucccugagcgcuguccgggcagcucugggugacaggagggccuggcacgu

SEQ ID NO: 4107774 - RNA, 79 nt, Human
gcgugcucaugccaaggcagccuccaagcuagcccagccuggcaacauggacaggucugccuuaggaccugagcauugc

SEQ ID NO: 4107775 - RNA, 56 nt, Human
gcguggagccgagcuccggagcgcuuucugaccguguggagcuccagcguccaugu

SEQ ID NO: 4107776 - RNA, 79 nt, Human
gcguggcaaugugugagcuaagcaaauaugagccaucauacuggcucugcugcacccuuggcuccucacacaugucugc

SEQ ID NO: 4107777 - RNA, 87 nt, Human
gcguggcccguagauuguuucuuaauaucccuucaagccagaaauuuccuuugguaguaagaguuaagcaacagauaccagccaugu

SEQ ID NO: 4107778 - RNA, 61 nt, Human
gcgugggcuggacugggaugaaaugagcuuaaucgccagacacucaguaccugcccgcugc

SEQ ID NO: 4107779 - RNA, 86 nt, Human
gcgugguggggaaugggaggugcucaagagggcauccucucugaaaggggugacagccgcuuggcgcuagcuaauuauugccacgu

SEQ ID NO: 4107780 - RNA, 73 nt, Human
gcgugguguggugaaacaaugauaaaauuuggaaucagaaaaccaaauucaaguccagcuucucuacacuggc

SEQ ID NO: 4107781 - RNA, 101 nt, Human
gcgugguguuuaggagcauguaauucuagcuacuugggaggcuaagacaugacaguagcuugaaugcaggaggcagagguugcagcgaacugagaucaugc

SEQ ID NO: 4107782 - RNA, 93 nt, Human
gcgugguuggagggcagccuguggaucccugcacuggagucuugcugucuucgaugcagguuggaucauacauuguuaccuccuacuguaugc

SEQ ID NO: 4107783 - RNA, 62 nt, Human
gcgugugcgccuggcaggcgggcggcgaaaagacguccagggcagccgcgggugcgcacagc

SEQ ID NO: 4107784 - RNA, 59 nt, Human
gcguguguagggcccuguugggagaccucucuacccaggaggugugcccaacucgccgc

SEQ ID NO: 4107785 - RNA, 57 nt, Human
gcguuauuuccugucugauuucccgaggggagaaaucucuggaggggguaguaaagc

SEQ ID NO: 4107786 - RNA, 130 nt, Human
gcguucaggucccaaucaauggcucugcaucuuuuaaaucuucuacaucaucauaaugucauuauuguugucauuguagaggauuucagaagaucuuuugaguuccuuguuaguaaagauuugucuuugc

SEQ ID NO: 4107787 - RNA, 64 nt, Human
gcguucuuuggaaggaagaccuuucagaugaccugaccaguccuccucuucagaacccggaugc

SEQ ID NO: 4107788 - RNA, 116 nt, Human
gcguugaccguggagggcaguucaggcgguuuguugggguccaggcccaggcccggugucucgggcccggcucccgacgcccggccaggacaguagggcccauagggaucauaagc

SEQ ID NO: 4107789 - RNA, 67 nt, Human
gcguugguccaaguuaacuguacaccaaaacaucacuuccuguguagauguuaacaauuacuaacgc

SEQ ID NO: 4107790 - RNA, 59 nt, Human
gcguuuacggaucauauauguacuguuuccaaaauguauauguagacucguuagaaugc

SEQ ID NO: 4107791 - RNA, 114 nt, Human
gcguuucaagcuggagcaaagguuucuuuucagcauuguggcagagaaugguagauuuuaaccuauuuccucauucuugccgcauauguuccuccuuuguccugccacucuugc

SEQ ID NO: 4107792 - RNA, 71 nt, Human
gcguuucuggcgccggggcaggccggcgauguccgagucgucgaagggcaugcacccggugaccaugacgu

SEQ ID NO: 4107793 - RNA, 57 nt, Human
gcguuucuugucugcccugcaggcagaaugaacugugaguggguuaucaggaaaggu

SEQ ID NO: 4107794 - RNA, 129 nt, Human
gcguuugacuucaugcaggaauuucacaccuucccagaccuuagagugcagguggagggugucuggcagagaaggcgccaaguacugccugcuggggcugggaaggacugcucccauggcaagggaggc

SEQ ID NO: 4107795 - RNA, 56 nt, Human
gcguuuguucccacuggaggaugcagcaacaagcugccauccugggagcagacagc

SEQ ID NO: 4107796 - RNA, 66 nt, Human
gcuaaaaauggaggugauuaauaugcuaaguaggaaaaccuuggcugucagucgccugcauucagc

SEQ ID NO: 4107797 - RNA, 56 nt, Human
gcuaaaaccaccaguggugugauggaugguuucauuucuucuuggacuguuuuggc

SEQ ID NO: 4107798 - RNA, 76 nt, Human
gcuaaaagguggccuaguuuuuucugguagguacaauaaguuguagcuaaugacauaacuggguucuaugcuuugc

SEQ ID NO: 4107799 - RNA, 89 nt, Human
gcuaaaauuaaguaccauguagcaucuauccugauaaaaguagugacuuauaacaguuuagguggugucauuuguaaguuaacuucagu

SEQ ID NO: 4107800 - RNA, 86 nt, Human
gcuaaacauauauauccaugaauguauuuccucaggaauguuaauaauagaacauuuacccuggaacauuggauagauaagucugc

SEQ ID NO: 4107801 - RNA, 62 nt, Human
gcuaaacuuaaauuggaugaguuaaguucaggguugagaacugcucugauccauuaaguagu

SEQ ID NO: 4107802 - RNA, 100 nt, Human
gcuaaacuuagaguguuaaaucuguuucucauaggguaggugacagcuaaaauaucaacuacuuuaguuucagauggacuauuuagcaucuucauugagc

SEQ ID NO: 4107803 - RNA, 66 nt, Human
gcuaaagaguuuacaaauuagguaauuuucucuaaagugaauuugccucagcuguugaccuugagc

SEQ ID NO: 4107804 - RNA, 55 nt, Human
gcuaaauaaucuucuucugacauguauagcagcacagugugaaguguuguuuagc

SEQ ID NO: 4107805 - RNA, 58 nt, Human
gcuaaaugacagagcugggacuaguagugcacaggcacgcugaccccugcugucaugc

SEQ ID NO: 4107806 - RNA, 64 nt, Human
gcuaaaugaggucauuaauggugggauccuaaucugauaggauugguggccucagaaaaagagc

SEQ ID NO: 4107807 - RNA, 79 nt, Human
gcuaacaguguucuuggcgcugagugcgauauagaagaaggcacaggauccgcccaaggcacuugcaaccuaaguuagu

SEQ ID NO: 4107808 - RNA, 59 nt, Human
gcuaacauguuccugagcuguuuagggcuuuucccacccucaggaucuuauauauuagu

SEQ ID NO: 4107809 - RNA, 99 nt, Human
gcuaacugcacuaaccaggagagcuggcugguuggggagaagacacuaacccugugagucugaccucagccagcuaaccugcccuggggugccaccagc

SEQ ID NO: 4107810 - RNA, 56 nt, Human
gcuaagaaggccauaucagagaaaaaauaacacucuagaucaugguauucuuuggc

SEQ ID NO: 4107811 - RNA, 68 nt, Human
gcuaagcagcuuucuuuccugugaagcugaaaaacgugcugcuucaaaccuacaagaggagcugcagc

SEQ ID NO: 4107812 - RNA, 77 nt, Human
gcuaagccugguucuaagggcuugaaauguaucagcaaacaaaguagaucaagcccuuacagagcuucuauuuuggc

SEQ ID NO: 4107813 - RNA, 88 nt, Human
gcuaaggauauugauaacuuuuaaaacuugugaaaaauuugguauuuuacaugaagaaaauuaagcaguuguaaaugucuguaauagc

SEQ ID NO: 4107814 - RNA, 66 nt, Human
gcuaaggcccagcuuuucacuuccacacgcuugcugcgcgauguggggauaauacugguaccuagc

SEQ ID NO: 4107815 - RNA, 73 nt, Human
gcuaaggugaaugucucuuagucucauuuucugcucacuucagcaugaacagcuugagagaugcacacuuagc

SEQ ID NO: 4107816 - RNA, 69 nt, Human
gcuaaguaacaggugcuuaguuuauucagugaauaaaugaauaaauggaagacaucugauaucuauagc

SEQ ID NO: 4107817 - RNA, 130 nt, Human
gcuaaguauugcuaaauucucuuuaugugcagaacaguguacuagguacauguucccgggaagccagguaauuugaggggcacuguacacugugcauggaauugcaaggcccugagguuucagcauuagc

SEQ ID NO: 4107818 - RNA, 61 nt, Human
gcccuguggccaagccuugacagauggugaacagaaucuggaaagacagagggcauggggc

SEQ ID NO: 4107819 - RNA, 64 nt, Human
gcccugugguuccaggaagcaaaacccaacccaccgccaagugcgcucccaaaccaccaggggc

SEQ ID NO: 4107820 - RNA, 59 nt, Human
gcccugugugaucacaugaacaucuuuaaauauuguuuuucaaaaugugguccagaggc

SEQ ID NO: 4107821 - RNA, 58 nt, Human
gcccuguuagguucuuugcucuuaccauugguucagucuuugaaguucugacagaggc

SEQ ID NO: 4107822 - RNA, 67 nt, Human
gcccuguuuggauggggacccagcuggggcugucucugaccugggugauuccuguccaggcaaaggc

SEQ ID NO: 4107823 - RNA, 82 nt, Human
gcccuuaaacucugauaugauauugaguauguugccagaagaugcaagaauaaaauaaaguaugauuuuuagaguuuguggc

SEQ ID NO: 4107824 - RNA, 76 nt, Human
gcccuuaagugcuucaguauccuccacauguuaagauuucucucauuaaauuagagcauuugaagcaaaugggggu

SEQ ID NO: 4107825 - RNA, 60 nt, Human
gcccuuaggcaagcagaagcccaaucacaugaaccugggcugcccucgcuugguuaaggc

SEQ ID NO: 4107826 - RNA, 58 nt, Human
gcccuuagucagcacuuucacuucagucacugugauugcaaaguucugacuguagagc

SEQ ID NO: 4107827 - RNA, 55 nt, Human
gcccuucauugcccaaagagccuccagacaggugggcuccugcuuugugaggggc

SEQ ID NO: 4107828 - RNA, 114 nt, Human
gcucgaacagauugacagggauuuuuuguuaaagugcagauugugauucaggaggucugggccagggcuugaaguucugcauuucuaauaaacugagacucccuauccaugagc

SEQ ID NO: 4107829 - RNA, 64 nt, Human
gcucgagccugggaggcagagggugcagugagccgagauugcaccacugcauuccagccugggc

SEQ ID NO: 4107830 - RNA, 62 nt, Human
gcucgaggcugcagaugccaccacuguugggagcuagcagugacagggcugcugccuugggu

SEQ ID NO: 4107831 - RNA, 71 nt, Human
gcucgccgccggcggggccacuucauaacgcgccgugcgugacgugaggggcuccuguugcaauggcgagc

SEQ ID NO: 4107832 - RNA, 129 nt, Human
gcucggguggaauguugugaugaauuauuccuuaaaugcccugagacugagcauggguuccaaucuggauguuuccagcucagcugcaggaggagggagaauuuagacagagacguuguccgccaaagc

SEQ ID NO: 4107833 - RNA, 92 nt, Human
gcucuaaaugguuaaaaauauguuuauguugggcuauauuuaaagcaauuuaaagauguguaagaaauaaacaacauggggcuauuuucagc

SEQ ID NO: 4107834 - RNA, 99 nt, Human
gcucuaauuauauugaaauguucagaggacaauauaaaccacagaggcaaaauacaagugguguguucaugucacuggaauccucaaugugcuuguagc

SEQ ID NO: 4107835 - RNA, 56 nt, Human
gcucuacgaacaugaaggucaauuugaaaccaagaccauugcuguauuuguagagu

SEQ ID NO: 4107836 - RNA, 64 nt, Human
gcucuaggguccucaucuguaaaugagggcagugguguuauuuauaagugaggauccacugagc

SEQ ID NO: 4107837 - RNA, 55 nt, Human
gcucuaugucagagagcuugggccagcugaugcaccaggcaugacugcagagagc

SEQ ID NO: 4107838 - RNA, 65 nt, Human
gccuugauuuucucaucucugagagaugaacacaagaguuuguauuucauugaaugagauaaggu

SEQ ID NO: 4107839 - RNA, 59 nt, Human
gccuugccaaggggcagcagagcuugcguggagcccccuccucucuccuuuggcagggu

SEQ ID NO: 4107840 - RNA, 74 nt, Human
gccuugccugugugcucuaaugccuaguacucuguuagcacagagaaggugcuuaguaagagauauguguuggc

SEQ ID NO: 4107841 - RNA, 57 nt, Human
gccuugcgcccccggagucggcucagaggagagauugacugccaugagggugagggc

SEQ ID NO: 4107842 - RNA, 81 nt, Human
gccuugcuaggcaguucuaauugcguuuucuugcauaguaacuguuauggagagugagugauuaggacaguguggaggggc

SEQ ID NO: 4107843 - RNA, 69 nt, Human
gccuugcucaucccccagugccucauuuuauaaauaaaaggcagugcaguggagggauagaagcagggu

SEQ ID NO: 4107844 - RNA, 56 nt, Human
gccuugcugauuaccuuccuuuaaaccaguccaucuaaagguugguguuaagaggc

SEQ ID NO: 4107845 - RNA, 59 nt, Human
gccuuggcacaacucuucagcauuuuacaaggauaagaaugccuuggagcagccaaggu

SEQ ID NO: 4107846 - RNA, 78 nt, Human
gccuugggugagagaaaagaaacacuguucuuuguaaagaaauguucucuaaucuuucucuuuauccaaucucugggc

SEQ ID NO: 4107847 - RNA, 78 nt, Human
gccuugguaccccagcccucagcaaagacaucuaugcguacgggcagugucugaacugggugcugacgguggcaaggu

SEQ ID NO: 4107848 - RNA, 115 nt, Human
gccuugguucugcaggcaaccccagcccugcauggccacgucugggcagaccggcaccccuacccugacacccaucugugccaguccugcacggcaaacaccucagagcccaggc

SEQ ID NO: 4107849 - RNA, 85 nt, Human
gccuuguaaacaguaguauuuaaacugaacuaacagacaauagaacaagaaaguuagaaguuugugaaauuacuguacgaaaggc

SEQ ID NO: 4107850 - RNA, 63 nt, Human
gccuuguauucacuguaacucagcaauagaaagcucuguuuggugggagcagggaagcaaggu

SEQ ID NO: 4107851 - RNA, 60 nt, Human
gccuugugguaaguugggcccuggcaggauguucccaggguccagagaagccauuagggc

SEQ ID NO: 4107852 - RNA, 77 nt, Human
gccuuguuugcugccagggugaggcgcagcagcuguuuaacagcccugugagugacccuggucagcacuuucaaggc

SEQ ID NO: 4107853 - RNA, 61 nt, Human
gccuuucaaugugccugccuuggggauagaaccuagcucccaggaguuucacugcaaaggu

SEQ ID NO: 4107854 - RNA, 66 nt, Human
gccuuucacgcguuuuuuccugugucucaaacgggguaccaggaggcucagggaaacagcgcaggc

SEQ ID NO: 4107855 - RNA, 81 nt, Human
gccuuucagcccccauuccgcuccccuuccuugcgcugcgucgggaaagggaaugggaucccuaggggugcaaauacaggc

SEQ ID NO: 4107856 - RNA, 56 nt, Human
gccuuucucuuugcugaucaugucugauuuggacaacaagagcuaaggguaagggc

SEQ ID NO: 4107857 - RNA, 83 nt, Human
gccuuucugggcuguccugauggaaaaugugccugcucagcacauagggguuacauuucucauaggagagccaccucuggggc

SEQ ID NO: 4107858 - RNA, 66 nt, Human
gccuuugaauuguuguggugaguaggaauauguuuuguuuccguguauuacccauucagucagagc

SEQ ID NO: 4107859 - RNA, 89 nt, Human
gccuuugagcaccuguggccagaaccaggagaaugauauacuuuccauucacaguuaucuucuccuuuucugucccaaggcucaauagu

SEQ ID NO: 4107860 - RNA, 56 nt, Human
gccuuugcauaaagugccauaguauuacuaagguuuacagggcacucuuaugcagc

SEQ ID NO: 4107861 - RNA, 82 nt, Human
gccuuugcuauuguaaauagugccacaauaaacauaugugugcgugugucuuuauaguagcaucauuuauaauccuuugggu

SEQ ID NO: 4107862 - RNA, 82 nt, Human
gccuuugcuauugugaauagugccacaauaaacauacgugugcaugugucuuuauaguagcaugauuuauaguccuuugggu

SEQ ID NO: 4107863 - RNA, 56 nt, Human
gccuuuggagaugucauaggaucagcuucugggauuccauguacauuugcuaaagc

SEQ ID NO: 4107864 - RNA, 67 nt, Human
gccuuuguaccuuaaauccuguggggccuguguccucuuucuacaggaucucuagggugcuggaggu

SEQ ID NO: 4107865 - RNA, 67 nt, Human
gccuuugucuuuugccaaagaucaguugaccguaguuaugugagucuguucugcgggggaagggggc

SEQ ID NO: 4107866 - RNA, 57 nt, Human
gccuuugugaugggcgggcaccaggagaacgaggaucugugccugccccguaagggu

SEQ ID NO: 4107867 - RNA, 105 nt, Human
gccuuuguguggagaucuggcuggccucucuagcauccagccuguccuguccuguuaugucucgguuugagguugugcugaggggucucuucccauagaggaggc

SEQ ID NO: 4107868 - RNA, 65 nt, Human
gccuuuguuagcaguuaaagacuccacuggacuuaucaucaguucuggcugcugcugucagaggu

SEQ ID NO: 4107869 - RNA, 66 nt, Human
gccuuuuacagaucaucaagguauaaugauucuguucauucauacuaugguggcugucccagaggc

SEQ ID NO: 4107870 - RNA, 67 nt, Human
gccuuuucccuuuuuaagccuacuucucuucaucuacaaagugaaagguugggugaaugguggaggc

SEQ ID NO: 4107871 - RNA, 63 nt, Human
gccuuuucugaugucacgaggucuaacucuacuuagcagaagacuggggcauaagaagauggc

SEQ ID NO: 4107872 - RNA, 70 nt, Human
gccuuuucuuccugugucugugcccccauuuuccuggaagacucccugcacauacuacacagaaaauggc

SEQ ID NO: 4107873 - RNA, 68 nt, Human
gccuuuuuaagaugaaugcgcaaaaaggggaagaggaaucugaaaagcaguucgucuuagaaaauggc

SEQ ID NO: 4107874 - RNA, 81 nt, Human
gccuuuuuugucuucuccugcuucuuagagcugcucuggaugcugcagguucguucucaguucaggaaggacauguacggu

SEQ ID NO: 4107875 - RNA, 121 nt, Human
gcgaaaucugagccuuggggggugcaaauggaccccuuucccuucuggcucagggagguuuugggcuuacgcucgaguccuggccgaaguggaaagggcauaacucaguuuuggagaacgc

SEQ ID NO: 4107876 - RNA, 103 nt, Human
gcgaccucccucaggcuucugugcagcuucuccaucuccuuguauucacucccgacaucuacaggagagcagaaagcucacaucaggacuugguguccguugc

SEQ ID NO: 4107877 - RNA, 73 nt, Human
gcgagaagaguuggugagccccugugcugaugaucccaucuagaucagcuaacuuuccaguuuucuuaguugc

SEQ ID NO: 4107878 - RNA, 55 nt, Human
gcgagacgggcccccggcgccuccggucggucagagagcggcggggcgcgucugc

SEQ ID NO: 4107879 - RNA, 80 nt, Human
gcgaggacaggaagaagcagggcauuugaaugcauuuuaaggugccauuuaaauacagguucuguuacuuccaggccugc

SEQ ID NO: 4107880 - RNA, 65 nt, Human
gcgaggacauaguccagauggcaaucaaggaagaccccgcccucuugcuuauggcacugcuuugc

SEQ ID NO: 4107881 - RNA, 55 nt, Human
gcgaggcagugcauugucuaggggagauuaaagccccagggccguauugucuggc

SEQ ID NO: 4107882 - RNA, 61 nt, Human
gcgaggccagaguuaaggagaacagcuaggaaagaguugcagucacuaauguggcacucgu

SEQ ID NO: 4107883 - RNA, 89 nt, Human
gcgagggcagccugacuucucuggccuggugcagaaugucuccuggagaccagcugagggggccaagagcucaggugacuuuccuuugc

SEQ ID NO: 4107884 - RNA, 88 nt, Human
gcgaguggggguccuguggggaggccgcgcgcgugggcguccagggcggcggccccguccaccgcgucccacacgcuccccgcggcgc

SEQ ID NO: 4107885 - RNA, 69 nt, Human
gcgauauuuucacaauugugagaauaguuuaauuccacuaggaguaucuuuucacaaugaacaugucuc

SEQ ID NO: 4107886 - RNA, 102 nt, Human
gcgaugcuuucccuucuuggagagauuaucagaccagcaaucuuuuagaaaagguccguaggaauuuugugagcuuucccagaagauagguaggguaucugc

SEQ ID NO: 4107887 - RNA, 72 nt, Human
gcgauuuccuuggagaauguuuuccugcagugcuucacacuggcagagggaaaaccauuccccaacaggagc

SEQ ID NO: 4107888 - RNA, 76 nt, Human
gcgcacccacggcugccaguccugagccucuucugcuuucagggaggugucaucaggcagcucugggccacugggu

SEQ ID NO: 4107889 - RNA, 74 nt, Human
gcgcagccauccagggguacccuggagcccgacagaagcagggccgggcuccagauguccccuggcaaaugcgc

SEQ ID NO: 4107890 - RNA, 55 nt, Human
gcgcagcucugcaugcuacuaucaugaguguagguggcaggaguggaugcugagc

SEQ ID NO: 4107891 - RNA, 65 nt, Human
gcgcagcuugggggcgcuggccucagagacacccucacuugaccccgagcucaccacagcugagc

SEQ ID NO: 4107892 - RNA, 89 nt, Human
gcgcaggaccggcagcccgaggcggagacgaagggggcccgcagggacuccuggccuugcgucuugggagagcgcacgcuggccugcgc

SEQ ID NO: 4107893 - RNA, 92 nt, Human
gcgcaggcugggcucagaggaguggccugggagauguuuucugagugaaagaaagaaugagccuaggcauuuguuuagcuucagcucugcgc

SEQ ID NO: 4107894 - RNA, 55 nt, Human
gcgcagguccagucugcuguugauaaucaauuuucagcuucuucugugaccuggu

SEQ ID NO: 4107895 - RNA, 129 nt, Human
gcgcagguguuugagcagcgcagagcccuggccgaagcccuuggcgcacaccgggcacuuguggggccgcgggccgccgugcgugcgcaggugcugugccaggagcgagccgugcccgaaggccuugcc

SEQ ID NO: 4107896 - RNA, 101 nt, Human
gcgcaguccugugcuauugugcauaugucauucgauccguguucagccugguccuggagaucaauaugcauuacuaaucaaaauggcauaggaaucagugc

SEQ ID NO: 4107897 - RNA, 71 nt, Human
gcgcauuuguccuuacagcgccauggcuuccaugaguaauuagaugaggccuccugcagggaugagugugu

SEQ ID NO: 4107898 - RNA, 63 nt, Human
gcgccagggccagcccacuagcgaggaggaggaagccgccucggugggaguuggcugaggggu

SEQ ID NO: 4107899 - RNA, 66 nt, Human
gcgcccggcuuccugccucucgccgcccgcccuccgggccgcggcauggcgagcaggacugggcgc

SEQ ID NO: 4107900 - RNA, 55 nt, Human
gcgcccucugguggccgccucggcugucccagcccaggucaggcuucagagcugc

SEQ ID NO: 4107901 - RNA, 55 nt, Human
gcgccuauuuucauuaucaaggccacauuccugggauuccuuggugacuaggcgc

SEQ ID NO: 4107902 - RNA, 64 nt, Human
gcgccucuacccaccugagacaugcaggggggcaccugucuuccuucccaguggggagaggugu

SEQ ID NO: 4107903 - RNA, 126 nt, Human
gcggcagcggugucuggcucucgcgcuuucuccagcugcaguucguuccagcucucccgacuucgcgcucggcgccggaguuggugggcugcagcugcagaccccgcgacgcuucgcccgugccgc

SEQ ID NO: 4107904 - RNA, 82 nt, Human
gcggcccugcugcucccccaaguauggcucaccaaagcuccagaggcggucuguguccaagcuggacagcagcaaggaccgc

SEQ ID NO: 4107905 - RNA, 59 nt, Human
gcggccguggccucagcccugcggaggaccuccugccgcaaguacugcugccuguccgc

SEQ ID NO: 4107906 - RNA, 58 nt, Human
gcggccuuguggcggagcaggcucugcggagccgaguaggacuugccgcacaggucgc

SEQ ID NO: 4107907 - RNA, 114 nt, Human
gcggcgaggcccugccauguuccccgagagcugcacauugccaccuguugcuauggagaagccucuuuaucgcaaacacuggguaaacagcugcugcugggagccccuuucugc

SEQ ID NO: 4107908 - RNA, 98 nt, Human
gcggcgcccagaguuucaaccggugcguucagccugcaucccucgaauuccuugacccagcccggggcuggagccuggcggugguuucuaggcgcugu

SEQ ID NO: 4107909 - RNA, 59 nt, Human
gcggcggcgguagcaaaaaugaccccgggacuuugcccuggccgcuaccguugggcugc

SEQ ID NO: 4107910 - RNA, 61 nt, Human
gcggcuuaggggcagaagcggcgguccagggccgccuggcgcagcagccugucccagccgc

SEQ ID NO: 4107911 - RNA, 79 nt, Human
gcgggagcccagagaggcuggcagugccagguucaaacuuagagccaugggcucccaguccuuucaacuggguucuuuc

SEQ ID NO: 4107912 - RNA, 57 nt, Human
gcgggagggugggccccuucugugccaucuggaacagaggccacaccagccucccgu

SEQ ID NO: 4107913 - RNA, 82 nt, Human
gcgggcacccucagguauccugggcugcacccucagccucugggacaccaagggcaaggggguaguugaggagugggccugc

SEQ ID NO: 4107914 - RNA, 57 nt, Human
gcgggcaggcugaugccucuugggacauguaagugcagaaggcaaggccugccacgc

SEQ ID NO: 4107915 - RNA, 92 nt, Human
gcgggcgggacaggaagcacaggcugggcagccuccccggccagggaggagccaggcugggccaccucccggucugucugccgacuacccgc

SEQ ID NO: 4107916 - RNA, 58 nt, Human
gcgggcuggcugcagcugcuggagccagagacggcucucaagccagaccaggccucgc

SEQ ID NO: 4107917 - RNA, 89 nt, Human
gcggggacauggcagaggcaaugauucugacuucacaccucgguuugauuggcucuucaaagucucugcuucuguaacaugaaaccagc

SEQ ID NO: 4107918 - RNA, 79 nt, Human
gcggggaccacguggaggggccuggucagcaaguggcaaggacgcggcgcaaagccaggcuuucuaauguacaauccgc

SEQ ID NO: 4107919 - RNA, 81 nt, Human
gcggggcaccguaggaggaggguggaagagcugcugagaccgcaaguuuaccagccucccacccaccacauggugcucagc

SEQ ID NO: 4107920 - RNA, 63 nt, Human
gcgggggcgcgcacgccagacagccucccgugcggccucgggcugagcgugcgcgccaccggc

SEQ ID NO: 4107921 - RNA, 92 nt, Human
gcggggggauugcuugaacccaaagguugaggcugcagugagccauguuugugccauugcacuccagccugggugacaaagcaagaaccugu

SEQ ID NO: 4107922 - RNA, 60 nt, Human
gcggggugugagugugugugugugcgcgcgcgugcacacacaugugaguacaugccuagc

SEQ ID NO: 4107923 - RNA, 83 nt, Human
gcggguccagcuuugaauaugugcuuguuaaauugucugugugaggagccgaggggcacuguucaauagguagcuggauaugc

SEQ ID NO: 4107924 - RNA, 119 nt, Human
gcgguacgcuuuuccgcaguaaguacaaauguaagcuccuuuggcucgagaucucaaguuccucuugaugacuugcugugcuugggagcuacucugucccugaaaaccaggcuugccgc

SEQ ID NO: 4107925 - RNA, 55 nt, Human
gcggugccuccuccaguguugcugcuguccagcagcucaguggcuggggcgcugc

SEQ ID NO: 4107926 - RNA, 58 nt, Human
gcgguggcgguggugcaugugggcaugagggugguggugccgcauguacacgucaugc

SEQ ID NO: 4107927 - RNA, 65 nt, Human
gcguaacucagagcucugcuuggguucuuaggggcuuagcugucccuggcagaagccugauaugc

SEQ ID NO: 4107928 - RNA, 57 nt, Human
gcguccaggacguggguuucuucccucuuccaggcgagaggcccucggacugggcgu

SEQ ID NO: 4107929 - RNA, 56 nt, Human
gcguccccguggcgggagaggccaccucguggucgcgcgcccaggccgccgggagc

SEQ ID NO: 4107930 - RNA, 109 nt, Human
gcguccuccucucugcugccccguguguuuucuccucugggagaccucuccccacagcaggagcuccucagaagaggguaacacaugggugggggcuugaggaggaugu

SEQ ID NO: 4107931 - RNA, 69 nt, Human
gcgucgcucuggacaggggcgcuuuggggugagaugugcgcucgcggccuugauccauuuaguggacgc

SEQ ID NO: 4107932 - RNA, 78 nt, Human
gcgucgggaagccaggccagguggucaugcuugcugagucauuuagcugcaacuguccuugccuuguuuccugauagu

SEQ ID NO: 4107933 - RNA, 68 nt, Human
gcgucuagucacauggaauguggagcagagacuaugcuacaucuucaccacauucucauucugacugc

SEQ ID NO: 4107934 - RNA, 66 nt, Human
gcgugccugggcagcuuagcaccguaaauccaccgcugcuggcuggcagagcagugcccaggcggc

SEQ ID NO: 4107935 - RNA, 79 nt, Human
gcguggccaggugcuggcugcuggccugaggaugccaacuggcauucaggguucacggucaacuccaccugagucaggc

SEQ ID NO: 4107936 - RNA, 78 nt, Human
gcguggcgggagggucuuccuaauuugcuauuaggaugaauuccuagcaagauauuauggaaugacaauuccacaugc

SEQ ID NO: 4107937 - RNA, 57 nt, Human
gcguggggcagcccagggcuucagcuccagccuggagaccugcuucuugucacaugc

SEQ ID NO: 4107938 - RNA, 87 nt, Human
gcguguggggccagcacaggucaguuuuuuaagagccuccguagaacagggucuuauuuuuguuccugagcugaaaugcacacaugc

SEQ ID NO: 4107939 - RNA, 99 nt, Human
gcguuaaaauagccuaucugcauguguauauauguguguauguguauguauaugcacucacacgcauaaauacacagucuauuuaguuaccuuuaaugu

SEQ ID NO: 4107940 - RNA, 60 nt, Human
gcguucuugccagcauccucagguucccgagccggugaccagggaccugugcgggaaagc

SEQ ID NO: 4107941 - RNA, 79 nt, Human
gcguuuacuguguaccaggcacuugccuaggcucggaauauucacuggcccacaacagugccuaguauauaggaggcgc

SEQ ID NO: 4107942 - RNA, 59 nt, Human
gcguuuguucacuaauucagcuggggaacccuugccaucuggacugaggagacagucgc

SEQ ID NO: 4107943 - RNA, 58 nt, Human
gcuaaaacuggccuaucagcaugagucuucacuaacagauuacaaugggcuagcuagu

SEQ ID NO: 4107944 - RNA, 95 nt, Human
gcuaaaccauaguuuugggauaauuuaaauacuucucauccguuuggacaaaacugaggagaaauuugagugaagcuuaaggcucuuguuucagc

SEQ ID NO: 4107945 - RNA, 105 nt, Human
gcuaaaggcugcgguuuuuguggugugaguggacauaggacucuuucaucaggguaauuuauaguccaauguccauuuguuuuagaacagacugaaauugcuggc

SEQ ID NO: 4107946 - RNA, 63 nt, Human
gcuaaaguuuauggacaucuuuuggccuuucccuuguggucacaagauaaacauagcuccagc

SEQ ID NO: 4107947 - RNA, 77 nt, Human
gcuaaaucagaugcaagagauggacuuguguucuauuauuagaauauaaauuucuugucuuucuguauaugauuagc

SEQ ID NO: 4107948 - RNA, 62 nt, Human
gcuaaauuuaagccuuucuccucuuagggcggaagccaugaggaccagagccuuaauauagc

SEQ ID NO: 4107949 - RNA, 86 nt, Human
gcuaaauuuuaccaaggucuuuuaaguccuuuggcugaaacagguauucaggacaguauaggcuuuaggagaauaugguauuuggu

SEQ ID NO: 4107950 - RNA, 95 nt, Human
gcuaacaaauuauuggagaaaaucuugcauuaacaacuugugauuuauagguaauuucuugucagugacagauuuaugaucucuuaauuuuuagc

SEQ ID NO: 4107951 - RNA, 108 nt, Human
gcuaacaggcuuuugaaagaaugggcaagaauaggcucagggcugggugacgggugccugcccauucacugagaucuauagcaugcccacuccucagggccuugaagc

SEQ ID NO: 4107952 - RNA, 129 nt, Human
gcuaacccuuggaauuaccugggaagauuuuuaaaauucagaugcuccagucucaucaugcagugauucuagcaucaggcucaagcacugauauuuuugaaagcuccccaggugacucuaacguucagc

SEQ ID NO: 4107953 - RNA, 74 nt, Human
gcuaagaaggcacacagaccccagcaagucagaccuggaagcauacucacugcuggaggccugggguccuuggu

SEQ ID NO: 4107954 - RNA, 63 nt, Human
gcuaagaaguguuugcccagccauauacauugaaacaaauaugccugggucuuauuucuaagc

SEQ ID NO: 4107955 - RNA, 96 nt, Human
gcuaagagaguaagaguagaagauguugucguuagugaugaaugcagaggaaagcagcucggcuaauuguuaguaucaacccuuacuuugcuaagc

SEQ ID NO: 4107956 - RNA, 88 nt, Human
gcuaagauuguaagggacucuugaguaauauuuacaugugucuuagccacauucaguguuaaauucaaagaguugguuucaauccagc

SEQ ID NO: 4107957 - RNA, 73 nt, Human
gcuaagcacagacacaaaaggcuuuccuggugccuugcccugaucgggaaaaauaagccaugucugugcuagc

SEQ ID NO: 4107958 - RNA, 72 nt, Human
gcuaagcuucauacaguggcugcacuccagccaguaaaaaggcuggagugcagucacuguguguagcuuagc

SEQ ID NO: 4107959 - RNA, 95 nt, Human
gcuaaggaucuaagguugacuugaaucaaaauuugacuuacauuuccccuagugcuuaaagcuugauucgaagcuuaaauacuuggguucaaagu

SEQ ID NO: 4107960 - RNA, 64 nt, Human
gcuaagguuucuggacagcaagaucaguuaauaaaguggcagagugagcuuccagaaguuuugc

SEQ ID NO: 4107961 - RNA, 68 nt, Human
gcuaaguccugcuuuaaguauucaacaaaguggcucaugugaagaauauugaagcaguuggaaguagc

SEQ ID NO: 4107962 - RNA, 57 nt, Human
gcuaagugcuucuuucuccucaagccuucccucaaggagagguggaaaaagcacagc

SEQ ID NO: 4107963 - RNA, 61 nt, Human
gcuaaguuucaggggaugccaacugaguacuuuaugcugucuugugucuucugaagagagc

SEQ ID NO: 4107964 - RNA, 65 nt, Human
gcuaauagcuuaugggauagauguuacugcuagaugaagaaacaucuucagagaagcuaaguagc

SEQ ID NO: 4107965 - RNA, 88 nt, Human
gcucuuugaaggaauagaaugccuuagaauguucacccuaguacauacccuggcaaaugaacuuaacggcaacuauuuaagaaugagc

SEQ ID NO: 4107966 - RNA, 87 nt, Human
gcucuuugacaacagggcuuacgugauaacuucucaaaaacaagccaaaaauacuuuuuaagacaaucauguacuguagucaaaagu

SEQ ID NO: 4107967 - RNA, 83 nt, Human
gcucuuugcacaguggguggucauguacagcacucguaacgguuucacgaggaccauguggccgagacccccaggguaggggc

SEQ ID NO: 4107968 - RNA, 56 nt, Human
gcucuuuggcuccacuuggaacgauuccucauucuuccagaaggaagccggggagc

SEQ ID NO: 4107969 - RNA, 74 nt, Human
gcucuuugguuuucagcuguuugcauccaaaugaagacacauuuggcaacauuaauugaauccuuauaaagggc

SEQ ID NO: 4107970 - RNA, 67 nt, Human
gcucuuuguaugucaugacaacugugccaauuauuuuuggcacaguucacuuuuuauaucaaagagc

SEQ ID NO: 4107971 - RNA, 68 nt, Human
gcucuuuuccuccuucagauucagagggcuaggaggucagagugcagccuuugagggaggggcagagu

SEQ ID NO: 4107972 - RNA, 75 nt, Human
gcugaaaacucuuuguggacauuaaauuccuccuggaaaagaguaguuugaugauuacagagaaaaugaaucagu

SEQ ID NO: 4107973 - RNA, 66 nt, Human
gcugaaaagauaauuugaguaaauuaauuuaggcuggagaguuagucaugacucagauuauucagc

SEQ ID NO: 4107974 - RNA, 56 nt, Human
gcugaaaagaugccagaucuuagcgaagaacugcaagaagaugguuaacuuucagu

SEQ ID NO: 4107975 - RNA, 77 nt, Human
gcugaaaauucuuuauucagcuguuugcuucuacugauuccauaaucuugaugacaaaggcugaaagggaaaagagc

SEQ ID NO: 4107976 - RNA, 129 nt, Human
gcugaaacuugcucuaaguuauacaaagaguggagacagagauagccaauuggaagccgguuacaucuaggccauguguuauuucuguauuuacguagucuucucuguguaauuagaacugcuauaggu

SEQ ID NO: 4107977 - RNA, 63 nt, Human
gcugaaauuagacugcagaaguccuugcugguugcagaaugguuguaaaucuaguuucacggc

SEQ ID NO: 4107978 - RNA, 83 nt, Human
gcugaacacaggcuacaugaacucuugcuuuauuucagcacagggcuucugauauugcaauuuauaccauguuuguuucuagc

SEQ ID NO: 4107979 - RNA, 59 nt, Human
gcugaacacauuucuccugccuccaggacagagcaucaggcaugaggaaucauugcagc

SEQ ID NO: 4107980 - RNA, 85 nt, Human
gcugaacauuaggugaagugcaucacuacucauuacaguauuuuuugacaaucuauauuuaagaguuuagugccaccuggucagu

SEQ ID NO: 4107981 - RNA, 113 nt, Human
gcugaaccaaaguguguguaaugauauacuggaugcuggcaugaacuuauguugucucaaaugguaacaaaguucacugaccagcacuggucugcaaucacccuuugaguagc

SEQ ID NO: 4107982 - RNA, 109 nt, Human
gcugaaccccagcaaacagaggaagaggacugcccccucccgcggaggcccacucacgcugggcacuagugacaaggggacaucagccuuuguucuccuggggcuuggc

SEQ ID NO: 4107983 - RNA, 64 nt, Human
gcugaagaagcugcagccuggaggggaagugccucaccaaaggccacacagugaauucuuuagc

SEQ ID NO: 4107984 - RNA, 57 nt, Human
gcugaagagcaaggcugggucuccuuuuccagagacugagcccauuacccucucggc

SEQ ID NO: 4107985 - RNA, 70 nt, Human
gcugaagaugcaucccuucucuucuuuuccccuaaauaaguaaagcuggaaaaguaaugcauucuacagu

SEQ ID NO: 4107986 - RNA, 80 nt, Human
gcugaagcauuuauuuccaagagcuuauuucugaaugacaaacaucuucauacaugaaauaggauucuggagguuugagc

SEQ ID NO: 4107987 - RNA, 98 nt, Human
gcugaaggaguggacuggggcacuuaaugggcacagagauugauuaauucauucaauaccuuugugccauuuaguguugugccaggcacuuucuaggc

SEQ ID NO: 4107988 - RNA, 56 nt, Human
gcugaagggcauggggccugggcuccucagaaagaaacaagccugccccaugcugc

SEQ ID NO: 4107989 - RNA, 56 nt, Human
gcugaaggucucuggagaggucaugggucaggucauguucaucuccugucuucagc

SEQ ID NO: 4107990 - RNA, 58 nt, Human
gcugaagguuacuccugugucugcggaaacccugucugcaggcuggucaaaccucagu

SEQ ID NO: 4107991 - RNA, 61 nt, Human
gcugaaguccuaaucccaaguacaguagaaugugccuguauuuggagauaaggccuucagu

SEQ ID NO: 4107992 - RNA, 56 nt, Human
gcugaaguggcgugaucagaauuauuauuagggcugugaacauggccaucuucugc

SEQ ID NO: 4107993 - RNA, 61 nt, Human
gcugaaugaagcugaaaaaggcauauauugauauugauauagguaacacauuuuauucagc

SEQ ID NO: 4107994 - RNA, 90 nt, Human
gcugaauuuugaacagcccugagaaggaggaucucuauucaccuacgaacugaaggaccuuguccaggguuacuuaguuguuuaaacagc

SEQ ID NO: 4107995 - RNA, 58 nt, Human
gcugacacuuagaagugcccugucuauagcccucugaccuugacuucuaauugccagc

SEQ ID NO: 4107996 - RNA, 81 nt, Human
gcugacagcgcaggugcugcuggagcagcaggcacuacagagccaguguucuccaguaagcccucugccacuguucuuugc

SEQ ID NO: 4107997 - RNA, 116 nt, Human
gcugacaggaaguggcuuuuuauccugcagcagauggcugaggacaaggccucugugaaagcccaggugacguccuugcucggggagcugcaggagagccagagucgcuuggaggc

SEQ ID NO: 4107998 - RNA, 68 nt, Human
gcugacauggucucugguaagcagcuuuaauuugauauggcuggauguacuuuggggcuggcugcagc

SEQ ID NO: 4107999 - RNA, 57 nt, Human
gcugacauucuaaaaaauauggaagggaaggucuucuaguauuuuagggugcucagu

SEQ ID NO: 4108000 - RNA, 85 nt, Human
gcugaccuggugcuguagccugauugaggggcacagccuuuuccccagucuuggugucuguagcacguauguucuuagucucagc

SEQ ID NO: 4108001 - RNA, 68 nt, Human
gcugacuaaccuggaguuguuucauugcagagaggcuggcuguggcagaugcaacugcaggugagugc

SEQ ID NO: 4108002 - RNA, 114 nt, Human
gcugacuaagacaggcaggagcaaauaguacacacugcaggccugagaagagacacugucacagugcaccagugugaagcuuguugaagccugcaaagaacuggucaucacagc

SEQ ID NO: 4108003 - RNA, 62 nt, Human
gcugacucagcagcugaugauccuugggaugggcuaggauaugaagcuaguguuggguuagc

SEQ ID NO: 4108004 - RNA, 77 nt, Human
gcugacugacuacauguccugucauuuucuuuacaugcacgauugauaaaacaaugacaguggcacagucacuuggc

SEQ ID NO: 4108005 - RNA, 89 nt, Human
gcugacugagugccagguccugaaaguguacuaugucaugaacacucuaaaguauucucugaucaguauuacuacuguucacucuuagc

SEQ ID NO: 4108006 - RNA, 61 nt, Human
gcugacugauggacacagcaccugaguuccucagauuuugcuggaguuuacucaggccagc

SEQ ID NO: 4108007 - RNA, 60 nt, Human
gcugacugcucagggccagcuggcuuuggcuccugcagguuuggucucagagcaggcagc

SEQ ID NO: 4108008 - RNA, 106 nt, Human
gcugacuucaugggccuaccuggcuaggaauccaugacucuccuguggaggucauuagccauugccugucgccaguggcccuacaaacccccacauggaagucagc

SEQ ID NO: 4108009 - RNA, 57 nt, Human
gcugacuuggccaaggccccggguuagucgcagaccugggauggggccagguuuagc

SEQ ID NO: 4108010 - RNA, 129 nt, Human
gcugacuuucuucuuccuucuuguugaauaucugucugguugaggaaucaggaauccuucccugcuuccuucuucaauuagauagcuauugccucuccugccagccaaaggaaguagggauguuuuggu

SEQ ID NO: 4108011 - RNA, 104 nt, Human
gcugagaaagggcgggcagcugagcaggcagccaagccagccggagcauugugugugaucugcaggcugaggcuggcucaacugccuuggagcucuuugacagc

SEQ ID NO: 4108012 - RNA, 75 nt, Human
gcugagaccuguaaugagaaauugaaagugcuaucagucaaccuggugaugugauuugcucuugagggucucagc

SEQ ID NO: 4108013 - RNA, 55 nt, Human
gcugagagugugagaucagauuagagagacuggaagucuggcuccgccucuuagu

SEQ ID NO: 4108014 - RNA, 87 nt, Human
gcugagauaaacugcuggaauauguuugcuaaccaaacuuccagcagcuuggcagcaagaauaauuuggguaguacaucacuucagc

SEQ ID NO: 4108015 - RNA, 66 nt, Human
gcugagaugcggguuccgggcuccuguuccccucggggaaggaggcacccugagccugccuucagc

SEQ ID NO: 4108016 - RNA, 78 nt, Human
gcugagauuauaggugggugccuauguauguauauaauauauaguauaucauauuguaagcaccucauaaguuucagc

SEQ ID NO: 4108017 - RNA, 69 nt, Human
gcugagcaguggggccagcucccgcccacccccaggagacuggugaggagagcuguccggcugagcagc

SEQ ID NO: 4108018 - RNA, 59 nt, Human
gcugagcccuagucuaguauuauagccagggaagguguagggaggaaagggcucuuggc

SEQ ID NO: 4108019 - RNA, 84 nt, Human
gcugagcggccacgagcagggcuggccgggccgccauuaaugauuaacuuggggccugggccuugaccucgugggccucugagu

SEQ ID NO: 4108020 - RNA, 78 nt, Human
gcugagcugaugguaacugaaggaagugacugagaccugaauuaaugucauuucuauugcuacugucugaggcuuggc

SEQ ID NO: 4108021 - RNA, 77 nt, Human
gcugagcuguguggcauguggaccuguuuucccaggagggagcacuccugggguuuuggccgcagcugcacaucagc

SEQ ID NO: 4108022 - RNA, 78 nt, Human
gcugaggagguagauguccuuguuaauaauuguuaauuaauuaacaauuaaggauuauacucuccuuucauucacagc

SEQ ID NO: 4108023 - RNA, 60 nt, Human
gcugaggauugaagaguugccaguuguucuaacaacaugguggccauuauuaaccuuagu

SEQ ID NO: 4108024 - RNA, 105 nt, Human
gcugaggcaggagaaucgcuugaaccugggaggcagaaguugcagugagccgagauugcgccacugcacuccagccugggccacggagcgagacucugucucagu

SEQ ID NO: 4108025 - RNA, 56 nt, Human
gcugaggccaguuuaaugaggacucauugacuuucuucauugggccugccugcagc

SEQ ID NO: 4108026 - RNA, 77 nt, Human
gcugaggcuccaugccuguggcaauaguugcuucacauggcggcaacucuucuugcaauggggaacauggaggcagc

SEQ ID NO: 4108027 - RNA, 72 nt, Human
gcugagguggcacaggguuguuggucauaugauuugcuaucugauggccugaugcaccugucccaccacagc

SEQ ID NO: 4108028 - RNA, 71 nt, Human
gcugaggugucaccuugcugggccaagaggaaaagagcagcugggauuagcaacuugguggcauuaacagc

SEQ ID NO: 4108029 - RNA, 108 nt, Human
gcugagguguucuuauaacuuguucuagcgagggaccuagggauuucugagucucuuuuuugcauucaccccaaauucccaguggaauagguuacuggaaaccauagc

SEQ ID NO: 4108030 - RNA, 88 nt, Human
gcugagugcuauuuuucucuuuugcucucucacucucuaagguguaaauagauugaguaaacaguuucuuagaagaaaaguugucagc

SEQ ID NO: 4108031 - RNA, 83 nt, Human
gcugaguggaaggcuucuccagggcuuacuucaguucuucguggauuuugcccagucgcccggaggcugcaguuccaccaggc

SEQ ID NO: 4108032 - RNA, 83 nt, Human
gcugaguuacauguccugcuggcaaggaagggacugguuguccuguuaccaguccugaccagaacaggucugcaaagcucagc

SEQ ID NO: 4108033 - RNA, 128 nt, Human
gcugaguuggcucugucaauccuauacaaaucccugcgugcauuaauauuuccuugagccagagcaaaggaauucuagaauauuggcauucugagggugaauagugauggauauaguaaacuuuuagc

SEQ ID NO: 4108034 - RNA, 72 nt, Human
gcugaguuucuuaagugggaagaauugggugauucuaguuauucuguucuuguccccacuucaguccucugu

SEQ ID NO: 4108035 - RNA, 68 nt, Human
gcugaguuugagaauuugcuuugagucugugcagaguuucacagcuacaaagcucuucuacaggcagc

SEQ ID NO: 4108036 - RNA, 61 nt, Human
gcugauagacccucuuuggguuauuaaccaguuaguuucuuccagaaaagaggucauuagc

SEQ ID NO: 4108037 - RNA, 57 nt, Human
gcugaucuggauuauucaucugaaggcucagcugggucuacaggauccucauacagu

SEQ ID NO: 4108038 - RNA, 63 nt, Human
gcugaucugguuccaggacauugcaaaagauuuauuuacaaucacccaaagagccagaauagc

SEQ ID NO: 4108039 - RNA, 98 nt, Human
gcugaucuuuuccaaaaagguuuacagaaaauguguuuuaacuuauugccaugaacaaauggaggcaaccuacauuuuuuugaauuuuugagauuagu

SEQ ID NO: 4108040 - RNA, 97 nt, Human
gcugaugaguucugccuucugagagcacugagugagcaaggccuuucaucaguguuuuggccuucucauugggugaggaagacauugaaccaacagc

SEQ ID NO: 4108041 - RNA, 61 nt, Human
gcugaugggggcgaguuucuaaagccggcaaagaaagagcagguaggcuggccuucacagu

SEQ ID NO: 4108042 - RNA, 56 nt, Human
gcugaugucccacugacagccagcaucaacugccaggugugagugaagauaucagc

SEQ ID NO: 4108043 - RNA, 58 nt, Human
gcugaugugaugucagaagaggccaauuagacaaucaggacuuucaacaucacucagc

SEQ ID NO: 4108044 - RNA, 71 nt, Human
gcugauguuaagguagugaguuuccugucacuggagagauccaagcagaaguugaucuaccauauaucagc

SEQ ID NO: 4108045 - RNA, 60 nt, Human
gcugauugauaaaugacuaaaucagagagcaaaagagacugauucuguuuuaucaucagc

SEQ ID NO: 4108046 - RNA, 89 nt, Human
gcugauuuuauuugaaggcauacauuuugagguucagacuccuacagagggaucuuuguuuuaaaguggugcuuugaaauuuauuuagu

SEQ ID NO: 4108047 - RNA, 69 nt, Human
gcugauuuucagucuggcuggacccagaguucuguauuuuuaacgaguccaggugacugagagaugagc

SEQ ID NO: 4108048 - RNA, 77 nt, Human
gcugcaaaggggaaagacaucagguugccugcaucagcugauggcagcuugcccuggucucaacucaacuuggcagc

SEQ ID NO: 4108049 - RNA, 78 nt, Human
gcuuaaucucuacacacagaaucggccgauggugcucugaaaagugguaggucugaagucugguuaaauggagaaggc

SEQ ID NO: 4108050 - RNA, 68 nt, Human
gcuuacaaggguaggaagucuaacggguuuuauuuguaccucugaguacauuccacuccucugugagc

SEQ ID NO: 4108051 - RNA, 56 nt, Human
gcuaguuucuugaauacucuaagauauuagcuggggaguauuuauacagagacugu

SEQ ID NO: 4108052 - RNA, 62 nt, Human
gcuaguuuuaagccuagaacucaagaugccuaggcucuugaguucuaggcuuaaaacuaagc

SEQ ID NO: 4108053 - RNA, 59 nt, Human
gcuaguuuuagcucuuugggggauacuugccaaacucuucaucaaaaguuaacacuagu

SEQ ID NO: 4108054 - RNA, 58 nt, Human
gcuauaacuaucugucaaaguuugauaaggcaaacuuugccccaaagaaguugguagc

SEQ ID NO: 4108055 - RNA, 55 nt, Human
gcuauacaucccaauuucagagacccauguuauggguuuuccagagauguguggu

SEQ ID NO: 4108056 - RNA, 74 nt, Human
gcuauacauuauaccaguggguacauugagaucaauuuguaccaucugguauacagacaaauuuuaugaauagc

SEQ ID NO: 4108057 - RNA, 55 nt, Human
gcuauacccuagcuuucuuuagggcuuuagcccuagagaaagucauggcuguggc

SEQ ID NO: 4108058 - RNA, 90 nt, Human
gcuauaccuaagugucuuuuuguaaaauccuauuugugaaacuauguuuaauuuuaggaaugugguuuuugagcagauaugguaauaagc

SEQ ID NO: 4108059 - RNA, 70 nt, Human
gcuauacuacaucacagccaagaagcggcuagcugcagcagccaaagauuucucugggugaugagguggc

SEQ ID NO: 4108060 - RNA, 58 nt, Human
gcuauaggguacauuuguguuugacuuaucccuugugaaacauggauagcucuguggc

SEQ ID NO: 4108061 - RNA, 82 nt, Human
gcuauauacucauggcauuguuuauagauugcaugagacaaugcauguaauauacuuagcacagugcagccugucauauggu

SEQ ID NO: 4108062 - RNA, 121 nt, Human
gcuauaucuuacuuuguaucucuacuguucuuugauuaucggugugaauguuuuaaugaaguucucaaauuaacuuccauuauaaugaaaggcagugaucuuuuuaacuuuaaauuauggc

SEQ ID NO: 4108063 - RNA, 84 nt, Human
gcuauaugaacauuugcauaggguucaaaggcuguagaguugcuuuuuaaaagucuuuaaaauucuguaauaaugguuuauggu

SEQ ID NO: 4108064 - RNA, 63 nt, Human
gcuauaugcucugaaguucacuuugccacucaacuauauggcuggcauuucaggcauguuugc

SEQ ID NO: 4108065 - RNA, 121 nt, Human
gcuauauuuuacuuuguaucucuacuguucuuugauuaucggugugaauguuuuaaugaaguucucaaauuaacuuccauuauaaugaaaggcagugaucuuuuuaacuuuaaauuauggc

SEQ ID NO: 4108066 - RNA, 71 nt, Human
gcuaucuacuuacacugaagcaaagauacauaaagaaauaugucucuacugcuucugugagugagucuugc

SEQ ID NO: 4108067 - RNA, 55 nt, Human
gcuaucugcaggaacugauaucuauuauauacaguaauugcccugcaaugauagu

SEQ ID NO: 4108068 - RNA, 70 nt, Human
gcuaucuggugaauagagauguagcggguaaauguuuuguaauuuacucagauguucaauccaggauagc

SEQ ID NO: 4108069 - RNA, 66 nt, Human
gcuaucuguagucucaugguuccugcggugacuucacccacuccagugccauggcugcuagauggc

SEQ ID NO: 4108070 - RNA, 71 nt, Human
gcuaugacgucaucuuguggucugcugaaaggcuacuggagccacagcagccagacaagauacaucaaagc

SEQ ID NO: 4108071 - RNA, 83 nt, Human
gcuaugagaagaggaaggaaagauucucucucuagaaugggagaauccauucauggggaugcucuuaucuucugacugauagu

SEQ ID NO: 4108072 - RNA, 66 nt, Human
gcuaugagauuuuuauguuuuacucuggguuuguaaauccguuucauaacuguaaagaucuguagc

SEQ ID NO: 4108073 - RNA, 70 nt, Human
gcuaugauuucucacuguggauuuccucagagugccauuaguguaccaaggagaacacaggggagauugc

SEQ ID NO: 4108074 - RNA, 85 nt, Human
gcuaugcaauguuucuagcuuuuuaugacaaucuuggccaaagcaggcuagauggcaauaagaaagacuagaauuguugcauggc

SEQ ID NO: 4108075 - RNA, 89 nt, Human
gcuaugcagcugggagaugcugugucuguucccuugauacauauccugggaaugcaggggacuaggacaccaucaccugcccauauagc

SEQ ID NO: 4108076 - RNA, 85 nt, Human
gcuauggggcuaucucuuagaauucugaauuguguucaucacuugucaaaggagagagcauggcacagaggggugccccuguagc

SEQ ID NO: 4108077 - RNA, 72 nt, Human
gcuauguaagugaugccaguaagucucagcuaggguggaaaaaucaggcugacaacugagcauuuucguagc

SEQ ID NO: 4108078 - RNA, 77 nt, Human
gcuauguccuuagaucagaggcucuuccuauguggcauuucuguguauuggagcugccucucuugagguuacguggu

SEQ ID NO: 4108079 - RNA, 115 nt, Human
gcuauuauaauuucuguuuaacaagucaaauuucuauuuaaccaguuaaauuuccauuucacaauggagauucaaagggguuaagugacuugccuaaagucacagaucugguggc

SEQ ID NO: 4108080 - RNA, 70 nt, Human
gcuauuccacagguguguccuggucuuguggugacugccacaggcccuggguacaugaccugccuucagc

SEQ ID NO: 4108081 - RNA, 82 nt, Human
gcuauugcggugcagagcugcagcgaggccugggucacacagugcuccgggugucugcaggcugcaggccgagcccaguggc

SEQ ID NO: 4108082 - RNA, 75 nt, Human
gcuauuggugucucaacuguauugguggcucaacauuggucucugccacuggcaguuugagaaugcauugucagc

SEQ ID NO: 4108083 - RNA, 62 nt, Human
gcuauuucuaauuagggaaaauuuacuuguaggggguuacaaguauauucuagugauauagc

SEQ ID NO: 4108084 - RNA, 70 nt, Human
gcuauuucuguuugcuacuauaaguaaucuaagugguuguauucaugcucuguaguauuuaguaaauagc

SEQ ID NO: 4108085 - RNA, 65 nt, Human
gcuauuucuuuaaauugaucuccagcagaauuccaaauguaaaggucagcaggcaaggaaauggc

SEQ ID NO: 4108086 - RNA, 68 nt, Human
gcuauuuuugagccauuuauaaagccaguuuucaauaggcuuguguuauagaaggauuaaauuauagc

SEQ ID NO: 4108087 - RNA, 80 nt, Human
gcuauuuuuguugugcaccaugguaggagugaggccauaucucuucuucuucugcugcugcugcacccaaugcccauggc

SEQ ID NO: 4108088 - RNA, 72 nt, Human
gcucaaaugccagcuccugcagcuccuguaccuccucggucguagcaggaaccccgggaggcuggcaucagc

SEQ ID NO: 4108089 - RNA, 63 nt, Human
gcucaaggcaggcagacaugaguuucccuccucgccauacucacuagucaagugccuuugagu

SEQ ID NO: 4108090 - RNA, 109 nt, Human
gcucaaggcaggccccaggccggcagcuggacacuuggcuuuuauccugaggaguucacacccucagcauucaauguccaguccgucugcucaggagauugcaaagggc

SEQ ID NO: 4108091 - RNA, 60 nt, Human
gcucaagggaugggagugggugggugauauguuuugggauagucccaccccauccucagu

SEQ ID NO: 4108092 - RNA, 85 nt, Human
gcucaagucuuuucuugaauuccuagagagaggauuguaaacagcuuauuuuuaucuuuaggacuuugcagauuaugacuuggac

SEQ ID NO: 4108093 - RNA, 70 nt, Human
gcucacacauuuauuacaugcaugugucgccuauccucccauagauauauguagugcggugaaugagagc

SEQ ID NO: 4108094 - RNA, 62 nt, Human
gcucacagucugccccacagcaaaugauuguuuaacccaaauaucugugcagcaaacugagc

SEQ ID NO: 4108095 - RNA, 128 nt, Human
gcucacaguuuaggaggcguuaguagaguugguuccuuccagaggcucugagggagagucuggucucuauaccucucuuguagcugcuggugguuggcaacauuuuuugguguuucuuauuuuguagc

SEQ ID NO: 4108096 - RNA, 99 nt, Human
gcucacauggaugcagucagauggccuguauuugggccagagcuagaacacugauguuccacuauaggcuaucaaaagaugaaguguaaauggaugggc

SEQ ID NO: 4108097 - RNA, 86 nt, Human
gcucacaugggcccuuggaagagaaugcuauggugaaaagagaaaaucagaauguguuuauuuucauaguuggcccagcaacgagc

SEQ ID NO: 4108098 - RNA, 63 nt, Human
gcucacauuuuucugcaguuuuccaguggaccugccuauggaauacuguaaagaaaaaucugc

SEQ ID NO: 4108099 - RNA, 102 nt, Human
gcucaccagagcgagacauuuucuguucaacuuuggagauuuaauaauagcuuuaggauggucacuacugguugcguggcugaaaugcucuggccugggagc

SEQ ID NO: 4108100 - RNA, 61 nt, Human
gcucacugguaggcggcccuggaagucaaagaucugcugcuccagcgcugccaccaguugc

SEQ ID NO: 4108101 - RNA, 66 nt, Human
gcucacuucaccuggcgagggaauggccaggacgcgucccccccaaggccaggcugagaccggagc

SEQ ID NO: 4108102 - RNA, 63 nt, Human
gcucacuuguaaccccuuccucagguccaagagaaugggaggagggucauguugaaguguagc

SEQ ID NO: 4108103 - RNA, 97 nt, Human
gcucagaaggcucuucucuuugacauuauucagguggugucccagcgaaucaguaccguggaucucucguguuacagccucgaggagguuccugagc

SEQ ID NO: 4108104 - RNA, 63 nt, Human
gcucagaauguaucccauucauguauuguuuugaaauacauguauugaagugugcaucugagu

SEQ ID NO: 4108105 - RNA, 79 nt, Human
gcucagacacaacaccuaaaaaucauuguugaccccucccugggaucaacucugucugggauguagcucuggucugagc

SEQ ID NO: 4108106 - RNA, 60 nt, Human
gcucagagagauuaaauaauuuguguaaagucacacacauuauuaguugucuauuugagu

SEQ ID NO: 4108107 - RNA, 64 nt, Human
gcucagagcaucccagugaaugccaccagggaggugucagcucacuuugauguaauugaaaagc

SEQ ID NO: 4108108 - RNA, 70 nt, Human
gcucagagcugcugguugcuggugccucccaucagccccagggaggagcugcaaaaccggccgcuggggc

SEQ ID NO: 4108109 - RNA, 61 nt, Human
gcucagaucuggaaagugugguggagagaauuucuuucacuugacuuuccagucuuggggc

SEQ ID NO: 4108110 - RNA, 61 nt, Human
gcucagccgaacuucagagcagaaggcugguucuucuugcccuuguuguucgguggugagc

SEQ ID NO: 4108111 - RNA, 88 nt, Human
gcucagccugacauuugacccuggcagcauuuuuuucagaagcgaccauccuucugaaugagaucugcccuagauguacucugcuugc

SEQ ID NO: 4108112 - RNA, 73 nt, Human
gcucaggacuguggggaagccuugagcuccucugaggagucugucuuuggcuucaccacaccccaagcugagc

SEQ ID NO: 4108113 - RNA, 87 nt, Human
gcucaggagggauggagggcccaggagcugggagcuuuggucaucugcaguccagucaugguguccucacaaccgcuuugucugagu

SEQ ID NO: 4108114 - RNA, 76 nt, Human
gcucaggaucacuaugggcugggaucugagugucaugcuuaggaaauggcauuuuguucaguauaugguggagagc

SEQ ID NO: 4108115 - RNA, 61 nt, Human
gcucaggcaccagccaccuauuucuaggcagcacuuucuguccagggccuggugucugagc

SEQ ID NO: 4108116 - RNA, 58 nt, Human
gcucaggcaggagugcaguggcgcaaucauagcucacugcagccucaaccuccugagc

SEQ ID NO: 4108117 - RNA, 68 nt, Human
gcucaggccacccagagcuggcucugcauguacagccuaugugcuuacagaccagugucuccugaagc

SEQ ID NO: 4108118 - RNA, 56 nt, Human
gcucaggcucucccaggggaauguagaggccuguccuggguucccagggucugagc

SEQ ID NO: 4108119 - RNA, 81 nt, Human
gcucaggcuggagugcgauggcgugaucuuggcucacugcaaccuccagcucccagguucaagcgauucuccugccucagc

SEQ ID NO: 4108120 - RNA, 55 nt, Human
gcucagggaacuuuuugcaggcacauccuaugcccagcagggaguguccuugagc

SEQ ID NO: 4108121 - RNA, 65 nt, Human
gcuuacacagcuaggaaauggaagaacuagaauuugaaucuaaauuuucugucuccagcuauagc

SEQ ID NO: 4108122 - RNA, 70 nt, Human
gcuuacaguguguaggcuauuacuuuacaguguaucgagagacauuguuucagcuguaugcuauguaagc

SEQ ID NO: 4108123 - RNA, 77 nt, Human
gcuuaccaguuagauauuuuuauauguguuguguugagcuuacauacaucuaucuagaugcucagacugugaugagc

SEQ ID NO: 4108124 - RNA, 69 nt, Human
gcuuacccauagaagaaacacuagguagauaagcgcaguaauaucaguagugauucgauguggguaagu

SEQ ID NO: 4108125 - RNA, 59 nt, Human
gcuuacguacccaccugggucaucugucaucaaaaugcccccagguaggugccaugagu

SEQ ID NO: 4108126 - RNA, 59 nt, Human
gcuuacuagaaaguuuccagaguuauaacauugauauaaugguuggagacuuucuaagc

SEQ ID NO: 4108127 - RNA, 98 nt, Human
gcuuacuauggugagacuacuguagaagcuagggugccccagccaacccuggaggucuacagugcaggcaguuccaccaaugaagaaugguggugagu

SEQ ID NO: 4108128 - RNA, 56 nt, Human
gcuuacucucaggguuaguacaggaagauuugauuucacuguuucugugagugagc

SEQ ID NO: 4108129 - RNA, 72 nt, Human
gcuuacuuguaacaaucugucauaaauguccuuagaaauauaaaugcuugauuacagguuguuacuuuaggu

SEQ ID NO: 4108130 - RNA, 81 nt, Human
gcuuacuuuggguauaugugagauguuguauaagauauauuuauuccaacauucuuaucacuauaagccucuagucuuagc

SEQ ID NO: 4108131 - RNA, 79 nt, Human
gcuuagaacaucugaggccgggacuaucaaagguuucucaagaccccuuaauucaggccuggccuuuauguucaagagc

SEQ ID NO: 4108132 - RNA, 55 nt, Human
gcuuagcucaugaacuguaggcccuucucuggcccugguaguaaaugaguagagc

SEQ ID NO: 4108133 - RNA, 55 nt, Human
gcuuagcugaagaggguauuguagguaaaagcuucagagucuuuuuuaguaaagc

SEQ ID NO: 4108134 - RNA, 57 nt, Human
gcuuaggugagguuacaagaguucaugucaaaauggagcuuuaaaucucuccuaggu

SEQ ID NO: 4108135 - RNA, 127 nt, Human
gcuuagguucuucuuuuucacauuagagacuuucuucaaacuuauuguuuccuuggcugucuguucauauuuaaugguaagguucuacaguguugaguaaaagcucugggugcuuggugggucuggc

SEQ ID NO: 4108136 - RNA, 72 nt, Human
gcuuagugugggcugacagaggagugcugggaucuuaccauggaacuagcuucaugcuucaccacgcuaagu

SEQ ID NO: 4108137 - RNA, 88 nt, Human
gcuuauagcuguaauccaacucugaauacugcugauaagguuaucaauacuaaaucuuugaagaguuugauagaguugaguugaaagc

SEQ ID NO: 4108138 - RNA, 64 nt, Human
gcuuauauuaucaucauuggcaggugagaaauucuucucuuucuacagugugauuguguaaagu

SEQ ID NO: 4108139 - RNA, 124 nt, Human
gcuuaucaaaauuguuuucauauagcaauuugacauuacaacacaaucucuauaggcucccccuuggaauguuaugaugaugguaaauugcauucaaaugagugggaauagaauuaugauaagc

SEQ ID NO: 4108140 - RNA, 75 nt, Human
gcuuauccagaaaguuuagguagccuguucaaguucauaagggcugaaugcagccuccuggaguuucugggaugc

SEQ ID NO: 4108141 - RNA, 72 nt, Human
gcuuaugaaacaugcuuuguggaugacaccugggcagcagcccaacucagcuaugagguggugguucuaggu

SEQ ID NO: 4108142 - RNA, 130 nt, Human
gcuuauggugcauuguuuccuaauagcuuucuggucugagaacuacugaggauaaggauuucauuuugcucaucuauuuguucucagcauuuuaguacaguaccugucauagaaaauucguauucaaagu

SEQ ID NO: 4108143 - RNA, 76 nt, Human
gcuuauugugcagcagugguaccuggaaccccgcagaaaggcaugggggaucaggcacggcugaaugcacauuggc

SEQ ID NO: 4108144 - RNA, 61 nt, Human
gcuuauuuccacuccagaacugaauaugcagagcauugccaguccugcuagugugaaaagc

SEQ ID NO: 4108145 - RNA, 60 nt, Human
gcuuauuuucaccuucucucaggauggagccucagaauagagaccagguugaaaaucagu

SEQ ID NO: 4108146 - RNA, 55 nt, Human
gcuucaaauuaaggugaaucccugaagacgucagauagguucaaaaauuuggggu

SEQ ID NO: 4108147 - RNA, 70 nt, Human
gcuucaacauacacagagagaggccugaaaaacauaacuuggucucuaugucuaaguuuauguuguuagu

SEQ ID NO: 4108148 - RNA, 81 nt, Human
gcuucacagacaucucggggaagagaguuccuggcagagggagcugcuagugcaaaggcccugagauggaacugugcuggc

SEQ ID NO: 4108149 - RNA, 77 nt, Human
gcuucacccugagaaagucacaugcauucuccugugaucugcagcccaugcuugagugugguuucucagguaggagc

SEQ ID NO: 4108150 - RNA, 74 nt, Human
gcuucacuggcagacagcaaauagcaaugcaacagacguugcauugcacgggcgucugucuguuggagaugggc

SEQ ID NO: 4108151 - RNA, 70 nt, Human
gcuucagaaggaaucacucaacugcauuuaucuggcaggagaaaaaugcagguaguauuuauuuuggggu

SEQ ID NO: 4108152 - RNA, 92 nt, Human
gcuucagcuuuccuugcuuuagauuccuaacucacuguucacuaaauuagcugugggccuuguccuuaaucugaggcuaggagagcauaugc

SEQ ID NO: 4108153 - RNA, 59 nt, Human
gcuucaggguuaugcaagagugagaaacaaaugagaccacaucagcugagccuugaagu

SEQ ID NO: 4108154 - RNA, 62 nt, Human
gcuucaguaucaugcgguagccauguuggccacugggccccucaugccaugucuacugaggc

SEQ ID NO: 4108155 - RNA, 74 nt, Human
gcuucagugcaauguugugggugguuccaacugccuuugaacuagguguugacagaaaaauaacauagcacagc

SEQ ID NO: 4108156 - RNA, 66 nt, Human
gcuucaguuucuucccugugaaauggggcaaaaaauaaccccauagugugguuggaaaacugaagu

SEQ ID NO: 4108157 - RNA, 81 nt, Human
gcuucaugauacuaagcugaaguguuggugguuucaguauuaaugugugauaacuaauauauuuuaguguguguuuugugc

SEQ ID NO: 4108158 - RNA, 75 nt, Human
gcuucauggaggaguuaggugugagucuagcaaagaccccagcccaugauacucagccuaacuccccaauguggc

SEQ ID NO: 4108159 - RNA, 59 nt, Human
gcuucauuuugcccucugguggaaaacgaaguucuaaaguuccauuaggcaaaaaaagc

SEQ ID NO: 4108160 - RNA, 64 nt, Human
gcuuccaagcgguagauagcauuuuucucuccuacagcauguuucucugauggcccuuggaagc

SEQ ID NO: 4108161 - RNA, 64 nt, Human
gcuuccagaguugcguucucggucuuaguccuuaauaugagaucagcuccaucacucuggaggc

SEQ ID NO: 4108162 - RNA, 75 nt, Human
gcuuccauccuuggagaaucuuguuuuacuaagagaauugcacuuggaugauaacagcauuucaacuguggaagc

SEQ ID NO: 4108163 - RNA, 101 nt, Human
gcuuccauuacucacagagaacuaggugguuauaaauucaaggcuguuggcuaugaauauccaugaucagcauuucgauuaggccuuuggggcaauguagu

SEQ ID NO: 4108164 - RNA, 58 nt, Human
gcuucccacagcuggacuggggcuccgcguuacugcacccagaaguuccauggggggc

SEQ ID NO: 4108165 - RNA, 66 nt, Human
gcuuccccuuggcuuggucaagaggcugagcuccguguucccaggcuagaugccaaggggcagagc

SEQ ID NO: 4108166 - RNA, 67 nt, Human
gcuucccucacucacucagguugcucaugauggcaauaugacagccagugcuccgugaggacagagc

SEQ ID NO: 4108167 - RNA, 69 nt, Human
gcuuccgugugaccagcaugucagugucguuugugucccggaaugaagcaagcugcuguguuuggaagc

SEQ ID NO: 4108168 - RNA, 88 nt, Human
gcuuccuagagagaguuauauucugcuucugguggccugcgguuuuauuugguuaccaauuauggaagcuaguuguguuucaggaagc

SEQ ID NO: 4108169 - RNA, 105 nt, Human
gcuuccucaguuuuccugugcuagagucaauguguucaggauccaaagucucagagagugagucugauuuuucuagcauuuggucgcauaaaacuguagucaagc

SEQ ID NO: 4108170 - RNA, 71 nt, Human
gcuuccugcaggccaggguagggacuagagugaccagagcucauggcuggucuccucuggcugcaauaagc

SEQ ID NO: 4108171 - RNA, 66 nt, Human
gcuuccuggcuccucuacacacccaaauugcuaaucaaugcugcaauggcaggagccacuggaagc

SEQ ID NO: 4108172 - RNA, 75 nt, Human
gcuuccugggagccuggacucuacuugcauuuagacuccgcuuccugcaggucaaucuucagguuccugcugagc

SEQ ID NO: 4108173 - RNA, 56 nt, Human
gcuuccugggcccaagauguacuggggagucucggagacauggcaucccaggaggu

SEQ ID NO: 4108174 - RNA, 93 nt, Human
gcuuccuucuuccaggcugcucaguacucugcuguaggaaucuuugaagauuugggcacagauauuaaguauaaaagucagggagauggcagc

SEQ ID NO: 4108175 - RNA, 55 nt, Human
gcuuccuuucuuuguuugacaucuucaaagugaaaagugucauugccagggaagc

SEQ ID NO: 4108176 - RNA, 55 nt, Human
gcuucuaugcuucaagagagagcccagagguaacuuccuaaguggcuguagaagc

SEQ ID NO: 4108177 - RNA, 90 nt, Human
gcuucucaaagggccuuucuuuugaaucucugcagaaugaacugauuccucagcaggucaugaaagaaaaccagcuaauauugaugaagc

SEQ ID NO: 4108178 - RNA, 79 nt, Human
gcuucucaguacacaggaauagcaugccucaaaucuaagacaaauuuugaaaugagcauuuauucuuuaucugaauggu

SEQ ID NO: 4108179 - RNA, 99 nt, Human
gcuucuccauggcagcagcaccuccauuguuuuuaguccauuccaggagcaagcccaugauguagaugcugaaacauggaggcguguuguacgaggagc

SEQ ID NO: 4108180 - RNA, 78 nt, Human
gcuucuccuaauuguaagcuccuugagggaggcaauggguuuaaccacugcugaauacccagugugcaugggagaugc

SEQ ID NO: 4108181 - RNA, 57 nt, Human
gcuucucgcgcucgccccuccuaccgcaucuccggccaggggcaccugcgacggggc

SEQ ID NO: 4108182 - RNA, 77 nt, Human
gcuucugagagauacaaggaggcaacugauaagaagcgcaucagaagggcaguuaauugccuccagucucucggugc

SEQ ID NO: 4108183 - RNA, 91 nt, Human
gcuucugagagcgguuuugcagauguguuaccuauugugcggcacaaaaggugccagcauaguaagcagucaucaauaccgagucaggagc

SEQ ID NO: 4108184 - RNA, 64 nt, Human
gcuucugauagcuuuuugggauguggcauaucauuguggguauuccaauugguuguaaagaagu

SEQ ID NO: 4108185 - RNA, 66 nt, Human
gcuucugcgcacgcuucuucccucccuauuagucuuuucuggggaagaggacagaaugggugaagc

SEQ ID NO: 4108186 - RNA, 55 nt, Human
gcuucuggagucuucagaggaaacuguugucuugccuuuuccagcuccuagaggc

SEQ ID NO: 4108187 - RNA, 69 nt, Human
gcuucugggcuuuugcacuggccauucccuuugccuggaauguucuuccucugcacagcuacagaaagc

SEQ ID NO: 4108188 - RNA, 70 nt, Human
gcuucuggggguugcugugcacaugaauguuugcuauuguuccaggcgcacgucggccuuaagaaauagc

SEQ ID NO: 4108189 - RNA, 61 nt, Human
gcuucuguaauuucagcuugagugucugccauugaccugcagcagcugaaaucacaggugc

SEQ ID NO: 4108190 - RNA, 82 nt, Human
gcuucuguacaaguuguggcugcucagaagaggcccaaggagccccguaaugagugucacaaaccugccuuguaaagacagc

SEQ ID NO: 4108191 - RNA, 62 nt, Human
gcccucucuuuccacuccuauugcaucucagaguccuuuucuagucgggggaaggggagggu

SEQ ID NO: 4108192 - RNA, 59 nt, Human
gcccucugaccuccugccacaguuccccacugauggaacuggaccagaaggcagagggc

SEQ ID NO: 4108193 - RNA, 68 nt, Human
gcccucugcaguugguggguccucgguuccguugcugugcauggacugacaucaacuguaaggugggu

SEQ ID NO: 4108194 - RNA, 64 nt, Human
gcccucugccacugugaugcaugauaauaaaagcuuugucaugcccaggagcaagguaaugggc

SEQ ID NO: 4108195 - RNA, 66 nt, Human
gcccucugccugugucgccaccacagcccacagggcucagaugugguuucacagacccagaugggc

SEQ ID NO: 4108196 - RNA, 58 nt, Human
gcccucuguguaacaauccagacaaggccacaguuguccucggugagcaucagagggc

SEQ ID NO: 4108197 - RNA, 57 nt, Human
gcccugagccccaggaugaagggcgugggcacagccucucuuucugguggcuaaggu

SEQ ID NO: 4108198 - RNA, 62 nt, Human
gcccugcccagcgcgcucuaggacaccgcggcgccuccgcgcagcuccggcgugggcggggc

SEQ ID NO: 4108199 - RNA, 59 nt, Human
gcccugccucuguggaaaugguggucgggaagcagccccgccccucauggaggcguggc

SEQ ID NO: 4108200 - RNA, 80 nt, Human
gccuaguggguagggacuuagcuggcugaauaagcuaaguuuagccuauaaggguugaguuucuuucauauuugcuaggc

SEQ ID NO: 4108201 - RNA, 61 nt, Human
gccuagugugggcccccagguuagcccuucuagggcuguccuggcggggacgcaaaguggc

SEQ ID NO: 4108202 - RNA, 74 nt, Human
gccuauacugauuuuggaauuggaaagugcuguggucaccucaugagcuaguuccaaguccaugaguaacaggu

SEQ ID NO: 4108203 - RNA, 65 nt, Human
gccuauagcagaagcagaggcucuggaauuuuugucugaagauccuugguucugcuuucccuggc

SEQ ID NO: 4108204 - RNA, 73 nt, Human
gccuauaguugaguauggauggcccuccgugagcaguucacugugcccauguggggguacacguacacauggc

SEQ ID NO: 4108205 - RNA, 76 nt, Human
gccuauaugauggagggaaguauuuuggcaaagcaugcaugccuggcucaugacaauauguucuuucauuauuagc

SEQ ID NO: 4108206 - RNA, 66 nt, Human
gccuaucggccucuccuaaccuuggucuuguuuucuggcaggcagagguggaggagacacugaagc

SEQ ID NO: 4108207 - RNA, 73 nt, Human
gccuaucugcuggggcucuucuuuugccucaugcuuaugcugucuguggagaagcaggccucacagaucuggu

SEQ ID NO: 4108208 - RNA, 130 nt, Human
gccuaugacaucuggguugguuccaagucuuugcuauugugaauggugccgcaauaaacauacaugugcaugugucuuuauagcagcaugauuuauaauccuuuggguauauacccaguagugggauggc

SEQ ID NO: 4108209 - RNA, 81 nt, Human
gccuaugacucagcucccugaggaagggguguggugggucaccgacccucaccccacucccaggaccaugagucacuaugc

SEQ ID NO: 4108210 - RNA, 71 nt, Human
gccuaugaggauucuuuagagaaccuauauugaauugugugauauaacacucagaaagaaucaugaugggu

SEQ ID NO: 4108211 - RNA, 74 nt, Human
gccuauggaaugucaagaagcaguaaggguguaauguuagcaccuuaauaagcaauuuaugagcauuucaaugc

SEQ ID NO: 4108212 - RNA, 79 nt, Human
gccuaugggggaggacugugcuaucuacugaauuauauguugugugugaaggugccuagcauaguguuuggcccagugc

SEQ ID NO: 4108213 - RNA, 75 nt, Human
gccuauguuucuguguugauaauuuuggagaugauauuuacuucauggcuaagaauguuaugcagcaauguuggu

SEQ ID NO: 4108214 - RNA, 68 nt, Human
gccuauuuauguuguuucuacuaauaggccaguacuucgcuacuuauaaggaggcacacaaaaaaggc

SEQ ID NO: 4108215 - RNA, 69 nt, Human
gccucaaaauucuuguauguaugcaaaaucaaaaucucaucuugauucuucauaucaguacaaggaggc

SEQ ID NO: 4108216 - RNA, 67 nt, Human
gccucaaacccaggucuuuggcuuccaggaaauaaaccuguaaccacuccaccugcggccuugaggu

SEQ ID NO: 4108217 - RNA, 76 nt, Human
gccucaagcuacuuuaacaauucgcaagaaaaauuugauuuaauuguuuuuggugaaauguucaguuggcacaggc

SEQ ID NO: 4108218 - RNA, 130 nt, Human
gccucaauacucaaaggugaccacauguagauucugagacaggaaguggagggugaauaggucacccuccuaacauuuccuuuuuugcugucuagucauccuuguuggucuucugcuucuugguauaggc

SEQ ID NO: 4108219 - RNA, 76 nt, Human
gccucacacucugugauucucauguaccacugagaacauuuggaagcagaaguggaacaugcuacagguguguggc

SEQ ID NO: 4108220 - RNA, 76 nt, Human
gccucacauauucaugguuacugagacagaauuauggcgauugaaguaaggggcugaggauuaugauuugugaggc

SEQ ID NO: 4108221 - RNA, 80 nt, Human
gccucacugugaggcuggcaggggccaggcucuggggcagcucccagcccucucugcuucucccggcuucaccguggggu

SEQ ID NO: 4108222 - RNA, 70 nt, Human
gccucagaaagguuagaaaccacccggcuaguaugugguggggccagggcuccaaccucuccuauguggc

SEQ ID NO: 4108223 - RNA, 61 nt, Human
gccucagacacugccuggguguccccuccuaggacccugccauguggggcaggucuggggc

SEQ ID NO: 4108224 - RNA, 87 nt, Human
gccucagacccauugaacacugaaccguaaaugauuuaggaaagcugcgagaaguuauacuaugggguucuuuaaagggucugaggc

SEQ ID NO: 4108225 - RNA, 75 nt, Human
gccucagccacaaaccugagcucuguguggcuuggguggaggucccauccugggcacagacuccugggcuggggc

SEQ ID NO: 4108226 - RNA, 87 nt, Human
gccucagccagacaacuguugcugccuuggagaagcuccugcugcugcagcugcugcuuggggcggcugcacgccuggggcugaggc

SEQ ID NO: 4108227 - RNA, 59 nt, Human
gccucagcucuucccugugcacaccuauuuucagaugaacaguagugaaggguuugggu

SEQ ID NO: 4108228 - RNA, 56 nt, Human
gccucaggccuauagcugcuguggccacaccuuccgccagccaugcuugccuaggc

SEQ ID NO: 4108229 - RNA, 70 nt, Human
gccucagugggcccuugucacacugauuugaggaaaggcuuuggaagguggaugauggggccuucugagc

SEQ ID NO: 4108230 - RNA, 56 nt, Human
gccucaguugggccaguucuaggggccaucccaaccccuguguggccagcugaggc

SEQ ID NO: 4108231 - RNA, 65 nt, Human
gccucaucaggugaugcucugguucccauuuuauagauuguggaaacagagacuacuuaagaggu

SEQ ID NO: 4108232 - RNA, 60 nt, Human
gccucaucaguucccaggcccagacagacucugcugccaccugguggcugaaggguaggc

SEQ ID NO: 4108233 - RNA, 78 nt, Human
gccucauuuauaaaaaucuggcaaaaggcuuuguagugacaccuuacuugcuuggauuucaccagacuuaaaugaggc

SEQ ID NO: 4108234 - RNA, 63 nt, Human
gccuccacucucagggcagguggccuuuccccagggaaaucucgccaagcaccugggccaggc

SEQ ID NO: 4108235 - RNA, 58 nt, Human
gccuccagaacugggagagaauaauaauuucuguuauuuaagcuacccggucuguggu

SEQ ID NO: 4108236 - RNA, 74 nt, Human
gccucccaaagugcugggauuacaggcaugagccaccacugcuccugaccugguccuuguacuuugaaaagggc

SEQ ID NO: 4108237 - RNA, 69 nt, Human
gccucccaaagugcugggauuacaggcuugagccacugcgccuggcccaguuuucccaugucuugaggc

SEQ ID NO: 4108238 - RNA, 86 nt, Human
gccucccagccucagccagcugugugcuucugcauuauugcaguggggcgggcaagcguggagggcacagcuggcagggcagaggc

SEQ ID NO: 4108239 - RNA, 74 nt, Human
gccuccccacccacggcugguggaaccugagggcccccggcgccaccagagcuucguggcuuaaugggggaggc

SEQ ID NO: 4108240 - RNA, 85 nt, Human
gccuccccagauaguauucaucauuuggguggugugugugaauauucaaagcauggccaggaaagguagaaaccucugggauggu

SEQ ID NO: 4108241 - RNA, 60 nt, Human
gccucccccaggugugggcauugggcagagccagcaguggccaccaccagggucagaggu

SEQ ID NO: 4108242 - RNA, 67 nt, Human
gccuccccucugcccucagcucuaucucccucggccugggaguggcacucugaggcggggggagagu

SEQ ID NO: 4108243 - RNA, 58 nt, Human
gccucccgcagcccccacagccacugcaccgugagccagaggaggcuguguggguggc

SEQ ID NO: 4108244 - RNA, 58 nt, Human
gccucccugcuucaacucagauuccuauagcagagaaaagucuguugagcagagaggc

SEQ ID NO: 4108245 - RNA, 63 nt, Human
gccucccuggccagagcagcagccccugcgcucuccucagccgcugcugugggccagggaggc

SEQ ID NO: 4108246 - RNA, 63 nt, Human
gccucccuggcccacagcagcggcugaggagagcgcaggggcugcugcucuggccagggaggc

SEQ ID NO: 4108247 - RNA, 60 nt, Human
gccucccuggggcuccuccuauuucccugaggaaguaauagaagcucuaagggcacaggc

SEQ ID NO: 4108248 - RNA, 99 nt, Human
gccuccuaaaugcuuugaccuggauaugcaccacaucacuucugcucacaacccauuggugagaaccagucaugugggcacaccuggaggcaaaggggc

SEQ ID NO: 4108249 - RNA, 55 nt, Human
gccuccucacaauguacccacguacagguggugucuucggcacugugcagggggc

SEQ ID NO: 4108250 - RNA, 65 nt, Human
gccuccucagagcagcccuccgcauauaaccuguauguaggagugugagcucugaaacacagggu

SEQ ID NO: 4108251 - RNA, 81 nt, Human
gccuccugacggggucauagaagcagggcagggaaaagcaaaucacuuugcuccugcugcaugcaucucccacaaggaggc

SEQ ID NO: 4108252 - RNA, 78 nt, Human
gccuccugcggggccuggacagggagggggccagaccacagcggccccuccuccggucauugugcgggccucugaggc

SEQ ID NO: 4108253 - RNA, 57 nt, Human
gcuucugucuguaaacuucucaauuguuugauacgauuuaaguacuguagacagagc

SEQ ID NO: 4108254 - RNA, 58 nt, Human
gcuucugucuuagcuaccucccgucuguuuuggaauggggugggauauagauaaaagc

SEQ ID NO: 4108255 - RNA, 67 nt, Human
gcuucuguuuugcacagacuugaaucuggccauauguuucucuuuucaauucugguaagacagaugc

SEQ ID NO: 4108256 - RNA, 127 nt, Human
gcuucuguuuuugacugcucucauauuuucuaaaguacauccuagucucuuucaacucauggggaaaauugcagagaguuagggcccguauaguaugugacaccaaucaagacauaaauaaugaagc

SEQ ID NO: 4108257 - RNA, 70 nt, Human
gcuucuuaaauucucagaauacucuucuugugguagaugcuacaaguuccauuuugaaagugaaggaagc

SEQ ID NO: 4108258 - RNA, 127 nt, Human
gcuucuucaaauucuagcucacaagaguuuaaaauacugacaacuuuuucugugaaagguaggaaacaauaggaaauaggaccagacaaagccauaacucuuugagcaggcagaaugaggaggaagc

SEQ ID NO: 4108259 - RNA, 80 nt, Human
gcuucuucaugaaggauuauuuagagcucuaaugccugugaaaggaauaguuuuacuuaauucuuggucaugcagggagu

SEQ ID NO: 4108260 - RNA, 86 nt, Human
gcuucuuuccuuuguggugacaucugugcaauagguauucacuuaguauccugggcaagucaaugucccaagcaaaggacucuagc

SEQ ID NO: 4108261 - RNA, 130 nt, Human
gcuucuuuuagggaaaagauagguguguuaagaauaacuucuaaucuguacaguuuucauuuucuuuugugaaaauguguguuauuuagaaaauaguucucuacaguacgaguuuaccccugaaaaaggu

SEQ ID NO: 4108262 - RNA, 70 nt, Human
gcuucuuuuuguuuaguguucuucuuggaccaaucuugucuuuauguggaaauacuaaacacaaagcagu

SEQ ID NO: 4108263 - RNA, 73 nt, Human
gcuugaacccgggaggcggagguugcagugagccaagcuugugccacuguacuccagccuuggcgacaagagc

SEQ ID NO: 4108264 - RNA, 59 nt, Human
gcuugaagccaguugccugguggacaacuauugcuauccaugagaugugggcuucuagu

SEQ ID NO: 4108265 - RNA, 64 nt, Human
gcuugaauuacugcugccuccuggcugaguuuaaauguuucucaaggaggcaauguagauaagc

SEQ ID NO: 4108266 - RNA, 60 nt, Human
gcuugacuaggcucuggcgacaagaacuggacgcuucuggaaacucaggccuggacgagc

SEQ ID NO: 4108267 - RNA, 86 nt, Human
gcuugacuugauaguguuguauguacagucugaaaugucaagaaaaucugaaaugucaagaauauaaauacuuucaaaagacaagc

SEQ ID NO: 4108268 - RNA, 72 nt, Human
gcuugagaccagcagguugagggugcagugagucgugacugggucacugcacuccagccugggcaacagagc

SEQ ID NO: 4108269 - RNA, 65 nt, Human
gcuugagcauaugcauuuccaauuggcacagcaauugccggcauguaaauggauacugcuuuugu

SEQ ID NO: 4108270 - RNA, 72 nt, Human
gcuugagcccaggaguucaaggcugcagugaacugugaucacauuacugcacuccagccugggcaacacagc

SEQ ID NO: 4108271 - RNA, 64 nt, Human
gcuugagcccaggaguuugaggcugcagugaucuaugaucaugccacuauacuccagccuaggc

SEQ ID NO: 4108272 - RNA, 87 nt, Human
gcuugaggcaguagcucuaggacaugaauguuauacuuuauuaaauucugaaaauaaugauacuaguuauguugaaguuacugaagc

SEQ ID NO: 4108273 - RNA, 65 nt, Human
gcuugagguuugcaggguaauuaaaggcacaguaggcaggugucauuaacuuguuaaccuaaagu

SEQ ID NO: 4108274 - RNA, 70 nt, Human
gcuugauacuuauggcugugaaaugguaggugguuaauucagccacaucauggauacaguuauguuaagc

SEQ ID NO: 4108275 - RNA, 70 nt, Human
gcugagucaccacacggugcugacucacccucuucacgugacagcccuuccuguguguggagaccacagu

SEQ ID NO: 4108276 - RNA, 61 nt, Human
gcugaguccugggaggggcugguccugaugcugucugaccagcccugcccagggaagcagc

SEQ ID NO: 4108277 - RNA, 61 nt, Human
gcugaguguacucucaagaugcauuucucucaggaaguguguuuucaguguacuuaaaagc

SEQ ID NO: 4108278 - RNA, 74 nt, Human
gcugaguuucuaugugaaaugcacaugucuuuuuccuucauccagacgcgcauauuccaagcauaggaaacagc

SEQ ID NO: 4108279 - RNA, 68 nt, Human
gcugauagacugaauguugggagacagagagaaagcagccauggaugcucccagucuuuggucugagc

SEQ ID NO: 4108280 - RNA, 91 nt, Human
gcugauauuucaaggacuagacuuaggagcugacaucucuuagauaauugucagagggauucagaauucccaggacgcuuuugaauucagu

SEQ ID NO: 4108281 - RNA, 61 nt, Human
gcugaucaccaguuguagguauuuucuagccauugggagacugccuuucccuggugccggc

SEQ ID NO: 4108282 - RNA, 58 nt, Human
gcugaucauucagguugggcaagugucacaguccuggcaauugagaccugagugaagu

SEQ ID NO: 4108283 - RNA, 58 nt, Human
gcugauccuuuuaugucuagcuugauguuuacaguaacucuggagguagaggguuagu

SEQ ID NO: 4108284 - RNA, 63 nt, Human
gcugaucucagagcuggaggguuuaugcgggacuggccagccccuucagcugagugggacagc

SEQ ID NO: 4108285 - RNA, 61 nt, Human
gcugaucuucaugcacuaguggccucuggauuggcugguauacagugcauggggggacagc

SEQ ID NO: 4108286 - RNA, 76 nt, Human
gcugauguaauggaaguuaaauaugguaugggggaacuacauuacauaguaauuuuuuacuuuuaauuacaguagc

SEQ ID NO: 4108287 - RNA, 88 nt, Human
gcugauguugcuggugucaggaccacacuuugaguaggaagagucuagaagugguccucauaauucagugagcauaaaauuuuccagu

SEQ ID NO: 4108288 - RNA, 63 nt, Human
gcugauucugggaacuuugucucucagggcacugauucugagagcauuauuucuagaagcugc

SEQ ID NO: 4108289 - RNA, 70 nt, Human
gcugauuuauguuugcauuuuguuccaggacagcagauuauagcccaaguucugaggcaaaggcagcagc

SEQ ID NO: 4108290 - RNA, 63 nt, Human
gcugauuuauugaccuagugguauuuuaauuuuguuuuauuuacccuuuguuuaugaaucagc

SEQ ID NO: 4108291 - RNA, 67 nt, Human
gcugauuuuauuugaagcagaaggcacagacucucgucuggcagaagugcugucaguaagaagcagc

SEQ ID NO: 4108292 - RNA, 69 nt, Human
gcugcaacucagaugccaaaggcagcgggcauuucuuggcaaacucccuuuggcucugaucaguggagc

SEQ ID NO: 4108293 - RNA, 68 nt, Human
gcugcaagacccagaugucagguucagggaugcauuuucucuggcagggauaucuggcuccucucggc

SEQ ID NO: 4108294 - RNA, 57 nt, Human
gcugcaagcaugucauccucacauuuggccccuuggcccagagauggcauuggcagc

SEQ ID NO: 4108295 - RNA, 84 nt, Human
gcugcaauuaucuuagaugaggcuauggguugcuugauuucuccagggagucugguaauguagcucaaccucuccuguugcagu

SEQ ID NO: 4108296 - RNA, 106 nt, Human
gcugcaauucauagccuguuaguagcugugucuucaauguacugggaaauuuaucuuuguacaggaaggcacuguuucaagacccagagcuguguuccucaauagu

SEQ ID NO: 4108297 - RNA, 113 nt, Human
gcugcagagcugagugcgcaccuucuugggccaggccuuaccauagcuguagcaccgucugccgcagugcggggagggccccaugugccacaggguccacucggaccugcagc

SEQ ID NO: 4108298 - RNA, 66 nt, Human
gcugcagaggucuugcugauggugugugcauauccucugauuggaaccacagcaugacaccugggc

SEQ ID NO: 4108299 - RNA, 57 nt, Human
gcugcagaucccacccauucccagagaccagggcugaggacagugugaucugccagc

SEQ ID NO: 4108300 - RNA, 60 nt, Human
gcugcagcaagcccuccaggggauuaugauaccugccccucugagaacuucugcugcagc

SEQ ID NO: 4108301 - RNA, 71 nt, Human
gcugcagcagaaauggauuuugagauuuaauaaaugcauauuuagacucugcuuccacuuuugcuaacagc

SEQ ID NO: 4108302 - RNA, 60 nt, Human
gcugcagcagaaguucucagaggggcagguaucauaauccccuggagggcuugcugcagc

SEQ ID NO: 4108303 - RNA, 55 nt, Human
gcugcagcagcugcaggguugugaagagggaaaugacucuccggcugccagcagc

SEQ ID NO: 4108304 - RNA, 63 nt, Human
gcugcagcccgcagcuccuugcagagaugucuaccugcuucucucuggagcuggggcaugagc

SEQ ID NO: 4108305 - RNA, 111 nt, Human
gcugcagccuggccugguccugucugccuggcugucaaacccagaagaccgugguuucugguggccucugugugacagcggaggagguggggcgaggccuggaagugaagc

SEQ ID NO: 4108306 - RNA, 110 nt, Human
gcugcaggagucgggcccaggacuggugaagccuucggagacccugucccucaccugcacugucucugguggcuccaucaguaguuacuacuggagcuggauccggcagc

SEQ ID NO: 4108307 - RNA, 72 nt, Human
gcugcaggccuugagggcaguacuugggauaguauaucugcuggcccaggccaaagcccuggacgcuguggu

SEQ ID NO: 4108308 - RNA, 65 nt, Human
gcugcagggccauggguucuauagaacagaauacagagcuauaggauauacaagguucugugagu

SEQ ID NO: 4108309 - RNA, 57 nt, Human
gcugcagguugggcaacagaguguguguggagaggcuuugaaggaccggccuggggc

SEQ ID NO: 4108310 - RNA, 63 nt, Human
gcugcaguucuucuccucaaggccuccaaaaaagcgucaugagaaauaaaggaacugugcagc

SEQ ID NO: 4108311 - RNA, 93 nt, Human
gcugcaugggcuaaacuuagaggauauaaaacaagcacagucuuaaacagggugaagauaagcauguuuucuagaguuuaaaaucugugaagu

SEQ ID NO: 4108312 - RNA, 75 nt, Human
gcugccaaaggccaauguuguucucuugugaugccuuuuuggcguguuacauaacauugagcagcauuccucagc

SEQ ID NO: 4108313 - RNA, 79 nt, Human
gcugccaauucaugacacuucugaaacggaaguugugauuuuaaaauaacuuucuggaagccuuguccuaauugguagc

SEQ ID NO: 4108314 - RNA, 77 nt, Human
gcugccagagacagaguguuuuuuaagguacuguacugcucuuugcucuguacucagagaacauucccagucuuagc

SEQ ID NO: 4108315 - RNA, 76 nt, Human
gcugccagauuuaugucuuacuacagcaauuaacaaaguuauuuuuggaaguaagcauuuaauaucuucuuguagc

SEQ ID NO: 4108316 - RNA, 73 nt, Human
gcugccagccagaaaacucuacaugcuugugguagaaagcugcccuagcuaagcacaguuuucuggguguggc

SEQ ID NO: 4108317 - RNA, 68 nt, Human
gcugccagccuccccggccugugaaguggagcagaugcagagucugccaggccgggugagcaggcagc

SEQ ID NO: 4108318 - RNA, 64 nt, Human
gcugccagcgucagaccuggggcuuaccgaggaccuggggucagggacgcugugcuuucccagc

SEQ ID NO: 4108319 - RNA, 79 nt, Human
gcugccaggagaggucucccuuccccagucaccucaugccccacggucauacugggguggaugggccuguccugacugu

SEQ ID NO: 4108320 - RNA, 72 nt, Human
gcugccaggccaggcccucaggcaagggcucugaagucagggucaccugcuugccagggccgaucuuggugc

SEQ ID NO: 4108321 - RNA, 61 nt, Human
gcugccagggccaccgcggggggucagcuuccauugcugagcugugcuacgcccugggagc

SEQ ID NO: 4108322 - RNA, 60 nt, Human
gcugccaugccacagcacucacauacccacuaauucugugugaugagugaggcuggcggc

SEQ ID NO: 4108323 - RNA, 61 nt, Human
gcugccauuuaguugaagcaugugccaagcucucagcaauaacaucuuaacuugauggagu

SEQ ID NO: 4108324 - RNA, 56 nt, Human
gcugccccagcgccgacccuugcccgcauggcacaggaugauggguugagggccgc

SEQ ID NO: 4108325 - RNA, 60 nt, Human
gcugccccccggacucggcggggcugcggggaggccgccgcugggaucuaggggugcagc

SEQ ID NO: 4108326 - RNA, 66 nt, Human
gcugccccucgaccaagcgcgucccuaaucucucugcugaaggaacagauugcuuggagggccagc

SEQ ID NO: 4108327 - RNA, 60 nt, Human
gcugcccugacaagcuacucccaggggagaguacugagagaagccugaugcaggaacagc

SEQ ID NO: 4108328 - RNA, 81 nt, Human
gcugcccuggccagaugcugaaagcaggagcccucugccaagcaggggcugaacucaagucagcuccgccuaaaggacagc

SEQ ID NO: 4108329 - RNA, 62 nt, Human
gcugcccuuccagguugccacagugcagucugcacuuggccugcccagccagaaggagcagc

SEQ ID NO: 4108330 - RNA, 80 nt, Human
gcugccuauggacagaccucuaagauguugccuggaucucuggguaaguccuauuccaggucucuccaucacugcauugc

SEQ ID NO: 4108331 - RNA, 71 nt, Human
gcugccuccaagaggugugagcccucugucucggggaugaacaagcagagucugggcuaccucuugacagc

SEQ ID NO: 4108332 - RNA, 61 nt, Human
gcugccuccacuggcucccaguagaacccaaacuggcaauaugcuuucaguggccggcagc

SEQ ID NO: 4108333 - RNA, 57 nt, Human
gcugccucccagagcccugcagcuuccccagcccgcaggggccuuuugugaggaagc

SEQ ID NO: 4108334 - RNA, 61 nt, Human
gcugccugacuuaggagcucaauggcagcaccaggaagcugcacugggcuggagucagggc

SEQ ID NO: 4108335 - RNA, 71 nt, Human
gcugccugccuggcccaggaaccaguaggccucaaagaucuuggucaggucucgagccaggcagcugcagu

SEQ ID NO: 4108336 - RNA, 75 nt, Human
gcugcgauccucucugugacagggaacggcucgggaaacgcuuggcgcguucccuccugccacgggaggagcagc

SEQ ID NO: 4108337 - RNA, 55 nt, Human
gcugcgcagccaggccguggugcuaaugacauccaggccucuuccaugcagcagc

SEQ ID NO: 4108338 - RNA, 97 nt, Human
gcugcgcuagccauccugggcuuccaguccugugucccuugguggguucccuccaggaaccaaggggcggcucucacuccagguggcagcagguagc

SEQ ID NO: 4108339 - RNA, 69 nt, Human
gcugcgggcaggcggggcccagcucugcuccgugcggaggcuguguucugcccucucccugcccacagc

SEQ ID NO: 4108340 - RNA, 74 nt, Human
gcugcgggcugugucgguguuccauguggugggagaguccgccccagccaguugagcggcgacaccucccgagu

SEQ ID NO: 4108341 - RNA, 117 nt, Human
gcugcuacauagucugcuucuguuaauuuuuuaaccacuguuuaaucuggccauaauuaaguuuggcuuucuucguuguuugagauuuucagaauucaaggcaagcuaguagaaagc

SEQ ID NO: 4108342 - RNA, 79 nt, Human
gcugcucaauggccuuguucuguuaugcugcagagggucuguacuucggcagcaaaggaagccagguccagcauagcgc

SEQ ID NO: 4108343 - RNA, 85 nt, Human
gccuuagcagagaauaugcuuucagaaagcauuggccuacauuccaacuuguagggccugugcuuccugagauaacugcuuuugc

SEQ ID NO: 4108344 - RNA, 58 nt, Human
gccuuaggggucagacagagcuggauauggggguccuuguucuguaggagcuuaaggc

SEQ ID NO: 4108345 - RNA, 70 nt, Human
gccuuaggugguugucugcuuuccuaaggacucccauuuccaguauuaaagagagaaucaucaucaaggc

SEQ ID NO: 4108346 - RNA, 65 nt, Human
gccuuauugagucaguuagcuaacucuaugcuuugcuucuauguggcugcuuguuuuagugaggc

SEQ ID NO: 4108347 - RNA, 113 nt, Human
gccuucaguuuccuuccuuugugcucuucuuugugcugugguuuucucagccuggaauacccuuuuuccaccugccagaauccaagccacaguacaaaucccagagcacaggc

SEQ ID NO: 4108348 - RNA, 61 nt, Human
gccuucauaggagaauuuaagcacagaagaucugccuguuuccuucugucucuuuggaggc

SEQ ID NO: 4108349 - RNA, 79 nt, Human
gccuuccagaugaucugucacuuaucacauuuaaguuuguagauggauuagaugcugauugaauagauuucugaaaggc

SEQ ID NO: 4108350 - RNA, 101 nt, Human
gccuuccccaaggcccucugacgaucugagcaucuagcuugcaucacgggggccaggcaggcugugaggcucagaugggcuggggguccugcggacaaggc

SEQ ID NO: 4108351 - RNA, 72 nt, Human
gccuucccccacuggcccuuaagucugcuuaauaauaaguccuuugcuucugucauucuccugggggauggc

SEQ ID NO: 4108352 - RNA, 84 nt, Human
gccuucccugagcuccuguuccagccauucuccuguuuuccuuucuggugggaggaggcugggcacaguggccucguggaaugu

SEQ ID NO: 4108353 - RNA, 98 nt, Human
gccuuccggcagaagaggguaaagguggagaugaauuggccuuucugcguuucagaaaugugaauuucauuuccuuccacaccucucuguccaguggc

SEQ ID NO: 4108354 - RNA, 56 nt, Human
gccuuccuuacaccugcucagccucucacagcagagcugcgcagaccuaagagggc

SEQ ID NO: 4108355 - RNA, 91 nt, Human
gccuucgauguucuugcugacuucuggcaggcaaucggcucugggaguuucugucuagggaccccuccagcagcaguaucugcguaggggc

SEQ ID NO: 4108356 - RNA, 65 nt, Human
gccuucuaccauaucuggcauuuucaaguccugaucccuuugaggcucuaugugguagauuaggu

SEQ ID NO: 4108357 - RNA, 57 nt, Human
gccuucugaucgcuggacugacucucucgcccucucuuggugcagcccucgggaggc

SEQ ID NO: 4108358 - RNA, 57 nt, Human
gccuucugaucgcuggacugacucucucgccuucucuuggugcagcccucgggaggc

SEQ ID NO: 4108359 - RNA, 57 nt, Human
gccuucugauugcuggacugacucucucgcccucucuuggugcagcccucgggaggc

SEQ ID NO: 4108360 - RNA, 59 nt, Human
gccuucuguugcagcaguauguagccuuguggagaaaugagucugucugcgcaugaggu

SEQ ID NO: 4108361 - RNA, 68 nt, Human
gccuucuucucucagcucgucaaagucauucuccauccagcuuugauccguugcuggugaggaacugc

SEQ ID NO: 4108362 - RNA, 70 nt, Human
gccuugaacucauguauauugauuuuuguugcuaucacaaaucagguagaaaauguuuaucaguucaggc

SEQ ID NO: 4108363 - RNA, 74 nt, Human
gccuugacuguuaugggugucagcuuaacauuccauagaugggugguuaguuuuuauaucccauaauauaaagc

SEQ ID NO: 4108364 - RNA, 56 nt, Human
gccuugcaggaaggagggacagcaggacugagcgacucuguccuuucugcuaaggc

SEQ ID NO: 4108365 - RNA, 63 nt, Human
gccuugcuucauggacaauuuacagcagcugucugaagcacaguugcuucuggaaugcaaggc

SEQ ID NO: 4108366 - RNA, 84 nt, Human
gccuugcuuucaugguuuuucaaauuccuaagcuagcuaguggaagauggcuaguuugaagaaggaucuaugaaauaauagggu

SEQ ID NO: 4108367 - RNA, 89 nt, Human
gccuuggaccuuauagugcacuucaacucacuguaucccugcaucucuaagauccugcaggaguuaagugcucuccugguucccauggc

SEQ ID NO: 4108368 - RNA, 75 nt, Human
gccuuggauggauucaauguugcagauggaauuaacuucucuugauaccaacuguuauauugaaggguaaagggc

SEQ ID NO: 4108369 - RNA, 57 nt, Human
gccuugggagaaauugcagagucuggcuugaaagggacaugugagucucccaugggc

SEQ ID NO: 4108370 - RNA, 59 nt, Human
gccuuggucagucagagaauggagucaucugauuuaccauccugugaauggcccuaggc

SEQ ID NO: 4108371 - RNA, 73 nt, Human
gccuuguggcucgugagauguuagggaggccaaaagaaauugcuagaaccagaacucaugagugccucaaggc

SEQ ID NO: 4108372 - RNA, 76 nt, Human
gccuugugguguguugagucauugcucuggcaaaagaucuguuugcuccagcaacaggcuuagcuuucaacaaggc

SEQ ID NO: 4108373 - RNA, 61 nt, Human
gccuuguuuaaaugguugcuaucuugccucugcaggaagccaagcagcguuuaaaaaaugc

SEQ ID NO: 4108374 - RNA, 118 nt, Human
gccuuuacuaccacuacaugcacucacuuguuuucucagcacuauuagccuccacugaccucaaagggaagcauguguauaagcugggcaggagguaggcaugggccguguuaaaggc

SEQ ID NO: 4108375 - RNA, 71 nt, Human
gccuuuauguuucugcagcccccucgccgagucugcccggagaaccagggaaagcugcagauaacgcuggc

SEQ ID NO: 4108376 - RNA, 59 nt, Human
gccuuuauuuucaacggaguguugccauaauuuaagcaaauauucugaggaaugagggc

SEQ ID NO: 4108377 - RNA, 71 nt, Human
gccuuucaaaugucuucaaauauugaaauccuggguauacacucuaggauucguuuaguuaaggauaaggc

SEQ ID NO: 4108378 - RNA, 66 nt, Human
gccuuucugacucccaggcagauauggacacagcaucagagguguccggggcugggagggagaggu

SEQ ID NO: 4108379 - RNA, 93 nt, Human
gccuuucuuaaauuucuuuccuguacagcccacuccacugggcagauaaucaggcagagggcuucccuaggagugagagcauaagagaauggc

SEQ ID NO: 4108380 - RNA, 119 nt, Human
gccuuugaaggcagcaguccuugauauuucuuaggcugacuuguuucauaaagauuucuaaaagaguuuuuagagagccagugagccccgugauuuaugaugauugcucaagcaguggc

SEQ ID NO: 4108381 - RNA, 120 nt, Human
gccuuugcccucaauugcaaacagaguggagugucucuuagcuaagaaguuugugcugcucaaggguuugcacaaauacaaaguugagaaauacuccuugcugaaagggguguaaaaggc

SEQ ID NO: 4108382 - RNA, 123 nt, Human
gccuuuguauguucagaaggagaagaaaauggagucuggugaauacucagcaauaccugccucuccagccagguauuccaguggucaccaagauacccccugucagucagaaaguacaguugc

SEQ ID NO: 4108383 - RNA, 75 nt, Human
gccuuuuaacccuccccaagaggucgugccucugagccccaaagcugaaggccccucuugggggugggugcgggc

SEQ ID NO: 4108384 - RNA, 63 nt, Human
gccuuuuagguugucaaccucuugggaguagcccuacuccuggcagacagcacugaagcuggc

SEQ ID NO: 4108385 - RNA, 64 nt, Human
gccuuuucucaguuuccuuccuuguuuuugaugacuugagagcacugaggaaagcugguuaggu

SEQ ID NO: 4108386 - RNA, 79 nt, Human
gccuuuuguagaccacccucucucugucucaacuacucaacucugaaauuguacaaaagugagugugucucagaauggu

SEQ ID NO: 4108387 - RNA, 59 nt, Human
gccuuuuucaggaguugugggagaccaucuguacuuuucucucauuauauccaagaggc

SEQ ID NO: 4108388 - RNA, 64 nt, Human
gccuuuuucuguuugcuucaagacauuauuuuucgaagaugaauugaggaaaacagucguaggc

SEQ ID NO: 4108389 - RNA, 73 nt, Human
gccuuuuugcagucucagagaacaguuggugcuucugggcaggaggagcugggcugcugcugggagccagggc

SEQ ID NO: 4108390 - RNA, 75 nt, Human
gccuuuuuggauuaucugucacuugggauuacuuguacugugauccugucuaugaguagauaauugaauguuggc

SEQ ID NO: 4108391 - RNA, 55 nt, Human
gccuuuuuuguugcucugucacuuagagagacuuuccauucgagcaacagaaggc

SEQ ID NO: 4108392 - RNA, 63 nt, Human
gcgaacaguuacccuuaagaucuuuccuaguuaggaaacacucgccugcaaguguagcugcgc

SEQ ID NO: 4108393 - RNA, 64 nt, Human
gcgaagagguuuuagggaagaguuaguaaccauacagaggcuuugcccuggaaaccaauguugu

SEQ ID NO: 4108394 - RNA, 117 nt, Human
gcgacaaacagaagcacuucuuauucuuuuuaugcucagcaacauauuuauuucagauacacaaaaaagacaggcugaagucagaaaagaauuagggagaauggcgaaguuugaagc

SEQ ID NO: 4108395 - RNA, 79 nt, Human
gcgagacagugacuuagugaccagacccaggcuccuaguucuuggcccugugaucuugucacuacgugauacugcuugu

SEQ ID NO: 4108396 - RNA, 74 nt, Human
gcgagaugggcgggggcggguguaaguaggacagcgcuuugugcgcguugcuauggcgccgccgccgcccgugc

SEQ ID NO: 4108397 - RNA, 85 nt, Human
gcgagaugguuuuguugggagacaauucucuugugaucucucacauuucugcaagucuaauuuucugaacaaagccauuaucagc

SEQ ID NO: 4108398 - RNA, 77 nt, Human
gcgagcggugggcgcgggcgcgcggccucgggaggggcgcaauuccaggccagcggcccgcgcguucugcugcccgc

SEQ ID NO: 4108399 - RNA, 130 nt, Human
gcgagcuccagaggugccucccaugaacagaaaggaugcugucaggccugucgugagucccagggcacugagcugugcagggacuggcacagggcugggagcugguaggucccagaaacaggagcugugc

SEQ ID NO: 4108400 - RNA, 88 nt, Human
gcgagcucucuggagcuguuuuccugguuagagacauuguucuggaaagcagacuggguugccauggugacggcucccggggccucgc

SEQ ID NO: 4108401 - RNA, 59 nt, Human
gcgaggaggaaacgcggagaacucaggccacuucuccugggucccacguccccucccgu

SEQ ID NO: 4108402 - RNA, 55 nt, Human
gcgaggcagaggggcagaggacaauggggacagguccucuccaugaucuguuugu

SEQ ID NO: 4108403 - RNA, 84 nt, Human
gcgauauuuuauuucuacauugaguuuuagcaacucuaaaaaggcuuuguaaaaauuaacuguaggauggaauaagauauuugc

SEQ ID NO: 4108404 - RNA, 59 nt, Human
gcgauggccagaugaaauaauagaguuaaauacaucuauguuguucucugguuuaaagc

SEQ ID NO: 4108405 - RNA, 71 nt, Human
gcgaugguaggggcugggcaggaguuggagcaugaacaucugagacaauggcuuagcucagcgcucagcgc

SEQ ID NO: 4108406 - RNA, 103 nt, Human
gcgauguggaaaaguuuuauugccauuucaaggugcaggaggguuuuuuucgaagaugauaugaggauuaacugaccuaguguuuguaaagauuuuacguugc

SEQ ID NO: 4108407 - RNA, 59 nt, Human
gcgauuccagaagugguaauggguugugcugagcuagccccacacucucucugagaagc

SEQ ID NO: 4108408 - RNA, 73 nt, Human
gcgauuuucauuauucaugcuaguuaugcucuauauauaaaguugcaagcacugaauuagugaaaacugacgc

SEQ ID NO: 4108409 - RNA, 74 nt, Human
gcgcaacaccucuauuuacaaguauuaucauucugcuccugugagaagugauggcagugaauaaggcugugugc

SEQ ID NO: 4108410 - RNA, 80 nt, Human
gcgcaagcccaucuucuguugucguaaugauggugccuuugaauauuuaucugccagaugacaaacaggacaucuugugc

SEQ ID NO: 4108411 - RNA, 61 nt, Human
gcgcaccaccuccagguggccgucgaagcaggcggcgcggagaggcguggaguuggugcgc

SEQ ID NO: 4108412 - RNA, 56 nt, Human
gcugcucucucccuaaguugggcuugagaaacaguuucuauaggagagggaggagu

SEQ ID NO: 4108413 - RNA, 57 nt, Human
gcugcucuggcucugcagugucugaugugaugcuugaaaacaagaaggcagagcagc

SEQ ID NO: 4108414 - RNA, 68 nt, Human
gcugcugagacaccuaagguaaaucucuauauauuaguccauuuacuaaauaggucagucaugguagu

SEQ ID NO: 4108415 - RNA, 59 nt, Human
gcugcugcacucaucuccucuccuggcacaagggccagggcuggagacaagugagccgc

SEQ ID NO: 4108416 - RNA, 82 nt, Human
gcugcugcagggacuugagacccccugaguuauggccugaagaacggguccacuucccaggaggguuguccacugacagagu

SEQ ID NO: 4108417 - RNA, 81 nt, Human
gcugcugcugcugacccuugcccaucccggagcucacuuugagagcuggcugagaucccaggcaggguggccaguggcugc

SEQ ID NO: 4108418 - RNA, 65 nt, Human
gcugcugcuguggagauaagcaguccagccccugagggaucuggaagguuccucccagcuccagc

SEQ ID NO: 4108419 - RNA, 63 nt, Human
gcugcuggugagauuuuauguuuccccugugccggggacaaaauauuuuucucccaucuaagc

SEQ ID NO: 4108420 - RNA, 58 nt, Human
gcugcugucacccacaucugucuugguaaugaaacauuaacaguguugugagagcagc

SEQ ID NO: 4108421 - RNA, 60 nt, Human
gcugcuguccuuagggaguucucugucuagugggagaacauagauaccuaagacagaagc

SEQ ID NO: 4108422 - RNA, 61 nt, Human
gcugcuguccuucaagucugcguugccaagguaacuggggauuuggaagggacagccaagu

SEQ ID NO: 4108423 - RNA, 61 nt, Human
gcugcuguuuucgagcuuuaaauguggguucuuuggcauuagcuuuauuugaaauaggagu

SEQ ID NO: 4108424 - RNA, 92 nt, Human
gcugcuuauugugaucuugacagugaugccgggcgagaaugaauagaccgugaggccguucauauuccuggcacugacgagcccacugcagc

SEQ ID NO: 4108425 - RNA, 124 nt, Human
gcugcuuccgaguugggccaggguuuuaaagcccgggcugcagggagcugaggucacauacaaaagggguggcucacaggacucucugggccugggaggggcuuccggugcagcaggagggagu

SEQ ID NO: 4108426 - RNA, 64 nt, Human
gcugcuuccuagaaggcccaguucaggugcauaagaaccucacaguggagcuuucugggacagu

SEQ ID NO: 4108427 - RNA, 79 nt, Human
gcuggcggccaucucgccgcaggaggugggcgugcucacggggccggacaggcacaccuuccugcaggcgggccugagc

SEQ ID NO: 4108428 - RNA, 86 nt, Human
gcuggcgggggccuggaggccggacugagaggcauccauuuugucuagagccucucacugucacccucccacuguucuugcugugc

SEQ ID NO: 4108429 - RNA, 67 nt, Human
gcuggcguauucuuccuagaguugccuccuuauauauguaguugcaaguuaggaugaaugccuuagc

SEQ ID NO: 4108430 - RNA, 83 nt, Human
gcuggcucagagucacauuaauuuaauuuuaucugugauccacaucagccuagaaugcuauuaauucggauuugacugccagc

SEQ ID NO: 4108431 - RNA, 63 nt, Human
gcuggcucuacauuugaggucauuaauggauuguuuaauguguauuccauuguagcagcuagu

SEQ ID NO: 4108432 - RNA, 80 nt, Human
gcuggcucugaagagagcagcagaucuuccagcacagcacucgagcucugcuaagggauaggcugccuccucaagugggu

SEQ ID NO: 4108433 - RNA, 64 nt, Human
gcuggcucuguggcuuccuucauggacccucaagaggccagagggcugcugcacagugcucagc

SEQ ID NO: 4108434 - RNA, 59 nt, Human
gcuggcucuucaguggagauagguuuguuaccugacucauauuuguugagcuuaucagu

SEQ ID NO: 4108435 - RNA, 65 nt, Human
gcuggcugcgucaucacagggcugccacuugcaccuccucagucacugauguuacagcagccagu

SEQ ID NO: 4108436 - RNA, 74 nt, Human
gcuggcuggaacuagcaguuggcaggggauuagauaaggguggugucaagaaugacggcuggauuccugccugc

SEQ ID NO: 4108437 - RNA, 70 nt, Human
gcuggcuggaaugggagaagaaaugcacacacacuuucccaugcaggguucuccuuuuccaguucccagu

SEQ ID NO: 4108438 - RNA, 55 nt, Human
gcuggcugggacagauuccauugagucauuccucuaaagaaaugccuaguccagc

SEQ ID NO: 4108439 - RNA, 72 nt, Human
gcuggcugggcugcggcuguaccugcugacuuaacuguccaguuauucccaggaccgcccaccccagcuggc

SEQ ID NO: 4108440 - RNA, 55 nt, Human
gcuggcuguaucaccuggccagguauuauuugcauuaauaggagaacagcuaagc

SEQ ID NO: 4108441 - RNA, 60 nt, Human
gcuggcuguggcuuaagcaaacgcaaucacagaauugccuagcugugagucagagucggc

SEQ ID NO: 4108442 - RNA, 65 nt, Human
gcuggcuucagcugccaucaaugcugcugccgccacaugggaugguuguugaaaacugauccagc

SEQ ID NO: 4108443 - RNA, 70 nt, Human
gcugggaaauuguauuucuauuucaaagaugggacaccaaggcucagaaaaaugaagacaaagucccagc

SEQ ID NO: 4108444 - RNA, 63 nt, Human
gcugggaacauguaccaagucuuguucaaagaucugucuucaacuuuuggcuacaugcuuagc

SEQ ID NO: 4108445 - RNA, 100 nt, Human
gcugggaacuccaggaaggaaggggugggguugaggguggggaagcuucucuauuacccuccuuaccaccacagcuccagccaagcuuggagugaucugc

SEQ ID NO: 4108446 - RNA, 70 nt, Human
gcugggaaggacccucuggggucucagugcccuccccuggcauuugaggccagucuggguccuucaaggc

SEQ ID NO: 4108447 - RNA, 82 nt, Human
gcugggaaggcuugaagcccggagagaccauggggagcagaggcuucuccccagcucugugcuuccacugagccaccccagc

SEQ ID NO: 4108448 - RNA, 95 nt, Human
gcugggacugauugcagucuuugaggagguccuggguuuacucuucuugcugagaucccaccagauguucuucauuggacuccauuacaccaagc

SEQ ID NO: 4108449 - RNA, 59 nt, Human
gcugggagagggggaggguuguagucacuuuugugguugcaggguauccuugucucugc

SEQ ID NO: 4108450 - RNA, 75 nt, Human
gcugggagcagaguuuguauuuuugcuaacuuuuccugcuucugacaggacagcagugcccauucugcccccugu

SEQ ID NO: 4108451 - RNA, 58 nt, Human
gcugggaggcagcaccuuuagcaacccuugaagucugagaacacugugcucuccuagu

SEQ ID NO: 4108452 - RNA, 60 nt, Human
gcugggagucuaagcuagcaccguuugaacuaauuguguacaauuuagcauuccccaagc

SEQ ID NO: 4108453 - RNA, 56 nt, Human
gcugggaguuacugucuccuuuaucaccauuuugaaaagcagaagcugcucucagc

SEQ ID NO: 4108454 - RNA, 65 nt, Human
gcugggaucugaggagaugguggugcugggaagcugcagggccaagggcugcugagguguccagc

SEQ ID NO: 4108455 - RNA, 130 nt, Human
gcugggauucggucucuuuuagggaugggauucagggcaaaagggaaaccauucugugaagauuggcccuagaauggcaccuuugucuuaguuccucuugauuuacuuugggauccuucaaguuucuagc

SEQ ID NO: 4108456 - RNA, 72 nt, Human
gcugggcaacagcaguggguugccagugggcaagaaugaucuccucucuggcacuucauugcugugcccugc

SEQ ID NO: 4108457 - RNA, 55 nt, Human
gcugggcaaugccagagaggagccccccagcgccacaugcucugcauuccccagc

SEQ ID NO: 4108458 - RNA, 75 nt, Human
gcugggcaucucugcugccggccuaggaucaaggcaggaaaaggccaggaaaggagggcagaagagaaguccugc

SEQ ID NO: 4108459 - RNA, 97 nt, Human
gcugggcccccagggaucccacuggauugcaggcucugacaccaggcucuggcuggagcugucuugcucacucuugcagccaucccuggggaacagc

SEQ ID NO: 4108460 - RNA, 69 nt, Human
gcugggccugggcccucaccgccggugguccucuccccaggcgcgccgucggcgggcaccgggccuugc

SEQ ID NO: 4108461 - RNA, 70 nt, Human
gcuggggaacacuacuuuucauaaaaguaagcucagagaaaggcuugcuuuucuagauagugugaauagc

SEQ ID NO: 4108462 - RNA, 62 nt, Human
gcuggggaggaguggccagagcaccggccaaaucuucaugcucuggggagcuccucugcggu

SEQ ID NO: 4108463 - RNA, 57 nt, Human
gcuggggcagccgaggcuggcggccauucugcuagucgccccgaggcagcccuaugc

SEQ ID NO: 4108464 - RNA, 56 nt, Human
gcuggggcugcucacuggcauaucugaaaaggugggccuggcuagaagcuccuagc

SEQ ID NO: 4108465 - RNA, 55 nt, Human
gcuggggcuguaggaggacuuauguugugguuuaagagcuuccuacagcccuugu

SEQ ID NO: 4108466 - RNA, 62 nt, Human
gcugggggcaagaucagaaaacugggccaucaauacagcuguccuuuauuccugcccccagc

SEQ ID NO: 4108467 - RNA, 89 nt, Human
gcugggucaugcugugaugagggggcagcagcccucugccuccgcccagccuccuccugcugcuccccagcacacagcacccacccagu

SEQ ID NO: 4108468 - RNA, 89 nt, Human
gcugggugcugugggugaaggaggggucugugcaagcaugugcacaugugugcagccucugucuuuggugccagacguagguauccagc

SEQ ID NO: 4108469 - RNA, 129 nt, Human
gcuggguggagaccuccuaagaagagguaagagucuuguucuuucucuguaaaaggaaaaugguuuucuaacguuuuacuguuccagagaaagacaaaacgcccaaccuccauuuacaucugucucagc

SEQ ID NO: 4108470 - RNA, 62 nt, Human
gcuggguggugacuguccuagggauggugggauccaguagaccagaauugucagcaccuugc

SEQ ID NO: 4108471 - RNA, 78 nt, Human
gcuggguuacaagcugacccugaagaugaucagacaaggcaaaacgaaauugaucauccucgcuaacaacuacccagc

SEQ ID NO: 4108472 - RNA, 62 nt, Human
gcugguaaacuucuggugccauuggauuagagaaaauucccucaccucugaaaguuuccagc

SEQ ID NO: 4108473 - RNA, 102 nt, Human
gcgcacgcgccccggggcccgucgggccuuauuucacggccccgccuuccuccuccgcgagcgccaaauaaguguccggcccucccagccccgugcgugcgc

SEQ ID NO: 4108474 - RNA, 88 nt, Human
gcgcagccauucagaccccacaguccacauuccuuugagccaguccauugaggguccucagggaauguggcggguccccuggucucgc

SEQ ID NO: 4108475 - RNA, 76 nt, Human
gcgcagcccuccuguccugcaccgugggggcgccgcccucccaggcgggccucggagcgggucagagaggggaagc

SEQ ID NO: 4108476 - RNA, 61 nt, Human
gcgcagggaagacccggagcagcgguuuaccuaaggaacgggccgcgcggucuugcugcgc

SEQ ID NO: 4108477 - RNA, 64 nt, Human
gcgcaggugaugcgucugccuuggccucccaaagugcugggauuacaggcgucagccaccgcgc

SEQ ID NO: 4108478 - RNA, 76 nt, Human
gcgcaguuuuaaugauagcuguuucacaugugcaugcggcacucaugugggcagagcugucagaagacuguaaagu

SEQ ID NO: 4108479 - RNA, 79 nt, Human
gcgcauugagacuuucugaaguuuaaguucuaacuuacgucuucuaaauuagcaaaccuggacuacagaucaaagcagc

SEQ ID NO: 4108480 - RNA, 56 nt, Human
gcgccagcuuuguuuuuacuagagauagauacauguugcugagagcagggcugggc

SEQ ID NO: 4108481 - RNA, 128 nt, Human
gcgcccagccaauaccuggccuuuuaagaaguuugcugacuccugguauggaugacagaaaauggaauaacguuuuguuucuccagucuaggaaaagcaagucagguaguggauagacugacuggcgu

SEQ ID NO: 4108482 - RNA, 95 nt, Human
gcgccgcuguaaguaccuucccgcuucuuccgaaucgcgaagagacgguacugaucgcggggaaguggugggcuaaggggccaagccagcggagu

SEQ ID NO: 4108483 - RNA, 60 nt, Human
gcgccugggcacacagugacucugcacuuucugguccaguuuccuguggcugccuagggc

SEQ ID NO: 4108484 - RNA, 58 nt, Human
gcgcgccucugcccgguguucccccugcccgggcggggaggcuggagagagcgcgcgc

SEQ ID NO: 4108485 - RNA, 55 nt, Human
gcgcgcgcccugacacgcaggcaugcgcgcgccugugggaagucggggagcgcgc

SEQ ID NO: 4108486 - RNA, 67 nt, Human
gcgcggcgcgggcggaggaaggaagggcggcucuaggggcguccuggcuagucguccgcgaccgcgc

SEQ ID NO: 4108487 - RNA, 69 nt, Human
gcgcuaugcuacuucaaccuucucuauuagauaaaguaacugucaguaacuggguugaagcuagagcgc

SEQ ID NO: 4108488 - RNA, 56 nt, Human
gcgcucaccaccaccugcgguugcgucaggaagcgcccgcagguggaaggagccgc

SEQ ID NO: 4108489 - RNA, 76 nt, Human
gcgcuccuggcaggguggcagcgggugacauggaaucaggcuugucuagcuugcuugccgcucuccaagugagcgc

SEQ ID NO: 4108490 - RNA, 75 nt, Human
gcgcugcgccuccucuuccgcagccccguccgcaacccgucgcuggcggagagggugguacaauuggaacagcgc

SEQ ID NO: 4108491 - RNA, 61 nt, Human
gcgcuggaaauugccguuggcuuuauacaucucuauagagagaggcuaaagagucuugcgu

SEQ ID NO: 4108492 - RNA, 89 nt, Human
gcgcuggggaaggucgugauuucccacucaggccgcggcgcuaaggagacgcuuguccgaggucccgugggaucuccgacccucggggc

SEQ ID NO: 4108493 - RNA, 80 nt, Human
gcgcuggugagcggcgccgagcuuggccaggccgccacgucggcgagcgcgggcaaacccaggcuggacgccgccagugc

SEQ ID NO: 4108494 - RNA, 130 nt, Human
gcgcugguggacacgguagucacuggcacucuaaauguggcuuuuaugacugaggacauaaauguuuaacuuugauuguguuauaucuaaauagccacauguggcuaaaggcuacuguguugaacagcac

SEQ ID NO: 4108495 - RNA, 77 nt, Human
gcgcuuagaagauucugaaauuaacagacuggacugaauauuuucauuuuaguccuaaauuuagauuuucuuaguac

SEQ ID NO: 4108496 - RNA, 130 nt, Human
gcgcuuagcaucgcguguucucuuggaagucguacaggaagcccuggcaaugucagaugagggguauucuaauuugagcuaugggcaucuggauacgaauucuuuugggggcucaugaagggauaggugc

SEQ ID NO: 4108497 - RNA, 68 nt, Human
gcgcuugcagacugccuucaugcagaccccugacuccagcacgucugggcugccagguaggcacacgc

SEQ ID NO: 4108498 - RNA, 101 nt, Human
gcgcuugcgcaggaagucugcggcaggagggcguccucuugacucuaggagagcugggagggggagggaaagcuugaucugucucggagccugcgcagugc

SEQ ID NO: 4108499 - RNA, 86 nt, Human
gcgcuuggcuggguggugguaguaguaguaguaauuguuauucuuuauuuauuauuauuguugcggcuguuaccguugucauucgc

SEQ ID NO: 4108500 - RNA, 88 nt, Human
gcggaaugcuccuggugaaacacaaugauuuguaaaacaacuguggcgggguucucagagauuuuguuucccuuaggagacauuuggc

SEQ ID NO: 4108501 - RNA, 77 nt, Human
ggaccaaggcagggaccagaggaaugggaggggaggcauggcuggcccucacucagguuuggacccugccucgggcc

SEQ ID NO: 4108502 - RNA, 59 nt, Human
ggaccacagcacuuggcuugagaguaaaauccaacucagacccagguuaucugaggucc

SEQ ID NO: 4108503 - RNA, 70 nt, Human
ggaccaccgcagacacugaggguccggggugcucaccgcucccgucuugcuguugucugcguuacagucu

SEQ ID NO: 4108504 - RNA, 68 nt, Human
ggaccagcuccggucccugcccuuucuggucuuuugcagcuggaaauccagaugcuggaucuuggucc

SEQ ID NO: 4108505 - RNA, 67 nt, Human
ggaccauaagauucauguuaaacuuagugccagaaauaaccuuggguagccauguuccuuaugguuc

SEQ ID NO: 4108506 - RNA, 99 nt, Human
ggacccaaauuguaguaagguuuuacguucccacuagaaaugguaaaauauugagucuaaguagaaugugaaaaguuaaaaauuuauauauuauggucc

SEQ ID NO: 4108507 - RNA, 60 nt, Human
ggacccaagagaucgcauguaguugauaguaaucuccuuuugucuauuucuugguuuucc

SEQ ID NO: 4108508 - RNA, 78 nt, Human
ggacccacacagauccugccaauggaagcagguggggcucugccauccucugcugcagcaggauucucugugcacucc

SEQ ID NO: 4108509 - RNA, 57 nt, Human
ggacccaggaugcuggaacucaggccuucggccuagaaagacagagguuuugucucc

SEQ ID NO: 4108510 - RNA, 93 nt, Human
ggacccaugcugucuuggucaugcuaugucucagcugcagaagugaccuggugcuagaaaucugaaacuagcauuccaccgggaugacaaucc

SEQ ID NO: 4108511 - RNA, 112 nt, Human
ggacccccuuuccugcaccucuccccuuccugagccccccggcuguccuccaccacagccagagggaacugggccucauuagggggacaguuuguuccucauuaggggcacc

SEQ ID NO: 4108512 - RNA, 61 nt, Human
ggaccccggagagggugccuggaagccaggcugggcagguauggcugcauccucugggucc

SEQ ID NO: 4108513 - RNA, 76 nt, Human
ggaccccugggcuccaggaucacugccuggggccccugagugcacccacagguucuggguccuggguccugggucu

SEQ ID NO: 4108514 - RNA, 72 nt, Human
ggacccugagggagcaagaggagaugauggccccuagcuccacagcuccuaacaaaggcucucucugggacc

SEQ ID NO: 4108515 - RNA, 56 nt, Human
ggacccuggagccgucugaggcagguccuuccuggcccuguccgugauuuaggucc

SEQ ID NO: 4108516 - RNA, 77 nt, Human
ggacccuuauuaaggcguuggcgugcuuauuuauggaacauuaaauaccguuuguuugcgcugugacgaggccaucc

SEQ ID NO: 4108517 - RNA, 61 nt, Human
ggaccucgguguugggaacguggucuuccugguagacacuucccuucucugcucauggucc

SEQ ID NO: 4108518 - RNA, 55 nt, Human
ggaccucucugcuugcuggauagccaacuuugaugguaagcaggcugcagaggcc

SEQ ID NO: 4108519 - RNA, 77 nt, Human
ggaccucugauucucaaaacauaacuucacugcuccgcucacacaauugcagucaaggaauugaggacuagagguuu

SEQ ID NO: 4108520 - RNA, 70 nt, Human
ggaccucuggcauucuuguuucuggaaauauugacuguuuuuuacacaggagcaagagagccaucugucu

SEQ ID NO: 4108521 - RNA, 66 nt, Human
ggaccucuuauucucaaauagugacauauucuccguagucacuguuucagaacugaguaaggaucc

SEQ ID NO: 4108522 - RNA, 64 nt, Human
ggaccugcuuucccuggccuucuucucccuacuugucagagaauccuggccaggucagagcucc

SEQ ID NO: 4108523 - RNA, 60 nt, Human
ggaccuggaggcuuuucccaagacaucaugauggagucuucagggucugccccaggggcc

SEQ ID NO: 4108524 - RNA, 62 nt, Human
ggaccuggugacuggugcucuaggacacuuacucaugauuauuagagcaugaaguccuaucc

SEQ ID NO: 4108525 - RNA, 62 nt, Human
ggaccugguggggcuuuccuucugcuuggccauacagaguagagagaagccuggccuuugcu

SEQ ID NO: 4108526 - RNA, 66 nt, Human
ggaccugucuguuuuucuugccauaccugagaucaucagaaauggcauugcaagggcaggaggucc

SEQ ID NO: 4108527 - RNA, 58 nt, Human
ggaccugugcacagucagcccuggggggagccugucccccaagccuggcacgggaucc

SEQ ID NO: 4108528 - RNA, 93 nt, Human
ggaccugugcugucuguuugcucuggggucugggcaguccuguuguuuggguagaggccucagagggcccuagggacagacugacccaggucu

SEQ ID NO: 4108529 - RNA, 70 nt, Human
ggaccugugucuacagcaugugcaaccccaacuuuccuuuaugccuugcuuugccuggacaaucaggucc

SEQ ID NO: 4108530 - RNA, 55 nt, Human
ggaccuuauagauucucuguagcugcuuggcaacagaaaucauuuguaagguacc

SEQ ID NO: 4108531 - RNA, 74 nt, Human
ggaccuugaacaagaagcuguagggauuaacucccucccuugggcagucugucccugcccuucuaucagggucc

SEQ ID NO: 4108532 - RNA, 62 nt, Human
gcugguagaagcuaagaagagagggucugauggaagagucuagaacccucuggcuucugagc

SEQ ID NO: 4108533 - RNA, 68 nt, Human
gcugguagaccucacugcacucacugucuaaauuguccauggaguuacugugcugaugguccauuagu

SEQ ID NO: 4108534 - RNA, 77 nt, Human
gcuggucugggccaaggccucugcaggaugaguaguagcuguuccugcugggcuuugggcagccccuagacccuagc

SEQ ID NO: 4108535 - RNA, 108 nt, Human
gcuggucuguuucucugcuauaauuaugcucaaaauguaggcauucauauaugcucaggagugcuuguacaugagcugaguguaauuacagguaauaaagaagaaagc

SEQ ID NO: 4108536 - RNA, 122 nt, Human
gcuggugagccuguccaacuaaucugccucguuuguuuucacagcuuugcccggaacauuugcagggauggcccgacacuccccgcagagccugagagcgaguggcgagccaagauaccagc

SEQ ID NO: 4108537 - RNA, 102 nt, Human
gcuggugcccaggggugugguaacuguagaugugauuguuuguaccucuggcuuccagagacaaugccaaugcacacguggcccagauuccuguuucccggu

SEQ ID NO: 4108538 - RNA, 68 nt, Human
gcuggugcccucccuguacugucaggaggccagagggcccuucuccagcucaucagggagggaacugc

SEQ ID NO: 4108539 - RNA, 80 nt, Human
gcuggugccuccaggaggaggaaggcugccaggcuuccuggaugacagaucucagcccccuuuucuuggauagcaucugu

SEQ ID NO: 4108540 - RNA, 64 nt, Human
gcuggugggacaaagcuuugccaacccuucauggaggucuggagccaguguugcccaacacagc

SEQ ID NO: 4108541 - RNA, 61 nt, Human
gcugguggucaguuaggcaaucauguccagggagggaucuggugucucacuguccagaggc

SEQ ID NO: 4108542 - RNA, 86 nt, Human
gcugguuaugaaugaggauccuugaccuuaucacaggccuacuaaucacaaucucuaggguaaggcucaggaaucuccuuuucagc

SEQ ID NO: 4108543 - RNA, 70 nt, Human
gcugguugcauuucuccaccuuaacugugccugacaggcagcagagcauggugggaagggccugcacagu

SEQ ID NO: 4108544 - RNA, 68 nt, Human
gcugguuuguccuuuccaaaggacaaucuuauccuacauaagacugagacuggggaaagacaggaagc

SEQ ID NO: 4108545 - RNA, 73 nt, Human
gcuguaauaaacuggaagagugaauauaacugguuuucucaguccugugaguuuuucuaguuaccuguugagc

SEQ ID NO: 4108546 - RNA, 80 nt, Human
gcuguaaugacugcugcuuuauagggcuuccauguccuuagccacaugacaagguuuauaaggcuugccaucuauccagc

SEQ ID NO: 4108547 - RNA, 83 nt, Human
gcuguaccugcauugugcccucaaagggugcgucuucuuguuuugaggaccugcccacucugaggacaucuugugggaccagu

SEQ ID NO: 4108548 - RNA, 77 nt, Human
gcuguagagggccgaggcuuauaggugcuuccagggggacacggacccuggaaugagcagggcuuaugguagacagc

SEQ ID NO: 4108549 - RNA, 67 nt, Human
gcuguagcagccccucccaaccuccccuuccuguggcugccccagagccugugagggaugcugcagu

SEQ ID NO: 4108550 - RNA, 61 nt, Human
gcuguaggaaggaagagaggagcuuucucuggcuccugcuugaaacucugccuuccugagu

SEQ ID NO: 4108551 - RNA, 58 nt, Human
gcuguagugaauggccgcguucuggcccuggucccgguccguggccugcacucgcagc

SEQ ID NO: 4108552 - RNA, 90 nt, Human
gcuguaguuuuuaauguagugcuucauuaauauuauuaauauuguuguuauacacguuuauggagcuacuaggaaguugaugagcacagc

SEQ ID NO: 4108553 - RNA, 56 nt, Human
gcuguauccauacuaauugcuaaaucccaugggaucucacuaagaugagauauagc

SEQ ID NO: 4108554 - RNA, 60 nt, Human
gcuguauucaacagugaaaagagaguucgguuggauauuauagucggugauggacacagc

SEQ ID NO: 4108555 - RNA, 119 nt, Human
gcuguauuucuucuccuuugacuuagaauggaagguugagaagaacuguggccuguucaaccccaggccuucucuuagcacuuuguguuacuguguugggggccaaaaaggaaucaggc

SEQ ID NO: 4108556 - RNA, 56 nt, Human
gcugucacaaauuggguucuuuggaaacagaugcugagacauaguuuguggcaugc

SEQ ID NO: 4108557 - RNA, 86 nt, Human
gcugucacaugcccaggcaauaaaggguugguugggaggcacaccugcuacccuuucuuuuaucgcugggagcaaacaaugccagu

SEQ ID NO: 4108558 - RNA, 74 nt, Human
gcugucagcccagguccuccuccuccaggaaggcuuccucgagguccugggaggcaggaccccuuuccuacagc

SEQ ID NO: 4108559 - RNA, 78 nt, Human
gcugucagcugcccagauguggcucuggcuuuccaggcgggacuuuuugcuuguccucagccacugugcacugauugc

SEQ ID NO: 4108560 - RNA, 72 nt, Human
gcugucagucacauuguuacagauuucuaagucaauuguauuccgaucagaaaauacagucugccugacagu

SEQ ID NO: 4108561 - RNA, 113 nt, Human
gcuguccccaggccugcaccauacgaagcauccguugucuuugggggccccgcaggagggcuguauccacagagacaggguccuugcucuuuauuccagcugguggggacagu

SEQ ID NO: 4108562 - RNA, 60 nt, Human
gcugucccuaauuugauuuuaaauagccacauauagccaguggcuacugauuuggacagc

SEQ ID NO: 4108563 - RNA, 73 nt, Human
gcuguccuaauuauggcacauuuuuacuuucuagguucugugauuuacagaguggucuggcuauguggacagc

SEQ ID NO: 4108564 - RNA, 59 nt, Human
gcuguccuggggagggagaaugaucuggggugagauaaugcuccuuggcucaggacagu

SEQ ID NO: 4108565 - RNA, 88 nt, Human
gcugucgacuuaacuuuugccaguuucccuggauguguaaguagaauuauauuuucacagaacuugcaaaaaucucagacucggcugc

SEQ ID NO: 4108566 - RNA, 61 nt, Human
gcugucggccuuuggcuucuccuguguucuagaaccaggaguuuugaccaggggcggcggc

SEQ ID NO: 4108567 - RNA, 84 nt, Human
gcugucuacagugaugagggaauuuugugcacuccacauugcuuuccaguacuagugccauagacauucagcacucacuacagc

SEQ ID NO: 4108568 - RNA, 81 nt, Human
gcugucuagugguuuauaaaaucagauuccucucgacaaucaggacuuuaaauguauuuuuagaccuuuagaccaacuggc

SEQ ID NO: 4108569 - RNA, 58 nt, Human
gcugucucgccugacacuggcuuuccugcccacagcgggggacgggcaggcgggcagc

SEQ ID NO: 4108570 - RNA, 86 nt, Human
gcugucucggggccaccacugggugugccgcugccuggccgggggcuuaugccucccaugccauacuggccacccgggcccucagc

SEQ ID NO: 4108571 - RNA, 76 nt, Human
gcugucucuccaguugggauucuugguucugggguccucccgccccaaccaaggaugcccagcuggccaagucagc

SEQ ID NO: 4108572 - RNA, 56 nt, Human
gcugucuggcauggcguggcuggugcucuguucuggccaccucgucucggagcagc

SEQ ID NO: 4108573 - RNA, 121 nt, Human
gcugucugucuaaacgaagaucuuuuccucgaugucccuaaagaaacagacauuuggguauagccaacuguuagaagaauuuagggggauagaggagagucaucuuacagaaugacagagc

SEQ ID NO: 4108574 - RNA, 57 nt, Human
gcugucugucucugucccaccacuuucuaggcugugauuggguccagggauuacagc

SEQ ID NO: 4108575 - RNA, 68 nt, Human
gcugucugugagaggucacugccaagcauggcacagccauugcuccaggugugccucucauggaaggc

SEQ ID NO: 4108576 - RNA, 89 nt, Human
gcuugucauugaguguucuuugcuguugauguagaagauucucuugaagaaaucugcauaauugcagacacaaacaauggccuuugagc

SEQ ID NO: 4108577 - RNA, 65 nt, Human
gcuuguccuauugcugaaucuaaggcuuccaguacaauguucacuggaaagcauuaagggcaggc

SEQ ID NO: 4108578 - RNA, 129 nt, Human
gcuugucuacccuccagcauuggaacccucuuagaaggcuaaucaauucccaucguggcaacuucuccccagugccacaguuguuugugcucuagaggacucuaacacugcuccuuuuagaaacuuugc

SEQ ID NO: 4108579 - RNA, 59 nt, Human
gcuuguggagagauuuugaggagguuccaggagagaagucuggaagguuucucuuaggu

SEQ ID NO: 4108580 - RNA, 112 nt, Human
gcuuguggcccugguuuuccaucaggugaccugagccacuauggguuaccccuuccauggcaucuguguggccuccaagguuccugaagagcagacaucuugggccaugggc

SEQ ID NO: 4108581 - RNA, 105 nt, Human
gcuugugggcuggacccuggagcccagcugcacccuggugggucccaggcggcugagcagagggcucggacagugugcgucuggccucgggguccucccaucugc

SEQ ID NO: 4108582 - RNA, 67 nt, Human
gcuugugggugugcccugggagaucccuuuuccuuggccacugggcucuccuggguccaacccaugc

SEQ ID NO: 4108583 - RNA, 59 nt, Human
gcuuguguguaugugugugugugugugucuaugcaugaacacaauacgugcaugcaugu

SEQ ID NO: 4108584 - RNA, 93 nt, Human
gcuuguucaaacacagauuucuuugucccaucuccagaauuucugauuuaguaaaggugggauaaaccuugagaauuugcguuucuaacaagu

SEQ ID NO: 4108585 - RNA, 105 nt, Human
gcuuguucuucaccuuggcucuauugccuguagcauccccuucagcuuuuucuugggcauggcagugaugcggcaggacauaugcuauggaugcaggaaugcagc

SEQ ID NO: 4108586 - RNA, 74 nt, Human
gcuuguucuuugcaaagucuuuggcaagacauuuaacugucuggccagugaaaugcagaauaguggaaucaggu

SEQ ID NO: 4108587 - RNA, 96 nt, Human
gcuuguuucuagaacucuggccauugugacccagggccugauugucaccaugccacuguacucaacaauaguuuucagguuuuuagauacuucugc

SEQ ID NO: 4108588 - RNA, 63 nt, Human
gcuuguuugcacauuguuuuaggaauucagaacacauuucccauagaaacaaugcagacaagc

SEQ ID NO: 4108589 - RNA, 106 nt, Human
gcuuuaacaugugagaauguguguucggggcccagagaaagggccuggcuauugugaaaccucagcucuggagucccgacccgcacugcagucagcaugcuggggu

SEQ ID NO: 4108590 - RNA, 61 nt, Human
gcuuuaaugcuucguggggccaaagggaucccagcuuacccuucagcgagggcauuaaggu

SEQ ID NO: 4108591 - RNA, 55 nt, Human
gcuuuacacaugagaccugcaauaauuguuauuauucggugugaugguguggagc

SEQ ID NO: 4108592 - RNA, 77 nt, Human
gcuuuacucgaaauuuacuaagguguuucuuuugugguucuuguaaucuacaauccaacaguguuuuugaguagagc

SEQ ID NO: 4108593 - RNA, 63 nt, Human
gcuuuagacugagugguccauuauuguaguuaguguacugcaaaugcccauuuauuuucuggc

SEQ ID NO: 4108594 - RNA, 65 nt, Human
gcuuuagcucaggcuucuucuauaaagauugucucauggucuuagauggcagcuagagcuccagc

SEQ ID NO: 4108595 - RNA, 69 nt, Human
gcuuuagcugacuagaaaacagcucaguagaaaauuauuuuacaaagauuauauucaguuagcuaaggc

SEQ ID NO: 4108596 - RNA, 87 nt, Human
gcuuuaguggaguucaaguuagagauauauuuaguuuugguuaaaugggaccuauuuaugugguuuucugacaauuucacauauagc

SEQ ID NO: 4108597 - RNA, 72 nt, Human
gcuuuauccaaggguuuuaacuguaaaacacagucaucugaguaauaagcaggucaaaucuuuggauauagu

SEQ ID NO: 4108598 - RNA, 69 nt, Human
gcuuuaugagugaggcaggauaaccugguagagaaauuagguguuuuuuccuuccuucucucaaaaggc

SEQ ID NO: 4108599 - RNA, 92 nt, Human
gcuuucaaaaacucccaaguccaggugggcaaauaaagaaggaaacuaauuuuguuucugcaauaccuauagauuuucaaguuguuuaaagu

SEQ ID NO: 4108600 - RNA, 77 nt, Human
gcuuucacacguaguggguggaaaugacuacagcucuuuuacaguuuuguguaguagcauucacgaagugugaaagc

SEQ ID NO: 4108601 - RNA, 56 nt, Human
gcuuucacagucauaugaugaauuuucuuauagguuaccauagagacuaugaaagu

SEQ ID NO: 4108602 - RNA, 106 nt, Human
gcuuucacguauuucccaggucaucuggcuuuuacugaauugcucccacauuccugacagcaaagucaguggaaccauccuaugcuuggaacacauguuugaaggc

SEQ ID NO: 4108603 - RNA, 69 nt, Human
gcuuucacucauuugcagacguccucucugaugacagugcagaggauucacugcagaagacauggaagu

SEQ ID NO: 4108604 - RNA, 94 nt, Human
gcuuucaucauuuuauaauacugccaacaauacugagcauuugauagugaacaggucuacaguuuucuugggaguuguauaaauaaggugaagc

SEQ ID NO: 4108605 - RNA, 58 nt, Human
gcuuuccauguggcuugggcuuccucacaacaugguggccuagggcaagugggugggc

SEQ ID NO: 4108606 - RNA, 80 nt, Human
gcuuucccugcagcuacgcaugacugaguucuagccaaagagaguaaggaggguacaauggguggaaaucaugggaaagu

SEQ ID NO: 4108607 - RNA, 55 nt, Human
gcuuuccuggcugucacucggguugaagcuugcuuugcucuacagugagggcagc

SEQ ID NO: 4108608 - RNA, 96 nt, Human
gcuuuccuuuguuuaaucauuuauaucuucucugagaacacugagcuaaaguuuaauauuacagaaagggaugauugaucuaaaugccaacaaagc

SEQ ID NO: 4108609 - RNA, 125 nt, Human
gcuuucucaaugucuuuggacagcaggaggagggugauuuggaaaugacucugccugacuugagaagaaggaagaagcaugcugggucauuuuugccuuguuucuagcugcaugaauugaaaagc

SEQ ID NO: 4108610 - RNA, 62 nt, Human
gcuuucucagauuccccuuuuaauauugugauguaaaggagggaaauuuugguaaaggaagu

SEQ ID NO: 4108611 - RNA, 89 nt, Human
gcuuucugaaacacaguuauauguucacaaggacugaccaauccugauggucuaauucauuagugucaugugacugucagucuggaagu

SEQ ID NO: 4108612 - RNA, 63 nt, Human
gcuuucugaagcaguguuucucaaagggugguccagcaucaccugggaacuuguuagagaugc

SEQ ID NO: 4108613 - RNA, 92 nt, Human
gcuuucugaguuucugggacaggcuuacuguuucauaggguggagugaccuucccaaagcagcuuggccauguucuccggaugucaggaagc

SEQ ID NO: 4108614 - RNA, 68 nt, Human
gcuuucuggcucucugauuucacauuccgaagaccaggagugaaaaaggaagggccauaauuuaaggc

SEQ ID NO: 4108615 - RNA, 81 nt, Human
gcuuucuuuuauucuacaucacuuaacaugcuaauuucuuaguaaauaauuaagugauggguaauuuuagguaaggaaagu

SEQ ID NO: 4108616 - RNA, 56 nt, Human
gcuuucuuuucaagaauguauuuccauacuucuuuuggguuucuagaaaagaaggu

SEQ ID NO: 4108617 - RNA, 66 nt, Human
gcuuugacacagaucaauauucaacuuagcaagaaugagaugaaaggaauugauuuguguucaagc

SEQ ID NO: 4108618 - RNA, 74 nt, Human
gcuuugaucuguaguccagguuugcuaauuuagaagacguaaguuagaacuuaaacuucagaaagucucaaugc

SEQ ID NO: 4108619 - RNA, 69 nt, Human
gcuuugauugaaguguucuguuccaggcagccucaaugauugcuuguucacagagacucuaauccaugc

SEQ ID NO: 4108620 - RNA, 69 nt, Human
gcuuugcaaguuaugaagcugguccuguuggcauauaugacuuccaauuucagcucaaacuuguguugu

SEQ ID NO: 4108621 - RNA, 59 nt, Human
gcuuugcacucugauccuucccaauguucagauagcaagauggagugaagagugaaagc

SEQ ID NO: 4108622 - RNA, 69 nt, Human
gcuuugcagccaagaagcaagaaggagccucgcccuauuggggcugccccagugcucauggcugaaggc

SEQ ID NO: 4108623 - RNA, 61 nt, Human
gcuuugccaauggacgguuggcugugauuuccagggacaguuguucuuccagaagcaaagu

SEQ ID NO: 4108624 - RNA, 67 nt, Human
gcuuugccuugaacucucauguuguguacaaugaagaauauaaagacauggacuucuggguaugagc

SEQ ID NO: 4108625 - RNA, 94 nt, Human
gcuuugcgcuaauggacuguuauaaaaugcacaguuguuucuugcagucacugccaaaugccucccauucuacugacaguuuugugcauuaggc

SEQ ID NO: 4108626 - RNA, 55 nt, Human
gcucccugcugggagaugaccuuauuuccugaugggucccaggccagcugggagc

SEQ ID NO: 4108627 - RNA, 87 nt, Human
gcucccuuaccuaccucuuaggauaguugugaagauaggcugagauaacggauaacuucagauuaaguucgaaggagguguuggugc

SEQ ID NO: 4108628 - RNA, 62 nt, Human
gcucccuucuggggaggagcugaccaaaaugucguccagcuccugcuugacagaagaggugc

SEQ ID NO: 4108629 - RNA, 55 nt, Human
gcucccuuuaggcuggguauggugucucucagcacuuugcgaggccaaggcgggc

SEQ ID NO: 4108630 - RNA, 73 nt, Human
gcuccgggagugguaaugagcagauuaggguuauuacagccgaauggcucagagcgcacuugcucacccgagc

SEQ ID NO: 4108631 - RNA, 77 nt, Human
gcuccggggcugcugggaggucucuugcggccuaggccaggcucagggccgccggggaucucgccuccaucccgugc

SEQ ID NO: 4108632 - RNA, 73 nt, Human
gcuccuaaacaaacauccugcccuaauccagagacuagguuggugcuuauuggggggcggugagugggggagc

SEQ ID NO: 4108633 - RNA, 63 nt, Human
gcuccuacuuccucuguggcuucacccuugggugccaccccuguagagggacagacugggagc

SEQ ID NO: 4108634 - RNA, 81 nt, Human
gcuccuagagagacauuuauucacacauuuauuuuuaaagaagaaaagaauaaguauguauagugaguggccuccagaagc

SEQ ID NO: 4108635 - RNA, 57 nt, Human
gcuccuagugagauccgggggauuaguuuccaaaucuggaaugguacucacuggagu

SEQ ID NO: 4108636 - RNA, 114 nt, Human
gcuccucacagcuccagaaaucugugaagccgagaugguauuuuuaacgcagccauuuuaaacaaugucugugccgaaccacuuuugcuuucgcuguuggcgcaggugaggagc

SEQ ID NO: 4108637 - RNA, 93 nt, Human
gcuccucauuccaagcguagauuugggccaaggcugaaugcuuaagcuguuuaaaaagaauuuccuucccagauuugguucucuaaaaguagc

SEQ ID NO: 4108638 - RNA, 70 nt, Human
gcuccuccggaaauuagaccuuuggaaaucaaugcagaguuucuauuacauuucuggacauucagagagc

SEQ ID NO: 4108639 - RNA, 105 nt, Human
gcuccuccucaucgucguccgugucccgggggccgggggcccgggaacgagcccggcuggagcugccagcccucggggucugaguggcuguugaggugugggagc

SEQ ID NO: 4108640 - RNA, 83 nt, Human
gcuccucuuucucuucucagcacggcauuccuccuucccucucgcucacugagggagacaaucuggcucagaagaagaugagc

SEQ ID NO: 4108641 - RNA, 72 nt, Human
gcuccugaaugcccaccuaacaguguuuggauuguuuccuaagugcaaauccuguuuggaguaaguuggagc

SEQ ID NO: 4108642 - RNA, 56 nt, Human
gcuccugcaggacccaggagacacccaaauacagugacuuccccaacugcaggagu

SEQ ID NO: 4108643 - RNA, 63 nt, Human
gcuccugcccagcagccuccggggcagugugggccaauuguccugucaggcugggggcugagc

SEQ ID NO: 4108644 - RNA, 73 nt, Human
gcuccugcccaucuccgagccauucgcaggggaaggccuggaaugagagcccggggauccugggaccaggagc

SEQ ID NO: 4108645 - RNA, 74 nt, Human
gcuccuggaaggccuguggcugcugagggcugccuggucccccucaggacggccgggggagccucuccagaagc

SEQ ID NO: 4108646 - RNA, 62 nt, Human
gcuccuggagagcagggacccuggcuuauuagcagcucagcagccagucuguuuucuagugc

SEQ ID NO: 4108647 - RNA, 88 nt, Human
gcuccugggcucuugcuggugucgugccuucacuggugacacuuccugaacuuaaccaguggauggacaugggcaagaggccaguggc

SEQ ID NO: 4108648 - RNA, 69 nt, Human
gcuccuguaaagagcuaaaguauaaggggcuuaaaaaaauauucaaugcuuuuguucuuuacucacugu

SEQ ID NO: 4108649 - RNA, 85 nt, Human
gcuugcugguggagagcccuggcagucugggauggagccccugugagcccaaguccccaagcaugccaggcaagccaccauaagc

SEQ ID NO: 4108650 - RNA, 84 nt, Human
gcuugcuuccugagacaacauugaguacuugguuuauuguuaugaucauuauagcucugguucucuuagaguaguggagcaggc

SEQ ID NO: 4108651 - RNA, 83 nt, Human
gcuugcuuucccagcagacccugucuggagcuggcacagagcauccucuguuccagauucggcgugggacguuggaagcaagc

SEQ ID NO: 4108652 - RNA, 115 nt, Human
gcuuggaaacuuacuaaaaauauaauacaaauuauuggaucccacaccagacuuacuaaaucagcaauucugggaguggguccaaggaaucuguacuuuaucaagccuaccaggu

SEQ ID NO: 4108653 - RNA, 61 nt, Human
gcuuggaacuauggaaguuggcucggcauaggugucagagcuggagaaguggauuuaaagu

SEQ ID NO: 4108654 - RNA, 67 nt, Human
gcuuggcagcaacaggcauccccgagacaccaagggccaggugaugucucuuuuucgugcuccaagu

SEQ ID NO: 4108655 - RNA, 73 nt, Human
gcuuggcccuaggcugcccaugaguuugccaaagguguacuguagcccacucugaggcaggucagggcagagc

SEQ ID NO: 4108656 - RNA, 57 nt, Human
gcuuggccucauccauuucaguuuaacuuuuguauaaauugaugguauggguuaagc

SEQ ID NO: 4108657 - RNA, 75 nt, Human
gcuuggcuaaccuaguucaacaacugucuguaacccaaagcagaauggaaucaggaacuaguuagcacuacaagu

SEQ ID NO: 4108658 - RNA, 69 nt, Human
gcuuggcucucuggggccugaguuugaaaagggccacggaggggccgguagccaggccucaaguuaagu

SEQ ID NO: 4108659 - RNA, 79 nt, Human
gcuuggcugaagagguuggugagugguagagcugggucacuguggcucuuccgccaccagccacaccuuccauggaggc

SEQ ID NO: 4108660 - RNA, 57 nt, Human
gcuuggcuggagaaaguuaccucuuuuuaucaaaaaugugacuuagcccaguccagc

SEQ ID NO: 4108661 - RNA, 71 nt, Human
gcuuggcugguuuuaauacaugccauaauuacagauacuaaguuggcagguuucguuaaaaaugguuaagu

SEQ ID NO: 4108662 - RNA, 63 nt, Human
gcuuggcuucuugcagcagggugaauucacucugcgccaggguguucauucugcuguccaggc

SEQ ID NO: 4108663 - RNA, 55 nt, Human
gcuuggcuuugucuuguucacugucacagccugagcaucuaaaacagagccaggc

SEQ ID NO: 4108664 - RNA, 129 nt, Human
gcuugggaagacuaugugagggagagugcugggguaugagcagagaagagucuggccucucuuuuggcugaucugccccaacuagagaaccaugcucuuuuccauuuccaauccuuuccuuccccgucc

SEQ ID NO: 4108665 - RNA, 72 nt, Human
gcuugggccuggaaggcagagguugcagugagcugagaucaugccacugcacuucagccugggugacaaagc

SEQ ID NO: 4108666 - RNA, 57 nt, Human
gcuuggggcuccuguaagcaagaacucaaagguccuugagaggacagagccauaagc

SEQ ID NO: 4108667 - RNA, 129 nt, Human
gcuugggucuuguuuggucaauuggucaaagacuggauucucuuuguuuuacucagaggcaugcuugauauccaugccuaaaagaaaauaaacauuaaguuaaagacaauguugaguaaaagauuauuc

SEQ ID NO: 4108668 - RNA, 65 nt, Human
gcuuggguucgauguauauguagcccgggcauggggcagggcuucuuaacauuuggacaccacgc

SEQ ID NO: 4108669 - RNA, 60 nt, Human
gcuugguacucccuugggaugguucaguagagaugaggcaggcagaaggaaguaccaggc

SEQ ID NO: 4108670 - RNA, 69 nt, Human
gcuuggugucugaaaauaugauuuugccuggagaggauccaaggcugucaucuuugcaggcagcauggc

SEQ ID NO: 4108671 - RNA, 116 nt, Human
gcuuguaaugugucauuccuuuuacugugucacaugguuuacugcagcauaucccuacaaaauuuauauugugcugugcuggagugacugguauguuggaguggauuuuuauuagc

SEQ ID NO: 4108672 - RNA, 91 nt, Human
gcuuguaggagauauaagacucuccugaggaaaagcuuggucagguguaccuggagaaagcucccaggagguucuaauaccuucccacugc

SEQ ID NO: 4108673 - RNA, 57 nt, Human
gcuugucugugguucuaaugguggcugugcuccuccaugcuccagcuccagacaggu

SEQ ID NO: 4108674 - RNA, 78 nt, Human
gcuugucuuuugcuuuucauccaagaucuccaaucauaaccagacugcugagacaguggauaggggcuggagagaagu

SEQ ID NO: 4108675 - RNA, 78 nt, Human
gcuugugauaucugauguucaacuuaauauguaaguuuuaugagcuuuuaauacguaaguugaacaucagaaacaagu

SEQ ID NO: 4108676 - RNA, 83 nt, Human
gcuugugauuucacuccaucuuugcuacugguuuugacaacagggaaucauuuaaagacuuuaggcaguguagugacgugagc

SEQ ID NO: 4108677 - RNA, 100 nt, Human
gcuuguuacaggaacagccaggaggccucagcccuguccacagccucuguccagguccguccacagcucugaggucucccugcugugacccuuggcaggc

SEQ ID NO: 4108678 - RNA, 55 nt, Human
gcuuguugucaauguuaauuguucagguaaggcuuacaaaguauugaggacaagu

SEQ ID NO: 4108679 - RNA, 72 nt, Human
gcuuguuuuaggggcaugaaauucuuauagauaacaacauuucugagaacaucauuuccuacaacgacaagc

SEQ ID NO: 4108680 - RNA, 90 nt, Human
gcuuguuuugcucucagaagcuuccaguauggauuguagcauguguuguggccccauuugggaaucuuccauggaaggagcaaagcaggc

SEQ ID NO: 4108681 - RNA, 97 nt, Human
gcuuuaauuucuuggaccauuuuuacagagcauucauuuuucagcuauuacgaugaacaaaauugauuguuuuggaagaaugucuagggcuuauagc

SEQ ID NO: 4108682 - RNA, 93 nt, Human
gcuuuagcuacuauuguaguggccaaagaacucuugggaaaaagaccaagcuauuucauuuuggucacugcugggagcuaauauaugcaaagc

SEQ ID NO: 4108683 - RNA, 69 nt, Human
gcuuuauggaaucaaagacuggaaggaaaucaaagcacccuuccauccagcuccauuauuuuauauagc

SEQ ID NO: 4108684 - RNA, 89 nt, Human
ggagaaucacuugaacccaggaggaggagguugcagugagcagagaucaugccauugcacuccaucuugggcaacaagagugaaacucc

SEQ ID NO: 4108685 - RNA, 88 nt, Human
ggagaaucacuugaacccaggaggcagagauugcagugagccgagauugugccacugcacucuagccuaggugacagagugagacucc

SEQ ID NO: 4108686 - RNA, 87 nt, Human
ggagaaucacuugaacccaggaggcagagguugcagugagcugagaucgcggcacugcucuagccugggugacaagaaugaaacucc

SEQ ID NO: 4108687 - RNA, 88 nt, Human
ggagaaucgcuugaaccagggaggcugagguugcagugagcugacaucaugccacugcccuccagccuggaugacagagugagacucc

SEQ ID NO: 4108688 - RNA, 86 nt, Human
ggagaaucgcuugaacccaggguggagguugcagugagccaagaucgcaccauugcacuccggccugggugacagggugagauucc

SEQ ID NO: 4108689 - RNA, 88 nt, Human
ggagaaucgcuugaacccggaagguggagguugcagugagcugagaucacgccacugcacuccagccugggugacagagcaagacucc

SEQ ID NO: 4108690 - RNA, 88 nt, Human
ggagaaucgcuugaacccuggaggcagagguugcagugagccaagaucgugccacuguacuccagccucggugacaaagugagacucc

SEQ ID NO: 4108691 - RNA, 89 nt, Human
ggagaaucgcuugaaccuggaaggcggagguugcagugagcugagaucaugccacugcacuccagccugggcaacaaaagugaaacucc

SEQ ID NO: 4108692 - RNA, 88 nt, Human
ggagaaucgcuugaacucgguaggcggagguugcagugcgccaaguucaugccacuguacuccagccugggggacagagugagacucc

SEQ ID NO: 4108693 - RNA, 88 nt, Human
ggagaaucgcuugaacuugggaggcggagguugcagugagcugagaucacgccacugcacuccagcccgagcaacacagugagacucc

SEQ ID NO: 4108694 - RNA, 88 nt, Human
ggagaaucgcuuggaccugggagguggagguuguggugagccaagauuaugccacugcacuccagcccgggcaacagagugagacucc

SEQ ID NO: 4108695 - RNA, 85 nt, Human
ggagaaucgguugaacccaggaaguggagguggcaauaagcugagaucauaccacugcacugccuggguaacagagcaagacucc

SEQ ID NO: 4108696 - RNA, 88 nt, Human
ggagaauucuuugagccuaggaggcgggggcugcaguaagccaagacugugcugcugcacuccugccugggcaacagagcaagacucc

SEQ ID NO: 4108697 - RNA, 89 nt, Human
ggagaauugcuugaacccaggagauggagguuguggugagccaagaucgcaccauugcacuccagccugggcaaugagagcaaaacucc

SEQ ID NO: 4108698 - RNA, 88 nt, Human
ggagaauugcuugaacccuggaggcaaagguugcagugagucaagauggcaccacugcacuccagccugggugacagagcaagacucu

SEQ ID NO: 4108699 - RNA, 88 nt, Human
ggagaauugcuugaaccuuggagguggaaguugcagugagccaagauggugucacugcacuccagccugggugacagagugagacucc

SEQ ID NO: 4108700 - RNA, 89 nt, Human
ggagaauugcuugguuggaggcggaaguugcagugagccaagauugcgccacugcaccucagccugggcgaccgagcgagacuaucucc

SEQ ID NO: 4108701 - RNA, 123 nt, Human
ggagaauuuugaccagagaacagauggccaauagguaaugauauggagaaacugaacacaagagucggcacacuggaguuuuuccaguugccucagucaguuuguugcucuagcaauuucucu

SEQ ID NO: 4108702 - RNA, 90 nt, Human
ggagacaagcuguauagauucgucuccugccugguuucaccuugaaaaaaggaaaccagauaagggaggcugaaaauaaauccuguuuuc

SEQ ID NO: 4108703 - RNA, 60 nt, Human
ggagacacaguacaguggagagagaagcuaacuucuccaaauacaauauuguuguuagcc

SEQ ID NO: 4108704 - RNA, 65 nt, Human
ggagacagaggcagccacuccuucuggcuccccggccccaggguugccugccucugcuguucucc

SEQ ID NO: 4108705 - RNA, 72 nt, Human
ggagacagaggguaugguggugccacucccuucuguguagaagcuggaguaggaccaugcuugaugaacucc

SEQ ID NO: 4108706 - RNA, 59 nt, Human
ggagacaggccaguuuugauuuaagcccuuacugcaaggcuugggugaauugccuuucc

SEQ ID NO: 4108707 - RNA, 61 nt, Human
ggagacagugacuuagagacugaggcaagagugccguggucaaucaugggucauugucuuc

SEQ ID NO: 4108708 - RNA, 75 nt, Human
ggagacaucuuagcauucugccuccuauaucaacuaucuuauuagaggugaggacaaagaagcccagaagucuuc

SEQ ID NO: 4108709 - RNA, 56 nt, Human
ggagaccacaggaugaccuggagccaaagaagaagggcccaggucccagggucucu

SEQ ID NO: 4108710 - RNA, 66 nt, Human
ggagacccagcucagggaggcaguuggcagugcaguggaugcugcuccgucugagcucugguugcc

SEQ ID NO: 4108711 - RNA, 62 nt, Human
ggagaccgugccuuagugguguaccaggaggugcaaacaauuuccuauaaaguuaugguucc

SEQ ID NO: 4108712 - RNA, 58 nt, Human
ggagaccuuaaggugcuuccuauaagucuggcuuuugaggaaauacucuaaggucucc

SEQ ID NO: 4108713 - RNA, 72 nt, Human
ggagaccuuaggaacagccucaaauuaguaucauucuaacugugcaaccuugggcaaaucacuaacgucucc

SEQ ID NO: 4108714 - RNA, 58 nt, Human
ggagacguucccagugaucccuguugaacuugaaugcggaacauuguuaauagucucu

SEQ ID NO: 4108715 - RNA, 89 nt, Human
ggagacucacuugaacccugggaggcggagguugcagugaguggagauugcgccacugcacuccagccugggugacagagugagacucc

SEQ ID NO: 4108716 - RNA, 57 nt, Human
ggagacugaaugaugcugcuuguuuucuugauuaaauaguguuugcucacagucucc

SEQ ID NO: 4108717 - RNA, 102 nt, Human
ggagacugaguaaaggaagaggaagaaagcaggcaugaguguugaaguucgguuugacucaugucauguguucuuuacguuccuuuugaauauauuaaaucc

SEQ ID NO: 4108718 - RNA, 98 nt, Human
ggagacugauuuucuccauuguaaauucuguggaaguucuggagaauaauuucaucacuaccacccagcaguaugcaaucuagaaauuucagcuuucc

SEQ ID NO: 4108719 - RNA, 108 nt, Human
ggagacuucugacuaaggaaggugagaguaauugagauuuguaugaaggguagaacuuucauagacccagaacucauuaacuucacauaucucagaguagaagcaucc

SEQ ID NO: 4108720 - RNA, 104 nt, Human
ggaacaggcauuggcguguaccugacuucagcuguggcaccaccccccagcaauggugugguggcaucagugaaguacaccguggucacccccaugcugaaccc

SEQ ID NO: 4108721 - RNA, 59 nt, Human
ggaacagggauuuggccugguuuuuucugugaacuggggcuaggcccaguuucuguucu

SEQ ID NO: 4108722 - RNA, 104 nt, Human
ggaacauggaucgguaccugcacauaguaaguacucaaucaauuuuuguugaauaaaugaguugaaugcucacucugugccagguacagugaccagugauuucc

SEQ ID NO: 4108723 - RNA, 58 nt, Human
ggaacauguagagggccuguagguuaucacccugcuuugccaguuaauacuguguucc

SEQ ID NO: 4108724 - RNA, 97 nt, Human
ggaacauguauuaccucugggcagaagcagugcaaaguccccagagagcccucuagcucacugcugcugcuauagaggucuagaaaucucauguucu

SEQ ID NO: 4108725 - RNA, 57 nt, Human
ggaacauuuccuggcagagagggcauuucuccccuccccucucccagagcuuguucc

SEQ ID NO: 4108726 - RNA, 69 nt, Human
ggaaccagaugcuaaacaaaggacuuuguaccccacaguuuuaaacagagauccuaugaagcaucuucc

SEQ ID NO: 4108727 - RNA, 69 nt, Human
ggaaccaugcacuuaccugaaauucaagucuuugacggaaaacuugguuucaaugaugcccgugguuuu

SEQ ID NO: 4108728 - RNA, 68 nt, Human
ggaaccauuuauguagcuuaacauuccccaauguguggaggccugugagcccuugcauguacuguucc

SEQ ID NO: 4108729 - RNA, 55 nt, Human
ggaacccaggucucucugacuccaaacccauguucuuuucaggauccaggguucu

SEQ ID NO: 4108730 - RNA, 70 nt, Human
ggaacccuuacgcauugcuggugggaaugcagaauagugcagccucuguagaaagcaguguguugguucc

SEQ ID NO: 4108731 - RNA, 74 nt, Human
ggaaccgauaccuucugcaagagcaucaguugugaaauggccuagguacaaggauguucuuagaaucagguuuc

SEQ ID NO: 4108732 - RNA, 80 nt, Human
ggaaccuucugccuuuuaaagccaguguuauuuuggucucuguuaaaguagcuaaaccaguaugugaaggcagggguucu

SEQ ID NO: 4108733 - RNA, 72 nt, Human
ggaaccuugagaggaacguggucaugcaaccugaguccgguggcaugcaggcgcaacuucuacaaguuuucc

SEQ ID NO: 4108734 - RNA, 77 nt, Human
ggaacgcauucacccgggugugcacgugcgacgggggcuugggugugcauguggaccccuggugccuccguggagcc

SEQ ID NO: 4108735 - RNA, 77 nt, Human
ggaacggcagccuggcgggggccgcgcgggggaagcgcgccgcuucuuguaaacgguuccccgaagggcgcugggcc

SEQ ID NO: 4108736 - RNA, 57 nt, Human
ggaacgguccgacuccaugggcuccaucugccuaagauuggugugcacugugcuucc

SEQ ID NO: 4108737 - RNA, 72 nt, Human
ggaacuaaggguugcaaggucagaggaauaaagggggcuuuguaauaccugagauuuaacccuucuuauucc

SEQ ID NO: 4108738 - RNA, 58 nt, Human
ggaacuacaguaagaauugauguucagaauaaugacauuaagaugugcuguaggauuc

SEQ ID NO: 4108739 - RNA, 62 nt, Human
ggaacuacaguauguccaaagaaugugaaauauauuuguaauaaaagaccuacuguauuucc

SEQ ID NO: 4108740 - RNA, 57 nt, Human
ggaacucagacuugcuuuuuauggaauuaaucuuaaauuccucagaguuuugguucc

SEQ ID NO: 4108741 - RNA, 73 nt, Human
ggaacucuguggaaguucacguugcauugcauaguaauaaauguuaaugaacuccgaacauuuacauagcacc

SEQ ID NO: 4108742 - RNA, 60 nt, Human
ggaacugcuuguaaauaauguugauuaauuugcaaucagcacuuuuuaaagcagcauucc

SEQ ID NO: 4108743 - RNA, 71 nt, Human
ggaacugggguuauaucaggacgcuauguugcaaccuuauaaugacauggccuccccuaacagccucuucc

SEQ ID NO: 4108744 - RNA, 82 nt, Human
ggaacuguggugcauucaucuuccuccaugcagauuaaauagcagagaaagcugcagagagagauaagaaugaagcagcccc

SEQ ID NO: 4108745 - RNA, 90 nt, Human
ggaacuucuguuuucaaagcugcuacuuaguguccauacagucccaggcuggagagcacugguagcaguuaaguuaggaaaagagguucu

SEQ ID NO: 4108746 - RNA, 91 nt, Human
ggaacuuguaaaaucccuuaccuuugaucaauuauaguuacgugucuaaugauacauagcaaggaaaugacagagaagagauucaaguuuc

SEQ ID NO: 4108747 - RNA, 61 nt, Human
gcuuuauggauuguaaacugcauaggaaauucuauguuugaagaguuugagauccuagggc

SEQ ID NO: 4108748 - RNA, 87 nt, Human
gcuuucacucuucugcuuucgagccagcacuuuuucucugggcacagcacugcugggagguuguccuggcagcagucuugaguaagc

SEQ ID NO: 4108749 - RNA, 72 nt, Human
gcuuucacuggaggucaguggagcacugggguugcaaugauaggacagugcccugggccuuccaggacaagc

SEQ ID NO: 4108750 - RNA, 96 nt, Human
gcuuucagaaauaagccuuucuuugaaaaucagagaauauauuuagaagauuauauuguuuuccuuugaggaucaaggaaguuuuucccuguaggc

SEQ ID NO: 4108751 - RNA, 129 nt, Human
gcuuucauuaagaaguaaucagaggaagaacagccugcucugagguugaacuuugcaaagcugggaauguuccuucuuugaaggagaucuuaguuuaggcauucauuuuuauuuuauuuuuuauagagu

SEQ ID NO: 4108752 - RNA, 57 nt, Human
gcuuucauugcagagucugugugcugaccuccggcagggccaucugcaauggcgagu

SEQ ID NO: 4108753 - RNA, 127 nt, Human
gcuuuccaaggaggcaguuuucaggccugaaggaggucccuguggcaaucagcacuccucuuuccugggaugugcagugugaccagggcugccucuuacucccucuggcauauccuucugggaaagc

SEQ ID NO: 4108754 - RNA, 59 nt, Human
gcuuucccgccaagugcagccggaggacagacagccaugcguguccuuggcgggagagc

SEQ ID NO: 4108755 - RNA, 64 nt, Human
gcuuucccuacagacuuuccuguucaauuaacaccugucacugccaggcucuguaggagagggc

SEQ ID NO: 4108756 - RNA, 79 nt, Human
gcuuucccuauucaaggcagcuucaugugacuguggacacuguacgccauccucaucaaagcgcuuggaguaggggugc

SEQ ID NO: 4108757 - RNA, 97 nt, Human
gcuuuccuaccggcaccgccucugcuccugcccacagccagcccugagaacuagcucugccuggcauggagaagagaaggucuggccguaggguggc

SEQ ID NO: 4108758 - RNA, 75 nt, Human
gcuuuccugcccugucuaagcugucaguauagccuauaccuaugguuuugcugacagucaagauagcauauuagc

SEQ ID NO: 4108759 - RNA, 71 nt, Human
gcuuucuacauccuaaaugaaggcuaguuauagaacuuuuuugacuaucagucauauugauguagagcagc

SEQ ID NO: 4108760 - RNA, 68 nt, Human
gcuuucucuuacccaaggaucuggagggccaucugcuaggcuggacaguggcuugggaagcagaaggu

SEQ ID NO: 4108761 - RNA, 75 nt, Human
gcuuucucuuccagucuguaggacuaggccuccaacagggcccugggauuacaaauugaagacucaacagagagc

SEQ ID NO: 4108762 - RNA, 58 nt, Human
gcuuucuggcuuauauucagcagagugcauaccacacugugaaugcuaguaagagugc

SEQ ID NO: 4108763 - RNA, 65 nt, Human
gcuuucuuccagugugcagagugacccuggugcaucuccgcagggggcucagugacugaaguggc

SEQ ID NO: 4108764 - RNA, 79 nt, Human
gcuuugaauagauuucacaugcugcucuauuauugacuuuauucaggaaauggaguucuugcaguggcacagucagagc

SEQ ID NO: 4108765 - RNA, 67 nt, Human
gcuuugauuuggcuaacugcaaaaaguacagguuuaaacuggacuugccuuuaguuaaaauaaaggc

SEQ ID NO: 4108766 - RNA, 73 nt, Human
gcuuugcaagauauguguuguuagcucucucuucacagacgagguaucacauugcaucucaucuggcaggagc

SEQ ID NO: 4108767 - RNA, 80 nt, Human
gcuuugcagagggggugggagcuguguauggcauguuugauggagaccgaaaugaggagcucccgcgccugcugcagugu

SEQ ID NO: 4108768 - RNA, 67 nt, Human
gcuuugccacauucuucacauuuguaggguuucucuccacuauaaauucucugauguauaguaaggu

SEQ ID NO: 4108769 - RNA, 60 nt, Human
gcuuugccugccauauggggucuguuacauaacuuaacucugcuauugcagugcaaaagc

SEQ ID NO: 4108770 - RNA, 65 nt, Human
gcuuugcugaggccaggccccaccggagugaggacacuacuggcauggguggcccucggcccggc

SEQ ID NO: 4108771 - RNA, 58 nt, Human
gcuuugcugaggucugaggauuggcucagccaagggacccucaagccugagcugaagc

SEQ ID NO: 4108772 - RNA, 79 nt, Human
gcuuuggaagacuacauaugccacaugaagaauacauuaguggaaauugacuucuguguuaaaugagucuuuuaaaagu

SEQ ID NO: 4108773 - RNA, 87 nt, Human
gcuuuggaauaguuugaauuuacagccuugaaaacagcagauguacaaauagguguaauugucuuuuaaugcugcuauucccaaagc

SEQ ID NO: 4108774 - RNA, 95 nt, Human
gcuuuggacucacacugaaacacuggcuaguacugggucuugaggcuauuggccuuagacuggagcuaugccgucagcgcuugugagcccccagc

SEQ ID NO: 4108775 - RNA, 82 nt, Human
gcuuuggaguguccauguaucgguuagcuauugcugcguauuuguugcacagcaauagcuaacugauacauggacacaaagc

SEQ ID NO: 4108776 - RNA, 75 nt, Human
gcuuuggcuguuagauuuggcuguaguaacuggaucaggaacccuguauuagaguuaguuagaucaagucaaggu

SEQ ID NO: 4108777 - RNA, 61 nt, Human
gcuuugggaaauucaucuucauaaagcuugauuuuuaauugaagcaaauuuuucucagagu

SEQ ID NO: 4108778 - RNA, 101 nt, Human
gcuuugggagguuuuguucaugcugugugguuagaacuguuucuauauugaucuuuuuuucagcagugcuacaccucauacagccuaaacaccacuaaagu

SEQ ID NO: 4108779 - RNA, 58 nt, Human
gcuuugguauuugaaaugugcuagcuacuuacugcugagcaccaguuuuaugccaggc

SEQ ID NO: 4108780 - RNA, 72 nt, Human
gcuuuguaucuccaugucuguaacacaugacuagaaugacuucuugucagugucuuaacagagauuagaagc

SEQ ID NO: 4108781 - RNA, 72 nt, Human
gcuuuguggucuuggaagaaguugcuaccaguaugaggagagacaaucaguuuccuccaggauccagagagc

SEQ ID NO: 4108782 - RNA, 68 nt, Human
gcuuuguugcccaggcugguccugaacuccugggcuccagugaucuucccgccugggccuccaaaagu

SEQ ID NO: 4108783 - RNA, 108 nt, Human
gcuuuguuuuuaguauuugguaugaaauuggcaauagagaauaaauuguaugcacuugcauuaucucuucuauaugcuagcuuucuguugagguuugaagacuuuagc

SEQ ID NO: 4108784 - RNA, 68 nt, Human
gcuuuuagagagagagcugggcacucuguggaguuucuuuauaugaccugaggccuuacucuaguggc

SEQ ID NO: 4108785 - RNA, 71 nt, Human
gcuuuuaggaaaaugcaaaccuaccuacauacauacaaguguguguguuuauaguguaucuuccagauugc

SEQ ID NO: 4108786 - RNA, 80 nt, Human
gcuuuuauuaagcacuuucugugagguaaagcacagaaauagauucguauuuaaguguguauuaucucauuaaugaaagc

SEQ ID NO: 4108787 - RNA, 120 nt, Human
gcuuuuccuuuuccuuuuaaugaauguucauacauaagcaaaggauuuugaucuuuugaguagccacuuuagagaauguucuuugcaauguacauacaguuuuggaaagacuagcaaagc

SEQ ID NO: 4108788 - RNA, 96 nt, Human
gcuuuucuugauuguaacuuucagauaaaaauuccaggcagaaaugugagugauuccuauuuacaugcagucggaaugaaagcuacuuaggaaagc

SEQ ID NO: 4108789 - RNA, 58 nt, Human
gcuuuugaugaaaggcagccauuuuguaagcaagacauugcugcuuuuaauuguccgc

SEQ ID NO: 4108790 - RNA, 130 nt, Human
gcuuuugaugcacuugauuuccuuucaaggucucauuuucauaugucauuuuagggauaggaaaaauaauugugauuauggcaauuguaaauggaaagaaauggaaggaaaaaaagacuguauuaauacc

SEQ ID NO: 4108791 - RNA, 70 nt, Human
gcuuuugauggccugagggauucugcuugccaccugcauggcaggucagaagugccagggaauuaaaggc

SEQ ID NO: 4108792 - RNA, 66 nt, Human
gcuuuugcaccugucccucuuuuuuguuacuguagugacauguccugagaagauggcugcagaugu

SEQ ID NO: 4108793 - RNA, 62 nt, Human
gcuuuuggaaugaggaacauccagcauuuuccucucuguuagagauucagcaugccaaaagu

SEQ ID NO: 4108794 - RNA, 78 nt, Human
ggaaggggcaugauauaaaguaguagauaagcagcuucacgcuuucuccacuauauuccuacuuucuaucccuuuucc

SEQ ID NO: 4108795 - RNA, 57 nt, Human
ggaaggggggcacgcugaagagcucacgcacacggaucuccagggugcccuuguucu

SEQ ID NO: 4108796 - RNA, 89 nt, Human
ggaagguacugggugaggggagagugaaagaaagaaaagguuagaauuuuauuuguuuauccuuucuccaucuuaccuacuuuucuucc

SEQ ID NO: 4108797 - RNA, 80 nt, Human
ggaagguagauaugguucaguuccucguguuuuuuucauguagacagaaacagagaaauauuggcuauaugaucucaacc

SEQ ID NO: 4108798 - RNA, 60 nt, Human
ggaagguauuucuccuugaguguugggccuauugugccaagcucaguggagaaaugcacc

SEQ ID NO: 4108799 - RNA, 56 nt, Human
ggaaggucagagauggggagaugcccggcgugcccuuccuccuuucucugccuucc

SEQ ID NO: 4108800 - RNA, 72 nt, Human
ggaagguccugggcaggaaugguuaaucuaaaguggugggccaccuuggccuugcuauuucuccaaccuucu

SEQ ID NO: 4108801 - RNA, 123 nt, Human
ggaaggugguaccaucuuuccccaguggcaggguggaagauggcacuaucuuucugugguggcgggguggaagguuuuaccaucuuuccccaguggcaggguggaagguggcaccaucucucc

SEQ ID NO: 4108802 - RNA, 83 nt, Human
ggaagguucuagacccagccaagcagcaggggccugagcuguagcuugagucacagccuugccuuggucacacuagccuuucc

SEQ ID NO: 4108803 - RNA, 77 nt, Human
ggaaguagagauucauuaggagacauucagucagcuacuguuggcugaccucauagauguagucuccuacaacuucc

SEQ ID NO: 4108804 - RNA, 63 nt, Human
ggaaguagcagagcugggauugaaucugggcugccugacucuaaaccccacucugcugguucc

SEQ ID NO: 4108805 - RNA, 97 nt, Human
ggaagucagagagguccgagccugagcuagggcuggugaggagcgugcucagaucugcuccccgacagccaggcucuccucguacagcucacgcucc

SEQ ID NO: 4108806 - RNA, 75 nt, Human
ggaaguccagaguauucaaguaacuugacugagaucacacagcuaaguuugugguuauacuugauugagauuuuc

SEQ ID NO: 4108807 - RNA, 98 nt, Human
ggaaguccucuuggcguuggucaucucaucuacuugccacaggcagggcuguaccuccuuuggcccugagagaugauuaugguaaguggcccacuucc

SEQ ID NO: 4108808 - RNA, 130 nt, Human
ggaagucgagucuucuuuccauaaugucuauagugcugaacaauaagauugguucuaaacugaaguuagaaugucuaaguguucagcccaagcguauuagaaaaauuacuuugguagaacacuuacuuuc

SEQ ID NO: 4108809 - RNA, 64 nt, Human
ggaagugaaauaugcccauugcugucuucacccagagaaaauagauugcucauauauuacuucu

SEQ ID NO: 4108810 - RNA, 71 nt, Human
ggaagugaaauugagguaaauucuggcccaaacagcagggggcuguuugcuuccuacuucuuuuccuuucc

SEQ ID NO: 4108811 - RNA, 122 nt, Human
ggaagugcuggcgcccacuccuggaaaggcugagacagcacaggucccaaagcccagaggcugggcgugcauuacucagcaaauccuuacagagcccccggcgucacaggcauucacagucc

SEQ ID NO: 4108812 - RNA, 61 nt, Human
ggaaguggaaguaguugaugacaaaggaaacuuaauuacugcuucuuuuccuuccacuucc

SEQ ID NO: 4108813 - RNA, 64 nt, Human
ggaagugguagagccaugagugacucugcccaggugguuucuacccugugugcuuuaccacucu

SEQ ID NO: 4108814 - RNA, 72 nt, Human
ggaaguucucagcuaggugaugugugaagacgguaagggagugagccacacagaucccugaggagagcaucc

SEQ ID NO: 4108815 - RNA, 57 nt, Human
ggaaguuugggagcugguaaucaacauggaaacauguaucaagccaucaaauauucc

SEQ ID NO: 4108816 - RNA, 126 nt, Human
ggaaguuugguggugguggccagggcugugggcgggucgggggaagggggucuaaaugcuugcuggaugaguggauggaugugucgcccuggcucuccagggggcccuagacacacacuugcuuuc

SEQ ID NO: 4108817 - RNA, 89 nt, Human
ggaauacuuucauugaagauucugacaucagaaaccaugacggcaagggucaaaugccuucugaugucauucugggaugaauaaauucu

SEQ ID NO: 4108818 - RNA, 60 nt, Human
ggaauauugcaguauuguaaguguaggccaaguagucaacauuugugaugagcaaacucu

SEQ ID NO: 4108819 - RNA, 88 nt, Human
ggaaucaagcuguaugauuugguugcaggaagcaauugccuaaaaagcaguuauguccucagcaaaucaagagcccuugaacauuucc

SEQ ID NO: 4108820 - RNA, 65 nt, Human
ggaaucagcagaggcgauugcuaucauuuuuuauuacuguucaguguuugauuucugcuguagcc

SEQ ID NO: 4108821 - RNA, 70 nt, Human
ggaauccgugugauguggacuaggccugucucucuccauugccaguaagcucuccacauggcuuuauucc

SEQ ID NO: 4108822 - RNA, 88 nt, Human
ggaaucucaccuucucaccgaggcuggagugcaguggcacaaucuuggcucacugcaacauccaccuccugaguuuaagugauucucc

SEQ ID NO: 4108823 - RNA, 95 nt, Human
ggaaucucacucugucgcccagcuggagugcuggagugcaguggugcgaucucagcucacugcaaccucugccuccugggcacaagugagucucc

SEQ ID NO: 4108824 - RNA, 82 nt, Human
ggaaucucacugucgcccaggcuggaagugcaguggcaugaucuuggcucacugcaaacgccuccuggguucaggugauucu

SEQ ID NO: 4108825 - RNA, 58 nt, Human
ggaaucugccagcuucccacuaugggaaaaucugccacuguggaagcuggcagauuuu

SEQ ID NO: 4108826 - RNA, 78 nt, Human
ggaaucugguggccuccucgggcugacccuggggauggacgcccagcagcagccccaggaagguucugagucagaucc

SEQ ID NO: 4108827 - RNA, 65 nt, Human
ggaaucugugcuuuucacaagcuuugcugaugguccuuaugcagcagauuugggaaacacugucc

SEQ ID NO: 4108828 - RNA, 73 nt, Human
ggaaucuuugaaggauuuuaagggggcugugauuauaguuagauuugcauuuuaaaagcuuuuggagaauucc

SEQ ID NO: 4108829 - RNA, 66 nt, Human
ggaaugagucugugggcugaacgaaucgaucugucacagagcaacagauugcagcuauagacugcc

SEQ ID NO: 4108830 - RNA, 77 nt, Human
ggaaugagugggauuucaggugucaaggauaggcugaggaaggaauuccacauccuuuuaugauacccacucaaucu

SEQ ID NO: 4108831 - RNA, 98 nt, Human
ggaaugaguuugcaguuagaaaaccaguguugugacuaugaaauuacaauauuucaguuuuauaacuuuggccucauaaucacugcaagcauuuuucc

SEQ ID NO: 4108832 - RNA, 67 nt, Human
ggaaugauaugcagauugaccuuacagucauuuauaggcugugauucucaaauugugauaucgaacc

SEQ ID NO: 4108833 - RNA, 57 nt, Human
ggaaugcacaauguuuugauuugagauaguuuuauucucuagucauaaugugcuucu

SEQ ID NO: 4108834 - RNA, 71 nt, Human
ggaggggacacgcugugccacaguucacaugccacaagccagugcugccuugggacagugauggcuccucc

SEQ ID NO: 4108835 - RNA, 63 nt, Human
ggaggggagauguuugggcucaugaaagccaucgagucuucuaagauuucuaugcaccccucc

SEQ ID NO: 4108836 - RNA, 62 nt, Human
ggaggggagauugcuggauuccaggugggcacauccauuuggccucaugaauuucuugcucc

SEQ ID NO: 4108837 - RNA, 80 nt, Human
ggaggggaggacucucugagaagccuugauggggauguggacuccuccuccauacuugcuucacaagagacucugccucc

SEQ ID NO: 4108838 - RNA, 63 nt, Human
ggaggggcaagaaguuggccucucgguugacauuccagagaaauggccagacuugccccuacc

SEQ ID NO: 4108839 - RNA, 57 nt, Human
ggaggggcagagagaaggaagcuugcacccacugugcuuuugaauuucugucccuuu

SEQ ID NO: 4108840 - RNA, 73 nt, Human
ggaggggcaggguggcagaggcucagaacagaaaugguucaaugacaaauggucugccugucccugugccucc

SEQ ID NO: 4108841 - RNA, 62 nt, Human
ggaggggcggcuccgcgaugcucuccccaccgcucccggcggcccggcuggagcagcucccc

SEQ ID NO: 4108842 - RNA, 117 nt, Human
ggaggggcugcuucugcugguagacaaaguucagggagauuuggggacucaaaguucucagcuuugucuugucugcccaauguccuuaucuccugucuuacagcucugcuucuuucc

SEQ ID NO: 4108843 - RNA, 57 nt, Human
ggagggggaaacuuuggcugccaauuucagggcagccagccagaagauucucucucu

SEQ ID NO: 4108844 - RNA, 55 nt, Human
ggagggggaauucagccccagccugugugacucaaaguuccuguuucccaccucu

SEQ ID NO: 4108845 - RNA, 113 nt, Human
ggagggggcggcuccgaccugucccuucucaucacaucaguuacuuuccauuagcgggaggggaaaucagcagaugcuggugaggggggucccggcgggaagcagaccccuuc

SEQ ID NO: 4108846 - RNA, 82 nt, Human
ggagggggcugggggucaggaugaggccuugggcuuggcccaggcucuucccucuggccaagacuuguccagccccaccucc

SEQ ID NO: 4108847 - RNA, 81 nt, Human
ggagggggugagguggaggaaugacuaacuguuaggauugaauaacaacggaguucccuccacaacuucucacacacuucc

SEQ ID NO: 4108848 - RNA, 59 nt, Human
ggaggggugagaauggcugccuguaaccccaacccaucuaggcagccccucuuccuucc

SEQ ID NO: 4108849 - RNA, 85 nt, Human
ggagggguuaaauuggucuagaauucagggugacaggggcacauggagcaacuuucugaauucugacaauuugaauauagcuuuc

SEQ ID NO: 4108850 - RNA, 70 nt, Human
ggagggguuugcagggguggaggcuguccugugcauuacaguauauuuagcaacauccuuggccucugcc

SEQ ID NO: 4108851 - RNA, 76 nt, Human
ggaggguccccagcagcaugaagguccagauucccccaauaguaacuccuuagcacaugcucguuggguuucuucc

SEQ ID NO: 4108852 - RNA, 62 nt, Human
ggagggucccugcucagggccaggacccgugcauuuaugggggcuggaaggagggacuguuc

SEQ ID NO: 4108853 - RNA, 92 nt, Human
ggagggugaagaaaaggccgucuggcggugacugagcuguguuugugcccccacacgccagccacguuagacuggcccauaccuuaaccucc

SEQ ID NO: 4108854 - RNA, 69 nt, Human
ggagggugggcaaggucccugccagcucugucucugggaccagugggcaggggccucugccucaccccc

SEQ ID NO: 4108855 - RNA, 71 nt, Human
ggagggugguggggacgggauggcucacugggcagcuaacccguguaggccacuuccuccucgucacugcc

SEQ ID NO: 4108856 - RNA, 60 nt, Human
ggagggugugccugccggguggccaggcuaucugccuuccuggcagcagcacaugccuuc

SEQ ID NO: 4108857 - RNA, 61 nt, Human
ggaggguuagcuguuacugguuacacggaagcccguguccagggggcuuaccuggaggucc

SEQ ID NO: 4108858 - RNA, 76 nt, Human
ggaggguugguacaaaguuagauuuaacuugaguuaaaauaacaaaagaaaucugauauuuguuucacaacuguuu

SEQ ID NO: 4108859 - RNA, 70 nt, Human
ggagguaaaggaauaucaguuuggaggcaauguauuaggucacugucaaucagaacaauuccaugccucc

SEQ ID NO: 4108860 - RNA, 59 nt, Human
ggagguaagaggcccugggccgaggugcagugacccugcaggccagcccuccaaccucc

SEQ ID NO: 4108861 - RNA, 112 nt, Human
ggagguaagggguucggggacccgggcugggcuccaggaguggccuggacaccuccuucggggccccaguucacuccuggccgaguugcauccuugagcccacgucaccccc

SEQ ID NO: 4108862 - RNA, 68 nt, Human
ggagguagaaaacacauaugcagguaugaacaaucaaagaaaacuugcacuuuguggauuguauuucc

SEQ ID NO: 4108863 - RNA, 64 nt, Human
ggagguauggcaagaugacauguucucccugcugcuuggugggggaaauguggucuuuacuucu

SEQ ID NO: 4108864 - RNA, 65 nt, Human
ggagguauguaugcuacauucuuuaguuaauuucaugugagggaucaucagguauauauauuucc

SEQ ID NO: 4108865 - RNA, 74 nt, Human
ggagguauuggugcuucucaagcucgcacauugaggaagacccuucucuugugaggagaggcccagcucccucc

SEQ ID NO: 4108866 - RNA, 68 nt, Human
ggaggucccaggccuggcagcaucagggcccaccacuaggcggggcugcugccugggccucggacucc

SEQ ID NO: 4108867 - RNA, 58 nt, Human
ggaggucucacuuuauugcccaggcuggucugaaacuccugggaucaagugauccucc

SEQ ID NO: 4108868 - RNA, 91 nt, Human
ggacagaacguguacuacaggggaauauuugucuugaguugucuuacaaacuuacaagauugauuugcuuggccacugacaguuuugaucc

SEQ ID NO: 4108869 - RNA, 64 nt, Human
ggacagagaugagucaacacagcugcugcccccaggucugggcaaagcuggcucuucuuugucu

SEQ ID NO: 4108870 - RNA, 55 nt, Human
ggacagagcguggggcaggggacccacaugcuuggccuccagucccagcucugcc

SEQ ID NO: 4108871 - RNA, 82 nt, Human
ggacagcaauagcuuugacaguugcaggcagucuugccacauuacaucccucuguuugcaugcuagucagugauuccuguuc

SEQ ID NO: 4108872 - RNA, 60 nt, Human
ggacagcauaucagcagggcagggucaggucccugcuacucuggcuguaugacccugacc

SEQ ID NO: 4108873 - RNA, 70 nt, Human
ggacagcccaaggcaugggcacuuucucaugguugcagcacaggguggugugugcuuagggcuagggucc

SEQ ID NO: 4108874 - RNA, 69 nt, Human
ggacagcugcauccucagacacaaaaccccugacggcccguguguaccacagagggugacgguaugucc

SEQ ID NO: 4108875 - RNA, 75 nt, Human
ggacagcugguagaguguuuaggguccugagauaauaaggaauccaggcagccuuuagacagucugcuguugucc

SEQ ID NO: 4108876 - RNA, 76 nt, Human
ggacagcuguggaagaggcucaggcaggaauggcggauccacugucggccucacugucggccucgcccgggaaucc

SEQ ID NO: 4108877 - RNA, 59 nt, Human
ggacaggagugaggcggguuccccccaccuuuuuccggagagaucccgcuuaacuuccc

SEQ ID NO: 4108878 - RNA, 60 nt, Human
ggacaggcccccucaggacugauuucuuggcagucuauccaaguccuugggugucugcac

SEQ ID NO: 4108879 - RNA, 55 nt, Human
ggacaggccuggcacaguacugauuucccuuuaaacagccugggcagccuugucu

SEQ ID NO: 4108880 - RNA, 62 nt, Human
ggacagggcucuuggcacuccuugccucucagacuccauccaggaagccagagaccacugcc

SEQ ID NO: 4108881 - RNA, 80 nt, Human
ggacagugacucaugaugagauuagccgcaauccugacuugauccagagucaccacugugauagucgauugucacuuucc

SEQ ID NO: 4108882 - RNA, 92 nt, Human
ggacagugguauuccuuuuagcugacauucuuggagucagccaaccaaaucugggcuagcagagagguuucagcuaauguaccaauuugucc

SEQ ID NO: 4108883 - RNA, 62 nt, Human
ggacagugguuuaggucaaggggaggcagcagaugcuggaaccuggccugagcuaccacucc

SEQ ID NO: 4108884 - RNA, 109 nt, Human
ggacaguguguggcuuccagagucuagaaacaagguagagcucccauaagguuucaugggagcucacuuucccugcuuugugucuguaacucugaggcaugggcuguuc

SEQ ID NO: 4108885 - RNA, 103 nt, Human
ggacauggagaagcugagcuguggagccagcaggaccuuuucuccuggaagagaaaaaugaaacggcugguuggcugcgaguuguucagcugaguccuugucc

SEQ ID NO: 4108886 - RNA, 97 nt, Human
ggacauggggcuguagcuuguuuggaugaagagcaugggcucugcaguaaugugggguugagucuucugcucugucacuaacuaggggcccauguuc

SEQ ID NO: 4108887 - RNA, 55 nt, Human
ggacaugguacugcugagguuggccugauguuggaguaaccuggagaccaagucc

SEQ ID NO: 4108888 - RNA, 119 nt, Human
ggacauucccaguaaguaaucccggggaaguauuauagcauauuagccccuccacagagaugggcuggcauugcucuauugccuccuccggggcagagucccuucuggcauaugugucc

SEQ ID NO: 4108889 - RNA, 74 nt, Human
ggacauuuauguauauauacgugcauauauauauguauguauguaugcauguauguaucgcuagaggaaugugc

SEQ ID NO: 4108890 - RNA, 62 nt, Human
ggacauuuccaggaggagguacuagagggaagcccuuuacaaaguucuucaugggaguaccc

SEQ ID NO: 4108891 - RNA, 80 nt, Human
ggacauuuuacaacucuggaugcacauuuugagguaacucaacaguguugcaaucugaaaaacuauuuuguaucauguuc

SEQ ID NO: 4108892 - RNA, 76 nt, Human
ggaccaagcagcagccaagucuccaggagcuccagugacucagaggccuggagucucuucuguagcuacaggguuc

SEQ ID NO: 4108893 - RNA, 84 nt, Human
ggaccaagcagcagcucccagagcgguggcccagcaaacacgacuugacucgaggccaaggcucuugagggcugagcagugucc

SEQ ID NO: 4108894 - RNA, 100 nt, Human
ggaccagauacuuuuuaaacaugcuaauucccaggccccaagccagacauucugauugaauugggcaauuaggcagaguggaaacuagaugucuguguuu

SEQ ID NO: 4108895 - RNA, 124 nt, Human
ggaccagccucagcaaaaacaaggagaaacgggcuuuuuaaauauauauauauauauauguauguauauguauguguguguguauguauguauguauuuggggcaauauuguugaaguagggcc

SEQ ID NO: 4108896 - RNA, 66 nt, Human
ggaccagggggugcaggcccugugaccuguagacagaguccucugggcagcugccccaccuggacc

SEQ ID NO: 4108897 - RNA, 61 nt, Human
ggaccaucucuagccagagcuuuccaccucuauuacugauagcuccaggcuccugggguuc

SEQ ID NO: 4108898 - RNA, 77 nt, Human
gcuggaacagcucaaaauugaauaauuaauuacacucagcuucaaucgcagugacuaauugaucaggggcugccagc

SEQ ID NO: 4108899 - RNA, 63 nt, Human
gcuggaaggcgcagugaugaugcucgucaucugaccuucacgagccacugccagccuccaugu

SEQ ID NO: 4108900 - RNA, 73 nt, Human
gcuggaauccuggcagucuugguucaucauggcucuaccggagcuugaggucugagacugugcaggguuacgc

SEQ ID NO: 4108901 - RNA, 79 nt, Human
gcuggaauuauuuacugauaaggauucguuauuuaauaaaagaaaucaccaggauuccuaucaguaguguguucacagu

SEQ ID NO: 4108902 - RNA, 66 nt, Human
gcuggaauugcauaauauguccuucuaguuuuaaauauguaggacaaauaagcaauaauauucagc

SEQ ID NO: 4108903 - RNA, 75 nt, Human
gcuggacagggagcagggccacuucuguaccucugcacacuucuagaaugcggacucauccugcauccauccagu

SEQ ID NO: 4108904 - RNA, 103 nt, Human
gcuggaccauucacgcccucugugaaguuuagggaagucugagcgcugccuucccagccagccacuucccagacuggccagcagagggcacccagcugccagu

SEQ ID NO: 4108905 - RNA, 63 nt, Human
gcuggacugcguuacggacaugggcuuccuucggguggcaucaguuuggagaggcgguuuggc

SEQ ID NO: 4108906 - RNA, 58 nt, Human
gcuggagaacccaggaggaagaggaaaaaaguuuuuuccuccucuacacuccccaugc

SEQ ID NO: 4108907 - RNA, 64 nt, Human
gcuggagagucagacauggguuucaggccuggcccugacacuuauuagcugugugaccuugggc

SEQ ID NO: 4108908 - RNA, 76 nt, Human
gcuggagccuggucucuuucaugucagugccuccugauccauacugcuaguguauagggaccaguguucuguuagc

SEQ ID NO: 4108909 - RNA, 63 nt, Human
gcuggagggacaagguaugcauuuuuugaauaaguaauguuucauuuaguugucuccuccugu

SEQ ID NO: 4108910 - RNA, 74 nt, Human
gcuggagggaggaaguggggcagggcugcuaggauucacagcaguccauagaggcugcuuucauccacuucagc

SEQ ID NO: 4108911 - RNA, 57 nt, Human
gcuggaguuagaacuagccuggcugacuccaaguucugggcucuuucugucuccagc

SEQ ID NO: 4108912 - RNA, 77 nt, Human
gcuggaucaggauucugcgaugaggacgagcuuaucccagauaaggcaggcugccacgucgaggguccaaggccagc

SEQ ID NO: 4108913 - RNA, 57 nt, Human
gcuggaucauauggugguucuauuuuuaauuuuuugaagaaccuccauaaugacugc

SEQ ID NO: 4108914 - RNA, 59 nt, Human
gcuggaugcaagagguacauggggacuuccucacugucuccagugucucuucauugagu

SEQ ID NO: 4108915 - RNA, 122 nt, Human
gcuggaugugguggcaugcaccuguaggagucccagcuacuugggaggcugaggugggacgaucccuugagccuaggagguuggggcugcagugagccaagaucaugcuacugcacuccagc

SEQ ID NO: 4108916 - RNA, 79 nt, Human
gcuggauguuacagggcagggaaguagggguccccaaggagccccucacaaaugucuccuguccugugaaucacucagu

SEQ ID NO: 4108917 - RNA, 91 nt, Human
gcuggcacaccgcugacauuuaguaucccacugacauuagcacaccgcugacauuagcacccugauacuagaauguuaaggaugugccagc

SEQ ID NO: 4108918 - RNA, 69 nt, Human
gcuggcacuaaugccugcugcaucgcugacccacucagcuucaguguuuuggccauuagugugaucagc

SEQ ID NO: 4108919 - RNA, 62 nt, Human
gcuggcagacugggggcagaaccaaggcccaugcggggcaggaaguggcccuagacuccagc

SEQ ID NO: 4108920 - RNA, 56 nt, Human
gcuggcagacuuccucuggaacuuccucuggacaucuggagggacguccugucagc

SEQ ID NO: 4108921 - RNA, 98 nt, Human
gcuggcagauaucuggaggauucugggacuugauauuguucuguuauuuuaagguauuguaguaagccaggaaacuuccccaggcaauccaagucagc

SEQ ID NO: 4108922 - RNA, 72 nt, Human
gcuggcaggauaacuucuaagcuccuugacuucugucaccauuccuugccuuggacuuugucucuagccagc

SEQ ID NO: 4108923 - RNA, 68 nt, Human
gcuggcagucaguggaaccugcuggggguaucuuuacaccucuccaggggaacauuguuccugccacc

SEQ ID NO: 4108924 - RNA, 68 nt, Human
gcuggcaguuggcagggcugccagaaagccuuauuuuuaacuugaucuccacccuguagcuugccagc

SEQ ID NO: 4108925 - RNA, 72 nt, Human
gcuggcaguuggggcuucucucaguuucuggccacuugggcuucugcuuagagcagcucacaacauggcagc

SEQ ID NO: 4108926 - RNA, 59 nt, Human
gcuggcauuuggucuggccaaaaagccaaaauggcuuugauaguugauuaaauuccagu

SEQ ID NO: 4108927 - RNA, 59 nt, Human
gcuggcccagagcucuggccuuuagcccugggaucagagcagagguggcucugaucagc

SEQ ID NO: 4108928 - RNA, 79 nt, Human
gcuggccuuugcuccagaggucugagaggcuggcccugccucuucugcuucaggagcacuucuuugcacugaggccugc

SEQ ID NO: 4108929 - RNA, 123 nt, Human
gcuggcgaagaggauguacaggagccagaggcccaggaagagcgcggugguggcgagcuuggguccgcgcgggccgcccagcucgccgccgaugugcggccggcgccgguacagcagcacggc

SEQ ID NO: 4108930 - RNA, 118 nt, Human
gcuggcgcgcuggcaggggcagacagaucagugggccuggaggaggugcccagaugggcuggugaucauuucugcccaucuccuuuggucuacuuccaaccccccauccuuggcaagc

SEQ ID NO: 4108931 - RNA, 70 nt, Human
gcuggcucuggcuggcucggccgggagugaggagagugucucagccacugccgcucugccaggugccagc

SEQ ID NO: 4108932 - RNA, 81 nt, Human
gcuggcucuuuucugugugucccucgacaggcucuuggccucucugagaggcugggguaugcagacaagcaagaagugggc

SEQ ID NO: 4108933 - RNA, 56 nt, Human
gcuggcucuuuuugccgggcucgccuccuuucaggagccacagucagaggagccgc

SEQ ID NO: 4108934 - RNA, 78 nt, Human
gcuggcugucucuccaccucuugugugccaggcaucacuguaggcacaggaaucugugaagugcuagacaaagccugc

SEQ ID NO: 4108935 - RNA, 56 nt, Human
gcuggcuguguuccuucugccaucuuccauugauuaaagcaggccacagggccagc

SEQ ID NO: 4108936 - RNA, 55 nt, Human
gcuggcuuccuucugcagcuaguuuucucuaguuaguggcagagauggccacagc

SEQ ID NO: 4108937 - RNA, 66 nt, Human
gcuggcuugcuuucaugaagucuauagagaacccuuuucucugcugcccaugaugguauagcuggc

SEQ ID NO: 4108938 - RNA, 64 nt, Human
gcuggcuuguacugguaucggcuaaagaauucccauuggaaucagcccacaucuagucauuagc

SEQ ID NO: 4108939 - RNA, 85 nt, Human
gcuggcuugugauguuauuagauacaaaccauuuuauauaaauuuaaaaauacuauugaaguuguucucauaacguauagccagu

SEQ ID NO: 4108940 - RNA, 72 nt, Human
gcugggaagcugggccaggcagagcuccaguugccagacacuguggccgcucugguaccagcuacuccuagu

SEQ ID NO: 4108941 - RNA, 70 nt, Human
gcugggaaggacccucuggggucucagugcccuccccuggcauuugaggcagguccggguccuucaaagc

SEQ ID NO: 4108942 - RNA, 89 nt, Human
ggaguuuugcucuuguugcccaggguggagugcaguggcgugaucucagcucacugcaaccuccgccucccggguucaagccauucucc

SEQ ID NO: 4108943 - RNA, 87 nt, Human
ggauaacgcacaucugugacccagaggcugacuaacacaugccugcugauggucucauuucuagggucucaggugcuauguaaaucc

SEQ ID NO: 4108944 - RNA, 62 nt, Human
ggauaacugcaucuuuugugugaugguuuucuuuucacuguguacacaaugauugcagagcc

SEQ ID NO: 4108945 - RNA, 69 nt, Human
ggauaauccuagaauauuuguggagguucccagacugucuugggaccuagagcuauauuuuggguguuc

SEQ ID NO: 4108946 - RNA, 83 nt, Human
ggauaauggccauuggaguugcaaaagaagugccuguuuucauuauuuauacucucuggcacucccuuauggcuccuuuauuc

SEQ ID NO: 4108947 - RNA, 99 nt, Human
ggauacaaaauucagaucugcuguuucucaaaauuaaguacacccuuguuagcaugacacuuaaauuugaucaugcagucucucugauuaaagccuucc

SEQ ID NO: 4108948 - RNA, 78 nt, Human
ggauacaauaaauauuuagugcuucauguuucucauguauauuugggguaucaugaauauuuaguauuuacuugguuc

SEQ ID NO: 4108949 - RNA, 77 nt, Human
ggauacaguuguguuacaaacuguuguuucuauagauggaaguucaugaaaauaauuacuuguauuauucuguaucu

SEQ ID NO: 4108950 - RNA, 65 nt, Human
ggauacauuccacuagugacuggcgggggaaagacacauguccugccaggcacgugagaguggcc

SEQ ID NO: 4108951 - RNA, 58 nt, Human
ggauaccauugcauggguagcucugccacccuacaccugccucagugcagcuggaucu

SEQ ID NO: 4108952 - RNA, 87 nt, Human
ggauagaaugagguuugagccucuugacccagucuacugagaucugggacugcuuuggucaugaagcuacacaaaccuuucucuucc

SEQ ID NO: 4108953 - RNA, 79 nt, Human
ggauagcaacuauuuuucugcagguuguaugcucauucuuuuaggaaaucuagcaacuucuacagauauagcauuaucc

SEQ ID NO: 4108954 - RNA, 64 nt, Human
ggauagccacggucuaagcaugguuaucaauaaacagauuagauguucaaagaucgugcuaucc

SEQ ID NO: 4108955 - RNA, 91 nt, Human
ggauaggagaggagaccacaguuaagaauaguuuuuccuuugcauuauaaaggcaggaaaaaagucugugauuauaagguucucugcuucc

SEQ ID NO: 4108956 - RNA, 84 nt, Human
ggauagggaaaggcaggaagaugagcucagguaaacuccaaguuuguuuggucaaauuaucuccuccugugccucguuuuauuc

SEQ ID NO: 4108957 - RNA, 62 nt, Human
gcuguggucugugagcuccaaagucagcaaucuuugcagcagaugcuuucauggacaauggc

SEQ ID NO: 4108958 - RNA, 102 nt, Human
gcuguggugagcaggugaggcccccaggguggaugcaagcagcagauggcuucugugcugcuaugugccaccugggaauggauuagcuuugcuccugacagc

SEQ ID NO: 4108959 - RNA, 83 nt, Human
gcuguguauacauaaaaucaaauauaauaauuuucgcuggaucccaauguggagaguuuguguguguguguguguguguuugu

SEQ ID NO: 4108960 - RNA, 74 nt, Human
gcuguguauuuuaugucccuucaaauguuuacuuuugcacaaagaugaguguuuggaggacauggaagacuggc

SEQ ID NO: 4108961 - RNA, 62 nt, Human
gcugugucuuuaaguuucccauuuauaaaaugaaucauaauacgaacuuggccaggcacagu

SEQ ID NO: 4108962 - RNA, 55 nt, Human
gcugugugaccuugagccugcuacuuagguucucugaggcuaguguuacaccugc

SEQ ID NO: 4108963 - RNA, 81 nt, Human
gcugugugacuuccgaagccaggucauaagaagccuugcagcuucuugauucucagaaugcuugcucuggaagaagccagc

SEQ ID NO: 4108964 - RNA, 68 nt, Human
gcuguguuucuccaggcuuuuugugaauuguuugauguaaggcaacacuacaguuuggaaggcacugc

SEQ ID NO: 4108965 - RNA, 74 nt, Human
gcuguguuugacaacaggcucacagaauuccugaacccuugacaauggauucucacaagcccuugcgagccagc

SEQ ID NO: 4108966 - RNA, 75 nt, Human
gcuguuaaaucagugguucccagcccaggaugugcacugauacccugaugccuagagccccugaugaaugacagc

SEQ ID NO: 4108967 - RNA, 66 nt, Human
gcuguuagaauuccuaguuguacuuagugaaaagucacugcucuccaauguggaguuccuaagagc

SEQ ID NO: 4108968 - RNA, 73 nt, Human
gcuguucauauuaucgucaucaucccugucccugaaacuucaguacaagugaugugguaaaaacuagaauagu

SEQ ID NO: 4108969 - RNA, 56 nt, Human
gcuguucauuaaacuacugugugggagccccacuggagaacgucugaugaagaagc

SEQ ID NO: 4108970 - RNA, 63 nt, Human
gcuguuccugcuuagaggucgggaaguugagaccgugcugcgaucucuagaggcagaaacagu

SEQ ID NO: 4108971 - RNA, 66 nt, Human
gcuguucuauggcugaaaauagaauuuaggguugauaaugcccagauuucuaggcuaugaagcagu

SEQ ID NO: 4108972 - RNA, 58 nt, Human
gcuguucuguaaaguaaggauaaaaacaccuaucccgugacauguuuugcagaacagc

SEQ ID NO: 4108973 - RNA, 72 nt, Human
gcuguugagauucuaucucaugacuagauuaguaauaugcuauuuuagcuaagacauagauucuuguaaggc

SEQ ID NO: 4108974 - RNA, 70 nt, Human
gcuguugcauuacauuugcucagucuaguuaugucucuuauauuuugagacuuggaaauggaaugucagc

SEQ ID NO: 4108975 - RNA, 67 nt, Human
gcuguuggcgugcuacaaguccucacccaccuuccacggagaaggacuaaggcuugggcccagcagc

SEQ ID NO: 4108976 - RNA, 78 nt, Human
gcuguugucagcuauuguauuugacugucugcauggaggugcuuaugugacagaucucuauacaugaagauaauuugc

SEQ ID NO: 4108977 - RNA, 72 nt, Human
gcuguuuacaguaugagaguugaaucaaggagacagaguauugccuugcucaaucucagcugggaacuaggc

SEQ ID NO: 4108978 - RNA, 62 nt, Human
gcuguuuagcuggguaaauggagacaaaacaauguuagucuucaagaagcccaaagacuagc

SEQ ID NO: 4108979 - RNA, 55 nt, Human
gcuguuuccagacaaugucuuuuuuggaucagccagaagagaccugggagccagc

SEQ ID NO: 4108980 - RNA, 59 nt, Human
gcuguuugcccccacuccuucagugcgacagacagccucagagcugguggggagacagc

SEQ ID NO: 4108981 - RNA, 81 nt, Human
gcuguuuuagucauucauuuauuagauaguugaaugcuacccauauauaagugucaaguacaugguagugauuaaaacagu

SEQ ID NO: 4108982 - RNA, 70 nt, Human
gcuuaaagaaugaagccagguagaagagaaugcugacauuuucugauugcuuuuugguuuuccauuaagc

SEQ ID NO: 4108983 - RNA, 81 nt, Human
gcuuaagagagggugaaggauuggagggcaucuuuuauucaugguccaggguacccuguauccaucccuuauucuauaagc

SEQ ID NO: 4108984 - RNA, 76 nt, Human
gcuuaagauaacacccauuuacaugucacaccucuguaggucagaagugugggcaaaggguagcuggguucuuagc

SEQ ID NO: 4108985 - RNA, 56 nt, Human
gcuuaagauguuuguggcaauuugacauauuagcaaauuggagagaugucuuaggu

SEQ ID NO: 4108986 - RNA, 92 nt, Human
gcuuaagauuuugauuacugacacagguagaauaaaguacuauuaggagagguaaugcuuuaaauccuaguguaaaugaagacucugaaagc

SEQ ID NO: 4108987 - RNA, 92 nt, Human
gcuuaauaaaauucacauucuagggcccuacuuugcaccuguugaauugaaacuucuggggauguagccugggaauaugaauuuuaucaagc

SEQ ID NO: 4108988 - RNA, 92 nt, Human
gcuuaaugacucuuugugcaucuuggaccaucagcuccuccuggauuuucauuaaucccaggggcaauggcuuagaccacaaucauuauugc

SEQ ID NO: 4108989 - RNA, 73 nt, Human
gcuuaauuggcaguguuuuucaaugcuuccacuguaauaaacauggacaaguaaaagcacuuccccccgaggc

SEQ ID NO: 4108990 - RNA, 81 nt, Human
gcuuaauugucagaaauuauccccugaauuuaccacuuuucugagggagggugguucuuuuaguggaagaauugguuaggc

SEQ ID NO: 4108991 - RNA, 87 nt, Human
gcuuacagaggaagcccugucauucugcugccugaugaccucacggucuccuguccugcaggauggagccucagcuccuuugugggc

SEQ ID NO: 4108992 - RNA, 55 nt, Human
gcuuacaggacauuuucuugggucaauuucuguuucuaaggucugucugguaggu

SEQ ID NO: 4108993 - RNA, 76 nt, Human
gcuuacuaugugccaggcacuuugaaauuuggagcucaaugcuuuuagcuccacaaucuggugucaugguguaagc

SEQ ID NO: 4108994 - RNA, 74 nt, Human
gcuuagagcaccauuagcguugggccggugccacagagcaaauaggacugagccccaucugaggugcccagagu

SEQ ID NO: 4108995 - RNA, 74 nt, Human
gcuuagcuucucugccuggaaggagcaaggggaacucugguuccucucccaccucccuccagguuggcuguugc

SEQ ID NO: 4108996 - RNA, 61 nt, Human
gcuuagggauguucuggaacuccagauggcacccugggauuccugccuacaugccuuaugc

SEQ ID NO: 4108997 - RNA, 71 nt, Human
gcuuagggcucugagaguucagccugggccgugauguucaggagcagcugucuaccugcagaguccugggc

SEQ ID NO: 4108998 - RNA, 55 nt, Human
gcuuagguuagcuggcauuuaaaggguuucuuucaaaaugcaguucugccuuggc

SEQ ID NO: 4108999 - RNA, 66 nt, Human
gcuuaguguuucuuuaggcuguguugccaagacuucuugucaacuguguuuggaguggacacaagc

SEQ ID NO: 4109000 - RNA, 70 nt, Human
gcuuaguuagagcccuauguuaggguuagaauccucugcccuaauguucugaggguucuugcuguugggc

SEQ ID NO: 4109001 - RNA, 89 nt, Human
gcuuaguuuucugccuugccuuuaugugugcuuuugguuaagauaauacaauaaggaaauguacaaaugaagauggcuaaggacugggu

SEQ ID NO: 4109002 - RNA, 77 nt, Human
gcuuauagauggcggaguuggcauuauggccagggucugcuuuacccccaagucuugucccagcucugccacucagc

SEQ ID NO: 4109003 - RNA, 105 nt, Human
gcuuauagcaggugauggggguagucugagcaauuuccaaaauuugaaaaagccucauggaaauugugcauuuagcaacaccuccucucauaagucugcacaagc

SEQ ID NO: 4109004 - RNA, 61 nt, Human
gcuuauauuuguuucuaguggcagcaaguucuguuuugcucaccugagaagaauagagggc

SEQ ID NO: 4109005 - RNA, 85 nt, Human
gcuuauccucccaggauuuugcagacauugucuuuugaagcgagggucugaagcaugcguuuguaaacuccuucagacaauaagu

SEQ ID NO: 4109006 - RNA, 66 nt, Human
gcuuaucuccaggcacuuggcugcuacugaggacagaguccaagugagucuggauaguuuuguagc

SEQ ID NO: 4109007 - RNA, 89 nt, Human
gcuuaugagucugagagugguucagcucagaagagcaaucuggaugcauuuucaguuaacuucuugggcugccaguuucagaaaggagc

SEQ ID NO: 4109008 - RNA, 77 nt, Human
gcuuaugccauuauuucugcauaucagggacuauuaguauuuucacuaauuuacuacugcuaucuagaaggcagagc

SEQ ID NO: 4109009 - RNA, 73 nt, Human
gcuuaugguucugcaggcuguacaggaagcauggugcugccaucugcuucuggugaggccucaggaaguuugc

SEQ ID NO: 4109010 - RNA, 56 nt, Human
gcuuauguuuugccauugaagagacaaugagcuuuucuucuauggcugucaaaggc

SEQ ID NO: 4109011 - RNA, 68 nt, Human
gcuucaaagcagccgguucccuggucucccugggugggcugggucccugggggccggcugugggaagu

SEQ ID NO: 4109012 - RNA, 55 nt, Human
gcuucaacauucuagaacugauaaguggaccuucagugugcaagaauggagaagc

SEQ ID NO: 4109013 - RNA, 57 nt, Human
gcuucaagaaucugaguaauuaguugaacugucuuguuuaacuaaagaucuuuaagc

SEQ ID NO: 4109014 - RNA, 84 nt, Human
gcuucaauaauuugauuucuuuuugcugcagugauuaauauuuagaauccaccaagagcauuagaagaaaugauuauagacagc

SEQ ID NO: 4109015 - RNA, 84 nt, Human
gcuucaaucuauuuugugauuaauuuucaaccucgguuuuuuuaacggacuggaaaaggguuaaugacauugucugguugaagc

SEQ ID NO: 4109016 - RNA, 61 nt, Human
gcuucacccuggaccagaaauugggccaccugccaucauuuucugaccaggcugauuuagc

SEQ ID NO: 4109017 - RNA, 74 nt, Human
gcuucacuuggcagauuccucaagaguuggaugaacuccagccaaugucugagucucuguaucccauguggggc

SEQ ID NO: 4109018 - RNA, 57 nt, Human
ggaggcugcugccucacgugggccaccucuagcacuacaacccaggcaggagcaucc

SEQ ID NO: 4109019 - RNA, 68 nt, Human
ggaggcugcuguauuccuuggcucauggaucucuuucuccaucuuuaagccagcaacacagcaucucc

SEQ ID NO: 4109020 - RNA, 56 nt, Human
ggaggcuggccuucagacggguguccuccuccccagccuccugaagcccagcuucc

SEQ ID NO: 4109021 - RNA, 55 nt, Human
ggaggcuggucuuugcaggucuguuauuaacuuggccugacuugaucggcucucu

SEQ ID NO: 4109022 - RNA, 69 nt, Human
ggaggcuguccugaaguuuucaugagaggaugucaauucuaaccucuaugaggcugucaggacgaaucu

SEQ ID NO: 4109023 - RNA, 56 nt, Human
ggaggcuucaauuccuuacccagugggccuuuccacugggcugcuugagugccuuc

SEQ ID NO: 4109024 - RNA, 129 nt, Human
ggaggcuuccaggggcacacugugagcaggagcccucucuggaccccgcagggucagguggccuuacuuucauucugcaccccgcagggucagguggccucaccuucauucuguacccguggcaccugc

SEQ ID NO: 4109025 - RNA, 81 nt, Human
ggagggaacagccugagcaaaggcccagagggaggaacuugcaccuucauaagagacucuuggggcucccugcugcccucu

SEQ ID NO: 4109026 - RNA, 106 nt, Human
ggagggagaagggaaugcucaguuugggacacuuugaguugaaggggucuacaggaguagaccuucaacucaaagugucccaaacugagcauucccuucucccucc

SEQ ID NO: 4109027 - RNA, 78 nt, Human
ggagggaggaggaggugaggagaaggagcuaccaagacugaauguggcuaauaaagccucuuuaguuccuggcccuuu

SEQ ID NO: 4109028 - RNA, 61 nt, Human
ggagggagggagaaucucaucggccaccacagaaggaaaaggcccaggguuuccucucucc

SEQ ID NO: 4109029 - RNA, 56 nt, Human
ggagggagggcuagaccaaagacagcagccaaagucugggcuccugcccucugucc

SEQ ID NO: 4109030 - RNA, 60 nt, Human
ggagggaugggcugaaagguagccccaggccagagcugggguagcugacagucaucuccc

SEQ ID NO: 4109031 - RNA, 91 nt, Human
ggagggaugggugaauggauggauggauggauugauggauaacuaaaguuccagucaaucauucuugccauuuauuuucucaggaauuucu

SEQ ID NO: 4109032 - RNA, 112 nt, Human
ggagggaugggugggagugccauaguggguggauagagcagccgccccaggcagaagguugggcaggcuggcuuuguuccaggugaaucccaggacuugcggacauccuucc

SEQ ID NO: 4109033 - RNA, 56 nt, Human
ggagggcacaggaccagaaaucaggagcccugcuuuuuaguuacaccucugccacc

SEQ ID NO: 4109034 - RNA, 59 nt, Human
ggagggcaggagcagggaagcagaugggacagucggcuguggcccugcuucaugcagcc

SEQ ID NO: 4109035 - RNA, 63 nt, Human
ggagggcaggggccucccucuucacugcggcgccuccccugccagcugcaggcuccugucccu

SEQ ID NO: 4109036 - RNA, 60 nt, Human
ggagggccacagucaguuuugaagcaacuccagcaagugauccaaccagcuguccccucc

SEQ ID NO: 4109037 - RNA, 105 nt, Human
ggagggccccgggucucucgggcaagcucuggagccggaggauuuccaggaacagaggcugggaucgccuggcggcuccacagccccgccaaccugccucccuuc

SEQ ID NO: 4109038 - RNA, 55 nt, Human
ggagggccccuccagugggcagcccgggcugccggccacccacgcgggcucugcc

SEQ ID NO: 4109039 - RNA, 98 nt, Human
ggagggcucugggaagccccugaccugcugccccgcugacccugaggcccgaugugggcggcuuugcaggcagcaucaaggcuggccgccgcuccucc

SEQ ID NO: 4109040 - RNA, 57 nt, Human
ggagggcuguagaggagaccugaauuuagggcccaucagauuuucuucuuuaccucc

SEQ ID NO: 4109041 - RNA, 88 nt, Human
ggagggcuucaggaaggcucuguggcugcguaggucuggcacccggugcugccuguuguggggccacgugagacuuccacagcuuucc

SEQ ID NO: 4109042 - RNA, 81 nt, Human
ggagggcuuuuuuacaucugaccuaauuuugcuaguuuauaaaauguaaagauuagauuacaugaauuuuaaggucccuuc

SEQ ID NO: 4109043 - RNA, 75 nt, Human
ggaggggaggcaaagacagugcugcauagacccccaccgaacaaaaugugauugcuugcuuauuugcccuucucc

SEQ ID NO: 4109044 - RNA, 66 nt, Human
ggaggggagggacccagucugggcccaggugucaucaucucagccacagcagggcccucucaggcu

SEQ ID NO: 4109045 - RNA, 80 nt, Human
ggcaagcagaguguugaagcaggaaccagcagcauuggcaaacuggcaaaugcuucuguuuugcuaaacaccugcuuuuc

SEQ ID NO: 4109046 - RNA, 61 nt, Human
ggcaagcaugugcgaguccucacagccuccagauaaugacggcugggaguucacugcugcc

SEQ ID NO: 4109047 - RNA, 73 nt, Human
ggcaagccuggaucuuucugacugacaaaagagacuguuuccccuugguagugguaaagaaucaccccuugcc

SEQ ID NO: 4109048 - RNA, 93 nt, Human
ggcaaggacugacaugauaagacaggaauacaagugaggcaauaacuggcugcuaugucaauauauuccauguuuucucucaggucuccugcc

SEQ ID NO: 4109049 - RNA, 81 nt, Human
ggcaaggagaucugaagggaaguggaaggcagaaaaacacccagacuucuucuucuucucauccuuuaguauccucaugcc

SEQ ID NO: 4109050 - RNA, 77 nt, Human
ggcaaggcaggauaaauaguaaauguaaguaauaauaaaauuuagccuuugcuuuacuuauuuauugagagccagcc

SEQ ID NO: 4109051 - RNA, 61 nt, Human
ggcaaggggucaggcugagacacaggcaccucugcaggugacgaggccugcaccuccugcu

SEQ ID NO: 4109052 - RNA, 63 nt, Human
ggcaaggguugaagauaaauaagguagcaaugucuacuuuauauuuuuggccuuaauuaugcc

SEQ ID NO: 4109053 - RNA, 59 nt, Human
ggcaaggguugaagauaagguagcaaugucuacuuuguauuuuuggccuuaacuaugcc

SEQ ID NO: 4109054 - RNA, 61 nt, Human
ggcaagguacucuagagcacauaccaagaguggaauugcuaaguuauagaguaucuuugcu

SEQ ID NO: 4109055 - RNA, 88 nt, Human
ggcaaguauggcagauggguugagaacacaugcuuugcaaacugcagcaguauagugcuaacccauccagaaauaacccauuccuucc

SEQ ID NO: 4109056 - RNA, 62 nt, Human
ggcaagucacuggcaaaagcugcaguuuuggaaguggcugacagcuguugcagugaaugguc

SEQ ID NO: 4109057 - RNA, 102 nt, Human
ggcaauacagagaauguuauuuggaaaaguugacuucaaaccuuuuaauuuuucuuuccauuaaauagcgugucuuccauuuauucaaaucuuuguguuacu

SEQ ID NO: 4109058 - RNA, 83 nt, Human
ggcaauauucuaggucuguaaaugagagagacaggaccugugaguugcuuucuuauaccgauagaauaccuggaaggguagcc

SEQ ID NO: 4109059 - RNA, 61 nt, Human
ggcaaucugguucuucuuaggcaucaacaucuugauggcuguaggguccggggccagggcc

SEQ ID NO: 4109060 - RNA, 99 nt, Human
ggcaaugaaagcuuuuaaggaggacacacagaauacaaauccacaggagugaaacuuaaaaggcucugcaggucugugacugcccccugcuuucaugcc

SEQ ID NO: 4109061 - RNA, 79 nt, Human
ggcaaugauugcauuagaagaugaagcuacuaaugucaauggcagaacugcucagcaucucuacccaugcagaucagcc

SEQ ID NO: 4109062 - RNA, 66 nt, Human
ggcaauggccacuccucccugcaggcuggccucggcauagcagaggggcaggugguggccauggcu

SEQ ID NO: 4109063 - RNA, 55 nt, Human
ggcaauggggcagagggucaugugaggccucaugggucacuguuucaccauugcu

SEQ ID NO: 4109064 - RNA, 72 nt, Human
ggcacaaaacuucagcaguagagggggcacagucgcagcugcacccuggccccuccacugcuccgcguugcc

SEQ ID NO: 4109065 - RNA, 81 nt, Human
ggcacaaauucgcucugcacuguccggcuuucuucgcuauguauugaaugaaagaacagcugacagaagacaguuuguguc

SEQ ID NO: 4109066 - RNA, 67 nt, Human
ggcacaaggcuaugaaguauuaguuggcuauugugucagcuauuuaaauuuuuuggcucuuucuguu

SEQ ID NO: 4109067 - RNA, 65 nt, Human
ggcacacagacacuccaaagguauuuguuaugauuauuaaagcagugggggaguguuaguuugcu

SEQ ID NO: 4109068 - RNA, 59 nt, Human
ggcacagcgacuaccaucgaaaguugauagggcagacguucgaaugggucguugcugcc

SEQ ID NO: 4109069 - RNA, 71 nt, Human
ggcacagcugcuggggccgcaggcuggagccagcguugugauuggauccagcugcugacccaguagccgcc

SEQ ID NO: 4109070 - RNA, 62 nt, Human
ggcacagcuguugcgucaggcaaggucaccugcauuuauuuauugagcagcagugcuguguc

SEQ ID NO: 4109071 - RNA, 56 nt, Human
ggcacaggagcuagucaaagccccuaaagcaucagguuggugaccuucuccuuguc

SEQ ID NO: 4109072 - RNA, 105 nt, Human
ggcacaggcagcuucacuggagaauucuaugaaauauuuaaaggauaaauaaugucaauauuccaugaacucuuugaggaaacagugaaagaaguaacacuugcc

SEQ ID NO: 4109073 - RNA, 113 nt, Human
ggcacagucccuggaggccaacccacagcacauccacaggcuccagccaccgcggcacucaaacaccaugggccugggagugcacagugagguccugccugcaggagcgugcc

SEQ ID NO: 4109074 - RNA, 87 nt, Human
ggcacaguccuguuauuuuuaccagugaguuccacagcuaagggugcuggcuuucuaccugagguaaggaugaugaggucugaugcc

SEQ ID NO: 4109075 - RNA, 82 nt, Human
ggcacauaccuguaaucccagcuacuugugaggcugaggcaggaggauugcuugagcuaggaaggcugaggcugcaguggcc

SEQ ID NO: 4109076 - RNA, 59 nt, Human
ggcacauggccaacauucucugccccguaugcggggugccagagaccaggccagguguc

SEQ ID NO: 4109077 - RNA, 73 nt, Human
ggcacauuagcaacucuuauguaagcagaagugugaaaaccguuugcacauugggguuugccugguacuugcc

SEQ ID NO: 4109078 - RNA, 70 nt, Human
ggcaccagcugucaccaggagccggaccacagacgguaauguggugaucacagccagguggagcgguguc

SEQ ID NO: 4109079 - RNA, 81 nt, Human
ggcaccaggccaggccaggccucggccacugcuuccacuacaggcagcagggaggcccagggcacuggccgaggcccugcc

SEQ ID NO: 4109080 - RNA, 70 nt, Human
ggcaccaguccguggccagacucaagagggcaaacgcuccacuccuugcgaucaacuaggauucucugcc

SEQ ID NO: 4109081 - RNA, 59 nt, Human
ggcacccaggccggcgacugcagcgggggccucccuacugccaguucccggccgggucc

SEQ ID NO: 4109082 - RNA, 78 nt, Human
ggcaccccaggccaagccccagcuggggagagagcugccacguuuuccuccaagcguggguguuugagagaaggugcu

SEQ ID NO: 4109083 - RNA, 58 nt, Human
ggcaccucuaaugagagcagggacaggcuuucucauccuaacucaauucagggguguc

SEQ ID NO: 4109084 - RNA, 60 nt, Human
ggcaccucugggcucuguuaggugccuguggcagacgaaauaaugguccccaaagauguc

SEQ ID NO: 4109085 - RNA, 55 nt, Human
ggcaccugucugcucacagugaaggcaaucaugcaaucaugacaaaacaggcgcu

SEQ ID NO: 4109086 - RNA, 59 nt, Human
ggcaccuguggggggccuuccggaaccagaacucuggcagggucaggaaccaggguacc

SEQ ID NO: 4109087 - RNA, 71 nt, Human
ggcacuccagggcuucuaugaugguuccagcauuaccagggacccaaguccauccaggccucugcucuguc

SEQ ID NO: 4109088 - RNA, 72 nt, Human
ggcacuccccucgcccagcacuacuccucucugccuggggucgagccacagucugugcuuggugggagggcc

SEQ ID NO: 4109089 - RNA, 62 nt, Human
ggcacucucgcugauuagcguaaaaccucucaugcuuuuuaugagaauuaagugcgagugcc

SEQ ID NO: 4109090 - RNA, 70 nt, Human
ggcacucucugggucacugugggagggcagggaagccaugcuacccucucaguagacccagagcagcucc

SEQ ID NO: 4109091 - RNA, 76 nt, Human
ggcacugagcugccuuggggcagagacuuugcucgaaggguuuaacacucuaucuccaaggcauagacacagugcc

SEQ ID NO: 4109092 - RNA, 70 nt, Human
ggcacugauggacucacuaauuccuccaccacugagaaacacagaguggaagcagugaguucacugugcu

SEQ ID NO: 4109093 - RNA, 67 nt, Human
ggcacugcauggcugugaggcagcuggucagagagcaggcugcucucagagcucaugcugaguagcu

SEQ ID NO: 4109094 - RNA, 61 nt, Human
ggaggcaaagcacuuugcuuggaaauauuuuucacaugacauacaaggugcuucgaccucc

SEQ ID NO: 4109095 - RNA, 66 nt, Human
ggaggcagagccaaaaccguaacagccagagcuagagacuccggccugggguucuggcucuguccc

SEQ ID NO: 4109096 - RNA, 128 nt, Human
ggaggcagcacagacauuaaacacgguauuuucagaaggagcagacauaaccuuacagaagugcuuuauuuucuguaacuagauuuuguuuuacuggaggcagcuuuguauaagguucaggcgucucu

SEQ ID NO: 4109097 - RNA, 75 nt, Human
ggaggcagcagcccacagccgaccccucaugccacgcacugagcaggguuccgcauggacgcuggucuugccucc

SEQ ID NO: 4109098 - RNA, 55 nt, Human
ggaggcagcggcucacagagaaaaagcucuggcuuuucuccgcccgcugcguucc

SEQ ID NO: 4109099 - RNA, 59 nt, Human
ggaggcauuugaauggcauaccaggcucauccccugagccugggagaucagcugccuuc

SEQ ID NO: 4109100 - RNA, 70 nt, Human
ggaggccaggggggaguuuugcucagaggaaugacaugaucugauuguaacaggaucccuguggcugacu

SEQ ID NO: 4109101 - RNA, 58 nt, Human
ggaggccaucuggcuggaggcugcaaagugagacaugaaccucccccaggaggccucc

SEQ ID NO: 4109102 - RNA, 61 nt, Human
ggaggcccaggggagccgccugccagagucaucagcagagccaggcucuaccuggguuucc

SEQ ID NO: 4109103 - RNA, 91 nt, Human
ggaggcccuugccaaugggaaaugagagacaggaacgagcugggcagaugaauuuccucucguucucucucccccaaugugcaguuccucc

SEQ ID NO: 4109104 - RNA, 56 nt, Human
ggaggccgggggaaagucuaagcgagcgucgugcccgggacuguugccaggccucu

SEQ ID NO: 4109105 - RNA, 71 nt, Human
ggaggccuacguagauccaucaccugagcacuugcuuguugacuaggucucaucuuguucaucuacccuuc

SEQ ID NO: 4109106 - RNA, 59 nt, Human
ggaggccucacuuguguugcccaggcuggucuugaacuucugggcucaagugauccucc

SEQ ID NO: 4109107 - RNA, 55 nt, Human
ggaggccucaucuugccccgugcccagguagagcaugagguagcaugaggcaucu

SEQ ID NO: 4109108 - RNA, 122 nt, Human
ggaggccucggguggccgccugcgcgcccgggauguacugcgccuucaccaagcggcccucagccgggcugucggggggugagggggcggcgggcggcgcagcgggcucgggugccgccucc

SEQ ID NO: 4109109 - RNA, 87 nt, Human
ggaggccugaaguccaagaucaaggugucagcaggcuugguuuccucugaggccucucuccuuggcuuguagacggccacugucucc

SEQ ID NO: 4109110 - RNA, 82 nt, Human
gcuuuggagaagcagguuuagcagacaaccucuuggaucuuuucugugguuuguccuucauguuggauuuaucuccuuuagc

SEQ ID NO: 4109111 - RNA, 72 nt, Human
gcuuuggccagaggagcaggcuggcuccacgcuugucugcugggggcgggaugauuccuuuggacucauggc

SEQ ID NO: 4109112 - RNA, 70 nt, Human
gcuuugggcccaucauugcugugggcauguggacacuugacacuggcccugccauugaucggcccagggc

SEQ ID NO: 4109113 - RNA, 58 nt, Human
gcuuuggucagguguccagcccugguucaaucagguguuggggacaggaccccaaggc

SEQ ID NO: 4109114 - RNA, 62 nt, Human
gcuuuguacauguucagggagauccaaguguuuauuggagauuacuugaauguugcagcagu

SEQ ID NO: 4109115 - RNA, 77 nt, Human
gcuuugucuaaaaugaguuuaaugauauuuauaugacaggguuaugauaugcguuaaauuucuaauuuugagaaagc

SEQ ID NO: 4109116 - RNA, 61 nt, Human
gcuuugugcaggugugucagaucguuaagacucguguucaauaugauggccacugcaaagc

SEQ ID NO: 4109117 - RNA, 124 nt, Human
gcuuuguggguguuuguuuuauuaaauaaucugggcagauuucauugagaauauaagauuugaacaaagacuuggaaaaucuaucuggaggaagaguaguccagauagagcagauaauuagagc

SEQ ID NO: 4109118 - RNA, 87 nt, Human
gcuuuuaccuuugccugggauuguguaagugaauaugaaauaaggauuucaagaaaguucaggugcacaugucaagcaugggcaggc

SEQ ID NO: 4109119 - RNA, 55 nt, Human
gcuuuuacucaugacagaaggcaaagcaggagcaggcacuucacauggugaaagc

SEQ ID NO: 4109120 - RNA, 57 nt, Human
gcuuuuaguuacuucuuaaggcuggauuauagccuuuccaguuuguguaagaaaagc

SEQ ID NO: 4109121 - RNA, 59 nt, Human
gcuuuuaugucauaaggacacucaagaagcccuaugagaaggccugugugacagggagc

SEQ ID NO: 4109122 - RNA, 67 nt, Human
gcuuuuauuacccagagggagagcaacuauaguguugugccauagaauagcacugcccugggaaggc

SEQ ID NO: 4109123 - RNA, 103 nt, Human
gcuuuucacuaacaauuucuucucauuccccagagaugccuuaaugagccccucggacauggccaaaggcaaucuuguucucugggccagugaggugaaaagc

SEQ ID NO: 4109124 - RNA, 71 nt, Human
gcuuuucaugcagaggaaggcuaguuuccucaaaucuuggagagcaagcuacuuccacugauaagagaagc

SEQ ID NO: 4109125 - RNA, 84 nt, Human
gcuuuucccauauuggcacugcacaugauugcucagagcggagagacacaagcaaaaaugugcuagugccaaaaucggccaagc

SEQ ID NO: 4109126 - RNA, 110 nt, Human
gcuuuucccuuugcaucggccuggggcccuggggccugauuugcagcaucaacagcuuuuccacugcugugugucagcccaagggccuugucacugugagaggguaacgu

SEQ ID NO: 4109127 - RNA, 63 nt, Human
gcuuuucucuuugacaggaaucagagguguuuccuuuguccccuacucuguagaagaggaugc

SEQ ID NO: 4109128 - RNA, 71 nt, Human
gcuuuugaaaaugugauuuucccaguagaauuccuaauuuuaaaaaauggaaaaguacaauauccaagagc

SEQ ID NO: 4109129 - RNA, 60 nt, Human
gcuuuugaccuucucugucucagaacguucugcauaguucuauccagagaggacagaggc

SEQ ID NO: 4109130 - RNA, 64 nt, Human
gcuuuugaggugaaggcuuguguaaaggaggcaguucuggcuccuucagagccucccuccaagc

SEQ ID NO: 4109131 - RNA, 95 nt, Human
gcuuuugcugcuuaacaaaccauugccaacagccauuuguugagcaugugauuccacuggucagcaauuuggacugggcucaggugggcgccugc

SEQ ID NO: 4109132 - RNA, 56 nt, Human
gcuuuuggaccucugauguuucuccugaaaaucacuguuaugaaggauccaggggc

SEQ ID NO: 4109133 - RNA, 100 nt, Human
gcuuuuggaggcccuggggcucucccgacacccccucugugugucuggcaaugcgcaggugcaccugagggugucaucggaucugagggccacaaacagc

SEQ ID NO: 4109134 - RNA, 72 nt, Human
gcuuuugugccuuugcuuuuacaaguuuggaagggccucauuguacccugugauugagcuagguauuuaagc

SEQ ID NO: 4109135 - RNA, 129 nt, Human
gcuuuuguuuuaauggguguucacuuuuaaugguuucaagcauucaucaaaaauguuccucuuugaaaaagugaagaggacacaaaguggcugagaugcagaccuagugcuucccaguuuucaaagugc

SEQ ID NO: 4109136 - RNA, 60 nt, Human
gcuuuuuauaucaucguguuacauugcgucaugugcagaguaagaugagcuauaagaagu

SEQ ID NO: 4109137 - RNA, 97 nt, Human
gcuuuuuauguuccuauagcauuuguacaaaaugcaguaggaguggaaucauuauucuaaauugcauaaguacaaaugaaauggaagagcacaaagc

SEQ ID NO: 4109138 - RNA, 65 nt, Human
gcuuuuucuaccaggucacuuuuuacuuuuaugugagaaaacucuggcucuggguaggagagugc

SEQ ID NO: 4109139 - RNA, 105 nt, Human
gcuuuuugauguguugcuaauucaguuugccaguauuuuauugaugauuuuugcauugauguucaucagggauauuggccugaaauuauuuugucauuguugugu

SEQ ID NO: 4109140 - RNA, 117 nt, Human
gcuuuuugccaugugucauucaguuuuagaauuucugcucacuuugauuguaccaugaaaccuacacuuagauggagcagaaaacuucaauagggcuaaggcaugugagcaagaagu

SEQ ID NO: 4109141 - RNA, 70 nt, Human
gcuuuuugcgagcugguaacugcacacuucaucuguucucuuaguguaucuuuuaucugcugcaaagggu

SEQ ID NO: 4109142 - RNA, 67 nt, Human
ggaaaaaggugugaaguaaaugcaucgacugauguaccuugcacacauuucacacccuccuuuuucu

SEQ ID NO: 4109143 - RNA, 130 nt, Human
ggaaaaaguaaaccuuucccuuacaguuuuguaugcuucucuagguucuaaauuagguauuuaucuaaauaguauagaauucguguuuguaauucaggagguaaaaaagaguauuaaagggacuugauuu

SEQ ID NO: 4109144 - RNA, 86 nt, Human
ggaaaaaguuggcucuuaugcuuguguaagaauagucguagucacuuuauucauauuuguuacagcuuaaaaaagccaacuuaucc

SEQ ID NO: 4109145 - RNA, 77 nt, Human
ggaaaaauuuggcaaauucuugguaguauuuuuugagcauguagauaaaacuaugaaugaauuuucuaaguuacucc

SEQ ID NO: 4109146 - RNA, 75 nt, Human
ggaaaacagcgauugguaucauaauucucuuuacacagugcucuaagggauaaacuguuggcaauuguuguuucc

SEQ ID NO: 4109147 - RNA, 76 nt, Human
ggaaaacccuaagguagauuaucaauagugguagcuggaacuauuacugucauuagcauuaacuuuaggggauuuu

SEQ ID NO: 4109148 - RNA, 70 nt, Human
ggaaaacguggccaugugagacuaguauagaucuccaacuauugcugccucugcugauauggccaccucc

SEQ ID NO: 4109149 - RNA, 69 nt, Human
ggaaaacuggcaggaaguuagaugguaacuacagauuacuuaccagcuucuuucuugucccagucaucc

SEQ ID NO: 4109150 - RNA, 104 nt, Human
ggaaaagaagaacuggagcuguaagggccugacuacccugagaagcauuucuuucccaucuacagguaagucuguccucacaaguuaaucaguagcuucuuucc

SEQ ID NO: 4109151 - RNA, 72 nt, Human
ggaaaagcaagggacauuucucauaggagaugacaguucauuuggcuccugagggaugcuuaggcuuuugcc

SEQ ID NO: 4109152 - RNA, 75 nt, Human
ggaaaagggaaugcuuggcccgucugaagaaggcuccaaugucucuuuccaggguaccccaggugcuucuuuucc

SEQ ID NO: 4109153 - RNA, 62 nt, Human
ggaaaaguagcaaaugugacauaggcggugaacugaaaaucgcuugguuuugguuacuugcc

SEQ ID NO: 4109154 - RNA, 122 nt, Human
ggaaaauauugccuuaauuauuacucugaguggaucuucaccuaguuucuuacaagauugcuuaagauaaguggguugagauggacagugcugaggagugucauagguuuuuauuguuuucc

SEQ ID NO: 4109155 - RNA, 85 nt, Human
ggaaaaucacuugagcccagaguucaaggcugcagugaguuugaucauaccauugcacuucagccugggugacagagugagaucc

SEQ ID NO: 4109156 - RNA, 86 nt, Human
ggaaaaucagguggggaagugagggacuggaguaaagaggaaagcgucuuucuccaagaaaagaucucagcuauccauguggaucc

SEQ ID NO: 4109157 - RNA, 76 nt, Human
ggaaaauggagagcuggcacuuggcacccaugaaagacccacuuucccugcccuaccagguggcauuucuccuucc

SEQ ID NO: 4109158 - RNA, 69 nt, Human
ggaaaauugagagucuugugcaaguuguaagcuuucugcuuaaucuucuggaaacuuuuccaauuuucc

SEQ ID NO: 4109159 - RNA, 55 nt, Human
ggaaacaugccugcuggacaguggugcaguaugacaauccagcagcauaguuucc

SEQ ID NO: 4109160 - RNA, 59 nt, Human
ggaaacauuccaagaguugaaaaagacaauucauucaacuaaauaaauggaaugguucc

SEQ ID NO: 4109161 - RNA, 93 nt, Human
ggaaacauuuugcaguaguucgucuguguucccuuccucauaucacaccaccuagggaauuaccuuggauuacuacaaaaaucuaauguaucu

SEQ ID NO: 4109162 - RNA, 72 nt, Human
ggaaacucaaucucugggggucagaguccacuuccuggggagcccaaucugugaccccuaggaguggggacc

SEQ ID NO: 4109163 - RNA, 57 nt, Human
ggaaacugagugacacucccucagaaaaaguugugggccuguguaaauugaguuucc

SEQ ID NO: 4109164 - RNA, 64 nt, Human
ggaaacugaucuccucuccccaccugaagguuucuggauaugggagagggagcaucagagagcc

SEQ ID NO: 4109165 - RNA, 97 nt, Human
ggaaacugcccacucuuguaagauguugcucagcguucuugggacccaggaauucacugcuccaaaggcccugaguucacuuucaaggcuugguucu

SEQ ID NO: 4109166 - RNA, 71 nt, Human
ggaaagaaacacuguuucucccauaagugauuuggacuccacugguuacauggaagaaauauaauuuuucc

SEQ ID NO: 4109167 - RNA, 88 nt, Human
ggagucuugcuuuguugccuaggcuggagugcaguggcacaaucuuggcucacugcaaacugugccucccggccucaagcgauucuuc

SEQ ID NO: 4109168 - RNA, 56 nt, Human
ggagucuuggccugcugagaaaaugcuugacagaguacauuucgaggcaagucucc

SEQ ID NO: 4109169 - RNA, 76 nt, Human
ggagucuuucaccccauuugauuugcaggggaugucaagcagaaacuucaaaaugcacaaagggcuagaagacucu

SEQ ID NO: 4109170 - RNA, 68 nt, Human
ggagugaaggcaaagggaauggaauccagcaacuucgugacuugguacaaagccucuuugccuccucu

SEQ ID NO: 4109171 - RNA, 79 nt, Human
ggagugacccaucccccaccagaccacuguguccugcggagcccgggcaaggaggcugguggaggaagggcugagcucu

SEQ ID NO: 4109172 - RNA, 67 nt, Human
ggaaaggaagggcccauucucucagaaaacauguguuuucuguuuacagagggaccuguccaguucc

SEQ ID NO: 4109173 - RNA, 85 nt, Human
ggaaaggaggcugugguugcucugauuucaaggcccacaaaacuucucugacaacucucagaguaacuacaguauagacuuuucc

SEQ ID NO: 4109174 - RNA, 75 nt, Human
ggaaaggagucaggcauggcucuuccucaggugaagugauauuccucuguggauuaaucugucucuuuccuuucu

SEQ ID NO: 4109175 - RNA, 80 nt, Human
ggaaaggcaggccagaguggcugagaggcugggaguaggggagccuguucucucagcgauagugaugggggugccuuucc

SEQ ID NO: 4109176 - RNA, 74 nt, Human
ggaaaggcuuaaauuguaagggcacacucuuuaaaaaacacagugcucauugacagugggagcuuuaaaaaucc

SEQ ID NO: 4109177 - RNA, 66 nt, Human
ggaaaggggccuggaucuuuuguuccauccugagcagagggguuucuuuggcugaccauucuuucc

SEQ ID NO: 4109178 - RNA, 71 nt, Human
ggaaaggggguguguagucaccucggccaaaacccggcuuugggcagaaacaugcgccccagcuucuuucc

SEQ ID NO: 4109179 - RNA, 82 nt, Human
ggaaaggugagcuuuguuguuugguauccuuaaguucacucaaaugauacagguggaacuaaauaaaugauuucauguuuuu

SEQ ID NO: 4109180 - RNA, 61 nt, Human
ggaaagucagaggaggcuaagggaagcuggcugagauucacuuugaauuccuugauuuucc

SEQ ID NO: 4109181 - RNA, 62 nt, Human
ggaaagugaccccauguuaagucgaggagcuccuuaugucuuauuaugagguuagacuuucu

SEQ ID NO: 4109182 - RNA, 67 nt, Human
ggaaagugauggaauaauccaagauuuuaacgguuuugaagccuuggcccuucauuauaauuuuucc

SEQ ID NO: 4109183 - RNA, 57 nt, Human
ggaaagugcucugugaacucugauugcuaaaugcagguggguacaucacagagaccc

SEQ ID NO: 4109184 - RNA, 127 nt, Human
ggaaaguguagcuuacuaacggacagggaaugaagcugagguucucuuugaagccucuucuguagcuacuuaaagcaaccucagcccucuucccauaacaugaccaagcugagcacaucacuguucc

SEQ ID NO: 4109185 - RNA, 78 nt, Human
ggaaaguuauaucaugauuuuaggagacugugaacauaaaaugugugaguggaaaauuaagauuucauauggcuuuuu

SEQ ID NO: 4109186 - RNA, 76 nt, Human
ggaaaguuuccaaguauauguuugcuagguauaaucaacgaaaucggcaugcuuuaaaacguauguguaauuuucu

SEQ ID NO: 4109187 - RNA, 83 nt, Human
ggaaaguuuuaacaacugagguaucugcuguguuuaguaaaucauaaaaguaagcacaaugaacaucuuagaugaaaagcucc

SEQ ID NO: 4109188 - RNA, 84 nt, Human
ggaaaguuuuuguuugugcuauuuaauguaguugaaggguaaacaacauagaaagcacuaagcuuauauaaagaaauacuuucc

SEQ ID NO: 4109189 - RNA, 77 nt, Human
ggaaauaaaacaacucggcaacugcuuuucuacccgaaagucgggagcaaggagugggggcgagaaguuaaguuucc

SEQ ID NO: 4109190 - RNA, 60 nt, Human
ggaaauacugcacacccuguaagccuaauugggucauacauaacuuguacagugauuucc

SEQ ID NO: 4109191 - RNA, 59 nt, Human
ggaaauauacuucacugagccucugcauucaguaccuggcagugaaaaaguauguuucc

SEQ ID NO: 4109192 - RNA, 77 nt, Human
ggaaauaugccuacaaugcauucguugucucggccaguggcucgugacccucugcacuuggaagguauauaauuucc

SEQ ID NO: 4109193 - RNA, 70 nt, Human
ggaaauauuaauguaagacuagguuccaguguguguucauuauacacuguucacuagaucuucaguuucc

SEQ ID NO: 4109194 - RNA, 93 nt, Human
ggaaauauuuuucagaaugcauguuuccucucagcagacacucugaccaccaguuggggaggcaaacuaucaguguauuuugaaaaaguuucc

SEQ ID NO: 4109195 - RNA, 77 nt, Human
ggaaaucagaggcaacaacuacuuccugacaaauucaguucucucucuuucacugaguagauguucuuuugauuacu

SEQ ID NO: 4109196 - RNA, 83 nt, Human
ggaaauguguaaaaugucuuaucucaguuauguuucugaaacucuaugaucuauacacugguuuaugauauugucuuguuucc

SEQ ID NO: 4109197 - RNA, 75 nt, Human
ggaaauguucacagagcacugccaaguacaaguguacucucuugugucccggugguucucugucacgaucuuucc

SEQ ID NO: 4109198 - RNA, 57 nt, Human
ggaaauuacuuuagggucacagcgagauuucugugacagccaguaaaguaagcuuuc

SEQ ID NO: 4109199 - RNA, 75 nt, Human
ggaaauuauugagacgugauacacuuccuaucaaaacaacacaugagguggugauucauucgauuaguauuuucu

SEQ ID NO: 4109200 - RNA, 114 nt, Human
ggaaauucauuaaugucggagacagcauuagaaguaguuggggauuauuuuaucuucuacauauauuuuucucacuugcuguuucauauuuaccacucaaacauagaccuuucu

SEQ ID NO: 4109201 - RNA, 91 nt, Human
ggaaauuccuucaugggaaacaagcagauggccaguguccagcccuccaggaggacagacaggaggccaccugcucacccaugauggaucu

SEQ ID NO: 4109202 - RNA, 77 nt, Human
ggaaauucgagucaccuacugaccaaauuggauaauccagaugauuccagagcagguggucagaagguauaauuucc

SEQ ID NO: 4109203 - RNA, 107 nt, Human
ggaaauugcaugugcauuuugggugcccugauaauguccugcaguaaauuguuuucauauaaauugcaugcuuaauuaaucgcuuucaaaaaugcucauguauuucu

SEQ ID NO: 4109204 - RNA, 67 nt, Human
ggaaauuggcuuauggucagaccaaacuguucuuauccccuguguaagaggccaagucaucauuucc

SEQ ID NO: 4109205 - RNA, 81 nt, Human
ggaaauuuggaacuacuuuaguauuuuuucaugauuuuguucuuuaagauucagaaagcaagugcuggguacuuuccuucc

SEQ ID NO: 4109206 - RNA, 94 nt, Human
ggaacaaaagcacaaguccuggcuuauuuuuauagcagugcgaucagaaugccugaacugacagaaagaaugucuauggaccugguuugguucc

SEQ ID NO: 4109207 - RNA, 71 nt, Human
ggaacaaccagcuguggagggaggaaaugcgauuuguagcacuugccaauuuccacagaugcaaaugcucc

SEQ ID NO: 4109208 - RNA, 73 nt, Human
ggaacaagauuuugucugguaggguugaucuuugaaaggcuacaaaucauccuacuagccaggauuuuucacc

SEQ ID NO: 4109209 - RNA, 61 nt, Human
ggaacaaugaaugugauuaacuucaaggacgggaguccagaaguaaugaugucauuccuuc

SEQ ID NO: 4109210 - RNA, 94 nt, Human
ggaacaauguccccagaauucuuuucuuucugaaagucgcuucucuuagaugccauuuuaaaggaguuuauggggaguaaaauuguaauuaucc

SEQ ID NO: 4109211 - RNA, 56 nt, Human
ggaacacuggcucaauuauaucuuuguggccauuuguuaguuguagccacuguucu

SEQ ID NO: 4109212 - RNA, 79 nt, Human
ggaacagaaugccuaugaguuuguuguaaacaccugaaguaagaggguuuacacugacagcacauaaggaaucuuaacc

SEQ ID NO: 4109213 - RNA, 83 nt, Human
ggaacaggcccaggaagaggcagccguauuucaaaggcucuccugcauggucugggaucgauggggcugccugccugggcucc

SEQ ID NO: 4109214 - RNA, 85 nt, Human
ggaacagggccaucaaaguggcccuaggccaaggggaggucucugcccccuuccccagcccggggcuacccuuggguccugcucc

SEQ ID NO: 4109215 - RNA, 59 nt, Human
ggaacaguaucaguagugccagugguaguauuugcacuggcagaacuggugauugucuc

SEQ ID NO: 4109216 - RNA, 75 nt, Human
ggaacauguuaccuagggcugugucuccaggaccaucaguaggggaugcugggauauagcuucuagggcauagcc

SEQ ID NO: 4109217 - RNA, 59 nt, Human
ggaaccacagcccccagcaggccucgcgcggcgcgcugccuccugggauuuguaguucc

SEQ ID NO: 4109218 - RNA, 57 nt, Human
ggaaccaggugauacccuuuaacaggccccaagggggcaggugugguaucagcuucc

SEQ ID NO: 4109219 - RNA, 60 nt, Human
ggaaccggguuugggcagcccaggcugccugccagaugagcccuccaaacccaggauucc

SEQ ID NO: 4109220 - RNA, 65 nt, Human
ggaaccucaggccugccagagccccaccccuacaccgggagguugggggcaggcgugaggcagcc

SEQ ID NO: 4109221 - RNA, 73 nt, Human
ggaaccuggcaggagguuuucuccaggaaaaucugaaagucagcaaguuuuaguuugccuccuaccagcuucc

SEQ ID NO: 4109222 - RNA, 78 nt, Human
ggaacgaugguugaauguagcauuuaugguugaauguagagaaaauacaguauaaugagucgcuuuguuccagguucc

SEQ ID NO: 4109223 - RNA, 93 nt, Human
ggaacuaaaagaggacagaguacugaguggaacauaggaugauagauuuacaaauaauguagcauacuucuacuucauuguaucuuaaguuuc

SEQ ID NO: 4109224 - RNA, 92 nt, Human
ggaacuaauuuuggaauuuguugauagacacaggauaguguucucuucccacucacugacuguggauggcagcagccagggaauuagauacc

SEQ ID NO: 4109225 - RNA, 79 nt, Human
ggaacuagaccuggaagccaggcccgcuccuaagacagguaucuugugggugggacuggcuuccagccccagaguuacc

SEQ ID NO: 4109226 - RNA, 77 nt, Human
ggaacucauaguuuucuaugcacuguuaucugagcugaauuaaaauucgaugcaguguuuggaagcuuaagauuucc

SEQ ID NO: 4109227 - RNA, 72 nt, Human
ggaacucucuuuaaugugauuguaauuauuuuaccuagaguguuuacagugaacacauuaaguaugaaagcc

SEQ ID NO: 4109228 - RNA, 67 nt, Human
ggaacugaguuguccgggcuucaguaugugcugacuuacccuguggccuuggaccagcaucuuuucc

SEQ ID NO: 4109229 - RNA, 104 nt, Human
ggaacuggacaugggaccaaauuguucccuucaagcugcuauagguugcugggcuggcgcaaacuggccugcacuuuagugcuugguuugccaugucuaauucu

SEQ ID NO: 4109230 - RNA, 58 nt, Human
ggaacuggcagagguaagacuagaacacuggucucccaugucccuguccaguguuucc

SEQ ID NO: 4109231 - RNA, 101 nt, Human
ggaacugguauucaacauccauguguuuuccuguccacaauaaauuguaauaauugugccugaaaagagagaauauauuggcaauuuugauuucauguuuc

SEQ ID NO: 4109232 - RNA, 72 nt, Human
ggaacuuugggucuuguuuaacugucguuaguuggucaaccagcugucuaaguugagcaggaaagugaggcc

SEQ ID NO: 4109233 - RNA, 55 nt, Human
ggaagaaaagcuuccagcgccuccccuccaaccggcccuugaggcuucgcuuacc

SEQ ID NO: 4109234 - RNA, 88 nt, Human
ggaagaaaggcacuuggcuguggccuugaggagauucaugcaugaagguaaaggcaggaguugggagcagcagaccaagagcucuucc

SEQ ID NO: 4109235 - RNA, 80 nt, Human
ggaagaaauauauuaaaaaguugaaaggacuuaucucugugagaugggauuuuucuccuuuucauguuucuguauuuucc

SEQ ID NO: 4109236 - RNA, 61 nt, Human
ggaagaacucacagcugagccagguggaauguguucccugggccacagcugugagcucucc

SEQ ID NO: 4109237 - RNA, 93 nt, Human
ggaagagaaaguauaggcugcggagaguugccguccugguaccugugugcauggugcucuggggaugcuucugccgugaucaugaacucuucc

SEQ ID NO: 4109238 - RNA, 68 nt, Human
ggaagagaaugauggcuaugggaaauuuauggauacaucuaugcacauaaaggcaucuuucucuaucc

SEQ ID NO: 4109239 - RNA, 67 nt, Human
ggaagagaccuggacaauucuugggaugaagugguguucuaauaguuugaauguuucugucucuucu

SEQ ID NO: 4109240 - RNA, 57 nt, Human
ggaagagaguaaaaacagaaaaugggcauuuuuugccauuugcugagcuuuuucucc

SEQ ID NO: 4109241 - RNA, 95 nt, Human
ggaguggggcagggggcggcuuauucacucuggggauucgccauggacacgucucaacagugcaagcugcuccccguguuucccugccccacuuc

SEQ ID NO: 4109242 - RNA, 65 nt, Human
ggagugucaucgugaaaacauagcaaaccagugaaaguuugcauacuguugagauguugagaccu

SEQ ID NO: 4109243 - RNA, 61 nt, Human
ggagugugcaguuguucugggacuggacugccaucucaggguuuguacaaguguagacuuu

SEQ ID NO: 4109244 - RNA, 59 nt, Human
ggaguguuugugaguuuaacuuggcuugaauaccaaguucuugcuauaaaaacaaaucc

SEQ ID NO: 4109245 - RNA, 58 nt, Human
ggaguuacacagaagucaguuugagucccaguucagcugcuuacuagcugugugaccc

SEQ ID NO: 4109246 - RNA, 70 nt, Human
ggaguuacagagcccugcgcuauagaauaaacuggcuuccucuuagguccaggagcucagggcuuauucc

SEQ ID NO: 4109247 - RNA, 71 nt, Human
ggaguuauaaauuauuaagcaucacaugaauaauuuauuaaucauucaugaggugcuagugcugugucucu

SEQ ID NO: 4109248 - RNA, 69 nt, Human
ggaguuauacagugcacaaccugugcagccacacacagcuggccccguacauguaauguacuguccucc

SEQ ID NO: 4109249 - RNA, 67 nt, Human
ggaguuauuauuggauugguacagaguuuggaaugauaaaagaauucugaaaauagauaguggcucc

SEQ ID NO: 4109250 - RNA, 96 nt, Human
ggaguuccuggggaccugagcacagaaauaagauauuuuguaaaggaaguaacucuuauuguugaugcauuauuagacagacucaggagaaucucc

SEQ ID NO: 4109251 - RNA, 55 nt, Human
ggaguucugggaggauauuugcauguaaguuugcaaauucaccuaguaaaacuuc

SEQ ID NO: 4109252 - RNA, 65 nt, Human
ggaguucuuacacucuuaaaaaucauuaaugacccugaagaguuuuuggagugugaguuacaucu

SEQ ID NO: 4109253 - RNA, 66 nt, Human
ggaguugagagggugccuuguuacuguacagucuuacaguaacucauguaaaccucacaacaaucc

SEQ ID NO: 4109254 - RNA, 64 nt, Human
ggaguugaguccgguacaauguccuucaaaaucaggccacagaugagaagcugcauucaauucc

SEQ ID NO: 4109255 - RNA, 84 nt, Human
ggaguugauucaaaggggacaaguggggccuccauucauucugaccugaucuucacucugucccccauugagaucaagugcuuc

SEQ ID NO: 4109256 - RNA, 59 nt, Human
ggaguuggaggcuccagggaacuccagaaaucccagagagauuccgggccaccaacucc

SEQ ID NO: 4109257 - RNA, 76 nt, Human
ggaguuggcaaauuucugauugcugaugaggcccacggugcgguggauccaggccagcagcucagccgccagcucc

SEQ ID NO: 4109258 - RNA, 87 nt, Human
ggaguugggaaagggaagagaugggggguaagccuuggauugugacuguuuacugggcuguuccuuauuucuaccccacgucgcacc

SEQ ID NO: 4109259 - RNA, 56 nt, Human
ggaguuggugccgccgggccagaggcugcgaguccagcuggcucuggacuugcucc

SEQ ID NO: 4109260 - RNA, 88 nt, Human
ggaguuucgcucugucaccgaggcuggagugcaguggcgggaucucuagucacugcaagcucugccuuccggguucaagcgauucucc

SEQ ID NO: 4109261 - RNA, 65 nt, Human
ggaguuugaagcaaaauugaggaauggcugucccucagagguuuauuaaugaugcugagagcuuu

SEQ ID NO: 4109262 - RNA, 83 nt, Human
ggaguuugauuuguaauuaaguguaguagcuauuucuguuugcacaaagcauaaaacguuacaacauguucaaguuuaagucc

SEQ ID NO: 4109263 - RNA, 89 nt, Human
ggaguuuugcucuuguugcccaggcuggaguacaauggugcaaucuuggcucauugcaacuucaaacuccuggguucaagcgauucucc

SEQ ID NO: 4109264 - RNA, 89 nt, Human
ggaguuuugcucuuguugcccaggcuggagugcaauggugcuaucucagcucacugcaaucucugccucccggguucaagagauucucc

SEQ ID NO: 4109265 - RNA, 78 nt, Human
ggaguuuugcucuuguugccuaggcuggagugcaauggcucaccgcaaccucugccucccagguucaagcgauucucc

SEQ ID NO: 4109266 - RNA, 56 nt, Human
ggaguuuugggcacaggcuguccuggauaauuggacauuuuggugaacacagcuuc

SEQ ID NO: 4109267 - RNA, 69 nt, Human
ggauaaaagacacacgaauguguaugugcacacacacacacacgcacacauuuacauguuuacguaucu

SEQ ID NO: 4109268 - RNA, 79 nt, Human
ggauaaaagcauguagcugggaaugggcugcugaguagccucuacucccagcccagacuucuccaguauguuuucauuc

SEQ ID NO: 4109269 - RNA, 76 nt, Human
ggauaaacacagagggacaguaugaugaaagcauguuauuuaauucauaagcuuuuccaaaguccaucuggucucc

SEQ ID NO: 4109270 - RNA, 66 nt, Human
ggauaaagaccaguaucuuauguucucuaacuuaagaacuagaaccugagauacuggucuuuaucc

SEQ ID NO: 4109271 - RNA, 85 nt, Human
ggauaaagucucacauaugucucuguacaacagucucgggcugucauuguuuaggcuugcagaauuuauguaaugaugaagaucc

SEQ ID NO: 4109272 - RNA, 73 nt, Human
ggauaaauaguucuuaucuagaagcauguuuuaaguguucuuauugcaaucucugagaaaguacuguauguuc

SEQ ID NO: 4109273 - RNA, 82 nt, Human
ggauaaauaucaaauaaucucacuuuauguggaaucuaauaaaguugauuucacagaagcagagaguagaauggugguuucc

SEQ ID NO: 4109274 - RNA, 117 nt, Human
ggauaaauuaacuggggaauauggauaaauuagaucuugcaaccugcuguguggcuuauuuaauguuggcccacaguuaguuugcauggcugauuugaaguuucuuuccucaaaucc

SEQ ID NO: 4109275 - RNA, 62 nt, Human
ggauaauaagcacagcaggaugucccucaaggugcuucagacuccggcuguguuuauuaucc

SEQ ID NO: 4109276 - RNA, 60 nt, Human
ggauaccagggaggaggggcugugugaaagucagagcugcgcuuuuuccugguuuuaucc

SEQ ID NO: 4109277 - RNA, 89 nt, Human
ggauaccauuuggagaucacuggaaaagcucaaagcaaaauuuauuuuauuguucuguuguuuuauugugagucccauuagaugguucc

SEQ ID NO: 4109278 - RNA, 89 nt, Human
ggauacugcacacagacaggccucuugucuuccucacaugugcugggccaaugacauguggugagaagaggcuguaaagugagccugcc

SEQ ID NO: 4109279 - RNA, 81 nt, Human
ggauagaguugucgugaaaguuuaaugaaauugcaugcaccccagcauguaacaguaguuacuauucuuacagcuguauuu

SEQ ID NO: 4109280 - RNA, 86 nt, Human
ggauagcagagaccugccacuggcaaugcagggcucucaguggaguguccuggcagacugugagggcagggaggaaucuguuguuu

SEQ ID NO: 4109281 - RNA, 86 nt, Human
ggauaggccagggaugggauggagucaguucugccugggaaacuaauccgaaucauuuaccuuucuguauuaaccuuggccugucc

SEQ ID NO: 4109282 - RNA, 88 nt, Human
ggauaguaaguggaagaugaaaauaugaaggcuuugagagguucuacuauaauuucucaauauuauaugucauaaauauauauuaucc

SEQ ID NO: 4109283 - RNA, 62 nt, Human
ggauagugguuugacuucauggacuuuuacuaccaagggucuccauguuaacaucacuuucc

SEQ ID NO: 4109284 - RNA, 68 nt, Human
ggauaguucugagaguugaaaacaccacugugaugauaaugacaguguuccugcucucaggaagcucc

SEQ ID NO: 4109285 - RNA, 62 nt, Human
ggauaguuuuccauuuugugauuuuuaaguggacauuacuuggaaaauucaaaauggcaucc

SEQ ID NO: 4109286 - RNA, 79 nt, Human
ggauauaauaagcuacugcuuacaaaaggaaagaauacaaauaugugucuugcgugggguaggcauugcuuauuuguuu

SEQ ID NO: 4109287 - RNA, 57 nt, Human
ggauauauggucaccuuaaacauaaucucccuaccuuguguuugagacuauguuucc

SEQ ID NO: 4109288 - RNA, 61 nt, Human
ggauaugagaggguaugcaucucugcugcaugaagagaagacagcagcaccucucguuuuc

SEQ ID NO: 4109289 - RNA, 76 nt, Human
ggaucaaagcaugauuuggcacuucacgagacagcuaucggcaccagugauucuguuuagaggugauguuuugucc

SEQ ID NO: 4109290 - RNA, 84 nt, Human
ggaucaaagucagaaauuaaauugaguuauaggaaauaaguuauguuucuuguacacuggaauuuaugguuguaaaauuugucc

SEQ ID NO: 4109291 - RNA, 117 nt, Human
ggaucacauuuuccugccuucuucauguuaguaauugagugcuagacaucaugaauauuacauuguucagagucuagauuuugcuauguuucugcaaagaagguugaaguuuguucu

SEQ ID NO: 4109292 - RNA, 71 nt, Human
ggaucauuaacacauccaucaccucgcguagcugccauucuuuuugcggguagugagaacuuuuaagaucu

SEQ ID NO: 4109293 - RNA, 68 nt, Human
ggauccagagcucuguuacucagccucuucuucaaucccugaggcagcuaagcagaauucuaggguuc

SEQ ID NO: 4109294 - RNA, 61 nt, Human
ggauccaggaggguuuagacaugaacccaauagguaaucagguccccaacucuucucaccc

SEQ ID NO: 4109295 - RNA, 63 nt, Human
ggaucccuaaaagucagcuucgacacaauaauuuguguguaaauaguuuauuauaggugauuc

SEQ ID NO: 4109296 - RNA, 88 nt, Human
ggaucccuguguccacucucugccgugccuguccccaucaucacuccuggugaagcagggacgauagcagaguucccacuggaggacc

SEQ ID NO: 4109297 - RNA, 57 nt, Human
ggauccguuugugugggaguauuuaagccuauugaugucuccuggaaagacgguucc

SEQ ID NO: 4109298 - RNA, 79 nt, Human
ggauccucuuguuucucugaaggccaugcucacuuguccaaguuccaucaucuauucagggacagacuuagaaagaucc

SEQ ID NO: 4109299 - RNA, 82 nt, Human
ggaucgcuuaagccugagagguggagguugcagugagcugagaucaugccacugcacuccagccuaggugacaaagugagac

SEQ ID NO: 4109300 - RNA, 130 nt, Human
ggaucgggggacccugggggcucaggaucuagcaaggggcggcaggaguaaaggaggaaggaaugacaggugcaaauaccuucccaccaaagcccuuguugcccucuggcuccuccccagaguugucccc

SEQ ID NO: 4109301 - RNA, 68 nt, Human
ggaagagcugguuuuaggcuaugucucugggauugacuuccagaaugucaaccaagaaccagcucacc

SEQ ID NO: 4109302 - RNA, 67 nt, Human
ggaagaggaagccucucuguuagucacugggucacagacccugacccuaucagagggccaccuuucc

SEQ ID NO: 4109303 - RNA, 115 nt, Human
ggaagaggauguccuguagaugcaacaugucaagaaagagauuugaaauaaaauuucaagugugcuuugacuggcuguauuuaaugaauguccuuaaucgaaucaauuaacuucc

SEQ ID NO: 4109304 - RNA, 130 nt, Human
ggaagaggcauccuccgagacuacggcaguggcuccucucuacucccagcugacccccagaacacugucaccgcgccgcggaggagagggggcuuugccucaagucaggaagauccucgccucuccaucc

SEQ ID NO: 4109305 - RNA, 82 nt, Human
ggaagaggcccaagcaggcaucuuggaggucaagugcggcauuugaccuuugauuuaggguguuauauguuggcauacuucu

SEQ ID NO: 4109306 - RNA, 64 nt, Human
ggaagagugcacaggacagggaauucgaaauuccaaauuagaaucuuggcucuguuugucuucc

SEQ ID NO: 4109307 - RNA, 70 nt, Human
ggaagaguucauuguuuugagaacaaccugaauaaguucagaauugauuuucaaaacagccuuuucuucc

SEQ ID NO: 4109308 - RNA, 71 nt, Human
ggaagauagugcccugagcuuaugcauucuuuaacccaaacaauccauauuagggacacauauggccuucc

SEQ ID NO: 4109309 - RNA, 82 nt, Human
ggaagaucauucuaggccuggcuugggcccaguccuugcuggaagcuugaacagggccaggcucuggagagaauguucuucu

SEQ ID NO: 4109310 - RNA, 118 nt, Human
ggaagaucucuguuuuaacauauauuguaagguuuagagcuacggccuuuaaaaaguaauaugauuacucuaaagguacaauagcuaccugcggaaaugaugaaaagaucaguuuucc

SEQ ID NO: 4109311 - RNA, 55 nt, Human
ggaagaugaagagaccugcccaaggucgcacagcuaacaggccucuugaucuucc

SEQ ID NO: 4109312 - RNA, 91 nt, Human
ggaagaugcagaugggcaggaaucccuggauggcuuccucaaggagaagcuacaggaaggaucuugcucaagagaaagagucugauuggcc

SEQ ID NO: 4109313 - RNA, 68 nt, Human
ggaagauuaaguugcuaaaguuuucuguucaaauaauauguucaauaaacauuaguaauuugacuuuu

SEQ ID NO: 4109314 - RNA, 58 nt, Human
ggacgccagauagcucucaagggaaccacccagauggcuucccuuccugucgggcucc

SEQ ID NO: 4109315 - RNA, 92 nt, Human
ggacgggggugugggcagggcacagagcugcucaugguggccagguccccugugcuacaaguaaggcagcuccugccauugccaccucgucc

SEQ ID NO: 4109316 - RNA, 94 nt, Human
ggacggggucacgcagguugccguggaggacaucugucgggggggaugccagacucgacugccaggugagcuccaggccuugagugucuccucu

SEQ ID NO: 4109317 - RNA, 59 nt, Human
ggacggugggggcaggagggaaagccaaggccguggguucuaauccugacucagcugcu

SEQ ID NO: 4109318 - RNA, 60 nt, Human
ggacgguucuggaucaccacuucugccucgcuguggugagaagggugggaaucuaugucc

SEQ ID NO: 4109319 - RNA, 129 nt, Human
ggacuaggcugggcugagcuggacugagcugagcuagacugagcugagcugggugagcuuagguggacugagcugggcugggcugagcugagcuggacugggcugggccgaacugagcuagacugggcu

SEQ ID NO: 4109320 - RNA, 59 nt, Human
ggacucaggucggucucacucuugccccuagggcuuccucgaggaacuggcuugguucc

SEQ ID NO: 4109321 - RNA, 60 nt, Human
ggacucagguuggagucacagugauuggggcagagauggucaugugacccaaccugagcc

SEQ ID NO: 4109322 - RNA, 56 nt, Human
ggauggaggcggguguggaaggugcucugaugcagcagcccagaugccuuccaucc

SEQ ID NO: 4109323 - RNA, 58 nt, Human
ggauggauacuauaggaggcacauuugagaucuuucaaauugcuccagcugaccaucc

SEQ ID NO: 4109324 - RNA, 63 nt, Human
ggauggaugugaucugccuccuacgggaaugcuauuuaaaggggcagccucacaauccucucc

SEQ ID NO: 4109325 - RNA, 96 nt, Human
ggauggccccaggcucgacuccugucucaguguauuugcagucggcauaggcuuauccugcagcagcuggacuggcagagucugggagccuugucc

SEQ ID NO: 4109326 - RNA, 72 nt, Human
ggauggcuuuccggacuuuggccaggauccuccuaguaaccccuuggcccaagcccgggacggccacugucc

SEQ ID NO: 4109327 - RNA, 83 nt, Human
ggaugggaggggcaaugagggaaagagucuggaggaaacaugccccuuacaaauuccaccacucaugggugucccaaucauuc

SEQ ID NO: 4109328 - RNA, 66 nt, Human
ggaugggcguggccgggauggaaaugggacuggauuccagagcaucagaccuggccgccuccaucc

SEQ ID NO: 4109329 - RNA, 90 nt, Human
ggaugggcugcguggguggcuguggcccaggccggauucugucacacuggguccucugucccuggggcacggccagccgggugcucaucu

SEQ ID NO: 4109330 - RNA, 103 nt, Human
ggauggggagguauguugaagcagcaugauuguaauacuauggucuucucuccuaccuccuaguuccacaguuuugucuguauuggaaauaucgucuccaucc

SEQ ID NO: 4109331 - RNA, 78 nt, Human
ggauggggguauagggugcuccuggguguggcugccccuccucugaggugcccaggcucaggggcuacacccccagcc

SEQ ID NO: 4109332 - RNA, 57 nt, Human
ggaugggugugaaaauggucaucuugauuuauacagaaccacauuuacagcccgucc

SEQ ID NO: 4109333 - RNA, 89 nt, Human
ggaugguaagaauguuguguuugauuuuuguuuguuuauuucuuugaaguacaugaacaauaaaauagaucacaggaaaauuauuaucu

SEQ ID NO: 4109334 - RNA, 85 nt, Human
ggaugguaggccucuugaguauguugugcaugggaauuugcugucaucacucauagcaacguguauaaacucaaggaucccaucc

SEQ ID NO: 4109335 - RNA, 110 nt, Human
ggaugguauguugaguucuaauuuaaaggagaugcuacagagauagguuggguuaagauaacuuccugcuaugagcuucugugauuuuuauuugaauuuucuucccaucc

SEQ ID NO: 4109336 - RNA, 65 nt, Human
ggauggucaggcuuuaacaucuguuuggguugccuugaagucaugaguucaaaaugccugccucc

SEQ ID NO: 4109337 - RNA, 76 nt, Human
ggaugguggagguggaggcugaacaucuggcauugcucccaacccuggaguccugauccuuagcucuccaucaucu

SEQ ID NO: 4109338 - RNA, 64 nt, Human
ggaugguggauggaucgauggauggaucugucuucccugaagaucugucuuccaccacacaucc

SEQ ID NO: 4109339 - RNA, 127 nt, Human
ggaugguguauucuuagcuuucauauuuaucuugacccacaagccuguggcuuucugggucacuuuguccaaagcagagccagagcuugucaugagguaucagugauuagaggaggacgcauuaucc

SEQ ID NO: 4109340 - RNA, 64 nt, Human
ggauggugucauggcugaaagugggggcucucaagcuuccguccacauccuggcugugccauuu

SEQ ID NO: 4109341 - RNA, 79 nt, Human
ggaugguguuccugcugagcgucugucauuucuacgggaugauuuccaaagauggagcuccuaggaugaggcacccucc

SEQ ID NO: 4109342 - RNA, 103 nt, Human
ggaugguucuuuaagguaaagauuccugggcucuauccugacccagugaaugagacucucugaggauggagcccaggcauuugcuuuccuuaauaaguugucc

SEQ ID NO: 4109343 - RNA, 130 nt, Human
ggaugguugcaaguuucaggacaugauaucuucuacuuugccaaucaggcugaauguuucuuauuuccuuuccaccugaacuguuugccagauaggagauggcaaauaaugaaacugauaguaacuuucc

SEQ ID NO: 4109344 - RNA, 72 nt, Human
ggauguaagugugggucauucaggauggagcagggaucuuccccauccugaauggucucagccaugucaucc

SEQ ID NO: 4109345 - RNA, 77 nt, Human
ggauguacagucaugcuuucuguuccucaaacuguaauguguuuguaagugaaaaaugaugaguaugauguggaucc

SEQ ID NO: 4109346 - RNA, 89 nt, Human
ggauguagagcugguugacacucugcuuucucaaacccugugcuucccugguauuaaugggguuuagcagacagugagcuucugccccc

SEQ ID NO: 4109347 - RNA, 110 nt, Human
ggauguaugauuucaagcuauuaaggugagcuguauaacagggaaggucaaaaccgugaacugaguccuaaauuauguagccuaccccagugacuuacauuguacuuucc

SEQ ID NO: 4109348 - RNA, 57 nt, Human
ggaugucgaggaugggguagcagcucaguccgccccuaccccaggccccucgaugcc

SEQ ID NO: 4109349 - RNA, 63 nt, Human
ggaugucuuuacuuugggauuuuguuaucuaagaucuaaaucugucccacauguaaggaugcc

SEQ ID NO: 4109350 - RNA, 57 nt, Human
ggaugugaaucugggcugagacagggcaauauagcuuaguuucaccaggguucuacc

SEQ ID NO: 4109351 - RNA, 58 nt, Human
ggaugugaggaggcuguauucuucucccuagagagauuuacacaugccuuuucccacc

SEQ ID NO: 4109352 - RNA, 128 nt, Human
ggaugugcauuuuucuaugaagaacauuccagaggauugaucaaacacugcagagaggcuggguuccuguaaaaguuugucgaucccugcaguauauccuucaugucagaaauucaugcaacuauacc

SEQ ID NO: 4109353 - RNA, 80 nt, Human
ggaugugcuucugccgguggaggcggugguucccauguguuaaaaugaagugcuucucaugcuuccaccugaagcgcacc

SEQ ID NO: 4109354 - RNA, 56 nt, Human
ggaugugcuuggaacaccgucauccaggauaggaauaugagguggcugggccaucu

SEQ ID NO: 4109355 - RNA, 58 nt, Human
ggauguguggcuggcucuuugucucuaggcagggacacagcugcagccacacccaucc

SEQ ID NO: 4109356 - RNA, 64 nt, Human
ggauguuagaacacuuuggaagcucugaauuuuaaaaauuugaaaguguugauaugugacaucc

SEQ ID NO: 4109357 - RNA, 79 nt, Human
ggauguuauuuucccaguuuaucauuuccaagucuuccuugaguggccaggaauggagagguggccucgaauaauguuc

SEQ ID NO: 4109358 - RNA, 56 nt, Human
ggauguuccaaagucucugagcugagaugggcucaccuccuuugcuuuggaacccc

SEQ ID NO: 4109359 - RNA, 67 nt, Human
ggauguugcacugaaggcuaggauuagaugauggaauccucuaauuauuuguuuuuacuaaauaucc

SEQ ID NO: 4109360 - RNA, 55 nt, Human
ggauguuugcccacuuucuugagauuuaaaauucagagagggagaugaaacaucc

SEQ ID NO: 4109361 - RNA, 59 nt, Human
ggauuaagaccugucaguacaccaagacuggggcccagucaccuggcagguuuuuaucu

SEQ ID NO: 4109362 - RNA, 70 nt, Human
ggauuaagugcaauguuuuacuuaaaaguaguuuccuacucuuuucaggaauauuauuggcaauuaaucu

SEQ ID NO: 4109363 - RNA, 65 nt, Human
ggauuaauauugugacacaugccguccugagaaaugucucagacuuuuguucaacgaguuaaucc

SEQ ID NO: 4109364 - RNA, 67 nt, Human
ggauuacaauuuuuuggaagaguaaaaaguucacacuuuugaaauuucacagaaggauuguagggcc

SEQ ID NO: 4109365 - RNA, 95 nt, Human
ggauuacagauagccgcggagucgguggacccccgcuuuuucccgccaucuggucuccucagcugggggucgcgccucugggcagaucuguggcc

SEQ ID NO: 4109366 - RNA, 100 nt, Human
ggauuacucaccagacagauggcagugagguuccuagccugauagcagggaccuaauagcaggcuaggaaccucacugccaucugucuggggaauaaucc

SEQ ID NO: 4109367 - RNA, 81 nt, Human
ggauuacuuguuucaguuuuuuacuuccucugcuaugagacuuugcaguacaguaaagcaagcugaauaugcaucccaucc

SEQ ID NO: 4109368 - RNA, 126 nt, Human
ggauuagcaggugaaggccaaugaaaguccauauaauggaaaacagaaguggcaggaaauuuugauauauucuuauacucuggaauuuuauucuuuuggcuuuauucccuucuuuguaaguaaucu

SEQ ID NO: 4109369 - RNA, 58 nt, Human
ggauuagcuuuccuuguugccugugcucagcacagcaugaagagaggaagcauggucu

SEQ ID NO: 4109370 - RNA, 103 nt, Human
ggauuccagagaugucuugauuuuuauuaauguugguuucaauggauguuccccagguuuguaaugagauuuuaauauugagaaaaucucugucuuuggcucc

SEQ ID NO: 4109371 - RNA, 130 nt, Human
ggauucccucagcauagguagguucugggcagucaaaaaugaggagagauguucucuagagguggcuagcagagcacaucuucauucugcacucugacuccuccuauuaguuggaaauaacagggaaucc

SEQ ID NO: 4109372 - RNA, 62 nt, Human
ggauuccuggaaagaauuaaagagaauuugcuggagauuugaauagggcuuugcagggaacc

SEQ ID NO: 4109373 - RNA, 88 nt, Human
ggauuccuggccaggggcgguggcucacgccuguaauccuagcacuuugggaggccggagcgggucgaucgccugaggucaggaguuc

SEQ ID NO: 4109374 - RNA, 128 nt, Human
ggauucgcgggagggcagggagagcagacagacagacagacagccguggccacccuagagacacacugcagccgugguggcccacaggacucuuuagucucugugcucuaaggcccccugcagagucc

SEQ ID NO: 4109375 - RNA, 83 nt, Human
ggauucggggccucuagcagggccaggcugggaaccgaggacacuuggucucccucccugggccugcaacaggccugaaauuc

SEQ ID NO: 4109376 - RNA, 102 nt, Human
ggauucucccugccuccaaguggcucucccagucaggcucaggauugggcucccaguccugugcucagacauggggguucaaauuuagugcuauaaggaucc

SEQ ID NO: 4109377 - RNA, 56 nt, Human
ggauucuguguccaauggccuuagcaggaagauugcuucggaauuuggcacgaacc

SEQ ID NO: 4109378 - RNA, 78 nt, Human
ggauucuugugccucugggugacgaaaggugaagggauuguacgcuucgcccacgccagccuggggcucgggaucucc

SEQ ID NO: 4109379 - RNA, 73 nt, Human
ggauugaaacccaaggcugcuggcuucugagcucaugcuguacccugggcaggcaaggcagccuggugauucc

SEQ ID NO: 4109380 - RNA, 58 nt, Human
ggauugaaggcccuuaacugaugccaaaacacccaccaguaauagaggcuuugagucu

SEQ ID NO: 4109381 - RNA, 76 nt, Human
ggauugagguauuuuggaaugucaaaagucugcuauuccauaaauguagcauuaauauucuagaauauuucucucc

SEQ ID NO: 4109382 - RNA, 56 nt, Human
ggauugagguuuaaagaguuuuugagcaaguaauuaaauuucugcaagccucaacu

SEQ ID NO: 4109383 - RNA, 124 nt, Human
ggauugcagauacacauagcaggaguugcuuuagauuguuuugggggcgaaaguaauauuuuuuucaguauucaaauaugucuuacguaguuauuucugauaaggaagaaacauuuguuaaucc

SEQ ID NO: 4109384 - RNA, 95 nt, Human
ggauugcauaccuugucugaagucacacagaugcaaaaggaaggacuagaaacugacccugggcaucuuuugugacucaggcgaauguucuuucc

SEQ ID NO: 4109385 - RNA, 60 nt, Human
ggauuggugauagacucuuggugaacaaagauuuccuuucauaaaguuaucaccaaaucc

SEQ ID NO: 4109386 - RNA, 64 nt, Human
ggauuuagggcaaucaucaggagcagcccugugacauggagcuggccuugaggugucuuuauuc

SEQ ID NO: 4109387 - RNA, 73 nt, Human
ggauuugacuuugccugcuggccaugcagaggccaauuccugaauuccugcuggccaagcagaggucaauucc

SEQ ID NO: 4109388 - RNA, 68 nt, Human
ggauuuggcagguggagacagcagagcagguuaugacaccagcuuugucuucccacguguggaucacc

SEQ ID NO: 4109389 - RNA, 71 nt, Human
ggauuugguuugccaguauuuuauugaugauuuuugcauugauauucaucagggauauuggucuaaaauuc

SEQ ID NO: 4109390 - RNA, 93 nt, Human
ggauuuuaaugugggaauuuauuuucuggaauuguccaauguacaaauagauaaaauaauuucagagguagagauucuaaaguaauugaaccc

SEQ ID NO: 4109391 - RNA, 69 nt, Human
ggauuuuacuaggccacgaaggagaugauagaaaccauuccagacucuuugggugugccagaggaaucc

SEQ ID NO: 4109392 - RNA, 98 nt, Human
ggauuuucucugcuccagugucugagcccuuagcugggaugacucacaugacucaggaagcugaaggcuagaacagcugguuuggagaaaccaauucc

SEQ ID NO: 4109393 - RNA, 73 nt, Human
ggauuuugauaagugcuuuggaagaaacguucuucggaacauucauucauucaacaaauauuuauugagcucc

SEQ ID NO: 4109394 - RNA, 66 nt, Human
ggauuuuguuccuagcuuuaaacaaaaccuaugcuuagaguuaaguuagaguagagaacaugaucc

SEQ ID NO: 4109395 - RNA, 69 nt, Human
ggauuuuguugaugguggaguagccuccugauacuguaugguggcuaucuuccucaaugucagcuuucc

SEQ ID NO: 4109396 - RNA, 76 nt, Human
ggcaaaaaugucuacagaauguuaauauuuuuaacuccuugacaaauaugaauagucugugguucauuuaaaugcc

SEQ ID NO: 4109397 - RNA, 76 nt, Human
ggcaaaagcauuucuugguuuuaaaagguacuucaccccuuuacaaccuguguaauugcuauuggaaugcuuugcc

SEQ ID NO: 4109398 - RNA, 82 nt, Human
ggcaaaagugaguuuugaaccuaaggcccuggguaugccgccuacacaggcccccacaccugguuuaaugcucacuguugcu

SEQ ID NO: 4109399 - RNA, 101 nt, Human
ggcaaagaaaugccuuguuuuagauuauuuuguguccuguuucccugucuauaaggaaggacccuauagaaaucaggacaggacugaauccuaacuuugcc

SEQ ID NO: 4109400 - RNA, 73 nt, Human
ggcaaagacccagaaggcaagcacaaacuuggcauguuugagaaguuagaagugugucaucugugucucuguc

SEQ ID NO: 4109401 - RNA, 71 nt, Human
ggcaaagaugcuacccagccauugcuuucuaaggaagaguguagugcuuucaucuggagugucucccugcc

SEQ ID NO: 4109402 - RNA, 78 nt, Human
ggcaaagcucauccaagcauaguucaaagccacuuuuguauaaaggcuuaaacuacuaggaugaauuuuuuagaugcc

SEQ ID NO: 4109403 - RNA, 69 nt, Human
ggcaaaggaggggaaggaaaguuauuagcagagaucucccagaaguccucuguaacugucccuuuugcc

SEQ ID NO: 4109404 - RNA, 57 nt, Human
ggcaaaucaaagggccagcagcucucucccugcuucugccaaaggcuuuguuuugcc

SEQ ID NO: 4109405 - RNA, 86 nt, Human
ggcaacaagaaacagaguucuuaaagcccagaugauaagggccucagucugggugugaaugaacuuggccugacuucuuugcugcc

SEQ ID NO: 4109406 - RNA, 109 nt, Human
ggcaacacagauuuggccuggcuuuugcuuuuuugggaugccugccuugggaucccagaggcauucuauaagaagucuggugcucagaggccaucauguuagaaaagcc

SEQ ID NO: 4109407 - RNA, 59 nt, Human
ggcaacaggagaaaucuggucaaaagccaguuugucuccaguuuucuucugccuuugcc

SEQ ID NO: 4109408 - RNA, 68 nt, Human
ggcaacaucucauuagauucuucuucuuggaguaaacaauagaguccagaagccugaugaggucugcu

SEQ ID NO: 4109409 - RNA, 92 nt, Human
ggcaacauguuaauggguaauagacaagauuucuguggucauguaaugucaauuuaaaagacaucacuaaauguugucuaugacauguuguc

SEQ ID NO: 4109410 - RNA, 98 nt, Human
ggcaacugaauuuguaaucuuuagugaccaucucauucucaccacgaggccuggagaaaaagagaugguguacagggagagaaaagcauucagcagcc

SEQ ID NO: 4109411 - RNA, 70 nt, Human
ggcaagaauauaguuaccaaauucugaugcugacucaaaagcuaacaaaaugaugugauuuuauugugcc

SEQ ID NO: 4109412 - RNA, 81 nt, Human
ggcaagagugucaguuuccaugucugugaacuggagauaagauucgucucuaaauacagaugucaugguggcucucucacc

SEQ ID NO: 4109413 - RNA, 76 nt, Human
ggcaagauccaaggggcuaggagcucacacugagaccaaguucacagugcaucaucauuggccaguggauguuguc

SEQ ID NO: 4109414 - RNA, 59 nt, Human
ggcaagccucuuguucugagagcuguugauggauaggaaaucagagaaagaggugaguc

SEQ ID NO: 4109415 - RNA, 59 nt, Human
ggcaagcugugcugacaagaucagaagguuacuaucagaaccgucagcuccaguuugcu

SEQ ID NO: 4109416 - RNA, 81 nt, Human
ggcaaggaguccgagucuuggcuaugcauagagcucagucccguauccgagucuucgucguugccaggaccgcucuuggcc

SEQ ID NO: 4109417 - RNA, 81 nt, Human
ggcaaggcauuuaguauucugcucacaugucccggacgccuacaaugugccgggcacuguguucagagugcagcugcugcc

SEQ ID NO: 4109418 - RNA, 55 nt, Human
ggcaaggccaggccuccaagaccuuccuccgcgggucuguggucaaggccuuguc

SEQ ID NO: 4109419 - RNA, 56 nt, Human
ggcaaggccuugcccagcauucugcacuacagaggugcuggcuauaaaggcuuucc

SEQ ID NO: 4109420 - RNA, 62 nt, Human
ggcaaggcugcugaggauguugggggagaggacccagccuguccagccagcugguccuugcc

SEQ ID NO: 4109421 - RNA, 55 nt, Human
ggcaagggacggccgugagacaggaugaauggcacacugcuggcugacccaugcc

SEQ ID NO: 4109422 - RNA, 130 nt, Human
ggcaagguggccagguguucguauccauacauuggccaggcuuugguggggggcugccccuugggagagcaaggcaguucucagccaaggcaauccccaugagggacacaccuguaugccuuugacagcc

SEQ ID NO: 4109423 - RNA, 62 nt, Human
ggcaaggugugcaguagcaggaggccugggaagggcccagguccagacuguguacccuagcc

SEQ ID NO: 4109424 - RNA, 79 nt, Human
ggcaagucccuacagcugagggccauucccggcugggaaauaucagcagcuggcagucccaucagcugggaaggguguc

SEQ ID NO: 4109425 - RNA, 79 nt, Human
ggcaaguggcaaggccuuauucuuaggaaacacuacucuggcuauuggguagacaauggaauguggccugccacagguc

SEQ ID NO: 4109426 - RNA, 62 nt, Human
ggcaaguuuuagauugacuccaaugucaugugcuuugacagaaagaguauuaaagaucugcu

SEQ ID NO: 4109427 - RNA, 59 nt, Human
ggcaauaaaaguauccaguuucccagaugagaaaacugaaguggguguaaguuauugcc

SEQ ID NO: 4109428 - RNA, 96 nt, Human
ggcaauaucucauauuacagaaauauggucaaagagacgagaaagacaugaagaccucucuguccuagucuguaguguauauuugagaaaucugcc

SEQ ID NO: 4109429 - RNA, 94 nt, Human
ggcaauccuuuaaauuggugggagugagggcaugccaggcuggacagugcaucuuaacugcugccccauuccauaccuagcacagggaugggcc

SEQ ID NO: 4109430 - RNA, 87 nt, Human
ggcaaucgcaacauuuucugguaugcuucuauugaaugguugacaccggccauugaagacuugguauccguggaaauuugaauugcc

SEQ ID NO: 4109431 - RNA, 116 nt, Human
ggcaaugcccggggauagcucucgggacccagguaauccugugcuucucaucccuuccuguggagacagcucuggguuccacacucuagcuguccugaucuggccuucgcuaugcc

SEQ ID NO: 4109432 - RNA, 61 nt, Human
ggcaauggcauugagaaagauugcaaguaguaaugugcaggugcguuuucaagccuccgcu

SEQ ID NO: 4109433 - RNA, 65 nt, Human
ggcaaugguuugauggacaaaaugaacuguuaguucuauugucuuuucucagaucagucagugcc

SEQ ID NO: 4109434 - RNA, 60 nt, Human
ggcaauguagcuugucccacaucauaugcuaauagaugugagcccaggcugcuuucugcc

SEQ ID NO: 4109435 - RNA, 60 nt, Human
ggcaauuacguauuagucaugugagcggagacagaaccgauuaugacaaguacuaguucu

SEQ ID NO: 4109436 - RNA, 81 nt, Human
ggcaauuauuuauugagcaccuacaguauuaccaagcacacaucuagguucugugucuggugcacaaaacaaauuuuugcc

SEQ ID NO: 4109437 - RNA, 65 nt, Human
ggcaauuugucugcuugcugccuucccucgugucuggggguagcugcagcaggcuggcaaaugcu

SEQ ID NO: 4109438 - RNA, 77 nt, Human
ggcaauuuugccacccaggggacauuuagcaaugacuagagauguuucugguugucacaacugggugggagggugcu

SEQ ID NO: 4109439 - RNA, 74 nt, Human
ggcacacagcaauggcaggcggagagugacacugcagguuucuagucccaauguccaugcugcuaaugacugcc

SEQ ID NO: 4109440 - RNA, 56 nt, Human
ggcacacaggcagauggaguguccuuucccacaucacuucaucauacuaugugacc

SEQ ID NO: 4109441 - RNA, 77 nt, Human
ggcacacucacaaccccucaugccagacagcaugcaaucacgggaugcucuguggggcugagggaagaaagugugcc

SEQ ID NO: 4109442 - RNA, 57 nt, Human
ggcacacucacuucugcccugagggggagcugcucucuggcugaaaggggcugugcc

SEQ ID NO: 4109443 - RNA, 119 nt, Human
ggcacacuugauggggaugcaagggacugaggacaguuugggcucugccuguggccuuccaggugagggccucagcucccagcccaggcuggccaguccagagcgccucuugggugacc

SEQ ID NO: 4109444 - RNA, 81 nt, Human
ggcacagagaggcuguggcacuggucuagugucacacagcauguuggcagaggggccaccugcccagcccuuccugaggcc

SEQ ID NO: 4109445 - RNA, 92 nt, Human
ggcacagagcuuguaagaggggugguuauguggccacaggaacacgaacagaauugcuguccauccaggcccauagacacuucucgugugcc

SEQ ID NO: 4109446 - RNA, 57 nt, Human
ggcacagcaggagcuaugugaaugaaugagucauuuaagcugaaccuugugugugcc

SEQ ID NO: 4109447 - RNA, 63 nt, Human
ggcacaggccuggagaggagaaagggcccagagauucucaugugcccuccucuuaggcuggcc

SEQ ID NO: 4109448 - RNA, 55 nt, Human
ggcacaggggcaaacuguaggggagugcuuggcuguaccuggagagcucuuggcc

SEQ ID NO: 4109449 - RNA, 83 nt, Human
ggcacagggucuugcccauggugggggccuaacaaaugcauugauucuaguaaacucccacugugaauccaaggccugguucc

SEQ ID NO: 4109450 - RNA, 111 nt, Human
ggcacauaauaggcaucccauaagcacuggaugacugaguaaauaaaacacguuguguucaugauuuauucacucauucagccagugcuuaugggaugucuaccaugugcc

SEQ ID NO: 4109451 - RNA, 61 nt, Human
ggcacauguccucaggccgcugguggaggcuucacucuccaggagagguguggggacugcc

SEQ ID NO: 4109452 - RNA, 77 nt, Human
ggcaagggcugggggaggcucugcucagcccccggguggcccugggggacaccagucucucucugggccucaauguc

SEQ ID NO: 4109453 - RNA, 60 nt, Human
ggcaaggguucagauauacucauaugggggcagucucuuugcaguuucagaacccugacc

SEQ ID NO: 4109454 - RNA, 63 nt, Human
ggcaaggguugaagauaaauaagguagcaacgucuacuuuauauuuuuggcccuaacuaugcc

SEQ ID NO: 4109455 - RNA, 63 nt, Human
ggcaaggguugaagauaaauaagguagcaacgucuacuuuauauuuuuggccuuaacuaugcc

SEQ ID NO: 4109456 - RNA, 82 nt, Human
ggcaaggucugaacagcugucagggaaugcaagugaugcuaagaacacuagcuccagcuucaacugcacagucaaccuuucc

SEQ ID NO: 4109457 - RNA, 68 nt, Human
ggcaaguaaggucauuuucugagugcuuacuauuugcugggcacugugcugggugcuuuacacauguu

SEQ ID NO: 4109458 - RNA, 60 nt, Human
ggcaaguaggaauccgaaugaguaguuucacauaaggcuacucauuuauuuuugcagucc

SEQ ID NO: 4109459 - RNA, 71 nt, Human
ggcaaguauggaaagggaguuuaauuuggggcccuaguaauggugcuaucugaauaaaucuuuucagugcc

SEQ ID NO: 4109460 - RNA, 58 nt, Human
ggacuguuuugaggauucaaucaauuaauauagauauaagguccuuagaacagugucc

SEQ ID NO: 4109461 - RNA, 60 nt, Human
ggacuucaugugcaagcgcuuugccuuaaugaguacugcagcaaaugcacagugagggac

SEQ ID NO: 4109462 - RNA, 60 nt, Human
ggacuucuauggauguuugaucuuccuaauggcagaccauuuacucccauuggaaguacc

SEQ ID NO: 4109463 - RNA, 64 nt, Human
ggacuucuugggccugcagggagcuccaaacagaucuccagccucccugagcccaaggggcucc

SEQ ID NO: 4109464 - RNA, 76 nt, Human
ggacuugccucuguuucacuugccuagcccaguucaggagauguuccuguuuuuuauguaaguggcagaucagucu

SEQ ID NO: 4109465 - RNA, 58 nt, Human
ggacuugcuaagguggcugaacuccgaagacgggugaacgcucagccaaggcaggucu

SEQ ID NO: 4109466 - RNA, 99 nt, Human
ggacuugugggaaugauggaacaguggcagccacauggcagccgacaaguccguggcuccagugcucaugccguugaccuggucuguccucgcaaggcc

SEQ ID NO: 4109467 - RNA, 66 nt, Human
ggacuuguggggguuccuggugaaaaucugaguucaaaggccuuagaaccaggaacucuaauaucc

SEQ ID NO: 4109468 - RNA, 71 nt, Human
ggacuuuacgagugugauuaagguaaggaccuugagaugaggagauuauccuggauuauauaugugaguuu

SEQ ID NO: 4109469 - RNA, 65 nt, Human
ggacuuucucaggcacuucuuccccgcacugucugcuugggcggggcaggagccuggguuaaacc

SEQ ID NO: 4109470 - RNA, 117 nt, Human
ggacuuuuguaaauauuguuugucagauucagaaaauucucuguuccucugauuugcaaagauggcuguggaauagagaguagguuucaggagggagagaacagaagcagaaagucc

SEQ ID NO: 4109471 - RNA, 97 nt, Human
ggagaaaaacagcauuacauacuaguacagguuuaagucagugaggccaagagcuggccagagcacaggcugguaguaaaugccugacauguucuuc

SEQ ID NO: 4109472 - RNA, 68 nt, Human
ggagaaaacaggguggugaauagcuauagugguagugagguaacuggccacagccucuucaccccucc

SEQ ID NO: 4109473 - RNA, 104 nt, Human
ggagaaaauucaaacaauuuaguguagcauucagagucaacucugucuuuaucuucuaucucuuacgguggcucuguuuguuaacuagacuggucuuauucucc

SEQ ID NO: 4109474 - RNA, 74 nt, Human
ggagaaagaaauacaugguuuuugagugcauaauaugugccagaugcucagcuaucaguguuccugaaguuucc

SEQ ID NO: 4109475 - RNA, 69 nt, Human
ggagaaagagggggacuugaagagugagauguagacaucugagccuauuucaaauuccucugagccucc

SEQ ID NO: 4109476 - RNA, 58 nt, Human
ggagaaagcagucccuuccgaccgccugaacagggugggaauagaagaugcauucucc

SEQ ID NO: 4109477 - RNA, 56 nt, Human
ggagaaagcuaugugggggaguccagagaaaaccaggcgcuuccaugguccucucc

SEQ ID NO: 4109478 - RNA, 89 nt, Human
ggagaaaggauauuugugguaacggagaaauuugccacccagcgcuguugcuuuggugucauguuucugcggucacaaguuauucaucc

SEQ ID NO: 4109479 - RNA, 66 nt, Human
ggagaaauuauauucacuuguguccaaccacuguuaaagaaaugguugcacauggauggguuuucu

SEQ ID NO: 4109480 - RNA, 55 nt, Human
ggagaaauugauccuucugguuaugggauauucuuagcagagaguuaacuucucc

SEQ ID NO: 4109481 - RNA, 66 nt, Human
ggagaacacgaggaggcccagcgauguggcagccgucugcgcuggccauagccuccuguguugacc

SEQ ID NO: 4109482 - RNA, 91 nt, Human
ggagaacaugaaucaucuuugguaaucugagggcagaguaugguguucaugcuccagcaugacccucaaugauuccucuuucauguuuuuc

SEQ ID NO: 4109483 - RNA, 83 nt, Human
ggagaacucagaguaauguuugagauguuggauuugagaugccuuucagauauccaaaaggagauauucaguuugaguuuacc

SEQ ID NO: 4109484 - RNA, 71 nt, Human
ggagaagagaugacugauggcugauuauuaaugcucuuucacaggugauaugaaucaaucacucuucaucu

SEQ ID NO: 4109485 - RNA, 57 nt, Human
ggagaagccacucucccaggaucuugucagcaagagggaaauccaggagugcuuccc

SEQ ID NO: 4109486 - RNA, 76 nt, Human
ggagaagccgaagcgcaaggugucagcagguuucgucucuucugaggccucucuccuuggcuugcagauggccucc

SEQ ID NO: 4109487 - RNA, 81 nt, Human
ggagaagcugcagggagaagagaacaaagcccucacuguggucaggauggguguaucauuccuuuucucuggggucauucc

SEQ ID NO: 4109488 - RNA, 66 nt, Human
ggagaagcugcugugggcaggguagcuggcuaggcagccagcuucucuguuccagccccuuugucc

SEQ ID NO: 4109489 - RNA, 86 nt, Human
ggagaaggaacaaggugcuguggacuugggagccagaaaaggaccuggcuuggugccagcuaugcaucuuucuacccauugccucc

SEQ ID NO: 4109490 - RNA, 77 nt, Human
ggagaaggacuaggguccaagccuuauaauuacuacaucagcacaguauuauagaauguuggccccgucucuuuucc

SEQ ID NO: 4109491 - RNA, 82 nt, Human
ggagaaggagaggcuggugggaaacccuccugaugacuucauauaaaaacaagagcuucucaacaguuaucucuuuuucucc

SEQ ID NO: 4109492 - RNA, 79 nt, Human
ggagaaggauguccauuucaaaccucauuugcagcugcuuuuuagucuuagugguuuuggaauggaauucaucugcuuc

SEQ ID NO: 4109493 - RNA, 75 nt, Human
ggagaaggccaguggggaguuuccagaugugucacucaaaagacaaaaagcuccauuacuguccucacuuucuuc

SEQ ID NO: 4109494 - RNA, 76 nt, Human
ggagaaggcguggaaagacauucagccgcugggcaaaugcugagaaugucugaggguccuucaggagcccuucucc

SEQ ID NO: 4109495 - RNA, 60 nt, Human
ggagaagggccaauuccauguauucaccagguaaaaggacagcaggggaugcccuucacc

SEQ ID NO: 4109496 - RNA, 86 nt, Human
ggagaaguacggugagccugucauuauucagagaggcuagauccucuguguugagaaggaucaugaugggcuccucgguguucucc

SEQ ID NO: 4109497 - RNA, 77 nt, Human
ggagaaguuuugugucuagcucagggauuguaaacgcaccagucagcacccugucaaaauggaccaaucagcucucu

SEQ ID NO: 4109498 - RNA, 67 nt, Human
ggagaauaggcagguuuugauggcagauggcuacacccaagccacagaucguucugucacuucaucc

SEQ ID NO: 4109499 - RNA, 88 nt, Human
ggagaaucacuugaacccaggagauggagguuguggugagccaagaucacgccaucgcacucuagccugggcaacaaagugagacucc

SEQ ID NO: 4109500 - RNA, 89 nt, Human
ggagaaucacuugaacccaggaggcagaaguugcagugagccgaguuugcgccauugcacuccugccugggcaacaagaggaaaacucc

SEQ ID NO: 4109501 - RNA, 88 nt, Human
ggagaaucgcuggaacccgagagguggagguugcagugagccgagauggcaucacugcaguccagccugggugacagagcgagacucc

SEQ ID NO: 4109502 - RNA, 89 nt, Human
ggagaaucgcuuaaacccaggaggcagcauuugcagugagcuaagaccgcgccauuguacuccagccugggugacaagagcgaaacucu

SEQ ID NO: 4109503 - RNA, 94 nt, Human
ggagaaucgcuugaacccaggaggcggauguuguggugaaccaagaucacaccacugcacuccagccugggugacacagcaagacuuuuucucc

SEQ ID NO: 4109504 - RNA, 85 nt, Human
ggagaaucgcuugaaccuggaagguggagguugcagugagcugagauagcgccguucuccagccugggugacagagcgaggcucc

SEQ ID NO: 4109505 - RNA, 87 nt, Human
ggagaaucgcuugaaucugggaggcggagguuguagugagcugagaucacaccacugcacuccagccugaugacagagcgagacucc

SEQ ID NO: 4109506 - RNA, 89 nt, Human
ggagaaucucuugaacccaggagguggagguugcggugagccaagauugggccauugcacaccagccugggcaacaagagugaaacucc

SEQ ID NO: 4109507 - RNA, 88 nt, Human
ggagaauuacuugaacccaggaggcagagguugcagugagccaagauugugccacugcacucuagccuaggcgacagagugagacucc

SEQ ID NO: 4109508 - RNA, 96 nt, Human
ggagaauugccugaacccgggaggcggagguugcagugagcugagaucgcaccacugcacuccagcacuccagccugggugacagagcaagacucu

SEQ ID NO: 4109509 - RNA, 89 nt, Human
ggagaauugcuugaacccaagagguggagguugcagugagccaagauugcgccacugcacuccagccugggugacaagagccaaacucu

SEQ ID NO: 4109510 - RNA, 87 nt, Human
ggagaauugcuugaacccuggaggcagagguugcagugggccaagauggugccacugcacucuggccuggugacagagugaggcucc

SEQ ID NO: 4109511 - RNA, 64 nt, Human
ggcacauuuauaaguggacauaggaaugagaaagaguaaauucuguguaauuuuuuaaauggcc

SEQ ID NO: 4109512 - RNA, 79 nt, Human
ggcaccagagggaguuucugagguugcagaggugacugggcaauaucuuccaagcucccugguguauucugguuuggcc

SEQ ID NO: 4109513 - RNA, 119 nt, Human
ggcaccaucuuggaagcagagagaacccuuaccagauucugaaucggcugaugccuuaaucuuaggcuucccagcuuuuaggacugugagaaauaaauuucuuuuguuuacaaaguguc

SEQ ID NO: 4109514 - RNA, 75 nt, Human
ggcaccaucuuuuggaggggaauuuagcagcgugcugacacucugacccagcaauuccccuucuaggaaucuguc

SEQ ID NO: 4109515 - RNA, 58 nt, Human
ggcaccauggucugauaaacuaugcucaggagagucaugggauagaaauauggcugcu

SEQ ID NO: 4109516 - RNA, 56 nt, Human
ggcacccuuggggggccacagcagcgugagcagccugggggaccaaggagggugcc

SEQ ID NO: 4109517 - RNA, 76 nt, Human
ggcaccuaacucacuccaaaaaggcauucuggcaaaaauuaccuuugauuugcgaugcacuggaugaguaggaguu

SEQ ID NO: 4109518 - RNA, 95 nt, Human
ggcaccugggaugccauuugucuaaggagcucugacaaggauuuucugcaaaccauuguaguaucaucugcagaccuuggacaacucucagugcc

SEQ ID NO: 4109519 - RNA, 120 nt, Human
ggcaccuggggcuuccugggcuucgauccucagugguggggagggacccugccagcccagguuggggucuguggccagcccucuucccacacuagcugcgggugcaggaaccccuuuguc

SEQ ID NO: 4109520 - RNA, 58 nt, Human
ggcaccuuggcuagugaucaaccgggaugauguucccagauacacagcacagagggcc

SEQ ID NO: 4109521 - RNA, 85 nt, Human
ggcaccuuucuuuucuuucauauuguccagucagcgcuuuuaaaauagaaaagcgggaaguaccaguagaaaaaagauuagggcc

SEQ ID NO: 4109522 - RNA, 96 nt, Human
ggcacgacagcauaacaguaugagacugugagugagaaauaaccacaaagguucauuucucacucacaguccauguccacugugugcucuggagcc

SEQ ID NO: 4109523 - RNA, 78 nt, Human
ggcacgcaauucaaauuuguuccaccugauauucugugaccagaaacuauuaugguaaacaaaauuuuuugguguguc

SEQ ID NO: 4109524 - RNA, 77 nt, Human
ggcacgucugcugagaacagagcucugagcuuuugauaaauggaagaagcuccuggcuuuccucucaccacagaucc

SEQ ID NO: 4109525 - RNA, 76 nt, Human
ggcacuauucauguuguacucuguggaaugaagcuuccaggagcacugcuccauagaaugcaguguaaauugugcc

SEQ ID NO: 4109526 - RNA, 75 nt, Human
ggcacucacugccauguugauagauguguaaagagauuaauuccaggcuugucagucaaggugugcaggcagguc

SEQ ID NO: 4109527 - RNA, 82 nt, Human
ggcacucagcaagguggagaaggaugggugcagagagcaaucggggugaucuaaccuuccucuuuauucuugucugaauguu

SEQ ID NO: 4109528 - RNA, 64 nt, Human
ggcacucuuuuuccucccagcuaggaaaguguuaguggagaccuaguggggagucaggagugcc

SEQ ID NO: 4109529 - RNA, 69 nt, Human
ggcacugacacguggagaauuccgaagccucaccugcuauacgugagguuuaugauucugcacguggcc

SEQ ID NO: 4109530 - RNA, 59 nt, Human
ggcacugcccacccucacaggguaugagucaguagucagcccugugauuggcaaguguc

SEQ ID NO: 4109531 - RNA, 65 nt, Human
ggcacugccggccugggugucccgcggacaggugcccgucggcgggcgcucaggcugcagcugcc

SEQ ID NO: 4109532 - RNA, 74 nt, Human
ggcacugcugugaggggaacugaugcccauugucuccaccugagggcccugcccaucucuccucacauucugcu

SEQ ID NO: 4109533 - RNA, 78 nt, Human
ggccauugucaguuuaauauagucaauguaacugaagaauggguuaccuugacuagaauuauuuaaucgacagugacc

SEQ ID NO: 4109534 - RNA, 60 nt, Human
ggccauuucgugcugaaucaaggaaaaacaccaagauuugggggcacggaaucugagguc

SEQ ID NO: 4109535 - RNA, 60 nt, Human
ggcccacacugacagcugagcugggccccucaauuucccggccacggaggcaguguggcc

SEQ ID NO: 4109536 - RNA, 74 nt, Human
ggcccacuguguggcaagggagccaagaaagcagggcccaguggcucugcugaagccccuugcauguggaggcc

SEQ ID NO: 4109537 - RNA, 80 nt, Human
ggcccacuugaaagugcuuucccacauuuguugcaaugccaaaguauagaaggaagugcagggggaaguacugucaggcc

SEQ ID NO: 4109538 - RNA, 119 nt, Human
ggcccacuuggaggcugguagagaguuaugggaugcgggcccgcuccacugccagggagcauugcugcgguaggggggccggcccccaggagugaugcuuuccugcuccgucuugggcu

SEQ ID NO: 4109539 - RNA, 74 nt, Human
ggcccagacacauaggaccacacugugguauguguaugaacuguuuuucacauugugguccuauaugucugguc

SEQ ID NO: 4109540 - RNA, 82 nt, Human
ggcccagagugggcgugcccggcagucacacacccagggguugucguugagccucagguacugcagggcacgcaggggggcc

SEQ ID NO: 4109541 - RNA, 56 nt, Human
ggcccagccuggcaacaaugacgcugcucgcuacgcuuguccugcgagguagggcu

SEQ ID NO: 4109542 - RNA, 58 nt, Human
ggcccagcugggcggggacacggcggccucgggcuugugcuccagccccagccgggcc

SEQ ID NO: 4109543 - RNA, 68 nt, Human
ggcccaggcucugugcagccugcaucugaggaagaaugcccacagaggccggcacagggccucaggcc

SEQ ID NO: 4109544 - RNA, 103 nt, Human
ggcccaggguucuaggggaggccaugggcagaaucuuugaauaaguuucguggagcuccuuguaaagcugcugucaaugcccuguccuuagacccucugggcc

SEQ ID NO: 4109545 - RNA, 63 nt, Human
ggcccaguguaccccaggcaguugcaucaauaaaaucugcuugaguggguucagcacagggcu

SEQ ID NO: 4109546 - RNA, 70 nt, Human
ggcccauacaauaguaagguauauugucauucauagcugaugacagccaugauccuuacuguuuuaugcc

SEQ ID NO: 4109547 - RNA, 80 nt, Human
ggcccaucccagcaugccccauccccuuccugggugccccaggcagaucacaggagggccugacugcugggcuuugggcu

SEQ ID NO: 4109548 - RNA, 89 nt, Human
ggcccaugcccuccuuggcccgccggaagaagauguccucggcgcucucgcuggcgucuccugcgggcgggacggcguucacccgggcc

SEQ ID NO: 4109549 - RNA, 85 nt, Human
ggcccaugggagugggaagagccaauugggguagcagaggaugcugugcucccuuaggaaagcuuggccagcgcucugaugggcc

SEQ ID NO: 4109550 - RNA, 71 nt, Human
ggccccacuggacagacugucccaccacauggaguggcuccucaauggaggaacagugugaucuggggguc

SEQ ID NO: 4109551 - RNA, 84 nt, Human
ggccccacuuuguaauguguuauguuccagacucuccacacuaauccuuuacugagucuuuagcaaaucauucaugagugaguc

SEQ ID NO: 4109552 - RNA, 75 nt, Human
ggccccaugcugcuuccucccaccagaaaugauuucccauuaucuaguggcugguggguagagggcaucagggcu

SEQ ID NO: 4109553 - RNA, 66 nt, Human
ggccccuccuucucuucuugaccacuagaacugacauccagggcuacucagaaggcaggagaggcc

SEQ ID NO: 4109554 - RNA, 60 nt, Human
ggccccuucccaggugguugggauagccugagcugaacccagcagagaugaggagggguc

SEQ ID NO: 4109555 - RNA, 56 nt, Human
ggcccgguugcccacacuggccgggggccuggaaugugcugggacacagccaggcu

SEQ ID NO: 4109556 - RNA, 63 nt, Human
ggcccuauucgcaugucccccacuauauagcaagcucuguggugggacaucugaggagaggcu

SEQ ID NO: 4109557 - RNA, 55 nt, Human
ggcccucacuaaagcugcagggguacaugacucugaagggcugaguggaggagcc

SEQ ID NO: 4109558 - RNA, 58 nt, Human
ggcccucagcuccccugcgcuggacucugcucuccagccugcagggcccuuguggguc

SEQ ID NO: 4109559 - RNA, 66 nt, Human
ggcccucagcugcagccuggcuggcaagcucaggugugacccaggccccagcagccucugugggcc

SEQ ID NO: 4109560 - RNA, 91 nt, Human
ggcccuccagagaggcauugauuaucccaaggccucuaguugauuaguucagggauugcaacuagauuuugggauaucugccugcugaucc

SEQ ID NO: 4109561 - RNA, 107 nt, Human
ggcccucucauuggcucugcuccccaagugggaaguggggaaguuguuuugucaauucugccacuuuugcuuacugggaauagaagcagaggaccacaggcagggcc

SEQ ID NO: 4109562 - RNA, 67 nt, Human
ggcccucugcucugagaugaagcccuggaccugcagaagcccuuccccucucagagcccuagaggcc

SEQ ID NO: 4109563 - RNA, 63 nt, Human
ggcccugagccacacagagcaggugcaucuggcuuugaugacuggaggugggguucuggggcc

SEQ ID NO: 4109564 - RNA, 59 nt, Human
ggcccugagcugaaguacugugcccaagggucagccaaggacagcacucagacggggcc

SEQ ID NO: 4109565 - RNA, 59 nt, Human
ggcccugaggauuugcauuuccuauaaguucccaggugaugcugauguccucaggaacc

SEQ ID NO: 4109566 - RNA, 71 nt, Human
ggcccugcaaagguuuugguaaggcuuuaaagauuucaaaaaauuuuaagguauuaggaccuuugcaagcu

SEQ ID NO: 4109567 - RNA, 84 nt, Human
ggcccuggggucugguugcuuuacagcuggugacagggggaccacuccacuaccacaugugaauuaauccucaacuccagagcc

SEQ ID NO: 4109568 - RNA, 77 nt, Human
ggcccugguugugaguugaguugagcuuccagcccuguccuggaggagcuggccucagucaugcuacagccaaugcc

SEQ ID NO: 4109569 - RNA, 70 nt, Human
ggcccugugaggcucaagaaagauuuguugauugaacacaggagaacgauuucauugagcucauuugguc

SEQ ID NO: 4109570 - RNA, 65 nt, Human
ggcccugugguuuugcaaagucccuugauguuuuuggguuccauucucaguaaaagcacaggguc

SEQ ID NO: 4109571 - RNA, 58 nt, Human
ggcccuuaccucaguuauuuuuaacccgaagggugaacugaaaacaugggugaggguc

SEQ ID NO: 4109572 - RNA, 119 nt, Human
ggcccuuggguuuuuuguuuguuuguuugcuuguuuuguuucuuuuucugaauuacuagaguuaacuuuugagcacugucaggaagaagacggggcaggaaauuagaagacccagggcu

SEQ ID NO: 4109573 - RNA, 64 nt, Human
ggcccuuuccugucauaauguccgaugucaggccacgaggcuucgaauggcaaggaaagaggcu

SEQ ID NO: 4109574 - RNA, 80 nt, Human
ggccgacaugagagguagaggcucugcuuaaguccggaucuagagggacaguuaggugguccgugcuugucaauccgguc

SEQ ID NO: 4109575 - RNA, 58 nt, Human
ggccgacgcccgugucccuguggguuccuguccuuccucagaacaugagcaucgagcc

SEQ ID NO: 4109576 - RNA, 80 nt, Human
ggccgacuggggguccgggacggcgccgaggccgggccagcucccggcucugcuggcagcccccgggccccggguggguc

SEQ ID NO: 4109577 - RNA, 98 nt, Human
ggccgauggagccuggagacagauggucaguguugaaguucuacuugaggcauauucacaagauuugcuuuagauacucccaauguccuuccauugcc

SEQ ID NO: 4109578 - RNA, 82 nt, Human
ggccgcagccgcccacccccgcccacguggauguuaaccgucguggcauagcugagccgccuggcugggggaggugguggcu

SEQ ID NO: 4109579 - RNA, 91 nt, Human
ggccgcgugcguccccacuccaggcccacgucgaggaggggcacguggucggcccccuuuguugggagcugggcacuggaagggaccggcc

SEQ ID NO: 4109580 - RNA, 95 nt, Human
ggccgcuccuggugcaggcuccacguuguuguccaggcucacuucauaaaaaacuucggagagagggaggcgggggucugagcacagugcgagcc

SEQ ID NO: 4109581 - RNA, 60 nt, Human
ggccgcuguggugugggaguucagaacacuguuucuggagccacaaaccucagcucugcc

SEQ ID NO: 4109582 - RNA, 59 nt, Human
ggccggcuuacuggguaggguguuccugcagcuugugcagcucucuccaguggcuggcu

SEQ ID NO: 4109583 - RNA, 79 nt, Human
ggccgggcacggggcaggaggucacagcagcuaaucaaguccuugcuguguucuccugacucaccgccgagcucuggcc

SEQ ID NO: 4109584 - RNA, 93 nt, Human
ggccgggcgugguggcuuacgccuguaaucccagcacuuugggaggccgagguggguggaucacgaggucaggaguucgagaccagccuggcc

SEQ ID NO: 4109585 - RNA, 68 nt, Human
ggccggggacuggaguagaggccggugcucaccagagucucaccaaagucgcuucugucguccgugcc

SEQ ID NO: 4109586 - RNA, 59 nt, Human
ggccggggagagcacuggcuccuacucugcagagaaccccacugcucuucccuagggcc

SEQ ID NO: 4109587 - RNA, 60 nt, Human
ggccgguucaagggcagucagaugaaucgacccuucuuacaggcugucuacgaaccaguc

SEQ ID NO: 4109588 - RNA, 65 nt, Human
ggccgugaagccuucgguucaguucuccccuuguagaaaguguugcgaugaagagcuucacggcu

SEQ ID NO: 4109589 - RNA, 76 nt, Human
ggccgugaugauuuacucccacuuagagccugaacacaaaacuguggcuuucuugagggacugagaaucacaagcc

SEQ ID NO: 4109590 - RNA, 85 nt, Human
ggccguggagccagagaggcuggggcagcagaccuuucuugggcaaaucagggggcccugcuguccuccugucaccuccagagcc

SEQ ID NO: 4109591 - RNA, 75 nt, Human
ggccguucugacacauuacuacauggaugagccuuaagaacauuaugcaaagugagaugucagucacgaaaagcc

SEQ ID NO: 4109592 - RNA, 60 nt, Human
ggccuaaagagagugauuuauguuuuacugagugaaacagucaacuuucuuucccuggcc

SEQ ID NO: 4109593 - RNA, 86 nt, Human
ggccuaaaguauuagauuaacuuuaaugucuacaagaucaccccugucugggacacacaaguuaucuaaugaauuaauaauaggcc

SEQ ID NO: 4109594 - RNA, 77 nt, Human
ggccuaaccuacaggcagggcugggauuagacuccaagggugggguuuuccaaacagugcuguguucugugguagcc

SEQ ID NO: 4109595 - RNA, 96 nt, Human
ggccuaagcucuguuucgucuuuuucauuucaggugauggaguccagaacuaaacugcacaaugaaagcaagaagacggcccccaggcaggaggcc

SEQ ID NO: 4109596 - RNA, 73 nt, Human
ggccuaauggaagagacagaugcaucaagcuacagaaggcuugauucaagcuacuguuacugguccuaaggcu

SEQ ID NO: 4109597 - RNA, 62 nt, Human
ggccuacccaacaguucucauagcagauuccuacaacauggaguccugaguacuuugggccc

SEQ ID NO: 4109598 - RNA, 80 nt, Human
ggccuacugcagcagggagaaggaaguggaauauuucugguugauguggcacuucucuccuuguaaguaaauggcaggcc

SEQ ID NO: 4109599 - RNA, 81 nt, Human
ggccuagaagaccuggggaaguauuuauguaucaucuaauuggaagauuuacaaagcucucuagugucuuugguagagguc

SEQ ID NO: 4109600 - RNA, 78 nt, Human
ggccuagauggaaagauuuggugauuucaguuuuuugcuuaucagucaacugucuuuauuagaaucuuauucauuguc

SEQ ID NO: 4109601 - RNA, 107 nt, Human
ggccuagggaagagcucugggacagccagguaugggcgugcggguccugggacgaguuucuucccucgcguccagccggggcuuggccccagcagccucccucugcc

SEQ ID NO: 4109602 - RNA, 65 nt, Human
ggcugaugggcaugagcugucaggccacucuuucucccaaaggcagccauguucccgucucagcu

SEQ ID NO: 4109603 - RNA, 78 nt, Human
ggcugauuaaaagcagcuguccuuucccugacugcgucugaagcucccacaaggcuuauaguugcuuuuuguuguguc

SEQ ID NO: 4109604 - RNA, 55 nt, Human
ggcugauucugggguagagcaggucuucaaacccuuguacacccacagaucagcc

SEQ ID NO: 4109605 - RNA, 72 nt, Human
ggcugauugucaucauguuuuccaaaggucuaagaaacucucuuuccuuugggggaccugauacuuaaaguu

SEQ ID NO: 4109606 - RNA, 106 nt, Human
ggcugcagcucccagcgagaucaaugaggaagacaagugauuucugcauuuccaacucagguaccuuguucaucucauugggacugguuggacagggugggcagcc

SEQ ID NO: 4109607 - RNA, 68 nt, Human
ggcugcagggugacguugcccaccucuggcuccacgcagaugcuggugaaguaacgcgcccuguucac

SEQ ID NO: 4109608 - RNA, 66 nt, Human
ggaggagagcuuggagugcgauuuucacacagcaaaaggcgauaugaaaauugcucugcagucccc

SEQ ID NO: 4109609 - RNA, 102 nt, Human
ggaggagagggagaugggguggaggagagggguaggauuaauuugcagcuuagauuuuagggccaaggauugaagccucuuccugcacuccuccccuccucc

SEQ ID NO: 4109610 - RNA, 86 nt, Human
ggaggagcaggcacaguguacagagguugcuggaggcuccaggcagagacugguggccccagggcccugucuggcacccucucucc

SEQ ID NO: 4109611 - RNA, 57 nt, Human
ggaggaggagaggcugccauugauucaaaaauaacaugagcagaugcuccugccucu

SEQ ID NO: 4109612 - RNA, 90 nt, Human
ggaggaggaggaggaggaggcggcagaaguuccugcaccacagaggcccaggcauccucucugccuugagguuccaaaccuaccaccacc

SEQ ID NO: 4109613 - RNA, 55 nt, Human
ggaggaggcaaguaccagaugccucuagucagccaucuugaagacucucucuucc

SEQ ID NO: 4109614 - RNA, 56 nt, Human
ggaggaggcagauguaggagaagaggacuucuggcugcuccuuagcugccccugcc

SEQ ID NO: 4109615 - RNA, 65 nt, Human
ggaggaggccgagggcgaggcgccguggacguggaccggccucugcaucuucgccgcacucuucc

SEQ ID NO: 4109616 - RNA, 86 nt, Human
ggaggaggcugcaaggggauggcuuuguggcugacucuguccagcguuucccauggggcgucccagcucaucuuugcaguuuugcc

SEQ ID NO: 4109617 - RNA, 55 nt, Human
ggaggaggggugcugccucuggacuggcucagcucggcucagugccugcuccuuc

SEQ ID NO: 4109618 - RNA, 103 nt, Human
ggaggaggugguccagaguuuuguccaaucauaggguaggcaguugcagagcaggaagcauguggacuuuggcauuggacuuggccuugaaccccgcuccucc

SEQ ID NO: 4109619 - RNA, 81 nt, Human
ggaggaguucugggagaucuugagcuucugguggcccacgggugucugggaaaucucagaucucccagaucucagaucucc

SEQ ID NO: 4109620 - RNA, 77 nt, Human
ggaggaucuggcaggcgggagccauagaggccacguguccacaugucucuccccagccccggcugccggcagccccc

SEQ ID NO: 4109621 - RNA, 88 nt, Human
ggaggaugucuugagccuaggaguucgaagcugcagugagcugaaauggugccacugcacuucacccugggugacaaagcaagacccc

SEQ ID NO: 4109622 - RNA, 57 nt, Human
ggaggaugugggguggacucagggacccacccccucuguggccagucccacaccucc

SEQ ID NO: 4109623 - RNA, 83 nt, Human
ggaggauguggucucauaggcagaauuguugaaugaagugcuaagguuuuucugacuucuguuucggguuuccauauugcucc

SEQ ID NO: 4109624 - RNA, 88 nt, Human
ggaggauugcuugaccccaggaguuggagguugcagugaacuaugauaauaccauugcacucuagucugggugacagagcaagacucu

SEQ ID NO: 4109625 - RNA, 55 nt, Human
ggaggcaaagcauguggcucaggauagcaguccugaguuuccuguucuugcuucu

SEQ ID NO: 4109626 - RNA, 115 nt, Human
ggaggcaacaugauauagugaaaagagugccagaauaggaguaauaaaaccgggguuuuugcccaaggucugcuauugccuugcuuugugaccuuuggcaaauaucugagccucu

SEQ ID NO: 4109627 - RNA, 78 nt, Human
ggaggcaagaggagggucaaguaccaggaagcaagcuuuaagaguuucccuguccaaagucuuccuaucuaugccucc

SEQ ID NO: 4109628 - RNA, 72 nt, Human
ggaggcaagucuggcuccacucuccaggaguuucuggccaggaagccugcugugcagccaaauguagccucc

SEQ ID NO: 4109629 - RNA, 59 nt, Human
ggaggcacuggacaugcucuggccgugucauucccuugcucagagccuucagugacucc

SEQ ID NO: 4109630 - RNA, 65 nt, Human
ggaggcagagcacacugacgucagucugcagaugugccugggcugcgucgggugcgcaugugucc

SEQ ID NO: 4109631 - RNA, 60 nt, Human
ggaggcaggccgggcaggcagcgagcccagggcuuacggcucccaacucaggccuccucc

SEQ ID NO: 4109632 - RNA, 56 nt, Human
ggaggcagggacauccagggcuuugggggugacuccagguccuguuccuugucucc

SEQ ID NO: 4109633 - RNA, 124 nt, Human
ggaggcaggugggagccagccuggcugcugcuccacuguggcuggaacuguaucacgcaggcagugccaggagcaaggagcuccggcccuggaaccaaacuuucugggucucgacccugucucu

SEQ ID NO: 4109634 - RNA, 61 nt, Human
ggaggcaguccaguggguaagaaaucccccaacuucccauuuccccaccuuacuacccucc

SEQ ID NO: 4109635 - RNA, 56 nt, Human
ggaggcaucucuguggcugucuccacggugaagggggcaucuccagggcugucucc

SEQ ID NO: 4109636 - RNA, 64 nt, Human
ggaggcauugcaggguuucaauacacaggacauguucuaguuacagaagccuugcucugcuguc

SEQ ID NO: 4109637 - RNA, 83 nt, Human
ggaggccaagggaacagcauguaagaagcuacuaacacaaaaaagagcuuggaguagccucucagcguagccccucagccuuc

SEQ ID NO: 4109638 - RNA, 65 nt, Human
ggaggccaucagggagggcauuaugcuuugcaguggcauugcagcugccuuuccuuguggccucc

SEQ ID NO: 4109639 - RNA, 64 nt, Human
ggaggcccuuaggaccccugcguggucgcccuucagguagcgcccguccaucuugauggccucc

SEQ ID NO: 4109640 - RNA, 57 nt, Human
ggaggccgggagguggcugguggaguggggaaguaaaucaguggccuggaggucucu

SEQ ID NO: 4109641 - RNA, 58 nt, Human
ggaggccuccugggggagguucaugucucacuuugcagccuccagccagauggccucc

SEQ ID NO: 4109642 - RNA, 83 nt, Human
ggaggccugcccuggaggugcucagcuccaucucugcuguccaggcugugagcaagaacaccuaaggaaagccagcagccucc

SEQ ID NO: 4109643 - RNA, 75 nt, Human
ggaggccuggccagagguuccucugcccuaagaacccucaaggaguagcaggucaccuguguguccaggcuggcc

SEQ ID NO: 4109644 - RNA, 72 nt, Human
ggaggcggacauccgcagguuauaaagccccagaagaucugggguccugugagcugccgguguuccacaccc

SEQ ID NO: 4109645 - RNA, 57 nt, Human
ggaggcucuacaggcacuucugaaacaugcucggacauggagugucagggcccuucc

SEQ ID NO: 4109646 - RNA, 69 nt, Human
ggaggcugcccagagagggcaugaucaccguuccuggugcccugugccuggucccugagucgagccucc

SEQ ID NO: 4109647 - RNA, 57 nt, Human
ggaggcuggguccugaguuauaaagaaaaucaucuuuuaaucagucucccugucucc

SEQ ID NO: 4109648 - RNA, 70 nt, Human
ggaggcugugaguugucuggggaccucaucaacauuugcacaaaugccccagacucugcucaccucuuuc

SEQ ID NO: 4109649 - RNA, 62 nt, Human
ggaggcugugggaguugagagucuuuguagaauugcaggguacugcagcacccacagcagcc

SEQ ID NO: 4109650 - RNA, 107 nt, Human
ggaggcuucccggccugggggccacgggcccggaggaauuugccuggaaguuuuccaucacggcagagccuucuggagcucgccccgugcucgacaaggggagcccc

SEQ ID NO: 4109651 - RNA, 73 nt, Human
ggagggaacugcagaguggauuaagugguuggaaguaagcagccucacucagacauccagugcaguggucucc

SEQ ID NO: 4109652 - RNA, 105 nt, Human
ggagggacacaaacauucagaucacagcaaaugcugcuucucaaauacaccauacacauuccuguuuuaggaccuuuguguuugcugucucugggucguucuucc

SEQ ID NO: 4109653 - RNA, 91 nt, Human
ggagggacaguauagugguggggagcaaaucccuuacagccgggcugccuggauuugcaauccucgucaugccacugcaagcugacucuuc

SEQ ID NO: 4109654 - RNA, 64 nt, Human
ggagggagauggguacucguuggacugagggcacaucucaccaacucuagcaccuaguaccuuc

SEQ ID NO: 4109655 - RNA, 62 nt, Human
ggagggaggauagagaacuuuuauuucagaagagugcaaauaaacaaauccuuccuuccccc

SEQ ID NO: 4109656 - RNA, 78 nt, Human
ggagggaggccugucgaggguuucuugcacacucagauccaagucucagagugguggucccucugcuggccucucacc

SEQ ID NO: 4109657 - RNA, 65 nt, Human
ggagggagggguggcguuggcauuuaggcacuuggguuccuuaaauccuaugcuccuuucucucc

SEQ ID NO: 4109658 - RNA, 77 nt, Human
ggagggauaaauaaaggaggagugggguccuggaaccuagaacagccgguuccaaugggaucuccucccuucccucc

SEQ ID NO: 4109659 - RNA, 71 nt, Human
ggagggauguuaaagauggugggaaauuaacuggaaccagaauuucucauuuauacuuuugcuaucccuuc

SEQ ID NO: 4109660 - RNA, 77 nt, Human
ggagggcagaaggcaggagaagauugaugccugagcucaagcagucaggcagaguuaauuugcuccuccuccccuuu

SEQ ID NO: 4109661 - RNA, 117 nt, Human
ggaggggacccuggagcccaggugucugggcugugggacccggcacuuucucuucccuggagagagggauggccccguaacucagcauccugcgcuuucccuagcccggugccuucc

SEQ ID NO: 4109662 - RNA, 55 nt, Human
ggaggggaugguuugacccuggaaugcuggaaccagggauuccaccagccucucc

SEQ ID NO: 4109663 - RNA, 57 nt, Human
ggaggggauuuaguagaugcuacuuuauaagcuucuuuaacuguaaaauccuccuuc

SEQ ID NO: 4109664 - RNA, 55 nt, Human
ggaggggcagaggggccgggagggaggugcuucuccuggcuccagcagcucuucc

SEQ ID NO: 4109665 - RNA, 56 nt, Human
ggaggggccggcugccugccaccagccuucacauuuggccccugucggcccccucc

SEQ ID NO: 4109666 - RNA, 58 nt, Human
ggagggggaagaagcuaaagacuugccagccagagguuucaugcggucuuccccuuuc

SEQ ID NO: 4109667 - RNA, 83 nt, Human
ggccagaccugccuggguucaaaucccagcuucuucccacagccacauuggaacccugggcaagugacuuggcaccucugguc

SEQ ID NO: 4109668 - RNA, 74 nt, Human
ggccagagagcagccaggauucugucucccacaaaacauagcugacacuacuccuccagaggcccuccuuggcc

SEQ ID NO: 4109669 - RNA, 57 nt, Human
ggccagagagccgcuguuaggaguccggccgugcaacccuuccuagcggccucggcc

SEQ ID NO: 4109670 - RNA, 62 nt, Human
ggccagaggccacagcugugucuccagcaucagaagagaagcagugugcauggcuuuuggcc

SEQ ID NO: 4109671 - RNA, 92 nt, Human
ggccagaguaugagcacagggacaaucuuacuuuugaaaagugaaaggcaagcuuuuacuuaagauuauuccugaugaaauacccuagggcc

SEQ ID NO: 4109672 - RNA, 56 nt, Human
ggccagcaccuucacaggcucucagggccguccucugaggcugugggggugcagcc

SEQ ID NO: 4109673 - RNA, 73 nt, Human
ggccagcagcgggcggggguucccaggucuacagcuccugugagggccccaagaaccuccuccugcggcggcc

SEQ ID NO: 4109674 - RNA, 62 nt, Human
ggccagcauguuauaaugcauuuugugaggacucacagcuguguaugagagcaugcucaguc

SEQ ID NO: 4109675 - RNA, 93 nt, Human
ggccagccuggccucaaacuccugaccuugugauccaccugcuuuggccucccaaagugcugggauuacaggcuugagccacuacgccuggcc

SEQ ID NO: 4109676 - RNA, 59 nt, Human
ggccagcgauuggaggaccucucccauuuuaggagaggagccccucuucaguccuggcc

SEQ ID NO: 4109677 - RNA, 61 nt, Human
ggccagcgugagagaguuuggcaaggagagggaagccccaugacaaaggaucucaugggcc

SEQ ID NO: 4109678 - RNA, 59 nt, Human
ggccagcuuauuagcucagaggcuaucuucauuuguccuuguguacucaaaggcuggcc

SEQ ID NO: 4109679 - RNA, 69 nt, Human
ggccagcuuucuggaagccccagagucagauguacuccuguccugacuuccagccuuccaguacuggcu

SEQ ID NO: 4109680 - RNA, 62 nt, Human
ggccaggagauggacaccacauuuugaugguuucucaaaccgugugugaccuuuuccugguu

SEQ ID NO: 4109681 - RNA, 73 nt, Human
ggccaggauccuagcacagguucugacgcacagaggugcucagaagauauuugaugcugggugaaucaauguc

SEQ ID NO: 4109682 - RNA, 68 nt, Human
ggccaggcaugcagcugguguuuagucugcaguggacuuaucuucacaugcaucugucauguuuggcc

SEQ ID NO: 4109683 - RNA, 66 nt, Human
ggccaggccccagcugugcaggccccacccucucuuggccaccuccaccccagcugaggcuuagcc

SEQ ID NO: 4109684 - RNA, 98 nt, Human
ggccaggccgggcacggcggcuuaugccuguaaucccaguacuuugggaggccgaggugggcggaucacaaggucaggaguucgagaccagccuggcc

SEQ ID NO: 4109685 - RNA, 81 nt, Human
ggcuuacccaagggaagacuggacuucuauguggcugguuuccacaucacugaaccccaacuuucuacagcugggucggcc

SEQ ID NO: 4109686 - RNA, 79 nt, Human
ggcuuagacuggggcacccugagugggccuguguuaguuugggggcguggcuuagagugggguaccgugggacugggcc

SEQ ID NO: 4109687 - RNA, 56 nt, Human
ggcuuaguguuucugcucagccuucuuucuuggaggccugggcuugauguugaguu

SEQ ID NO: 4109688 - RNA, 67 nt, Human
ggcuucaaguuuuaauguucuggugggagaaaugaaaguaucauuucccaacacauuagaaaaugcc

SEQ ID NO: 4109689 - RNA, 57 nt, Human
ggcuucacuuaucucauccuuccuucauacuggaguuaaggcaugggaagagaaguc

SEQ ID NO: 4109690 - RNA, 59 nt, Human
ggcuucaggggcccagucagcacucuggaaucugguggugagacugggugccuagagcc

SEQ ID NO: 4109691 - RNA, 126 nt, Human
ggcuucauaggcacaugcgccagcccggccgaggcagaaccagcugggacuuuaagccgaugagcuguucgaugagguauauggccugguuuccugugcaggcaggguggaugcaguccagaagcc

SEQ ID NO: 4109692 - RNA, 60 nt, Human
ggcuuccacacuggcuccuugcauggcuggcaggcugaugcuggcuacugauggcaggcc

SEQ ID NO: 4109693 - RNA, 74 nt, Human
ggcuuccccaagcccacaaacgagcuuagaaucaacagauucacugcugggugauuggguuugaauggacagcu

SEQ ID NO: 4109694 - RNA, 60 nt, Human
ggcuuccucccucucucaaagugucccugcaagugcuggcugggccagggagaggaagcc

SEQ ID NO: 4109695 - RNA, 73 nt, Human
ggcuucgauaccugaaacuugugauuugcagguucaaaagcaaucguuuauauacacuguuucaguugaaguu

SEQ ID NO: 4109696 - RNA, 102 nt, Human
ggcuucucugggcugggguacuguccuagaaaagcugccagcucaggcucaagcagcugugggcucccagcuucucucugccgacccccaucccacuuugcc

SEQ ID NO: 4109697 - RNA, 71 nt, Human
ggcuucucuuggcucugauggggaucaggagcaagcuucaagcucagaaccucuaacagagccccagagcc

SEQ ID NO: 4109698 - RNA, 74 nt, Human
ggcuucugccuuucucccuucuggaaggcacugaagguuuggcucaguucagaggcaggagaaggcuuggagcu

SEQ ID NO: 4109699 - RNA, 55 nt, Human
ggcuucugugguugucacgacuaggggagcuccugguguggagugggcggaggcc

SEQ ID NO: 4109700 - RNA, 78 nt, Human
ggcuucuuaauacuuaacuguacaacugguuagucauauuaucugacauuccgcaguaagguuaaaucaaggucagcc

SEQ ID NO: 4109701 - RNA, 64 nt, Human
ggcuucuuucucaagccaaggugagccggaauaaggucauucuugaaacauaugaguaagugcc

SEQ ID NO: 4109702 - RNA, 73 nt, Human
ggcuucuuuuucauguaggucuuuacacgagauguagagaagucuccaggacuauaggaaagacacacaagcc

SEQ ID NO: 4109703 - RNA, 98 nt, Human
ggcuugaaaaaacugccuguguuuuaaaaugugcuuguguuuguuuccuaaugcaguacuuugaagauauuuuagguuuagguaaguugcuuuaaguu

SEQ ID NO: 4109704 - RNA, 123 nt, Human
ggcuugacagaggagggagaauuguauccugaguuaauucgaauauucuagcccaaacuaaguuaaacaaaggcuuagguaugauaguuagccugaugccaaauuuccuuccaguguaauguu

SEQ ID NO: 4109705 - RNA, 63 nt, Human
ggcuugagagacucauuugccaagugguucgcggccuuauggcaaaguaauuggguuucuccc

SEQ ID NO: 4109706 - RNA, 55 nt, Human
ggcuugcagcccuccugccuugccugcccaucuaaggugggagaccauguagguc

SEQ ID NO: 4109707 - RNA, 79 nt, Human
ggcuugccuauuucaaaaggacagaagaccuaaaaccuuuuauaguuuucgguucaaguuuugccuuuccuugcaggcu

SEQ ID NO: 4109708 - RNA, 59 nt, Human
ggcuugcuucaccuacccccagcucaugaaagagggcuuggggccagaugaaggaaguu

SEQ ID NO: 4109709 - RNA, 81 nt, Human
ggcuuggcugucauaacucaaguuguugggggacacaugacuauuuaagcagcaauuauggaguuguugacgggcaggacc

SEQ ID NO: 4109710 - RNA, 82 nt, Human
ggcuugggcagguggaacaaauuuuggggaccuugauucugaaugucaguccaaaucuuguuucauaucucuguuuaaagcc

SEQ ID NO: 4109711 - RNA, 68 nt, Human
ggcuugggggagcuguuauuggcagggaggccuuuguggcucgccaguugccugucuuccccauggcu

SEQ ID NO: 4109712 - RNA, 64 nt, Human
ggcuuguagucagagcaggugaugaccaaaucugaacuuuuggguccuguucuuggcugaggcu

SEQ ID NO: 4109713 - RNA, 65 nt, Human
ggcuugucugcauuguuucuaugggaaauguguucugaauuccuaaaacaaugugcaaacaagcu

SEQ ID NO: 4109714 - RNA, 84 nt, Human
ggcuugucuuauuguuggaauagcugaaucuugugugugagugucgucauaauaaugucugcuauuuuaaaauaaagcauagcu

SEQ ID NO: 4109715 - RNA, 56 nt, Human
ggcuuguggcaaguguuuuaaguucaagcaacuuaaugcagcucuaccacacagcu

SEQ ID NO: 4109716 - RNA, 65 nt, Human
ggcuugugguggcuauucuggucucauugcuaaauccaucugggguccagugccaccccaaggcc

SEQ ID NO: 4109717 - RNA, 62 nt, Human
ggcuuuaacagcagcuuugcuguaugguguccagcucucuaguggucauagcuguuguagcc

SEQ ID NO: 4109718 - RNA, 101 nt, Human
ggcuuuacaucuggcagggagacagcuccuuucugaggaugacagcugcagcuucagcucuaccugggagcugucuccccauggggaagauguucauagcc

SEQ ID NO: 4109719 - RNA, 56 nt, Human
ggcuuuacuauaugguacauuuugccccagugaguagaauucauaccauugaggcc

SEQ ID NO: 4109720 - RNA, 81 nt, Human
ggcuuuagaaugaacagaguuaaguuuacauccugguucuauucucuaugugaucagaggaaauuaacucucucagucucc

SEQ ID NO: 4109721 - RNA, 55 nt, Human
ggcuuuauauuguuugagcagaccucauuugaggcaagaaaacaauaaugaggcu

SEQ ID NO: 4109722 - RNA, 63 nt, Human
ggcuuuauguuuuucaugugguucaguggacugcauauuugagaggcguaacaucgugcagcc

SEQ ID NO: 4109723 - RNA, 83 nt, Human
ggcuuucaauuugaucugaaauagcuacugcagagucccugagggguggucugcucucugcuaucucagacauaguuguugcc

SEQ ID NO: 4109724 - RNA, 73 nt, Human
ggcuuucacccucaggaagccccagcauggccuugggcccagcuuagaggcuuguggggguuuggguguagcc

SEQ ID NO: 4109725 - RNA, 76 nt, Human
ggcuuucagaaauuauauuagaugcccagccuuucucauucagagaugccuguauuauuauguuauuucgauugcc

SEQ ID NO: 4109726 - RNA, 71 nt, Human
ggcuuucaggguugugguggaauucaguuauuuucaguuguaggacagaggucccuauuucuuuguuggcu

SEQ ID NO: 4109727 - RNA, 66 nt, Human
ggcuuuccgggaccagagcucuguugggaacugcugcugcuuggacagguguguucccggaaagcc

SEQ ID NO: 4109728 - RNA, 79 nt, Human
ggcgaggcuucucggggcgcggccagcaggacgggggcgugaagaauuucuccugcaggcuugaguccucagucuuguc

SEQ ID NO: 4109729 - RNA, 67 nt, Human
ggcgaguuguacagcauccagugcagagagaauggcauuuuggucucacuagguggcuuuaccuccc

SEQ ID NO: 4109730 - RNA, 87 nt, Human
ggcgauagagacccagcaggcaggccccaggcagggggaagaggcugcccuuaucuggccccaggcagccugcuggggucuguggcc

SEQ ID NO: 4109731 - RNA, 130 nt, Human
ggcgaugcuugccagccugagaugggccuguaggccugugggccaaggaccugccaucuggagcauuuggcaaaguugaggggcccaugugucuucgagacccgaaucucaggcugaacagggcuccgcc

SEQ ID NO: 4109732 - RNA, 81 nt, Human
ggcgccaagucgccacucagguggccaaaugggagcgcccguagggcggcccugcucuucggcccuuggguggcggguccc

SEQ ID NO: 4109733 - RNA, 62 nt, Human
ggcgccuaggcaaggaaccccugagccaggagagcuggaccaggggcccuugccaggacgcc

SEQ ID NO: 4109734 - RNA, 69 nt, Human
ggcgcgagguuuguuaaaaugagucuucggaagcaaaccucuggugacucuuaaagcaaaucuuggguc

SEQ ID NO: 4109735 - RNA, 69 nt, Human
ggcgcgccugagcccgugcacggcagccucuccggaaggugaagcacgcugccgcacugggggccugcc

SEQ ID NO: 4109736 - RNA, 63 nt, Human
ggcgcucaguguugccccagaguguccuuccagucacuccagauggggcagcagcugaacguc

SEQ ID NO: 4109737 - RNA, 65 nt, Human
ggcgcuccuaggaaggaguauaguaaaugccucauuuaauaacauacuccuuuuugaaaguugcc

SEQ ID NO: 4109738 - RNA, 61 nt, Human
ggcgcucgugccgcaucaggcaggcguaaagacaagugcccagccuggcugggaugagccc

SEQ ID NO: 4109739 - RNA, 58 nt, Human
ggcgcuuggugcagcuccucuucaggguccuccuaccugaaggagaggaccgagugcu

SEQ ID NO: 4109740 - RNA, 79 nt, Human
ggcgcuuugcagaagccaguggcgugggccccggggacaguuccuuggaggagaacucccuggcuacaggucaggcgcc

SEQ ID NO: 4109741 - RNA, 63 nt, Human
ggcggagguggagcaccaagggcgcuuggaagcggccucuuaucuggcuccugcaccucugcc

SEQ ID NO: 4109742 - RNA, 129 nt, Human
ggcggaucacaacauugaacauaacuauugacacaauucauugccagaaucuaugauaauuuuccacacauuuucuugucuauggaguuugaaugagaaaauccaucaauggccuaccaaugcaucgcc

SEQ ID NO: 4109743 - RNA, 60 nt, Human
ggcggcccagugucccggucguggcaggcgccaucugcccgaccagcgccugggucagcc

SEQ ID NO: 4109744 - RNA, 56 nt, Human
ggcggccccucccugcuccgcuguccgccuuggguacagaagcggcgaguggcccc

SEQ ID NO: 4109745 - RNA, 101 nt, Human
ggcggcugacagcggucauuugucaucacugagcugcccaaacuccucagacugcacugcggauggcugcuuagggugacuuauggcccugucgggcugcc

SEQ ID NO: 4109746 - RNA, 72 nt, Human
ggcggcugucggcacugccuggcauucucuggcugauagaagcuccgaguucuggcggcugucggcacugcc

SEQ ID NO: 4109747 - RNA, 55 nt, Human
ggcgggcagcgucuugcuggccucggugcugcucuccccaaggaugcugccggcc

SEQ ID NO: 4109748 - RNA, 90 nt, Human
ggcggggacagucugauugagcuguguaaguuggaagcagcgagacauugcauuccagcucucauacucugggaacgucaccuaccugcc

SEQ ID NO: 4109749 - RNA, 57 nt, Human
ggcggggaggcuggcgagaggcuuaaugaaacugcuaacgcguuagugauuccugcc

SEQ ID NO: 4109750 - RNA, 70 nt, Human
ggcggggcuggcacauggcucagggccuacaguggugggcuccagcuguuugccaugagaucgucuugcc

SEQ ID NO: 4109751 - RNA, 57 nt, Human
ggcgggugcacagacccuuccccaaaggccucaggucugagguccuggcugcccgcc

SEQ ID NO: 4109752 - RNA, 71 nt, Human
ggcggugaagcagcuucaguaggugaagacauggcacgaagcaacugucuggcuuucuggggcucaagguc

SEQ ID NO: 4109753 - RNA, 73 nt, Human
ggcgucauuccaguguagcucuccagccagcaaggcgcggccaaauaccguguggcggggacuuguggcugcc

SEQ ID NO: 4109754 - RNA, 86 nt, Human
ggcgucccauggcaugccacauggacuucaaaccgagugcccuuucucccaugugguuuacucguaguggcgguuuuacagaugcc

SEQ ID NO: 4109755 - RNA, 78 nt, Human
ggcguccugcagggcgcguuugagcgggcucugcagguaucaguagaaguccguuggagagcgcccgggcagggcgcc

SEQ ID NO: 4109756 - RNA, 82 nt, Human
ggcguccuggggagagccaaggcccugacucucuaauaacacaaguggacuccugggagcccuugcuccaccccuggacucc

SEQ ID NO: 4109757 - RNA, 75 nt, Human
ggcgucuucucucccugcuuccuguggcacauccugagcuuugggugcucaacagaggguguggaggaagacgcu

SEQ ID NO: 4109758 - RNA, 55 nt, Human
ggcgugaagcccagggaacgaggcugaaaaaggcucucuucccuggcugucaguc

SEQ ID NO: 4109759 - RNA, 57 nt, Human
ggcgugggaaguggggcuucuggccaggcugacgcgugaagaaccgcacucccagcc

SEQ ID NO: 4109760 - RNA, 86 nt, Human
ggcgugggagccggggcccagggcagcagugcagcucaccccagacccgggcacagcggcggcugcccggccaccuccgcccgccc

SEQ ID NO: 4109761 - RNA, 86 nt, Human
ggaugccaagugacacaggggaaggagucuggacacugucaaguaaugcccaggauucuccucuugugugggcuuggcuggaaacc

SEQ ID NO: 4109762 - RNA, 74 nt, Human
ggaugccacucaucauuuuacggagcagccgguggaugccaggcuguggcuccaauggugagccuggccagucc

SEQ ID NO: 4109763 - RNA, 78 nt, Human
ggaugcuaugauacauguucaguuauucuggaagacuuuauaauguuugcuuagaaucuggacuuguugauaguauuc

SEQ ID NO: 4109764 - RNA, 73 nt, Human
ggaugcugucugaccagggucucucagaaugacugaguccagguggaccuuggccagauuugaaccagcaccc

SEQ ID NO: 4109765 - RNA, 84 nt, Human
ggaugcuuuuaccuaauaggcuucugggauugcuugcucuucugggcccuccgugguucucagaggcugcuaagugcaaggccc

SEQ ID NO: 4109766 - RNA, 85 nt, Human
ggauggagggaggcuggagguggcacaagggaggucugacuuaacagugagcccuuguuuaugucauuucccuugccugaugucu

SEQ ID NO: 4109767 - RNA, 55 nt, Human
ggauggauggauggauggauggacggacugccaguuccaagcccuccuuccauuc

SEQ ID NO: 4109768 - RNA, 64 nt, Human
ggauggauggugaguggauuguaauggucgauggauaauggcaaauaaaugcucacugcugucu

SEQ ID NO: 4109769 - RNA, 80 nt, Human
ggauggauuuggagcugagaguuaauaaggauugaugauucagaguccacuccuucagcuacucaguuuccauaugcacc

SEQ ID NO: 4109770 - RNA, 91 nt, Human
ggauggcaagugccuggaaagccuuggauuggguuucaguuaguaauuauaaaaugcuaaguauaauccaggguauucuaguuucccuucc

SEQ ID NO: 4109771 - RNA, 59 nt, Human
ggauggcgggccauggacaaugcgcugaccuagcuguaagucaccuggcccgauaaucc

SEQ ID NO: 4109772 - RNA, 119 nt, Human
ggauggcuaaugcaaacugcaacccuauagaauauccacuucaauacaggcaucacggcucggguggugucuguauugaggugcauauuauauggggcugcagcuugcauuauuccucc

SEQ ID NO: 4109773 - RNA, 130 nt, Human
ggauggcuggagaggcuccuggggccaaccacucccacuugggcccauggggcuaagcuaaguggaaacaaauguucccuggcuuucccccagcccaguuguggugggcgagcagcagccccuccuuccc

SEQ ID NO: 4109774 - RNA, 93 nt, Human
ggauggggagagagggagggggagccagugccaaguuggcccgccccuugugaaccugggccucugccacgcucccccgcccgccugcccgcc

SEQ ID NO: 4109775 - RNA, 68 nt, Human
ggauggggcugaaacauggaagagagguacaagauccagcccuucuggcuccacucagccccacaacc

SEQ ID NO: 4109776 - RNA, 74 nt, Human
ggaugggguaauucugugugaaucuauuaaggaaaagauaacuucaguggaacacacagagugggucaaaagcc

SEQ ID NO: 4109777 - RNA, 58 nt, Human
ggauggguugccugcugguggaauccccauugaguccagaucaugcagcaaaccaacc

SEQ ID NO: 4109778 - RNA, 68 nt, Human
ggauggguuuaaaccaaucgugauucaucccagggccagggauaaauuaugauuggucuaaaccagcc

SEQ ID NO: 4109779 - RNA, 106 nt, Human
ggaugguggcuacgggugguggccucaagugauagaucccagauagugacccucaggguguggcaccggauggugacccuggguggcuggcccugcuucccugucc

SEQ ID NO: 4109780 - RNA, 91 nt, Human
ggauguaauuauucuuuugucucuucugggaagcccagaguauacguuaauaaucaaguuccagaagauggcagcaaaggauuuacuaucc

SEQ ID NO: 4109781 - RNA, 59 nt, Human
ggauguacccgaaccuguugccuugcccuaccucugugggcugguucaguucugcauuc

SEQ ID NO: 4109782 - RNA, 61 nt, Human
ggauguagauuaguggcaaagcuggguuggugcaccuggcuucccagacaauacugcuucc

SEQ ID NO: 4109783 - RNA, 110 nt, Human
ggauguaucuguugccacugcagggcugcacauccgggguucagaugcugugguaaugagcuagguccugugucagcuaccuccucugcgugguccuuucagacucaucu

SEQ ID NO: 4109784 - RNA, 66 nt, Human
ggauguauuucugguaacugcugcuaucccugugaaaaagaauggaguggaucaagaaguaucucc

SEQ ID NO: 4109785 - RNA, 64 nt, Human
ggaugucacaguacaggacgaguuuuccuggggauaaaauucagguguggcuaugcuguguucc

SEQ ID NO: 4109786 - RNA, 77 nt, Human
ggauguccuaguuuacaugcagaaaaucaauguuccugggcucuugugggacucugagaagccuguaaagggcgucc

SEQ ID NO: 4109787 - RNA, 59 nt, Human
ggaugucuggucuauuucaaguauacuggcccuggccaggacacaugggcugagacucc

SEQ ID NO: 4109788 - RNA, 60 nt, Human
ggaugucuuuagggcaaaauauuuccaccacaagagaaaugugauugucauaaggcuucc

SEQ ID NO: 4109789 - RNA, 80 nt, Human
ggaugugacacauuaaaacgucuacaauguuaucacuacaucuugccaaauauacugaguguguuaaugaugauacaucc

SEQ ID NO: 4109790 - RNA, 62 nt, Human
ggauguggcucuguaaaaugccugcauaauuucuguguuaguaaagacgugggccgcagucc

SEQ ID NO: 4109791 - RNA, 115 nt, Human
ggaugugggcuccagagcaggcccuggcagucagagcacuuggcucauggcaggcgggccucuuauguguagugcauugaacgaaggucccuguucucugccagagcaaacaucc

SEQ ID NO: 4109792 - RNA, 82 nt, Human
ggaugugucagguaggcaguguauugcuagcggcuguuaaugauuuuaacaguugcuaguugcacuccucucuguugcauuc

SEQ ID NO: 4109793 - RNA, 56 nt, Human
ggaugugucuccauacaccacccugcauuacaagggcugugccagagacagcaucc

SEQ ID NO: 4109794 - RNA, 62 nt, Human
ggauguucuuccuugucuauuuuucauggccauaccugaagagguuguugaggaauaugucc

SEQ ID NO: 4109795 - RNA, 61 nt, Human
ggauguuggaggcugguuuucuguucaguuaacaugaaaugcagccuguaaccuuaauucc

SEQ ID NO: 4109796 - RNA, 65 nt, Human
ggauguuucucacuguuucucuauggagcccagggacaggccagugaggaaagagugggacaucu

SEQ ID NO: 4109797 - RNA, 125 nt, Human
ggauuaaaggcaugcaccuaauuguuaaauauuaguuuuuaaaaaacuagucugagucugucuuuaugggcucugagugguuucaccuuuagaagcuuguuuuaggaucuugugccaaccagucc

SEQ ID NO: 4109798 - RNA, 87 nt, Human
ggauuaagugagauaauuaugaaauuaagcucagugcaugacguauuugcuaaauaagugauuaagucuuguucuccaccuugaucc

SEQ ID NO: 4109799 - RNA, 93 nt, Human
ggauuaagugaggugaugcacaagaugguuuccagaugcugggugccaggcucagcacuuugcauccauucuuaauuacauuucauuaaaucu

SEQ ID NO: 4109800 - RNA, 76 nt, Human
ggauuacuaacacuuuguugccuaugaacguacauucuuccuguugcguaugaaggcagaaagucaguuacaaucu

SEQ ID NO: 4109801 - RNA, 130 nt, Human
ggauuagauuagguucagauacugguccaggcugaacaaucuguucgauagaaaauuagagauggccugguuguucuaugaauaauuaguaaaaaguuggaaaucagauuucucaugaccuaaucacccc

SEQ ID NO: 4109802 - RNA, 65 nt, Human
ggauuagauuucucacuuuggagguauccuuaacaguugggcuaauuaaaguugaaaucaagucc

SEQ ID NO: 4109803 - RNA, 75 nt, Human
ggauuaggcacaacagagcacugccuuauuccccauaagcuagaauacgagcagucuaucuugugauuuaacucc

SEQ ID NO: 4109804 - RNA, 125 nt, Human
ggauuauacaauuuugaugacagaaacuuguucuuaaccaccucucugucuucagcauucagccuaauguuggaagaauagaagaugguugauaaauguuugcugaaucagaaauggaaugaucu

SEQ ID NO: 4109805 - RNA, 93 nt, Human
ggauuaugguucauccaacuucaaaguuguuaucauggguaucuaaaauuucuaaaauacuuugccaaguucgaagaaccaacuguauaaucc

SEQ ID NO: 4109806 - RNA, 65 nt, Human
ggauucacauguucuuuuccacucucucauuauggcaccagagaauuuaggaugcaugugaauuu

SEQ ID NO: 4109807 - RNA, 58 nt, Human
ggauucaggguaaaguuucaguuaugucccaguaaucauuuauuuuacccucgaaucu

SEQ ID NO: 4109808 - RNA, 96 nt, Human
ggauucauuagcuguuauuuugcuacccaucaguuucauuaauaggagcuuuacaauuuggaaggggggaaaauagcacuagauaauuaaugaacc

SEQ ID NO: 4109809 - RNA, 74 nt, Human
ggauucggguagagaaaaauauuuucuauuuauuuuauugcagagucugagguaauauuuuucucccugacucc

SEQ ID NO: 4109810 - RNA, 75 nt, Human
ggauucucagaggugaagaccagaagccaugaguggaaaaaccccacacagcagcuggcagcuucuucucuggcc

SEQ ID NO: 4109811 - RNA, 77 nt, Human
ggauucugugaugacucuuuugcuaggugaauauguucuuugauucauauccauaguaaaagucauuaaggaggucu

SEQ ID NO: 4109812 - RNA, 57 nt, Human
ggauugagaaucugagagccuaggacaucucaaaauugaccuugcuuuuucucaacc

SEQ ID NO: 4109813 - RNA, 57 nt, Human
ggauugcaacaagcuaguuuaggaaccgcuggcggacuagaaagaauguugucgucu

SEQ ID NO: 4109814 - RNA, 73 nt, Human
gggagaagggagaaagugcacaccuuccaaagagcucccaaagcucuccgaugugcacaucuccuuguccacc

SEQ ID NO: 4109815 - RNA, 55 nt, Human
gggagaagggauaugccacucucggguucccaguuggcuagcauccccuucuuuc

SEQ ID NO: 4109816 - RNA, 55 nt, Human
gggagaauggguauucaaccugguacagccaguaagaaucuuacuacauucucuc

SEQ ID NO: 4109817 - RNA, 76 nt, Human
gggagaccauggccccccgucccagcacagaggcugcccuuggcagugggcauggggcggaccugguucaaguccc

SEQ ID NO: 4109818 - RNA, 57 nt, Human
gggagacccaccugaggcucagcccuagcccucagcccaccuucaggggaguuuccu

SEQ ID NO: 4109819 - RNA, 82 nt, Human
gggagagaagccagcucccuuucuggcaauaauuguauuucucuaccaaaggccucaguucuugccagguggccccucuccu

SEQ ID NO: 4109820 - RNA, 57 nt, Human
gggagagagcugaggggcucugggcuguggcaguuacaguugcccccagccucgccc

SEQ ID NO: 4109821 - RNA, 103 nt, Human
gggagagagugcuuugaucucuuuuuaaaguauuuucugaaagcaaaagucuaucagaaggaagugccuuuaaaaaaaaucuaagagaagcaaccgaucuucc

SEQ ID NO: 4109822 - RNA, 78 nt, Human
gggagagauuuugagaagcaucugguccacuucuccaccuucagaggagucuggguugauauuucucaauuuucuucu

SEQ ID NO: 4109823 - RNA, 107 nt, Human
gggagaggcaccccucaccucagagggcagcuggagaccuccugugugaggagggcuuggccuccuuccuggggucucugcugcucaggcagggggcucccucuccc

SEQ ID NO: 4109824 - RNA, 70 nt, Human
gggagaggccaggagagaggucuagugaaguuccuuccggagcuacccugggaaucucccucacucugcc

SEQ ID NO: 4109825 - RNA, 68 nt, Human
gggagaggcugagcccacugcccacagggccucccggccuuuauugcaggagggcccgagacucuucc

SEQ ID NO: 4109826 - RNA, 59 nt, Human
gggagaggcuucauggagcuggcagcccuugagggguagagcauugcugaggccucccu

SEQ ID NO: 4109827 - RNA, 97 nt, Human
gggagauaucagugauucagguauugcuauuucugacuuaagagauaaaaugauaguaacacauugaacgaucgcuagauacgaaaugaccccuccc

SEQ ID NO: 4109828 - RNA, 72 nt, Human
gggagaucuuacucacuucagcuggcguugcucauuagugaauguaugacagcaggaugugaggggaugccc

SEQ ID NO: 4109829 - RNA, 59 nt, Human
gggagaugacucagugaccucgaggccaccacuaggcugugggugggugggugucucuc

SEQ ID NO: 4109830 - RNA, 55 nt, Human
gggagaugcacuggacuuagcauagcugcccugguguccuggucacugcucuccc

SEQ ID NO: 4109831 - RNA, 55 nt, Human
gggagauggcucagaggccgcgccacagggugugcccacaugggaccauucucuc

SEQ ID NO: 4109832 - RNA, 78 nt, Human
gggagauguguggaguggcuggacgacaagggugagaggucuucucaaucaccugguccucguccuccacuagcuccc

SEQ ID NO: 4109833 - RNA, 76 nt, Human
gggagcaacagaggauuauuucagaaucuacgcaaauaaaauucuguguguuggugaagucucucugcugccacuc

SEQ ID NO: 4109834 - RNA, 56 nt, Human
gggagcagguggcaauguggcagcaccuugaacugugcaucacugggccugcuccc

SEQ ID NO: 4109835 - RNA, 80 nt, Human
gggagcaugaggcccucugggcugguccugcugcccucacccucaccucaagcaggucccucagaggccucaccgagccc

SEQ ID NO: 4109836 - RNA, 85 nt, Human
gggagcauuaagccucuaaguuugugguaauuugcuacacaguguagaaaacuaauacaugcuugaugaugaaguuucuguuucc

SEQ ID NO: 4109837 - RNA, 69 nt, Human
gggagcauuucccuguguugaaccauugaccuaccucuaaauguacugucagggcagugggagguuccu

SEQ ID NO: 4109838 - RNA, 56 nt, Human
gggagccacugcgguccacugcaauugaugcagcaacaggggcugacaguggccuc

SEQ ID NO: 4109839 - RNA, 91 nt, Human
gggagccacuggcuggagaccagcugccucccagggcccugccagggcuggcacagagggcugguguuucuauucccagggccuggcuccc

SEQ ID NO: 4109840 - RNA, 67 nt, Human
gggagccagaggagagugaguauuagugcaggucggccuaguuaaaaucacaacuccaucauuuccc

SEQ ID NO: 4109841 - RNA, 71 nt, Human
gggagccaggaggugguuuccaggcacagggauaaaggaaaauccuggcuaauggcauuuccugggugccc

SEQ ID NO: 4109842 - RNA, 66 nt, Human
gggagccauggcagaaucaagccgacagccuuagucaggcugcagccuucuugccauuaaacucuc

SEQ ID NO: 4109843 - RNA, 129 nt, Human
gggagcccagacccuguagggaguuuuguuuuccuuucuucucuuggguguggugucuuguguuucugaaugugaacccaaagacccuaccccuggagaggaagcaccuuccucuuuguguuggucucc

SEQ ID NO: 4109844 - RNA, 57 nt, Human
gggagccccucccagcccgaguccucaucguauccucggagcugggcagggcauccc

SEQ ID NO: 4109845 - RNA, 77 nt, Human
gggagcccuggggagaaucagagaaugcugaggguuggaaaagaccuuagacaucagugcuucucagcggggguccc

SEQ ID NO: 4109846 - RNA, 72 nt, Human
gggagcccuuucacuggguggaugagcgucucccacauuucuacucccuugccucugugcuaaagggcuccc

SEQ ID NO: 4109847 - RNA, 73 nt, Human
gggagccggccuugcggaacgcucaggcgcgcuacuucagagcaugcgcagcaagaccgcgcggcccguuccu

SEQ ID NO: 4109848 - RNA, 55 nt, Human
gggagccucccgggaugggggugaagaggcacaaaccccucuggguuuuguuccc

SEQ ID NO: 4109849 - RNA, 77 nt, Human
gggagccuggauugucaccgacuuguccccucggcccccaucucgacucuuagagcggugucggucccggcgguccc

SEQ ID NO: 4109850 - RNA, 73 nt, Human
gggagccuggcuccacaggccaggguguggggggaccuccuggccacaccucagccauguggaggcagcaccc

SEQ ID NO: 4109851 - RNA, 77 nt, Human
gggagcucaauagaaaugcagagucucaggucccucuccggccccacugaaugagagucugcauuucaucaagaccc

SEQ ID NO: 4109852 - RNA, 59 nt, Human
gggagcugaaggagccggcggggccagcucacaguguuccagcuguuccaucagcucuu

SEQ ID NO: 4109853 - RNA, 65 nt, Human
gggagcugagggaccucuguggucaggcugcuucacuggccaaccagggaccuugugccauuccc

SEQ ID NO: 4109854 - RNA, 59 nt, Human
gggagcugaugauguaagucccaggccaagggcaggaaaagaccaaugucucagcucuc

SEQ ID NO: 4109855 - RNA, 71 nt, Human
gggagcugggcccaggcagcaugcuggcguuuccccgagggaauccuggcaugugccuugggaaagguccc

SEQ ID NO: 4109856 - RNA, 61 nt, Human
gggagcugggcugguuuugcugggccauacuguacugccucuguggaacugccaggcuccc

SEQ ID NO: 4109857 - RNA, 87 nt, Human
gggagcuggugagccugguuucacugacaaggucaggcccacucuggggcaugugugugagggaaacauguuuggagccgugcucuc

SEQ ID NO: 4109858 - RNA, 57 nt, Human
gggagcuguaguccagauaccgcggggcacgucggaagcugauaaacuacaacuccc

SEQ ID NO: 4109859 - RNA, 61 nt, Human
gggagcuguugauuguuugaggacuauuuguugcauaaucuccuuucuuuuagcagcuucu

SEQ ID NO: 4109860 - RNA, 82 nt, Human
gggagcuuggcaggccugguuuacaugguagaaaacaggggccccugggccugcuccaagccagcccugcagcagagcuucu

SEQ ID NO: 4109861 - RNA, 90 nt, Human
gggagcuuguuaaagaugcagauuccaucaccaauccagagauucuuauucaguagaugggcuaugagagcugcauuuuaacaaggaccc

SEQ ID NO: 4109862 - RNA, 77 nt, Human
gggagcuuguuggaaaugcagagucucagacagcagauccacugaaucagaacauggcauguuccauccaggcuccc

SEQ ID NO: 4109863 - RNA, 82 nt, Human
gggaggaaguaugguggggcagggauugcaggccagggcccagaacaguggccugagcuguuacucuguccucguuccuccc

SEQ ID NO: 4109864 - RNA, 92 nt, Human
gggaggacacaguagaaacaggcaggcagaugcagguguagugaacacuuauuggauacugugugcugaguguugucugaggugcucuuuuc

SEQ ID NO: 4109865 - RNA, 59 nt, Human
gggaggagacaguaaaaagcacgcaaacacaguguguucagaauuugcugcuuugaccc

SEQ ID NO: 4109866 - RNA, 74 nt, Human
gggaggagcccuguuccccaggccugacagugcaggagcugugggccugcaggcugggcugggcugccccuccc

SEQ ID NO: 4109867 - RNA, 82 nt, Human
gggaggauagagggucuuaccuaagcaggguucauugcuggcagugccugucuugcugugcuugggaagaaucucugcaccc

SEQ ID NO: 4109868 - RNA, 68 nt, Human
gggaggcagaaagauuucaucacuaaguucugaucaacauagcugaugaauaauuauucuucaagccc

SEQ ID NO: 4109869 - RNA, 90 nt, Human
gggaggcagagacguuggcacagagggacccagcagccccgggcuccugcccuggugcuggcugaggucuagcucuuugcucuguuuccc

SEQ ID NO: 4109870 - RNA, 75 nt, Human
gggaggcagaugccuuggccgugacccauggcuaaagcucagggggaaucaggucacaggccugccuguccuccc

SEQ ID NO: 4109871 - RNA, 81 nt, Human
gggaggcauuucuaucacccauugcacaaagagggaaacugaggccagagagggcacuugcuuccucugugcaauccuccc

SEQ ID NO: 4109872 - RNA, 84 nt, Human
gggaggccaccaggucucuuuugucacaccacugaaaaauauaaguaagcagugaugaguuacucaagaaucuuaaggccuucu

SEQ ID NO: 4109873 - RNA, 66 nt, Human
gggaggccgggccaggggcugguggcuuccuccgcgagcucugccaguuucuggccucagguaccc

SEQ ID NO: 4109874 - RNA, 63 nt, Human
gggaggccuauaugguuggauauaauuccucugucuuagaaguuuaaauucaccaugccuccc

SEQ ID NO: 4109875 - RNA, 56 nt, Human
gggaggccugcagccugggaacugggagaccugggucccaguggagaggccucacc

SEQ ID NO: 4109876 - RNA, 67 nt, Human
gggaggccuggcugucgcuggcaguguugugcacacagacaaggcaaggcggccagaucugcugccc

SEQ ID NO: 4109877 - RNA, 66 nt, Human
gggaggcgggggcugagucagugggaagaggggaagguuuucugggugacucacgcucccccaccc

SEQ ID NO: 4109878 - RNA, 75 nt, Human
gggaggcggugcugggauuuaguuuuaaauggaaaaugccucuggcuuuuaauuuucugggcccagcaguuuucu

SEQ ID NO: 4109879 - RNA, 93 nt, Human
gggaggcguuuauaaauaacuuuuccucagggccacggggugagccccggcuucugauuggcucagaggggaagugguuuugaacacuacacc

SEQ ID NO: 4109880 - RNA, 86 nt, Human
gggaggcucucuucucauucucugccauugcgguggaugguaacacuacuuaagagguagggaacuuuaaaagaaagagaguuccc

SEQ ID NO: 4109881 - RNA, 123 nt, Human
gggaggcugagguagggggaucacuugagccugggaggcagagguuguagugagccagguugugccacugcacuccagccuuggugacagagugagacccugucucagaaaaaaaaaaauccc

SEQ ID NO: 4109882 - RNA, 55 nt, Human
gggaggcugagguggauggaugaccugaggucagaaguucaagaccagccugccc

SEQ ID NO: 4109883 - RNA, 57 nt, Human
gggaggcugcucuccugucuggggccagaggucccugcauuugggagagugucuuuc

SEQ ID NO: 4109884 - RNA, 66 nt, Human
gggagggaaggaccuuaugaauaguccauuuagccuaagaaauggcagauuuaguucuucucuucc

SEQ ID NO: 4109885 - RNA, 66 nt, Human
ggcuagcacugaucacacuguguucugauuauuaguuuaaauaacaggcucaucagaugcugagcu

SEQ ID NO: 4109886 - RNA, 55 nt, Human
ggcuagcuccuccgcgcauccacguucaaccgaggcuggugauguuggagcggcc

SEQ ID NO: 4109887 - RNA, 85 nt, Human
ggcuaggaaugacccacugcagagcuuuucaguugagguaguguccucuuuaaccuuagcuaagaccuuggcggcaggcccagcc

SEQ ID NO: 4109888 - RNA, 93 nt, Human
ggcuaggauggucuucaucucuugaccuugugauccacccgcuuuggacugccaaagugcugggauuacaggugugagccaccaugccuggcc

SEQ ID NO: 4109889 - RNA, 71 nt, Human
ggcuaggguuggagagucagcuucagaggauagauaauuaaagccacaagaauagcugaggucacccagcc

SEQ ID NO: 4109890 - RNA, 79 nt, Human
ggcuaguauucaaaucaccauccuuaauuauaauuguuggcugcaaugaauaaucuguggaugguuuugaguugcugcc

SEQ ID NO: 4109891 - RNA, 63 nt, Human
ggcuauaaaucuacccagcauuggaaggccccagaaugaauuggguggaauuaaacauuggcc

SEQ ID NO: 4109892 - RNA, 70 nt, Human
ggcuaucucacucgaaacacagcauccccucccaucccaucacgaggggacccuguggagggugagaguc

SEQ ID NO: 4109893 - RNA, 76 nt, Human
ggcuaugauggaauugagcaucaguuguuugaaauauucaauaacaauuccuuggaugguaguucuaauuuuagcu

SEQ ID NO: 4109894 - RNA, 99 nt, Human
ggcuaugcaggggugauagaauuuuauguuuuauggcuauaucaucaguucauaucgaugauugggaccuugaaauaggauuuaucaucuuauuuaguu

SEQ ID NO: 4109895 - RNA, 86 nt, Human
ggcuaugcugucagaaacauaaggaaccugggcuuaagagaauggcucugccucucccaugucaagguugcuuuuggcugcacgcu

SEQ ID NO: 4109896 - RNA, 66 nt, Human
ggcuaugcuucaggaguaaggguaacccagaaguaaacuagccuucucccuagcucuagccuggcc

SEQ ID NO: 4109897 - RNA, 65 nt, Human
ggcuaugggagggacauuuuggaggcaagccuuccauggaaaccuccaaaucccauucuguaguc

SEQ ID NO: 4109898 - RNA, 67 nt, Human
ggcuauuugaucuaagucccaguguaaucuuauagauaaucgcauugaaggacuuccauuauaagcu

SEQ ID NO: 4109899 - RNA, 84 nt, Human
ggcuauuuucacuucuuuuguggaucuucuguugcuucgggccaucuggauguauacgugcaggucacaggggauaugauggcu

SEQ ID NO: 4109900 - RNA, 111 nt, Human
ggcucaaaacacuacacugaaucuuaugguuagcuaaaacaguuuggacauaggcucuaugcucaugcuucuuguauuuggcugacuuagagaaugugaguguuuacugcu

SEQ ID NO: 4109901 - RNA, 71 nt, Human
ggcucaaccagaggcugagcagucaguuugcuauuauuaccauauggcuucuucagccuccuggauagguu

SEQ ID NO: 4109902 - RNA, 70 nt, Human
ggcucaauacugugauccuucuagggcuggaacuaaaggagacaggcucuugagaggcacagguuuggcu

SEQ ID NO: 4109903 - RNA, 78 nt, Human
ggcucaauaguauuuaauaguuagcucaaaaggacgaauaaaguucuacaugggaagcugcugaacuacagucaggcc

SEQ ID NO: 4109904 - RNA, 62 nt, Human
ggcucaauauuuggccaggguguggugagcagacaagggucucacagacuggucagugaggc

SEQ ID NO: 4109905 - RNA, 109 nt, Human
ggcucacagggugcauuugacaaagagaagggcaugagucuauaaaccugggacaauugcagguuuagaggcaucuugcuuuucugggaacaaaggcauccacagaguc

SEQ ID NO: 4109906 - RNA, 80 nt, Human
ggcucacucacauggcuguuggcaggaggccucaguugcuugucgcauugggccccuccacauggcugcuugaguguacu

SEQ ID NO: 4109907 - RNA, 56 nt, Human
ggcucacuuuggggucagcugggggaccaugcuucugguggcucauguagugggcc

SEQ ID NO: 4109908 - RNA, 55 nt, Human
ggcucagagagacaaugugggacauuugaggucaguggcucauccuuucugcgcc

SEQ ID NO: 4109909 - RNA, 94 nt, Human
ggcaaagugaaaucucaguuaauguccuauacaauagugagugugcauauuguuguauguuuguuggccauuuagauuuguacuaugucuugcc

SEQ ID NO: 4109910 - RNA, 117 nt, Human
ggcaaagugaaggucccuugacagauggucugauagucugaaaaugaugggaggauaggaaccauucauugcuguggcuucaguaccaaauugugaauuggacucuuacaaugugcc

SEQ ID NO: 4109911 - RNA, 73 nt, Human
ggcaaaugacacacuaggaaaagcauuuguaacucauaacaagccuaguuuucuuacuguguaaaguacugcc

SEQ ID NO: 4109912 - RNA, 94 nt, Human
ggcaaauucuaucuuccccugcaagaccugagacacacccacuucuacugagagacacuggguggcaggcuggcauuggcaagaugguucugcc

SEQ ID NO: 4109913 - RNA, 114 nt, Human
ggcaacaacucugguuuauaugcauuggucugcuguuaguugucuaaugcucuuaauuuccauaacagaaacagauaaguguaaguguaugagaccggauucucuucauuugcc

SEQ ID NO: 4109914 - RNA, 124 nt, Human
ggcaacaugaaaaugcacacucguucaauaaauaucagaugaauaaaugaugagguaauuuaccuagaaaguugcauuuauaaaauguucgugguuuauuguguuaauguucaacuugauggcc

SEQ ID NO: 4109915 - RNA, 56 nt, Human
ggcaaccauguacaaagaugcugagguaagaaagagcucaguguauucugggugcu

SEQ ID NO: 4109916 - RNA, 80 nt, Human
ggcaacuagagcagugauugguaaccugguguauggaaucuaccuccaccugccugggaaccaauccuggcuuuagugcu

SEQ ID NO: 4109917 - RNA, 55 nt, Human
ggcaacugaggugucuagggugcaaaaugugaguugucuagacaccaaaguuguc

SEQ ID NO: 4109918 - RNA, 71 nt, Human
ggcaacuugugcuggagccccaggcugugcagacagagcccuucuccacagaagguuccaggccgguggcu

SEQ ID NO: 4109919 - RNA, 57 nt, Human
ggcaagaaugagcuggcaguucucaucccccugguggugaagagugcgcacauugcc

SEQ ID NO: 4109920 - RNA, 76 nt, Human
ggcaagacagcacagucuuucaggucagggagaaccaaguugaaauucugauucugccacguacuggcuguguucc

SEQ ID NO: 4109921 - RNA, 105 nt, Human
ggcaagauugaucugaggacugaacaaaaucauccaugugcaaacuuugguaucaguuaaccaaugugccucauauggaugggcccagaccuuugaugucaugcc

SEQ ID NO: 4109922 - RNA, 65 nt, Human
ggcaaggcugcuugguuuucucauggguauuucacuuagucuauguaaacuucagagucauugcc

SEQ ID NO: 4109923 - RNA, 78 nt, Human
ggcaagggaucugcuagcgguaacagcguuugcccauucccaugguguaaacacccuuacuguggccuguuucgugcu

SEQ ID NO: 4109924 - RNA, 75 nt, Human
ggcaagguuaagagauagugcuggagugaguauguguagucuuagugacaccucaucucacucauagccuuugcc

SEQ ID NO: 4109925 - RNA, 74 nt, Human
ggcaaguaauacaggauuauuuuagaguaguuacuggaaaggucuccuaagugaauucauuguguuauauugcc

SEQ ID NO: 4109926 - RNA, 66 nt, Human
ggcaaguauuugugcaucuacacacaucuaaacauagaaaagguacagcauaaauacacuauuguc

SEQ ID NO: 4109927 - RNA, 103 nt, Human
ggcaagucauuucacuuaaguagggcucagggucaccaucugucuauacagcaaaagucuggaccagauggccuuugaggcccaucuuaacaguaccucugcc

SEQ ID NO: 4109928 - RNA, 88 nt, Human
ggcaagucuguaugcugaggaagguuucuuaucaaucguaauuuauuugcuauaggaaguaaacuuucuucagcuaaucauaauuguc

SEQ ID NO: 4109929 - RNA, 69 nt, Human
ggcaauaugucaucugcuaaaauucaucucugcuucugcaagauacauugcacgaugcagauuuuugcc

SEQ ID NO: 4109930 - RNA, 67 nt, Human
ggcaauggagcugguaaacagugacauccuauauuaauuugaggucacugcuuaucaccaggcagcc

SEQ ID NO: 4109931 - RNA, 79 nt, Human
ggcaauggcaccuagggcaucccugccccagcagcccuuggcgugggagcuggggcaggagugcugggggcacggggcc

SEQ ID NO: 4109932 - RNA, 57 nt, Human
ggcaauggggaugaggcaugcuggugagugacagucguggcucugggcuccuuugcc

SEQ ID NO: 4109933 - RNA, 90 nt, Human
ggcaauguuuuggacauacuugaagcaagugaucaucaauuuauagugauuaucaaucugcuuugugguaucauuuucuccaauauugcu

SEQ ID NO: 4109934 - RNA, 60 nt, Human
ggcaauuacuuuaugcaaaugugggcaucucuggauggcuggcaaggcuggagucaggcc

SEQ ID NO: 4109935 - RNA, 107 nt, Human
ggcaauucacuacuaacuacaguuguuuagaaggcucuuagugauucagaaagcacauuaugcauuuagagcugauaguacacugguaggauugguguagucaugcc

SEQ ID NO: 4109936 - RNA, 85 nt, Human
ggcaauucuucaucaagacauaccuuuuuguugcuucuaauuaccugcuggcaggaacuaaaagugugucucuuguaugcaugcc

SEQ ID NO: 4109937 - RNA, 69 nt, Human
ggcaauuuucaugaauuauugauuuggccaaaaauaauugaaaagguuuauaauuacauagagauugcc

SEQ ID NO: 4109938 - RNA, 88 nt, Human
ggcacaaccuccagggauucccagauggggcaaggccaucugucucaggugugggacucccucaccccgucugggccuggaaccggcc

SEQ ID NO: 4109939 - RNA, 66 nt, Human
ggcacaaggagagggcaggccuaggaaugguuuagcugcauccugaugauauugcucuuucuugcu

SEQ ID NO: 4109940 - RNA, 56 nt, Human
ggcacaagguuuaaauaacaucaaaaugguguuugagcuaaaaguaagcuuuggcc

SEQ ID NO: 4109941 - RNA, 62 nt, Human
ggcacacagaggacaugcauuuguuucuucaagaaacauuuauugagcaccuacugugugcc

SEQ ID NO: 4109942 - RNA, 69 nt, Human
ggcacacagcaggcaugaagaaauguuuuugcaugaaagaauaugccuucugcugugcugcaguuugcc

SEQ ID NO: 4109943 - RNA, 117 nt, Human
ggcacacaggauuucaauagaaauugcaugccuuuuuagaugugcgaauguuucauuaagcguaugaauauuugaagagauguaugacacuuuaaaaacuguuuccucuacuguguu

SEQ ID NO: 4109944 - RNA, 86 nt, Human
ggcuucuugguaagggcauaucuaaaguauuugggguauuagggaaaacuuccuugguaacugauguucccuuacuguagggagcu

SEQ ID NO: 4109945 - RNA, 129 nt, Human
ggcuugaagaaaaagaagaggauaguggcauccagccaguguggaugacuucuaguggaccagaaguaccuucugccaugcuccuugggugaaggccaucauaucuuccuccucucaugcuucucugcc

SEQ ID NO: 4109946 - RNA, 82 nt, Human
ggcuugaguguguuugugagcacaggcacacacgugugcaugugcacaugugcgugucuguguaugcaggccguauuaggcc

SEQ ID NO: 4109947 - RNA, 59 nt, Human
ggcuugcacucauugggcauccgcuggugucggcucagcuggguggccugcgugaagcu

SEQ ID NO: 4109948 - RNA, 59 nt, Human
ggcuugccaugagugcaccugugcuucgguugccagcccagcaggugagccguggcucc

SEQ ID NO: 4109949 - RNA, 64 nt, Human
ggcuuggaauugguaggauguauguuagcuccagcuggcaauaagaaucuuaauaauucuggcc

SEQ ID NO: 4109950 - RNA, 87 nt, Human
ggcuuggaggucccuccugaaugggguuguggugucuuccacuggacaucaugguaacacagcuguauccaggagauccucuggguu

SEQ ID NO: 4109951 - RNA, 60 nt, Human
ggcuuggcuacaagccaugggcaauuccucuguccucugcccaacaggagugaucaggcc

SEQ ID NO: 4109952 - RNA, 88 nt, Human
ggcuugggacaugugugaaucuuuugggaucagaagacaacucugcuaggcagaauaauggucccuaaagaugucuacaucccaaucc

SEQ ID NO: 4109953 - RNA, 78 nt, Human
ggcuuggucucuaacacagcuuucagucauuaucucagugcuuugagacuaguaaagaggauguguuaaaggcaagcc

SEQ ID NO: 4109954 - RNA, 82 nt, Human
ggcuuguagauggcuuccuucucacugugugcuugccugguucuuguuuaguucaugcauggagauagggagacugugagcc

SEQ ID NO: 4109955 - RNA, 121 nt, Human
ggcuugucuuucccucucagagcuugguccacugaccuuccuugucuacaaaagcucuuaagaaguguuugcugaaaggaagcagggcagggcuuacagaggagggagcaugggggaagcu

SEQ ID NO: 4109956 - RNA, 127 nt, Human
ggcuuguggaacucaucugccuggucuauuccuugagagcaacacgcaguaguauacgagcguaacaagaacagcucaguaccuggugcuugaccucagaacaucucagcugaagucccagcaugcc

SEQ ID NO: 4109957 - RNA, 75 nt, Human
ggcuuuacaggguuuguaucuuccuuuaccugcaaagacagaaaagcaaaaggaggcaaacagccuagaugaguc

SEQ ID NO: 4109958 - RNA, 58 nt, Human
ggcuuuagggagcccccucccaagcccaucugcugggacagggcccugcccuauggcc

SEQ ID NO: 4109959 - RNA, 56 nt, Human
ggcuuuaugcagggauagaaauguaaauaugacagauucuugacuuucauaaagcu

SEQ ID NO: 4109960 - RNA, 62 nt, Human
ggcuuuaugcagggcauccugaaaagaagcacuuauuucagacacugaucuugcaucucgcc

SEQ ID NO: 4109961 - RNA, 74 nt, Human
ggcuuuauuccaugugucuaugaccaagguguuuuucucucauuggucauaguccauggcauaauguccuggcc

SEQ ID NO: 4109962 - RNA, 130 nt, Human
ggcuuucaguacuucccagguuuagguacugagcugaguggcaggucucagcuaccgacggguuuguggguucccgucacucucucugggucuuugcucaguucgccuaucuuugcuuuugucuguuguc

SEQ ID NO: 4109963 - RNA, 71 nt, Human
ggcuuuccuggguccucuagggagggggcucuaggagcccuccugauccuuccccuugaggauggaaaguc

SEQ ID NO: 4109964 - RNA, 83 nt, Human
ggcuuuccuucuuggcacagaugagauucuucuugugagaaaugguggaaucuucagccaugccaagauacagggaccgaguc

SEQ ID NO: 4109965 - RNA, 76 nt, Human
ggcuuucugaggcuacuguuggacuuuucaaggucugauuauuaggccauuuaaagggucagcuccugccugagcc

SEQ ID NO: 4109966 - RNA, 55 nt, Human
ggcuuucuugguucugcaggggccuccgggccuuuguucucugaacaagaacgcc

SEQ ID NO: 4109967 - RNA, 104 nt, Human
ggcuuugccauuccaaacuucugcagggcagagggaaacuccuuugcaggaaaauugccaaacagaaauuuccucaugcuccuauggaagguaaugcagaagcc

SEQ ID NO: 4109968 - RNA, 82 nt, Human
ggcuuuggcuuaagagaauguuguggcuagguugaucuuuuauucagacuacucaaacuuucucuauagcaacacuagggcu

SEQ ID NO: 4109969 - RNA, 70 nt, Human
ggcuuugugcuccaugaauuugagcuuuguguuguguauacauugcuccugguucacugguaaugcugcc

SEQ ID NO: 4109970 - RNA, 63 nt, Human
ggcuuuuacuguggaaauggggaggaaggagaaacccuuauaucuccagacuacagaagagcc

SEQ ID NO: 4109971 - RNA, 76 nt, Human
ggcuuuuauaugaacauagauuuugugucucuggaauauaugucaaagaguacaacugaugggucaugugggaguu

SEQ ID NO: 4109972 - RNA, 58 nt, Human
ggcuuuucgcccuuaccuggguccugcuuccagccaggcagagccggggcgagaaggc

SEQ ID NO: 4109973 - RNA, 88 nt, Human
ggcuuuugaaggaaaacuuacaaaggaaacuucuuuucccucaaaggaaauugggggaauugaugucucauuugucuccaucaaaacc

SEQ ID NO: 4109974 - RNA, 69 nt, Human
ggcuuuugagcagaggagugacguagguaacuuguuuugcacaauuaaucuggcugcugugcuuaagcu

SEQ ID NO: 4109975 - RNA, 130 nt, Human
ggcuuuugugauugguccuccuugucgccuuggccccucugguccucaguggcaguucuuucucucuugcugccuccuucaggagggcccggcucagggucuggguguucagggagaagaccucaggcuc

SEQ ID NO: 4109976 - RNA, 74 nt, Human
ggcuuuuguuuucagaauguggauucacaagugcucaaggaauaugacuucagcacuauacauuuugaauagcc

SEQ ID NO: 4109977 - RNA, 60 nt, Human
ggcuuuuuagggagccaacacugggcuuccaagagccagcugugcuuuuccuaaaaggcc

SEQ ID NO: 4109978 - RNA, 56 nt, Human
ggcuuuuugaugagaguccucuuuaaaaggaaagaaaugcagucucgucaaaagcc

SEQ ID NO: 4109979 - RNA, 83 nt, Human
gggaaaaaagguagacccggagcaccugagccaauggggccuggccccaggcagggacgugcucugguccugaaucauuuccc

SEQ ID NO: 4109980 - RNA, 64 nt, Human
gggaccaccuggggcucagaccugccucccccgacaggcaggucagcuggugccccaggugccc

SEQ ID NO: 4109981 - RNA, 78 nt, Human
gggaccagcuagugcccagaugagccagcagcucccuccagaugcaggggugaggcccauuugaggccagcugagccc

SEQ ID NO: 4109982 - RNA, 59 nt, Human
gggaccaggccagccucccugcggagccuaagggcccucucagagacagggccgguccc

SEQ ID NO: 4109983 - RNA, 59 nt, Human
gggaccagguaacuguuagucaugcuuugaguccuuugugauuuccagaaaauuggccc

SEQ ID NO: 4109984 - RNA, 79 nt, Human
gggaccccugccacccccagcagggaaaggaggagaaggugacacuggcccuccuguuguccugcuggggcagaggccc

SEQ ID NO: 4109985 - RNA, 56 nt, Human
gggacccuccuacuacccuggaaaccugggugagccuggagucguggaggggcccc

SEQ ID NO: 4109986 - RNA, 94 nt, Human
gggaccugaaggcuggcuucccaagcguccucgaggccuugugccaggaagaggacccucgggcuuagggaagugaaaaccaggcucagguccc

SEQ ID NO: 4109987 - RNA, 66 nt, Human
gggaccuggucuagcacugagcuccaaacaggcagaggggacuuugugccaaacgccagaacuccc

SEQ ID NO: 4109988 - RNA, 111 nt, Human
gggaccuucuugccuugcucuugcuacucugcucuggguggucauugugaaaagcccgcaccaaccaugccaguggcagccagacgaggacacagccuggcucuggguccc

SEQ ID NO: 4109989 - RNA, 65 nt, Human
gggaccuuggugcucccagaugcagcgcagaaucacuauugccuguguggggucugccgccuccc

SEQ ID NO: 4109990 - RNA, 76 nt, Human
gggaccuuuggaaggaauuaaggucaugaggguggagccuucaugaaugggauuaauguccuuacaaaaggggacc

SEQ ID NO: 4109991 - RNA, 66 nt, Human
gggacgacaaauguggugacugagagugacagcauccucccagauucucagcaccuguccaguccc

SEQ ID NO: 4109992 - RNA, 71 nt, Human
gggacgauguggccugaaucaggcacuguuggaaauucucauuuugugcaauuucaggcauauauugugac

SEQ ID NO: 4109993 - RNA, 74 nt, Human
gggacgcauuuucugcuaaaauggcugugcgaggcugccaccucguggccagcacaaggcagugaguguguccc

SEQ ID NO: 4109994 - RNA, 59 nt, Human
gggacggcaucaugggggugguuucucaugguucagcgccagccccuugguacuguccu

SEQ ID NO: 4109995 - RNA, 99 nt, Human
gggacucaguuugucaccacauggaccucucuguagggcugcuugaguaucuuaugguaguuggcuucccgcagaguaagugaugagacagagagugcc

SEQ ID NO: 4109996 - RNA, 128 nt, Human
gggacucauugcucuuuggaaacucuuuaaccuuuacaacaaaggcacgugcaugggauucaugauuccuaaaggcucguauuguuguguguuaaauuguguucucucaaaagauauguugaauuccc

SEQ ID NO: 4109997 - RNA, 75 nt, Human
gggacucuggccaggugcgguaugugucugguccucggcuaaguucucagugauauucacgccgccagagguccc

SEQ ID NO: 4109998 - RNA, 56 nt, Human
gggacuggauagaugugggugacccaaccauaacuaccuacucucccucagcuccc

SEQ ID NO: 4109999 - RNA, 64 nt, Human
gggacuguccggcagaagguacacacgucguagggugugaggccuucagcucgggaaggcuccc

SEQ ID NO: 4110000 - RNA, 57 nt, Human
gggacugugaggccuaacugggaccccaggcaaugggaaucccaugagcccacuccc

SEQ ID NO: 4110001 - RNA, 98 nt, Human
gggacuuguucacguagacaugauugaccaucugcugggcugaccuuggucaccagcacuuccagaggucagguugauacugugugguucaaaguccc

SEQ ID NO: 4110002 - RNA, 83 nt, Human
ggcacagcccuccgagaagcgggguguuuuggguggccugcccaggcaggcgcauugaggcccuguugcucugagaguuuguu

SEQ ID NO: 4110003 - RNA, 59 nt, Human
ggcacagggagaggcggauuuucccccaagggauguuccucugcacuccugcaugugcc

SEQ ID NO: 4110004 - RNA, 67 nt, Human
ggcacagugaguauuuaguaccuaagguauguuucuuggugcuguaucuauacuuuuccacuuugcu

SEQ ID NO: 4110005 - RNA, 129 nt, Human
ggcacagugugaacccuaaagugauggcaagcaagcugaagagaucaacacaaauaccuaaggagauguuuucggacucuuccguacuugcacauccaccuuagugaucugguuccaacccaacuuguc

SEQ ID NO: 4110006 - RNA, 65 nt, Human
ggcacauaagaaaugaauaugagaacaguaugaaagugaagcaguucucuuuauuccuuugugcc

SEQ ID NO: 4110007 - RNA, 69 nt, Human
ggcacauaccuacuuccuuuucagcuuugaaaaucacaagaaaggcugagucaaguuagggugaaggcu

SEQ ID NO: 4110008 - RNA, 64 nt, Human
ggcacauagucaacacacgguacuugagaaugcuuuucccaagacgaugugcuuggcccuugcc

SEQ ID NO: 4110009 - RNA, 68 nt, Human
ggcacauggauaauuuacgauucccauuguccccucugcagggauuaauucugaauuauuuauguacc

SEQ ID NO: 4110010 - RNA, 63 nt, Human
ggcacauuagaggagcugggacccugucaucugaucuuaguucaguguccagagcccauggcc

SEQ ID NO: 4110011 - RNA, 83 nt, Human
ggcacauuaguauguacaaguguuugcuauuaugaugaugaaaugcuuacaggaagcaaagcacuuugcauacauauuaugcc

SEQ ID NO: 4110012 - RNA, 86 nt, Human
ggcaccaccaagcacuauccuaaaauuguucaauuucuuuccaaggaaagacugaauuuuguuggguuggguuuguuuuguuugcc

SEQ ID NO: 4110013 - RNA, 71 nt, Human
ggcaccagaaguuauugccugugaugaaaacccagaugccacauaugauuucaagguauggcuucuuuguc

SEQ ID NO: 4110014 - RNA, 108 nt, Human
ggcaccagaguauucacgguagguguaaggacaacaggagaaaaauaagccgucuuaguacauuuuuucaaguuucuguuugucuuccaucugcaggcucuuuaagcu

SEQ ID NO: 4110015 - RNA, 59 nt, Human
ggcaccaucagcugugcagggggaauuucuucacuuuauucugugaucagccuggugcc

SEQ ID NO: 4110016 - RNA, 58 nt, Human
ggcaccaugcuguccaugacguacagcgagagucugcggagcgugagcagcaggugcc

SEQ ID NO: 4110017 - RNA, 61 nt, Human
ggcaccauuaaagagauccuggggacugcccagucugugggcuguaauguugauggccgcc

SEQ ID NO: 4110018 - RNA, 99 nt, Human
ggcaccggccuugucauggggagacaccuagggaaagaugggcaaagagacaagaauuuccaaguuuccucugacugcuccccugcaacacggagagcc

SEQ ID NO: 4110019 - RNA, 91 nt, Human
ggcaccuccaagaagugucauuccuggcaucugucuggggcucuggcagugugccaggaacuggcugcugguucugaacucuugccgggcu

SEQ ID NO: 4110020 - RNA, 74 nt, Human
ggcaccugcagauggcuucucgcuggcaccugucaugcucugcagacgugccuggaaaagaagcuuauguugcc

SEQ ID NO: 4110021 - RNA, 86 nt, Human
ggcaccugcagcugacagugaggugggggcuuugcagcaggugcuggggccuccccaaagugcugacagcuacaggaaaaggugcc

SEQ ID NO: 4110022 - RNA, 57 nt, Human
ggcaccugcuccucucucugggcagauuguccucucccuggaggcagguccagggcc

SEQ ID NO: 4110023 - RNA, 65 nt, Human
ggcacggagguggcuuagucucuggacaagaggcccccugacuugucuggcuuucuccaugugcc

SEQ ID NO: 4110024 - RNA, 71 nt, Human
ggcacgucgcggcaaugaccacacacugggcucuuuuggaaagaguuuacaguucucaucgcaacguugcc

SEQ ID NO: 4110025 - RNA, 80 nt, Human
ggcacguuaauucaugugaucacagauuguaauauaauuagcuccuucauuaauaucugcuaucagaugauggacaggcc

SEQ ID NO: 4110026 - RNA, 77 nt, Human
ggcacucaggauucaagcucagcuuucccgcggaccugcugggaagccacggguaagcugcuuuaucucucugugcc

SEQ ID NO: 4110027 - RNA, 66 nt, Human
ggcacucuucugugagaauucaagcaaggaaaacaaaucuuuucucaggguugcagaaggcaggcu

SEQ ID NO: 4110028 - RNA, 95 nt, Human
ggcacugaacacaggcccugugaacaaggaugagggcuccuaugguucccaaccagagugggugaucucuguuguccauagggagaaucagugcc

SEQ ID NO: 4110029 - RNA, 60 nt, Human
ggcacugacacuagcauggcacuggccacgugccaggaaaugaacuguguguuuugugcu

SEQ ID NO: 4110030 - RNA, 83 nt, Human
ggcacugacugaccucagggccccuguucgccugccugaggcacuucaggguggagggagucccugagcacagccuucaggcc

SEQ ID NO: 4110031 - RNA, 71 nt, Human
ggcacugcuccccgaguuagcuggccaguuccccucggggcugccuugacccuggcuccggaggcagcgcc

SEQ ID NO: 4110032 - RNA, 63 nt, Human
ggcacuggaaggaucaugugagggcaguuugagugacagguauucaaugguccuucuaagucc

SEQ ID NO: 4110033 - RNA, 84 nt, Human
ggcacugggcacagucccuguccuuguagcccaucagguggaugaugauaugguggggucacgacagagggaagcccagaugcu

SEQ ID NO: 4110034 - RNA, 58 nt, Human
ggcacugucuauagaaugucaaaguaauuucuuaugaagacaucauguacacauugcc

SEQ ID NO: 4110035 - RNA, 66 nt, Human
ggcacugugaaaguaagucagacuuuacuuaauuauugugaaaguaagucuuacauucacauugcc

SEQ ID NO: 4110036 - RNA, 85 nt, Human
ggcacuugggaauggcaaggaaaccguuaccauuacugaguuuaguaaugguaaugguucucuugcuauacccagaaaacgugcc

SEQ ID NO: 4110037 - RNA, 113 nt, Human
ggcagaaaauaauugaaauaacuuccguucaauuucuaauugaaucucucuucuguggggaaggaaguaaaguacaauuaaagauguaguggaaagcuguuuuuuuuucuucc

SEQ ID NO: 4110038 - RNA, 70 nt, Human
ggcagaacucccacccugggcuacacauccagggugcaggcccuugggugucuccaggagggaaagagcu

SEQ ID NO: 4110039 - RNA, 73 nt, Human
ggcagaaggaucgcuugagcccaggaauucgagacugcacucuacccugggugacagagugagaccuuguguc

SEQ ID NO: 4110040 - RNA, 86 nt, Human
ggcagaagggcugcacugauuacccauugcugcugaacuaaugacccaaaaacuuagcagcuggaacuaauagugguuucucuguu

SEQ ID NO: 4110041 - RNA, 64 nt, Human
ggcagaaguggaacuuggcugcagggagucuggcccuggagccugcaguuuucacuuuuacucc

SEQ ID NO: 4110042 - RNA, 58 nt, Human
ggcagaagugguaccguguggccuuugcaaggcuaaaucaggccuuacagcuucugcc

SEQ ID NO: 4110043 - RNA, 59 nt, Human
ggcagaaugaggcuuaggaaugcauuucacuuaauugauagaccugucuuguuucugcc

SEQ ID NO: 4110044 - RNA, 69 nt, Human
ggcagaauggcugcagccggcccugcgcaugcucccugcgccgcgcaugcucccugcgccaccccugcu

SEQ ID NO: 4110045 - RNA, 70 nt, Human
ggcagacauuuccccacccaggacaggccagaugugcucccugagcuguugccugugcuggguguuugcc

SEQ ID NO: 4110046 - RNA, 62 nt, Human
ggcagacccgugcucuuucugucucugcacccaguguguguugauacaguaagguguuugcc

SEQ ID NO: 4110047 - RNA, 77 nt, Human
ggcagagaacucaguuaugcugcuacccaguuucugaccuacagaaacugugagcuaguaaauagguguuuuaagcc

SEQ ID NO: 4110048 - RNA, 60 nt, Human
ggcagagagagaggccaguauuugaggacugauauuuaaaugaacaacuugauuuuugcc

SEQ ID NO: 4110049 - RNA, 78 nt, Human
ggcagagcacaauauuuugcauucuguuaaaauguauuuuccccccucuggagaaagaaugaaaauguguuucaugcc

SEQ ID NO: 4110050 - RNA, 55 nt, Human
ggcagagccucagcccuccacccagucuuuggugggaauugcaggggguucugcc

SEQ ID NO: 4110051 - RNA, 78 nt, Human
ggcagagcuccugaagcuggagaaugggucuaggccacgccuggccucgugcucacggcuccagcugcauccccugcc

SEQ ID NO: 4110052 - RNA, 55 nt, Human
ggcagagcucuggacugagaacuaaaguccuggauuccagcucaguuuuuuuguc

SEQ ID NO: 4110053 - RNA, 75 nt, Human
ggcagaggaagcuggaagugggagauguagcaacugaaagacacgcugccuucccccacacucagcagcccugcc

SEQ ID NO: 4110054 - RNA, 65 nt, Human
ggcagagggcacucgagacuacggcaccaaguucgcgucuguaggggccggcggagcccuucgcc

SEQ ID NO: 4110055 - RNA, 88 nt, Human
gggaacugugucuuagaggagguccuuuucugauguggguauccuccagaguugguugacauccucccuuucugggaauauacuuccc

SEQ ID NO: 4110056 - RNA, 61 nt, Human
gggaacuguguggugcucugaugaaccccaucuuucuaucuguagucacugcacagcuccc

SEQ ID NO: 4110057 - RNA, 59 nt, Human
gggaacuucagaaagucgcugcauucuugauuucaugccgugacuuucagagcuucacc

SEQ ID NO: 4110058 - RNA, 56 nt, Human
gggaacuugccccagaggaauuuccccugcuggaauguuccuuuaauguaguuccc

SEQ ID NO: 4110059 - RNA, 90 nt, Human
gggaagaaacugauaggagaggugagugauacuggacuuacagauauauaucauaaauuaucuauuuggcuauuauuuauguuucuuccc

SEQ ID NO: 4110060 - RNA, 65 nt, Human
gggaagaagacauggugaaggcagggcagaccucuucugugcuaggcuucauggugcuuauuccc

SEQ ID NO: 4110061 - RNA, 61 nt, Human
gggaagacugcugcaaggcuaaagccagugaagaacugguaaagaagcaccagucauuccu

SEQ ID NO: 4110062 - RNA, 60 nt, Human
gggaagagagaucccauagauguggacgcucuuuaguacgcaucguggcauccuccuccc

SEQ ID NO: 4110063 - RNA, 76 nt, Human
gggaagagaggccaagaugaucuuuacaguguuuucaaacucugacagcagcuuuaagucacugguuacucauccc

SEQ ID NO: 4110064 - RNA, 59 nt, Human
gggaagaggugcauacagacggcaccauaucugauaauagugcuuccucaccaucuccc

SEQ ID NO: 4110065 - RNA, 79 nt, Human
gggaagaguuggauuugaaagggacaaagucacugaauacaaucaauuauccaugagacugccuuuucaaacccuuccc

SEQ ID NO: 4110066 - RNA, 69 nt, Human
gggaagcacauuuggucacuauccuuuuugucaucuuggacucaggauauugggcuggagcaguuucuc

SEQ ID NO: 4110067 - RNA, 64 nt, Human
gggaagcagacggcggggaaaucccacacugcucaguccuggcccauuuccucccucucuucuc

SEQ ID NO: 4110068 - RNA, 65 nt, Human
gggaagcauuccugauggguuuuuuuuggggaucagaacuagcaaaagcucaacaggaagguccu

SEQ ID NO: 4110069 - RNA, 83 nt, Human
gggaagcccucccugcugucagggugagaaacggaggcgauuccccgcguccaggcuccccugcgugcuccacggggcuuccc

SEQ ID NO: 4110070 - RNA, 65 nt, Human
gggaagcugaagcuagagaaaaggcgggggucuagaagucccgugguuucuaguuucagcuuguc

SEQ ID NO: 4110071 - RNA, 63 nt, Human
gggaaggacacagccaugacuggaacccaggcagcccagcucauagaucaggcuuugauuccc

SEQ ID NO: 4110072 - RNA, 84 nt, Human
gggaaggacuacccucucuguggcaagcaugcugcucagcugccccaggggccaggcagcagcuuuguccaggagagugugccc

SEQ ID NO: 4110073 - RNA, 63 nt, Human
gggaaggagguggaccugccccuuuguccuggcugggguggcugggccgggccccuccuuccc

SEQ ID NO: 4110074 - RNA, 95 nt, Human
gggaaggcagcauucuucuggauaguuaguugauaauaccagcagauaauaucagagagagcuggcaguugauaauaccagagagaguuguuccc

SEQ ID NO: 4110075 - RNA, 56 nt, Human
gggaaggcaggauucucuggugggcagagccuguucucagagacaaaugccauccc

SEQ ID NO: 4110076 - RNA, 90 nt, Human
gggaaggcaggcaucucaguucaggcuccacuguccucacccacagacaugggcaggcagccucucugacagcagcucugcccaauuccc

SEQ ID NO: 4110077 - RNA, 123 nt, Human
gggaaggcuuucaggucuggcuugcucaagggacucagcuccuaccccggccccagcuguugcugagccugagggcagguggugcugccaggugccuuguguuggccucccugcaugcguccu

SEQ ID NO: 4110078 - RNA, 67 nt, Human
gggaagggaauggggggaaaccuggagugaagaacaugaauccaucugucuuucccauccacuaccc

SEQ ID NO: 4110079 - RNA, 59 nt, Human
gggaagggcucaucagguggccgcucugccuugaagagugguacccucaggcccuuuuc

SEQ ID NO: 4110080 - RNA, 73 nt, Human
gggaagggcuccuuuuauugcaaggaagccucauguacuucccauuucagccuaauaaaagaagccuucaccc

SEQ ID NO: 4110081 - RNA, 73 nt, Human
gggaagggcucuaggccaagagucccggcaucauucgagucugcucuggcccgcuccugcccuaagcccuccu

SEQ ID NO: 4110082 - RNA, 79 nt, Human
gggaaggggcggggcugugagaucugugguguggugcugaaggagcugcugccucacagccucaugcccagcccguccc

SEQ ID NO: 4110083 - RNA, 61 nt, Human
gggaaggucauugaucugcggcacaauaacucccacccugcaacagucuaauucccuuccc

SEQ ID NO: 4110084 - RNA, 81 nt, Human
gggaaggugaguccuuacucgggggcccagaucuccccacggaggccacagaucuggguccccgaggaaggagagcccccc

SEQ ID NO: 4110085 - RNA, 66 nt, Human
gggaagguggcgagcggauugcugcuugggcauguggcccguuccuagcccuucuccaccucgccc

SEQ ID NO: 4110086 - RNA, 55 nt, Human
gggaaguaaauuaggacagcuuuccuuuccauuuaaguugucucuuuugguuccu

SEQ ID NO: 4110087 - RNA, 74 nt, Human
gggaaguccuccuaucuugcucuuccucauauuacugagaaggaaacaggcugagagaggaaaagggacuugcc

SEQ ID NO: 4110088 - RNA, 55 nt, Human
gggaagugaaguguagcugucuuaacacugacagaaagaccuuguaacacuucuc

SEQ ID NO: 4110089 - RNA, 75 nt, Human
gggaagugcuguugugcuguacucuacaugguuauauaaauuaugcaguuuaaggcacaauuagcaugcauucuc

SEQ ID NO: 4110090 - RNA, 70 nt, Human
gggaaguggcucagagcagggacucuggagcuagacugccugcguuugagauccugcucagccaauuacu

SEQ ID NO: 4110091 - RNA, 76 nt, Human
gggaaguguagucuugagcccccaagauuccuuuucuguucuauggagugggcccgcgcaaaggacuccauuuccc

SEQ ID NO: 4110092 - RNA, 66 nt, Human
gggaagugugcagaguucucuuagaacacccagucacaugguguagagacugcucuuacacuuccu

SEQ ID NO: 4110093 - RNA, 81 nt, Human
gggaauaauuguaaauaucuuuaaugcuuggagguuaagagaaacuugaacuuuguaguaauggagauuaaagcuauucuc

SEQ ID NO: 4110094 - RNA, 55 nt, Human
gggaauaggacaaaugaaggagaguaaaacuucauccuuuauugcuuuuuuuccc

SEQ ID NO: 4110095 - RNA, 118 nt, Human
gggaauauugggaagguuagauauuaguggucaccucuagcauuccugucacuaagauguugacuacucauauuguacagagggaucacccuguuucuggaucuaaccauuuaucacc

SEQ ID NO: 4110096 - RNA, 60 nt, Human
gggaaugaguuuuagggccauuaaaggacaugaccugaaguuuccucugaggccaguccc

SEQ ID NO: 4110097 - RNA, 74 nt, Human
gggaauggagaccaggcccgaguccccaggugaccuaaagaggggugaggugccuugggccugucagcacuccc

SEQ ID NO: 4110098 - RNA, 64 nt, Human
gggaauggcgucguccaaaugccugagcaaugacacggccucagauggaaugaugccacugccc

SEQ ID NO: 4110099 - RNA, 61 nt, Human
gggaauguuugagugccaugugacguccagagugacguucuacaugacacucaacauuuuu

SEQ ID NO: 4110100 - RNA, 77 nt, Human
gggaauugagguagggacuuaaaacuguuuucacuaauggcucuuuagugcaucauagugagguuuuuauucuuccc

SEQ ID NO: 4110101 - RNA, 83 nt, Human
gggaauuguauuauaauuuuaauuuagcugcuguaacaagauccagaauagcaguggcuuaaauaagauuagguuuauuucuc

SEQ ID NO: 4110102 - RNA, 69 nt, Human
gggaauuucugaaaaauaauugcugaauuuuacaaaagugauucagcacuuggauuucagagauuaguc

SEQ ID NO: 4110103 - RNA, 91 nt, Human
gggacaaacagguacuuguuaaaauauuagcuauuauuuggggaguagguauugaaugaugguuaauauuuuaagugauucuuuuguacuc

SEQ ID NO: 4110104 - RNA, 76 nt, Human
gggauguuuuugagaaggaaacaauggcuuuugagacaaaauucaagaagcagcaagcccuucaaagaagcaucuu

SEQ ID NO: 4110105 - RNA, 66 nt, Human
gggauucagggagcagccccuagaaguaagugcuuucacuugcuaggcagugcuucccugacucuu

SEQ ID NO: 4110106 - RNA, 83 nt, Human
gggauuccaauagcaucuaaauaaacgugggagucaaaagacacauaaaggacuucccuugcuuuacgauguugugguuuccc

SEQ ID NO: 4110107 - RNA, 80 nt, Human
gggauugaaauguaagucuuuguuucuuaaaauaacuuuuuaagguuacaaaggacuucauaguaaaucuuccaaauccc

SEQ ID NO: 4110108 - RNA, 113 nt, Human
gggauugagggugagcaaagcccaaaggucccuguccucaggguucccugaccucuccucugggagaucuccugagggcaggacccuccucugggugucuugcccccaacccc

SEQ ID NO: 4110109 - RNA, 92 nt, Human
gggauugauuggcacagauagaucaagugucucccacugacauuguaauggaggagguagaagagaacuugaaaugucuauuguucaaucuc

SEQ ID NO: 4110110 - RNA, 88 nt, Human
gggauuucauugugggaauuagaguguguacuacucauuuauggaugacaguaauacacacucucauuccuaaaagugaaaaugucuc

SEQ ID NO: 4110111 - RNA, 69 nt, Human
gggauuugggcuugcagcagagcaucacccgcacagacaggggcaggcuuggguuggagcccaggaacc

SEQ ID NO: 4110112 - RNA, 75 nt, Human
gggauuugguuuggauugcguuucuuaauaagcaugguggcuguugugcagagugcaauguagacaucagggacc

SEQ ID NO: 4110113 - RNA, 71 nt, Human
gggcaaaaaugggacaguugguugggcucuugugccuccugcaugggccuccuauuauccccaucuugccc

SEQ ID NO: 4110114 - RNA, 124 nt, Human
gggcaacacagugcuccacacagagugugauucuguaaauguuuccugagugcagguagagugcagaggccucuguccagcucucaggagacaaucaccagcacaccugagaagacuguggccc

SEQ ID NO: 4110115 - RNA, 122 nt, Human
gggcaacaccgaggugaguaugaccaucccuguccucaaggagcuucagucuaguaggggaugagacauacuagacugugagcuccucgagggcaggaaaaguguuuuagucaucuuugccc

SEQ ID NO: 4110116 - RNA, 89 nt, Human
gggcaaggcauuuuacagauagaugauaauggcuuucaguguuucucaaauuggcucaaagcccauacuguguaaauugcuaaaagccc

SEQ ID NO: 4110117 - RNA, 91 nt, Human
gggcaaggcuaaaggucugggggugguugggggccugguuccaggcccagcucugccaucuacccacuguguggcuuuaaagggcuugccc

SEQ ID NO: 4110118 - RNA, 76 nt, Human
gggcaaggguuuugucuguauuguuugcugcuguaucuccaggucuaaaacagugccaggcagaugccaggugccc

SEQ ID NO: 4110119 - RNA, 64 nt, Human
gggcaaguccggugcccagagcacaguccagugucuccucaauuucuugggcccggcuugcgcc

SEQ ID NO: 4110120 - RNA, 58 nt, Human
gggcaauggcucugauguuguugugacuucugaugucaccaccugaagagcuauucuc

SEQ ID NO: 4110121 - RNA, 71 nt, Human
gggcaaugguuggggccuggagauugggaggaccucccaaccucagccucuccaggccuuacuccaggccu

SEQ ID NO: 4110122 - RNA, 77 nt, Human
gggcacauucuaagacauuuauguuucucuaggaaaaauuccugguuugaaauacuuguccuggacuuaaugugucu

SEQ ID NO: 4110123 - RNA, 78 nt, Human
gggcaccaauguaaucuguuaauauuuguauccuaauguuaugcagguggauauaaagaauuaacauuuuuagggccc

SEQ ID NO: 4110124 - RNA, 73 nt, Human
gggcaccccaggauugaagggaaccucagaaucaugucacugccauucuagaguuucaauccaaggggucccc

SEQ ID NO: 4110125 - RNA, 75 nt, Human
gggcaccgagucgcugauaaacgucacguucccauagacgugcugcgggaaggccuugucagcggauuggcuccc

SEQ ID NO: 4110126 - RNA, 75 nt, Human
gggcaccuguuucacauguauauaggcauuauuucuuuuuaacauaggaauuauugccagcauguguaacacccc

SEQ ID NO: 4110127 - RNA, 89 nt, Human
gggcacggcgaagggcggggcccgucggcccaaguccuuguagggaaaucgaggagagggcugcgggcccacgugacugacccucgccc

SEQ ID NO: 4110128 - RNA, 58 nt, Human
gggcacugagggcccacaggaugugagcacauuucugauccugugagucucagucccc

SEQ ID NO: 4110129 - RNA, 63 nt, Human
gggcccugcgacucgcggcggaggcgcacagcaggcgcucaaacgaucguggguucagggccc

SEQ ID NO: 4110130 - RNA, 59 nt, Human
gggcccugcguccggaagucugcgcccugcgcggugggcggagaagccacgaggagucc

SEQ ID NO: 4110131 - RNA, 77 nt, Human
gggcccuggaagaggcuggaggauacugcgcugucacugagacaccugccccagguccuccaucucagccacugccc

SEQ ID NO: 4110132 - RNA, 64 nt, Human
gggccgggcccggcggggccugcaaggcggagccucggccuguggccgcgucgggcggcggccc

SEQ ID NO: 4110133 - RNA, 83 nt, Human
gggccgggcuggucgcacccgggcgcugcuggcggccaagcuggaugggucgccagugaguuucggugcggcaccgcuggccc

SEQ ID NO: 4110134 - RNA, 55 nt, Human
gggccgggugcgcguguccgcgccucuucccgccggccgggcgggcgccuggccc

SEQ ID NO: 4110135 - RNA, 91 nt, Human
gggccggugugucuggucaucauccaggagucguggcgcucagcguucauuaccgagagcaagugcugacccuggccgacacucacggcuc

SEQ ID NO: 4110136 - RNA, 73 nt, Human
gggccuagggacucaggacccccuguggaugcagcugagcugcaccugagaggucucugagguggacaggccc

SEQ ID NO: 4110137 - RNA, 79 nt, Human
gggccuaugcccucccuccugcucucugugccagcuaguuuguggcaggcagagggguguguggaaagugcaugggccu

SEQ ID NO: 4110138 - RNA, 64 nt, Human
gggccuccauuuguauuacugccccagggcuguaaauguuagggguaggcccgaaugggagucc

SEQ ID NO: 4110139 - RNA, 72 nt, Human
gggccucugggaucgcugguuuccccaccucuaaagcagagggggcagcggaccagugacccccaaaguccc

SEQ ID NO: 4110140 - RNA, 55 nt, Human
gggccucuguuuggagccaggaugaggaguuucagccgagcucugagcagggccu

SEQ ID NO: 4110141 - RNA, 57 nt, Human
gggccugagaaucugcaugucuaguuaguucccaggagaugcugaugcugcaggucc

SEQ ID NO: 4110142 - RNA, 67 nt, Human
gggccugagcuacuagguagguuagggcaauaaaaggugaucugucugucagcagugggucaggcuu

SEQ ID NO: 4110143 - RNA, 56 nt, Human
gggccugcaggugguguggaggagaggguccccucuacaaagcugugucaggaccc

SEQ ID NO: 4110144 - RNA, 55 nt, Human
gggccugcaugcagaagggcuuccccgguuuuggguggaaggccacggcaggcuu

SEQ ID NO: 4110145 - RNA, 61 nt, Human
gggccugcaugugcccacucuggcuuagagaacucuaaguaguugaauuacaugauggccc

SEQ ID NO: 4110146 - RNA, 55 nt, Human
gggccugcuccccaucgcugcucuuccuccagggcaggguccauggaggcagccc

SEQ ID NO: 4110147 - RNA, 80 nt, Human
gggccugcugggugcggggcgcugggcagaacaaggcagcauggccuggcccuguguccugcugccagugaagcaggccc

SEQ ID NO: 4110148 - RNA, 89 nt, Human
gggccuggcuggaggugagucacugaacccccugcaguugaguccauuccucucggagagcuuagugauguccucacagucaguggccu

SEQ ID NO: 4110149 - RNA, 66 nt, Human
gggccuggcuggcuugucccaggacaaaggaaggccuuggccugggccgcagccacucccaggccc

SEQ ID NO: 4110150 - RNA, 67 nt, Human
gggccugggggcagcuugugucccccgauuggggucuuggcuggaacagaggcugaucuucaagccc

SEQ ID NO: 4110151 - RNA, 56 nt, Human
gggccuggugcuucugacuccugacuuaacagaaacaggauggagguaccgggucc

SEQ ID NO: 4110152 - RNA, 72 nt, Human
gggccugugccugccccacuccucagcacgguggugccccgugcacuggagaggcuggggaggcaggggccc

SEQ ID NO: 4110153 - RNA, 59 nt, Human
gggccugugcugaacgggucuuuccgaucucuuucuagaaacgccuuuagcacaacccc

SEQ ID NO: 4110154 - RNA, 101 nt, Human
gggccuguggaugcccucagccaguacuucucaaguuuccacgggcuugagaauccacuggggacucugugaagaugcaggcuuggugugucuacaagucc

SEQ ID NO: 4110155 - RNA, 62 nt, Human
gggccuguuccggcuuugucugcagacuuccuuugccaaguagauccagugccauaaggccc

SEQ ID NO: 4110156 - RNA, 69 nt, Human
gggccuucaucagugagucaacugcucuugacgccagcaagucagucugauguucgcaggugaaacccc

SEQ ID NO: 4110157 - RNA, 61 nt, Human
gggccuucuaguuagccccaauucaguuggagguaugacgugggacagcuuuaggaggccu

SEQ ID NO: 4110158 - RNA, 126 nt, Human
gggccuugagcauugugccuuucuuuagcacggaugugacaggcaguggcaucaggucccauuuuccugccuugugcagaaccugugccacugcccugccacgccaggcaaaggacucgaaggccc

SEQ ID NO: 4110159 - RNA, 63 nt, Human
gggccuuggcgaagugugguggaaagaauuaugaacgggccaagaccugcuuugaaaaggcuc

SEQ ID NO: 4110160 - RNA, 103 nt, Human
gggccuuggggagagggacccaggcagccaagugugugugugagcacagucaugcaccaugcaucaccgaguugcccaccagggccucccccuccuacccccc

SEQ ID NO: 4110161 - RNA, 57 nt, Human
gggcgagcagaagccaccccugcuggguagacagcagucaggguuguaggcucaccc

SEQ ID NO: 4110162 - RNA, 57 nt, Human
gggcgaggcugggggcaacuguaacugccacagcccagagccccucagcucucuccc

SEQ ID NO: 4110163 - RNA, 72 nt, Human
gggcgagggaaaggggaauacugguuggggcuggaaguacggcugaggcaguccacccuugugcucuugccc

SEQ ID NO: 4110164 - RNA, 61 nt, Human
ggccagggagcuccuaagucuucuccuaucuuugaggcugagacucuggggaucucugucc

SEQ ID NO: 4110165 - RNA, 82 nt, Human
ggccagggauaguucuggauauuuuaagcauguuauuuuauuuaacagucaugcaaaauaugcaaaagagguauagcugacc

SEQ ID NO: 4110166 - RNA, 60 nt, Human
ggccagggcugcugggggaguugaagguaccuuggaccccugcucgggagcccugcugcc

SEQ ID NO: 4110167 - RNA, 56 nt, Human
ggccaggggcucuggauuuguuuccacccagccugcaagucccuaagucucuggcc

SEQ ID NO: 4110168 - RNA, 74 nt, Human
ggccagggucuuggcgccaucacccguggccaugggguagucaauguuggagucggggaggcgcagcccuggcc

SEQ ID NO: 4110169 - RNA, 95 nt, Human
ggccaggucaagaaaagagacacagaggcaugacaguggcuucuuccaucaaaagagcuuuuguacugcuuuugcuuuuccccuugcuucuggcc

SEQ ID NO: 4110170 - RNA, 57 nt, Human
ggccaggugcucuaauucaucuggguauuccacaggauuucuaggagaguaccuacc

SEQ ID NO: 4110171 - RNA, 62 nt, Human
ggccagguggcugccuccccgcgcgggccaugccugcacaguggguggggcgucagguggcc

SEQ ID NO: 4110172 - RNA, 55 nt, Human
ggccaguggaagggcaggggagucaccccagggacagcucugaccgccacuugcu

SEQ ID NO: 4110173 - RNA, 61 nt, Human
ggccaguucucaggaauacaggcggcagcucugcuugcucuugaccuuggagaacucggcc

SEQ ID NO: 4110174 - RNA, 87 nt, Human
ggccaguucuuuaaugucuacaucagcagagaguaacugaugcccucucauucuugcuguguggaugugaagaaucuguagucggcc

SEQ ID NO: 4110175 - RNA, 63 nt, Human
ggccaguuuccaugcacuauuucugaacggccccagcuucucuccuagugaguggaucuggcc

SEQ ID NO: 4110176 - RNA, 66 nt, Human
ggccauaggggcuuacauaguuauuaaaauugcaucauaaauuuggcucugagcuuccugguggcc

SEQ ID NO: 4110177 - RNA, 120 nt, Human
ggccaugcccuucccuugguggagggaaaaaggagguggcagaacuaugugauugcuguugaagacacacucaaaagggcauuuguuacuuuucccauugaccaaaagaagucauaugcc

SEQ ID NO: 4110178 - RNA, 64 nt, Human
ggccaugcgcugggucaucuugcgcucguagcggaagggccuggagauggcccaguagcgggcc

SEQ ID NO: 4110179 - RNA, 55 nt, Human
ggccaugcucguggcuggacugcugcccacacacagacagcuccugcccauggcu

SEQ ID NO: 4110180 - RNA, 72 nt, Human
ggccaugcucugcugagauaucugggagaaaguaauuuauauuucaucauuccuaggugcagagcuccagcu

SEQ ID NO: 4110181 - RNA, 129 nt, Human
ggccauggcuggcgcucugcauggacgugugagccgcccuggccuggcgcguugucagcuagcacugcugagugccgugggccggggagaugucucacagccccgucucguuuauuuuccgccauugcc

SEQ ID NO: 4110182 - RNA, 57 nt, Human
ggccaugguuggggaagacauggguuaacuccacauaucaauccauccacuguggcc

SEQ ID NO: 4110183 - RNA, 55 nt, Human
ggccaugugaaaaagacccagggguuuuagguaaccccaaagcuucauaugagcc

SEQ ID NO: 4110184 - RNA, 59 nt, Human
ggccaugugguagugcuuaaccuucagagaaaaggugguugcaauuaccauaaucggcc

SEQ ID NO: 4110185 - RNA, 69 nt, Human
ggccauucagacuggccacaucugcacugugugaggcgugcaggcagagacgucaguguaggaguggcu

SEQ ID NO: 4110186 - RNA, 55 nt, Human
ggccauugugaauuucaguugggcuuuuaacaaaaaagcucugcuucaugugguc

SEQ ID NO: 4110187 - RNA, 76 nt, Human
ggccauuugucuuuaguguaauucugccuuuuguggcuucuuuacaaaagcaguucuaucugaguuaaaauaggcc

SEQ ID NO: 4110188 - RNA, 58 nt, Human
ggccauuuuuguucuuaucucugguucaaggauuccuuggaaaauaacaaaguuggcu

SEQ ID NO: 4110189 - RNA, 83 nt, Human
ggcccaacuggcagagcuggagggggaagaggagggauggggacugcauccuucuucuucccccuucaggggucauagggguc

SEQ ID NO: 4110190 - RNA, 70 nt, Human
ggcccaaugugugguccuaaagucuagcuggaugccgccuguacacuuuuuacuacagauucuaggugcc

SEQ ID NO: 4110191 - RNA, 69 nt, Human
ggcccacugagcgacaaguagcuuuugauguagacaucacucccccagagagcuauuuguuuggaggcu

SEQ ID NO: 4110192 - RNA, 58 nt, Human
ggcccagaauacuuuguaaaauuuagcucuaacuaauguugacaaaauauuuuaggcc

SEQ ID NO: 4110193 - RNA, 74 nt, Human
ggcccagacccaagagugguggaggugguacaggccuucucccacucccacccccgccaccucuaagcuggguc

SEQ ID NO: 4110194 - RNA, 74 nt, Human
ggcccagagggguugagcaucucagcaauauuauauacccagucugcucgccugcucgccuccuccugcucgcc

SEQ ID NO: 4110195 - RNA, 71 nt, Human
ggcccagcacagaggcucaaagccaggugcagcuggaagagcagcuccccacagucucuguugcugggacc

SEQ ID NO: 4110196 - RNA, 74 nt, Human
ggcccagcagauggagggccaggaggaggaagagucugcagcauuuguucuccuggcucccacccugccagguc

SEQ ID NO: 4110197 - RNA, 56 nt, Human
ggcccagccacuguggaauagcccccccagggagugggagggacagggcuaggguu

SEQ ID NO: 4110198 - RNA, 59 nt, Human
ggcccagccucagacaugcccuggccccuccccaacagggcacagucuaaagucgggcc

SEQ ID NO: 4110199 - RNA, 81 nt, Human
ggcccagccuggagccucagcaaggaggugguuaugugaggcgagcagcccuccagaugcaggggcucucaggccagggcc

SEQ ID NO: 4110200 - RNA, 57 nt, Human
ggcccagccuugggguuucuuuccucaccucuaacaagaaggccccgagucagggcc

SEQ ID NO: 4110201 - RNA, 59 nt, Human
ggcccagcugucugccugagaggagcugcugaugcaaucuuucugcagggagcugggcu

SEQ ID NO: 4110202 - RNA, 87 nt, Human
ggcccagggaagucuuuagcagagagcugagacggagaaaaggguucugaaccacagcugucugcugaaggaagcuguccaaaggcc

SEQ ID NO: 4110203 - RNA, 63 nt, Human
ggcccaggguugcuuuagauucugaagcaacuucaggguuuaaaggcaucccugaaauggguc

SEQ ID NO: 4110204 - RNA, 60 nt, Human
ggcccagguuggagugcagugacaucaucucaguucacugcagccuuugccuccuggguu

SEQ ID NO: 4110205 - RNA, 67 nt, Human
ggcccaguguggguggauguugaacuccugcaguuaccauuacagcuccugccaacacugaugggcu

SEQ ID NO: 4110206 - RNA, 85 nt, Human
ggcccaucacacuguguggucucucucggagcccgugaccuccuuauuuuuuccagugccuuccgaagaucaccacugugacccc

SEQ ID NO: 4110207 - RNA, 67 nt, Human
ggggacuuauaacucuucuuuuagggaagaagugcagacauuuguucucauaaagaaugaaggcucc

SEQ ID NO: 4110208 - RNA, 130 nt, Human
ggggagacucgcuaauauuuuugggguguucucagauucugggcccagcuugucugcgugagucuaggcaccaaugaguuaggagggucaggcuggggcucagaauucaccccuuugaguccuguucugc

SEQ ID NO: 4110209 - RNA, 85 nt, Human
ggggagaggauccuacacgaagccucccuggccucagcaaugccaggcugaggguuuagggucagguggcuucuguccucuccuu

SEQ ID NO: 4110210 - RNA, 130 nt, Human
ggggagagggaagggagccacauccaggcgacggggcugcucguccuccugugcgagaguggggagacucaggccagcccaagugggcggcggccccgguugcuugaucuaagcucugcucacacugccc

SEQ ID NO: 4110211 - RNA, 78 nt, Human
ggggagagggauagguaauaccccaggguccucccagcccaagggccaggaacuggggcuauucacccuccaauuccc

SEQ ID NO: 4110212 - RNA, 58 nt, Human
ggggagaguuucgcaggcagggacaggaaagguccuggagugcugcccaacucucccc

SEQ ID NO: 4110213 - RNA, 75 nt, Human
ggggagauacaguucaauccauaacagcucccuucuuggugccaagggaaaaugaccggaugcugugugcuccuu

SEQ ID NO: 4110214 - RNA, 84 nt, Human
ggggagaucuuguucuucgauaaucaauucccagauguuacagaaaauggcagauuaaaagacucuaagaacaugauucucccu

SEQ ID NO: 4110215 - RNA, 118 nt, Human
ggggagaugucuuuguaccaguccaugaugcccagagaaucuuucagaaaggaaugaguccauucucccuuuucuaucccguugcuuagggcagguagacggugcaggguggcucccu

SEQ ID NO: 4110216 - RNA, 66 nt, Human
ggggagauucauuacagccaggaggaacucagugaaacuguucaaggagaucugguuaauaucccc

SEQ ID NO: 4110217 - RNA, 58 nt, Human
ggggagauuuagagagacuuaaacagcagauuucucuguguggaugcuaacucucccc

SEQ ID NO: 4110218 - RNA, 101 nt, Human
ggggagauuuuuugauuaugaacauccuaggaggcauuuguuaaaaccuuuuuacuaaaaaaugccuuuugauguguugagauugucacauggauuucuuc

SEQ ID NO: 4110219 - RNA, 73 nt, Human
ggggagcaaauaauugagaagaguaauaaaaucuaccacacuuggcucuuuuaguaauaaauauuuguucccc

SEQ ID NO: 4110220 - RNA, 69 nt, Human
ggggagcagcuugcaugcucagggaugccaagaacuguuggaaacucagacaucauccgagcacucccc

SEQ ID NO: 4110221 - RNA, 69 nt, Human
ggggagccugcagggcccccagcugaauguguaugucaggauggaaggcaggaccugccuugggccccc

SEQ ID NO: 4110222 - RNA, 66 nt, Human
ggggagcuaggucaggggucaccaccagguuuuuccuuucuguguggccucugcacugggcucccc

SEQ ID NO: 4110223 - RNA, 110 nt, Human
ggggagcucaagggccuuacucuuagguuucuaauugccccuuguaaacuggguccugcggugaaagggagcaaauggacagacgguaggaaaggcaguuuggaaucccu

SEQ ID NO: 4110224 - RNA, 124 nt, Human
ggggagcugggugaccggguggagguagcgggugggugaugggcccuuuuuggaaucagaaaauguuguuggaaggcacccuccaucacucacccagcuagcggcccuuggagcccaucucccu

SEQ ID NO: 4110225 - RNA, 70 nt, Human
ggggaggcaugcacugcccgaguuugaaguguaacaugggauuucucugcaggggaggcaugcacugccc

SEQ ID NO: 4110226 - RNA, 89 nt, Human
ggggaggcauuccucaccccacacacccugggagcugcagagacugcaauuucacuaaugauguggggaagagaggaaaaggcuagccc

SEQ ID NO: 4110227 - RNA, 58 nt, Human
ggggaggccagugaaauguuauaaagguucaggaggagcuuugcucacucuccuuccc

SEQ ID NO: 4110228 - RNA, 74 nt, Human
ggggaggcuggggugugguggauaagcuaaagggaaacuuggcguuccucccacacaccuuggaaggucgacuu

SEQ ID NO: 4110229 - RNA, 85 nt, Human
gggacaagaugggaggaugcucgggugcucagggauccuccagccucccuuguccaccccuucuccuaaccccaacuucuuuccc

SEQ ID NO: 4110230 - RNA, 85 nt, Human
gggacacuggcaaggcuuagauaaauugcaacuugauugaauccuuuuaaugcaagaaacauuuauuaaaugccuacugugcacc

SEQ ID NO: 4110231 - RNA, 64 nt, Human
gggacagaagaggaggauuagaagugagaaggagaacuacuuucacuggauucucuuuuguucc

SEQ ID NO: 4110232 - RNA, 55 nt, Human
gggacagcuggucuaccugguaacagcaaagccugccaggcaacuauccugucuc

SEQ ID NO: 4110233 - RNA, 75 nt, Human
gggacaggagccgagggccgcgugcaccccuugggcccuuggaggggccggcaugugccucucugucccugugcc

SEQ ID NO: 4110234 - RNA, 89 nt, Human
gggacaggauuaaggugaggggaguaaagccauguuacagagaaaaaaacauacaguaaucaagaugcuucccucacuucaccuggccc

SEQ ID NO: 4110235 - RNA, 63 nt, Human
gggacagggcgugggguagaggaagaagcuagaaugcugaucccugagaugcugcucuguccc

SEQ ID NO: 4110236 - RNA, 61 nt, Human
gggacaguagguauggucugauggauuugaaaccugugucaguaccacagcugcaugaccu

SEQ ID NO: 4110237 - RNA, 88 nt, Human
gggacaguggauccaaggacacuguucauggggaggggauuguuuggaauccccuccucccagaauacguguggauccugcuuuuccc

SEQ ID NO: 4110238 - RNA, 67 nt, Human
gggacaucuuucuagucagggucaaaauacugagaaguuauuucccaguggcuagagcagauauccu

SEQ ID NO: 4110239 - RNA, 89 nt, Human
gggacauggugugugcgcuucuuccugagccagguugagguugggaccacugauccauuggaagccuggugagggguacagccaguucu

SEQ ID NO: 4110240 - RNA, 66 nt, Human
gggacauuagcaugugggaugcaagcacaaucuuaguaaaugcuugcacauuggagcuggucuucu

SEQ ID NO: 4110241 - RNA, 84 nt, Human
gggaccagcccugcauacccaggugugccagcagggacugggaaucgggccagaugcuuggaggacacuugggcggggccuccc

SEQ ID NO: 4110242 - RNA, 73 nt, Human
gggaccaggacagguguagugggcucuguauucagcuaaggccugagcuuggugcaacgcuauugucuuuccc

SEQ ID NO: 4110243 - RNA, 72 nt, Human
gggaccaggucuuuggaacagcaauuuuuggaagguuuauaaucuaaugccgucucuacaagacuccuuccc

SEQ ID NO: 4110244 - RNA, 77 nt, Human
gggaccauccagagacauguggccugcacguugaugagcaaugugaacugaauuacuguuguaucuggaggaauucc

SEQ ID NO: 4110245 - RNA, 75 nt, Human
gggaccaucugagcugggucuugacagcugcguaggaguuugcagcuggagaugagugacgugccccaugguccc

SEQ ID NO: 4110246 - RNA, 69 nt, Human
gggacccaggcugguguugcuuccaccacuaggcccugccuagggacaggccccucgcuagcuucuccc

SEQ ID NO: 4110247 - RNA, 97 nt, Human
gggaccccagaauaacauggggggaucgggcuccuaaugcaauugcaggagcaggcucugcaccgcugggaggaucucucccuguccucugcuuccc

SEQ ID NO: 4110248 - RNA, 86 nt, Human
gggaccccaggauaguuuauuuuucuaaggugccacaggcaacuaauguacuuuggguuuagaauaaacuccuugggaguagaccc

SEQ ID NO: 4110249 - RNA, 80 nt, Human
gggaccccuucccugcuguacccuacucggaguucuaggucccccuuaugcuuucugguuugugcuacagggaagggccc

SEQ ID NO: 4110250 - RNA, 70 nt, Human
gggacccuaccacagucugacagauuuuggcauucugcucggugucugaugguggcuucucacggugccc

SEQ ID NO: 4110251 - RNA, 73 nt, Human
gggacccuggggacacugccccugugcugaguuacugagaugagccagccuugcagcugugcccagccuuccc

SEQ ID NO: 4110252 - RNA, 55 nt, Human
gggacccuguggaggugagaugaugaaaacgaaauggucucugcuccagggucuc

SEQ ID NO: 4110253 - RNA, 87 nt, Human
gggaccguggaccaaagggcagaacaugagcauguuguucaugcucaggucguucugccccuugcucaugaacauguccaugguccc

SEQ ID NO: 4110254 - RNA, 77 nt, Human
gggaccugagaguauaauuugcaauaucugauuauuaaucuugaggaugugugcugcauaguauauuuuaugguguc

SEQ ID NO: 4110255 - RNA, 59 nt, Human
gggaccugaggcccugcuccacuggcccagaagcucuguggaaauagcagccagguccc

SEQ ID NO: 4110256 - RNA, 55 nt, Human
gggaccugccaaggccacccagccacccucccugggcggccccuccagcaggccc

SEQ ID NO: 4110257 - RNA, 89 nt, Human
gggaccugccaauuuccugaucagguucccauguguaacugaaucuucucuaccagcuauggaaaccuaaucaggagagcuaggauccu

SEQ ID NO: 4110258 - RNA, 56 nt, Human
gggaccugccauugcucacaggaugacuguggacaucagaggcacuggcagguccu

SEQ ID NO: 4110259 - RNA, 55 nt, Human
gggaccuggacaugugugugcucuccgagcugagcugugugcgcguccggguucu

SEQ ID NO: 4110260 - RNA, 58 nt, Human
gggaccuggcagggcagggguuugugccuccaaugagcacaagcucccccugcccccc

SEQ ID NO: 4110261 - RNA, 109 nt, Human
gggacggccgaggcagcagaagcagccgcucaugggcccggagcagcccugcccacccaagcggccgcucaugggcccagagcagcccugccagccccugcggccgcuc

SEQ ID NO: 4110262 - RNA, 76 nt, Human
gggacggguagccagcucuguggcaugguaucuggaggcaggccagcaaccugaugugcaugccacggcccguccc

SEQ ID NO: 4110263 - RNA, 102 nt, Human
gggacguaagcuccacugcuuuuucaagaacaacauucauucaggagcaacuuugugagcccuguuucuugguuaaguuggucacggaaauuacauaguccc

SEQ ID NO: 4110264 - RNA, 111 nt, Human
gggacuaaguaacaagaugagugagauuguggacauagaagcauguggaagacucucuguaucucauguuuuaccuguccucauguuuuaccugucugacaacugcauccc

SEQ ID NO: 4110265 - RNA, 80 nt, Human
gggacuagagaccaauguuuauaggauuaaaaauauuaauuacuaaaauaauucagcugaacaacuguguuucuauuccu

SEQ ID NO: 4110266 - RNA, 65 nt, Human
gggacuagcuugugugaaggccuugcagugaaaaacugcugaagagcuccaggcaaugcgguccu

SEQ ID NO: 4110267 - RNA, 83 nt, Human
gggacucagcaagagugcagcuugccagguccucccacugcagccagggccugggaacuugcauuuagugaugcguguguccc

SEQ ID NO: 4110268 - RNA, 80 nt, Human
gggacucagugauuugacaugccuggaacagugacaccaggggaugugguggcaaagaaggcaugaaguuagugggugcc

SEQ ID NO: 4110269 - RNA, 62 nt, Human
gggacuggccggcgcugaggcccgcgggccggcgcagcguggccuucggagccggucggcuc

SEQ ID NO: 4110270 - RNA, 104 nt, Human
gggacugguugaugggaaguggcaguggcgggacucagggcuccccgcagucagcuccacaaucugugcccugaguucuccuugcccagcuuggcguuaguccc

SEQ ID NO: 4110271 - RNA, 63 nt, Human
gggacuguuggguaggagaacugaaaacaccaagcauguuggcaucacauuacucaaaguccu

SEQ ID NO: 4110272 - RNA, 80 nt, Human
gggacuugcucuguuucucauggcccuuggcuuuucaugcauacacaagaaguuucaggagucagaggaggguaagcacc

SEQ ID NO: 4110273 - RNA, 100 nt, Human
gggagaaagaugagcauuugggaaggcacugaagcaagcagagaaauuuuuacaugcugcuacugugaaggagucuuucucaugccaguuccauucuccc

SEQ ID NO: 4110274 - RNA, 62 nt, Human
gggagaagcaacacauuaaaucagcugacgagacuaaauugggauguguugugaucaucacc

SEQ ID NO: 4110275 - RNA, 101 nt, Human
gggagaagcuggccccagcccaguccaggccugccucugaggagcccucccaggugggcugcacaggccucaggcuuggugggggcagggcugagucuucc

SEQ ID NO: 4110276 - RNA, 81 nt, Human
gggagaaggucaguuuuggaugagcccagauuucuccucccuccgagacauuuuaucucacccaacacagccccuucuccc

SEQ ID NO: 4110277 - RNA, 68 nt, Human
gggagacagcaggugcuugggaaaggccgagcucugggcuuuccuuucccaagccuugcuucccuccc

SEQ ID NO: 4110278 - RNA, 86 nt, Human
gggagacguaggccucugcuguacuuaggaagaggaaccaggaagcuguucucuucucuugaggcagcaaggcaaggauguuugcu

SEQ ID NO: 4110279 - RNA, 130 nt, Human
gggcugcagugagguuagagugagcguuaucauaguuuggaaaucuggcauugaauaccugaauuuuacuugcuauucuguuucucagcaacuauaugacuuggcuuagucagugcuccucucacagcuc

SEQ ID NO: 4110280 - RNA, 61 nt, Human
gggcugccagugggugugcagagacuugaugucaccagucuagucuguucuacuggugccc

SEQ ID NO: 4110281 - RNA, 55 nt, Human
gggcugcccaaauuggaguaacuugcugagaauguucucuccauaugcccagccc

SEQ ID NO: 4110282 - RNA, 91 nt, Human
gggcugccucuguggcuugggggugaggccuggcccugggguuugucaaagcugcaggaaccagaaccuucccccggaaucaggagcaccc

SEQ ID NO: 4110283 - RNA, 58 nt, Human
gggcugcgaggagccuugucugcuuuuacaagggcacugaacacccucuucgcugcuc

SEQ ID NO: 4110284 - RNA, 57 nt, Human
gggcugcugcccaggaggcaccaacaauuaaaggcugagaucgugguaagcagaucc

SEQ ID NO: 4110285 - RNA, 72 nt, Human
gggcugcugggcaguucgcuuucguuuucacguuuuuguggggguagggcgauugcugcuuuuuucucaccc

SEQ ID NO: 4110286 - RNA, 118 nt, Human
gggcuggaauauaagcugcacuuaagagaugaagacauagaggcagaacgagcuuaagugauuuauuuauccaagguuauucucuaucucaucccuguguauauuuccuugccagccc

SEQ ID NO: 4110287 - RNA, 67 nt, Human
gggcuggaggagagucugaaugacaguccccaugcuauacucucauuuacuucucucuuccaagcuu

SEQ ID NO: 4110288 - RNA, 57 nt, Human
gggcuggcaucaguugccgagagguggaaggaguaccucucugcaguuuguuagcuc

SEQ ID NO: 4110289 - RNA, 57 nt, Human
gggcuggcaucgguugcugagagguggaaggaguaccucucugcagcguguuagcuc

SEQ ID NO: 4110290 - RNA, 71 nt, Human
gggcuggccagggcugcucgcggaaagggcaagcguggccccgcagugauccacgaggcucugguuagccc

SEQ ID NO: 4110291 - RNA, 61 nt, Human
gggcuggcugauuuuccucucuaagauccgugugaauagggugggccaaauuagguagccu

SEQ ID NO: 4110292 - RNA, 62 nt, Human
ggcccuggggaggaaggggcgggccauggcaugucugacugccccuuccauuccugcuggcc

SEQ ID NO: 4110293 - RNA, 63 nt, Human
ggcccugguccuagggguggaaccauggaggaacacccuggucacccacugggacugcggguc

SEQ ID NO: 4110294 - RNA, 81 nt, Human
ggcccugguggcugcauccucccggugcugcuggcuuuugcaacggggccggcuguugguugggaggaagcagccagggcc

SEQ ID NO: 4110295 - RNA, 59 nt, Human
ggcccuguccccuucaguuuugcagaugaggaaaccgaggcuaaaagaggggcagugcc

SEQ ID NO: 4110296 - RNA, 58 nt, Human
ggcccuguuugauagcuccugauaaaagcgagcugugucuggagccugagcaggugcu

SEQ ID NO: 4110297 - RNA, 61 nt, Human
ggcccuuccucuugugcuggcaccauguucuccaggcgugucagggccugaggacugggcc

SEQ ID NO: 4110298 - RNA, 76 nt, Human
ggcccuucuuggcccuggcacacccccacggaggucucacuguguggggcagcuagccggccuggccaucaagguc

SEQ ID NO: 4110299 - RNA, 64 nt, Human
ggcccuugcagcaggcgcuggcaggguggaagaccuggcagugccugaugcugcaggaauggcc

SEQ ID NO: 4110300 - RNA, 121 nt, Human
ggccgaccccacaaugcugggaaagcccucaggcagauucuccaggggcugcagagggccugcgcagugccucgagccaugagccuggggagucaccagggcaccagcagaaaccacggcu

SEQ ID NO: 4110301 - RNA, 85 nt, Human
ggccgaggcaggaggcuuggcuggcagcccugggggcuccuucaccuccacgggcuccccuggcccugcagccccuccucuggcc

SEQ ID NO: 4110302 - RNA, 129 nt, Human
ggccgaucgggcgcgccgaggucgucagagcagccggccgagcccccaguccccgcggguccguggggcugucccgguuuggcgagcuccggcugccgagaugcgccaaacgcggaacccggguuggcc

SEQ ID NO: 4110303 - RNA, 84 nt, Human
ggccgcaggggucauuauaguggggagguggugacaucagacuccagggagugcuacuuguucacuguaggucgccccgcugcc

SEQ ID NO: 4110304 - RNA, 91 nt, Human
ggccgcaucuccuuugagcuguuugcagacaaguuuccaaagacagcaggaaacuuucaugcucugagcacuggagagaaaggauuuggcu

SEQ ID NO: 4110305 - RNA, 66 nt, Human
ggccgcgagggaggcgaccucggcauccaaacaggcacuugcgccaggugcuaucccugcgcugcc

SEQ ID NO: 4110306 - RNA, 105 nt, Human
ggccgcgggcucugggcguaggugcagcuucuccggccuggugcggggccagacggccgccgccggcuuagcgggggaacuucgccuaguccucgggcugcgguc

SEQ ID NO: 4110307 - RNA, 96 nt, Human
ggccgcguuggcacgucgggcauucccaggaugugcgugccgccggcgggccugccugucgcagcagccugggguuuuggacgccgcacgcgugcc

SEQ ID NO: 4110308 - RNA, 113 nt, Human
ggccgcugcugcagcgcucagcgcccgggcccugcugaagccgggucuagcaugugccgcggcuccccggcggcggcggcggcuccucugcagcagccucagcagcagcggcc

SEQ ID NO: 4110309 - RNA, 75 nt, Human
ggccggcacggggcagcucccgagggcaggagagugccgugcuuuucagucugaucugagcugagaguggcggcc

SEQ ID NO: 4110310 - RNA, 93 nt, Human
ggccggcauggcugcaguagcuguugcaauaaacaguuccagacauugucauucugggacccugggcagcuggcugcugucuccaugccaccc

SEQ ID NO: 4110311 - RNA, 71 nt, Human
ggccggcccagccagcagcuggccccugccacucagcaggaggccagccugaggcugaggggcucccggcc

SEQ ID NO: 4110312 - RNA, 89 nt, Human
ggccggcucuuuugcaugcaggcccgccugaauggggcgccuggaggcugcauugaggccgggcuguguaaacuguagggugccucgcc

SEQ ID NO: 4110313 - RNA, 63 nt, Human
ggccgggagcaggcgccaccgccagcgaccauggggaacauguuggccgccagcucgccgccc

SEQ ID NO: 4110314 - RNA, 93 nt, Human
ggccgggcauggugccuuacgccuguaaucccagcacuuuggaaggccgaggugggcggaucacgagguuaggagauugagaccauccuggcc

SEQ ID NO: 4110315 - RNA, 92 nt, Human
ggccgggcguaguggcucacgccuguaauccaacacuuugggaggccaaggugggcagaucacgaggucaggaguucgagaccagccuggcc

SEQ ID NO: 4110316 - RNA, 64 nt, Human
ggccgggcuggcuccucuguccucacgggacuugggcccugaucuuggaggggucagccaggcc

SEQ ID NO: 4110317 - RNA, 60 nt, Human
ggccggggaggcugucccggggccgagugcuuggcagcagggcugucucccuacaaggcc

SEQ ID NO: 4110318 - RNA, 59 nt, Human
ggccggggcaggggcagagacuguccagaccagguugaacuccagccccugcccugguc

SEQ ID NO: 4110319 - RNA, 95 nt, Human
ggccggggccgcugaggaggcuuccgggaggcacggccgccgcagagaugaagagguuguggccauucuugaggucgaccucgcggucccgggcc

SEQ ID NO: 4110320 - RNA, 76 nt, Human
ggccgggggcggcgcggcccgggcgucggggggcggcggcuuccugugggaggggccuggcgcggcgguuccggcc

SEQ ID NO: 4110321 - RNA, 69 nt, Human
ggccgggguggggaagcagguuccugggcucacgggcaggcaucugccuccucuaccccugcacagguc

SEQ ID NO: 4110322 - RNA, 79 nt, Human
ggccgucugccacagugcagcaugcuggggaggcugccaagugcgggaguccucagcugcucagugucacagcaccgcc

SEQ ID NO: 4110323 - RNA, 72 nt, Human
ggccuaaaagggaaaauauuuagacauaugggucacaaaagccauuuaugcuuaaaauauuuccuuaaagcc

SEQ ID NO: 4110324 - RNA, 89 nt, Human
ggccuaaagcugaccacuauuuucucuucagauggccagguggacagaacccuggacugggaggagauggaggacucaguuugcaggcu

SEQ ID NO: 4110325 - RNA, 78 nt, Human
ggccuaaggcccagauuuuguucuguuuguacccuccugggugguggcacaagggagagaaucugaggucuuucaguc

SEQ ID NO: 4110326 - RNA, 63 nt, Human
ggccuacacuucaaagggugacuugauagaaaaagauauggaaaauuaguuuggaguguggcu

SEQ ID NO: 4110327 - RNA, 95 nt, Human
ggccuacccuuacugagugugaccucaucuuaacuggaacccaucugcaaagauccuauuuccaaagaaguucacauuuacgauuacuggggguu

SEQ ID NO: 4110328 - RNA, 85 nt, Human
ggccuaccuccaggagcagggcuggcgugcaggcugaggccagaggaaggccaagguuagccagcccagcuccaggggaaagguu

SEQ ID NO: 4110329 - RNA, 87 nt, Human
ggccuacgguggggugggguguaucggauccuagcaggggaagagcugggauguggccucuccacccuccuguccgcuuuaaaggcc

SEQ ID NO: 4110330 - RNA, 56 nt, Human
ggccuagccucuccugagagaggcagaaaauguaaggcucagagaggggcagugcc

SEQ ID NO: 4110331 - RNA, 72 nt, Human
ggccuagcugaggcaggcucaaugcccagucugagcuguagaggaguagcugagcucugcacuuugccagcc

SEQ ID NO: 4110332 - RNA, 74 nt, Human
ggccucaaaacuucacacagcaaauuuaucuagcaguggcaugcaggguagguugaggguugagcaaggagguc

SEQ ID NO: 4110333 - RNA, 115 nt, Human
ggccucaaagguuccgcucucaugucggcaagugugauuugaauuuuaaaacacugagcuuugccgguggaagaguucccaaguuuauuccgaccuacggaagcccaggaggacc

SEQ ID NO: 4110334 - RNA, 67 nt, Human
ggccucagaggaggugugagucugcuagccauugugcacuccccugacucaccucugaguuccggcc

SEQ ID NO: 4110335 - RNA, 80 nt, Human
ggccucagcuucccuaucugaccauaaaaauugcuaucucauuggcuugcuguggagauuaaauaggggagcuaagugcu

SEQ ID NO: 4110336 - RNA, 55 nt, Human
ggccucagggucacucuguagauaucaacugacucugccuguugagccuaaggcc

SEQ ID NO: 4110337 - RNA, 61 nt, Human
ggccucagguccagaaaccaaaggauuuagacaaagucccaaguuuggacuugaugaugcc

SEQ ID NO: 4110338 - RNA, 77 nt, Human
ggccucauuagaaccagguucccggcaaguaaccaguuccagacacuggccuuggaagggagcccgugcugcuggcc

SEQ ID NO: 4110339 - RNA, 87 nt, Human
ggccucauuuacgugccgaugucuagagcaagagaugcuggaaaagaaguaucuagaauuuucugcuuugauaguaggagaggggcu

SEQ ID NO: 4110340 - RNA, 76 nt, Human
ggccuccaauacccacccagauuucaaacaucuuuccuuguuuggcagaguaguuuggaguguggucuuugagguc

SEQ ID NO: 4110341 - RNA, 61 nt, Human
ggccuccagggcuccccaggacucccugcagccucugcaccacccugcagcccaggaggcc

SEQ ID NO: 4110342 - RNA, 65 nt, Human
ggccucccaaagugcugggguuacaggcaugagccaucgcgccuggccccuacauuuuuaaugcc

SEQ ID NO: 4110343 - RNA, 74 nt, Human
ggccucccaaaguguugggaggucagaugugagccacugcaucuggccccgcaugcacuuuauagaggagggcu

SEQ ID NO: 4110344 - RNA, 89 nt, Human
ggccucccacacugacccucuggccccacagccacaacaagcagagugugagccaggcccaguggggucaucugugggucauaaagguc

SEQ ID NO: 4110345 - RNA, 84 nt, Human
ggccucgcucugucacccaggcuggagugcaguggcacgaucucggcucacuacaaucuccaccucccggguucaagugauucu

SEQ ID NO: 4110346 - RNA, 82 nt, Human
ggccucugaacugugucuguucaauucuguggaaauuuauuuaacaacacuauaauccaggcauuggagagauaaugaggcc

SEQ ID NO: 4110347 - RNA, 74 nt, Human
ggccucugggcugcugacaauuuuauagcuacagaugguaaagaaaugucagggcaguccucuuuauggaggcc

SEQ ID NO: 4110348 - RNA, 74 nt, Human
ggccucuggguuuugucagcugaggagauugaaauacuucaaacuaugccuugagcugcucagaaacagauacc

SEQ ID NO: 4110349 - RNA, 80 nt, Human
ggccugaaccacagcaagccagcuugucacugagccugucacguggggcagaagcaaaugccuugcugaggccucagguc

SEQ ID NO: 4110350 - RNA, 107 nt, Human
ggccugaaggucuugagagcaagcucaucagugcgggugguggggacaccucucuguuuucaccaggaccccacgguggguugccugguuggaaaggacugcagguc

SEQ ID NO: 4110351 - RNA, 55 nt, Human
gggguggcuuuaaauaugccacaagagauucuugcuuuauuuggcaugccacuuc

SEQ ID NO: 4110352 - RNA, 67 nt, Human
ggggugggacagguaggaguggcucuuccccuagaugaccuagcuagcccuucaaccugccuacucc

SEQ ID NO: 4110353 - RNA, 86 nt, Human
ggggugggcagguguugucaaucuaaucagguuauguguucuuaaccauuguauuggccauaucaugcugaguaacagauuacccc

SEQ ID NO: 4110354 - RNA, 89 nt, Human
ggggugggggagagugauggcuaguuuuaauguuaaaauuuuucuuuagucuguuauuguggcaguaaaauugggcaacaaaccacccc

SEQ ID NO: 4110355 - RNA, 123 nt, Human
gggguggugggguccccccugcuggccgcaggugcucugacgagguugcacuacugugcucugagaagcagugcaaugauauugucaaagcaucugggaccagccuuggggaucucccucccu

SEQ ID NO: 4110356 - RNA, 55 nt, Human
gggguguggaaucuggcagugacugguggagcucagggugcugcagacccacccc

SEQ ID NO: 4110357 - RNA, 66 nt, Human
gggguguggaucaucugaggucaggaguucaagaccagccuggccaacauggugaaaccccaucuc

SEQ ID NO: 4110358 - RNA, 91 nt, Human
ggggugugggggaccguaagccauccucaggggccugaccuggguuuccguuugcagcagccuggagggggccacguucuuccugcgcccc

SEQ ID NO: 4110359 - RNA, 72 nt, Human
gggguguuuccaggcaggguuaaggguccuggggguggaaucucagggggugucucugauuggguuagcucu

SEQ ID NO: 4110360 - RNA, 99 nt, Human
gggguguuuggaagaugacccugugagaguugagauauuuugccaugaucccacugguggcagcacaucagaauucugcaggucgcuuugagguucuuu

SEQ ID NO: 4110361 - RNA, 56 nt, Human
gggguuaccaugagugggugggugagcucagggcucugccugccagucugguccuc

SEQ ID NO: 4110362 - RNA, 106 nt, Human
gggguuccaggaggucagcggacacagccagggucucaggaggcgcgcucugcgcgcuguuuccuuucuucccugggugaucuccugcguggccaagguuugcccc

SEQ ID NO: 4110363 - RNA, 68 nt, Human
gggguuccagggaaugauauuuuugccuuuuauguccccaaguguagaaagugcaucucuguugcccc

SEQ ID NO: 4110364 - RNA, 55 nt, Human
gggguuccucgaaggaccugaggccaggcuggggccaggaaccaaagaggacucc

SEQ ID NO: 4110365 - RNA, 55 nt, Human
gggguugaucacagaggggucucuguauccgcaggaaucuccuuucuucaagcuu

SEQ ID NO: 4110366 - RNA, 85 nt, Human
gggguuggccuauuuauugagagggaggggaauugcacuuacaagguucuccuuaucaaugaagacagaaugauuggccgagccc

SEQ ID NO: 4110367 - RNA, 88 nt, Human
gggguuggugucuuaauaaacugcuucucucagucugucacauuuaguuacggagcugugcaguuuagggggaaaaaaggcuaauucu

SEQ ID NO: 4110368 - RNA, 56 nt, Human
gggguugguuuaaaugcuugagcagauaccaacuguccacagccacagccaaccuc

SEQ ID NO: 4110369 - RNA, 130 nt, Human
gggguugugaauugcuccagaagugcaguagucugggguugccucccgcccuggaaggaacugaccauucaucacccugcaagcuccuucucaggcagcccacuugugauucuggaagauuauuugcccu

SEQ ID NO: 4110370 - RNA, 77 nt, Human
gggguugugggcagcugggggccccaguaccagcaaccuugaccccccaccugguacugggcagcugcucugacacc

SEQ ID NO: 4110371 - RNA, 67 nt, Human
gggguuuaggggauaguaaguaacacccuagccaccugcugaauguagaaacugucuuuuacacccu

SEQ ID NO: 4110372 - RNA, 56 nt, Human
gggguuucaucauguuggcagauugguuuugaacuacugaccucagaugauccgcc

SEQ ID NO: 4110373 - RNA, 104 nt, Human
gggguuucuuuugcacucaauuucucaaguaaaugagucaugcuguucuccaggacaucuuuuacuagugagcuuuuuauuugggcugaaguaacagugacccc

SEQ ID NO: 4110374 - RNA, 80 nt, Human
gggguuugcaucuuugguugcacauuagaauccucagacacacagguacuguacugaguucuuugcaaauaacaagcccc

SEQ ID NO: 4110375 - RNA, 55 nt, Human
gggguuugcuauguugcccaggcuagucucgaacuccugggcucaaagcauccuc

SEQ ID NO: 4110376 - RNA, 56 nt, Human
gggguuugggagaguuucccacucaauaauacucaguaagcuuucccauuaacccc

SEQ ID NO: 4110377 - RNA, 115 nt, Human
gggguuuggggaaagguagaggagacagccaggggccugagugugcccguaaauaucagcguucagcaggagccuccugauuccaauugcuugucuaauuuccaccucccacccc

SEQ ID NO: 4110378 - RNA, 92 nt, Human
ggggggaaaacacguuuguguaauuuuucaggcugugagaaagcaauuauuuucuuuggucagaaagauuacacucgauaguuuuucacucc

SEQ ID NO: 4110379 - RNA, 61 nt, Human
ggggggaaggggcaccuucaggucaccuagacaauuggauaaauggugcuaucacccaccc

SEQ ID NO: 4110380 - RNA, 80 nt, Human
ggggggaauuccugcugggccugagcaaugagccauugcuucugguggcucauugcucagccucagcagaaauaccccuu

SEQ ID NO: 4110381 - RNA, 59 nt, Human
ggggggcagggggugugugugagaggcuagguccacccuugccaguaccuccuccucuc

SEQ ID NO: 4110382 - RNA, 72 nt, Human
ggggggugaggacccuggugaggacaggcaaacucagccaucaccccccuggccaggguacuacacccaccc

SEQ ID NO: 4110383 - RNA, 65 nt, Human
gggggguuauucuuauuaaaauguuuagagaggacuuucuguucauuucugcagaauugcucuuc

SEQ ID NO: 4110384 - RNA, 71 nt, Human
gggggguuuaccucagucucaggagccauccuucagaucaggaaauauggcccugaccuugaugaccuucc

SEQ ID NO: 4110385 - RNA, 113 nt, Human
ggggguaaguuaucaucaguaauuguaaaguaguaguacagguacucuguuacuaacucaaaauauguaaacuaccacugauauucuauuuugcuugcuguccucugucuucc

SEQ ID NO: 4110386 - RNA, 66 nt, Human
ggggguauuauuaccuagagcagacagcuuagugucuguuucaaaacagugauaauuuuuauuccc

SEQ ID NO: 4110387 - RNA, 85 nt, Human
gggggucccaggggcuggaggccugccugguuagccucuguuucccagacauugacucgaggcgccuccaguccucucaaccccc

SEQ ID NO: 4110388 - RNA, 105 nt, Human
ggggguccucccaccccauccuccccucagacagagacuggguguuguguggguuucuacuggguccucugagagggcagcgcuuggggugaagaaguagccccc

SEQ ID NO: 4110389 - RNA, 61 nt, Human
gggggucucauccaacagccuacaaaacccuuauuugacucuguccccagugagcaccccc

SEQ ID NO: 4110390 - RNA, 78 nt, Human
gggggugacaguccaugguucugacucaucuagcaguagcugcuagaguuuucucuaccacugggaugcugagcucuu

SEQ ID NO: 4110391 - RNA, 69 nt, Human
gggggugagccugccaggcccagagcugcaaacaccccucccucccuaagggcucccaggcucaccucc

SEQ ID NO: 4110392 - RNA, 72 nt, Human
gggggugcaggcaggugggcgggcaggugccaccccucccuggcacuuuccucuggcacugucuggucucuu

SEQ ID NO: 4110393 - RNA, 65 nt, Human
gggggugcugaagaugucauggugcgauguugggauuucugcaguguuuauguucagugacccuc

SEQ ID NO: 4110394 - RNA, 83 nt, Human
ggggguggaggcugguccagggccucugugggcacuugcgagcaaugcuggcuuccucagaugcucuuggacgccccaccucc

SEQ ID NO: 4110395 - RNA, 60 nt, Human
gggggugucucaguucgcucuggaagcuuacugcccucugcagagaacugagggacagcc

SEQ ID NO: 4110396 - RNA, 60 nt, Human
ggggguuaggcugcgggcugcugagacgccgagcuguuucucagaagugcagcugccccu

SEQ ID NO: 4110397 - RNA, 74 nt, Human
ggggguuggaggggaagguuccuuugaggcuuuugacagcaccagcuaagugguuuucuucuccuccuauuccu

SEQ ID NO: 4110398 - RNA, 128 nt, Human
ggggguugggagguggugagcccuagagguagagugcuaggagaggugguuguagggucagucagggacaaaugaugcagggccuucuagaccaugggccuuccuggggaucuucucuuucagcccuc

SEQ ID NO: 4110399 - RNA, 57 nt, Human
ggggguuuuuguuugggguggcauuccuccugaccacacccaucacuaagagcuccu

SEQ ID NO: 4110400 - RNA, 78 nt, Human
gggguaaaugauagucuuuuuaauaaauaaugcuagaacaauaguagauauauaugagggaagaugaaauuugacccc

SEQ ID NO: 4110401 - RNA, 58 nt, Human
gggguaagaagaugaauccaggcuguccugcaauggaauggauuuauuuucuugagcu

SEQ ID NO: 4110402 - RNA, 62 nt, Human
gggguaaggagcucggcagggccuucagggauaagcugcuggcuuugaugcugccuugcucc

SEQ ID NO: 4110403 - RNA, 128 nt, Human
gggguaaggauucuugccugcagaacaaggaagcacuuuuaaagcuagaaggugcuguacagaaaagacucuuaccuuugcgucuagcucuugaagcaggcucuccucucaugccagguacccucccc

SEQ ID NO: 4110404 - RNA, 63 nt, Human
gggguaaugugagggaagucauaauguucuaguuggagaaacggagcacuucuuucguacccc

SEQ ID NO: 4110405 - RNA, 79 nt, Human
gggguacugauaaauuucuggaagugucagaguaugcccagcaacacugaaugcuguuuagaaauuauuuuaguauuuu

SEQ ID NO: 4110406 - RNA, 91 nt, Human
gggguagagcaugucccaggaucuuuuaaugucuccagauucaagcacaauauuugguauauaauaggucuucaaaugcuguuguugcccu

SEQ ID NO: 4110407 - RNA, 84 nt, Human
gggguagauuccuuggccucuuuccccaaggccuguguucuauuacaacaucaugcugugaaaaagaaggcugacauuuacucc

SEQ ID NO: 4110408 - RNA, 55 nt, Human
gggguagcagugauagaaaggacaagaggacagggucccucagcacuucuaccuc

SEQ ID NO: 4110409 - RNA, 77 nt, Human
gggguagcccauguggcugaggcuucuagacacauuucaccucucaugggucagagacagacacaucgggcugcucu

SEQ ID NO: 4110410 - RNA, 69 nt, Human
gggguaggaugcgugcugacuuucugcuuucacagggagagggucaguagugaugcgugaacuuaccuc

SEQ ID NO: 4110411 - RNA, 65 nt, Human
gggguaguccuggugauggcugagcuggacuuuccuuccaagcaggcaggaugaggacuacacuc

SEQ ID NO: 4110412 - RNA, 82 nt, Human
gggguauguguggcaggaacagaauugggguucuuggggagguuuuuuuccacuuaaaacucuuuuugucgccuacgucucc

SEQ ID NO: 4110413 - RNA, 76 nt, Human
ggggucaccucucuggccgucuaccuuccacacugacaagggccguggggacguagcuggccagacaggugacccc

SEQ ID NO: 4110414 - RNA, 61 nt, Human
ggggucagcaaaauuuggucugugggugaaauccagccuacugccuguuuggcauggcccc

SEQ ID NO: 4110415 - RNA, 76 nt, Human
ggggucaggaauuaucugaugugauguucaggaaguagcuuuggcacugucaagcagaagauaauuuaaaaccacc

SEQ ID NO: 4110416 - RNA, 82 nt, Human
ggggucaggcugggccagagcagcagcacucuccagcaguuauaaugcuagcccugggcucuggcccccgcccucugauccu

SEQ ID NO: 4110417 - RNA, 77 nt, Human
ggggucaguaggaaccuagggucaaaaaaugggauacagucucccccuuuaugcaguugaucuuuucuugcugcccc

SEQ ID NO: 4110418 - RNA, 79 nt, Human
gggguccaggcuggugagcugccuacauugccaagaggggacccuuggagggcuuauaggcggcugagccagggacucu

SEQ ID NO: 4110419 - RNA, 77 nt, Human
gggguccaguuaugaauaaaucagguuuucguuaaucaagauuaugaaccuugauuuguucaucugcucuugauccc

SEQ ID NO: 4110420 - RNA, 112 nt, Human
gggguccauccaucugggcugugguggaggggauuuucauuuugcauggauucaaaggaacauuccagcaguaaggaaaguacauucaccaccacuccagguucaauccccc

SEQ ID NO: 4110421 - RNA, 60 nt, Human
gggguccucggagccugggucuuucccucccuguccagcgaccccaggccccaguaucuc

SEQ ID NO: 4110422 - RNA, 60 nt, Human
gggguccuggugccaccugcgggaugggagugcccagccugagucugcacauagaacccc

SEQ ID NO: 4110423 - RNA, 60 nt, Human
ggggucgccgggagccugagugacaucucuucccaacacugccaggcccugucuggccuc

SEQ ID NO: 4110424 - RNA, 57 nt, Human
ggggucucacuuuguugcccagauuggucucuaacuaagugacucaagugauccucc

SEQ ID NO: 4110425 - RNA, 124 nt, Human
ggggucucccaagggcuggugcuuacccuguccugcuguguuccuccugcaucuccaaaagggcucagggcuugggugaucgggggaugggguagggguguggacacaacccgcaggagaaacu

SEQ ID NO: 4110426 - RNA, 75 nt, Human
ggggucugagagccuguguucaaaugccagcucuguccuuucccgcugagucaccuugaacaggcuacucacccu

SEQ ID NO: 4110427 - RNA, 85 nt, Human
ggggucugauaugccaggggagucaaacagugccuugagagacccccacuaguuucuccucuguuggccuucccugccugacccu

SEQ ID NO: 4110428 - RNA, 57 nt, Human
ggggucuuagaacacuauuuugcacacugagguguuauagaauuguuuugagacccc

SEQ ID NO: 4110429 - RNA, 82 nt, Human
ggggucuucuuggggcagcccaggcugagccucucccccugcgaccugcuccuggccgggcugcuccuggaugagguacucc

SEQ ID NO: 4110430 - RNA, 85 nt, Human
ggggucuuucuugucaccgaggcuggagugcaguggcacaaucuuggcucacugcaaccuccaccucccagguucaagcgauccu

SEQ ID NO: 4110431 - RNA, 70 nt, Human
ggggucuuuguaguuaagggugagccugggugcaauuccuggcucccacauucaccagcugcacgacucu

SEQ ID NO: 4110432 - RNA, 92 nt, Human
ggggucuuugugaggagguguagaguagccuugggaaggagacuugaggcaaacugggcccugcgucuccagggcugcuggcgccuggcccu

SEQ ID NO: 4110433 - RNA, 62 nt, Human
ggggugacagcagcuaaugacagcugccuuuacuguacccaggcccugugcuguguuacccu

SEQ ID NO: 4110434 - RNA, 90 nt, Human
ggggugacucuggggaguuuuuugcuuucucuguuccucacugagaucuacauggaagggaagggaaaaacacucgucucuaaaaaccuc

SEQ ID NO: 4110435 - RNA, 77 nt, Human
ggggugacuuuguuuucacagcagaauuucugaggcucaguuauauggcaucagggucugugaguggcugucacccc

SEQ ID NO: 4110436 - RNA, 60 nt, Human
ggggugaggguguggcugggugagaggcggaggccacccuagccagccacuuccugcucc

SEQ ID NO: 4110437 - RNA, 78 nt, Human
ggggugagguuggccucagggaggcucugagccaggaucuucagcaguccugagaccuccaucugugccucucauucu

SEQ ID NO: 4110438 - RNA, 70 nt, Human
ggggugaguguaccaucuucucucugggucagcuacaaagacccagagagcauuuggacaaagguagccu

SEQ ID NO: 4110439 - RNA, 69 nt, Human
ggggugaguuacugcacgccagguucucagaacggugguguggagagacugcgugucagcgcuggcccu

SEQ ID NO: 4110440 - RNA, 64 nt, Human
ggggugaugggggccugaacaggcaaaaggcccacuaugcacuccacacggccuccauaacccc

SEQ ID NO: 4110441 - RNA, 88 nt, Human
ggggugcaggagcacugugggggaggcugagacauggucgcccugacacaggugggcacauucagucucugucacaccuagcuaccuc

SEQ ID NO: 4110442 - RNA, 98 nt, Human
ggggugccaggaauggggaggcgcugcgcuggggccagaagcgcaaugggucgugccaguuucuggaggcgggcgaccucgccucugaccgcaacccc

SEQ ID NO: 4110443 - RNA, 87 nt, Human
ggggugcccccacgcuggccagcaugagggucuccaugcagcgugcacaugcccgcacccugugucccccucagccaggugcacccu

SEQ ID NO: 4110444 - RNA, 61 nt, Human
ggggugcuuuacauauguuauuucguguaaauguuacaagagaacuaauguaagucauucc

SEQ ID NO: 4110445 - RNA, 59 nt, Human
gggguggaucaggcaggcccaggcacgucagaagcacgggacccugccgccuccacccu

SEQ ID NO: 4110446 - RNA, 76 nt, Human
gggguggcccuacccucuggaauauacaaaaccuuacacagacacaauguguacaccggggaacgggggccacccc

SEQ ID NO: 4110447 - RNA, 69 nt, Human
gggcaggcccucguggugagcugggaucacagacauuuguugaguuccugccauagcgaggaacuguuc

SEQ ID NO: 4110448 - RNA, 80 nt, Human
gggcaggcuggcuggagcuguuguaggcugucccucaucuccuggaucagccccugugaugucucuugcuuucuccuccu

SEQ ID NO: 4110449 - RNA, 59 nt, Human
gggcagggacagaguguuguggccaggaaggucugaugagcagcuacucugucucgcuc

SEQ ID NO: 4110450 - RNA, 62 nt, Human
gggcaggggcagcucgguggcuccugugucccugccucgggccugccugcugucaucugccu

SEQ ID NO: 4110451 - RNA, 65 nt, Human
gggcagggggguuaccuaauucaacuuguaauaugcccugacagguucucuuaucaucucugccc

SEQ ID NO: 4110452 - RNA, 70 nt, Human
gggcaggggucaguggccccaaccagguccuaaaucaaacguccuagcuaggugcccuuccccccugccc

SEQ ID NO: 4110453 - RNA, 114 nt, Human
gggcagggucuucgaaugguucugucacuaugguauuucugugcccagcucagucugucugucccauucugggccacacacagaagaaucaaagggagccuagaagcucagccc

SEQ ID NO: 4110454 - RNA, 62 nt, Human
gggcagggugaccccucgcaaauagcagacuccuguuauuuugccacaggugaccuucuccc

SEQ ID NO: 4110455 - RNA, 58 nt, Human
gggcagggugcagagcuaggguagugggugaauguucacacaagcugugcacuuuccu

SEQ ID NO: 4110456 - RNA, 85 nt, Human
gggcaggguuugagcccacaggaccugcacacaaacuuccccaccucuuggacuuggggacaggaucugugccucaacccagacc

SEQ ID NO: 4110457 - RNA, 79 nt, Human
gggcaggucccaugggaggcauccuugugcguggugguuacaggcugugagagguggcucccaagcaggaggcuuuccc

SEQ ID NO: 4110458 - RNA, 58 nt, Human
gggcagguggggcagcugugggagcuggugccagucucugaccugcgucccuccuccc

SEQ ID NO: 4110459 - RNA, 65 nt, Human
gggcaguaaguucucagaagauuuuguaggucuuuuagucuauaaauucuucucugaauuagccu

SEQ ID NO: 4110460 - RNA, 57 nt, Human
gggcagucacagugcuggagcaagaaaaggucgugcucacagccuuccuggcugccc

SEQ ID NO: 4110461 - RNA, 128 nt, Human
gggcagucagaaguggcauuuucagccugagcuccuguggagcccccaggagugggguccagcaccagcccccagcccuagggccuccuagaccugagcucuccuagaacccacaccucccuuugccc

SEQ ID NO: 4110462 - RNA, 81 nt, Human
gggcaguggcuggcgugcccuccagacuuggcuggagccucugcucccugcgguccuaggggguuaugcuggucauugccu

SEQ ID NO: 4110463 - RNA, 55 nt, Human
gggcagugggaccaggcaccagacaagcugcccagugcccuguucccacaugccc

SEQ ID NO: 4110464 - RNA, 82 nt, Human
gggcagugggcuuucucauucuuucacagucuguggcucccaauuuaaagcugaggaauuggaaagauggaaugucuuguuc

SEQ ID NO: 4110465 - RNA, 58 nt, Human
gggcaguguagcauuuugggcuguucugaguaacagaauaaccaguguuucacaguuc

SEQ ID NO: 4110466 - RNA, 57 nt, Human
gggcaguguugcucucaaagucccaucugacaggacagaggcucuuccucacugccc

SEQ ID NO: 4110467 - RNA, 77 nt, Human
gggcaguucaaggcuuccacuuuguugggucagaaugaaagcugaugaugcucuaguggaguuuugggauuuugcuu

SEQ ID NO: 4110468 - RNA, 55 nt, Human
gggcaguugggugacaccaucagcuucuugaggcugcuucucacucauuugcacc

SEQ ID NO: 4110469 - RNA, 56 nt, Human
gggcaucagagauuggagauugguucauccaacuucuuccucuagaucugaggccc

SEQ ID NO: 4110470 - RNA, 99 nt, Human
gggcaucagggaauuccuggcuucccggcugggggaaggggaccucaagagaggaggcuguaagguccucugugccugcuggcgccaggcccugauccc

SEQ ID NO: 4110471 - RNA, 58 nt, Human
gggcauccacagggauuuggcacgggaaaugcuaugcucuuuguucauguggaugccu

SEQ ID NO: 4110472 - RNA, 66 nt, Human
gggcauccugucauucugucaaauuucccuuaugaauagauuaggaguggaaagaaacaggugucc

SEQ ID NO: 4110473 - RNA, 86 nt, Human
gggcaucuauuggguacuccuguauguugggcuucacacuaagugcagcaguuggagccaugaagacaggcugucccauggagcuu

SEQ ID NO: 4110474 - RNA, 65 nt, Human
gggcaugagauuucaccccucuuaaccuuccgauccucgugaaggaggaguggguaagacugccc

SEQ ID NO: 4110475 - RNA, 129 nt, Human
gggcaugcauacagagaguucugcgugugcauggagggucugugugcacaggaguguuugaauguccauguguuuuguucaggccaugugcacaggaccccgugugagugcaucagugagugugugucu

SEQ ID NO: 4110476 - RNA, 83 nt, Human
gggcaugccgaugggccuggggcugugaaccagggcaacucgcuuuggcucucacuugcacucaggggacccauuuagugccc

SEQ ID NO: 4110477 - RNA, 76 nt, Human
gggcaugggggcucaggccuguaauccuagcacuuugagaggcugaggugggaggauugcuugaguccaagagccc

SEQ ID NO: 4110478 - RNA, 66 nt, Human
gggcauggguggccacgggggcauggacuggcugaccccugugcauugaccacacucuccaucccc

SEQ ID NO: 4110479 - RNA, 56 nt, Human
gggcauggugagggauaugaaguauacaagacauaauuucugcucucaaaaugcuc

SEQ ID NO: 4110480 - RNA, 56 nt, Human
gggcauggugcugguguucaugggauacagaacuguugaagauacacacccugccu

SEQ ID NO: 4110481 - RNA, 71 nt, Human
gggcauuaucccagaaacuauguaagaaagugacaucuuucacgaucuuuucauccuuucuacuugagccc

SEQ ID NO: 4110482 - RNA, 108 nt, Human
gggcauuccagguaaaggacuagucuguacaaaggcuauuuggaggcuaaagggaauauguggccuuugggagaguguacaugguucaauauggcuggaauuuggcuu

SEQ ID NO: 4110483 - RNA, 63 nt, Human
gggcauuuacuuuugaaaauauagacccuacuuauaaaagucaauauuucagguagugugccc

SEQ ID NO: 4110484 - RNA, 128 nt, Human
gggccaaggagagaaauucacuggcuuaaugcagcugcccaagccccagaugucagucaguugaugcacugggaaugagggcagcuuuaccuggagccagucacaguguugccaaucuccugggaccu

SEQ ID NO: 4110485 - RNA, 68 nt, Human
gggccacacagcagaaggcccgugucugcucaaugacugaagauacgcggcucuuuucuugauucucc

SEQ ID NO: 4110486 - RNA, 81 nt, Human
gggccacgccagaggccucaggcccagcccugccagcucagcugcagggccaccagggagucucaggccuccugugggccu

SEQ ID NO: 4110487 - RNA, 62 nt, Human
gggccagacccuuggcgaucugagaaagaaagacugaguccggaugucaagaggccugggcc

SEQ ID NO: 4110488 - RNA, 58 nt, Human
gggccagcacuuuguuucaacaagcccuccaggagacucugaggcacuagucuggucc

SEQ ID NO: 4110489 - RNA, 58 nt, Human
gggccagcaguaucggaggcaucacagcugucaugaucauccagagccugcugagccc

SEQ ID NO: 4110490 - RNA, 61 nt, Human
gggccagcuguaagcugcugaauuuuuccaaauugaauuauucgauauucucagcugaucc

SEQ ID NO: 4110491 - RNA, 56 nt, Human
gggccaggcacugugugagauauggggauacaaccaugaggacagugccuuggccu

SEQ ID NO: 4110492 - RNA, 59 nt, Human
gggccagucugacucugcuggucaguguccaguguguuucccagcagacacagcugccc

SEQ ID NO: 4110493 - RNA, 59 nt, Human
gggccaugaguaaacuggaaagccaggaaaggcacucggcaggcaggucuucauggccc

SEQ ID NO: 4110494 - RNA, 86 nt, Human
gggccauuuucacuucuuuugucauuuuucaguuacuucaggccaucuggauguauacgugcaggucacaggagauaugauggcuu

SEQ ID NO: 4110495 - RNA, 56 nt, Human
gggcccaucacaaccaagggcagccagcugcuguuccucuggcuugugcugugccc

SEQ ID NO: 4110496 - RNA, 78 nt, Human
gggcccccauaaucacuaugcuuauguggcacagcucuuccuaugucacauuguaacaguguguguaugugggugucu

SEQ ID NO: 4110497 - RNA, 81 nt, Human
gggccccgggccggaggcgggcacuggagggccgggguuguccugggccugaaggagcugcgccccgggggucugggguuc

SEQ ID NO: 4110498 - RNA, 87 nt, Human
gggccccggucucagguccaagauggccauccagacccagcagucgaaguuugugaacuggcagguggacggggaguaucggggcuc

SEQ ID NO: 4110499 - RNA, 56 nt, Human
gggcuccucacuucacgucucucgaugucuaaagggucagcugugugugaggaccc

SEQ ID NO: 4110500 - RNA, 70 nt, Human
gggcuccucaguugucccauggagacacagcucugucucucagggggaaggcugaaggucaaaggagccc

SEQ ID NO: 4110501 - RNA, 72 nt, Human
gggcuccugguaaguaauaagugcucaauaaacacucucuuuauucucugauguucacuuuuccaggagucc

SEQ ID NO: 4110502 - RNA, 55 nt, Human
gggcuccuguuugagaaaaagccccaagaaugguucauuuccaagaagagagcuc

SEQ ID NO: 4110503 - RNA, 55 nt, Human
gggcuccuguuugcgaaaaagccccaagaaugguucauuuccaagaagagagcuc

SEQ ID NO: 4110504 - RNA, 61 nt, Human
gggcuccuuggauuccgugaacuuaaccaucucauaggaaggcuacaggaauccagcgccc

SEQ ID NO: 4110505 - RNA, 57 nt, Human
gggcuccuuuccagcaucuuccaucaauucaaaagggggauggccggaccagagccu

SEQ ID NO: 4110506 - RNA, 84 nt, Human
gggcucggcuccacgcaggcaccacggcucaggucuccuguccccagaggcugugggaauggcugcuugcuugguuaugaguuc

SEQ ID NO: 4110507 - RNA, 78 nt, Human
gggcucgucuugcaugugacagcagcacauauguccgaggaagcuggacucugucacauacacuuuucaggggagccc

SEQ ID NO: 4110508 - RNA, 80 nt, Human
ggcugacuuuguggcauuugaacaaucacauaggcaccugaacuuggacucugugauugauuuaaugcucuucuguugcc

SEQ ID NO: 4110509 - RNA, 80 nt, Human
ggcugagaaguccagagguccaggaucaaggcaucaccacauuugaugucuggugagggccugccuucugguucauaguc

SEQ ID NO: 4110510 - RNA, 99 nt, Human
ggcugagaaugucccuucuucuucugaucaggagucagagcuaaggcacaugucacagcagcucucucccaagaggcaggggagcuggaaggguaagcc

SEQ ID NO: 4110511 - RNA, 76 nt, Human
ggcugagacagguggaucacuugaggucaggaguuugagaccaaccugaccaacauggugaaaccuugucucuacu

SEQ ID NO: 4110512 - RNA, 56 nt, Human
ggcugagacuuccacugccaucuuucccuccagaagcgaggcaaugcaguccagcc

SEQ ID NO: 4110513 - RNA, 65 nt, Human
ggcugagauagaugccaguccauaagagucuuuaccaaguuaucucuuuuguaacuauuucagcc

SEQ ID NO: 4110514 - RNA, 61 nt, Human
ggcugagcaauaugaggggaaauaaauuucucagaaauguauccccugcagguugcuaucc

SEQ ID NO: 4110515 - RNA, 87 nt, Human
ggcugagcagagcaggcauucuaguggcugaaggagauuucucuuucuguuucccuuucuacucucuaugccugccucugccuagcc

SEQ ID NO: 4110516 - RNA, 56 nt, Human
ggcugagcccgggugcucuaccccgcuuccuggggacucugcuucugggaucagcc

SEQ ID NO: 4110517 - RNA, 55 nt, Human
ggcugagcguggcugccguggggacacaccugccaacacagccacguuccuggcu

SEQ ID NO: 4110518 - RNA, 57 nt, Human
ggcugaggcggcgaugcccuugucuucuccggaggcuacggcggcgacgcucucgcc

SEQ ID NO: 4110519 - RNA, 67 nt, Human
ggcugaggcuagccuccuaagugcaauugggaaaaaaaauuuuguaaauaguuagcuugccucugcu

SEQ ID NO: 4110520 - RNA, 73 nt, Human
ggcugaggggacaaggcauggcucggagucagaacagucucugucugaacccuggcccugccuccugacagcu

SEQ ID NO: 4110521 - RNA, 66 nt, Human
ggcugagguggguggaucaccugaggucaggaccagcuuggccaacaucgugauaacccccucucc

SEQ ID NO: 4110522 - RNA, 60 nt, Human
ggcugagugcugcuccagaagucaucaaccccuugacaguaguucuggcucacucaugcu

SEQ ID NO: 4110523 - RNA, 61 nt, Human
ggcugagugcugcuguucacgaguccuguggacucgcguggacacuggcagcagcucagcu

SEQ ID NO: 4110524 - RNA, 56 nt, Human
ggcugaguucucuugcugaaucuaagacuacgguucuauugugagaaccucagacc

SEQ ID NO: 4110525 - RNA, 93 nt, Human
ggcugaguuuaaaggcuuuucuguuugucuugguagcaugugucaucuugugauauuuacaugacucaauagaagggcaugaguaagcuggcc

SEQ ID NO: 4110526 - RNA, 82 nt, Human
ggcugauaaggaagaaacugaaagggguuggugucacggguuaugcugcgggaccccccauuuguguuuucaagaaucagcc

SEQ ID NO: 4110527 - RNA, 64 nt, Human
ggcugaugaaccaucuggcuccagaagagguuuuugcuuuuccuguuaguaugguucuugagcu

SEQ ID NO: 4110528 - RNA, 97 nt, Human
ggcugauuguauuagcacguacuuccucuuuccucccaccaucauuaagacgagguccaggaaggguggauaguaacgugacuuucuauggucuccc

SEQ ID NO: 4110529 - RNA, 80 nt, Human
ggcugauuugaagacccugggggaagagaggggaaaguaacucaaugguuuccucuuccaucuucccagggacaccagcu

SEQ ID NO: 4110530 - RNA, 67 nt, Human
ggcugcaagcacagacucccucugagugugaauguuaucucucaccagaugagggaugugcucagcc

SEQ ID NO: 4110531 - RNA, 110 nt, Human
ggcugcaaggagccuuuccagcugcugcccuuggcugcagguggguggaugugccucccaccuguccguuggcuuggcucucucuggcagcagcggguaggcucguagcc

SEQ ID NO: 4110532 - RNA, 61 nt, Human
ggcugcagaggcgaucugaggugccaucaucaauguucuucacaaugacggcuuugcaucc

SEQ ID NO: 4110533 - RNA, 66 nt, Human
ggcugcagccuuugggaaggacagggacacccaugcaacacccaugcccaccccuuagagcucacc

SEQ ID NO: 4110534 - RNA, 57 nt, Human
ggcugcagcgggaggggcccggcucagccacucagccagccuugcucuccugcagcc

SEQ ID NO: 4110535 - RNA, 75 nt, Human
ggcugcagcucuggcuggguuccaggauuccauuagccagacaauggguggccccagcugagccaacaggcagcc

SEQ ID NO: 4110536 - RNA, 67 nt, Human
ggcugcaggagucccagaagguuuuguuuugaaaacuggggccuggcugggaccccugaggguggcc

SEQ ID NO: 4110537 - RNA, 66 nt, Human
ggcugcaggcauuuuccugggcagggugcagucaccaugugucacuggcagaugccugcagaagcc

SEQ ID NO: 4110538 - RNA, 74 nt, Human
ggcugcagggcagucugacucacucaugcccugguugacaagccagcucaggacagacagaaugccuaacagcc

SEQ ID NO: 4110539 - RNA, 68 nt, Human
ggcugcagucuggggauggcuggaggguccuggaagugcgcagcucacagccucccccggccugagcc

SEQ ID NO: 4110540 - RNA, 92 nt, Human
ggcugcauggaccagggcuggagcacaggggcuggaugaacuugcaucugucugcuguuagcugcauugcuucugggugugaugcuuaggcc

SEQ ID NO: 4110541 - RNA, 57 nt, Human
ggcugcauguucagaugacacuuguccccaaguguuuuucauuuugaacugucagcu

SEQ ID NO: 4110542 - RNA, 121 nt, Human
ggcugcauuagggguggcugcugguuuguaacgugcguuguugggggcuggggaggauuuacggcucuaaagccuuccauauaacgcuuuaacggugggcagagcgguuucuguugcgucc

SEQ ID NO: 4110543 - RNA, 61 nt, Human
ggcugccaaagucagaccuaacuccuucccaggaaauucuuggcucugcuugugagcagcc

SEQ ID NO: 4110544 - RNA, 90 nt, Human
ggcugccacuccuacuuuaguacuguguggugagcugucuccuccuggguuucagagggcacagcugcuacccagugccauggaggcgcu

SEQ ID NO: 4110545 - RNA, 64 nt, Human
ggcugccagugagugcagaccggagacuagacagaaaggucucaaagagcaguccuggccaguc

SEQ ID NO: 4110546 - RNA, 62 nt, Human
ggcugccccaugggcugggcuggauggaaggagcgguugagggucaagucccuggggcagcu

SEQ ID NO: 4110547 - RNA, 55 nt, Human
ggcugcccucugcugacugcaaaggcaaaccacaugcagauggccugggccugcc

SEQ ID NO: 4110548 - RNA, 61 nt, Human
ggcugccgagugggucaugaggcacuugggccccuacaagugcagcugacacugguaugcc

SEQ ID NO: 4110549 - RNA, 65 nt, Human
ggcugccucaaagcucaagcuccaguagcagcauucccacuggggcuuggaaagcagaggcaguu

SEQ ID NO: 4110550 - RNA, 60 nt, Human
ggcugccucagauuugcugacucugggaagcuaggucagcuugugcgcaucugagccucc

SEQ ID NO: 4110551 - RNA, 77 nt, Human
ggcugccugcaccaggcuuagagccccaggcacauugucucucagcuuugagaccugcucugugcuagacaacagcu

SEQ ID NO: 4110552 - RNA, 57 nt, Human
ggcugccugccgcccacuuggcgucucccaagugaugugccuggcagggccacagcc

SEQ ID NO: 4110553 - RNA, 127 nt, Human
ggcugccugcugagacccagggcuggagcauggcucugugcgggccauggucaggaaccuggggcuuccacgaccuugcucaggccuaagccagaaugccagcuccacaucuucucugccggcaguc

SEQ ID NO: 4110554 - RNA, 59 nt, Human
ggcugccuucauagaccaugggagaggugaccaugguuugaaguaggaugggggcaguc

SEQ ID NO: 4110555 - RNA, 64 nt, Human
ggcugccuuccaaagaguuuuauaaguaggaauuaugaaacuugagggagggugauugaaagcc

SEQ ID NO: 4110556 - RNA, 126 nt, Human
ggcugccuuuuaauucaugacucccuguuaaugcauuuggggcagacuagcaguaugugacugcauucugcuacacgauucugauuccagaauaguugauaaccuauaaagaagaaaaagauagcc

SEQ ID NO: 4110557 - RNA, 56 nt, Human
ggcugcuauauugguucaggcuugggcacaugacccaagccagaccaauagcagcc

SEQ ID NO: 4110558 - RNA, 114 nt, Human
ggcugcuauguguauguaugcauguuauugaugccugaggcuuguggaacucaucugccuggucuauuccuugagagcaacacgcaguaguauacgagcguaacaagaacagcu

SEQ ID NO: 4110559 - RNA, 94 nt, Human
ggcugcuccagggcccuuauucuugccagauccuggaggccauuucuucuucaccaggaaaugaacaggaaugaaccccaagagcuucuaagcc

SEQ ID NO: 4110560 - RNA, 60 nt, Human
ggcugcuccuguccagcagggccaccccacaggcagugugcugagcugagaggagcggcu

SEQ ID NO: 4110561 - RNA, 67 nt, Human
ggcugcuggauuguguaucugugagacuuuuuagggauuuauuaacaugauacacaauuagcaaacc

SEQ ID NO: 4110562 - RNA, 66 nt, Human
ggcugcuggcuguguaccaucucaagcuugcugaaacuuggggguuccuaaacaagcacaccagcc

SEQ ID NO: 4110563 - RNA, 68 nt, Human
ggcugcugguuucuuguuuuagaagauuggguuuagacuugcccuuaaaaccuagagaucagacaguc

SEQ ID NO: 4110564 - RNA, 72 nt, Human
ggcugcugugccaaccccggcugcccuccugucaucagaaugcaggcagcuggguuggccagaaacauugcc

SEQ ID NO: 4110565 - RNA, 65 nt, Human
ggcugcuguuucagagacuguuuauuugacuuagaacaaagcucaccauucucaacagcacugcc

SEQ ID NO: 4110566 - RNA, 71 nt, Human
ggcuggaaaacacauuugggcuccuacauaaaggcauggacagcuuuuguggggccccaauguugcuggcc

SEQ ID NO: 4110567 - RNA, 56 nt, Human
ggcuggaggaaaauuacuggggucugaaggagugcaggcccagcuuuccucuugcu

SEQ ID NO: 4110568 - RNA, 63 nt, Human
ggcuggaggucugcagacuacgcuucccaggcugccgugccugggcugccggcaggcucugcc

SEQ ID NO: 4110569 - RNA, 57 nt, Human
ggcuggagucuacauucaagaaucauaaaccaagauuucuggcuuuggacauuagcc

SEQ ID NO: 4110570 - RNA, 67 nt, Human
ggcuggauggggcugggcugggcaaggcugagcaaagccagcccauuaaccccuguccucuccugcc

SEQ ID NO: 4110571 - RNA, 71 nt, Human
ggcuggauuuggggggauucaggagauggagccaaggguaacaacucaguuuguuccuugggaaucuugcc

SEQ ID NO: 4110572 - RNA, 60 nt, Human
ggcuggcaaguagguuuuggcugucugaugggauaccagcugaagcucuugucaaagguc

SEQ ID NO: 4110573 - RNA, 71 nt, Human
ggcuggcaggacucacacuuggccgggcuucuauagacaugauaggccagacuguggaguuccuggugguc

SEQ ID NO: 4110574 - RNA, 63 nt, Human
ggcuggcauuuacacaaugcauuuaccucuuaaauuccaugugcgugguguuucucaucagcc

SEQ ID NO: 4110575 - RNA, 62 nt, Human
ggcuggccaugguguuugcaauaaauacacuguguuuauuguuguuagucauaagucaagcc

SEQ ID NO: 4110576 - RNA, 86 nt, Human
gguaucgaaaucguuuucucaugucccucgaggggcccuaagucacucucaccaaagagcugcaugcggaaaccuguucugauucc

SEQ ID NO: 4110577 - RNA, 80 nt, Human
gguaucuaccauauugaauauuugguuuucuugaacucacccaagaaagcugaauauucuguguggaaacagguuacacc

SEQ ID NO: 4110578 - RNA, 90 nt, Human
gguaugaagagauucagugcucuuaaauaacaucauugcuuuguaaggacugaacauuauacaagaguuuccugcaaucugauucuuacc

SEQ ID NO: 4110579 - RNA, 77 nt, Human
gguaugaauaaauguaaauggugcuugcuggccuuaggugugugagagucagaagcauccauuucaccacucaggcc

SEQ ID NO: 4110580 - RNA, 77 nt, Human
gguaugacuaaagggauagauuuaugucuuugaguuaaguuggcuaggaaggcauuuuaugccuuauaguucuugcc

SEQ ID NO: 4110581 - RNA, 79 nt, Human
gguaugagugucccccagcucugagugaaucaguaggaggugcuggaccugggcugauucucacagugggaccucaacu

SEQ ID NO: 4110582 - RNA, 72 nt, Human
gguauggaucagaugggcucaacccugccaccucaccccucauccacagguaugaguucaguauccagauuc

SEQ ID NO: 4110583 - RNA, 88 nt, Human
gguauguuucugaguuguuguccauguugcaugcaauguuuuaugaaauaauugguagcugguauaaugccucauugaaauaacugcc

SEQ ID NO: 4110584 - RNA, 77 nt, Human
gguauuaacagucaacaguuuuugauguaaagguccugacuuugccacuaacuagcugugagacauuaguuaacccc

SEQ ID NO: 4110585 - RNA, 77 nt, Human
gguauuaccaagaucuaguuuucuagguuuucuugagaaauuagaaaaucuggcaacacuaaguuuguaauaauacc

SEQ ID NO: 4110586 - RNA, 77 nt, Human
gguauucagcaguuacccaggaaagaaaugguaugucccuagcaauggcauuuaaucuggguaauuuguaggucucc

SEQ ID NO: 4110587 - RNA, 61 nt, Human
gguauucuuauuaaauagccagaaguauauuuucagagcuucuagcuuggauuagaguccc

SEQ ID NO: 4110588 - RNA, 73 nt, Human
gguauuguauauuugcaaauacauuggguuagaaaucaucuuuaacauuuuguguuaguguaauaacaauauu

SEQ ID NO: 4110589 - RNA, 69 nt, Human
gguauugugccaguaauuucuuaaaaaguaaaaugaaaauuggcugcuuaaaauugcugcaacaagacc

SEQ ID NO: 4110590 - RNA, 87 nt, Human
gguauuuggucagguaaaggucauuuaacaauuuaugacuacaguuggauggugcaaaugaucucguaucaaaauauaccaaaugcc

SEQ ID NO: 4110591 - RNA, 79 nt, Human
gguauuugucagcucaaaugagugacucacacaggauuuguccuuuugugaccagcucauuucacucagcacaaagucc

SEQ ID NO: 4110592 - RNA, 80 nt, Human
gguauuugugaggaaugaaaggucacaguaucuuuccuuggcccacagacuguggcuaauucauuuggucaacaaauauu

SEQ ID NO: 4110593 - RNA, 76 nt, Human
ggucaaaggguauaaauauuuuugaggugauucauauauuuuaugaaacauuauagaauauuuauacucuuugauc

SEQ ID NO: 4110594 - RNA, 63 nt, Human
ggucaaaucauccuuuguagaaacuucucuggggacuugucccuuuuacagggaauggagacc

SEQ ID NO: 4110595 - RNA, 75 nt, Human
ggucaacacaauacaacucuccuaauuaaaugcucuuauguaccacacaaaagcaugugauugggagaguugacc

SEQ ID NO: 4110596 - RNA, 67 nt, Human
ggucaacauaguuuuagguagaaacuggcucuuugaagccauucaaaccugagccuauugguugacu

SEQ ID NO: 4110597 - RNA, 79 nt, Human
ggucaaccccuaugccugugcacaagacuuuagucucacaaaccugagacugaaggaagcgggcagggguagggggacc

SEQ ID NO: 4110598 - RNA, 62 nt, Human
ggucaaggcccaggcugcccugggcacacgccccugugcaggggcuugucugggccugggcc

SEQ ID NO: 4110599 - RNA, 67 nt, Human
ggggcagggacgucagggcccacagcagaugccaggcagugccacauggcuuugcccugcuugcccc

SEQ ID NO: 4110600 - RNA, 78 nt, Human
ggggcagggcuugaugucaggcugaaaauaggagaauuaaggaaaagucuguacucagcucagaucucaggaugccuc

SEQ ID NO: 4110601 - RNA, 103 nt, Human
ggggcaggggacgcuccagcuggucugggguuggccagggcccuaguggcccgcccuggggccccagcucggccccucgccucgcugagcucuagugugcccc

SEQ ID NO: 4110602 - RNA, 62 nt, Human
ggggcaggggcucuggugauuggcaugagagaccaccgaugucaccccagaggccuggccuc

SEQ ID NO: 4110603 - RNA, 78 nt, Human
ggggcaguagguggcacucaaccuuuuauuagcagaaaauuguuaguuucaaauuagaguguucaacacugcuucccu

SEQ ID NO: 4110604 - RNA, 83 nt, Human
ggggcagugacuucuccguggcaggauaauuggacccuggaguccccacaucugugcacaacggggaaggaacacacagcccc

SEQ ID NO: 4110605 - RNA, 56 nt, Human
ggggcaugcauguguuucauacagcaggcauuuguugagcaccagcugcaugcccc

SEQ ID NO: 4110606 - RNA, 74 nt, Human
ggggcauggaggugccaggugugagggaagaagccauuuucacagucccacccguggagccuccagauagcucc

SEQ ID NO: 4110607 - RNA, 100 nt, Human
ggggcauguggaagggucuuaguuucuguuuaggggugaugugauggugcugguuucaugguuaaguccagaaaggaagccagguucccuuucuacuccc

SEQ ID NO: 4110608 - RNA, 80 nt, Human
ggggcauugcagcuguugugauccauuuacgaggaacaucugaugagagugaaaugucacaugucacacugcugugccuc

SEQ ID NO: 4110609 - RNA, 60 nt, Human
ggggcauuuguauucuaacuuagugaaagaaguuuguaauaguggaauuucagauacccc

SEQ ID NO: 4110610 - RNA, 57 nt, Human
ggggcauuuuauaaccgguuauuagucucggcuagacuaaaggcugugagguggccc

SEQ ID NO: 4110611 - RNA, 92 nt, Human
ggggccaggucccaagacaccagcuggggcugcagagaacaggcuccucaaaggccuuccagaaagcacuuaguuagugucagccuggcccc

SEQ ID NO: 4110612 - RNA, 85 nt, Human
ggggccaguguccuagagacuggggacuuccuuuggggccaaccccaucugggcucgaauccuagcucugcugccaacuggccuc

SEQ ID NO: 4110613 - RNA, 68 nt, Human
ggggcccagcaccccuccucgccccauccccguccggguacgggggcgcggcagggguccccggcccc

SEQ ID NO: 4110614 - RNA, 81 nt, Human
ggggccccugcuggccugcugguuucucugugagcugcugcuaugaggccaguagugggcagcgaucagggcuggggcucu

SEQ ID NO: 4110615 - RNA, 70 nt, Human
ggggcccgagccugcagugcccacgugaccacgggaaacucacucugggccagcgcagguaaggagcucc

SEQ ID NO: 4110616 - RNA, 57 nt, Human
ggggcccgucgcuguaccaggcugagggccuuacauucagcccugugaccuggcccu

SEQ ID NO: 4110617 - RNA, 86 nt, Human
ggggcccuaaaucaaggugagcuucccccaccuccgugcacuugcauucugugugggcaggaggcccugcccugaaagggggcucc

SEQ ID NO: 4110618 - RNA, 73 nt, Human
ggggcccuucuuggcaaaagauggagaagcccuacuucaguacagucugaagcuucaucugaugccgaacucc

SEQ ID NO: 4110619 - RNA, 83 nt, Human
ggggccgugggcuguccaugaccuuguacaaccaggagauuccccuuggcugcagccccuaucgcggacagguccacguuccu

SEQ ID NO: 4110620 - RNA, 60 nt, Human
ggggccuacaggcgggugggcaggaggcggcccaggcccgccccagucuguaggugcccc

SEQ ID NO: 4110621 - RNA, 69 nt, Human
ggggccuauuuguucaacuucccucaaggugaccucaucacagauaagggaugaauaaugaagggccuc

SEQ ID NO: 4110622 - RNA, 58 nt, Human
ggggccucacuaugugguccaggcuggucuugaacuccugggcucaagugaugguccc

SEQ ID NO: 4110623 - RNA, 82 nt, Human
ggggccuggaggagcaauaugguuagguuuguguugcacaugguuguugugugguccuagcuagguuagcccucaggguacu

SEQ ID NO: 4110624 - RNA, 62 nt, Human
ggggccugguggugccucugugggccccaagggggcuggguggcugggcuaccacuggcccu

SEQ ID NO: 4110625 - RNA, 82 nt, Human
ggggcgcuggguagcucauuugaagguugcaugagacuaaauuuauuccucccucaugcuuaauuggagcauucauuucccc

SEQ ID NO: 4110626 - RNA, 77 nt, Human
ggggcgggucagagggagccagaguugggagcucugaagcagaggacccugugacuggcuaccuuggacagagcuuc

SEQ ID NO: 4110627 - RNA, 76 nt, Human
ggggcggguuuucugcacugugucauuuggggaacagcugggcacagcuguguccugaagacacugccccagcccc

SEQ ID NO: 4110628 - RNA, 63 nt, Human
ggggcgugguaggggcagcagugccagccagagcccuggggaggcagggcugccccucccucu

SEQ ID NO: 4110629 - RNA, 58 nt, Human
ggggcgugguugcugguggccuggagugagcugccugcuguggccuccagcacucccc

SEQ ID NO: 4110630 - RNA, 74 nt, Human
ggggcuaauacuccagcagcugacaccagucccagcucugcugcugggaugcgggguggcugcaggccaguccc

SEQ ID NO: 4110631 - RNA, 55 nt, Human
ggggcuagaguguuggcugggagaacuaucccaggcugggaacgauucuaggccc

SEQ ID NO: 4110632 - RNA, 58 nt, Human
ggggcuaggcuuggccagcacugugacauugcugcacgugggcaaaauggccuucccc

SEQ ID NO: 4110633 - RNA, 70 nt, Human
ggggcuaucaauuucuacaguugguggaggucuuacaagaaaaaaguaagcaauaccaggugugggcccu

SEQ ID NO: 4110634 - RNA, 58 nt, Human
ggggcucagugaagcuaaguguauggcccacaaguggucauauuggcuccacuuccuc

SEQ ID NO: 4110635 - RNA, 56 nt, Human
ggggcucaguucggacagccugucugccuaacguagcccugagacgacugagcucc

SEQ ID NO: 4110636 - RNA, 63 nt, Human
ggggcuccagucuucacauuuucuaaauguccuuaaggaggagaaauggugagugagagcccc

SEQ ID NO: 4110637 - RNA, 77 nt, Human
ggggcuccggauagccacaggugguccaacuggccacucaucgccuggccacccccaaguagguggucugggucccc

SEQ ID NO: 4110638 - RNA, 71 nt, Human
ggggcugagagcuggaaucugagggauggggaugucuugggauccagccucugauuccauucuaggcaccc

SEQ ID NO: 4110639 - RNA, 128 nt, Human
ggggcugagccaggcgggucucacuccuccuggcugggucaccuccugugucacccuggcucuauuuucuggagucagggguuggacggggccacagucaaggugaugugcagccugccagcagcccc

SEQ ID NO: 4110640 - RNA, 56 nt, Human
ggggcugccuuucuucugggagccucgucccugcugccucccacuugggcagcccc

SEQ ID NO: 4110641 - RNA, 56 nt, Human
ggggcugcugggcaagaaacauuucuuacgugauaaugugaagcgucagagguccc

SEQ ID NO: 4110642 - RNA, 72 nt, Human
ggggcugcuggggggcuacugacagaggagacaucuucauccaucucucugugagaugccuuccugagccuu

SEQ ID NO: 4110643 - RNA, 69 nt, Human
ggggcuggcuugccaagcucagggagucgaggucugagugcuugagcucugggcgggcaggucagccuc

SEQ ID NO: 4110644 - RNA, 98 nt, Human
ggggcuggguuugacuacaugguaggcauguguuuggugggucauuauguauuaucauacagauaaaggcuuacuaguagugugaagacauaagccuc

SEQ ID NO: 4110645 - RNA, 74 nt, Human
ggggcuguccugugcuuuacaggaucauuagcaacauucccagauucuacucacaagacaccaguggcagcccc

SEQ ID NO: 4110646 - RNA, 111 nt, Human
ggggcuguuuuagacagaggaggcggcaggugcgcguauguagguuugagguagauuuugcuacccaggaaaugggcucuugccucuuccaccugccugugaacuggcccu

SEQ ID NO: 4110647 - RNA, 72 nt, Human
ggggcuugagcuggcuaagauccaagaaaggcauccauguaaggugggcuguuuuucuucuuuucaggcucc

SEQ ID NO: 4110648 - RNA, 74 nt, Human
ggggcuugaggcagagaggggcacagcagcuguugcacaggcuggugcaagauucccugcuucuucucagcucc

SEQ ID NO: 4110649 - RNA, 69 nt, Human
ggggcuuggaaggcugaauggccucucuuaagacccacaggcagagaacauuggucuuccuauggcucc

SEQ ID NO: 4110650 - RNA, 64 nt, Human
ggggcuuuggcagguccugcuuaugauaaaaugcaaaggcucuuaacccucugccacaagccuc

SEQ ID NO: 4110651 - RNA, 61 nt, Human
gggggaaaaacaccugggacucugggacacaggaccuaggcaaauccagauuuuuccaccc

SEQ ID NO: 4110652 - RNA, 75 nt, Human
gggggaaaauaauuuucaacaaaucagcaaaaaaagcaggaagaaugaguuguuaacggaaaacuguuuuccuuc

SEQ ID NO: 4110653 - RNA, 75 nt, Human
gggggaaaaucaucuuuuaucacuauuguguaccgugccgguccagauggaggauaaaacaugcaugaguugccc

SEQ ID NO: 4110654 - RNA, 67 nt, Human
gggggaagacugggcuagugaucugagaaacugucaagcgauuauuaaagcuuaggucuuauccucc

SEQ ID NO: 4110655 - RNA, 87 nt, Human
gggggaaugaagauaaugugucugucuuugccaguucaguguguacacuuaagagguaugggauguggugcauuaucagauuccgcc

SEQ ID NO: 4110656 - RNA, 71 nt, Human
gggggacagcagugggggaugggcagaagggggcgacucgggcugcccaggcuccucgcagccuuccugcc

SEQ ID NO: 4110657 - RNA, 59 nt, Human
gggggacaggaugaauaucugucugauaagcucacugagauauguuaggcuuguucccu

SEQ ID NO: 4110658 - RNA, 63 nt, Human
gggggacaggcugagacuugagcuuguaucuccugggccagcugcaacaucugcuugucccuc

SEQ ID NO: 4110659 - RNA, 65 nt, Human
gggggagagagcuccgugacagcuucagcugcccuagcucuagccuggcuuagcucucucacuuu

SEQ ID NO: 4110660 - RNA, 68 nt, Human
gggggagccuggggaggucccgccaccccugugggcugagcuggcgauuucuuccucaucgcucuccc

SEQ ID NO: 4110661 - RNA, 55 nt, Human
gggggagcucucucgaggauaucugggcugcuuguucuccagggggagcucucuc

SEQ ID NO: 4110662 - RNA, 127 nt, Human
gggggaggaggcugcagcugggguugggggcaccgggagauguggcuuccucugcccuggaugcuuccuggggagaggcacagaggcaguccccuaggugacccccuccccacuggcccacuuuccc

SEQ ID NO: 4110663 - RNA, 89 nt, Human
gggggagucuccccugggaccagcagcugcaaagccugggugcucucuuggaccaacacccuagcagcugcugccccuggggcuccucc

SEQ ID NO: 4110664 - RNA, 56 nt, Human
gggggauaagcggggagaggaaaaccacucacucucacaugcccugucaguccccc

SEQ ID NO: 4110665 - RNA, 96 nt, Human
gggggaucaauuccuuccacuguccaggcacuuuaggaucagguugaaacccccuccuuucagaaucugaaaagcgcuuggucggggagaucgccc

SEQ ID NO: 4110666 - RNA, 61 nt, Human
gggggaugaagcuauuugguuggcacuacauaaagagcccaccuuugguuuuauggcuccc

SEQ ID NO: 4110667 - RNA, 61 nt, Human
gggggcagcagguguccugcgaugccccggggaugugcgcgcagacugcccugcugucccc

SEQ ID NO: 4110668 - RNA, 65 nt, Human
gggggcagcauucaggucccggggugcccgagccaggucagacccagggacacgaugacaccucc

SEQ ID NO: 4110669 - RNA, 55 nt, Human
gggggcaggaccuggcuucggauuccacacugggcucagaaaaaguccuggccuc

SEQ ID NO: 4110670 - RNA, 76 nt, Human
gggaccucucuguuccuggccucuugcccccgcccugccaucugccggccccaagagggcagcacaggugggucuu

SEQ ID NO: 4110671 - RNA, 55 nt, Human
gggaccugaggagggguuucagccuggaggcuaggguggcauccugcccaggccc

SEQ ID NO: 4110672 - RNA, 68 nt, Human
gggacgcggcucggcgggugcgccccgggggcauguccgcgcgcuaccgccagggcugcagugguccc

SEQ ID NO: 4110673 - RNA, 112 nt, Human
gggacgugaagccagacaugugaggugccugugaguaucaucugccugcccaucagacagggaagcaguugagucugcuagcuaggaccccagauuuucugccuuuccuccu

SEQ ID NO: 4110674 - RNA, 129 nt, Human
gggacguggagcgaggaguggggcuccaggcugcugaggcuccggaccaagugcccccugcacuuucaacgccguaggucucccggcagcccuggaaggacagucuuacccggacgccacgguggucuc

SEQ ID NO: 4110675 - RNA, 85 nt, Human
gggacuaaguacugacuacuugguaccugaagaucgggauucuuuucuacucccucagaccuugcuaguagucuaggcuuauccc

SEQ ID NO: 4110676 - RNA, 129 nt, Human
gggacuacuagacuguauacuucuguauacaauuuaggcuguauauacuguauacaguuugugacuacuagacuguauacuucuguauacaauuuagacuguguauacuguauacaauuugugacuacu

SEQ ID NO: 4110677 - RNA, 55 nt, Human
gggacuauuagaaacuaugccagaacaauaggcauaaauuaggaucugggguucc

SEQ ID NO: 4110678 - RNA, 120 nt, Human
gggacucaaggcauuggcucaauggggcaccuuguucuguuuacucuuguuuuggucagcaccgauugcccuagggcuaagcaggacugccaccacagacucaguugccaagaguauccc

SEQ ID NO: 4110679 - RNA, 63 nt, Human
gggacucagcaaacaagggauucuucaaaaguuguccucccaaaucccucuuccuagaguccc

SEQ ID NO: 4110680 - RNA, 60 nt, Human
gggacucaguuucugugucaaacucuguuagaacugauaggagacacaggagagaguccc

SEQ ID NO: 4110681 - RNA, 87 nt, Human
gggacucaugugacuucagcuaccuuguuuguacugaccaucaucacuaacuacagaaauacuacaaggccgaagcucucaagcccc

SEQ ID NO: 4110682 - RNA, 60 nt, Human
gggacucuccuguguggacccagcccugacgaggaagggaaaggccagagggaggguccc

SEQ ID NO: 4110683 - RNA, 101 nt, Human
gggacucugacuaucaccccugcucugcaguggauuuggcucucagcacucccaggcugggagcuggaugcccugcccuggcagcaugacucagacugccc

SEQ ID NO: 4110684 - RNA, 61 nt, Human
gggacugaguggcuggagcuuccccacugaccuggcugggcugaccccaccccucacuccc

SEQ ID NO: 4110685 - RNA, 94 nt, Human
gggacugcggguguccccgagucuggccugccagcucugguggccagggcaccucugcgcgcgggccagggccccggggcucucccgcaguccc

SEQ ID NO: 4110686 - RNA, 85 nt, Human
gggacuggacaagaaauggauaagcagcuuuugagcaguaacauggcuaaucaggaaaauacugcuuauccaugagcuagggccc

SEQ ID NO: 4110687 - RNA, 67 nt, Human
gggacuggggaaggacccgagacccucucggaggacuugggcagguuucgacuucuuuuucauuccc

SEQ ID NO: 4110688 - RNA, 60 nt, Human
gggacugggucacuaagauaguagaaauggucgcauaaauacuauugccugacaggucuc

SEQ ID NO: 4110689 - RNA, 61 nt, Human
gggacugucugugugguucucugccuaaggaaggaagaaucuaaguacacagacagaucuu

SEQ ID NO: 4110690 - RNA, 104 nt, Human
gggacuugaaacaugcuuuucacaucugcugcugacuggaguuucucaaaugccauauuuagcauucagcucugugaagccagcaguuccuagagcuaagcacc

SEQ ID NO: 4110691 - RNA, 66 nt, Human
gggagaaaaggggugacacauaucagugcaguggcuguggugaucugugugcccccagcagcuccc

SEQ ID NO: 4110692 - RNA, 91 nt, Human
gggagaaagaauaaaggaaaacuuuuggggagucaguagaagacccugaucaaucugacccuugccaaguuccuuuuauucaacaucugcc

SEQ ID NO: 4110693 - RNA, 58 nt, Human
gggagaaagacguaggcugggaggcuaggccagucucgccuuuucacguuuuucugcc

SEQ ID NO: 4110694 - RNA, 69 nt, Human
gggagaaagauucuuaagacauuauguauuuuuagugauucaaguacgugaaucaaggaucuauuuccc

SEQ ID NO: 4110695 - RNA, 82 nt, Human
gggagaacaacucaaaggagaaaugguagaugugcagcaugggagcucauaucuuuucuuauuucuuucuuuccuuucucuc

SEQ ID NO: 4110696 - RNA, 56 nt, Human
gggagaaccagccagugcaagggccccucauguccugccuggccuuugcuuuuccu

SEQ ID NO: 4110697 - RNA, 71 nt, Human
gggagaagauugugucagaacguuuguaaggacacuucaaaggcaagcuucauauggcauuuucugcuccu

SEQ ID NO: 4110698 - RNA, 79 nt, Human
gggagaagauuuucacaaagcuggagcauuuccuccacugccugcacugaggaguugccaaggcuugaaaaucucuucu

SEQ ID NO: 4110699 - RNA, 128 nt, Human
gggagaagcagauguuuucagaugagaugugugugaaaaaugauuuguuaacuguaaaccacaguacaguugucucuugaggucauuuaucuaauuucugucugaauuagaaaaucugugguguuucc

SEQ ID NO: 4110700 - RNA, 106 nt, Human
gggagaagccaguagguucagagaaguuccaggucacaggccaaguaaggggugaaguaggcuuucaacuccagguguguuggacucuaaaccuucugcuucuuuc

SEQ ID NO: 4110701 - RNA, 70 nt, Human
gggagaaggaggacugugcugugccauauuugaugcuauuaaaagcagcucgcauaguuuccaucauucc

SEQ ID NO: 4110702 - RNA, 62 nt, Human
gggagaagggugagaggcagugcuguggaaggggccuggccccugcugccugcgauucuccc

SEQ ID NO: 4110703 - RNA, 126 nt, Human
gggagaagucacuucuaaaaccggggagauggaggaaagcaguuagaaugucuguuacuaauuuuuguuaacgugcugcuguuuccuacaucucauucaggcauuaguuucaaguuccauuuuccc

SEQ ID NO: 4110704 - RNA, 55 nt, Human
gggagaagucaucucuagguuggcagucccugucagccucuuaggacuucucacc

SEQ ID NO: 4110705 - RNA, 101 nt, Human
gggagaaguuuccuggcagggcugagaggcagaauggugccugcaccuccuggagugcacggcaauggucuggcucugcugccuucuauggguaagggccc

SEQ ID NO: 4110706 - RNA, 85 nt, Human
gggagacaaagccccauccacccgcagugcauucauucauggaggaauaaauguguguuggcuggagagggcuuuuauauuacuc

SEQ ID NO: 4110707 - RNA, 78 nt, Human
gggagacagcauguaugucugaugcacaugcaugugcgaauguguguguguguuagaggugcaggugguguacagccc

SEQ ID NO: 4110708 - RNA, 96 nt, Human
gggagacauugcuauucuugcugaucauguagcuuuggcaucacaagauagauguggaaguaaagcaguaugauggaaggauccuaaugugcuucc

SEQ ID NO: 4110709 - RNA, 81 nt, Human
gggagacccacugucacuugcaacugugaggaacggcagagcagccccuugccccagcucagugcagggacaugguuuucc

SEQ ID NO: 4110710 - RNA, 55 nt, Human
gggagacucuccucugcucucuugggaaaagccuaggagagccacauagucuccc

SEQ ID NO: 4110711 - RNA, 68 nt, Human
gggagacugaggaaaugcuggcuuuaggccaaaaaacccuggcucaaaacagcuuccuccaguggcuc

SEQ ID NO: 4110712 - RNA, 76 nt, Human
gggagagaaagcaugaaaugagcgaauauaauggcagccagaggccaugguauuaauuaucuuuuuauucucuucu

SEQ ID NO: 4110713 - RNA, 130 nt, Human
gggagagagcacagugauaaacugcccagaugguggggcagcugaucugaagccuccagugaugcuuccucaagggcugagaauucagcuuuccugaucccuguuggucgguaauccuuuccucuguacc

SEQ ID NO: 4110714 - RNA, 113 nt, Human
gggagagaugaauguagaaaagcuggccuggggcccaggccugccugcugugcaucccuggguggaugccagcccucucugggccccaaggcucugccugacuugggucuccc

SEQ ID NO: 4110715 - RNA, 56 nt, Human
gggagagaugcugauugccaaugucuuauuuccuuuggcaagguagcauuucuucu

SEQ ID NO: 4110716 - RNA, 82 nt, Human
gggagaggcuccaggcugaggagacagaagccaaauacccugcucuggguguuucuccaucguggccugcucugccccuccc

SEQ ID NO: 4110717 - RNA, 65 nt, Human
gggagaggcuccaugaccccggcaggcucuggccaaaccuugcugcguuucauggagccccuccc

SEQ ID NO: 4110718 - RNA, 95 nt, Human
gggagagggagucagagcuggagauucuggggacagugcaugcugcaaugcucauacugucccagcaaauuucaaguucugggacucuuuuuccc

SEQ ID NO: 4110719 - RNA, 68 nt, Human
gggagaggggugggaaauaaugucauugaaauagucaugaccaaggcaugaacuccaagcuuccuucc

SEQ ID NO: 4110720 - RNA, 80 nt, Human
gggagaguacaucugaggagaccagccucugcugcagcccaccccuuggccagaggacggucaccuuaaugauaguuccc

SEQ ID NO: 4110721 - RNA, 116 nt, Human
gggagaguagcuggagaugaagccaaaaagcuugauaguggcuaucaagccagagagacaaggaaugauggugacuucgagugucuguuuguuguauuucuuacagcagcucuuuc

SEQ ID NO: 4110722 - RNA, 70 nt, Human
gguagccguacuuccuggaaguggggcagauauggccuacauugugauaggaagucaccuccaggcuacc

SEQ ID NO: 4110723 - RNA, 74 nt, Human
gguagcuggauaaaaugacauuaccugauuguguuuaauuuuguaguugucgaugucauuuuauucuuuguacc

SEQ ID NO: 4110724 - RNA, 78 nt, Human
gguagcuuucuucucuggacagugaagagaggagcauugggaccuuucucucuuucuguucagaggcugagaguuucc

SEQ ID NO: 4110725 - RNA, 103 nt, Human
gggagcccaacauaguaaguuccuggggcccaaggccuccagcccagcaugccaguuucauccuggguugcccugggccugugagguagcugagaggacuccc

SEQ ID NO: 4110726 - RNA, 61 nt, Human
gggagccugcacugcuguuugcuguuugguauucugugcaggcagcagcuugcugguugcc

SEQ ID NO: 4110727 - RNA, 84 nt, Human
gggagccugccaggcgcugccuggauucccuuuguccaugauacagccggaaauacacuccaggcaguaggcugggcgguugcc

SEQ ID NO: 4110728 - RNA, 69 nt, Human
gggagccugguaauauuuacaaagcaucuaguauugcuagguucuuuguauauaucacuuuaccucacc

SEQ ID NO: 4110729 - RNA, 105 nt, Human
gggagcucaggcucaaguccucccaccucuuuauugcuacugguuugucaccauucugcuggcgagaaugguagugagcagcagggaggaagccacaggguuucc

SEQ ID NO: 4110730 - RNA, 67 nt, Human
gggagcugaauggcaauggagaaugugaagaggaucaaagucaucacagguucauucaugugcuccu

SEQ ID NO: 4110731 - RNA, 62 nt, Human
gggagcugagguaacagugagugugccugagugggaauuacccaccuugacuucuagcuucu

SEQ ID NO: 4110732 - RNA, 61 nt, Human
gggagcugcuagggcauuaugauaaagggguggcucuuuaucuguccuuugccagugaccc

SEQ ID NO: 4110733 - RNA, 56 nt, Human
gggagcuggaguuguguugccuuaagugaaggaagaccaaguauggcgcagccccc

SEQ ID NO: 4110734 - RNA, 59 nt, Human
gggagcuggccuacuauuagauagauuugaaauugguauucacgaguagacuaguuucc

SEQ ID NO: 4110735 - RNA, 63 nt, Human
gggagcuguaagggacagguagcuaaaaauaaugacagagaugcacgguuucauuacaguccc

SEQ ID NO: 4110736 - RNA, 97 nt, Human
gggagcuguugcauauguaagcaggugguucaccuaaaaguuggauguaacguaguuaacgccagcucuuggugcacuuacauauugcauugcuucc

SEQ ID NO: 4110737 - RNA, 64 nt, Human
gggagcuuacaggaaucacugcuagaugaggacaccaucaucuguuuccuaaucuguagcuccu

SEQ ID NO: 4110738 - RNA, 75 nt, Human
gggagcuuauuaaccaugcaugucucuaguuucacagaccuguuagauuggaagcugcauuuuaacaagcaucuc

SEQ ID NO: 4110739 - RNA, 66 nt, Human
gggagcuuccggguucaagccagcugcuucaaaggccaaagcuucccuggcuucuucgguguuccc

SEQ ID NO: 4110740 - RNA, 101 nt, Human
gggagcuugauaaaaaugcagcuacuugaauccuacuccaggagauucugaucaaaucagucaggggugggaucaaggcauucacauuuuuaacaccuccc

SEQ ID NO: 4110741 - RNA, 87 nt, Human
gggaggaagggaggaagggagggguguagagggggccagaaugaugucucccagcucugcagaccugcccuacaccaucccccuccu

SEQ ID NO: 4110742 - RNA, 76 nt, Human
gggaggacaacagagaagacuuacagccacagugucacaauggaaugguaucugcaguuaagguccucucccuccc

SEQ ID NO: 4110743 - RNA, 119 nt, Human
gggaggacucagggucuucuuuuuacucucuugguggguggccuguugauuugggcuuauaccgcucagcguguacucauuaggcuaagcuguaauuagaccaagacuguggcauuccu

SEQ ID NO: 4110744 - RNA, 58 nt, Human
gggaggagacaguaaaaagcacgcaaacacaguguguucagaauuugcugcuuugacc

SEQ ID NO: 4110745 - RNA, 76 nt, Human
gggaggagaguggagauuugauaaaaguagcaguuucccucaaguggagcugcucugauaaaccuacuuuccuccc

SEQ ID NO: 4110746 - RNA, 88 nt, Human
gggaggaggggcuuccccuucauuuagucaaggacacguggccuguggucccccgauguccuccugaagggaagauccccccacuccc

SEQ ID NO: 4110747 - RNA, 66 nt, Human
gggaggaggguucucuggacagaggugugaauugugucucuaguucccaggggaccacaucuuucc

SEQ ID NO: 4110748 - RNA, 64 nt, Human
gggaggagugaagauucaccugcuuauucacaccgucacaaucagaaguccuuucacucuuccc

SEQ ID NO: 4110749 - RNA, 81 nt, Human
gggaggaucacuugagcccaggaggcugcagugagcugugauuaugccacugcacuccagcugggugacagagauccuguc

SEQ ID NO: 4110750 - RNA, 107 nt, Human
gggaggauuccccaaaagaauaacugucuucugacacuguuaggagggcaaagccuugccaguguugcagaagcucagucguguuuugcuggcacaggaacccaccc

SEQ ID NO: 4110751 - RNA, 69 nt, Human
gggaggauugaaauauaaauauguguuguccuaacugcugacauaaccaucacuguuucacaucuuucc

SEQ ID NO: 4110752 - RNA, 80 nt, Human
gggaggcaaacugaggcaggacuugcauaaaguccucugaaaugugacuagacuugcuggcuccuugcuucuagccuucc

SEQ ID NO: 4110753 - RNA, 89 nt, Human
gggaggcagaggugggaggaucauuuaaggccaggagcucacucaaggucagccuggccaacauagugggacccccaccucucucucuc

SEQ ID NO: 4110754 - RNA, 61 nt, Human
gggaggcagccagcacauggaagagggaaggacccaagaacugcagagcuggcuggcuccu

SEQ ID NO: 4110755 - RNA, 68 nt, Human
gggaggcagggagguaggagcuucuagcuguucacagauuuccaucagcuauaaccccuuccucuccc

SEQ ID NO: 4110756 - RNA, 58 nt, Human
gggaggcagugcuggaggcuggcucaaccccaagaccagcaggccaagcugccauccc

SEQ ID NO: 4110757 - RNA, 63 nt, Human
gggaggcaugcucuggggguccuccgagggacaucuuucagccccugcugagccugccauccc

SEQ ID NO: 4110758 - RNA, 68 nt, Human
gggaggccaaggaaggggaugccugaggaucuguacacacugcaccauacccauuccccucugccccc

SEQ ID NO: 4110759 - RNA, 93 nt, Human
gggaggccugagaggagcugcuucaagaucaucucccacuugccuccuuaugucccuuggcaaguuucaugagacagauuuucauagccuccc

SEQ ID NO: 4110760 - RNA, 90 nt, Human
gggaggcuaacuuuugucuucuugacuuuccuaugcaagcuacucaauuuuggagaggaagugucagggauaacgauaagauaacuuccc

SEQ ID NO: 4110761 - RNA, 71 nt, Human
gggagggaaauaaccucaugcaccaugagggagggaaauaaccucaugcaccaugagguuauuucuuuccc

SEQ ID NO: 4110762 - RNA, 57 nt, Human
gggagggaaggaggcgccgugucagagaggaccacccagcccaucccuucugcuccc

SEQ ID NO: 4110763 - RNA, 59 nt, Human
gggagggaagguaccugugugaccaugcauugugcuuuagccacagugcuuugcuuucc

SEQ ID NO: 4110764 - RNA, 68 nt, Human
gggagggaugggggucguuggcagcagcgcacgugaagucacugccacugccuggccuuucucugccc

SEQ ID NO: 4110765 - RNA, 58 nt, Human
gggagggauggugugagaggcucagugaaggcacugagugcugcaugccuuuccuccu

SEQ ID NO: 4110766 - RNA, 113 nt, Human
gggagggcacaugagcuggcaggaggucucuugugagccguuuccuuucuucucuaauaauaggaaugcuggcuuacaggcaguuuuacccccugggauggcaaagcccucuc

SEQ ID NO: 4110767 - RNA, 73 nt, Human
gggagggcauuuucuggguuaucagggguuaaaggguugccagucuugacagcugaggcccagaguacccccc

SEQ ID NO: 4110768 - RNA, 59 nt, Human
gggagggccaauggauuucaacugauguaucaauuccagcuggucgccaauggcucccu

SEQ ID NO: 4110769 - RNA, 82 nt, Human
gggagggcccugggagcccgcguccugguggcggcacccccugugcucccacccagcgggggcucaccaccggccccuucuc

SEQ ID NO: 4110770 - RNA, 55 nt, Human
gggagggccugaggccaggugcaauuccccagggcugguccucacagguccuccc

SEQ ID NO: 4110771 - RNA, 90 nt, Human
gggaggggagcugugcacacggcggaggcgcacggcgugggcacccagcacccgguacacuguguccucccgcugcacccagccccuucc

SEQ ID NO: 4110772 - RNA, 62 nt, Human
gggagggggcgccgagagggagcugggagucucuccuccucuuuccuuuucgccucucuccc

SEQ ID NO: 4110773 - RNA, 83 nt, Human
gggagggguagguggaggaggugcugcaaggggucccaggccaagccagcuccccugcagcugcuugauucaucuugucucuc

SEQ ID NO: 4110774 - RNA, 80 nt, Human
gggagggguggggagugaggccgaggggagugugagggccuaaucuuggaugcagucccuggcccacuuuaaucucucuu

SEQ ID NO: 4110775 - RNA, 65 nt, Human
gggagggucugccaugcucccuggccucagcucaaccagggagaaagugaggaggacccuaucuc

SEQ ID NO: 4110776 - RNA, 104 nt, Human
gggagggugcuucccacucggggucuuugggaggccaguacuucugggaauccauagaggaggacaagagcaggccucucgaagcuucaguccagaacccaccc

SEQ ID NO: 4110777 - RNA, 66 nt, Human
gggaggguggugagcaguagcacuuuguacauuugaaauguucauuagcauuguugacauuuuccc

SEQ ID NO: 4110778 - RNA, 109 nt, Human
gggaggguucaguccguccuugagucugugcccuaugcuguccaaucucagguugacaccggcagcucaaggguuagauuccagcucaauacggaaacuuaaaacuccc

SEQ ID NO: 4110779 - RNA, 57 nt, Human
gggaggucauaauugguuuguaguaauuguuuuuacuuucccauagcauggcuuccu

SEQ ID NO: 4110780 - RNA, 82 nt, Human
gggaggucggcuguccauuccauaugagcuaagaggccucccugggguccuuggccuggguggggucucagccgcaucuccc

SEQ ID NO: 4110781 - RNA, 75 nt, Human
gggaggucuaagcaggcuuggcugcacgccucgcuccaguagaggagucagaugaagccaaaccuaagauuuccc

SEQ ID NO: 4110782 - RNA, 59 nt, Human
gggaggugaaaggucaugugugaguaagaauugaucaauaccugaaccaaucaccuccu

SEQ ID NO: 4110783 - RNA, 76 nt, Human
gggaggugccaccuggccagggucugggcugcuccaggaagacgguggcaggagaggacccggccaggggccuccc

SEQ ID NO: 4110784 - RNA, 65 nt, Human
gggagguggggaugggccgcagccccguccagagggggacugaggagcaaccccgugcccugccc

SEQ ID NO: 4110785 - RNA, 55 nt, Human
gggaggugugcaugugugucauucuccuagaguuuucaugagcugcucacuuccc

SEQ ID NO: 4110786 - RNA, 75 nt, Human
gggagguuagaaggaugagaacacucauugcagacugugaggagauagacaacuguucauuauucuucaucugcc

SEQ ID NO: 4110787 - RNA, 130 nt, Human
gggagguugcagcugacugcauggggugccaggacacuuggguccaugggcagcccccagugggcuggucaggggugcuagaguggggccacuuuccuggauccucuccaggucauaagcugacuucacc

SEQ ID NO: 4110788 - RNA, 86 nt, Human
gggagguugggagagagggggcgggcgacuccucgccgcgcggguuccuggcuggagcgcccuccucugcguccucccaaccuucc

SEQ ID NO: 4110789 - RNA, 64 nt, Human
gggaguaaacuauggugaggaugcgcccguuuuaucugcuuggacaucccaucugguuuuuccc

SEQ ID NO: 4110790 - RNA, 73 nt, Human
gggaguaguuucucaugcuguuucagugcuaucagcucacaaggaaucugcaaacaccacagagacaauuccc

SEQ ID NO: 4110791 - RNA, 97 nt, Human
gggagucaaaggcagccaagaaaguggcaccccuagggaaugagcagauggaucccugggccugccaccaucuuaggaaaucaggucucugaucccc

SEQ ID NO: 4110792 - RNA, 59 nt, Human
gggagucagagagguaaugggaacucacucauugguucucggccuacuaguugauuccu

SEQ ID NO: 4110793 - RNA, 74 nt, Human
gggagucaggagagaccuguucuccugggcccacugauuccuucccagggaaacaggaaguuuuucucguuccc

SEQ ID NO: 4110794 - RNA, 58 nt, Human
gguaggcagaucacugucuauggaaauccagaauacauggacaggaagacaaccuacc

SEQ ID NO: 4110795 - RNA, 102 nt, Human
gguaggcauuuacacaucagaugacacuaguucaacuuaauuucuauuuuuaaauuuuguaggaaacaaaguaaugcaacucagguucugugaaagcugacc

SEQ ID NO: 4110796 - RNA, 56 nt, Human
gggccucugccugaaagaacagauuuaccgaaugucuggucuggccaauaaggucc

SEQ ID NO: 4110797 - RNA, 61 nt, Human
gggccucuggccuaggccgggagagcccugauucucgccugucccugggccggagcugccu

SEQ ID NO: 4110798 - RNA, 76 nt, Human
gggccugaccuucucaguuucacugauaacagaguaacuaacacuugcugugauuuaugagauagagaaaaggucc

SEQ ID NO: 4110799 - RNA, 107 nt, Human
gggccugagguuccuucuagcuuuaacuuucuuugcaucuaaguuucguagcucaagcaucuggaauuccaggugagagaagguaugguagauugaacuguuggccc

SEQ ID NO: 4110800 - RNA, 83 nt, Human
gggccugcagcugcugccgggaggccuucaugcuggcugcaaagcgcaggagccgcguggcacccuccuggaggagcugcccc

SEQ ID NO: 4110801 - RNA, 59 nt, Human
gggccugccaggcuuucagcauuucuugugauuugucacaacuugagggcuuggugucc

SEQ ID NO: 4110802 - RNA, 71 nt, Human
gggccugccugcugccacccuggcuccgucccagcugugagccgugcgggaguuaggauggcuaggaaccc

SEQ ID NO: 4110803 - RNA, 79 nt, Human
gggccugccuguggcugccccgcuguuggcauccuacccagagccacaaugcuagugggccacagguacagauggacuc

SEQ ID NO: 4110804 - RNA, 62 nt, Human
gggccugcucuguuuagagggggugccaggguccugggucccucccucuguuagagcugucu

SEQ ID NO: 4110805 - RNA, 93 nt, Human
gggccuggaggaaauaagugguugcuuguuuucauucuuugagacucuaaagaaacagcauguuggaccauuuaacuuuuuacugucaggcuu

SEQ ID NO: 4110806 - RNA, 81 nt, Human
gggccuggggcuaacuugucuucaacaccuugucuagugaauaaaucuaguucaggaagagaaacaacagcccgcaggccu

SEQ ID NO: 4110807 - RNA, 89 nt, Human
gggccugggggcuguaggcggaguucacaguaucuagcgauggagcugguagguccugaggguucgucugcagcuuggaagacaggccc

SEQ ID NO: 4110808 - RNA, 61 nt, Human
gggccugucucacucccugguuugauccaagacccaggacucuuuccagggugggcggccc

SEQ ID NO: 4110809 - RNA, 56 nt, Human
gggccuuagagaucuuuuguuuacccucuuuuacacaaauggagaaacugaggccc

SEQ ID NO: 4110810 - RNA, 88 nt, Human
gggccuucugauggcacagccuguucucuucccaguuugcuuauggcaagacgagggcccccaggacagcaaugccgauggauggucc

SEQ ID NO: 4110811 - RNA, 61 nt, Human
gggcgaaggccagggucccacacucgcagcgcugcgacggcgcucgggaccucccucgucc

SEQ ID NO: 4110812 - RNA, 86 nt, Human
gggcgccgugcguccugggcgcguccccugaggcggaggacggucguccggcgggaggacgcguccagggggagcgccgcaggucc

SEQ ID NO: 4110813 - RNA, 76 nt, Human
ggugccaccagaugcuguugcuacuaccacuggcaaaguuuaaggguaaaauagcauaaaguuucugugugguucu

SEQ ID NO: 4110814 - RNA, 81 nt, Human
ggugccagaauucauacucuauauugcuuuugcaccauuagugcaaaugucaacacaagagaaaugcaaauuauugguauu

SEQ ID NO: 4110815 - RNA, 66 nt, Human
ggugccagagaaagguuugauucauuuggaaaacaguucuuagucucagugaccuuuucugccgcc

SEQ ID NO: 4110816 - RNA, 83 nt, Human
ggugccagcagaguguacaggaggccacauuggaagacgauggucuuugcugucuucuuaccuuucuguaugcucccugggcc

SEQ ID NO: 4110817 - RNA, 61 nt, Human
ggugccagcugcugugaggaccacagggauuuucuuuuccuguguuugaugagaagccacc

SEQ ID NO: 4110818 - RNA, 64 nt, Human
ggugccauccugagaggucucucuaccaugaguggucuguagguagugaguucaggagggcagc

SEQ ID NO: 4110819 - RNA, 55 nt, Human
ggugcccagagccaggaaugagccgccuguggugauuccugugugucuggagucc

SEQ ID NO: 4110820 - RNA, 56 nt, Human
ggugccccaucgcggguggcuggcucaaggagguggacgccgacuuuggaggcgcu

SEQ ID NO: 4110821 - RNA, 72 nt, Human
ggugccccgccuucuguccaaccccacgauggaugccagugcuggaaagggacggaggaaugcaugggcacc

SEQ ID NO: 4110822 - RNA, 70 nt, Human
ggugcccugagaaagugaggguuaaacauugauucaggugucagugauaacucucaguuucucaugaacc

SEQ ID NO: 4110823 - RNA, 109 nt, Human
ggugccuaaggcagcaaggugaaucugggccccaaaguucucggcucaaguccuggucuaccacugacuugccugggacuucagguacaucacuuucugucuuggcauu

SEQ ID NO: 4110824 - RNA, 62 nt, Human
ggugccuccuaccacacccucagucugugauauuccagccaggggaaaugggggaaggggcc

SEQ ID NO: 4110825 - RNA, 89 nt, Human
ggugccuguugugcgucuguugcugggccuuuaccuccagggauucuaccucccuggguucuggcugggcugcacgcugauggggaacc

SEQ ID NO: 4110826 - RNA, 80 nt, Human
ggugccuugcuacauguauacauaugaaugucagccaucaaagaaaaugguagcuuaggaugaaugcuguagaauggccc

SEQ ID NO: 4110827 - RNA, 71 nt, Human
ggugcggggccuccccaggggugucaugagggaaugaagagaccccacggagccuggggaggcugcgcucc

SEQ ID NO: 4110828 - RNA, 126 nt, Human
ggugcuaggcugggagcugcccugagagcugggaugcccaccaaggcccacagaacugucuccaggcccuuguagacagugggaucucugggcugauuucugguuggggucugcuccuaccccacc

SEQ ID NO: 4110829 - RNA, 70 nt, Human
ggugcuccucucagcuuuguagucuucucuaacucauccagcagccacagggccaggugagaggugcucc

SEQ ID NO: 4110830 - RNA, 81 nt, Human
ggugcugaaccauuucugaauaguuuguuccuuggcuuuuaaauugguaucuggacagaaauuagcagugaguuuaguguc

SEQ ID NO: 4110831 - RNA, 76 nt, Human
ggugcugagauuguaguggaacacucaucaguggggucagggcuccugcugagauggccacugggucucaugcucu

SEQ ID NO: 4110832 - RNA, 97 nt, Human
ggugcugagauuuugauugacugggaggggaggcauggaagcucuuguaccacaggcugcuugcucaacccccgucucucuucagagcuuucaagcc

SEQ ID NO: 4110833 - RNA, 118 nt, Human
ggugcugagcccccaccacaccuuuccagcuuuugcacuggacugggaaugaguuuucaccugcucauucccaguccagugcaagagcugaaaaguuaaauucaccacagccagcacc

SEQ ID NO: 4110834 - RNA, 61 nt, Human
ggugcugaugaguuaggagaggucaucaaaggugauauuuggccaaacccauuauaguacu

SEQ ID NO: 4110835 - RNA, 110 nt, Human
ggugcugcuuaucugguguuggugucucugagcuuagagaaaggaaccuauuugccuauggcuagggaaccucuucugaggaagagcuacuagcaacugguaaaagcauu

SEQ ID NO: 4110836 - RNA, 63 nt, Human
ggugcuggaggggguuguuggugccaucguugcagaccuacucacaucugccuccauagcacc

SEQ ID NO: 4110837 - RNA, 79 nt, Human
ggugcugggagaggagaaggaggccccucacacucucgaucaaggguguuuguucauccucucuucucuccccgccacc

SEQ ID NO: 4110838 - RNA, 59 nt, Human
ggugcuggggaccuaaaggcuuuggccccugagcagguuggagguggguccccgcagcc

SEQ ID NO: 4110839 - RNA, 72 nt, Human
ggugcuggugaauucggugauggcacauagcuaagcaauuggcauguuucauggcugcaaaccaccugugcc

SEQ ID NO: 4110840 - RNA, 101 nt, Human
ggugcugucugggaaccgucagugcuagguuguguccaggagccaucaguauccuguuguauuuggaaaccaccagugccaggcuguuuccuggcugcuuc

SEQ ID NO: 4110841 - RNA, 102 nt, Human
ggugcugugguucacaccuguaaucccagcauuucaggaggcugaggugggaggaucacuugagcccaggagucugaggcuacagugaaccaugauggcacc

SEQ ID NO: 4110842 - RNA, 69 nt, Human
ggugcuuccaggccuccaugaaggguucauuggcagcagaggacgggcuucauggggccucucagcauc

SEQ ID NO: 4110843 - RNA, 97 nt, Human
ggugcuuggcuugcaagggguuaacaguauugcucaugaacuuggccugucugucuggcucgugaugaauggugagacccgcugacaaguucagccu

SEQ ID NO: 4110844 - RNA, 80 nt, Human
gguggaaacuucucugugggggagaggcagcugcucugcauugccagggcugugcuucgcaacuccaaggugaggccacc

SEQ ID NO: 4110845 - RNA, 70 nt, Human
gguggaacaauuauauuuagaaugauacagugaaaaaauuaauguauuuucugaagauaaucaagucacu

SEQ ID NO: 4110846 - RNA, 79 nt, Human
gguggaagguggggcuuugcaggcggcacccuggccagugggcucagugguguggcuggcagaguuuacuucuugaacc

SEQ ID NO: 4110847 - RNA, 76 nt, Human
gguggaauaaauggguggauggauagauguauggaugaauaaauccauacaucuggauguaugcauuuaaugaacc

SEQ ID NO: 4110848 - RNA, 102 nt, Human
gguggaauugagguggagcaaguccgugagucugugggugggaacugccuccuccacuaugccccucucagccaugggcuccuauugucaccagaaaucacc

SEQ ID NO: 4110849 - RNA, 73 nt, Human
gguggacaaggagaugugcacaucggagagcuuugggagcucuuuggaaggugugcacuuucucccuucuccc

SEQ ID NO: 4110850 - RNA, 87 nt, Human
gguggaccugacaugggccuugcugcacuuuggauuuagacaaaccaaauccacagugcagcaagggcccaugucagcuuugaaacc

SEQ ID NO: 4110851 - RNA, 126 nt, Human
gguggagagaagaaggcauauguuugacuggcuccugauuacgauguuuuggauguugccaaaaaauugguaucaucuaaauugaguccagcuggcuaguucuaaauauacguguaucuuuucacc

SEQ ID NO: 4110852 - RNA, 61 nt, Human
gguggagaggugaauggcugcucuagauagaauguuuacacgucauucuccucucuuugcc

SEQ ID NO: 4110853 - RNA, 107 nt, Human
gguggaggggcaucugagccaggccucagagaguggcgggggaaguuggguggggaagugugcccuucucauuccucugaggcucauccucuuggugccucucuuuc

SEQ ID NO: 4110854 - RNA, 65 nt, Human
gguggauagccuuggcuuugggcaguuagcuggagcaccagccggcaagcugagggcuguccacc

SEQ ID NO: 4110855 - RNA, 67 nt, Human
gguggaucagucauauccaaauuagcagcuuucuauuauccugcagggaaucuguggcuggacuacc

SEQ ID NO: 4110856 - RNA, 70 nt, Human
gguggauggcaagcacaugagcuauucaugcucauuucuggguguuauggauggaauguguguguccacc

SEQ ID NO: 4110857 - RNA, 75 nt, Human
gguggauuaaaaguuuaggcuuugaaaccagccuaucuagguuuauuuucuaguauaagcuucaguuuucucauc

SEQ ID NO: 4110858 - RNA, 60 nt, Human
gguggcagaguugagauuugaacccaggcaaaccuggcucuagaguccaggcucuucacc

SEQ ID NO: 4110859 - RNA, 92 nt, Human
gguggcaucauauaggagagcuuggaaagcuauggcugucuagcaucaagucucagauuuccaucuuuuucaugugcuuggagaaugucacc

SEQ ID NO: 4110860 - RNA, 81 nt, Human
gguggcauccuguccauggauagagcugcucgugccccuuguggccugugaacgcaguuccauggcaguggugguguugcc

SEQ ID NO: 4110861 - RNA, 60 nt, Human
gguggccuggcugggguagaagugagggucauccucuucucaacuccagccagagcagcu

SEQ ID NO: 4110862 - RNA, 80 nt, Human
gguggcgccgggugacgccaggugaugccggggcugcgcggguacugcagccuuccguggaccuggacacgcgugcaacc

SEQ ID NO: 4110863 - RNA, 95 nt, Human
gguggcgggcgccgucccuaccuggcagcugcgcuccagguggcugucccacgccggucuccgcgccugcccggugcgcggguggcguccgcucc

SEQ ID NO: 4110864 - RNA, 69 nt, Human
gguggcgguuugcaaacuuuuucuauauagggccagauaguaaauauuucagguuuugcaggccgcccc

SEQ ID NO: 4110865 - RNA, 66 nt, Human
gguggcuaaggugucccucuugcuggagaggguuuucuccaagggcucauggacacuuuucucacc

SEQ ID NO: 4110866 - RNA, 55 nt, Human
gguggcucacaccuguaaucccaggccuuugggaggccaaggcggguggaucacu

SEQ ID NO: 4110867 - RNA, 55 nt, Human
gguggcucacgccuguaaucccagcauuuuuggaggccaaggcaggcggaucacc

SEQ ID NO: 4110868 - RNA, 92 nt, Human
gguggcucuuugcccugucucacuauguuaagugaccaccaauuacugucugcacuuaacacaggaggcaagguaaccuggagagcaccacc

SEQ ID NO: 4110869 - RNA, 79 nt, Human
gguggcuggggugaggcagguggcugcugaggagcaagagggaucuacaguuguccccugcccuaugagaagggccacc

SEQ ID NO: 4110870 - RNA, 67 nt, Human
gguggcuguguucuaggagcaaagagucuacuagaacaaggcagaaagcuaccagaacaaggccauu

SEQ ID NO: 4110871 - RNA, 103 nt, Human
gguggcuuuaauuuuccugccuaacguuggucucuggucucuguacaaggauaagcaccuggugaagucagcggagcccggggagcagcagguaagugccacc

SEQ ID NO: 4110872 - RNA, 62 nt, Human
ggugggaaccgggucuccccagggugccgugaagucucugagggccgggacccaguuucucc

SEQ ID NO: 4110873 - RNA, 71 nt, Human
ggugggaacugugucagcaccgggguagacagaagucaaggaacuucuguggggagcugaucagaucagcc

SEQ ID NO: 4110874 - RNA, 110 nt, Human
ggugggaagacagggugcagccauugcccaguugggccccagagguccaggcccuccccaggguuagccuuggccugggguccaggcuugauggggucccuguccccacc

SEQ ID NO: 4110875 - RNA, 90 nt, Human
ggugggacccaaauguugagauuacuaugaacuaguggaaagaaaauuuuaccaggaguagaauaucugugaccaggguuuggucccauc

SEQ ID NO: 4110876 - RNA, 57 nt, Human
ggugggagaagaaccaucauggcuaaguagauggagucaggaagagcuucucccacu

SEQ ID NO: 4110877 - RNA, 58 nt, Human
ggugggagaagcccuguucguaguauuuguugaugcccauaguguaaauucucccauc

SEQ ID NO: 4110878 - RNA, 56 nt, Human
ggugggagaugggggagaggugguuuucaaugguuaauucuucuaccucuaccacu

SEQ ID NO: 4110879 - RNA, 100 nt, Human
ggugggagccaacacccuucugauggaaggugggagccaacacccuucugauggaaggugggagccaacacccuucugauggaaggugggagccaacacc

SEQ ID NO: 4110880 - RNA, 65 nt, Human
ggugacugggaggugaacagaaaaacuaagaaagacuuaguuuuuccuuauauauccuuugcacc

SEQ ID NO: 4110881 - RNA, 70 nt, Human
ggugacuggggcccgagccuugggccagcugcaggcggggugguagguggggucgguguuaccagugguc

SEQ ID NO: 4110882 - RNA, 95 nt, Human
ggugagagcugguggguagacucuuggagaagagcuauauauucucauacccggaaauauagccggcccuuccaagagcaccccaucacucaacc

SEQ ID NO: 4110883 - RNA, 129 nt, Human
ggugagagcuguaaguagaguguggugauggaguccagcaggggaacugugggccagcuugacucaggccgguuucaggaacuccugcagcauguuuuguuccacagccuccaugaagagcucaaagcc

SEQ ID NO: 4110884 - RNA, 69 nt, Human
ggugagcagaggcagaggaagguggucucucggggacagugucugaggacuccguucugucugcuuguc

SEQ ID NO: 4110885 - RNA, 70 nt, Human
ggugagcauggagggaggacccccaacaccucagagaccugugcugcagggccuucccugcaugagcagc

SEQ ID NO: 4110886 - RNA, 90 nt, Human
ggugagcucuuugauuuuuguuucugauccgaguuaaucauuuauucaugagcauuugaaaauuagacacaggcuaauugaaagcucauc

SEQ ID NO: 4110887 - RNA, 70 nt, Human
ggugagcuuaauugagcugaguuuaaaagcugcucugaacauguccagaaagccagcucugagcugcacc

SEQ ID NO: 4110888 - RNA, 65 nt, Human
ggugaggaaggaaggaggaaugagugacuauaaggaugguuaccauagaaacuuccuuuuuuacc

SEQ ID NO: 4110889 - RNA, 84 nt, Human
ggugaggaauaagccaggugggaaggcagcaccugagaucugccucccucagccugcaggccucacaccuggcaccuucucucc

SEQ ID NO: 4110890 - RNA, 68 nt, Human
ggugaggcagagggaguaaccuuuggcgucaacagaaaagccacuagguuuccucuucuuuucuuccc

SEQ ID NO: 4110891 - RNA, 105 nt, Human
ggugaggcaggugcccuggggcaggcgcacagucaccugcucagguguccgggacacuagugugaagcuguaggcaugggcagcgugcaccagggcggccucauc

SEQ ID NO: 4110892 - RNA, 56 nt, Human
ggugaggggcuccucugcccggccgccccuacugggaagugaggagccccucugcc

SEQ ID NO: 4110893 - RNA, 59 nt, Human
ggugaggguggaagcagaggugguucaaugacuuuccacaaagguuccauucucucacc

SEQ ID NO: 4110894 - RNA, 73 nt, Human
ggugagguuuacaaacuuguuuuaaguaaguguucauuaauucugaugcacucaauguuugagaaccacugcc

SEQ ID NO: 4110895 - RNA, 59 nt, Human
ggugaguagcaggcccugaaauuauucuggcauccuuggauaauuuacccugcaccacu

SEQ ID NO: 4110896 - RNA, 75 nt, Human
ggugagucuagguagagaaaugcaagcucagaagugugcugcaaguaguuugccuuccuccgcgccugacucacc

SEQ ID NO: 4110897 - RNA, 61 nt, Human
ggugaguuucaugguuguuuacagucaccaagaagugaauauacaaucauagaaacucucu

SEQ ID NO: 4110898 - RNA, 92 nt, Human
ggugaguuuccugggccuuguuuuggaccagcagccccagugccuccuuucagagccuagaaggcugggucugcagagccugggaaaguacc

SEQ ID NO: 4110899 - RNA, 65 nt, Human
ggugaguuuucugcuaaaccagcuaaagggagauuugcaccucuucuugccagcagaaacacgcc

SEQ ID NO: 4110900 - RNA, 60 nt, Human
ggugauagaaaaugcugucaagcugauucaugaaauaauauuagcauacagcucuauccc

SEQ ID NO: 4110901 - RNA, 61 nt, Human
ggugaucaggcuaacuguauucuacagauccuaucucuuuaaacuucaguuucugaucauc

SEQ ID NO: 4110902 - RNA, 96 nt, Human
ggugaucauauauaauuuauuauccacacugggauguuuugagauuaaauauauguucuuaauaauuacacugggauaacagacuuaagugaugcc

SEQ ID NO: 4110903 - RNA, 94 nt, Human
ggugauccaagggccugggagcuggccucaggcacaggagggcugcuccaacccagccucaggucaggccagcuccuugaggcccugguacacc

SEQ ID NO: 4110904 - RNA, 88 nt, Human
ggugaucggguucccagaccugucuauaaaagugaauacacugugggcuggauucacuuuuauagauaggucugggaacccaaucacc

SEQ ID NO: 4110905 - RNA, 71 nt, Human
ggugaugaauguauuuaauacauugauuguggugaugauaucacagguguaugaauauguuccaaauuauc

SEQ ID NO: 4110906 - RNA, 88 nt, Human
ggugaugcaucaggacacuuagcugagggugcagaugugcugagagccacagcuggagcuucaagcagguaaacccugaaagcucacu

SEQ ID NO: 4110907 - RNA, 83 nt, Human
ggugauguaauacauauggaauuccauguugguucaguacaagugggaaaggaaagaacauuauuccaucuguagcaucuucc

SEQ ID NO: 4110908 - RNA, 57 nt, Human
ggugaugugacccagacccucaugucugagagggcugagcuccuggucacaauuauc

SEQ ID NO: 4110909 - RNA, 84 nt, Human
ggugauuaauauauuucaggauuaguuuaagcagggcucuaccuccugcccagucaaguauguucugguuaauauccaauuauc

SEQ ID NO: 4110910 - RNA, 71 nt, Human
ggugauugagggacuuucucuauuauucggcuuugaagugccacaguucagggggaaauguccuucccgcu

SEQ ID NO: 4110911 - RNA, 81 nt, Human
ggugauugggcuagggaaugaaugauucguaaucaaagcuccguuugaauaagaacaguguuucaucucuaaacuaucacc

SEQ ID NO: 4110912 - RNA, 86 nt, Human
ggugauugucccacugucugucaucagggauauccugacuaaaagaagggacaggauugugucuuggucacagagggaucaucacc

SEQ ID NO: 4110913 - RNA, 75 nt, Human
ggugauuucaaauauagagugagauuugauaacuugugaugaaggacuuuuuauugcuaugucuugauugucacc

SEQ ID NO: 4110914 - RNA, 75 nt, Human
ggugauuucuaaggugauccuuucuuagucuguuccaaggggacuuaagaaaaucuggaucuucugggaaauccc

SEQ ID NO: 4110915 - RNA, 103 nt, Human
ggugcaaauacauuucuuugaaucaaaguucuauaucauaauaauuuuucucuauuacagauagagguguuguugauauagaaguuugggaugaauguguacc

SEQ ID NO: 4110916 - RNA, 58 nt, Human
ggugcaaucugguuaauacgacucaggagagggacugaucuuugaucugauugucauc

SEQ ID NO: 4110917 - RNA, 77 nt, Human
ggugcacagauugauguauuaugaagacaauaaaggacugucucauaaugaacaauauaucaauagccugugacauc

SEQ ID NO: 4110918 - RNA, 72 nt, Human
ggugcacugguacacugaauggcguucaaaguuggugaauuugcuggaaaugccauaaagguaccacuggcc

SEQ ID NO: 4110919 - RNA, 57 nt, Human
ggugcagaucuuucucuucaggggcccagcagugacuucauugaggaagaucuggcc

SEQ ID NO: 4110920 - RNA, 55 nt, Human
ggugcagcugcagccugggagcucauaucagagucuaucguaaagcagcuuuauu

SEQ ID NO: 4110921 - RNA, 63 nt, Human
ggugcaucccuggugauccaagguaaguguuuuacugcuucauauagggauguaauaauuacc

SEQ ID NO: 4110922 - RNA, 63 nt, Human
ggugcaugauguuaaacaucagguacauuugcgaugaccgaugucuaauuuuauguuucaacc

SEQ ID NO: 4110923 - RNA, 92 nt, Human
ggugcauugguugagggaagauagaugucaucagcauauauuugcaaaugaacuaugugccggugaccucuaccuucccucaaccucugccc

SEQ ID NO: 4110924 - RNA, 57 nt, Human
ggugccacucauucagcagguccugcuaaugccggaguguuggaccgagguggagcc

SEQ ID NO: 4110925 - RNA, 56 nt, Human
ggugccagaaaacuugaagaguggcucuggccagcucucugggcccaguuggcacc

SEQ ID NO: 4110926 - RNA, 72 nt, Human
ggugccagacagacaggagcucacaggcagcuggugccccgcugucaaggaaaaagccuguuuaucuucacc

SEQ ID NO: 4110927 - RNA, 72 nt, Human
ggugcccagcugcugucuuugaauggauggaaacccaaccccauugugcagggauaaugcagcugcgacacu

SEQ ID NO: 4110928 - RNA, 78 nt, Human
ggugcccaucugcuauuaugucuccagugcccagcacacuccagugcccagcacagaaccagacaugaggcaggcauu

SEQ ID NO: 4110929 - RNA, 59 nt, Human
ggugccccgagcgcgugccggacgcugguguuggcucuggcggccaugcucguggugcc

SEQ ID NO: 4110930 - RNA, 121 nt, Human
ggugcccuuauagcaugagacuccagagagcugccccauccaccaugugagggcacagccgacagacggccgccuguggaccaggaggcagcccucuccggacgccaaaucugccggcacc

SEQ ID NO: 4110931 - RNA, 92 nt, Human
ggugcccuugauccucagugagccucaucagguggggaugaguauucgcucuucuugccugaugaggcagcugagccuucgacagggggacc

SEQ ID NO: 4110932 - RNA, 59 nt, Human
ggugcccuuuguagaauucaguuggcuucugggcacagcaggcacuauacagggcagcc

SEQ ID NO: 4110933 - RNA, 88 nt, Human
ggugccguguuauucuggucaugaugaguucuuuucaaacagugauucaggacaagaaaugcucuuccugaccagaacccacauuacc

SEQ ID NO: 4110934 - RNA, 69 nt, Human
ggugccguugaggaaguaacugccuuaucuuuccaugaccugcaauugccaugcuccugagauggcgcu

SEQ ID NO: 4110935 - RNA, 55 nt, Human
ggugccucagccagggcaucugaugacuacacuugcagaagauggucugagcacc

SEQ ID NO: 4110936 - RNA, 90 nt, Human
ggugccuccccauccauggcugucacgccacugugagguggauggagaaugcccacuguggcagcacaguccacaggacggggagguguc

SEQ ID NO: 4110937 - RNA, 66 nt, Human
ggugccucccuguugacuaggguuaaggcaacaguaggaacccuccuggccaagagggcugguauc

SEQ ID NO: 4110938 - RNA, 73 nt, Human
ggugccugccugggcucacuugccagcauccugcaauuagagagggaccuggccagccucccagguacccgcu

SEQ ID NO: 4110939 - RNA, 60 nt, Human
ggugccuggggaucagcagaaugggacucuguucuggcucucucaucacccaauggcauc

SEQ ID NO: 4110940 - RNA, 79 nt, Human
ggugccuguaaucccagcuacucgggaggcugagccaggagaaucgcuugaccucgggagguggagguugcagugagcc

SEQ ID NO: 4110941 - RNA, 86 nt, Human
ggugccuucccacccggccucucccagccugugcucccuccugugagcagcugguaggaguggccacuggguggcgugugggcacc

SEQ ID NO: 4110942 - RNA, 63 nt, Human
ggugcgaggcacugcgcccggcaguaaucagacuuuuaauacaccaaugcaguaucucguucc

SEQ ID NO: 4110943 - RNA, 78 nt, Human
ggugcucuuuuaguuauugcacagaauuaguaccaaaaaacccucaauauauuaauuuuccaacagcugaauuguacc

SEQ ID NO: 4110944 - RNA, 69 nt, Human
ggugcugacuucacagucuuacuaugucagacauaacgauggcauugggcguuguagaggguuagcacc

SEQ ID NO: 4110945 - RNA, 71 nt, Human
ggugcugacuuugcucauaggucaaauuugccuucaauauuucaagauggugaccagcagcagucagggcc

SEQ ID NO: 4110946 - RNA, 93 nt, Human
ggugcugaggcuacauccaggguugguauucaccuggaaaacacccgcauggcuggcguccuggucagugccaaacugguguccuuauguacc

SEQ ID NO: 4110947 - RNA, 72 nt, Human
ggugcugauuuuuccucuuuauucugagauagcaaguggcaugcaacagaauaugaucggaauacagauacc

SEQ ID NO: 4110948 - RNA, 86 nt, Human
ggugcugcugguuuuuagugcuuaggaguuggccauguuaaauuucccacaccacaaguaacucuuuuccagaagccaguggcauu

SEQ ID NO: 4110949 - RNA, 61 nt, Human
ggugcugugugagcauuacuggcugaccgacucuaccccggucacccaugaucacaucacc

SEQ ID NO: 4110950 - RNA, 82 nt, Human
ggugcuuggcuauggcagggacuguggcccuugggaccacugcucucaccagguggccaccucuaugcugccaagacucacc

SEQ ID NO: 4110951 - RNA, 78 nt, Human
ggugcuugggguaucauuaaauauaagcuucacaauuaguucugauugaugcuacaucuuaauggguuccacaguacu

SEQ ID NO: 4110952 - RNA, 60 nt, Human
ggugcuuuucuucaugguuuuuguagcuuuguguugugagguuaucaucaguugagcacu

SEQ ID NO: 4110953 - RNA, 103 nt, Human
gguggaagaggggacaggaaggaaauuuagcuucuuuauuuucauuacauccaaugugauucucaaagguagacugggucugauucuucccccaucuucugcu

SEQ ID NO: 4110954 - RNA, 94 nt, Human
gguggaagcaccauucuccauuuccaaaacuaucggguacuuugcuaaacaauggaaaauguaccuugauaguuuggucucugaagcucccacu

SEQ ID NO: 4110955 - RNA, 107 nt, Human
gguggaauagagguacaauugggagauccugaaguaucuauggauauaagauuagaauauacuuauauuguacuuugauugucucagugaauucaucaacacacacc

SEQ ID NO: 4110956 - RNA, 67 nt, Human
gguggaauuucucauguacaaaaacacuguaacacaagaguguacuucuacaaugagaaguaucagc

SEQ ID NO: 4110957 - RNA, 61 nt, Human
gguggacagggcugugugggacccagagcugagaagggagucaccagcagcagcugccacc

SEQ ID NO: 4110958 - RNA, 70 nt, Human
gguggacaguggaaaucagagugagaguauauggcuguagauucuauaauucuuuuuccauuguaccacc

SEQ ID NO: 4110959 - RNA, 57 nt, Human
gguggacaguguuagcucuggguuccaguuccacaccagguuaaacaaauuucuacc

SEQ ID NO: 4110960 - RNA, 63 nt, Human
gguggacuuugggggauaaugaggugucaguguugcuucaucaacucuaacaaauguaccacc

SEQ ID NO: 4110961 - RNA, 83 nt, Human
gguggagaccgcaagccucucuuuauucccagcuaccgaauucaugguggcuuuuccagaggagaguaucuaaagguuccacc

SEQ ID NO: 4110962 - RNA, 70 nt, Human
gguggagagcuggaugagaggugcgacgaacucacaggugauguucacagccaucaccaagcucuucccc

SEQ ID NO: 4110963 - RNA, 61 nt, Human
gguggagaggccauccuaccaccacggaccucuccaguggccggugggugaccuccccacc

SEQ ID NO: 4110964 - RNA, 76 nt, Human
gguggagcuggggauccugagcugcacugguuccaauuuggggcugugcagagcacagggucccugcagcaccccc

SEQ ID NO: 4110965 - RNA, 75 nt, Human
gguggagcuucccagggccaguucagaggacaugggacagcaccguggucuaaagcccagguccuggacuccacc

SEQ ID NO: 4110966 - RNA, 57 nt, Human
gguggaggaaauagagcucucagcaccacccugcugagcccaguuuucccucuugcc

SEQ ID NO: 4110967 - RNA, 55 nt, Human
gguggaggggccacacucggggccgacuggccgccugguuuguauuuuuaacacc

SEQ ID NO: 4110968 - RNA, 80 nt, Human
gguggaggggcugacaccacccaggcgcagaggcagggcucagggccugcucugcagggagguuuuagcccagcccagcc

SEQ ID NO: 4110969 - RNA, 111 nt, Human
gguggagucucgcccugucacccaggcuggagugcuggagugcaguggcgugaucucagcucacugcaaccucggccuccugaguaacugggauuacaggcgugcaccacc

SEQ ID NO: 4110970 - RNA, 64 nt, Human
gguggaucucagagagcuguguuuuccuccaaucuuggaaggaaggcacccucugaaugucacu

SEQ ID NO: 4110971 - RNA, 72 nt, Human
gguggaugggagaugggcagauaaucuucacucagaucuaaacauggauuauuugugcauaucccauccacc

SEQ ID NO: 4110972 - RNA, 55 nt, Human
gguggauugcccaugacagauuauuugucuaaacuggcuucauuugcaacccacu

SEQ ID NO: 4110973 - RNA, 71 nt, Human
gguggcacagcccagagcucuugacguuuauuuucucaggcuucagugaaccuucuguggcagguguuucc

SEQ ID NO: 4110974 - RNA, 57 nt, Human
gguggcagaggaucaggcucuggaaaucuguggucuuccuccuggucuuuuggcauc

SEQ ID NO: 4110975 - RNA, 61 nt, Human
gguggcaucaccugguaucaagccgcagggggacacuucccaggcucagggcgcugccgcc

SEQ ID NO: 4110976 - RNA, 64 nt, Human
gguggccagugugcaggucagagauuaaacugguuugaucuucaguuccuccauugagacuacc

SEQ ID NO: 4110977 - RNA, 66 nt, Human
gguggccucugcaggccucgacaaggcccagccuccugccucccgaaggccugcacaggcccagcc

SEQ ID NO: 4110978 - RNA, 65 nt, Human
gguggcggccuccccgggacugugcacucuugcaggcggccguauuuccuggggauguggucacc

SEQ ID NO: 4110979 - RNA, 55 nt, Human
gguggcucacgucuguaaucccagcacuuugggaguccaaggcaggcggaucacc

SEQ ID NO: 4110980 - RNA, 55 nt, Human
gguggcucaugccuguaaucccagcaguuugggaggccaaggcaggcagaucacc

SEQ ID NO: 4110981 - RNA, 55 nt, Human
gguggcucaugccuguaaucuuagcacuuugggaggcugaggcgggcugagcccc

SEQ ID NO: 4110982 - RNA, 69 nt, Human
gguggcugcaggaguuauucaaaccuagccugggcagaucuggcugaaauucagaguaaauuccccacc

SEQ ID NO: 4110983 - RNA, 60 nt, Human
gguggcugggagcaacuugggaagggggaaauccccucuggccuuaucuguccaagcccu

SEQ ID NO: 4110984 - RNA, 67 nt, Human
gguggcugguuuuauaagagguuaacugcuucucaguuugagcaagacucauguggcaccaggcacu

SEQ ID NO: 4110985 - RNA, 122 nt, Human
gguggcuguuggaacuggccuaggucaaacacacuugggauuaggggcuaggucacacacacaaaugaugaagcccagcuccauucuuggugagcuuugugaccugggcagauugcuucacc

SEQ ID NO: 4110986 - RNA, 77 nt, Human
gguggcuuaggguugguggcguuggaccugggcagagaucucccuccaggcaggcagcugucaccacucggugcccc

SEQ ID NO: 4110987 - RNA, 76 nt, Human
gguggcuugcucuguggcucccgugccuggccucugcugucaugucaggaggccugggagcuguggaaaggcuguc

SEQ ID NO: 4110988 - RNA, 59 nt, Human
gguggcuuucuaaaccaaaugucuguccugaccccuguuuuggugcuggaaaugccauu

SEQ ID NO: 4110989 - RNA, 58 nt, Human
gguggcuuugcucuguaggacccuccagggcaggguuugugcagaagacaaaguggcc

SEQ ID NO: 4110990 - RNA, 59 nt, Human
gguggcuuuuauguuacuguuaguaucacacuguguacagaggggacauggaagacacu

SEQ ID NO: 4110991 - RNA, 60 nt, Human
ggugggaaggccacugaagguuagugcauucucauacaaaacucccagugccuucccagc

SEQ ID NO: 4110992 - RNA, 88 nt, Human
ggugggaaguggcaguggggagggaggugggucccagggaacguggguuaacuuuggggacacuucucuuuccccgucucuccccuuc

SEQ ID NO: 4110993 - RNA, 127 nt, Human
ggugggacaggagcccagcguguaggggaggaauaaaagcuguggucaggcuuggaccgcgaccuccauggcagccuggccuggcuuugucacgguccuuuaaguuauccugcauuccguucccacc

SEQ ID NO: 4110994 - RNA, 68 nt, Human
ggugggagagaaaaaagcagaggaagacauuuauagaucacucuuuaacucugucauucucuuuaacu

SEQ ID NO: 4110995 - RNA, 58 nt, Human
ggugggagcagcuuaugucaagccagaagggauucucugaaggggagcuguuuaagcc

SEQ ID NO: 4110996 - RNA, 57 nt, Human
ggugggagggucuaugauggguaguggggguagaggccuguagauccuugagcuacc

SEQ ID NO: 4110997 - RNA, 56 nt, Human
ggugggcacccgagacuggaucgagggggagaccuaccagugcagggugacccacc

SEQ ID NO: 4110998 - RNA, 68 nt, Human
ggugggcuggacuucaugcauuccugucauuacuguaggauggaaaugcuccaggaguccaacccauc

SEQ ID NO: 4110999 - RNA, 70 nt, Human
ggugggcuucuugggcaauuucucuagaggucauccaaggugaaacccucugugucuccaagaggccucc

SEQ ID NO: 4111000 - RNA, 93 nt, Human
gguggggacaauaagaaaagaggaggcagaggacugaggaggucagacaacucuugagagagaugccugcucuuuauuuuaugaucccauucc

SEQ ID NO: 4111001 - RNA, 76 nt, Human
gguggggagggaggggagcuccacccucgcgcaccguccgcagaggcugaaucaggaggccccuuccccaaccacc

SEQ ID NO: 4111002 - RNA, 78 nt, Human
gguggggaguggcuggcauggccagugcugggagugauguccacccuguuccuggcccugcugacuccucuccugacc

SEQ ID NO: 4111003 - RNA, 55 nt, Human
gguggggccguggguccauucuguguggacaggggcaagggcucacggcccagcc

SEQ ID NO: 4111004 - RNA, 55 nt, Human
gguggggcugcaagcaguucggaguagucagggcccuggcgcuggaagccucacu

SEQ ID NO: 4111005 - RNA, 88 nt, Human
ggugggggaauggaggccagugaaaguagauucaguuucuaaagaaauccaucagucaacauuuauucaagccucuuaaaucuucacc

SEQ ID NO: 4111006 - RNA, 65 nt, Human
ggugggggcagguacugggaugccucuguggcugguccagaggugacccauaguaccucuucacc

SEQ ID NO: 4111007 - RNA, 56 nt, Human
ggugggggcauauccuauccucccuggcagcaggauaggguggggacguucugacu

SEQ ID NO: 4111008 - RNA, 59 nt, Human
ggugggggccuguaaucccagcuacucaggaggcugaggcagggagaauagcuugaacc

SEQ ID NO: 4111009 - RNA, 101 nt, Human
ggugggguauagaggggucagucaucuucaguacucagguuaaaaggaagcccuuccucucugaaagcuagaaaaugcucuccuaucccuuucacuucacc

SEQ ID NO: 4111010 - RNA, 68 nt, Human
gguggguagaggccagggugcugugacacucuuuuacaaugcauauuacaagcucugccucucccacc

SEQ ID NO: 4111011 - RNA, 58 nt, Human
ggguuucuggucugugugauggagggcagcgugaacccaucacuggagaaggaaaccu

SEQ ID NO: 4111012 - RNA, 61 nt, Human
ggguuuggauguguagugaggggagggccagccuccuccugugcacugggaucacagcccc

SEQ ID NO: 4111013 - RNA, 93 nt, Human
ggguuuggcacaccugguuagggcucugagugggaaagaggguccugaaaccaggcugagcccccagccagagccagagccaaugcuggagcc

SEQ ID NO: 4111014 - RNA, 61 nt, Human
ggguuugggggcagcuggucugguccaggaaccuggcuggaggcaugcaagcucccuuccc

SEQ ID NO: 4111015 - RNA, 125 nt, Human
ggguuuggguuuuucugacaacaacgcuccccucucuaggguccacagggucagccggguccucgaggugccacugggaacucuggagcuaaggucaguggucucugcagggcucccccugaccc

SEQ ID NO: 4111016 - RNA, 108 nt, Human
ggguuuuaauuuagaguuuuuauucccugagguguaagaaauuaaaauuuuauuuucuggggagagugaaccauacuagcucugaauuucaaacacaacuauuaaccc

SEQ ID NO: 4111017 - RNA, 64 nt, Human
ggguuuuagccuagacaacuuuuaaggaagguaaguaccuuagaagucaucuagucuaaaaccc

SEQ ID NO: 4111018 - RNA, 64 nt, Human
ggguuuuccagugaauaaagauaaaguacacaagaauagguacugcauagacacugggauaucu

SEQ ID NO: 4111019 - RNA, 62 nt, Human
ggugguugguucuccuggcaaccagcccccauccugaggcuauccaggaaccccuagcuacc

SEQ ID NO: 4111020 - RNA, 128 nt, Human
ggugguuuuccuguuaucuauguagaggacauauuauuagcuauguuguuccuuggggucuuauuguauuucuuugaagugcuuggcuaaugguuaugucaccucagcuacucuguggaaguccuacc

SEQ ID NO: 4111021 - RNA, 61 nt, Human
gguguaagggacccccugcccccaguggccacaggucgggcagcagaggaucccuuaaucc

SEQ ID NO: 4111022 - RNA, 60 nt, Human
gguguagagguguuugucguuggcuucguguuacccagugcugagacagaccucugcauc

SEQ ID NO: 4111023 - RNA, 79 nt, Human
gguguauagaucugugcccgaguguguggagcuuugaguauagauggucacaaagcucugggguacacaucugcauacc

SEQ ID NO: 4111024 - RNA, 59 nt, Human
gguguauggauaugucaugguggccagaacucuugggcaucaucaccugcuauacgauc

SEQ ID NO: 4111025 - RNA, 89 nt, Human
gguguaugugacucucagugcagcuugacagagaaagugauucaguguuccugguuucuguuugaggcugucacaagucacaacaaacc

SEQ ID NO: 4111026 - RNA, 64 nt, Human
gguguauuagggacugggaacuugguuucacuagcauaagccagcaguccaguccuuagugacc

SEQ ID NO: 4111027 - RNA, 72 nt, Human
ggugucagacuuugcauauccucuugcuggcauaauccagaauauggcugaggaaugacagauguccgcacc

SEQ ID NO: 4111028 - RNA, 61 nt, Human
ggugucaguuuaguugaagaaagacuaagucuaggucauauucugucauugaacugaggcu

SEQ ID NO: 4111029 - RNA, 76 nt, Human
gguguccaauccaccucccuacacccaugggggcugcuccagugucucccccaggaaugggaaggaggaauggccc

SEQ ID NO: 4111030 - RNA, 61 nt, Human
gguguccaucaggcugugcuucuacgagcugugugauggagcauuuucugauguugacacc

SEQ ID NO: 4111031 - RNA, 78 nt, Human
ggugucccucgaggucagaggucccagaagaagcaggcaccuauguucgcugcucuccaagccuccuugagugacacc

SEQ ID NO: 4111032 - RNA, 98 nt, Human
gguguccuggagcaaaugggcaauaacagcaggguuacaggcauugccuuguccugggguugaugucuuugcuguuauccacugaguuccuagacucu

SEQ ID NO: 4111033 - RNA, 70 nt, Human
gguguccuggggcccgggcuuggcccuuguugcagaaggguugaggagccgggccugggcccugcgcacc

SEQ ID NO: 4111034 - RNA, 66 nt, Human
ggugucugcuucccuccagcuguccaggguuuucagcugggucucagaaacgaaguucaggacacc

SEQ ID NO: 4111035 - RNA, 68 nt, Human
ggugucuuuaaguuguaacagauucuaacauaauuugacuuguggguagaaguuacgauggguaugcc

SEQ ID NO: 4111036 - RNA, 75 nt, Human
ggugugaagcagcagcuggggacaguucagcccggcuuaggcaugaccucuguuuucaucugccugcgaggcacc

SEQ ID NO: 4111037 - RNA, 130 nt, Human
ggugugagccaggcagccacaguggucagcaaagagaagugggcagugcgcucggaugcggcucagggcaaggggcccggcgcuggcacagcccgcucccacugccccgcacaggcacgcggcucacacc

SEQ ID NO: 4111038 - RNA, 73 nt, Human
ggugugaggcaagggcauacuaggcagagggaacagaaacuccagaggccuaaggauaugcuuugcuuggccu

SEQ ID NO: 4111039 - RNA, 59 nt, Human
ggugugcacgaaggaccagcagcagaguggcacugccugaaggugucuuugugaacauc

SEQ ID NO: 4111040 - RNA, 68 nt, Human
ggugugcugaggcuagaccuggaaguguagcacaucacuuccacuuacauucuaguuaucaggccacc

SEQ ID NO: 4111041 - RNA, 82 nt, Human
ggugugcugggagucaccaggagcaagguggugaaggugaguuuucuccugagccccuccugggacucauuagcaccucacc

SEQ ID NO: 4111042 - RNA, 58 nt, Human
gguguggacccgcgucuggagaacgagcugcaucgccaaggcugcugcgggucgcacc

SEQ ID NO: 4111043 - RNA, 62 nt, Human
gguguggccuccugucccaggcugaggagucuggacucugagcuccaugcaggaggcuaacc

SEQ ID NO: 4111044 - RNA, 87 nt, Human
gguguggggacaggagcccucaccgccugaccaggugcccagcgccauccaggcugugggugagcucccaggccucugccccaccuc

SEQ ID NO: 4111045 - RNA, 78 nt, Human
gguguggggcuggccuaggcaggcugagggcuauuucuccuacuguggcccaggggcucuugguguugguccugcaac

SEQ ID NO: 4111046 - RNA, 102 nt, Human
ggugugguggugggcgccuguagucccagcuacuugggagucuaaggcaugaaaaucacuugaaucuaggaggcggagauugcagugagcugagaucacacc

SEQ ID NO: 4111047 - RNA, 96 nt, Human
gguguguaguuguugaaaggauuagaaucauaccucuaggaacaacagggcucuguguucaacugugaugguuuaaucuucacauacucauagacu

SEQ ID NO: 4111048 - RNA, 69 nt, Human
ggugugucagagcucagagaaguaaggcugggaggcggggaggccacauuaggcuggacuuuguaggcc

SEQ ID NO: 4111049 - RNA, 76 nt, Human
gguguguccugccugcaaaaugggacaagcugcgcgucaacgcugcugucccuugaguaggaacggaggccucgcc

SEQ ID NO: 4111050 - RNA, 58 nt, Human
ggugugugaggagucacuuaguugauauacauuaaguuucugugacucuuggcauacu

SEQ ID NO: 4111051 - RNA, 59 nt, Human
ggugugugguuuugauacagucuguggcaucagacagcaaaaauacaaagccauaaacc

SEQ ID NO: 4111052 - RNA, 125 nt, Human
gguguguguuuuauuuugcaguguuaguuuugaccucauuaugcucauuaugcuguuguaaggcuaaguaugucaugggucaaaaugaaggcaaaauagaccuuucucagcauuaaagcacaacc

SEQ ID NO: 4111053 - RNA, 91 nt, Human
gguguuccagugccugagacacagcagauauucaaucagcccugcugcguuaaaucagaucugcugccaugcuucguagcauuggaguccc

SEQ ID NO: 4111054 - RNA, 55 nt, Human
gguguuccuggacagcaagugagugacuugcucacaggcgguaauucagggaccc

SEQ ID NO: 4111055 - RNA, 58 nt, Human
gguguucuucugcauggugacugagaaugugagccucagaaugaaauguaagaacacc

SEQ ID NO: 4111056 - RNA, 82 nt, Human
gguguugcuucuguguguuuaugucuggguguuuacaugugucuguaugugagugucuggucauggcaggcagcuguagccc

SEQ ID NO: 4111057 - RNA, 57 nt, Human
gguguugggcucacugguccuuucuguauaagcacaguagggccugcagcucaagcu

SEQ ID NO: 4111058 - RNA, 96 nt, Human
gguguuguaaggauuaacuaguguguauaaugcuuugaagauuaaaagugcugagcauuauuagugaguauuacauaacuaauugucuauaauacu

SEQ ID NO: 4111059 - RNA, 59 nt, Human
gguguuuaugagugaccuugucuuguccucugaauuauggacaggcagcucagaacauc

SEQ ID NO: 4111060 - RNA, 63 nt, Human
gguguuucccaacagucucucucaaaggaacugcccuuugagaagcugucuugggcucgagcc

SEQ ID NO: 4111061 - RNA, 58 nt, Human
gguguuucuugauaaagcagaaaaucagcaggugcuucuuuucugugccaagaaaacu

SEQ ID NO: 4111062 - RNA, 79 nt, Human
gguguuugcaguuuauguuccugcaguacuguguacacacaacugaaaaucaauaggaaguuaauggaaagcaaauacc

SEQ ID NO: 4111063 - RNA, 129 nt, Human
gguguuugccaggcuuuggcaugugauuuuggggugcagcuaggaagguucaaaagaguuuugaggugagcagaaucuaagucagcacuccugaggaucacgggccuuggagaguccagggcaaacucc

SEQ ID NO: 4111064 - RNA, 60 nt, Human
gguguuuucauucuuggcugcuggaaaauagccaggagaccaagaaaggaugaggaucuc

SEQ ID NO: 4111065 - RNA, 94 nt, Human
gguuaaaagcacagccuuugaagucgagcugucuggauuuggauccucccuucacaauucaccagauggguuacuucaagcaagcuguuuaacc

SEQ ID NO: 4111066 - RNA, 88 nt, Human
gguuaaacauggccgggugcuuuggcucacgccuguaaucccagcacuuugggaggacaaggcaggcggaucacgaggucaggagauc

SEQ ID NO: 4111067 - RNA, 68 nt, Human
gguuaaagcugugaauuuuaugcuaguguaaaauagaaauuacauaauaaaaugcauagcugcauacc

SEQ ID NO: 4111068 - RNA, 62 nt, Human
gguuaaaguuaggagagagagagagagagcaacuguuacuuuuccagucccuggauuuaacc

SEQ ID NO: 4111069 - RNA, 72 nt, Human
gguguggcucuaguucuccugaaauguuuggucuugaacuagaagcaauguaggggagacuuggccuuagcc

SEQ ID NO: 4111070 - RNA, 88 nt, Human
ggugugggcacuagguaaguggguggcaaccggcucuuugggaccauuggugcugaccuuugccuggucaccugccugugccuaggcc

SEQ ID NO: 4111071 - RNA, 74 nt, Human
ggugugguaaucuuuuaugagcguucugacagcauccuucugucauauguugaugaaagagacaaagaaacacc

SEQ ID NO: 4111072 - RNA, 102 nt, Human
ggugugguggcacacgccuguaaucccagcuacucgggaggcugagacaugagaacugcuugaaccugggagguggagguugcagugagucaagaccacgcc

SEQ ID NO: 4111073 - RNA, 102 nt, Human
ggugugguggcagacagcuguaaucucagcugcucgggaggcugaggcacaagaaucgcuugagccagggagguggagguugcagugagcugagaucacauc

SEQ ID NO: 4111074 - RNA, 89 nt, Human
gguguggugguaggcacuuguaguucuagguacuccagagcacuauuugaguccaggaguuugagacugcagugagcuaugaucacgcu

SEQ ID NO: 4111075 - RNA, 90 nt, Human
gguguguaauuugggcaauuguagcagggaucagaauacaccauuaggcagguuguucuuguugauuuuguuaugccuauguuaugcauc

SEQ ID NO: 4111076 - RNA, 59 nt, Human
gguguguguggauuagcaugcccugacuacucugggucugcuggugacacggucacauu

SEQ ID NO: 4111077 - RNA, 69 nt, Human
ggugugugugugugcgugugcucaugcaugcacaagugaauuugcauacacaagcauacauguaccacc

SEQ ID NO: 4111078 - RNA, 79 nt, Human
gguguuaauggcugaagacauccuaauauguauggcccuuugauaacauauuuuacaggagccuuuuaugccuuaaccc

SEQ ID NO: 4111079 - RNA, 61 nt, Human
gguguuacucagcacugcucugcucgguggauggagcaggguucucaguuggugcuucacc

SEQ ID NO: 4111080 - RNA, 83 nt, Human
gguguuagcauuugcucugccucacauuggcugugugacccugaguacggugcauggccucucugggcuguaaugauaauacc

SEQ ID NO: 4111081 - RNA, 64 nt, Human
gguguucaaaugaacacaugcauuuacuaaauugccaccugugucuuuguuccauuugaccacc

SEQ ID NO: 4111082 - RNA, 64 nt, Human
gguguuccccuuaccucuuggccccccaaaacagggacagacauagauggugggcuggaacacc

SEQ ID NO: 4111083 - RNA, 80 nt, Human
gguguucugggaugauggacaaagcauuggugaguauaaacuuuccagggucccuguacaucacugagaaaaaucauacc

SEQ ID NO: 4111084 - RNA, 59 nt, Human
gguguugaauggugucuguuggauugaauugaguuccuaaucagaaguccuucaaggcc

SEQ ID NO: 4111085 - RNA, 81 nt, Human
gguguugagggugagguuugugugugauuucgugagaccucucacccauaccucuaccacacaugacccacuuuuaccgcc

SEQ ID NO: 4111086 - RNA, 109 nt, Human
gguguugcgauauuucucuuuagaagaaaauaaccuguuucagacauuuguuucuaauuguuugagcugcaaaugaaaacuagguuacuagugagaaauaugggacauu

SEQ ID NO: 4111087 - RNA, 126 nt, Human
gguguuggaauugcaggaguuaccaaauagguaggcagccagguccccucauggcuccuuggcaauucaaacccaggugcucacaggcuggccugaacugccuugcuugccugcuucuaucucacc

SEQ ID NO: 4111088 - RNA, 58 nt, Human
gguguuggauucugagcauuuaaagcauucguuuugaaaggccuguuuauccagcauc

SEQ ID NO: 4111089 - RNA, 61 nt, Human
gguguuguuuuccauaguuugguucauuuuuauugcugagucaaauucuguugaauacacc

SEQ ID NO: 4111090 - RNA, 110 nt, Human
gguguuucaaaauuguuccuugagaaagacagacauuccuaauuagaagaaucggcucuaagugacuuaguuauuuuuguccuccaagaagcaucuuuauuugaauuucc

SEQ ID NO: 4111091 - RNA, 60 nt, Human
gguguuugccaccugacggguccuccaguuuguccuuuugguuucugucugugguccacu

SEQ ID NO: 4111092 - RNA, 59 nt, Human
ggugaagggugucauggcauuuugggaauuggaguccugugaccagacugcccuuagcc

SEQ ID NO: 4111093 - RNA, 100 nt, Human
ggugaaguggagaaguugcauguuucauuggcuuucuuuugugaaaauugauuuucauuuuauuuugacagaagaggcccuaaaaaucuucuuuuucccc

SEQ ID NO: 4111094 - RNA, 91 nt, Human
ggugaaguuuucaggucugaugguauuuuaugucaaaauaacaagucaugagaauugaugaaaauucuaugcaggccaggaauccagaacc

SEQ ID NO: 4111095 - RNA, 82 nt, Human
ggugaaucuauaccauuguuucuaccagcugucucuggagugaguauugggauuggaagcggugguggucaaaggcuuuauc

SEQ ID NO: 4111096 - RNA, 91 nt, Human
gguuugguauucugucacuagcuucucugauuuauacuucugccuauaagagcuaagagucuagaaaggcuuccagagaguaaccuaaauc

SEQ ID NO: 4111097 - RNA, 93 nt, Human
gguuuguagaggaccaaaaaugucaggagagugaggggagaggcucuuacucugagucuagauuccuccugcauccuguggucccuaaaaauc

SEQ ID NO: 4111098 - RNA, 57 nt, Human
gguuuguggaugcaaggcgcugcgugaguacucagugcuacgguuaccauauaugcc

SEQ ID NO: 4111099 - RNA, 77 nt, Human
gguuuuacuaccccaggcacacugucuacacugaguaacuagaacuaagcugaggaaguguugcugagcggagaacc

SEQ ID NO: 4111100 - RNA, 71 nt, Human
gguuuuauuugccugcagcucugguuaaaaagaauuaaaggggccccuucagggcuuagggaaauagugcu

SEQ ID NO: 4111101 - RNA, 70 nt, Human
gguuuucacagcuggguggcagagucucacuuccuuuucaagguggauuacuccagcagcugugaagauu

SEQ ID NO: 4111102 - RNA, 57 nt, Human
gguuuucaguuugugagcucugaauccacacaaaaacaggacugcauucugaaaacc

SEQ ID NO: 4111103 - RNA, 61 nt, Human
gguuuucauuauuagugcuuuguuuuagaaaaaguccaaaacaagcccuaaugaagagucc

SEQ ID NO: 4111104 - RNA, 116 nt, Human
gguuuucauuuuauucuucaugugacuuuaguauaaaauguauaacuuuauuauuuaacauaaaaugugcaguuuuuaagcugcuagguuaaaugaguuuccaaaauaugaauucc

SEQ ID NO: 4111105 - RNA, 80 nt, Human
gguuuucccuugggcuuuaugagauugagaucuaguggcuuaugaaacuauacuuaaucagauaagucucacacuaaacu

SEQ ID NO: 4111106 - RNA, 64 nt, Human
gguuuucucugagaugccuuucugcccugauauuuugugguucuagaagcauucaaagaaaacu

SEQ ID NO: 4111107 - RNA, 81 nt, Human
gguuuucugaagcucuccaguuuguuucuccugauguguagguuuuuagagugaaauauuguacuggagauguugaaaacc

SEQ ID NO: 4111108 - RNA, 86 nt, Human
gguuuucugacucuuacuagaauuuuugagauuugaagcaaaauauagauuuagaugcuuaaguuuucaguguaccuaggaacacc

SEQ ID NO: 4111109 - RNA, 88 nt, Human
gguuuuggggguuaggacagggacaucuuuuugaggccaccauccaacucaauacacaugccgcuguucuccucuucccccaacagcc

SEQ ID NO: 4111110 - RNA, 69 nt, Human
gguuuuguugagguucacaggcuaucacaguuccgcaaagggcucagguguguguggaccagaacuucc

SEQ ID NO: 4111111 - RNA, 79 nt, Human
gguuuuguuuccuagaguuuuaaguacuugaaaaauauacuucuauugcauuaaggccauugaaauuuggaacguugcc

SEQ ID NO: 4111112 - RNA, 57 nt, Human
gguuuuucaucagaguggccacggaugccuugaacugugagccugcuguaggaggcc

SEQ ID NO: 4111113 - RNA, 81 nt, Human
gguuuuuggugugaaugagaaaguuaaucaucaugagagaauucagcucagagagcagaacuuuuuuacauaccagaugcu

SEQ ID NO: 4111114 - RNA, 90 nt, Human
guaaaagaauauaauaugcuuuuuuugccuaauggaacuuuagaacuucguuuuccaccagagggcaaaaugaagcuuauauaaguuuac

SEQ ID NO: 4111115 - RNA, 77 nt, Human
guaaaagagcugggccagccugaagccuuguuacugaaagacauuucaucuggcaguguauagguggcuccuuguac

SEQ ID NO: 4111116 - RNA, 71 nt, Human
guaaaagccagcuucuuuacgguggcauccaaggccuuuaugauguugccucccugaacugugcuuucuac

SEQ ID NO: 4111117 - RNA, 88 nt, Human
guaaaauaagcgaagaucaaugguugaacccugucaugagugggguauucgaucaugcagguuuccagccagauuuuuagaaauuugc

SEQ ID NO: 4111118 - RNA, 56 nt, Human
guaaaauagaauaacguggcuauccuuaaagaugucacguugcuuuucuguuguac

SEQ ID NO: 4111119 - RNA, 92 nt, Human
guaaacaccauuguccaggcuuucauuccagagggagaugucuacuuugcuguuuuucuuugugugaagacaaugacagugguugaaauuac

SEQ ID NO: 4111120 - RNA, 67 nt, Human
guaaacagccaucaguaaagacagcuuguauacaauucugaaaaggcggucauugaugguuguuaac

SEQ ID NO: 4111121 - RNA, 60 nt, Human
guaaacaggaauguggucauggccuuuauuccucaacccugacuauaaauuuucuguuac

SEQ ID NO: 4111122 - RNA, 109 nt, Human
guaaacugaaaagcauucuguggggacgggcuuuuggaagacuucuaugcucuugaugaaagcacaaguucuaacaggaggucucuugcagagcuggacuucaggaagc

SEQ ID NO: 4111123 - RNA, 85 nt, Human
guaaacuuucuacauugauguaaacuuugauuucauguaaacuuucuacauugauccaaaauuugaaucugugaggaagguuggc

SEQ ID NO: 4111124 - RNA, 65 nt, Human
guaaaggguucccucuccccggucgcaggaagacgccugagggggcgcucggagggauccccugc

SEQ ID NO: 4111125 - RNA, 82 nt, Human
guaaaguaacaaagagaacaauaauucuucucaggucccugauaucucagaggaugcuguucuuuaauacuuguguuuuugc

SEQ ID NO: 4111126 - RNA, 85 nt, Human
guaaagucaacaaagccagcaggugcagaauuccacaguucccuuaauuguggaauucugcaccuggugauuuuguugauuuuac

SEQ ID NO: 4111127 - RNA, 55 nt, Human
guaaagugcuuccuaacccagagcugaauguauuugacucuggaaagcauuuuau

SEQ ID NO: 4111128 - RNA, 62 nt, Human
guaaaguucuguggcuguuaucccacauuguuguggccacaauuagcugauagcuacuuuau

SEQ ID NO: 4111129 - RNA, 61 nt, Human
guaaaguuugucuuucucagggcaaguacauuccuucaugccagagaagugcauacauuau

SEQ ID NO: 4111130 - RNA, 74 nt, Human
guaaaguuuucuuagauauguugaugaagaguuaguccuucuuugauuuuacaugucauaucuauuaguuuuac

SEQ ID NO: 4111131 - RNA, 101 nt, Human
guaaauagacacaaaucuuuucaguggguuuauuucaugugguuuugccuauucauucaauuagcauuuaauagcucaucaagaagaucuguguuauuuac

SEQ ID NO: 4111132 - RNA, 59 nt, Human
guaaaucagugucauuuuagaaugagauacucagcuugcuucuaaagucacugaauuac

SEQ ID NO: 4111133 - RNA, 83 nt, Human
guaaauccauaguguuuuacaacagaauuacaugguaagcuucucuguacuuuaaaucaauguagauucacaauggguuucac

SEQ ID NO: 4111134 - RNA, 68 nt, Human
guaaauccuuuggaggacaugaugcuuuggaaaagaagggaaaaaggagguauccccaaaggauuuau

SEQ ID NO: 4111135 - RNA, 71 nt, Human
guaaaugccaaggagagacuguuacuaccaggcuuauuuacuagcaaucuagcauuuuucuaggcaucugc

SEQ ID NO: 4111136 - RNA, 59 nt, Human
guaaauguguggccugggagaauguguuggauaauucucaucuuagguuguacauauau

SEQ ID NO: 4111137 - RNA, 91 nt, Human
guaaauuccaugaaggcagugauuuuguuuggcuuauuuacaucuauuucucuaauaccuacaauacugccugucacagaauggaguuuau

SEQ ID NO: 4111138 - RNA, 56 nt, Human
guaacagaagagcaggcagcccucaguuuccgaaaggguuguauucucaauguuac

SEQ ID NO: 4111139 - RNA, 94 nt, Human
guaacagacaaaaggccugaggagcaggguggcuuacucggcugugaaacgacaccugggcugucacgccccugcaccucuggccagucagugc

SEQ ID NO: 4111140 - RNA, 59 nt, Human
guaacaguuuacuggccuugccguucucuuaagaggcacuaaugguaguggacuggugc

SEQ ID NO: 4111141 - RNA, 83 nt, Human
guaacauuaagauggcggaacagugaaggauuuuucagcuuugucaaucacuuguuuuaucugucaauagauuuccauguuac

SEQ ID NO: 4111142 - RNA, 91 nt, Human
guaacauuuguauuucguuuuuaguauaguaugugcucaaaguguaguacucuguaguaugguacuuauuuaaacgaaucacucauguuac

SEQ ID NO: 4111143 - RNA, 78 nt, Human
guaaccuacuucuuuccagaauggcauuauacuaaagcguguaaaaccauaaggcuggaaggaaauuugagugguuau

SEQ ID NO: 4111144 - RNA, 81 nt, Human
guaaccucaaagacuuccuccuuuacauaucuggugguuaaugcugggaccagauaaagggaggucccucuguuguuuugc

SEQ ID NO: 4111145 - RNA, 77 nt, Human
guaacggaucuugagguggugacauuauccuugauuaucuuaauaagcuugauguaacuaaccacaaggguccuuau

SEQ ID NO: 4111146 - RNA, 105 nt, Human
guaacguggagaaggugcccaguaauucucaguuggaaauagaaggaaacaggucaggaucugucuuguauuccccuaucucuaaauacagguaucccucguuac

SEQ ID NO: 4111147 - RNA, 80 nt, Human
guaacugguccccaugggguucagauuugugaucuuggccucauuaucacacuuuuguaaccaucagaccuaauagauac

SEQ ID NO: 4111148 - RNA, 82 nt, Human
guaacuucagaugaccuggguuggaguucugauccuagaacuuauuagucagaauucugaccuugggucaucauagagucac

SEQ ID NO: 4111149 - RNA, 71 nt, Human
guaacuucagucagacgucagccugcaucguaucgcgugugcacagguggccuguguuuugucugaaguac

SEQ ID NO: 4111150 - RNA, 59 nt, Human
guaacuucuggaaaugcaucugccauuuucaugguggucaggcacacauccagggcagc

SEQ ID NO: 4111151 - RNA, 57 nt, Human
guaacuuggucauuucugagacuuccugaaguagguuuuccagacuguccaggcuau

SEQ ID NO: 4111152 - RNA, 83 nt, Human
guaacuugguuguccagaagagaucacaguucuuggcaaacauguuuacguuacucuaggauguggcuuuggacagauguuau

SEQ ID NO: 4111153 - RNA, 104 nt, Human
guaacuuucauucucacauuugcuguuucaugguuguuugauggcagcugcaccuuuaggcaugcuguuggccagaaagaggagaaagaggcaaugacuguuac

SEQ ID NO: 4111154 - RNA, 94 nt, Human
guaagaaagguuauuagcuuuugguuauaaggugccccaaacuagucuguuuucauacaaguuuucuucauuuuguggccaugauccaucuugc

SEQ ID NO: 4111155 - RNA, 130 nt, Human
guaagaauguuucccuuggaagaagcccugggguuccagucugaaacuacaguugaaagaaggagaggaccagcugaaccuaccuggggccccauggaugcuucuucagcccaaggaaacaauuucaugc

SEQ ID NO: 4111156 - RNA, 130 nt, Human
guaagacacaauuuuagaguguguaucuagguuguagaagauuuacugaguuccaacugcuuugggcaagcacuggauugggaaaguacuucacauauauuacuccauaucacuuucaaaacaacuuuac

SEQ ID NO: 4111157 - RNA, 83 nt, Human
guaagagaucauggacugaguugggaagacuggcuuugauaguucuuagcugggcaaacuaggcucagucucuggucuguuac

SEQ ID NO: 4111158 - RNA, 67 nt, Human
guaagaggaguaaguguuaagacuagagccagacugccuggguucggaucuuuacuuuccuacuuac

SEQ ID NO: 4111159 - RNA, 112 nt, Human
guaagcaaagaugguggaaguauuuauuauuauaaagugcaugaccuuagagguuaucuguugccaauguuaucuacacuuuauauaagacuacugggccuaauuuguggac

SEQ ID NO: 4111160 - RNA, 55 nt, Human
guaagcauaagauacaugagacaguccucaucuauugucuuauuccaguguuuac

SEQ ID NO: 4111161 - RNA, 59 nt, Human
guaagcuggacagggcugaauacaauuguaugauuccuaauuagagcucuuucagcuac

SEQ ID NO: 4111162 - RNA, 86 nt, Human
guaaggacguuggcuuuucaucugaaauagagauccaguagaggguuuugagcagagaaaggacaugaccugacuuauguuuuugc

SEQ ID NO: 4111163 - RNA, 71 nt, Human
gguuguacuagagcaguguuuuccaauagaauguuuagugaugauggaaauguucuguaucugcuauagcc

SEQ ID NO: 4111164 - RNA, 65 nt, Human
ggugacuucagucucugccagcuggagcccugucucccaguagccaguggcaggggcaguacgcc

SEQ ID NO: 4111165 - RNA, 83 nt, Human
ggugagaaacugaauaucccgcuaugcaaaguacaaacaagcucucugugaaaaugcuuuguuauauggggauucuucucacu

SEQ ID NO: 4111166 - RNA, 80 nt, Human
ggugagaaguuugucaucugauguggucagaucagagcuuugucgaguccaggccacauggauggcgauacuuacaagcc

SEQ ID NO: 4111167 - RNA, 102 nt, Human
ggugagagaggcgccuagagcacaaauuuuaaggaggcaagaccacgaccccgaccgugagcgccugcuuaacauuugcuccccaggcgcuucccacucccc

SEQ ID NO: 4111168 - RNA, 60 nt, Human
ggugagagauugauuguagcggcagaagaugaauuugcccauagucucuuucuuucuucc

SEQ ID NO: 4111169 - RNA, 56 nt, Human
ggugagaggccaccccgcccgcccucuguggccgccgggcuggccgggcccucacc

SEQ ID NO: 4111170 - RNA, 74 nt, Human
ggugagcaggacuuuaaagagacgcggcaugcccaggguuucauagaugcugccuuuguggggucacuguuccc

SEQ ID NO: 4111171 - RNA, 56 nt, Human
ggugagccuggagucuugcugguuaucaaauguuaggagucacucagggcuucauc

SEQ ID NO: 4111172 - RNA, 60 nt, Human
ggugagccugggugugcucagcugcaggauggcagcuggccagcaccuccaggucauacc

SEQ ID NO: 4111173 - RNA, 56 nt, Human
ggugaggggcgccucugcccagccgccccuacugggaagugaggagccccucugcc

SEQ ID NO: 4111174 - RNA, 56 nt, Human
ggugaggggcgccucugccuggccgccccuacugggaagugaggagccccucugcc

SEQ ID NO: 4111175 - RNA, 56 nt, Human
ggugaggggcuccucugcccggccgccccuacugguaagugaggagccccucugcc

SEQ ID NO: 4111176 - RNA, 67 nt, Human
ggugagggguggggugauggugauugggggcugagguuuaccacuucaucagugcuccauuuucacu

SEQ ID NO: 4111177 - RNA, 56 nt, Human
ggugaggugucuagaucuaccaguagaucccgauuugcagguuugagacuccuacc

SEQ ID NO: 4111178 - RNA, 73 nt, Human
ggugagugccuggccuggccacuccccagaaccccuugaccaguggccagcugucagcacccuuguacccacc

SEQ ID NO: 4111179 - RNA, 122 nt, Human
ggugauagcuuuuggguagaauuuugaguucuuacuggaauaaacgaucuucagcacuucucugugaaaugaagggcuuguucugggaccugaaaugcuucaaacccugugcaguuguugcc

SEQ ID NO: 4111180 - RNA, 96 nt, Human
ggugaucaccuuagcuguuuguucauauuuaacuaagauaggggccuuaaaauuggcuguccuguaagcauggguagaacguguugagugguugcc

SEQ ID NO: 4111181 - RNA, 55 nt, Human
ggugauccaccugccuuggccucccaaagugcugagauuacaggugugauccacc

SEQ ID NO: 4111182 - RNA, 79 nt, Human
ggugaucugcguucagcuguggggcagccggccauggcucauggagguggcaucugacagcugacugagccagggagcc

SEQ ID NO: 4111183 - RNA, 67 nt, Human
ggugaugaguuuguauuuuuggugucuauauuugccaauagccuuucaugcaaacucacaaaauacc

SEQ ID NO: 4111184 - RNA, 124 nt, Human
ggugaugcaagcacaccuuccuucuucaagaguucaucuugaguuccuaaccagcagagaaacaauauuauauuucuuuccucugacugccuaggagagacaguacucuucaguuugcauuccc

SEQ ID NO: 4111185 - RNA, 85 nt, Human
ggugaugcauccccgcugcaccacagccugaggcagccacaugggugggggugugugugugcacgcguggguguguguuuguacc

SEQ ID NO: 4111186 - RNA, 107 nt, Human
ggugauggagcugcacuuggccaguggaaagaggaggaacucucaagccugugucuggauuuucaggcuccuccucuuccucuccauacacgguuccuguuuucacu

SEQ ID NO: 4111187 - RNA, 66 nt, Human
ggugauggcucccaugggcauaugucaucauuugaucuaugguucucauuggagucauaaaucacc

SEQ ID NO: 4111188 - RNA, 57 nt, Human
ggugauuaauacccuguuaacaggaugacagaauugucuugugcaauauuaaccacc

SEQ ID NO: 4111189 - RNA, 129 nt, Human
ggugauugaaucauggggguggguuuuuuuguuuguuuguuuugagauggagucuugcucugucgcccaggcuggagugcaguggcgcgaucuccgcucacugcaagcuccgccuccuggguucacacc

SEQ ID NO: 4111190 - RNA, 84 nt, Human
ggugauuuacauuucaugcccuuucaggaaggaguaaccauucuaauacauccuucucaaagagugcauguuuaguggaacauc

SEQ ID NO: 4111191 - RNA, 99 nt, Human
ggugcaaaauguaagggggcacucacuuugagggucgugcagguucaggaucaguacugacacaacccugagaaugagugucuccuaaaauugugugcc

SEQ ID NO: 4111192 - RNA, 77 nt, Human
ggugcaagggcacaggccacaguggagucucugggucuuccccgggugacuuugcuguuggcucugggccccacacu

SEQ ID NO: 4111193 - RNA, 99 nt, Human
ggugcacggcucucuggcccugcaggcucagacuggagugcccgugagcauccugggagcacucucugaagcccugaggggagcagcaggcucuucacc

SEQ ID NO: 4111194 - RNA, 83 nt, Human
ggugcagaggcuuacacuuaaaaacagauccagcaggaggggugggagcguuccuguuacuguuugugaguuucuuuugcacu

SEQ ID NO: 4111195 - RNA, 56 nt, Human
ggugcagcucaggugugccaucacucuucuaguugagggcacccccgcugccuacc

SEQ ID NO: 4111196 - RNA, 69 nt, Human
ggugcaggaacgccaguagacugaaccuuucacgacgugaauaucagaauccagcuguugcuccacacu

SEQ ID NO: 4111197 - RNA, 112 nt, Human
ggugcaggagcauuguaugcgaggcacuuagacuuucccauggcucauauuuuaaaucuagaaaagcucuaaggccucucccagcagcaagggcugagauuccaccuguacc

SEQ ID NO: 4111198 - RNA, 66 nt, Human
ggugcagggagaggcaggcccccaaacacagggggcuauugugccccucccaggaacacaggcacc

SEQ ID NO: 4111199 - RNA, 73 nt, Human
ggugcagucuuuaucccaugaguauguuagucuucauauaucacuaaguccuuugggaaaaaugacuacuacc

SEQ ID NO: 4111200 - RNA, 66 nt, Human
ggugcagugggccggaggccaggggagcccguguaggggaaccgccuggccucuguucagugugcc

SEQ ID NO: 4111201 - RNA, 96 nt, Human
ggugcauccugggaauauccaggugaaagugugagauuuaccuagaauagcuucugggccucugggguuuucacgcugucucuggugaaggugucc

SEQ ID NO: 4111202 - RNA, 60 nt, Human
ggugcauggcaggguuggagcccaggucccucuggguccagaguuuucccgcccugcauc

SEQ ID NO: 4111203 - RNA, 72 nt, Human
ggugcauggcuauucuaacucacauguuauuaacccauagauuuauuagugugauuugaaauaccauccacu

SEQ ID NO: 4111204 - RNA, 63 nt, Human
ggugccacacuagagauuguucuguguauacccaauacagauuuuaaauuuguaguugacacc

SEQ ID NO: 4111205 - RNA, 87 nt, Human
ggugccagcacaaaacaagguacacaguaaugguuagaaaugauuauuauuguuauuaucuacugucuauuauuaucuguugguacc

SEQ ID NO: 4111206 - RNA, 82 nt, Human
ggugccauauuuagcagcugucagaaguuggaaucuggcaagaucaacaacuuuugaauagcucaaaauucgcuaaaguccc

SEQ ID NO: 4111207 - RNA, 69 nt, Human
ggugcccacaacccucagccugagcaucugugugguagcugcagcagcucaguucugggagggggcauc

SEQ ID NO: 4111208 - RNA, 56 nt, Human
ggugcccaccugucuuccuggauuuuguaugugaccucccuaggcaggagggcacu

SEQ ID NO: 4111209 - RNA, 61 nt, Human
ggugcccagcuaccauucagugacuuccauuaguaaaaguaagaaggggaagguggguacc

SEQ ID NO: 4111210 - RNA, 62 nt, Human
ggugccgcugcagagcauacugcucaugaagaugaguggcauggccuugcuguagugguacu

SEQ ID NO: 4111211 - RNA, 68 nt, Human
ggugccuggacacagggggauguguggacggcuugggcagaccagccuccggccucuggugcaggccc

SEQ ID NO: 4111212 - RNA, 128 nt, Human
ggugccuggccugaugggaggugggcacaucacacagagcauuaggggccauguguaaggcucgguucaaauucaaugcucugugugauguccagcacaucucucuaccucucagggccuuggucacc

SEQ ID NO: 4111213 - RNA, 73 nt, Human
ggugccuggggcaugcaaaugugggugaccuucgucucagguagggacccucagcuuggaugucauggguacc

SEQ ID NO: 4111214 - RNA, 59 nt, Human
ggugccuugaggucccaaacccacugaggccacccacagugagcaaggcccagggcacc

SEQ ID NO: 4111215 - RNA, 75 nt, Human
ggugccuuguacagagaggcauucggugaucccaccgugaucccaccguucuucugauugccuucugcaaggucc

SEQ ID NO: 4111216 - RNA, 109 nt, Human
ggugcgcuacguuaggguucucuggugguuaguuccuuuggauaucuuguguugaaaugagggauuaaucagguguuuugucuaugagugccauaagacuuggugcauu

SEQ ID NO: 4111217 - RNA, 66 nt, Human
ggugcguauggaugcuggaagaucauuuucuccuggagagacaucucccaugcauuuuuaugagcc

SEQ ID NO: 4111218 - RNA, 55 nt, Human
ggugcuaguuggcuguguugcuuagcuacccaugaccacacaggcugacagcacc

SEQ ID NO: 4111219 - RNA, 103 nt, Human
ggugcuauguguauuugauuuuuguugugaaaguugcauucacugugucccuuuauuugacaucagcaagauguaauuucuauaaaccaauuaaugaugcacc

SEQ ID NO: 4111220 - RNA, 91 nt, Human
ggugcucaccccagguguuuccucacaagcuuuuccucagacgucuugucucuucccuuugcggaguaaggcucagaggaaaugccucacc

SEQ ID NO: 4111221 - RNA, 59 nt, Human
guaaaaggauuagcaggaugggcucagugggaaaggaggccccugugggauccuguuac

SEQ ID NO: 4111222 - RNA, 100 nt, Human
guaaaaguccuaaguagugcagacggaguaucuuguacauaaggagugcuuccuucagcaaaaauguauugauguccagucugagccagggacugugugc

SEQ ID NO: 4111223 - RNA, 66 nt, Human
guaaaaucuagcugcaugcuucuauuugcauauuauauacagacaaagagcaugcgguaauauugc

SEQ ID NO: 4111224 - RNA, 65 nt, Human
guaaacaaaggacuggauauuaaagagugaaauaagucacaaauuuaguaacuaguaccugguac

SEQ ID NO: 4111225 - RNA, 68 nt, Human
guaaacaguagucacuucuauuaauggcucagaugacugggccuguaauuucauguguuauugauuac

SEQ ID NO: 4111226 - RNA, 72 nt, Human
guaaacccaggguuuugucuuccccauuuccaucccacaaggccuugggggaagguuuguccugagguuugc

SEQ ID NO: 4111227 - RNA, 99 nt, Human
guaaacgccuugagccuugccugaauuuaucugaaugguggaacagaaaucauuuagggcucuauucuaauggauucugggaaguguuuuuagcuuugc

SEQ ID NO: 4111228 - RNA, 64 nt, Human
guaaacugcacaagggugcauagcuggcaaacaagaguugggcugugaacccuggcagugugac

SEQ ID NO: 4111229 - RNA, 82 nt, Human
guaaagaaagcauuucauuccuuugaaaguggaucaauucaguuguuuagggaauagaagugccaugauuauuuuucuuuac

SEQ ID NO: 4111230 - RNA, 90 nt, Human
guaaagaaugcuggguuccauguagccaagaguacuuuggggacucugcagcgugaauucauauucuucuccuccuccucucccuccugc

SEQ ID NO: 4111231 - RNA, 79 nt, Human
guaaagaucaguccuuggccuucuuguaggcaaaaggguucuguucuguaugccuaugauuaggggugccaggcuucgc

SEQ ID NO: 4111232 - RNA, 91 nt, Human
guaaagauugauuugaauaacaguggguuuuccuugcgguaaaguagaaauacaauuagaggaggaagcucauaauuuaucucagcuuuau

SEQ ID NO: 4111233 - RNA, 79 nt, Human
guaaagcuguaugugaaaaugucaagugcuuuuuaagaauggauuuuacacuugccauuuucaagugcaguagauuuac

SEQ ID NO: 4111234 - RNA, 83 nt, Human
guaaaguagcucaggucugugguucugagcaggacaccaugaugugugucuucaucucagacacaguuucaaguggacuuugc

SEQ ID NO: 4111235 - RNA, 83 nt, Human
guaaaguuugaucucaaguaguugacauuuauggaguauuuaccauaugccaaucuuugugauaauugcuagacauauuuuau

SEQ ID NO: 4111236 - RNA, 102 nt, Human
guaaauaaaaaauaaaacccauucucacucuaacccaugcuguaucugauuuuuuuccugagguaggcuugagaugggaggguuguuauuuuuuguaaaugc

SEQ ID NO: 4111237 - RNA, 86 nt, Human
guaaauaauucaaaugguaaggauuguagaaacgaagaaaaugaaaauuuaaguuuguuucguaguccauuauuuggauuuuuuau

SEQ ID NO: 4111238 - RNA, 82 nt, Human
guaaauacacauuucacuguaugagagggcuugauaauuuggugaggagaauuuuuuaggcuuuacucaauggcgaauuuac

SEQ ID NO: 4111239 - RNA, 70 nt, Human
guaaauagaauccugcagcaagccuuguguuucaacuguauaacagaagcuugaacuggggauuuuuaac

SEQ ID NO: 4111240 - RNA, 57 nt, Human
guaaauauaaaugcuagcugcccucccacucaacaugggcuguuaguagauauuuac

SEQ ID NO: 4111241 - RNA, 110 nt, Human
guaaauaucauagccaucacuacaaaagguuauacagucaauauauauauaugcaauauauuuauugcauuuuugacuguacaaccuuuuguagugauggcgauauuuau

SEQ ID NO: 4111242 - RNA, 85 nt, Human
guaaauccugcggaaucggagcccaacguguguaaugccggggcugugcuuacaagaucgugcuccaguccgcauggaaaauuac

SEQ ID NO: 4111243 - RNA, 76 nt, Human
guaaauuauccaaaaauaauugcuugcagggagacuuugcuccaauaaauagguaguuauuuucucuguaauuugc

SEQ ID NO: 4111244 - RNA, 68 nt, Human
guaaauuguuggccuuuaaacuggacuuucugaaucagaaccuccugagauggaguccugcaguuuau

SEQ ID NO: 4111245 - RNA, 79 nt, Human
guaaauuuaguuauuaacauuucugcccugaacugcauuacaauggauuaguuaagaaauguuagcaaguagcuaaugc

SEQ ID NO: 4111246 - RNA, 93 nt, Human
guaacaaaccaccuccaaauuuaguggcuuaaaauaauauaaacauucauuaaguuuaugauugugaaggcugguaguuugggcugggguuac

SEQ ID NO: 4111247 - RNA, 67 nt, Human
guaacagagcuaagaaacagaauugcugggauauuaacccagguaguuuugacuucauggcuugugc

SEQ ID NO: 4111248 - RNA, 82 nt, Human
guaacaguauuaagaggcagggccuucaagagcuggucaggccaugagggcccuguccuccugacugagugaaugcuguuau

SEQ ID NO: 4111249 - RNA, 66 nt, Human
guaacauagcaauggcaacaacuaagcgaagaggacuugcccuaguggacauuguuauggaguuac

SEQ ID NO: 4111250 - RNA, 62 nt, Human
guaacauuauucaugagauacaugagaucagugguuauuguugucuuugugaauaguguugc

SEQ ID NO: 4111251 - RNA, 101 nt, Human
guaaccucugugggguagaaacuguaucuguuugcucacagguguuauuccagaggaaaugcuugggcaagcagaacuuugucuaaaauaccacaguguac

SEQ ID NO: 4111252 - RNA, 71 nt, Human
guaaccuuuaagggugguguguuuauuuuucccauguuaaaacuaagaaaauagaagcaugcuaagguuac

SEQ ID NO: 4111253 - RNA, 64 nt, Human
guaacuaauauuugucucaaaauauguuuccaaaagcauguguggagaaauauuuuucaguuac

SEQ ID NO: 4111254 - RNA, 92 nt, Human
guaacuaguagcaagcagauuagaagauccaugagaucaaguaucauguaucuucccccuuaaucgcuguauuaccaaugcaaccuaguggc

SEQ ID NO: 4111255 - RNA, 60 nt, Human
guaacugcuuaaaauaguucauuuuugcauaaaagcagagcuaaguuuuugagcacuuac

SEQ ID NO: 4111256 - RNA, 65 nt, Human
guaacuugcuaagggucccaucaccaaugucaccuccaagguacaugagggcacucugcaucugc

SEQ ID NO: 4111257 - RNA, 90 nt, Human
guaacuuuggagaaaguauuuucucaauuagaaauguuauuauaaucuucaguaacauucaauugaggaaguuaacaguuucaaauuuau

SEQ ID NO: 4111258 - RNA, 62 nt, Human
guaagaaaaagcaagugcauguuugggaaacugucuaggaaaugucaaaugcuuuauuuuau

SEQ ID NO: 4111259 - RNA, 108 nt, Human
guaagaagucagaugaaaaauugcauuauucaaaccauuuuuauggagugucuuguacacagcaggcacugaagugguaaauguaaauacguuuucuuauugucuuau

SEQ ID NO: 4111260 - RNA, 56 nt, Human
guaagacaagcggacugccguucacaccuacuugagggacuggaaguuugucuuac

SEQ ID NO: 4111261 - RNA, 58 nt, Human
guaagacacagcgaaauguuccugcgucaguggauucagggaauccuguguguuuugc

SEQ ID NO: 4111262 - RNA, 59 nt, Human
guaagagagaccaggaauaacaguggcauaaacaccacagauguuuauuuuucucuuac

SEQ ID NO: 4111263 - RNA, 76 nt, Human
guaagauuauggguauuuuuugccucgauguuacauuuuuaugaacuuucaggcaaugaauauuuguuacuuuuau

SEQ ID NO: 4111264 - RNA, 71 nt, Human
guaagauuuaaaauagcaauuggagauucagcaacaauucucaccucucauuugucuuuaguaaaucuugc

SEQ ID NO: 4111265 - RNA, 74 nt, Human
guaagcauuacaacuuuagcaaaggugcauugcuuugcuuuguuuccuuuguauacaguucuugugauacuuac

SEQ ID NO: 4111266 - RNA, 98 nt, Human
guaagcauuuauuguuguaauagcaguaauugucaucguaguaaacauuuuuugaaugcuuacuaugugauagacacuauacuaaauauuuugcuggc

SEQ ID NO: 4111267 - RNA, 61 nt, Human
guaagccacuggagaugucagacagguuccuuucccaauagaacuuccauuccagugguac

SEQ ID NO: 4111268 - RNA, 82 nt, Human
guaagccuuccagaaacccuuuauguuuuucuuguaauuauauauugcauucauugacauaugaguguuaaauaaggcuugc

SEQ ID NO: 4111269 - RNA, 130 nt, Human
guaagcuacuggugaguugugagacaauuuagggauugcuuuuagugaaauuauauagaauagaaaauaugagaguucauuuaauuugguaagaguuuuguaaauguauaugcauacacagucauauuac

SEQ ID NO: 4111270 - RNA, 84 nt, Human
guaaggagaugaugguuaauuaugagaaagggaaaagguaggcagaugccuggcuuccugcugauaauccccucuucuucucac

SEQ ID NO: 4111271 - RNA, 110 nt, Human
guaaggcauagauuaauucaccccacuauuaauguguagccaacuuaaucccaggcucuggauuaagugguccauauguaacaguauuggugacaucuagaagaccuugc

SEQ ID NO: 4111272 - RNA, 105 nt, Human
guaaggccaaugcucagcuuucccuggugggugagaaccuggcuucugcuacuugugagaauuuauagaagcuuaaccaccugggacagaugaucauuguuuuau

SEQ ID NO: 4111273 - RNA, 66 nt, Human
guaagggaagaggaccagagucucugccucguaauccagagaauucuucuggaucuuguccaagac

SEQ ID NO: 4111274 - RNA, 59 nt, Human
guaagggccgaggguacaggaguggacuuuauuguucacauuaacucaccggugcuuac

SEQ ID NO: 4111275 - RNA, 75 nt, Human
guaaguccucagaucaucuuuaaauggcagcaggcauuuccaccuacaugcuggccuugugucugaggaaguuau

SEQ ID NO: 4111276 - RNA, 81 nt, Human
guaagugacacuggaggauacuguguuaaacauguuuuacuugaucuaccugcuaaacugguaucucuucaguguaauuac

SEQ ID NO: 4111277 - RNA, 74 nt, Human
guaagugccugugauuaggucccauuauacguaaugaaccuauuacgacacaucugaucucaaaauggauuuac

SEQ ID NO: 4111278 - RNA, 116 nt, Human
guaaguggcacugggcaaggcccccagagcagggcaaggucucuagagcgggucucccacaugacuggcuucacacaggcacuuccgcucggguugcaugcucugugucaucuuac

SEQ ID NO: 4111279 - RNA, 64 nt, Human
guaaguuucucuuugguggguugagaguuggaccaucaauucuaaucuacaaaaggaaauucau

SEQ ID NO: 4111280 - RNA, 56 nt, Human
guaaguuuuucccuagauguagaaagcacuaugcuucagcaucuagugagauuugc

SEQ ID NO: 4111281 - RNA, 129 nt, Human
guaauacaaggaaggugaugacuugcuccauugucuguggcuuucuuauguuguaaugggagcuuaucagugugcaccaugaucagguuacagcaucaggaggagcucuacaaccuauuuuagauucac

SEQ ID NO: 4111282 - RNA, 63 nt, Human
guaauacaguguuucccccaggauagcaucuaauugcuauuugaacgaacccacugucuuuac

SEQ ID NO: 4111283 - RNA, 63 nt, Human
guaauacuugaagaauucagagggcuccagcuuauugaggacucuggaagaaaaaaguauuau

SEQ ID NO: 4111284 - RNA, 67 nt, Human
guaauaucagguagauuuaauauucuguaguccaggcuuuggaaaacacugcucuacuugauauuau

SEQ ID NO: 4111285 - RNA, 101 nt, Human
guaauaucauuucauuaaugaacauaugacaaagugauuuugguagagauaugcuugccauugucauuccagucauuguuaaugccagaaaaugauguugc

SEQ ID NO: 4111286 - RNA, 71 nt, Human
guaaucagcaaacauugauuggacuuaggauugccaagaauauccugccaauuuaggguuuauugauuuac

SEQ ID NO: 4111287 - RNA, 69 nt, Human
guaaucaggaaagauauuuauuggcaacagcugcacugaaguugguggcauuguauuuucccugaaugc

SEQ ID NO: 4111288 - RNA, 55 nt, Human
guaaucccagcugcucaggaggcugaggcaagagaaccugggaggcggagguugc

SEQ ID NO: 4111289 - RNA, 94 nt, Human
guaauccuagcacuuugagaggcugaggcugguggaucauuugagcccaggaggucaagaccagccuggcaacaugucgaagugcugucuuuac

SEQ ID NO: 4111290 - RNA, 58 nt, Human
guaaugcuacaggagucuacauuccuacucccgauguagauuuuacuucugucauuac

SEQ ID NO: 4111291 - RNA, 61 nt, Human
guaaugcuagaggauuuugaguuuacaugccuuacauguaaacucacauuuucuucauuac

SEQ ID NO: 4111292 - RNA, 72 nt, Human
guaauguggaaguaauagaguacugggguugaaaauaacaaaucucccagucucuuuucagcuccauccuau

SEQ ID NO: 4111293 - RNA, 60 nt, Human
guaauguguguauugagcaucugcuuugugacaguguguuagaugcuuugcuuacguuau

SEQ ID NO: 4111294 - RNA, 95 nt, Human
guaauuccccucugacacauauuaugcuucugaagaagaaaagaccuuaaacagagucauuucuuuaaacagagcugcugaguaugucaaauuau

SEQ ID NO: 4111295 - RNA, 62 nt, Human
guaauucuaaucaccagcacaaagucuuaucauuccucacaguggcugcugaagagaauuac

SEQ ID NO: 4111296 - RNA, 78 nt, Human
guaauucuguuucuugcuuugcuuucaaggaauuugcaaauucuccuucagaggauaaggaagaauccauggaaauac

SEQ ID NO: 4111297 - RNA, 79 nt, Human
guaauugugguuuugccauuacaaguaauaacaaauuaaaaaauaauggcauuaaaaguaaugguaaaaccacaauuac

SEQ ID NO: 4111298 - RNA, 87 nt, Human
guaauuguuaacacuauuauuuucacaguaaauaauuguuacagccauuugcuggugaaauagugacauguuuuguugacuucuuac

SEQ ID NO: 4111299 - RNA, 64 nt, Human
guaauuucccagcagaugagcugaccuaggggaugcuucuaguaccucucagcugggauccugc

SEQ ID NO: 4111300 - RNA, 95 nt, Human
guaauuucuuccaccugcugccugcuaccugaaaugccaucauggagcaucugugauguugguaggggguagagggcagguguggaggguguugc

SEQ ID NO: 4111301 - RNA, 64 nt, Human
guaauuuuccuuuguggcucucauucuuuuucccccauugaaggcuaugaauguagaaaauuau

SEQ ID NO: 4111302 - RNA, 63 nt, Human
guacaaauuaggaagcuuugugaaagucauaggcccagcuaaucacaaagcugggauuuguac

SEQ ID NO: 4111303 - RNA, 59 nt, Human
guacaaccagauccucuaagucaucauguuauucaucugaccccagggcuggucugugc

SEQ ID NO: 4111304 - RNA, 113 nt, Human
guacaagcuagauuuggcaacauccagggucaugcaugggaaccugggagccccaugccccacugccuauuugcagggcccugggucuuggguggcccuaguucagugugugc

SEQ ID NO: 4111305 - RNA, 61 nt, Human
guacaaggcauuuaucuguucaacaaaggguucugauuccucauauagaaaguguuuuggc

SEQ ID NO: 4111306 - RNA, 117 nt, Human
guacaagugauuucaaacgaucucuaauguuggauuuuugcugcugcuguuacugcuauuagcgguaguagcagugacagcugagguaccauuagcaucuuagucaaagucacauac

SEQ ID NO: 4111307 - RNA, 70 nt, Human
guacaaguucuacucuauaaauucuggaaaccaaaaaggccaaguaguuguaguguagcuauuugcauac

SEQ ID NO: 4111308 - RNA, 66 nt, Human
guacacuugacucauaggaaauuugguacaauaggaguuccauugcuaugagccucaagugucugc

SEQ ID NO: 4111309 - RNA, 95 nt, Human
guacagacugugcacugcacaaguccaaggucaccauucacauagucugcaaugugauuggcaucccuuggaguugugcagugcacaaccugugc

SEQ ID NO: 4111310 - RNA, 74 nt, Human
guaauucagaguccugaguuauugucaagaagccagagacuucccuggcuuccagaaugacuaggauguuuuac

SEQ ID NO: 4111311 - RNA, 64 nt, Human
guaauuccagcuaccugggaggcugaggcagaagaaucgcuugaacccaggaagcggagguugc

SEQ ID NO: 4111312 - RNA, 76 nt, Human
guaauucucuaaccuaauguggagggagccgaggucuuuacauacuaauucccuagagucauugguugagggcugc

SEQ ID NO: 4111313 - RNA, 63 nt, Human
guaauuggagcagaacuacucacauaucggaaaauuugagguggguggcuucuguuauauuau

SEQ ID NO: 4111314 - RNA, 129 nt, Human
guaauuuuuaugaggucaguugaguuuagaguuggagauuagguagccaccagggggcuccagugaggaguuguaaagguuuuguugguucucuuccuggugaauccucugaauacuguguaauguuau

SEQ ID NO: 4111315 - RNA, 84 nt, Human
guacaagaaauuaaaggucuagcaccagguaaauucauaucucaggauuuuaaacuauagcuggaugcuuuaacuuagcuguac

SEQ ID NO: 4111316 - RNA, 67 nt, Human
guacaagcaaaagguuacacuucuggaauagcagacuaucuaauucagaccaaccucuugcuggaac

SEQ ID NO: 4111317 - RNA, 73 nt, Human
guacaauggcuggucacaugguaggucuguguauaacauugcaagaaauuaccgaaaugaucacacaauguac

SEQ ID NO: 4111318 - RNA, 56 nt, Human
guacacauguauuuauguguacaugugugugagcauguauaugugugcauguguau

SEQ ID NO: 4111319 - RNA, 82 nt, Human
guacaccucagggacuuuugagaauguaauuuacaacauuuaauauagaugaaaugugaaugcuuuucauacccaguugugc

SEQ ID NO: 4111320 - RNA, 108 nt, Human
guacacgcucgccuugggggcucuggggugcccuggcaugcugacccacccuucaccagucaucacguuugcccccagaugccuucugaaguccuagcauauguguac

SEQ ID NO: 4111321 - RNA, 65 nt, Human
guacagagggucacguggugaauauacccgcacccacucaccaccccaaaugaaccucuguucgc

SEQ ID NO: 4111322 - RNA, 66 nt, Human
guacagaucuauugaguuggaacaaaaugucaugcaggucauucuuaacaacucaguagguccuac

SEQ ID NO: 4111323 - RNA, 71 nt, Human
guacagcaggggcugugaaauccccaucaucagugaaugugcauguggaucauauguccuauuuccuguac

SEQ ID NO: 4111324 - RNA, 60 nt, Human
guacagccuuccuggaagggcauuuuggcuaagaauuaagucuuuaaaaaaggcugauac

SEQ ID NO: 4111325 - RNA, 91 nt, Human
guacagcuggccuucggugucacugggucuuuaucagcagcugguugaauccaugcaugcaaaaccgguagauacagagggccaacuguac

SEQ ID NO: 4111326 - RNA, 64 nt, Human
guacaggcauauuucucaaaguacaggcauauuuaugcuuguauuuauauugaauagcuuaugc

SEQ ID NO: 4111327 - RNA, 76 nt, Human
guacauauuaggagacagagauguucaaagugcauuuccaaggugacuguacacacuucucugucuucccauguac

SEQ ID NO: 4111328 - RNA, 62 nt, Human
guacauccuugauuauguaaggauuccauagagaaucuuuuacuacaaaucaggugaucuac

SEQ ID NO: 4111329 - RNA, 94 nt, Human
guacauuccugugugugugugcauguggcaggugugugugcaugggugagcauguaagcacaugugugugcauggauagguguguggggguugc

SEQ ID NO: 4111330 - RNA, 75 nt, Human
guacauugugcucagaaucugucgugugaacaaaugccuuugcuauauaugaaagaaucucagagcacaauauac

SEQ ID NO: 4111331 - RNA, 55 nt, Human
guaccagggaaugaagggggugaggcuuccccucagcuguucuuuucccugggac

SEQ ID NO: 4111332 - RNA, 94 nt, Human
guaccauuaaauuuuaguuauugagaauaauguugcuaugagcauuuguauauuagcugcugaauaaagauauauuuucaguucucuuggguau

SEQ ID NO: 4111333 - RNA, 80 nt, Human
guacccaaaaacauacaucuauuuuuuucuguccaucuguguugagcaaaugugagacuaaaaagaugugcaugugguac

SEQ ID NO: 4111334 - RNA, 80 nt, Human
guacccacuaaauaaaggcuuggaaacuagagugugcagcaaguccuaaagcucuggguuucuagaucccuagugggugc

SEQ ID NO: 4111335 - RNA, 64 nt, Human
guacccaugcuggagugcagaggcaugaucauagcucauacagccucgaacuccugcauuuugc

SEQ ID NO: 4111336 - RNA, 113 nt, Human
guacccucuuuucuagucucauguugaagaucuuuauguagaaggacuuccugaaggaauuccuuuuagaaggccaucuacuuacggaauuccucgccuggagaggauauuac

SEQ ID NO: 4111337 - RNA, 111 nt, Human
guaccuacuguaucuuuucucuaauuagagauggcguauagacuggcucauuacuucugccuaaugagccaggcuccaugccaccucucuaaucagaaaagagauagguac

SEQ ID NO: 4111338 - RNA, 86 nt, Human
guaccucagacucaucuuccuucuuugaugacaagggcucuaaagugagucaccuaaacugcagucugaggaggagucaaggguac

SEQ ID NO: 4111339 - RNA, 58 nt, Human
guaccugagaaguuccaggggagcaggcuggagaggcaccccuggggguuucugguac

SEQ ID NO: 4111340 - RNA, 90 nt, Human
guaccugguuggcuaaaaucaaagagcuugacaauccuagcugcaaggaaggcugggauauauaguucuuuauuccaggcagcaaugugc

SEQ ID NO: 4111341 - RNA, 84 nt, Human
guaccuucugcuaagacaagucaucuggggccugugucuagccuuccagaccaugcuaagaagacauguccauuuagaaccugc

SEQ ID NO: 4111342 - RNA, 64 nt, Human
guaccuugauuuccuggggauaacacuuacguguucuucauuacaagggaaccaaggaaauuac

SEQ ID NO: 4111343 - RNA, 58 nt, Human
guacgcacauuugauugugauugauuggacaaucaguuacaucuguuauguguguuac

SEQ ID NO: 4111344 - RNA, 61 nt, Human
guacggccaagugcauccugguauuucagaaaugugaauuuccugguugcauuggcuuugc

SEQ ID NO: 4111345 - RNA, 63 nt, Human
guacuaagucaggagaagaauugcccccugaaggggaagaagucuguaacuugaucuugguau

SEQ ID NO: 4111346 - RNA, 62 nt, Human
guagagacgggguuucaccgaguuagccaggauggucucgaucuccugaccuugugaucugc

SEQ ID NO: 4111347 - RNA, 72 nt, Human
guagagacgggguuuuaccauguuggucacgcuggucucaaacuccugaccucaugauccgcccaccucggc

SEQ ID NO: 4111348 - RNA, 63 nt, Human
guagagaugaguuucaccauguuggucaggcuggucucaaacuccugaccucaggugaucugc

SEQ ID NO: 4111349 - RNA, 73 nt, Human
guagagaugggugucaccauguugcucaggcugaucucgaauuccugagcucaagugaucugcccaccuuggc

SEQ ID NO: 4111350 - RNA, 89 nt, Human
guagagcauauacaguuacaucacuuacugacaucuguaacuaagcuaaggcacugucaggaaaagaguguuaacuguaaauguaguac

SEQ ID NO: 4111351 - RNA, 83 nt, Human
guagaggacaacaacacgcuuguguuugcugucguuguuaaacccaacaagcagcagaucaaacaggcuugaagaaacucuac

SEQ ID NO: 4111352 - RNA, 113 nt, Human
guagagugugccugacuggugguggaggaccugucuuuauaccuccugaggaucuggagaggaggugucucugaggugagggucagcacuccucccagcacaaacacaccugc

SEQ ID NO: 4111353 - RNA, 86 nt, Human
guagaguuugaguugugaucacugaaagcaucacaacuuauuacuaacaaugugugcuucagugugucauuauuuacagccuuuac

SEQ ID NO: 4111354 - RNA, 78 nt, Human
guagauaaugauaccuaugugacaguauuauugugguaauuaaauuauaaauguugccacauaggugucauuugaugc

SEQ ID NO: 4111355 - RNA, 76 nt, Human
guagauauugucacuuuuauguuacagaugaguauguugaugaaaucaaaagguaacauaauguggccaaagucac

SEQ ID NO: 4111356 - RNA, 70 nt, Human
guagauggagguggcaauuuaaugcagucuuagcuguuuaggauuuagaacuauguuacuuuuaauuuac

SEQ ID NO: 4111357 - RNA, 59 nt, Human
guagauguagccacugcuaaaagagagguccagguucuucccuucaguggcugcucugc

SEQ ID NO: 4111358 - RNA, 81 nt, Human
guagauugugcugcaguuuguaaacauuuuaaguugcauaaacugcuccuugauuuucaaauguaguauaauacugucuac

SEQ ID NO: 4111359 - RNA, 69 nt, Human
guagcaauacaguaagaguacuguaacuuugcauaugugcuuuauauacuguauauuacuguguuauac

SEQ ID NO: 4111360 - RNA, 125 nt, Human
guagcaauguacuucagaaauuagucaguaauuaaaaugcagugguuuggacuaaagugagauuaaaaaagcucaacuggcuuuaguuugucacuggcauugacuuugaguauuuuucauacuac

SEQ ID NO: 4111361 - RNA, 57 nt, Human
guagcacagcuaggagcagagccaggacuuaaaggcaggucuucugaauguggcugc

SEQ ID NO: 4111362 - RNA, 79 nt, Human
guagcagaaucucaaggcuugugaggauaagaagguggcuaaauuagcuuauucucacaggucuugagaucuugacuac

SEQ ID NO: 4111363 - RNA, 64 nt, Human
guagcagagcugggacuagauuagaauguuggucuucucaaucguggcucuaugcucuuucuac

SEQ ID NO: 4111364 - RNA, 74 nt, Human
guagcagagguaagggaaauacaauucacucuuuguauggagaggagguggugaugcuuuaaccuuccugggac

SEQ ID NO: 4111365 - RNA, 72 nt, Human
guagcagcgguggugucggcagcggcuguagcaaagaguuuggcgcgaugucucacaccauuuugcugauac

SEQ ID NO: 4111366 - RNA, 88 nt, Human
guagcuaggaaaaaguuugugcaaacacucagaggcauaaaaaauuaugcaguagcuggaaguuucacacaacuacauuguagaguac

SEQ ID NO: 4111367 - RNA, 78 nt, Human
guagcuuacaaagaaucacucaucuuuagcaguagaaagcacacacagcugaacagacugaaguucugauagaguuac

SEQ ID NO: 4111368 - RNA, 58 nt, Human
guagcuucaaguacucucccuggaaagucuagauaccuucagagcugcugaaagcuau

SEQ ID NO: 4111369 - RNA, 66 nt, Human
guaggaaauucaagaacuaaguaguccuggaaauuuuucagaaagcuuagugucuugcauuucugc

SEQ ID NO: 4111370 - RNA, 101 nt, Human
guaggaagaaugagggggaaaaagacaggaacauagcaaauccaugucuugucuaacaggaugcugagccuucuguucuauuuccaacucucauuucuugc

SEQ ID NO: 4111371 - RNA, 103 nt, Human
guaggaagccugucagccagcagcaugaauucgagccacaugugcauacaauauggugaaugccgcagucuguugcuagguagguugaauucaagcuuucugc

SEQ ID NO: 4111372 - RNA, 85 nt, Human
guaggaaguaggacuuuggcgucagaacugguuuugaagaacuuagucaauugcugaugcuaaguggaugaaccugaacucuugc

SEQ ID NO: 4111373 - RNA, 92 nt, Human
guaggacuguuugucaaaacuaggagugaguuugagauucaggauuaagguucaaguagggaaucuccauuuacccugcaucucagucuuac

SEQ ID NO: 4111374 - RNA, 75 nt, Human
guaggagaaaagugaagaccgucaguagaagcagaaagaacauaaaagcuccucuguugagcauuuuuccccuac

SEQ ID NO: 4111375 - RNA, 94 nt, Human
guaggagccaacaugauuaaaagauuuuaaagcaauuuacucgauagaaggguugggcuuaaucaggacuugugaucauggcaaugguuccugc

SEQ ID NO: 4111376 - RNA, 68 nt, Human
guaggaggcauucuugucaguggggucaggguacaggccacuggcccugucagcacagaauccacuac

SEQ ID NO: 4111377 - RNA, 66 nt, Human
guaggaggguuagagggaaauauucuuuugcuauuuugaagaaaguaucuuggaaaacucuucuau

SEQ ID NO: 4111378 - RNA, 101 nt, Human
guaggaucauugauuggaccuaugaugaaaugauagguuuguuauagguggagaagaacaaauaggcugagccauuucaaguagaccagcuaagauuuuac

SEQ ID NO: 4111379 - RNA, 66 nt, Human
guaggcaaaucucaguuggccucugguugcuuuugccugagaggugugcugagaucaucugccuau

SEQ ID NO: 4111380 - RNA, 56 nt, Human
guaggcacccagagccugaggggacugcagaacucucccucagacagggugccuau

SEQ ID NO: 4111381 - RNA, 92 nt, Human
guaggccagcagagggcugaaggaguuuggguagucauacaccuguuuccacgggucacugaggcauucaugcucugguccucuuggcuugc

SEQ ID NO: 4111382 - RNA, 72 nt, Human
guaggccauggugguugucucuggcaucagucugaaaugccagcuacauccaagcaacucucaccuggcugc

SEQ ID NO: 4111383 - RNA, 130 nt, Human
guauggcaauuccaagcuaagcuguauauugaaugaugcauuuguuucccaucaaggugccuggcacagcacuaucggaaguuagaguguguuauucccucauacaucaaagucugcuugccaguguuuu

SEQ ID NO: 4111384 - RNA, 64 nt, Human
guauggcagcaguccauugccucauccaggacacgcugcgugagagccaggaucugcucuauac

SEQ ID NO: 4111385 - RNA, 69 nt, Human
guaugguuuuaggccuauaauuauuuacucuauuuaagcccagguaugguucuaggccuauaauuauau

SEQ ID NO: 4111386 - RNA, 63 nt, Human
guauguaucuuucuaagggugagagaucccuaauuuguuaguuacaugcuuagagaugcaugc

SEQ ID NO: 4111387 - RNA, 60 nt, Human
guauguaugugugcauacacuuuauacaauacauaaaguguguauauacauaugguauac

SEQ ID NO: 4111388 - RNA, 71 nt, Human
guauguauuuaguauaauggggcaaaaguauuuuagggggcuaaaguccuauuagcauauugaauacacac

SEQ ID NO: 4111389 - RNA, 59 nt, Human
guauguccuggacauuucccaagagcaaaaaugcagcaugagagaguagcaggacauau

SEQ ID NO: 4111390 - RNA, 56 nt, Human
guaugucuuaggguucaguaacaguaacugacuggcccacugagcccaggacacac

SEQ ID NO: 4111391 - RNA, 68 nt, Human
guaugugaccuucugaaugaguaucggaguuaaucuaaaguacauccuacucaccugaaggaauauau

SEQ ID NO: 4111392 - RNA, 75 nt, Human
guaugugcucaguaaguacaugaagaacaaauacauaaauaaauggaugaacuggaaugucucuguagcacauac

SEQ ID NO: 4111393 - RNA, 64 nt, Human
guauguguguguguauguguauguauuuuuuccaauguauguguauacaugugcacacacaugc

SEQ ID NO: 4111394 - RNA, 59 nt, Human
guauguguguguuucugcauauuuuuaaggaaacuagaagacaggaaauacaaaccuac

SEQ ID NO: 4111395 - RNA, 69 nt, Human
guauguguugcagggcuggaacauggaauuguguucuacacgaauuuauagaagcgcuugcagccagac

SEQ ID NO: 4111396 - RNA, 70 nt, Human
guauguuaagagaagcucucucugaugaaaauaacucugcacuuagggagaaaugcuucccucaagauac

SEQ ID NO: 4111397 - RNA, 85 nt, Human
guauguucacaucuacugaaugagcaguguugaugggcagacuugagcuuuguuacauuccucauuucagugaauguguauuuau

SEQ ID NO: 4111398 - RNA, 81 nt, Human
guauguuccugccguaguucuuagagcaaaauuucaggaugugagucuccacacacugcucuguauaugagcaggaacuac

SEQ ID NO: 4111399 - RNA, 61 nt, Human
guauguuucugcccaucucuggaaaaacccagguaggcacuggugggaagagagaacaugc

SEQ ID NO: 4111400 - RNA, 75 nt, Human
guauguuugaagcaaagugguugucaucguuucugugauguuaauauuuauaggccacuuugugucaguaugugc

SEQ ID NO: 4111401 - RNA, 97 nt, Human
guauuaauuuccuuccuuagauccuucaaucacggacaaggggauagucaauaaauucugugauuuggaggaaugcagugaaaggaauuguuaaugc

SEQ ID NO: 4111402 - RNA, 78 nt, Human
guauuacagauuucuaggggagaggaagaagugaugaugaauuuuauccuguucuacugccuuuagaaguaaaaguac

SEQ ID NO: 4111403 - RNA, 84 nt, Human
guauuagguuggugcaaaaguaauugcaguuuuugccauuaaaguaggaccaaaauagcaauuacauuugcaccaaccuaauac

SEQ ID NO: 4111404 - RNA, 63 nt, Human
guauuaugaaugccgaggcggcaacaaaaauuuugacagaauugcgccgccuugcucgugaac

SEQ ID NO: 4111405 - RNA, 85 nt, Human
guauuaugagcucuuugaugggaguguuucugcaguggcuucacauucauuaguacaguuccaucaaagcaggccacauaaucac

SEQ ID NO: 4111406 - RNA, 64 nt, Human
guauuauucucagcuuugggauauggaacagcagucacguuuucacccaaaggagggugaucac

SEQ ID NO: 4111407 - RNA, 56 nt, Human
guauucaaggauuuuguucuacagaugcaauggugucacuggaaaaucuugaaugc

SEQ ID NO: 4111408 - RNA, 87 nt, Human
guauucaauuauaacuaucuucaucaugaaauguuagaauuagacagagcucagcacuuugauuuuauuggugaggaaauugaauac

SEQ ID NO: 4111409 - RNA, 98 nt, Human
guauucacuaauccuggaaauuucaagcaaaguagcuaucucucuguguggagaaaagauguuaaguuauuugagguuuucagcaugcugaaguuuac

SEQ ID NO: 4111410 - RNA, 72 nt, Human
guauucaugucagaaucuacauucuacuuugcaaaauuaguuaagagauuguauuucugaguuaaugagaac

SEQ ID NO: 4111411 - RNA, 56 nt, Human
guauucucaggugguuccucgaggccuuugggcuccuggguucuggaugaggaugc

SEQ ID NO: 4111412 - RNA, 55 nt, Human
guauucuguuuacagugagcaaugaaaaagaugccacuguguccaccaggaaugc

SEQ ID NO: 4111413 - RNA, 72 nt, Human
guauugagcuccaaguacauuucucccaacacuaaauuuccauuagaaauaaaauguuuuggggcugggcac

SEQ ID NO: 4111414 - RNA, 98 nt, Human
guauuggaauuauuuuacaugcaacauugguauuaguguggcugaucaaagaauugauuguacuuaaauaugcaaauaguauuaggauaauacaauac

SEQ ID NO: 4111415 - RNA, 55 nt, Human
guauugguauuauuuugucaugcagccaauuagcuguaggcauaugaccaauuac

SEQ ID NO: 4111416 - RNA, 110 nt, Human
guauuguguaggguacucagaaaagaccugugguagcucuaaauccucauuacccaacaggauggcaaagauaguuucauggguucucucugauuucuuacuuccaguac

SEQ ID NO: 4111417 - RNA, 90 nt, Human
guauuuaauacauguaugguauuuuauacauguauguaugguauuuuauacaugcaugggguaaugguauuuuauacauguauuuuauac

SEQ ID NO: 4111418 - RNA, 55 nt, Human
guauuuaauuccauuaaguuaguauuaauuuuaacuuaauacugggauaagaugc

SEQ ID NO: 4111419 - RNA, 58 nt, Human
guauuuaguuaaguguuguuauaaauguaaguauuucugcaugcauuuaauuaaaugc

SEQ ID NO: 4111420 - RNA, 76 nt, Human
guauuuauuuucacagaauaucaccaaauaagcaugaagcaaacagucuggaugaaauuuaggugcagauaaauau

SEQ ID NO: 4111421 - RNA, 66 nt, Human
guauuucuaguucuagaucccugaggaaucgccacacugacuuccacagugguugaacuaguuuac

SEQ ID NO: 4111422 - RNA, 86 nt, Human
guauuucucauucuccaacaugucuccagugccugacacagaaugaucugugugaucaggugaucaugugaguggaugagaaauac

SEQ ID NO: 4111423 - RNA, 87 nt, Human
guauuugagaaacacaaggaguagagcauuuagggcugaauuuuccaguaaaauugcuauuuaacuuuuauguguaguuucagguau

SEQ ID NO: 4111424 - RNA, 82 nt, Human
guauuugugaagaucugagcccucagguccugaaugguaauggccccagucucugacuuagggucucuucuucuccaggugc

SEQ ID NO: 4111425 - RNA, 81 nt, Human
guauuuuaaaguagguggcugcaguaguguagggucugggcaaucagacaccucacuggcagcuucacuguauuagaaugc

SEQ ID NO: 4111426 - RNA, 55 nt, Human
guauuuuaagugacuacuagguuuuaaucuacugccucauaguccuugaggucac

SEQ ID NO: 4111427 - RNA, 100 nt, Human
guauuuuaauaaggacuugaaugauguauaauauugagagcccaagcagcaggaaaggcauuucagaccauaugugauuaucugaguccugauuaaguac

SEQ ID NO: 4111428 - RNA, 92 nt, Human
guauuuuacauuuaauagcuugccuaauccucaugauccugaaaaauuagcaguauuaucaccccguguuggucaaguucaguguaagaaac

SEQ ID NO: 4111429 - RNA, 59 nt, Human
guauuuucuauucauugucuaugguggucuagcuacuuuagaaaaggaacagaggauau

SEQ ID NO: 4111430 - RNA, 95 nt, Human
guauuuuuaguagagaugggguuucaccauguuggccaggcuggucucaaauuccugaccucaggugauccaccccucuuggccucccaaagugc

SEQ ID NO: 4111431 - RNA, 79 nt, Human
gucaaaauucccaaaugcagucuuagaauccuggcaggcacacagacaaauggggcuuggcaggucugggauuguugac

SEQ ID NO: 4111432 - RNA, 77 nt, Human
gucaaacgugaggauuuuagauaagacagcaaggguuuuuuuccccuaguuuguagaaaucuagaaauuuaagugau

SEQ ID NO: 4111433 - RNA, 82 nt, Human
gguuuuggagacugaguugcccugcccugugcuugcagauccacucagugugaagggcaggacagcuuccccuuuccacacc

SEQ ID NO: 4111434 - RNA, 73 nt, Human
gguuuugggaaaaauaaugcacagauauuguguguaaaaugcuaauauuuuguaucuauuguuuccauaaacc

SEQ ID NO: 4111435 - RNA, 88 nt, Human
gguuuugggacuuauugucuguccgggucaaagcaccccauuucuaugaugggagcucugacccagacacacaauaaggcccaaaacu

SEQ ID NO: 4111436 - RNA, 92 nt, Human
gguuuuggguugguggacuucauuuucuuucacgcugcugcuugcccaguggguguagacagcaagaaaaugaagaaaaucaguccaaggcc

SEQ ID NO: 4111437 - RNA, 60 nt, Human
gguuuuucuguggaaagcuguuaggaaguuauugauaaacagcuacucugcagauaaauc

SEQ ID NO: 4111438 - RNA, 79 nt, Human
gguuuuugguucuguucaguugauuagacagagugauguaauuauuguauucguagauugaacaguaccuuaaaaaacu

SEQ ID NO: 4111439 - RNA, 62 nt, Human
gguuuuugucgaguuccuugaccugguuccugauaacuuggcagcggacccuggcccgaacc

SEQ ID NO: 4111440 - RNA, 101 nt, Human
guaaaaaaaaaaguggaaccaaguaggauacaaggagaaaauaauguuauucuuuuuauuacuguuccuuaaauccucucaugggcuaguucuuuuccugc

SEQ ID NO: 4111441 - RNA, 82 nt, Human
guaaaaccacugugugggccaaacuaaacauguuuacuagacucaacuccugggcaguuugccccgucacccuggugugugc

SEQ ID NO: 4111442 - RNA, 93 nt, Human
guaaaagcaacaguaccuaaccuguaaguugauaauuaaguggcaugacacguuaaacauuuagcauaguaccuguaacauguuagcuuuuau

SEQ ID NO: 4111443 - RNA, 62 nt, Human
guaaaaggucaaggccaagucuggggucugaauauuuuccuuucacgugcugugccuuuugc

SEQ ID NO: 4111444 - RNA, 56 nt, Human
guaaaauaagaggggacuugauuuagauuggcuuucacaguccuucuugguuuuac

SEQ ID NO: 4111445 - RNA, 114 nt, Human
guaaaccaaagguaucgaauuuguggcuuuugcuagcuuugcagaaaagauuuuuuuaaaauacauuucuugauagugcaaaacuagcaaaagccacaaauggaauggguuugc

SEQ ID NO: 4111446 - RNA, 83 nt, Human
guaaacuacgcguugucuguaacacacucuucagugucgucugauucugaacuguguacauuguagauaacugauagcaaugc

SEQ ID NO: 4111447 - RNA, 98 nt, Human
guaaagaauaagaagaggguuuuuaauugcauuuaaagauggacauagcaguacgucuauucauuuuguaguuaaaauacauuauuuuauaucucagc

SEQ ID NO: 4111448 - RNA, 75 nt, Human
guaaagucuucaguuaugauaauuacuguuacaucgauuauagaugagcaaggcugggucuaauggggaaauuac

SEQ ID NO: 4111449 - RNA, 86 nt, Human
guaaaugagaggaaugagguuaaggacuuuccaccaucaaccagaggaaauucacuaucucauaacguccuuccuucuaauuuuac

SEQ ID NO: 4111450 - RNA, 73 nt, Human
guaaauggcuuugaaguucagcuuuuggaauaaaauaaaccaagagcaauagcacagagcaaucaauauuuac

SEQ ID NO: 4111451 - RNA, 126 nt, Human
guaaaugggagggugcuggugucaggcauggcuggcccugggagugcagacaggcccaccaggccucugccagcucugugggucucgcuuagccucauucugugugccggcucucuuuccacuugc

SEQ ID NO: 4111452 - RNA, 118 nt, Human
guaaaugguguuugcaggcaaguaaugauuuuuccucccucucuauaaaugauauuacuuugguagagagagaaaugaaaugugcugauguuauuuguucuuugugaaaccauuuugc

SEQ ID NO: 4111453 - RNA, 119 nt, Human
guaaaugguucaagucuacaccaggaauaagagcuacagccaguucuguuugacucuaaaauucagaauuauaguugcuuuuuaaaguuaccuaggacaaauguaacaggauuauuuac

SEQ ID NO: 4111454 - RNA, 62 nt, Human
guaaauuauuucaagaucaucucuuucuuauauuaauagagaugauggaagggauaguuaac

SEQ ID NO: 4111455 - RNA, 88 nt, Human
guaaauuucuuucaaucgcuauuuguuuuaaagucacugcuuauauuuguggcagauaaaauaauagggaaaaggaggaauaauuuau

SEQ ID NO: 4111456 - RNA, 77 nt, Human
guaaauuuucagagcacuagagaagaaugagucucuccagcucauacugccuccuuuucuucugucuuuguguuugc

SEQ ID NO: 4111457 - RNA, 60 nt, Human
guaacacugugcaguguaaugcuggucuuugaauagcucagcagucuuuauagauguuac

SEQ ID NO: 4111458 - RNA, 77 nt, Human
guaacaucugaccauuacaagacauuuuaaaauauagaaaagucugaagaguaaugucagaucaccccuaauguuac

SEQ ID NO: 4111459 - RNA, 62 nt, Human
guaaccagcuggcuauuuacaaaaauuguaaaggcaacacugauuauggcugagcuggguau

SEQ ID NO: 4111460 - RNA, 57 nt, Human
guaacccggccagugucuagacucuucauucaggaaucacacguuuggccaggaugc

SEQ ID NO: 4111461 - RNA, 59 nt, Human
guaacucgaugcaauucacuuuguggaaccaagccacaaagugaaaagcaucgaauugc

SEQ ID NO: 4111462 - RNA, 71 nt, Human
guaacugagaguguggcuuccaggcccgcacugggagggaacagugggugguuuggaugccauaccuuuau

SEQ ID NO: 4111463 - RNA, 63 nt, Human
guaacuuuaaaugauguugguuuaauuugaguagcuuuuuaauuaaaguaaaccaacauuugc

SEQ ID NO: 4111464 - RNA, 79 nt, Human
guaagaaaaauaaauguccagaguaaagcacauucuuauuucaguaaaggguugugugaagcuauggcauuuuucuuac

SEQ ID NO: 4111465 - RNA, 58 nt, Human
guaagaaagguaggcuuucugagguuuaaggcagcagaaaaguucauaccuuuuuaac

SEQ ID NO: 4111466 - RNA, 70 nt, Human
guaagaagcccagggcuaauaggaaccagagaauauuuaguucuggguguucugggugaucuuuucuugc

SEQ ID NO: 4111467 - RNA, 68 nt, Human
guaagacacauugagaaacacaagaaacccauuguucucuggauguuugugcauuucagugguuuugc

SEQ ID NO: 4111468 - RNA, 55 nt, Human
guaagacgggagucaggugagcucgugcacgggccguaacugccucucgucuggc

SEQ ID NO: 4111469 - RNA, 71 nt, Human
guaagagcaggaaagaaaaaucuguguguucuagauuggacaucaaugguuuaucuuccaaaugguuuugc

SEQ ID NO: 4111470 - RNA, 64 nt, Human
guaagaggaggcggacacagguaguguugaacacucucaaucucugccacaugccucuauuugc

SEQ ID NO: 4111471 - RNA, 61 nt, Human
guaagauggcuagaaaagugaauggcacauaguuacuauucaaaguacuagcuauuuuuac

SEQ ID NO: 4111472 - RNA, 74 nt, Human
guaagcaauagaagcgcugccuuaacuaaaugucucugggggucauuaggacagugagcgguagugauugcugc

SEQ ID NO: 4111473 - RNA, 68 nt, Human
guaagcacgcuguaauaauuguguucucuacaaaaauggagaaauacuuaaucuuugcagguuuuuau

SEQ ID NO: 4111474 - RNA, 61 nt, Human
guaagcaugauuaauaugcuuacugugcugggcauauuaugcaaauuaaauuacugcuugc

SEQ ID NO: 4111475 - RNA, 86 nt, Human
guaagcugucacacugaggaagacagcagcuguguuauuccaugauuuauagaacagauuugcauuuccuugccuuugaagcuugc

SEQ ID NO: 4111476 - RNA, 63 nt, Human
guaagcuuggagcaaugauugcaccuaaacauguugacugcauucaaaucuccaggcucaaac

SEQ ID NO: 4111477 - RNA, 67 nt, Human
guaaggaaugcuugaauguuccugacaauguuuuuguauaauugcaggagcauuugauauuuauuac

SEQ ID NO: 4111478 - RNA, 57 nt, Human
guaaggcccuugcucaaggccacacggccaauaagauguauugagcagagccugugc

SEQ ID NO: 4111479 - RNA, 62 nt, Human
guaaggcuaaugucuuugugguugguagugagugcaaguuucucaaaguacaucagcccuac

SEQ ID NO: 4111480 - RNA, 80 nt, Human
guaagggcaccuguuuuagcuuggucaccuccuuugaaccuaaaacagaggccagccauaucuacagcaaguguccccac

SEQ ID NO: 4111481 - RNA, 58 nt, Human
guaagucugaguguaauucacaaugguuccuauuucugugaacugcauuacaggauac

SEQ ID NO: 4111482 - RNA, 70 nt, Human
guaagugacuuucaaggaucauuuugccaguuggauuuguaaucucaggggcagugauccuaaguacugc

SEQ ID NO: 4111483 - RNA, 64 nt, Human
guaagugcuguauaugcaagaggaagagauaguagucaguucuucucucuuuauuagccacuuc

SEQ ID NO: 4111484 - RNA, 65 nt, Human
guaaguggagaggccaggcccuaggcuccgggaagaggguugagggccugauggcucccgcuggc

SEQ ID NO: 4111485 - RNA, 114 nt, Human
guaaguuaaauggaaugagaucuucuucagugcaccugaugucuugggaagggugaguugaggcgugguggaugugaaacaugaucucauuauaaauguucccauuuguuuuau

SEQ ID NO: 4111486 - RNA, 71 nt, Human
guaaguuaguguguuauauaccaagcuucuuauagaagaggcuauagaguguuuguauaauauacccuuau

SEQ ID NO: 4111487 - RNA, 63 nt, Human
guaauacauauaugguacuuccuggcauuauugugucaagauaccaccauuauaugucaugac

SEQ ID NO: 4111488 - RNA, 63 nt, Human
guaauagcagcugaaagggaucucuacagauuauuacugucaucuuuucgcagcugcaguugc

SEQ ID NO: 4111489 - RNA, 55 nt, Human
guaauaggagucugugugauuuugucaguaauagaaaucacaugacagcuguugc

SEQ ID NO: 4111490 - RNA, 93 nt, Human
guaauaggcucaacauaucuggagacuccuggucuauaccacaauaauuaagcuaaaggaauucuagguagaaaguaugcagccacuuauuau

SEQ ID NO: 4111491 - RNA, 78 nt, Human
guaauagguuauucaguguguuauucuacuuucauaaucuuugugauccugagaugucauguuaaugcacuuuauugc

SEQ ID NO: 4111492 - RNA, 72 nt, Human
guaauauggcagaaaagauucuggauuuagaaucagaacacuuaaaucuacauuucaguuuugccccuuugc

SEQ ID NO: 4111493 - RNA, 86 nt, Human
guaaucaaacugccuuuacuagccaugugugagaagagcuauuucuuauucucuuuuaagccucuggcauagggaggaaugaauau

SEQ ID NO: 4111494 - RNA, 66 nt, Human
guaaucagguacagggaugcugagugauggggaaucaaaggccucuguccuagugccuaaguuuac

SEQ ID NO: 4111495 - RNA, 64 nt, Human
guaaucucagcuacuugggaggcugaggcaggagaauugcuugaacccaggaagcggagguugc

SEQ ID NO: 4111496 - RNA, 55 nt, Human
guaaucucauggagauuaggcaaaucuguauggcucuaauuuccauaugaauugc

SEQ ID NO: 4111497 - RNA, 75 nt, Human
guaaucuccaaggguuguggguggucacaugccagcauuacaaguagcuacucucaaggccuauauggagguugc

SEQ ID NO: 4111498 - RNA, 91 nt, Human
guaauggaucagauuuuggaggaauucaaugcaugguaauuaguccauggcagcuuugaauuucuugaaauuaggaacauugauucuuuac

SEQ ID NO: 4111499 - RNA, 105 nt, Human
guaaugggcauagccaagauuguggcagaccuucccuucuccuuccaugucuugaaggucgggagcaagccggagguacuguucauaauagggggcagccuggac

SEQ ID NO: 4111500 - RNA, 81 nt, Human
guaauguaauuuaguaaauuaugauuugauggcugggcaucagccccaguguugaacaguauuuggacuaugauuacuugc

SEQ ID NO: 4111501 - RNA, 60 nt, Human
guaauguacugcagccagaugugcugugaaugaagagccuuuuggcuucaagugcauugc

SEQ ID NO: 4111502 - RNA, 65 nt, Human
gucaaacuuguaugccgggacuagcucaugacaagcuuuguaugaucugcaaacaaguuuuagac

SEQ ID NO: 4111503 - RNA, 122 nt, Human
gucaaagaaaggaaugggucaggccugaguaggcugagcaguucuccuugguaggggcugcccugugagcuccacacugaggggaacugauuggaauauggggacugguucugccuagugac

SEQ ID NO: 4111504 - RNA, 66 nt, Human
gucaaagaugaugcugaaguuauuagcuugggugacugaggaaaugauaaugccauuaacuuugau

SEQ ID NO: 4111505 - RNA, 104 nt, Human
gucaaaggagaggggcgcauggcugugugugagaagcagguugagggaacuccuucaugcauugcagcacauucagcagcguugccagccaaucucuacuugau

SEQ ID NO: 4111506 - RNA, 127 nt, Human
gucaaauaauucaucuguccuucuugccuuuggagaauuaagagagaaggggugucugcuuggcagagggcaucagagacaaaccuuguuuuaugauggagggggacggauagacgaagagaaaggc

SEQ ID NO: 4111507 - RNA, 56 nt, Human
gucaaauauuaugcagcuuggauacccaauuuaguaugagcugcuuuguauuuggc

SEQ ID NO: 4111508 - RNA, 76 nt, Human
gucaaauugucuagaauugcuuggcagaugcacugagaauaauuucccuaucuuucaacuagccugaugauuugac

SEQ ID NO: 4111509 - RNA, 66 nt, Human
gucaacaaguaguuuucuuccacaguguuccuagcugggugugcagaaagaaagagacuuggggac

SEQ ID NO: 4111510 - RNA, 55 nt, Human
gucaacaauuccaguuuuuacugugauaaucacaaagggagacuaaacuguugac

SEQ ID NO: 4111511 - RNA, 107 nt, Human
gucaaccccauuucuccagagcaggauguacuauuccuuuauaaauugcuuugaaacgucuuuauaaagguuugugcauauuugucugcuuggggagcuucagugac

SEQ ID NO: 4111512 - RNA, 62 nt, Human
gucaacuacauguuuucccucagauggaaaauuccagaggaauugggaaacauguacaugau

SEQ ID NO: 4111513 - RNA, 58 nt, Human
gucaaguacaaggcaguuucuacuucuacauuccuguagcugcagccauguacauggc

SEQ ID NO: 4111514 - RNA, 84 nt, Human
gucaaguacugugguaacacuucauugcuaagaacaagguauuuccuucaccuuucagaguuaaugagucuaucagugcuagau

SEQ ID NO: 4111515 - RNA, 130 nt, Human
gucaagugauggggcgggggauggggaaagagaagucugccgcuccucuaggcuaccgcaccgccuuaaguggguggcucggccagugcaggccucacuuuccuccccuguaaggucuggggggcuugac

SEQ ID NO: 4111516 - RNA, 59 nt, Human
gucaauaaguuuguaacuggauuucucucuggagccaguggaugaggacuuaacuuggc

SEQ ID NO: 4111517 - RNA, 87 nt, Human
gucaauauuaauggggaggauucuggguccugugucuugcuaggauuuccagggacggcaauuccagaaguuuuccgauuaguuggc

SEQ ID NO: 4111518 - RNA, 102 nt, Human
gucaaucaccugaggacuuauuaaaaugcggauuuggcuacaguaggucuggagugguaccugagcaucugcauuucuaacaagcucccagaagguguggac

SEQ ID NO: 4111519 - RNA, 84 nt, Human
gucaaugaauguguguuguuacaagcugccagguuaaagauaauuuuuaaugcaacgugagauaauuaacacaaaucuauugac

SEQ ID NO: 4111520 - RNA, 66 nt, Human
gucaauguucacugucuccuagggggacuuccuggaggaggccaacuuuggagaacaggcauugac

SEQ ID NO: 4111521 - RNA, 75 nt, Human
gucaauguuuugccagaaaaucaaagucagaagccaccuaggugcgcucagaaaagauuuucuucaaauauugac

SEQ ID NO: 4111522 - RNA, 80 nt, Human
gucacaaaugauugaagcuagaacaaccauuaagggaaaaccaagaaaaucccaaaugauuuagccuuagucuuugagac

SEQ ID NO: 4111523 - RNA, 72 nt, Human
gucacaacuauucagcucuggaguuguauagcgucaggggccauauacaaugagugagugaauggguguggc

SEQ ID NO: 4111524 - RNA, 55 nt, Human
gucacaaugcaaguguucaguggccacaaguggcuagugacaacuguauuggaac

SEQ ID NO: 4111525 - RNA, 75 nt, Human
gucacacauaacuguaguuauaaagcuaucccuuaagaauuggguagauuuaaaacauuacagcguugucaugac

SEQ ID NO: 4111526 - RNA, 63 nt, Human
gucacacugaaauucuuugauguuaccuaaggucauaggaauguuuagaaugucagaaugugc

SEQ ID NO: 4111527 - RNA, 65 nt, Human
gucacauccaggaugccacguuauauuuagucauuaugucuucuuuggcuccucuuggcuguggc

SEQ ID NO: 4111528 - RNA, 73 nt, Human
gucacaugauucagcccaauuuuucuaccccuuccccuggcaacggugguugaacuugggcuggucauaugac

SEQ ID NO: 4111529 - RNA, 73 nt, Human
gucacaugugacaguuuugcuaaaagguugagauuagucguaaagugucuuuaucaagucuguucuuugugac

SEQ ID NO: 4111530 - RNA, 81 nt, Human
gucacauuauguugcacaaaguccauccauucuaccuagggagaaagauggaagagacuucauggggcgaguauuuuuggc

SEQ ID NO: 4111531 - RNA, 61 nt, Human
gucaugggccacauuccaaaccagcugccuugggcagcugcugggagaagugagccaaggc

SEQ ID NO: 4111532 - RNA, 66 nt, Human
gucauggguauaauuuuagauguuuucuggcucugaagccuugcauuuaaauuugaacuucagaac

SEQ ID NO: 4111533 - RNA, 57 nt, Human
gucaugucuuccuugcacacacacacuagaugguguugucagcucaggaaacaugac

SEQ ID NO: 4111534 - RNA, 83 nt, Human
gucaugugagguauaauuuucaguguaaauguuuuauuacaauauaacauacauacagaaaagugcauaaaccuuauguguac

SEQ ID NO: 4111535 - RNA, 63 nt, Human
gucaugugcuaagcaggccucuggcucuuguuuaccucuaugaggccucuucauggccaugau

SEQ ID NO: 4111536 - RNA, 102 nt, Human
gucauuaaauauuuaugcuccuuagcugauguuucugggagaauauuuaauuauaaaagaaguguuauuguccagcacaguuggggauagauucggugagac

SEQ ID NO: 4111537 - RNA, 73 nt, Human
gucauuacauaugaacuuuauaacuuggagacacaggcccaguaacagaaauuaagguucauauguucuuggc

SEQ ID NO: 4111538 - RNA, 73 nt, Human
gucauuacucucuaauugaugccugggguagcucucuucccugaagcaaggcccagagcaucagcagaaugac

SEQ ID NO: 4111539 - RNA, 65 nt, Human
gucauuacuuaaacccagauuauuauagacuguucucuaauuuuucugucugguuuuagaguggc

SEQ ID NO: 4111540 - RNA, 68 nt, Human
gucauuccuauccauuugauacuguuugccaccacaagaugacagggucaggguucaaaggaacugau

SEQ ID NO: 4111541 - RNA, 77 nt, Human
gucauuccugguugcuggcucugaagggcagguaaauuagaucaauguggccuggaggggaccaggaccaggaugac

SEQ ID NO: 4111542 - RNA, 70 nt, Human
gucauucuucucuuuugaaacuucacagaucucucuccuucuggaaaguuuuacugaggacacauguggc

SEQ ID NO: 4111543 - RNA, 70 nt, Human
gucauugagaugagucagcucugcucugaauauucccuuauuuuagcaaggugacaucaugcugaguggc

SEQ ID NO: 4111544 - RNA, 96 nt, Human
gucauuguaggucauagggagaagcccuuuuuccugguaguuuuguguaccauaauaaacaguagagaaaggugguugucuguguucuguaaugau

SEQ ID NO: 4111545 - RNA, 58 nt, Human
gucauuguuucaaaucuuucucucccuguagcagugagagccuggucugagauaggac

SEQ ID NO: 4111546 - RNA, 75 nt, Human
gucauuuagaaauguggcagaaucauugugugguaauuugcacauaaauggugccauguuuuauuuagccaugac

SEQ ID NO: 4111547 - RNA, 81 nt, Human
gucauuucuuuauuucuucauuccguagauauuuauugagcaacuuagaugaaucagaagagugugagaaggaggagagac

SEQ ID NO: 4111548 - RNA, 76 nt, Human
gucauuuggaaauguaagaaugcaauuaagccuguaaaaauaacuaggauuuugcucauucucauauuuccuuugc

SEQ ID NO: 4111549 - RNA, 84 nt, Human
gucauuuuuagauuaccuucaaacuuucauuaaccagaaauaaggauuugaguagagagaguugaagagcauaauagaauugac

SEQ ID NO: 4111550 - RNA, 61 nt, Human
guccaaaaguuuucccccagugguuuuaaguaaucuucuggaucugagggggaagauggau

SEQ ID NO: 4111551 - RNA, 98 nt, Human
guccaaagucaagugucagcaugguuggguucuggggagggcucucuuccugguccccagauggccagcuacauguuguguccucacauggcugggac

SEQ ID NO: 4111552 - RNA, 83 nt, Human
guccaagauacaagugcuagcagauauugugucuacuggggacccacuccugguucacagccuucucuucacugugucuucac

SEQ ID NO: 4111553 - RNA, 73 nt, Human
guccaaggguucacagacucuugauugucuaagcauuguuaagauccaggcuucugugcaauagcucuugaac

SEQ ID NO: 4111554 - RNA, 83 nt, Human
guccaaucucugccuuacucauuuuuauaaagaauacaguuguuucuacaguuucuuagaugauuaaugaugggggauuggac

SEQ ID NO: 4111555 - RNA, 87 nt, Human
guccacagagaucagcaguguugugauccaggucuucuauuuuaagggacauauauaagacagaugcaaccugcuagcuauggagac

SEQ ID NO: 4111556 - RNA, 77 nt, Human
guccacagagcccugcaggaggugggagaguagcuagcaagcuuuuccuccucucccucccugccuggcccuggggc

SEQ ID NO: 4111557 - RNA, 104 nt, Human
guccacauuuuuagauauuuguuauagcaacaccccaauuuucuaguacuaguuucuguuuuaguccauuuguccugcuauauaaaagugccugagacuggguc

SEQ ID NO: 4111558 - RNA, 84 nt, Human
guccacccuccacugcagccuagggaccacaguauuguacuguucuguacacacggggcucagggucuguaggugaaaauggau

SEQ ID NO: 4111559 - RNA, 63 nt, Human
guccacugaaggucaacauagagcaaagcuuugcuauggcuccagauaugucaccuucaagac

SEQ ID NO: 4111560 - RNA, 126 nt, Human
guaauguauucuugcuguuacaauuguauguuaaauuuguuaaaagugagugacaguugacuaauacuguccugcaauuaaggaagacauacaaaaaaaucagguauuggcuaauggauacaugac

SEQ ID NO: 4111561 - RNA, 59 nt, Human
guaaugugauuauuuaaaucaauaaaaauuaugugguugguauaaguaaucauaauugc

SEQ ID NO: 4111562 - RNA, 62 nt, Human
guaaugugccagagacaugacuagcugccucuuuggcccuggggaagugugucuggcccugc

SEQ ID NO: 4111563 - RNA, 59 nt, Human
guaauucagacaguuauuuacuuaccuguuagugaaaagucuuauauugucugaauugc

SEQ ID NO: 4111564 - RNA, 60 nt, Human
guaauugggagcuaauaccagauacacuuugugucuacuccugugcuagcucccauuuau

SEQ ID NO: 4111565 - RNA, 60 nt, Human
guaauugugguuuguugauaaauauuucaggucucuagaccuggaacaaacugcaaugac

SEQ ID NO: 4111566 - RNA, 69 nt, Human
guaauuugagcaaucuaauaguuuagcguguuucuguaccaggcugucuguuguauuauucaauauuau

SEQ ID NO: 4111567 - RNA, 75 nt, Human
guaauuugauguggccccacuuagcugugcuugcuuuuguugaguacaguuuuggugucauauccaugaaauuau

SEQ ID NO: 4111568 - RNA, 88 nt, Human
guaauuuuauuuguauuucaugcaguaaaauuggaccagugauuguguuugaccuggccuauuuauuguguugaaacugaauuauuac

SEQ ID NO: 4111569 - RNA, 97 nt, Human
guaauuuuucuuugugagcuaauuuucaaugagguuuuaacuugggaaacauuuuguaaacuuguuugaagguauggcccaucaaauggauuugugc

SEQ ID NO: 4111570 - RNA, 62 nt, Human
guaauuuuugcuagaagaucagcagcuaagagugcuguucauuuacuguaggcaaaaauugc

SEQ ID NO: 4111571 - RNA, 95 nt, Human
guacaaaacacauuuauagguauauucacugaaugaaaacugguuucuuugccacuccucagugagcauacaguauagaauguguauuaaugugc

SEQ ID NO: 4111572 - RNA, 77 nt, Human
guacaaauuaauaauuauuugagagcagaccagaaaucuguguuugaauaaguucuccaagugauucugaugccugc

SEQ ID NO: 4111573 - RNA, 93 nt, Human
guacaagcuuuuguguggauguacguuuucauuucucuuggguagacagauaccuaggagagggaaaaucuaggcacuuugagucuacuguac

SEQ ID NO: 4111574 - RNA, 77 nt, Human
guacacacaugacagugcuuagcaaacugugucauacaacacaguuuuuauuauuuguuuuagaaagguguguguau

SEQ ID NO: 4111575 - RNA, 90 nt, Human
guacacacuauuaucgcaguuggaguagaauaaaggagcgacauggucuauaauccuauuucaacugcuuccuagauuuuggcuuuguau

SEQ ID NO: 4111576 - RNA, 55 nt, Human
guacacauagacaaaaccuggcuuuaguuccuaaagcuauugcuguuuauuguac

SEQ ID NO: 4111577 - RNA, 71 nt, Human
guacacauauuuccaaggguaaauaaacaccagccugaauguuuggugagauuagcuuuggcaauagugac

SEQ ID NO: 4111578 - RNA, 95 nt, Human
guacagacugugcacugcacaacuccagggucaccauucacauagucugcaaugugauuggcaucccuuggaauugugcggugcacaaccugugc

SEQ ID NO: 4111579 - RNA, 61 nt, Human
guacagagaagcgaagcaggcccagaacccaagcucuggcuccuaaucggcuucuuucuac

SEQ ID NO: 4111580 - RNA, 83 nt, Human
guacagaugaaccauauauuuacaguugacauugggucugcuugggcaauuaucugcugugauuguuaguuccuauacuguac

SEQ ID NO: 4111581 - RNA, 99 nt, Human
guacagccucagagucucagguuucccaggugcccuauagauucucccagagucccaagggcagugggaaagccugcuccucucucccaggggccuugc

SEQ ID NO: 4111582 - RNA, 59 nt, Human
guacagccugauuuggagccacuguuacagugugugcauuggcuccuagucagcugagc

SEQ ID NO: 4111583 - RNA, 97 nt, Human
guacagcucagaguuggccccucauuaguggcaagggagcugggguauuuauauacuggcucccaucagucauugguugaggguugcucugaggugc

SEQ ID NO: 4111584 - RNA, 103 nt, Human
guacaggcuucuggguucacuucucuguauuagcugccuuggagcuaagaaguuuuccucuuaauaauaaacaguugaagaugguugaacacagaagccuugc

SEQ ID NO: 4111585 - RNA, 88 nt, Human
guacagucuuagguaauuucaugggcauauucucuaccucaugacuucucaauuuuaagaaagugugcuuaaguuuaucaggauuuac

SEQ ID NO: 4111586 - RNA, 65 nt, Human
guacaucccagcugcccagacauugaaucaggaaauuuuucugagaaaggcagguggguaugggc

SEQ ID NO: 4111587 - RNA, 79 nt, Human
guacauggguguguccaggcgggagucaaggauggucaccaggaugaggaccccauugcccaguaggaucaccagguac

SEQ ID NO: 4111588 - RNA, 56 nt, Human
guacauguaaagcauccuucuagggugaacgaucauccaggaaauuuuuacauuac

SEQ ID NO: 4111589 - RNA, 63 nt, Human
guacauugagcacguacuaugugccacacagugacuggcacauaguauacacucaauaaauac

SEQ ID NO: 4111590 - RNA, 62 nt, Human
guacauuggcaacucucuuagauauugcaauauucagcucuaaagugguggugcuaauguau

SEQ ID NO: 4111591 - RNA, 71 nt, Human
guacauuucuaugcuagucaggauagcuagguuguuggcuggguccuaugcugguagagaagccauuguau

SEQ ID NO: 4111592 - RNA, 62 nt, Human
guaccacagaggacaacuaggcgcucagcccacuuaugcagcugagucuuucccuugcguac

SEQ ID NO: 4111593 - RNA, 99 nt, Human
guaccacaggccugagcacuuagcagggcucuuaaaguuugauuuuguaauugguacagcaggcaguguagagccuucauaggugcuagcuuuagguau

SEQ ID NO: 4111594 - RNA, 69 nt, Human
guaccagcucacagaaauccugcaggaggcuguagcuucagcuucucuagcucugucuguugggcuuac

SEQ ID NO: 4111595 - RNA, 68 nt, Human
guaccaggcauggggccgcuccuggucccuuuuccggaccauaaaagggcagccucggugccugcugc

SEQ ID NO: 4111596 - RNA, 67 nt, Human
guaccaguugcuuaaacaagacagucauuucuuuacuacacaaaugaugucuggaggcaugcuguac

SEQ ID NO: 4111597 - RNA, 61 nt, Human
guaccaugggaucuagggcccaccuagguaggcaucucuaguggggccauucaccugguau

SEQ ID NO: 4111598 - RNA, 78 nt, Human
guacccaggaccuugccagauaaacaguggagacuacaugcaucugcugaaaucugcaugcaaaguccuauaagguau

SEQ ID NO: 4111599 - RNA, 61 nt, Human
guacccuggaucacuggggagcuuuaaaaaauccucuuucgggcugcccacuccagaguac

SEQ ID NO: 4111600 - RNA, 71 nt, Human
guaccgaacccuguauacgcuacauuuuuuccuauacauuggugaguggguaguguauacaguguggauac

SEQ ID NO: 4111601 - RNA, 68 nt, Human
guaccuuaagcuaagugaaauaagucagucacgaaagaauacugugugauuccacuuguuugagguac

SEQ ID NO: 4111602 - RNA, 130 nt, Human
guaccuugaaagaaggguuuauuuccugacugucagucaacuguggccugauuagagggagcaggaucugaggaggucagagucuggcuguggagucauuucugaugaguuuuucuuuuaccuauaauac

SEQ ID NO: 4111603 - RNA, 83 nt, Human
guacgaguuucacaugcauggauguguguguguguguguguguguguguuucacauggaccaugcaggagugaagcuguguau

SEQ ID NO: 4111604 - RNA, 62 nt, Human
guacgcugagaacagaacaaaaagguuucucagccaaaugaaccuucaguguucucagcugc

SEQ ID NO: 4111605 - RNA, 129 nt, Human
guacguaauauuugauauaauggauuucucuuaaugggaaggauacguuacaagauaaagacagaauucauugccuuuggcuuauuuuuuccuacagggaaauagccucuaccuuauuuaguauguuuc

SEQ ID NO: 4111606 - RNA, 68 nt, Human
guacgugacaaucucugcgcugagaauuccacaugccucacuucagcucaucugagugucagcgcuac

SEQ ID NO: 4111607 - RNA, 56 nt, Human
guacuagguuccauacucaaagauugugauuccacuagucugugugggaccagggc

SEQ ID NO: 4111608 - RNA, 65 nt, Human
guacucaagagucugcaguagucugagcaaaggauuaacauggucagaaagcugauucuugauac

SEQ ID NO: 4111609 - RNA, 115 nt, Human
guacucagagaagugcucccagcagaguaggugcuacuucugccagucucuccaucuuacccuuccaugaggcuuauguacagaaugccuauuuacugcugaccuucuccaguau

SEQ ID NO: 4111610 - RNA, 65 nt, Human
guacucaggcuucaggcacagcuguguccaggugcugaauguagcuaguguuuggagauggaugc

SEQ ID NO: 4111611 - RNA, 87 nt, Human
guacucaggguugggacuuuggaacagccuugcuacucuggggugcuugcagcagggccuguacaagucccaccccagcccugguau

SEQ ID NO: 4111612 - RNA, 72 nt, Human
guacugagaggaacaucuuaugcuucuaccuguguuugcaaagugaagucucuaagacugugccaucauuac

SEQ ID NO: 4111613 - RNA, 77 nt, Human
guacugcuuugagauccagauuuccauuccuuuggauaaauacccaaaaguaggauugcugaaucauacggcaguac

SEQ ID NO: 4111614 - RNA, 77 nt, Human
guacuggugauacaucugugaucaagacagacaguguugcauacauuuuugugagggaaacaggaaaguuaucaggc

SEQ ID NO: 4111615 - RNA, 71 nt, Human
guacuguacauaugucuccagagugugggagcuucauaaacaacacauuuugaucugagcagauguacugc

SEQ ID NO: 4111616 - RNA, 56 nt, Human
guacugucuggaguugccaaaggcuauaacauaugccuuuuugcuuauggacagac

SEQ ID NO: 4111617 - RNA, 82 nt, Human
guacugugagaaccaacuuuguguguuuaauauggcuguaugcucagcuaaauuaaaacacagagguaaagcucuaccugac

SEQ ID NO: 4111618 - RNA, 74 nt, Human
guacuuaugcaaagccacccagggacgaggcccucuucagaguggcuguguguuggcuuagcauuccagagugc

SEQ ID NO: 4111619 - RNA, 67 nt, Human
guacuuauuuuaauguuuaguugucaucaguucaugccuaagaggacaaagcacuugaaauguguac

SEQ ID NO: 4111620 - RNA, 67 nt, Human
guacuucagcucugaggaacacuccuuuacuuucuuaaacuuuugguccucauggguugcucuguac

SEQ ID NO: 4111621 - RNA, 109 nt, Human
guacuucguagaaggauauagaaacuguuaauugaaaugauguguuuggauagccuaugaguuacuagucacgucuuucaguuaccucuggcuccuguuaaugaaauac

SEQ ID NO: 4111622 - RNA, 73 nt, Human
guacuuguaaagugucugugucugucauuuucuguuauuagauagucaaaaugaagcaaaggcauucagguau

SEQ ID NO: 4111623 - RNA, 56 nt, Human
guacuuucaggcuuucccuuaacuccaucgagaaggaagagggaguaugugaguac

SEQ ID NO: 4111624 - RNA, 88 nt, Human
guacuuucucaaauauuggggauguagaaaugaacaacaggcaaaaauuacugcuguuguaaaucuuacacucuaguggggaaagaac

SEQ ID NO: 4111625 - RNA, 93 nt, Human
guagaaagagcaaugcacuugagcuugaaagguaugcucuccucaccuacccaggagcaugucuaacucuucagggugugcuccuuucuucac

SEQ ID NO: 4111626 - RNA, 64 nt, Human
guagaaaugagauuucaccauguuggucaggcugguuucgaacuccugaccucaggugaucugc

SEQ ID NO: 4111627 - RNA, 95 nt, Human
guagaacuuuacugagauugcaugucuagcuccuacuccaaagcugaaagcucuuuaggggcucagaacauguccuuggucucuguacaguuuac

SEQ ID NO: 4111628 - RNA, 85 nt, Human
ggguguucauuaaguuucaagagguucuuugaauuucaccagagguucaauuucgucgucucucuagaugaaauuguugaauccc

SEQ ID NO: 4111629 - RNA, 56 nt, Human
ggguguucccauuuuacagaugaggacucugagucaugugagaggguggcuugccc

SEQ ID NO: 4111630 - RNA, 55 nt, Human
ggguguuggggcccugauucgcccaugggccaccgucagagaugcccaacugccu

SEQ ID NO: 4111631 - RNA, 88 nt, Human
ggguguugucagcugccucccgccuuggcuucaguagcucacccagcuuacaggggagcugcccugggcuggagaugggcaugcaccc

SEQ ID NO: 4111632 - RNA, 55 nt, Human
ggguuaaagagcccaauguaugcuggauuuaguaagauuugggcccucccaaccc

SEQ ID NO: 4111633 - RNA, 90 nt, Human
ggguuaaaguagauaacagaugugaagugcuaauaguacauaaugaaacaaguacauauuagguauuauuauuauuauuugcuaggauuc

SEQ ID NO: 4111634 - RNA, 56 nt, Human
ggguuagcagcauccaccaggugaucugacagugacaccagguggcugaugacacc

SEQ ID NO: 4111635 - RNA, 69 nt, Human
ggguuaggucccucccuucuggagucuucacuacuacacuuucaaagaaaacacagauggaucuaacuc

SEQ ID NO: 4111636 - RNA, 70 nt, Human
ggguuauugcgacccuagcccccucacuucucccuccgaggcuaagugugggacuagggcuccagggccc

SEQ ID NO: 4111637 - RNA, 88 nt, Human
ggguucaagagagaugucuuugaggcucacugcugccuaguccacuaccugcaaaguguggcacaagucacaucuguuauugaaaccc

SEQ ID NO: 4111638 - RNA, 91 nt, Human
ggguuccagagaaugggguagugggcagccuggcaggcagggugccaggcacagaggccgaaacccaggcagccugcuccauucugagcuc

SEQ ID NO: 4111639 - RNA, 90 nt, Human
ggguucccagggaaccuggcuccacaggccagggugugggaggaccgccuggccacaccucagccauguggaggcggcaccugcacaccc

SEQ ID NO: 4111640 - RNA, 72 nt, Human
ggguucccucugugguggagugggcaugagcaguacugagacguucaucuugguccuggcacaugaguuccc

SEQ ID NO: 4111641 - RNA, 100 nt, Human
ggguuccuccuguaggggggcauggacuuuucuucccuuuguggcugcugugcaaaggggacagaguccacuggugcccauccuguacgggugggagcuc

SEQ ID NO: 4111642 - RNA, 93 nt, Human
ggguucugucuacagcccuggcucccagcagcgcuguccucucacaggcauaguugcccccagcugggcugugcuccacugugacaguagccc

SEQ ID NO: 4111643 - RNA, 82 nt, Human
ggguucuuaucaagcuuacggucauacagcuaggggaucgaagaacagggaucccagcccagauuugugugacuguaaaccc

SEQ ID NO: 4111644 - RNA, 58 nt, Human
ggguucuuugugcugaagaagcccuaaggugguccagggagaugccacaaagaugccc

SEQ ID NO: 4111645 - RNA, 67 nt, Human
ggguugagaaauaggugcugucagggccaaaacaagcuuggucucuguguucccuguuuucucuccc

SEQ ID NO: 4111646 - RNA, 58 nt, Human
ggguugcuaauaggaguuucuguuguaugccuuaggacagaacuucaguaguauuccc

SEQ ID NO: 4111647 - RNA, 92 nt, Human
ggguuggcuacauggcggggcggagguaucuuuagugggggaacagcguugugccaccaggaggggucucugucucccagguagaggaauuc

SEQ ID NO: 4111648 - RNA, 103 nt, Human
ggguugggaagaauggggaaaucaucugggaucucugauuggucacucgaauucaguagguguggcagguagaguucugagauggcccccacgauuccuaccc

SEQ ID NO: 4111649 - RNA, 55 nt, Human
ggguugggcuugucugggaaacugcuucaaucugaggccuaguuaggcucggcuc

SEQ ID NO: 4111650 - RNA, 88 nt, Human
ggguugguuccaagucuuugcuacugugaauagugccacaauaaucauaugugugcaugugucuuuauaguagcaugauuuauaaucc

SEQ ID NO: 4111651 - RNA, 58 nt, Human
ggguugugggauagagaaggagacagguuguuuucauuccugagcccauauuuaaccc

SEQ ID NO: 4111652 - RNA, 66 nt, Human
ggguuguucuggguuugcugauguucagguugucucugaauuacauggugugcugagaaugacacc

SEQ ID NO: 4111653 - RNA, 89 nt, Human
ggguuuaauuugcauuucccauugaguaaugauauugagcauuuuucucauguuuauuggccaguuggauuuguauuuugguuaagccu

SEQ ID NO: 4111654 - RNA, 117 nt, Human
ggguuuauaggcacgagacccugcacccaaccuagaguugccuuuuuuaagcaaagcaguuucuaguuaauguagcaucuuggacuuuggggcgucauucuuaagcuuguugugccc

SEQ ID NO: 4111655 - RNA, 58 nt, Human
ggguuuauaucacagcuuuggcacuuacugggugucugugagcaacauauguaaacuc

SEQ ID NO: 4111656 - RNA, 130 nt, Human
ggguuucaccguguucgccaggauggccucgaucuccugaccuugugauccgcccaccuuggccucccaaagugcugggauuacaggccucagccaccacgucaggcccuucuagaggauauuuaaaccc

SEQ ID NO: 4111657 - RNA, 116 nt, Human
ggguuucaccuuuuaaaaguuggcugacugaagcacuucuccuuuauuuccugcaauagaaaugucaaagacguguuuuuguuaugugcccugucugcuuuuguuuuuuuuaaccc

SEQ ID NO: 4111658 - RNA, 57 nt, Human
ggguuucuaaauguucugaguuuuuauucuaagggccauugaugcauuuagaaacuu

SEQ ID NO: 4111659 - RNA, 58 nt, Human
ggguuucuacaaccacacucucagcccgacugacuugcugcgagugcugguggagcuc

SEQ ID NO: 4111660 - RNA, 98 nt, Human
ggguuucuauauuucuucuuaaagcugcaguaucuuaaaauuuguagccuguagucccagcuacuugggaggcugaggcaggagaauagcuugaaccc

SEQ ID NO: 4111661 - RNA, 80 nt, Human
ggguuugacucugagcaguuucugugcagccacaaagauucuuaugugagacacacugcugcuucagagugcuccaaccc

SEQ ID NO: 4111662 - RNA, 70 nt, Human
ggguuuggaaggagucaaccagcugaaggugccaauaugacugucaguaauguugccuucuuuagggcuu

SEQ ID NO: 4111663 - RNA, 58 nt, Human
ggguuuguggagcuggaaacacugaaugaaugucagugcagcuggaucucagagagcc

SEQ ID NO: 4111664 - RNA, 57 nt, Human
ggguuuguuuuuguuccuguaaaacuggauugguucugcagaggcacaaacaagccc

SEQ ID NO: 4111665 - RNA, 83 nt, Human
ggguuuuccugaaccuccaagcugguccucugugucguugcuguccaggaacaaaggacaggagcugagggacaggaaacccc

SEQ ID NO: 4111666 - RNA, 99 nt, Human
ggguuuucuagguggugcuccuggcuucagguugggcuuagguccgguccacaugucauucuagggucuaggcugaaggggaagugcuacugaaggcuu

SEQ ID NO: 4111667 - RNA, 56 nt, Human
ggguuuucuucugcagaaaagauuaaaggaaaauuguuuuagcagaaagaaagcuc

SEQ ID NO: 4111668 - RNA, 106 nt, Human
ggguuuuuauuauugguccagguuuaaaacauuuuaucuauuuaaaacauauguuguguguuuuaagaaguuauguuauaaauaacagcauugugguuaagagccc

SEQ ID NO: 4111669 - RNA, 68 nt, Human
ggguuuuuuucauaagguaagagagaugaauaaguuaucacuuuuucauugaugggugauagaaacuc

SEQ ID NO: 4111670 - RNA, 82 nt, Human
gguaaaaaggucaagaaacugaacaacugaauaaccaaauaaguaggcgaaaccauuugguuacucaguugucugaccaacc

SEQ ID NO: 4111671 - RNA, 102 nt, Human
gguaaaaaguaacauguuuaugggcuggcucauauaguaugaaugaaagaauuaugugucuucuaagccaagccuguuuuggcauauaaaauaauuuuuacc

SEQ ID NO: 4111672 - RNA, 90 nt, Human
gguaaaaaugauuuucuggucacauguuauuaaccauaauaaacuaaauagaaaaaugguaaguggggaaagggcuagguuauucauacc

SEQ ID NO: 4111673 - RNA, 55 nt, Human
gguaaaacugcagaacuuggagguccugaugagagguuucugucuguguuuugcc

SEQ ID NO: 4111674 - RNA, 125 nt, Human
gguaaaguuucaguuuuucuuuagauguaaauuuucuuagcaauccuaggcuggaucagccuuuugguauguuuaugauuuucuaugauugcucagaaacuacucauaguggcugagaugauacc

SEQ ID NO: 4111675 - RNA, 60 nt, Human
gguaaauaugugucauggugguuuguugcacagaucagcccaucacucacguauuaagcc

SEQ ID NO: 4111676 - RNA, 59 nt, Human
gucugcccucacgccagcugggcucugccugccuugggggcucuugugagggagcagau

SEQ ID NO: 4111677 - RNA, 83 nt, Human
gucugcccucuaacagggcuuugaacaggcaucaagggccucuugcccuuguugauuggacacagcccacaaagagaccagac

SEQ ID NO: 4111678 - RNA, 61 nt, Human
gucugcccuuggccugggacuuugggcuuugguucuaaguuccuaaagucaggggucaagc

SEQ ID NO: 4111679 - RNA, 71 nt, Human
gucugccucaugggaguuuggccacagccaaggugcuccucuuggauugcagcagcuccugugggcagcac

SEQ ID NO: 4111680 - RNA, 73 nt, Human
gucugcuacugacaggcaugucaguuguuuuaguguuuugcugacaaugcugaaugcugcaugccguauagac

SEQ ID NO: 4111681 - RNA, 73 nt, Human
gucugcucuaccucccccauuuucccauuccuucacucuccagaguaggaaagauggaaggaggauaagcagc

SEQ ID NO: 4111682 - RNA, 60 nt, Human
gucugcucuguaggugcucuggugcagggcugagaccccaggcaucuaaagagaguagac

SEQ ID NO: 4111683 - RNA, 96 nt, Human
gucugcuggauaauuacguuuucuaaguaagauuaacuucuuaauuacuugugaaggagaagcuguaauauugaacugugauugcuuuuggcaggc

SEQ ID NO: 4111684 - RNA, 70 nt, Human
gucugcuggccuagacagacccugaucuccacccccaacccggauccugggcccuucugggucaccaggc

SEQ ID NO: 4111685 - RNA, 74 nt, Human
gucugcugugggugugguucguuuaagacagggucucacuuugucacccaaugaaugccaccccuuaaguaggc

SEQ ID NO: 4111686 - RNA, 55 nt, Human
gucugcuuccuaucuaaagugugccauggccucuuuucaaagacuggaggcugau

SEQ ID NO: 4111687 - RNA, 63 nt, Human
gucuggaaaguuuggcuuuuauuuuggucauugaaguuaaggcacaugcuuuggaaaccagau

SEQ ID NO: 4111688 - RNA, 63 nt, Human
gucuggaagacuugcugcauccuugcuggagugauugagaagggaacaagcaagcugcuaguc

SEQ ID NO: 4111689 - RNA, 57 nt, Human
gucuggaggagcgaggaagacggaagcaugugcuggcccuucucuugcuuccuggac

SEQ ID NO: 4111690 - RNA, 62 nt, Human
gucuggaguucuuauauggaggcuggcuuucccccagagugagcaucacaggagaaccaggc

SEQ ID NO: 4111691 - RNA, 75 nt, Human
gucuggcaaauaaugucuucuuuuaauuuggcauuuggagugccaggcuggugcaaggauauucucaugucagac

SEQ ID NO: 4111692 - RNA, 58 nt, Human
gucuggcuuuugcccuguguuucuuuaaaguugacucuaugcagaggcugagccauac

SEQ ID NO: 4111693 - RNA, 83 nt, Human
gucuggggauuggugacaauggcaacagcaucucaaucuuuuccuaagagauaucugagccuuauucaccagcccucauagac

SEQ ID NO: 4111694 - RNA, 86 nt, Human
gucuggguaaggggaguuugccuauugcuuuuggggugcccaaaguggggucauaccagcagcccaagcacacaccccuuccaggc

SEQ ID NO: 4111695 - RNA, 105 nt, Human
gucugguaagucuggaacuuaggacacuaaugagaaaggaauuaauuuauuuuuguauucaacguuauuaagcucuuuuuacauguuagguucuacacgcuaggc

SEQ ID NO: 4111696 - RNA, 95 nt, Human
gucuggucaaaauucugucauuaaauuguggccaacucaauugaucucuuugagccucaagguccucaacuuugacaugggaggguuggaccgac

SEQ ID NO: 4111697 - RNA, 55 nt, Human
gucugguccccauuccaggugggaggguuucccagaguuggucaggggacccggc

SEQ ID NO: 4111698 - RNA, 121 nt, Human
gucuggucccuauucaacacccucuucaagaauuccugcugcccggacuucauagcauucaucuacucugugaagucuaggacaggaagucuauggacaggaagaugguuggugaccugac

SEQ ID NO: 4111699 - RNA, 64 nt, Human
gucugguuggggcugcagucgcagcuucaggcgccucugcugcaggcugcagucucaggugggc

SEQ ID NO: 4111700 - RNA, 65 nt, Human
gucugguuuguguaggccacuagaauccucuuugggaaugaucuacugccuugcacaggcuagau

SEQ ID NO: 4111701 - RNA, 67 nt, Human
gucugucacucaggggcuggaggcuggagcugaggaugcagggagagccaaagccccgaaggcagau

SEQ ID NO: 4111702 - RNA, 58 nt, Human
gucugucauacggcuuauguaaccgugccuuuaggcgauucucauagccugugaagau

SEQ ID NO: 4111703 - RNA, 55 nt, Human
gucuguccaucagcaaaggcuugggaaaagcacccagguaugucccaggauagau

SEQ ID NO: 4111704 - RNA, 59 nt, Human
gucugucucccugugacugagaccaccgcuagugauucuccaaguacagaggggcauac

SEQ ID NO: 4111705 - RNA, 78 nt, Human
gucugucuggguggcuguccagccagccaucaggcugucauuuuucugcugucuggcuguccagcuuaucuaucuggc

SEQ ID NO: 4111706 - RNA, 117 nt, Human
gucugucuguugcuuuuucaggacugcuuaguggugugcaaagggguguucccaggccuuaacaucuacccuguggauaucacuauuuuggaagccuauuaguagcagcaguuagac

SEQ ID NO: 4111707 - RNA, 61 nt, Human
gucugugcuuuccuagggucuugccuuugugcaggucccucugcucuagagagccacagau

SEQ ID NO: 4111708 - RNA, 56 nt, Human
gucugugucuguuuucggucacugaaaacagugacugaaaggauccuagcagagac

SEQ ID NO: 4111709 - RNA, 62 nt, Human
gucugugugaguuacucuucucauuuauaaaagaaggauaauaauagugcucacucacagac

SEQ ID NO: 4111710 - RNA, 63 nt, Human
gucuguguguauguagugaaaacuguagaaaaucagcaguuuauuguugcguucacauaugac

SEQ ID NO: 4111711 - RNA, 82 nt, Human
gucuguugauuucuguacacccacuauucauuguguucaagcuuugaugaaaauacugugguugauaggaagaaauuauggc

SEQ ID NO: 4111712 - RNA, 78 nt, Human
gucuguuguguggugaagcagagaugcuaauccugguccuucgugagcaucgucuucaucucacaaaaacauccagac

SEQ ID NO: 4111713 - RNA, 59 nt, Human
gucuguuuuggucaccuuuauauccccagccuggcagauauuaggugcucaauacaugc

SEQ ID NO: 4111714 - RNA, 73 nt, Human
gucuuaagaaugaaugcugagauuuagcucuagcuuacuagaaugccuacucucuccauuaugucuuacagac

SEQ ID NO: 4111715 - RNA, 81 nt, Human
gucuuacaaaggcuucaaguucugaaauagaagugucuuucuggguuaagcuucccagaggcacucuuguuuugccuagac

SEQ ID NO: 4111716 - RNA, 60 nt, Human
gucacaucaguccaccacugcaguugcuuuuagcugccacauggugucacuguugaagac

SEQ ID NO: 4111717 - RNA, 57 nt, Human
gucacaugguuuucauggcauuaguucagcuccaagugucagaaauaagcaugugau

SEQ ID NO: 4111718 - RNA, 96 nt, Human
gucaccagauggggccucaccauucucagggcagauauugguaaagcaaagggagugugagcccuggaguggugcgguuuggguucuagucuugac

SEQ ID NO: 4111719 - RNA, 72 nt, Human
gucaccagccugccuucccagcuuggcuuuuucauuaccuuggagaaagaagccgggaggcaggccaguugc

SEQ ID NO: 4111720 - RNA, 55 nt, Human
gucaccagucccagcuccugaaugcccacauggccaucccagcugccacugggac

SEQ ID NO: 4111721 - RNA, 78 nt, Human
gucaccauggcuugggagaggcuuccucuuuaacaaaagcuguuaggaaagaaguacauucucaugccccggcuugac

SEQ ID NO: 4111722 - RNA, 80 nt, Human
gucaccauuaauuacuuuaugcuaaacuuuacucuuuagguauaucuuggaguauggggcagggugggguggugguggac

SEQ ID NO: 4111723 - RNA, 78 nt, Human
gucacccaggcuggaguucaguggugugaucuuggcucacuacaaccuuacaaccucugccucccaaguucaagugau

SEQ ID NO: 4111724 - RNA, 58 nt, Human
gucaccccgcccgccaucuguuuacaggcugaaagacagcuggcugcggugaggggac

SEQ ID NO: 4111725 - RNA, 57 nt, Human
gucacccugcuggcuguucagcugauguuuauugcugguguuucagccaguggugac

SEQ ID NO: 4111726 - RNA, 62 nt, Human
gucaccgagugacaguagccaucauggcucacaacagccuugacuuccugcacucaggugau

SEQ ID NO: 4111727 - RNA, 62 nt, Human
gucaccuaaccuuacugugucuuaguguccuuuucauaagaggagaaguaaggcuagaugau

SEQ ID NO: 4111728 - RNA, 65 nt, Human
gucacgcagcccuguugcgcuuccggcgccugcugguggcugagcugcagcguggcuucuuugac

SEQ ID NO: 4111729 - RNA, 63 nt, Human
gucacgccugcuuaccaaauuuguggauuacucuaaucugacagaggugguagauacagugac

SEQ ID NO: 4111730 - RNA, 62 nt, Human
gucacgugguggagcccgucuccaucuccacagugcagggaggagauggguaucgccugggc

SEQ ID NO: 4111731 - RNA, 67 nt, Human
gucacguuaacagcuaacagaugaaguuacagauuaacucuucacugccauuaguugguuaauguac

SEQ ID NO: 4111732 - RNA, 59 nt, Human
gucacuggcuuggcaggaggaagaucccuggggguccagaccaacugaccaggcagggc

SEQ ID NO: 4111733 - RNA, 68 nt, Human
gucacugggggaauggaaaggcuucguugaagagugacauuuaaugucuuucaaauucugccuagaac

SEQ ID NO: 4111734 - RNA, 55 nt, Human
gucacugggugcugcgccugucacuuugaauuguugagaggcaagggcucaugac

SEQ ID NO: 4111735 - RNA, 69 nt, Human
gucacugucccggcccccagcccugccccaggccccgggggcuugggcucagacuugaggacagaggac

SEQ ID NO: 4111736 - RNA, 75 nt, Human
gucacuuucaaacauaaacacuuaguagaaugguuguuagguuccauaucugugaaauguguuuguauaagugac

SEQ ID NO: 4111737 - RNA, 55 nt, Human
gucacuuugaagcuguuuuuagcaggauaagaacaaacaauguuuccaaaguggc

SEQ ID NO: 4111738 - RNA, 66 nt, Human
gucacuuuguuagcuuccaauugcuucuguaacaaauuaccacgaaucaguggcuaacaaggaaac

SEQ ID NO: 4111739 - RNA, 66 nt, Human
gucagaagaggacuggguagcucauugugugucuuuuacaaugguaacgacuuuuccuuuucucac

SEQ ID NO: 4111740 - RNA, 129 nt, Human
gucagaauuaccuaggagcuugugaaacaugcacauuuccaggccucacuccagaauuagugaaccugaaucuuugaaaguaggcauugugaaacugcauuuucagaggcugcccaggugacccuguac

SEQ ID NO: 4111741 - RNA, 64 nt, Human
gucagagaaccaucuuauuccuaaaauacuaggcuaagagggaauuagagaucaguucuuugac

SEQ ID NO: 4111742 - RNA, 96 nt, Human
gucagagagaugagcugaaagauucagugagggugagaagaaggcucguaaaaagauuuuuaugccuacgcugaaaaguucagccaucuuuaacac

SEQ ID NO: 4111743 - RNA, 112 nt, Human
gucagagcaaguuauuucugaauguugugggugauguuuuacugauuaauuuucugaaggaauuacaguaauguauuauuuaacuauaggucuaaaauagcuuuguucugau

SEQ ID NO: 4111744 - RNA, 97 nt, Human
gucagagcaccgacaugcagcagggucccuuccucaucgugacugucagccagagaaggcagugacauaccuggagggcaccuguugcaucucugcc

SEQ ID NO: 4111745 - RNA, 67 nt, Human
gucagaggaauggaugagugauuugugaggucuuaacuagauaccccaguuucguccuuguuuuggc

SEQ ID NO: 4111746 - RNA, 63 nt, Human
gucagaggcugcugaggccaccacgcugccagaggugauagugucauggccugagcaggugac

SEQ ID NO: 4111747 - RNA, 83 nt, Human
gucagaggcugggcuagggagacagagggcaugggcacaaguccuggcucugccccucgcucaccagcucugaggccuuagac

SEQ ID NO: 4111748 - RNA, 61 nt, Human
gucagagucuaucaaguggggaacuugaguagcaaaaucauuuucacuaguagucucuggc

SEQ ID NO: 4111749 - RNA, 83 nt, Human
gucagaucugaccacaucaggggcuccugggcccuccagaugcugcugccucauguccaaggccccuguggucuagcccugac

SEQ ID NO: 4111750 - RNA, 65 nt, Human
gucagaugccuccuacauacuggucugguuuuugcuuuuuggagcauaugaaagaaguaucugac

SEQ ID NO: 4111751 - RNA, 72 nt, Human
gucagauggagggacgccgugcgggaccgugcgcucgcgccuggcuuuuguucccggcgucugacuucugac

SEQ ID NO: 4111752 - RNA, 81 nt, Human
gucagauuggggaggaagucagauuucaggguguacagaaugacacuccucaaauccccguuccucauucccuccuuuggc

SEQ ID NO: 4111753 - RNA, 85 nt, Human
ggucucucagcaguucagcuugggaaauugagcaaggaaguuuccuucuuccuaaauuuccuaaucuaaauaaugcugagauguc

SEQ ID NO: 4111754 - RNA, 60 nt, Human
ggucucucucaucaacucugacuugacagaacaaggcaggcaagauuagagaugagcacc

SEQ ID NO: 4111755 - RNA, 69 nt, Human
ggucucucuugauuaccuagcaguuaguguacugaucagcacuugcaugucaggaaauuaacaaagacc

SEQ ID NO: 4111756 - RNA, 72 nt, Human
ggucucugcugaauauagagcaagaaguuauggagcuuaugagagugcuuauacucugugucuagcaaggcc

SEQ ID NO: 4111757 - RNA, 59 nt, Human
ggucucuggcuuuccuugucugcauccucuuccagaguguaggcuuuauggaagcuacc

SEQ ID NO: 4111758 - RNA, 81 nt, Human
ggucucugucauuugcacguuugucgagcaccaucugcugcacaggguggugucaggcacuagcaugcacuuuacgauucc

SEQ ID NO: 4111759 - RNA, 62 nt, Human
ggucucuuguccaaggucacacacagcuagggagcuacagggccagaaguuggaaaagagcc

SEQ ID NO: 4111760 - RNA, 76 nt, Human
ggucugacaaaggguccuucuuaaucauacaugaauuugugugcaugacaaguuuaaauguacccagugucaaucc

SEQ ID NO: 4111761 - RNA, 66 nt, Human
ggucugagccugcaauaagcacagcccuaaauuacacuugaggcugcuuaacguccaggcccagcc

SEQ ID NO: 4111762 - RNA, 70 nt, Human
ggucugauagggcccccgugggugcucagggagcaccgacugagcccguaggggccaaggcugacaggcc

SEQ ID NO: 4111763 - RNA, 75 nt, Human
ggucugcaucuggccuuugcuggcuaguggccucugagggauggauuugguuuaaggacagagagccagguggcc

SEQ ID NO: 4111764 - RNA, 76 nt, Human
ggucugccaugacaaaguaccacaaacuggguggcuccaaacaguagaaguguauuuuaucacaauucuggaggcu

SEQ ID NO: 4111765 - RNA, 66 nt, Human
ggucugcccagaagacauccccuagguccaguuuagaggucaaggucagcccucucugggcaggcc

SEQ ID NO: 4111766 - RNA, 62 nt, Human
ggucugcgugucugguaccauugugagcaggcacuggagcauggugggccaggcagaaggcu

SEQ ID NO: 4111767 - RNA, 73 nt, Human
ggucugcuaguguuugcuggagguccacuccagacccuguuugccuggguaucaccagcggaagcugcagacc

SEQ ID NO: 4111768 - RNA, 64 nt, Human
ggucuggaccauggacgccgggcaagucauccaagcaaagcccagugaaguuccaggaugggcu

SEQ ID NO: 4111769 - RNA, 69 nt, Human
ggucuggaccucacuguguuuauacucagcaucacgaagcccgugagcuuguguauacaggaggccacc

SEQ ID NO: 4111770 - RNA, 58 nt, Human
ggucuggagcuaaucuuguuggugaagccugaaugacuggaggaggagcugcagaacc

SEQ ID NO: 4111771 - RNA, 119 nt, Human
ggucuggcagaaaagcugucccaauguccuuccaucucucuaggccaacagcuuccuguuaauauuauuaagcuguggcuuggaggaaacaggcuggcagcaguuguuuuagccugucc

SEQ ID NO: 4111772 - RNA, 80 nt, Human
ggucuggcuuggcaguguuucaaaucaaaggcauugggauauuuuauuugacugagguuugauauauaccagcguagacu

SEQ ID NO: 4111773 - RNA, 69 nt, Human
ggucugggacccacacucugagaaaugcugaggcauagccauuugcacucaaaaguauggaccuagacc

SEQ ID NO: 4111774 - RNA, 69 nt, Human
ggucugggagaacuagguccucaguagaugcucucugagcucugggugagacagaccugguucccagcc

SEQ ID NO: 4111775 - RNA, 83 nt, Human
ggucuggggacagacagagucuucccaucagucuuccagaacagggaggagauggcugggagcucuguuugguaccaacaacc

SEQ ID NO: 4111776 - RNA, 111 nt, Human
ggucugggugacgcgguguccagaggcucuuggcccaguugccaaggaaagggacggccugucaguuguguuuugggccugucggguccuucagcaccuggagccacagcc

SEQ ID NO: 4111777 - RNA, 69 nt, Human
gucuucacaacuucucacagauaaauuucuuauuaauguacuagguuuuagagugagaguucugaagac

SEQ ID NO: 4111778 - RNA, 58 nt, Human
gucuucagacuccaaauguuuuauguucccugucaugagaugggaugucugugagugc

SEQ ID NO: 4111779 - RNA, 97 nt, Human
gucuucauucuucaagggccacuuuacagggacauggaacaggcuccacuaaagugguguccucuuauugcucuuggcccugaggacauaugaagau

SEQ ID NO: 4111780 - RNA, 84 nt, Human
gucuucccaggaggcucugagucuggugucugcuguugaagacauuggcagaucccuuggggcccagagcacuccugggccugc

SEQ ID NO: 4111781 - RNA, 90 nt, Human
gucuucucaaaaauauuugucguaacacaugucugggaugugaauuguggccaauuuuuccugaagcaguaguuaugauuuuguagaggc

SEQ ID NO: 4111782 - RNA, 79 nt, Human
gucuucuguaaugacugucuuuccauuguauauuguguguguguaugcaugugugcauguuagagagaguucagguaac

SEQ ID NO: 4111783 - RNA, 105 nt, Human
gucuugaauaauaaaaugccuuuuguucagcucucauugauuagucaucuucuuacccacauugaucaaauucaggagucuggacaaagugucuauuacagagau

SEQ ID NO: 4111784 - RNA, 73 nt, Human
gucuugauaugagaaauuauaccuagguuugcacuucuuucgcaaggcuaauuauugguuucucaaacaaaac

SEQ ID NO: 4111785 - RNA, 75 nt, Human
gucuugaucuccucaccuugugauccucuugccuuggccucccaaagugcugggauuacaggccugagucaagau

SEQ ID NO: 4111786 - RNA, 63 nt, Human
gucuugcaauuugcuuccauggaguugauccuugaaccuccaugaggaccaaauucguaggac

SEQ ID NO: 4111787 - RNA, 116 nt, Human
gucuugccuguguugagcgggggucauuugggcugcugguggaaugguaggccugaauacagaagcccaccacugguuauuagcuccuuuuagacuugcagacaaccaggcauggc

SEQ ID NO: 4111788 - RNA, 57 nt, Human
gucuugcuuauggcuaaagauaugaauuuaugggauaucuguagucuguggcaagac

SEQ ID NO: 4111789 - RNA, 55 nt, Human
gucuuggcaugcauauaucccaaagccugggaugccaagaaucauaugccaggau

SEQ ID NO: 4111790 - RNA, 62 nt, Human
gucuuggcaugugcagcugggauggaaaugcuccuccaguggacaguuacagcagcuaagac

SEQ ID NO: 4111791 - RNA, 95 nt, Human
gucuuggugauacacuuuaggaagaaacuuucccugcagcccucgaggguggcaugucaggaucaggaguuugugucuucuuuguaucccaagac

SEQ ID NO: 4111792 - RNA, 58 nt, Human
gucuugguuguucagguccuagggguuccaaguccccagucaccuugaggacucagac

SEQ ID NO: 4111793 - RNA, 79 nt, Human
gucuuguaauuuacauagguaucuuuaaugaacagcucguuuauaguuccacugaguuuuuccuguguguguugcaggc

SEQ ID NO: 4111794 - RNA, 85 nt, Human
gucuugucuuggccuggaucauauccagucaccacuaugcaacaaaugaugugcacugggcaaggauaugauggguuaugaaagc

SEQ ID NO: 4111795 - RNA, 82 nt, Human
gucuuuaaaagugggcuggccugggguuguccuugguuaaaccccaaggacacuugagaguccagucaucuuuuauccugau

SEQ ID NO: 4111796 - RNA, 76 nt, Human
gucuuuaaugugugaauugagcaucagaguuuauuucagauucguguauguguccuaauucaagcaguuugaagau

SEQ ID NO: 4111797 - RNA, 107 nt, Human
gucuuuauagcauugcugcuggucugggaugagggauguauauuuuuaaaaccaucuaaauuccuacauccuaucccuggauaguucaguagugucucugaugagac

SEQ ID NO: 4111798 - RNA, 57 nt, Human
gucuuucuaugaugaacuguugcuuuaguacuggugacauuuucauauuggaaagac

SEQ ID NO: 4111799 - RNA, 63 nt, Human
gucuuucuaugcauagagcagagcuuaccacgaaaggaauucauccucuaugcuagcagagac

SEQ ID NO: 4111800 - RNA, 80 nt, Human
gucuuucucuacugcugaauaaaaccuccugcagguccagaagauccugcaggggguuuuauucagcaguagagaaagau

SEQ ID NO: 4111801 - RNA, 55 nt, Human
gucuuucucuucucucugauggagcaaauagagucaucugcugagaaugaaaggc

SEQ ID NO: 4111802 - RNA, 70 nt, Human
gucuuucuucaaucugucuccauguguauagagucacaucuugcagaaggggacaguuaaagaccaagac

SEQ ID NO: 4111803 - RNA, 88 nt, Human
gucuuucuuugcacagaucugguggcaaggaauacuuuuuguccuuccuuauugauagugccaccuagugacucugcugcauaaagac

SEQ ID NO: 4111804 - RNA, 98 nt, Human
gucuuugagaaaacuauggaagacaggcuguauuuuaaaugauugauaaucuuaauguucuuuugaaacauuaccuguauuuccauaaaggucaagac

SEQ ID NO: 4111805 - RNA, 67 nt, Human
gucuuugagaucuaucuugucucucaacuaucuguagauaguuugagaauugaaauagaauuaagau

SEQ ID NO: 4111806 - RNA, 100 nt, Human
gucuuugcaagaguugcauuuucgguuauugagauuauggcaugcuaaaauauuugaguuugcuuaaauuucagcagcuuaauuuuguagcagcagggac

SEQ ID NO: 4111807 - RNA, 104 nt, Human
gucuuugccucauggagcuaacauucuaagaggagaaacaugcaguaaacaaguaaagaaauguaugcucuauucagggaguaguuugugcuaugaggaaaagc

SEQ ID NO: 4111808 - RNA, 69 nt, Human
gucuuugcuguucuucagacuccauuuauagagaaugagggcugauaacaggaauacaguggcaaagac

SEQ ID NO: 4111809 - RNA, 86 nt, Human
gucuuuggacuuucucuuuuguguaauucuuuguauauacaagauccuuggccaagaucccauuauacaaaagaaaagguggggau

SEQ ID NO: 4111810 - RNA, 70 nt, Human
gucuuuggcaacacaugugggacagagcuauagacuaaagaguguucugucccauucucuuguggaggac

SEQ ID NO: 4111811 - RNA, 56 nt, Human
gucuuugucaaugcaaagcugugugaacccagacgcaguuacagccaggacaaggc

SEQ ID NO: 4111812 - RNA, 59 nt, Human
gucuuugugguaguccucagccuagauuugaugaccaucuucuuggauuauccagagac

SEQ ID NO: 4111813 - RNA, 66 nt, Human
gucuuuguuacacucuccaggcacuugggagucagaacuuuuuccagggccuagaggugaccugac

SEQ ID NO: 4111814 - RNA, 59 nt, Human
gucuuuguucuuuaucugacugugagcuggugaaaagagaacagucagggaauaaagac

SEQ ID NO: 4111815 - RNA, 55 nt, Human
gucuuuuaggcacuggcaugcccggagaaucuccccacacacuaggccugaugac

SEQ ID NO: 4111816 - RNA, 69 nt, Human
gucuuuucaggagugucaggagugccuaaaaccuuuuucuucuuaaguaaaaccuggccuuuuguagac

SEQ ID NO: 4111817 - RNA, 70 nt, Human
gucuuuucuuuccccuucucaagaguagaugcagcuguucucaguuuaauaucagaagagaaagaaugau

SEQ ID NO: 4111818 - RNA, 55 nt, Human
gucuuuuggacuggacuuggaggaugaauagaaguucccaggacaggcaaaaggu

SEQ ID NO: 4111819 - RNA, 55 nt, Human
gucuuuuucuacgauagcgccuggcugccccuccaccaggugggagaaagggcac

SEQ ID NO: 4111820 - RNA, 65 nt, Human
gucuuuuuggggcgggugguguggggagaacggaaaaccuuuuuguguauccugcuccaugaagc

SEQ ID NO: 4111821 - RNA, 78 nt, Human
gugaaaaacugcagaaucagugucuccuuaaaagcugugcggguuuucuggcagcuccaaaaggaaacacuuuuucac

SEQ ID NO: 4111822 - RNA, 58 nt, Human
gugaaaaaguucuagaguugcaagagaccucaagggguccuucaaauagggcuauuac

SEQ ID NO: 4111823 - RNA, 73 nt, Human
gugaaaacauaccacugucagacaugaggauguuuuggacuuugauugucuguaagguguuuauguuaguuac

SEQ ID NO: 4111824 - RNA, 123 nt, Human
gugaaaaugucuauguuaaaaguaaaaaguaggaaagcacagagagcucuagguaaaauauuuuguuauugcuuauaauuuguugcaauuugaacuuauuuauuugacacaaauacuuuucac

SEQ ID NO: 4111825 - RNA, 63 nt, Human
gugaaaggcaggcaggguguccaucgguggauacauauggagaucaagaugccugacuuccau

SEQ ID NO: 4111826 - RNA, 66 nt, Human
gugaaaggcuuguccaguaaggggaaaggauuuaaugccugauugcuauguggauaaccuuuauac

SEQ ID NO: 4111827 - RNA, 70 nt, Human
gugaaauaauucagaauugugggcaguacauuauauaguguacugcugucauuucugcuaauucguuugc

SEQ ID NO: 4111828 - RNA, 97 nt, Human
gugaaauauauuuuuaaaagugucacagaaggagggaagcuaguuugcaggcucacacauugggcuuccauauuucuggugucacaaauaaagucac

SEQ ID NO: 4111829 - RNA, 74 nt, Human
gugaaauaugggaugcugucgcagagauggguuucuucuccagugucugaugcacaguugucccuugguugaac

SEQ ID NO: 4111830 - RNA, 55 nt, Human
gugaaaugcuguagaucagugaguugguaaaccaacuauggaaacaguguguuac

SEQ ID NO: 4111831 - RNA, 60 nt, Human
gugaaauucuacugacuuuauugagcaucuuacuucuuuaauggaggaaguauauuucau

SEQ ID NO: 4111832 - RNA, 68 nt, Human
gugaaauucuauccguacaguuaggacauuuauccuuuacugucaaauuuauggaaagagaauuuuac

SEQ ID NO: 4111833 - RNA, 90 nt, Human
gugaaauuguuuagcagaguugcaacgccaagcuugagcuuuugguguagcugaagugauugaguguuagcagucuguaacccgguucac

SEQ ID NO: 4111834 - RNA, 75 nt, Human
gugaacaaauaguaauguggauaccaauaaagcaagagaauaucugcauugguaaaauacauacacacuguauac

SEQ ID NO: 4111835 - RNA, 60 nt, Human
gugaacaacugcaaaaaucuccaugccccaguuuggcauagagggaguagaguuguucac

SEQ ID NO: 4111836 - RNA, 58 nt, Human
gugaacacacaccuauguacaaacaauuuuucaacauguuugauguuuugugugucau

SEQ ID NO: 4111837 - RNA, 85 nt, Human
gugaacacagagucucuuuugguuccaaaaauaauaaaaaauaccauuauuauuuuuagaaccaaaagagauucuguguguucac

SEQ ID NO: 4111838 - RNA, 64 nt, Human
gugaacauuugugggggaacaggauacuuacacagucucaaaguagcucccacagauuauuuau

SEQ ID NO: 4111839 - RNA, 108 nt, Human
gugaaccacgguguccaggugauucuacuuucugucucccaugaguuugacuacucuaaguacucauguaagcggaauguaguauuugucugucugcaucugguuuau

SEQ ID NO: 4111840 - RNA, 128 nt, Human
gugaaccauauggucucugucacaucucugucacaacuauucaauuuugcuauuguagugcgagagcagccgcagacauacugaagugaaugaguguggcuggauuugaucugugggcuguggaucgc

SEQ ID NO: 4111841 - RNA, 67 nt, Human
gugaaccugggaggcagagcuugcagugagccgagaucgcgccacugcacuucagccugggugacac

SEQ ID NO: 4111842 - RNA, 60 nt, Human
gugaacuguggcgucucuggcugagccuggagggcaggaggcuaggaugcugggguuucc

SEQ ID NO: 4111843 - RNA, 57 nt, Human
gugaacuguucugguaacucuacaucauaccuauguaacauaucagaauguguuuac

SEQ ID NO: 4111844 - RNA, 102 nt, Human
gugaagaaguaaagcccaaagcccugggcguuacugggaugcuuuuguugguaauaauaaugucccugugugcucccagggacugagaggugcuuuucucac

SEQ ID NO: 4111845 - RNA, 56 nt, Human
gugaagaggacccagaucuggcuucuuucccaagaagaggguggugugcucuucgc

SEQ ID NO: 4111846 - RNA, 86 nt, Human
ggucugguuuaagagcaggucugucugggaccagauucugcgaauacaaaucuguuucuuccuagccaugcucucacuucagaacc

SEQ ID NO: 4111847 - RNA, 59 nt, Human
ggucuguagucuagaccuguuagauagcugagccuaacagggcuggcagcugcaagacc

SEQ ID NO: 4111848 - RNA, 83 nt, Human
ggucugugaucuguccucaccuuuacagacugaaaaaaauacauuugucagugcuccuaaagugaaugcacaucacauggacc

SEQ ID NO: 4111849 - RNA, 65 nt, Human
ggucugugccucccuggaacaaagcugagaaggaaggagcuuugucccagagggagggauaggcu

SEQ ID NO: 4111850 - RNA, 72 nt, Human
ggucugugcgaaaugucucuauugccucugguuaaggaccaggcaccuguauugaggcauuagcaccaggcu

SEQ ID NO: 4111851 - RNA, 68 nt, Human
ggucuguucuguuuuguuuucucagacaugagauuugcugaaugagaaaacucaaagacagaucagcu

SEQ ID NO: 4111852 - RNA, 97 nt, Human
ggucuguuuugcugcccaguguauuuuugggaccugcagcugugucuuggauggaguagggcucaguaaauacuuuggaguuaaaauguauaagacc

SEQ ID NO: 4111853 - RNA, 85 nt, Human
ggucuuagguaugguauagaggguaaagcaucacaauuccaaacaaaauuaaagauauugcaccucuaauacauuaccagaggcu

SEQ ID NO: 4111854 - RNA, 64 nt, Human
ggucuucaggaggggagggcaugggcaaaggaaaaggcuguaccauguccugcuucuccucacc

SEQ ID NO: 4111855 - RNA, 102 nt, Human
ggucuucgguucaagguacauauacuaccuagaugauggcucccauucuugugguaagauaucaccucuaggcugguguuucaguugugccuuuggcaggcc

SEQ ID NO: 4111856 - RNA, 112 nt, Human
ggucuucucacucugucacgcccuggcuggagugcaggugagugaucagcaaugagcugugaccacacaugugcacuccagccugggugugaaacugugacacauggagauc

SEQ ID NO: 4111857 - RNA, 68 nt, Human
ggucuucugauuggacuuggacagagauucuugcuuuucucuuuaauccagggacaguauagaggauc

SEQ ID NO: 4111858 - RNA, 67 nt, Human
ggucuugaauuccugcccuuaagugacccacccaccucggccuccuaaagugcugggauuauaggcc

SEQ ID NO: 4111859 - RNA, 82 nt, Human
ggucuugcuugguuagaugaggcugguuucaccuggauuacaggacacugagucauuaguuucauuugucccuucaaaugcc

SEQ ID NO: 4111860 - RNA, 77 nt, Human
ggucuuucccaggcucacauagcuggaaaggggaaggggccuucuccuuccagaggcgugacacccuggagaaggcu

SEQ ID NO: 4111861 - RNA, 63 nt, Human
ggucuuucucucagguacagauaacagcuaaacagaauguuuuagcuccuuggagaagaggcc

SEQ ID NO: 4111862 - RNA, 61 nt, Human
ggucuuuucacagugguuugagguugguggcagagcuaauaauugaugugugggugggacc

SEQ ID NO: 4111863 - RNA, 81 nt, Human
ggucuuuucccaagagcagcugcauucagcaccugaccagacucuaggguuuuaagggugcagcugcccaaggacuggucc

SEQ ID NO: 4111864 - RNA, 67 nt, Human
ggugaaaaggacaagcuuuggaguuagacaaccugaguucaaauuuuggcucugccauuuuucagcc

SEQ ID NO: 4111865 - RNA, 94 nt, Human
ggugaaaggcagcgagcauggcuggaggccgggcuuccuuagagauggucggcugagcaggcuugguccccagccuccccuuccugaaauagcu

SEQ ID NO: 4111866 - RNA, 58 nt, Human
ggugaaguaugaggaaauggagaaggcauuguccaaggagcagucuucaaccuucacc

SEQ ID NO: 4111867 - RNA, 87 nt, Human
ggugaauaguaagagaauauuugcuugagcaaugauauccaauaaacuuucugugaugaugcaaauguucuauauuugcuguguccc

SEQ ID NO: 4111868 - RNA, 64 nt, Human
ggugaauaucaagcccuagguggauaccgagccccagguggauaccuggauccugguagacauc

SEQ ID NO: 4111869 - RNA, 62 nt, Human
ggugaauuguaccccauaggaucaucaauaagccacuuagauccacaauagggaaauucacc

SEQ ID NO: 4111870 - RNA, 92 nt, Human
ggugacaagccauucaagguauuuaaaacauaagcacuaaaauuuuauccaugcauuuaugugugugcuuuugaaaaaaaaggccugucacu

SEQ ID NO: 4111871 - RNA, 96 nt, Human
ggugacaaggaaagauguuuuauaauagaaucuucuucauaucagcaauuuugaugcagauguuccuacuguguuacguagacuuucugaugaucc

SEQ ID NO: 4111872 - RNA, 56 nt, Human
ggugacagccgcuugcccuguaacuuucuguuucggggcaagucgcgcuuucagcc

SEQ ID NO: 4111873 - RNA, 78 nt, Human
ggugacagguuccacaggcgcugacccugggguucuggcaagcuguuggcucaguguuuguggaacauagucgaagcc

SEQ ID NO: 4111874 - RNA, 66 nt, Human
ggugacaucacugaaugcaaagcugggaagagaggcuccccguugauuuagugauucugcaaggcc

SEQ ID NO: 4111875 - RNA, 60 nt, Human
ggugaccucagcugcccggcuggccccaacuccaccgcacaacgcagacugcgggucccc

SEQ ID NO: 4111876 - RNA, 68 nt, Human
ggugaccucugacccuggugguggccacugcuggcucugcccaaugcccacaccugggggaggcugcu

SEQ ID NO: 4111877 - RNA, 68 nt, Human
ggugaccuggaggugcaggaggaggaagagaauucccaggacucggcacucuccuuggaggggucacu

SEQ ID NO: 4111878 - RNA, 130 nt, Human
ggugaccuggcugucaauugguacaggucuguccaguuccuguccuggaucugcccaguuaguugggaaagacucaggacaggagcccuagaccuucaaaucuuagguauugaucucuucccagggcagc

SEQ ID NO: 4111879 - RNA, 79 nt, Human
ggugaccuuuugccuuuccaggguuaauuuauauggucauuaaagauuuuaugaaauugagccuggugcuucaaauccc

SEQ ID NO: 4111880 - RNA, 65 nt, Human
ggugacucagcccugagcacgcaggaggcagccugccugugcccggcccagggcccuggguuucc

SEQ ID NO: 4111881 - RNA, 75 nt, Human
ggugacuccuuucaagagaaaacuaaccuaugaugccacaagucgucauaguggccauucuugaggggagcuucc

SEQ ID NO: 4111882 - RNA, 80 nt, Human
ggugacuggacucuugaggaguggguuggaauuugcgcucccuucgugaccugugcagcugacccacuccagucccuccc

SEQ ID NO: 4111883 - RNA, 67 nt, Human
ggugagaaagcacacaccucacugccugcuucuguugaagguuguguaaaugucugucuuucuuccc

SEQ ID NO: 4111884 - RNA, 76 nt, Human
ggugagaaguguuuuuuguauauuuuuuugggaaaaagccaauuaagauauagauauacagagaauuauucacacc

SEQ ID NO: 4111885 - RNA, 97 nt, Human
ggugagacagucccaaagucuuaguaugguuuuagguuacuuaaaguauuuaaagcuugacgcuguacaaagacuucugggauauccuauguuaacc

SEQ ID NO: 4111886 - RNA, 75 nt, Human
ggugagacgcaggcgucaaagcuugaagagcaauugcauuaccugugcggcugagguuuucugccugcucaaucc

SEQ ID NO: 4111887 - RNA, 65 nt, Human
ggugagacuggacgcacaggauuggggcauuauuuaacacuucuguccuguaguucacguuggcc

SEQ ID NO: 4111888 - RNA, 81 nt, Human
ggugagagauugcucaguagaacuuuuaaccaauuucagaaugagaccuguuggguucauuggcuccauccaucucucacc

SEQ ID NO: 4111889 - RNA, 58 nt, Human
ggugagagcugcuccagaucucucugucacacagaagagacacggaacauucucagcc

SEQ ID NO: 4111890 - RNA, 84 nt, Human
ggugagcaauuucagccaggcucagaggcuaggaugggugaauggcagccucuccagagccuggcagaaugagggugccccacu

SEQ ID NO: 4111891 - RNA, 129 nt, Human
ggugagcauaguuaguaacaguguauuguacauuucaaaauugcuaagagagcaaauuucaaauguucucaccacaaaaaauaguaaguuuuugaagugauaacuauauuaacuugauuuaaguuuucc

SEQ ID NO: 4111892 - RNA, 62 nt, Human
ggugagccuuuaguaaggccuugacagaaauagcuuauuuccaaaaaggccauauucucauc

SEQ ID NO: 4111893 - RNA, 85 nt, Human
ggugagcuguagcacugccagaggugguggugucuagaacaaaguucuaagcagaccauuccuguggcccagucuuggcuguacc

SEQ ID NO: 4111894 - RNA, 55 nt, Human
ggugagcuuggacaccuuggcagguucagacaaugaacagacuucaaagcucacc

SEQ ID NO: 4111895 - RNA, 57 nt, Human
ggugaggaauuggggacugaccacaaugaaggcaaggaggcccagguuuccaucacc

SEQ ID NO: 4111896 - RNA, 61 nt, Human
ggugaggagauugagcuugguagguaaacuacuaacacaauguaccauaucuccaaacacc

SEQ ID NO: 4111897 - RNA, 74 nt, Human
ggugagggaguggcaggagggcuuggaggucaacucuuuagacccuucccacaguucucuugucacuuccuccc

SEQ ID NO: 4111898 - RNA, 98 nt, Human
ggugagggcacaguuggaggugggguccauguauucauaguggcaccagcaccagucugugugaaugugggcuuuuuccucuguuugcagcugucacc

SEQ ID NO: 4111899 - RNA, 56 nt, Human
ggugaggggcaccucugcccggccaccccuacugggaagugaggagccccucagcc

SEQ ID NO: 4111900 - RNA, 56 nt, Human
ggugaggggcgccucugcccggccgccccuacugggaagugaggagccccucugcc

SEQ ID NO: 4111901 - RNA, 55 nt, Human
ggugaggggcuccucugcccggccgccccuacugggaagugaggaccccucugcc

SEQ ID NO: 4111902 - RNA, 86 nt, Human
gugcaagguaguuuagugauuacagauauauaaauaguaaaauauauuuguuuaccaagcuuuaauuacauaagcaacuuuuguau

SEQ ID NO: 4111903 - RNA, 114 nt, Human
gugcaauaauuuuuaaggacguaugaauauggaguuuacuuaguguaauauuuguguuacacccacaaaaaauuccaaauugcagauguuuuauaccuuaaagcucuuugucac

SEQ ID NO: 4111904 - RNA, 122 nt, Human
gugcaauacugggcuuugucaauagaggaugugagagaaaugugggaagguguagaaagaacaaagcgcuugucaucuuuguuccuguauuuuccuuccucuuguggcucucaguggugugc

SEQ ID NO: 4111905 - RNA, 68 nt, Human
gugcaauauuuuauauccaacaaacacucaacaaacacuugguaauuguugauuauugaguauggcac

SEQ ID NO: 4111906 - RNA, 64 nt, Human
gugcacacuuaauacucacugugcugugggugaccacagaguggcccaagauugaaguguggac

SEQ ID NO: 4111907 - RNA, 123 nt, Human
gugcacaugaacgugaguugaaaauagccuucguuauuguuguuguaagccaccuaaacuugggggucauuuguuacugcaacauaauguagucuaagcuagcugauacacacacacaugcac

SEQ ID NO: 4111908 - RNA, 67 nt, Human
gugcacuucugcccucuugggagcuugcaauuuaguugaggagaaaaauacagaggcagacauguau

SEQ ID NO: 4111909 - RNA, 89 nt, Human
gugcagaaaauauaauuacaacuuuauuggauauuuacaagauacacaagguaucuuguaauaaugaaagauuucucuauuuucuauau

SEQ ID NO: 4111910 - RNA, 66 nt, Human
gugcagaauauuaguaucaguuauaccucaauaaaaggggucaguguauguauugauaagcuguau

SEQ ID NO: 4111911 - RNA, 64 nt, Human
gugcagagaaaugagaagucgagaauucauccugcuccaccggcuuccucaccuucucuugcau

SEQ ID NO: 4111912 - RNA, 80 nt, Human
gugcagagcucuccugcccugugcuacgcaaccgcucuccacacagggcucagcagagaccagggaggaagggcucgcac

SEQ ID NO: 4111913 - RNA, 69 nt, Human
gugcagaggucacaaaagugaacacuuuuuuaccucuccuuccugugcccacuguuaagacuuuugcau

SEQ ID NO: 4111914 - RNA, 62 nt, Human
gugcagcauggaguuguggaaugauguaugguauuguuccacacagcucaugacuccuguac

SEQ ID NO: 4111915 - RNA, 57 nt, Human
gugcagccauuugcaugcuuccccacaaaguugugacacaguugaugcuggcuguau

SEQ ID NO: 4111916 - RNA, 62 nt, Human
gugcagcugggacacugaggccagagagaagcuucuuggcucaaaacuuagauuccaggcau

SEQ ID NO: 4111917 - RNA, 94 nt, Human
gugcaggaggcuggagcucccaggcagggcugcccacuccgcucaacgggagucagauggggguggccccucagggcauuuuaccauccugugc

SEQ ID NO: 4111918 - RNA, 115 nt, Human
gugcaggcugcuucauguccuuuaggcucuucuguggcagccaaggggguuuccuuuuuucuucccucuauuucugggccacagagaggaaagaacaaagaugcuuucccugcac

SEQ ID NO: 4111919 - RNA, 73 nt, Human
gugcaggggcagagcauagcuccaauuauuuuuacauagucuuauaucacuaugcucugugcagguccugcac

SEQ ID NO: 4111920 - RNA, 57 nt, Human
gugcaggguacauugggaugggauggugagaauggucauuucaaaacuacccuccau

SEQ ID NO: 4111921 - RNA, 75 nt, Human
gugcaggguuugaggucuuauagcaccuacauaaauucuaccagggaucuaagggaacagcuucaaacucagcac

SEQ ID NO: 4111922 - RNA, 55 nt, Human
gugcagucaguacucuguagcgguuaaaagcauagacccuagaguaagacugcau

SEQ ID NO: 4111923 - RNA, 113 nt, Human
gugcagugggggccaaguggacucaguccaugauucugugacacccugcggaaggugcggccggcaggggcuggaucaggaguugggucccuagaagaggcccucagcugcac

SEQ ID NO: 4111924 - RNA, 74 nt, Human
gugcaguuacacagcuggugucaggcacugcaguguagguacacggcuggugucgggcacagcaaugcagguac

SEQ ID NO: 4111925 - RNA, 85 nt, Human
gugcaguucucagaagccagggucaggggccuccugccagugucacaugucaggugggacccggauucuccccuacuggcugcau

SEQ ID NO: 4111926 - RNA, 57 nt, Human
gugcaguucuuguaacaugcugcagaagggagcugugagcaugugaaagaccuggac

SEQ ID NO: 4111927 - RNA, 69 nt, Human
gugcaucuauuugguaagauauguuacacaaucauugaaaacaaugcuugccaagugugauaaaaacac

SEQ ID NO: 4111928 - RNA, 66 nt, Human
gugcaugaagacucagaaagucaggaucauuuggagucaauccagaaagucucagcuucacugcac

SEQ ID NO: 4111929 - RNA, 66 nt, Human
gugcaugauauuuuuaucaaacugcuuaagaaaauauuuuaugaguuuguaaagaaauauuugcac

SEQ ID NO: 4111930 - RNA, 57 nt, Human
gugcaugcacgugcuauguaugaguauccacauucauauaccugcaugugcaugugu

SEQ ID NO: 4111931 - RNA, 77 nt, Human
gugcaugguaaccaggaugucuaugcauucaugcauuccuucacugcauguaacuagcacuuucuugugccaugcau

SEQ ID NO: 4111932 - RNA, 62 nt, Human
gugcaugugugucugggcaugggugugugugcauaugugugugucugaggauauaugugcau

SEQ ID NO: 4111933 - RNA, 109 nt, Human
gugauguguuccauacaugcaaaugccaugcguggagcuuugcacuguggcaauaaaguaaaagggcugaguuccaugucuggguuugugagaugcagaacacagcagc

SEQ ID NO: 4111934 - RNA, 82 nt, Human
gugauguuacuaaugucauugguaaagauuagguugaaggcaucuucuuuccuuccaggguuuuugccaaucaaauauacac

SEQ ID NO: 4111935 - RNA, 129 nt, Human
gugauuaaauaaucucaaguacccaaaguucaaguguagaguuugguuucaaagcuaauucauuuugauuggcuacaugaacucuuaagucacaaugauacuugguuuacuacuuauuauucuaaucuc

SEQ ID NO: 4111936 - RNA, 103 nt, Human
gugauuacuuugggaacauaauuuuuaugcagcaaaauauuugauaugauuugagagguaccaaguagacuuuugcaucaaggaaaaaugucccaauugucac

SEQ ID NO: 4111937 - RNA, 83 nt, Human
gugauuagcuuuuuuaguuguuguuaugucauuacuacuuacgguaucagacaaaguaagggcuaaugagcaaaaauagucac

SEQ ID NO: 4111938 - RNA, 63 nt, Human
gugauuccuucgugagcagauguuagaggucucccuuugacagcuuguuacaaaguugaucac

SEQ ID NO: 4111939 - RNA, 55 nt, Human
gugauucugcacgucauuccuggcucaacagccugaaugaguccugcuggaucac

SEQ ID NO: 4111940 - RNA, 56 nt, Human
gugauuguccacaggccaaacuccagggggcaggacccuggagcugagggcaaugc

SEQ ID NO: 4111941 - RNA, 68 nt, Human
gugauuuaaaaguuuuucaauuuuugacaaugaaaacucauggucaaaaaggccuagacacaagucac

SEQ ID NO: 4111942 - RNA, 81 nt, Human
gugauuuagagauucagaaaugaggagggccuggugucuggcccauuuggguggugcccuuuggucuggagugucugucac

SEQ ID NO: 4111943 - RNA, 77 nt, Human
gugauuuagauguugaaagugacuaauugccauuucauauacaugcauagcuaucauuucuaaacgucuguaaucac

SEQ ID NO: 4111944 - RNA, 65 nt, Human
gugauuuaugggcugacuaaugguaaacugauuugugcaugugccagaagucagcucaggaauac

SEQ ID NO: 4111945 - RNA, 75 nt, Human
gugauuuccugugguguuucccagacagccaccuccaggagguuagcagugugcugggaaauggcaggauaucac

SEQ ID NO: 4111946 - RNA, 70 nt, Human
gugauuugcucaaauagaacugaucuauaauauaguuaaguguuguaucaguuagcuauugcugcauaac

SEQ ID NO: 4111947 - RNA, 77 nt, Human
gugauuuggauguuggggugcaugggccacgcuuggagaaaaacuggcccugcaccccaauggcaugacccguucac

SEQ ID NO: 4111948 - RNA, 72 nt, Human
gugauuuguuauucuguaauuacuguguaaaguacugugcuagguacugugaauacaaaauaaauuggucac

SEQ ID NO: 4111949 - RNA, 55 nt, Human
gugauuuucuccuccuagaaguucuuaaaugacgcgaaaagguggagaaguucac

SEQ ID NO: 4111950 - RNA, 61 nt, Human
gugcaaaaugcucaucagcgauggcugggagaacuaccagagcuggcagaguaucaagcac

SEQ ID NO: 4111951 - RNA, 56 nt, Human
gugcaaagggcuuugcauacagaaucucacuuguucuuugcaggagcccuuugaac

SEQ ID NO: 4111952 - RNA, 61 nt, Human
gugcaaauuuauauggugacugcugaaggccuucguaggcagugugugugugaguuuguau

SEQ ID NO: 4111953 - RNA, 68 nt, Human
gugcaagucagcagccuggccaggagagggcucuaccucaucccagaagguugcugcucgaaguguac

SEQ ID NO: 4111954 - RNA, 66 nt, Human
gugcaauacauguugagaaaauaucuggcacuagaacuuaugccaaguauuuggguaacauugggc

SEQ ID NO: 4111955 - RNA, 94 nt, Human
gugcaauguacuuugcugaagcguaaaaauuauaggguuucaaucuacagaaagaaacugaagagcuuuuugacacuagguaaguacauugugu

SEQ ID NO: 4111956 - RNA, 65 nt, Human
gugcaaugucugugauaugaaaugcagucuuacaugcacacuauguuacucacauguucuugcac

SEQ ID NO: 4111957 - RNA, 63 nt, Human
gugcaauuuugcaucuguaugcugcauauacuuugcguucucuguaugacaugcgaaaugcau

SEQ ID NO: 4111958 - RNA, 87 nt, Human
gugcaauuuuuaaaaaggcucuucuuuuauuaacugauguacuacucugcucagaguuuagaaaugaaagauuuugaaagccugcac

SEQ ID NO: 4111959 - RNA, 66 nt, Human
gugcaccacccaggcacagcagccacucacagucuccagagcuggcaccuggugcaggguggccac

SEQ ID NO: 4111960 - RNA, 57 nt, Human
gugcaccccagucuaaaaccagccucuagaugaaggaggcagagauuuggggugggc

SEQ ID NO: 4111961 - RNA, 94 nt, Human
gugcaccucauagaagcuuuuaauagucuuuauauuuacuaaagaauaggacuaacuauggaacuaugaagaugagcuggaaaugacaggugac

SEQ ID NO: 4111962 - RNA, 74 nt, Human
gugcacgugaaugugagugugcaugcgugcguauuucuguaugcauacacaugugcacauacgcauacguguac

SEQ ID NO: 4111963 - RNA, 74 nt, Human
gugcacgugggugcacagaugcaugucugugugcgugcguacauccaugcaugucugugcacguguacgugcau

SEQ ID NO: 4111964 - RNA, 72 nt, Human
gugcacuuuuaugagauacuacagauugugaauaauaaauuaguuacucguauguguuuuagaauaguguac

SEQ ID NO: 4111965 - RNA, 74 nt, Human
gugcagagagcacaugagaggaaaucaaaaccuguucuucuuagauuuuauuuaccuuauguccuccacugcac

SEQ ID NO: 4111966 - RNA, 64 nt, Human
gugcagauacagccugccagguucuucuacccugguguugaagaaccggucuggcuuugugcgc

SEQ ID NO: 4111967 - RNA, 67 nt, Human
gugcagcaucucugcauuuggaucuugagcugcuuugauaaguuccucugauuaaaugcaguugcac

SEQ ID NO: 4111968 - RNA, 80 nt, Human
gugcagccauuugaaaagcaguucagcauuaucuucuuuggauaccuguugacacaaugcuucucauccaaggccugcac

SEQ ID NO: 4111969 - RNA, 62 nt, Human
gugcagcugccaggggcagcugucucauggccacguguggcucugcccccugguaagagcac

SEQ ID NO: 4111970 - RNA, 69 nt, Human
gugcagcugggcgcugaccuuccagguagagcacagauggcacaaccccgaggcagccccaacuugcau

SEQ ID NO: 4111971 - RNA, 115 nt, Human
gugcagcuggugcagucuggggaugagaugaagaaggcuggggcaucagugaaagucuccugcaagacuuguggauacaccuaccuucaccaguuacucuaugcacuaggugcgc

SEQ ID NO: 4111972 - RNA, 56 nt, Human
gugcaggacacagggauugucugcgugggcauguuuuacaguccagcuguuuguac

SEQ ID NO: 4111973 - RNA, 72 nt, Human
gugcaggaguuagagguuuaaucugaacacaagagaugacugagugagaagauuguuuugauuuuacugcgc

SEQ ID NO: 4111974 - RNA, 58 nt, Human
gugcaggaucucagaacaagugccccagguagcaaaguguuuuauaaggagaccugac

SEQ ID NO: 4111975 - RNA, 58 nt, Human
gugcaggcuagauccuuccuacaccugggcuugugggugcaggaauuggggcugucac

SEQ ID NO: 4111976 - RNA, 67 nt, Human
gugcagguggcuucuagcuucuuuggcagggaaaagaggcaugaagaaaagaagcuaaauucugugc

SEQ ID NO: 4111977 - RNA, 98 nt, Human
gugcucuuucgaggggccuacaagagucuguuacuuguccccuaacgaacuguuugguauacaguagcaggcucugagcuggguaggugguggagaac

SEQ ID NO: 4111978 - RNA, 66 nt, Human
gugcucuuucuugcucccugcuguauccauggcaccaggaaacagugccuggcauggaggaggcac

SEQ ID NO: 4111979 - RNA, 66 nt, Human
gugcugaagucagugaaaaggcaucauccaaacacaauccaaggaaaaugcaagcugauacagcac

SEQ ID NO: 4111980 - RNA, 61 nt, Human
gugcugaggaaggaagacuuaucuauuugauaaguccuucuuguuuuuucugacucugcau

SEQ ID NO: 4111981 - RNA, 55 nt, Human
gugcugaggugggugggcagccuggagaagacuugccugcccuccccuucaccac

SEQ ID NO: 4111982 - RNA, 56 nt, Human
gugcugauugggagcugggauucauguuuaauuggauauuugugccccaucagcau

SEQ ID NO: 4111983 - RNA, 71 nt, Human
gugcugauuuugguuuugaaaagguuuaggagcugcuaaacucuucuguagaaucagauuauggucagugc

SEQ ID NO: 4111984 - RNA, 77 nt, Human
gugcugccaggauccccaggucgccguccugaccccuggcugggcuucuuggaugaguugccugggguccugcggcc

SEQ ID NO: 4111985 - RNA, 116 nt, Human
gugcugggagguuuaucuugaggccacugcugcucugguggagugauugggaacuauguauauauauuuucucuccagggaagcaguguacuuuugaagggcuuaauaacagacac

SEQ ID NO: 4111986 - RNA, 63 nt, Human
gugcugggauuacaggugugagccaccaagcccggcgaacccugcccuuuuacuccacagcau

SEQ ID NO: 4111987 - RNA, 65 nt, Human
gugcuggggcauaaugggaccaggaccgggcucugugcccgaugguccuccugcugccucuccac

SEQ ID NO: 4111988 - RNA, 60 nt, Human
gugcuggugcacgcugccuaccuggugcucauccagaaggccagcgcagacaccgagcac

SEQ ID NO: 4111989 - RNA, 80 nt, Human
gugcugguggaaucaagguaaagaaguggagcaggagcuaaacuuucccucucccuauugccuggagcugccugaggcac

SEQ ID NO: 4111990 - RNA, 69 nt, Human
gugcugguggucccguugugccgcagugugcugagccacccugagaugccacagcggggccgcuagagc

SEQ ID NO: 4111991 - RNA, 58 nt, Human
gugcugucggcggcugacuugccgguuugggaucccccaggccagugcccuggcucac

SEQ ID NO: 4111992 - RNA, 57 nt, Human
gugcugugcgcuuuuucuguauguguuuuaaaagcauauggggcaugcugucagcac

SEQ ID NO: 4111993 - RNA, 58 nt, Human
gugcuguuuuuggugaacgaagcaccccaugggcuugguggggucuuggagacagcac

SEQ ID NO: 4111994 - RNA, 66 nt, Human
gugcuuauagauuuuuuguuagcagcccucauguaguuguugguuguuuauaaaaauaucuagcau

SEQ ID NO: 4111995 - RNA, 80 nt, Human
gugcaugugugugcacacaugcguguauaugggugugugugcacaccugcauguauaugggugugugugcacacaugcau

SEQ ID NO: 4111996 - RNA, 66 nt, Human
gugcauuaauauccugcuggcuaaauauucugcuuauguguuuauacagugcaugguguuaggcau

SEQ ID NO: 4111997 - RNA, 77 nt, Human
gugcauuuauggaagaaaacuuggaaggcauuaaaggcuacauuuugagccuugcaugauuucauucauuuaugcau

SEQ ID NO: 4111998 - RNA, 79 nt, Human
gugcauuuguuccaugaguaaggcuauaaucgguacuuagaaucagaaaauuaguuuuuagucaugguaucaguggcau

SEQ ID NO: 4111999 - RNA, 96 nt, Human
gugcauuuuagaucauauuuuuuaguugaucauucaacaugggugaacugaacuuccuaguaucccauugaugcaacugaauguaguccugugcac

SEQ ID NO: 4112000 - RNA, 77 nt, Human
gugcauuuucucaagagagcacccgucggugguaggaaggggcauugcuaguacgucgggugcuggaggaaaccagc

SEQ ID NO: 4112001 - RNA, 60 nt, Human
gugccacaguugccaggaaccacauguguaaagguguggaggcaucagagugcuuggcau

SEQ ID NO: 4112002 - RNA, 85 nt, Human
gugccaccaagcacacagggcagaaauguugcaucugagauagguuaugagaagacuguagcuucugucuugagucuuggaucac

SEQ ID NO: 4112003 - RNA, 75 nt, Human
gugccacccaguugccaggaaaccugcgccauccagacucacuugugcugaggacagcuccuggcacgguggcac

SEQ ID NO: 4112004 - RNA, 58 nt, Human
gugccaccuucaaaucacauuggggcuuagggcuucggcaaaugaauuuaggggguac

SEQ ID NO: 4112005 - RNA, 97 nt, Human
gugccacuuuuagcucugugacccugggcaagucacuuagccucugugccucagauuccucagggcuagugcaaggauugcugcagagcugugguac

SEQ ID NO: 4112006 - RNA, 69 nt, Human
gugccagagaugacaggccugccugcuacccacucacacccuaccagugagguuugucaccucuuccac

SEQ ID NO: 4112007 - RNA, 55 nt, Human
gugccagaggccccaaacaaguccauacuugggcuucgggcuuggauuuuggcau

SEQ ID NO: 4112008 - RNA, 100 nt, Human
gugccaggcacugggcucugccaggcacugggcucugcagcagugguaacaggcuauaaagugcuucucugugccuggagaccuauacagugcuuugcac

SEQ ID NO: 4112009 - RNA, 72 nt, Human
gugccauggcuugguugguuaaagcaccugucuaguaaaauagaagucuggagccacccuaagcauuggcau

SEQ ID NO: 4112010 - RNA, 98 nt, Human
gugccaugguccuggagcagccagcuguggcuauggcuccucauucagcaggcagcuuccugagccagcagcuccuuggcggcccaguucuguagcau

SEQ ID NO: 4112011 - RNA, 83 nt, Human
gugcccaaaggacaaagcagagcuggaugcaucuguggcuaggagacagggauuuguuuuguuuuguuuuguuuuauaagcac

SEQ ID NO: 4112012 - RNA, 86 nt, Human
gugcccagcaggagcugagacccaguggcugaaauagacagaacauucucugguuaucaggcaucuggcuacacuccaggcugcac

SEQ ID NO: 4112013 - RNA, 63 nt, Human
gugcccaggcccaaggcaccacuuuaucacauuccccuggccauagcaaugggccuuggacac

SEQ ID NO: 4112014 - RNA, 81 nt, Human
gugcccauccaaggccggcccaugguggccagcuugcacagcaggguggauggcagggccagucauggggaaggagggcac

SEQ ID NO: 4112015 - RNA, 66 nt, Human
gugcccaugugcaggaagcucucaguuuguuuauaagugaaaaaggcuaagcaucuugugcuguac

SEQ ID NO: 4112016 - RNA, 127 nt, Human
gugccccuagcugacuguugaggguaagcagagccacagccuccagauuuuauucaaggugaaauggacauugggugagcucucuuguucucagaugaucugcuuuauaguacaggacuagggccau

SEQ ID NO: 4112017 - RNA, 93 nt, Human
gugccccucccuguccauucuccucaauuccacugucugaaggauggacugggguaaggugaggaggugccauuguuaacagguugguggcac

SEQ ID NO: 4112018 - RNA, 65 nt, Human
gugcccggaaagcuucucucagcucacccggcaggcuuuucuugcccagagccuagggagggcac

SEQ ID NO: 4112019 - RNA, 64 nt, Human
gugcccgugcuaagcuccaucacuuguuuccucccacgaugggugucgugcuugccauggguac

SEQ ID NO: 4112020 - RNA, 62 nt, Human
gugcccucguguaguuccagguacacugauagugacgugugcccagugggugcaggggguau

SEQ ID NO: 4112021 - RNA, 101 nt, Human
gugcccucucugugccccaguaguccuggauugguggaggcagagccaugggcuuauucccugucucuccacacagccagugccuaacacagugacagcac

SEQ ID NO: 4112022 - RNA, 68 nt, Human
gugcccugaggucuucacuuugcgauacaaagcccagaggaguucacagggagaggggccuggggcac

SEQ ID NO: 4112023 - RNA, 61 nt, Human
gugcccugaguggguaggagagggaguuauuauaaccucauuccugcuuccaccagagcac

SEQ ID NO: 4112024 - RNA, 89 nt, Human
gugcccugguucucgacucaucagccucuaggaaagaagcagcuugcugguccaucccaggcugcugggaggcccgagaaacaggucac

SEQ ID NO: 4112025 - RNA, 63 nt, Human
gugcccuguggguaucugauggcugcuaauuaucucaguggaccuuacaguaccuauagauac

SEQ ID NO: 4112026 - RNA, 58 nt, Human
gugcccuuauggaagaaaccucagagagcuaccugcuccuucuguuauaugagggcau

SEQ ID NO: 4112027 - RNA, 85 nt, Human
gugccgcacuugggguauuugacaaacugacacucuaccacauggaguguccaacucagcuugucaaauacacggagcguggcac

SEQ ID NO: 4112028 - RNA, 62 nt, Human
gugccgugggccuuagugaucugccuaccaucagccaaggcgccuuauuguggucacagcac

SEQ ID NO: 4112029 - RNA, 59 nt, Human
gugccuagacauuuugguuugcccaggacaggucggguuuacgccaguugucuuggcau

SEQ ID NO: 4112030 - RNA, 97 nt, Human
gugccuccuacacagugccuggcacagagcagguggccugugaucaugucaugagcuaacccaaacugugucuggcacaguugcaggauauggacac

SEQ ID NO: 4112031 - RNA, 65 nt, Human
gugccucucauuggcugagcccggcugaaagccagagagcaggggcacagcugaugcagacacac

SEQ ID NO: 4112032 - RNA, 66 nt, Human
gugccucuccucaucccuaccgacuugcagccgugauagggaugcuuaguaggacccaggaggcac

SEQ ID NO: 4112033 - RNA, 89 nt, Human
gugccucugcgaugguccugccaagguccuuuaccugacggccuggugaaggugaaggucagagcaggaaaaacgcaagaguggugcgc

SEQ ID NO: 4112034 - RNA, 88 nt, Human
gugccucuuugaugauggcaagugguaugcuggcagagguccccagaucaccucugcccaggacaccugccacuccccagggggggac

SEQ ID NO: 4112035 - RNA, 103 nt, Human
gugccugacucaucccuguuccugguccccagugcggcacgugugcguggcaggugucaccaccgaaacgucugcggauccuggagcaaaugcucacaagcac

SEQ ID NO: 4112036 - RNA, 69 nt, Human
gugccuggcaguugacaguuugcuaaaggugcaccuuuaauuaaugaguaagagucccuguccauccac

SEQ ID NO: 4112037 - RNA, 97 nt, Human
gugccuggccucuaggcuugaaauucuaaugaaaguggaccaugggcaggcuuauaacucagaguuccucauagauccaguccugaggcacagucau

SEQ ID NO: 4112038 - RNA, 66 nt, Human
gugccugggguuggcaaacugcucagagaaguauguuugugaccugagcaaccauccccagggcau

SEQ ID NO: 4112039 - RNA, 71 nt, Human
gugccuuggaggaaugaugagagccaugaaaggagaaaagcuuugguuccaccaauucuccuccaaggaac

SEQ ID NO: 4112040 - RNA, 80 nt, Human
gugccuuuguuaguauucuuauuauuugugucuauauuauuaaguaacauggaagauaaaaauacucauagcuagagcau

SEQ ID NO: 4112041 - RNA, 84 nt, Human
gugccuuuuaguuccuuuaguguuugucuuaauugauuuuuuuaaaguaguuuuauguucacagaaggauuaagcugacgguac

SEQ ID NO: 4112042 - RNA, 65 nt, Human
gugcgaaagugucuagagcauuauuauguaucuguuaugguaacacuagcucugucacuuucaac

SEQ ID NO: 4112043 - RNA, 67 nt, Human
gugcggccuggccuucaaguggucgucccacuaccaguaccacuuaaggcagcacacaggcgagcgc

SEQ ID NO: 4112044 - RNA, 58 nt, Human
gugcggucacgcccggcccgcguugagagagcgcuuggcagccagcggguggacgcgc

SEQ ID NO: 4112045 - RNA, 75 nt, Human
gugcgucuaucuccugguacccuuccuagcaucaauucuguauuuguaggaguccaaucaggagacacaaaccac

SEQ ID NO: 4112046 - RNA, 83 nt, Human
gugcgugaggaagacugcauggcauagugauuaagaaccaggguacggcuggguguggucacucaugccuguaaucucagcac

SEQ ID NO: 4112047 - RNA, 74 nt, Human
gugcguggggcuggcaggagcagucaacaggaauaguuagagucagaccugggcuuacaagccagcuguaccac

SEQ ID NO: 4112048 - RNA, 85 nt, Human
gugcgugucugggagggaccuggagccugccccgcaccugucccgcagggcuucugguucuucaggccauccucccagcaaaagc

SEQ ID NO: 4112049 - RNA, 92 nt, Human
gugcguuacagccuggaggggcgcugucgggucaccuugaccccagguggccuggaacagccccccaccuuacacaucuugcccugccgcac

SEQ ID NO: 4112050 - RNA, 125 nt, Human
gugcuaacaagugguucacauccaggaucucauuuaaucccccaacaaaccuguggggaaaugucauccucacuccacagguggggaggcugagguucaggauggcuaacagaccaugaggacac

SEQ ID NO: 4112051 - RNA, 65 nt, Human
gugcuacagacugaguacacuuaggauucaaaacuauuuucaggguacuauuagucauguggcac

SEQ ID NO: 4112052 - RNA, 124 nt, Human
gugcuacuuaaucuuaaaagcaaaauuaaacauuggacugguuuacauuucaagcuacaauauggaaccauuguauuuggaggaaugaguuuaauaugcauuguaaaauaaaauuaggggguac

SEQ ID NO: 4112053 - RNA, 55 nt, Human
gugcuaggaauuuuccuuguugauuuuauagggccaggagauuuuuccauagcac

SEQ ID NO: 4112054 - RNA, 73 nt, Human
gugcuauuuggcugugagguuguuugugaauuaaccucaaaauauuuacaauuacuugaucucagcucugcac

SEQ ID NO: 4112055 - RNA, 70 nt, Human
gugcucacacugacacagguuuaucucagucugugauccuugggaggagacccugugucaguuuaagcac

SEQ ID NO: 4112056 - RNA, 67 nt, Human
gugcucaccaugggaacuugggcaagccaagggacuuuucugggccucaguugaucugugugagcac

SEQ ID NO: 4112057 - RNA, 55 nt, Human
gugcucacugugagacguccugccacaccccacaggagacggaggcagugggcau

SEQ ID NO: 4112058 - RNA, 88 nt, Human
gugcucagagaugggaggcugcuuuccuccuauccuggaucucuggaggaugucagcaaggcaccccccauuucuuacacuggagcac

SEQ ID NO: 4112059 - RNA, 71 nt, Human
gugcuccauaacuguuagcuauuauuuuuccuauaacauuuuauaggaaugauaauaguaaagaguagcau

SEQ ID NO: 4112060 - RNA, 80 nt, Human
gugcuccuccuggugucgccuggucaguuagcuucaucuacaauugcauauguaacuucuaggcugcacacggcaugcac

SEQ ID NO: 4112061 - RNA, 56 nt, Human
gugcuccuggccacaugaagcuggaagaaggccagcuuuaacccuuucaggagcau

SEQ ID NO: 4112062 - RNA, 97 nt, Human
gugcuccuuugcugugaccccacaucgcuguccugaggugcagcugucggaggcugcugagucacgacagugaaugggcagagacagaggagucagc

SEQ ID NO: 4112063 - RNA, 65 nt, Human
gugcucucucacguguuaccuccuaagggauaucaaaucugggaagcaaauauguaagaaggcac

SEQ ID NO: 4112064 - RNA, 73 nt, Human
gugcucugaugugacuuuuucaucaagucaguauuccugggaucucuuguacaugauaaucucacucuugcac

SEQ ID NO: 4112065 - RNA, 61 nt, Human
gugcucuggagggaggcgucuucugcaggagggacgggagagccagcucacuccagggccc

SEQ ID NO: 4112066 - RNA, 64 nt, Human
gugcucuugcuuucuaaccuaaagugucuaaugagaacuuuagaaaggaaggaaguguuagcau

SEQ ID NO: 4112067 - RNA, 59 nt, Human
gugcucuuuauaaaagucauuaugucuauuuuuagacauuucaguguuuaugaagacau

SEQ ID NO: 4112068 - RNA, 55 nt, Human
gugcugagcacaaggcccagagucacuacugcagacuucugggcaaucucaguau

SEQ ID NO: 4112069 - RNA, 85 nt, Human
gugcugagcuggaaagggacugauuguagcaggaaugaaagaauaggauucacauuauaaucaguucugcugagcagcugagcac

SEQ ID NO: 4112070 - RNA, 65 nt, Human
gugcugagugagaacccagagagagugcaggucagcgugagggucucuguggguuucaccagcgc

SEQ ID NO: 4112071 - RNA, 58 nt, Human
gugcugauguugcuucccuugggcucauuauuggcauuagagaaagcaggcacagcac

SEQ ID NO: 4112072 - RNA, 80 nt, Human
gugcugcacucugccacaucucguuugccgccauaucacagaauuggcacacugcggugaugugagucaguguguggcac

SEQ ID NO: 4112073 - RNA, 66 nt, Human
gugcugcccuggcauuggguuggauaagugaguuauugcugucauuucccguguuaggagucacac

SEQ ID NO: 4112074 - RNA, 112 nt, Human
gugcugccuguggcuuccguggggccuguggcuuccguggggccuguggcuuccgugcugccuguggcuuccguggggccuguggcuuccguggggccuguggcuucugugc

SEQ ID NO: 4112075 - RNA, 84 nt, Human
gugcugcuccacagguacagacaaguaguucagacaagauccucucacuacccaaacucuugccuacuugucaaccagcaguau

SEQ ID NO: 4112076 - RNA, 68 nt, Human
gugcuggaggcccuccagcugucagcugggguccgugcaccccccagacugccuggagggcuucgcac

SEQ ID NO: 4112077 - RNA, 76 nt, Human
gugcuggagggcugagugggagagaguugcaaauaaaaauguuauauuaauucuaaaaaccuauggcccccuucac

SEQ ID NO: 4112078 - RNA, 55 nt, Human
gugcuggcccuguccucgagcugcuuccagugcagcggggagggcaggaccaggc

SEQ ID NO: 4112079 - RNA, 56 nt, Human
gugcuggcugccaggaggcugcuguggaaauaacuguaggccugagaagucagcau

SEQ ID NO: 4112080 - RNA, 97 nt, Human
gugcuggcugggcccagaacaccaaaggcagagcugaacacuuccacugggaaguggggguuuuggccucuugggcugggaaauuccuggccggcac

SEQ ID NO: 4112081 - RNA, 94 nt, Human
gugcugggagccaugacugaaauacugcucuuggauucugagcucaggagcuccauuagagaguauuacuaaagccaguuguggugcccagcgc

SEQ ID NO: 4112082 - RNA, 90 nt, Human
gugcugggcagauccuucugggccaacuuccaggagcuucuagaugaggguccugaagucacaggcucugagcgugggucugggcagcgc

SEQ ID NO: 4112083 - RNA, 63 nt, Human
gugcugggcguugugcuuaguaauuucauucauaugcaaagagcacccucaaugucugagcac

SEQ ID NO: 4112084 - RNA, 81 nt, Human
gugcuggguguugggcugcugcggugcucuuggaaagugcaaaagaauucccaagggagcacgcacagcagcauccagaac

SEQ ID NO: 4112085 - RNA, 65 nt, Human
gugcuggguucccugccuggccacucugaggucaguaaugcaggugggcagguggcagccuggcc

SEQ ID NO: 4112086 - RNA, 68 nt, Human
gugcugucaucugauguuccuggucuaacaccuaggcaguagguggaggcaggggauacaggucacac

SEQ ID NO: 4112087 - RNA, 63 nt, Human
gugcugucgccaaccccugcccaccuuugguuucaucucuccagugcccaguuggugacagac

SEQ ID NO: 4112088 - RNA, 62 nt, Human
gugcugugaguaaugaccugucuugcucugauccaaugaguaguacaguuuacuuucagcgc

SEQ ID NO: 4112089 - RNA, 60 nt, Human
gugcuguucauuagaaauagaaugcaagaaguauacuuuuacauuuucuggugaauauac

SEQ ID NO: 4112090 - RNA, 62 nt, Human
gugcuguuugaagccacuucaucugugguaauuucuuacacagcaguggaaaacaaauacac

SEQ ID NO: 4112091 - RNA, 79 nt, Human
gugcuguuuggcccuuuaugggaugggcacaaagacccugugucuaccuucccagugggcugcauaagagaccgggcac

SEQ ID NO: 4112092 - RNA, 73 nt, Human
gugcuuagauucuacuucagccugaacuccuuuugaaaggaaagggagaaagcuguaguggaaugugauucac

SEQ ID NO: 4112093 - RNA, 78 nt, Human
gugcuuaugacuaauuagguauucacuuuagaguuuuaaguaauuggucagaggcuuauaccugauuaggauauguac

SEQ ID NO: 4112094 - RNA, 64 nt, Human
gugcuucaacuauacauauuuacauagacguaaacaugaccuauguuguuugugugggcugcac

SEQ ID NO: 4112095 - RNA, 62 nt, Human
gugcuucaggcaaagggacccccaugugcaaaggcauggaggcaugacagugucuggagcac

SEQ ID NO: 4112096 - RNA, 63 nt, Human
gugcuuccagcccagccugcagucuaaggcugcccaaacacccaggagcaggcugggcagugc

SEQ ID NO: 4112097 - RNA, 100 nt, Human
gugcuucccacucuuuagcauggaucagaaucccgggagggcugugaaacagccaccacaccucacccucauuucugauucaguggguaggggugagcac

SEQ ID NO: 4112098 - RNA, 56 nt, Human
gugcuuccuagguaaguagguagcguuguccucagugaaccacaccaggggagcac

SEQ ID NO: 4112099 - RNA, 58 nt, Human
gugcuuccucagagguucccauccuucagcccugugccuuugaggaucuggggagcac

SEQ ID NO: 4112100 - RNA, 61 nt, Human
gugcuuccucaguguuuaaggacgaccagaacugucacauuugaguccacauugggaacac

SEQ ID NO: 4112101 - RNA, 72 nt, Human
gugcuucuaaaacaaguuuccaugcuugaagcguugagugucaaguaucugggagauuugcuuuuguaggac

SEQ ID NO: 4112102 - RNA, 67 nt, Human
gugcuuguuacucucugaaaugccuggggcugcagcagucacaggaaugaacagggaaagaggauac

SEQ ID NO: 4112103 - RNA, 69 nt, Human
gugcuuugcauuuuguuacaucuuauguaaguggugauauuagcauuacuacauuguaacacaguacac

SEQ ID NO: 4112104 - RNA, 72 nt, Human
gugcuuugcuccuuucccuguggugcuggucuuuaaaacaaacaaaccaaccacaaagaaugggggaagcau

SEQ ID NO: 4112105 - RNA, 61 nt, Human
gugcuuuuguuucuucugggaccugcaaacccauccagugcccucaggaaacagaaugcac

SEQ ID NO: 4112106 - RNA, 89 nt, Human
guggaaacuggaggcuuuuguuggucuuugguguuuucuuaacaagagaacagccuccuagagaaacagcgaaagagccagguuucugc

SEQ ID NO: 4112107 - RNA, 106 nt, Human
guggaaaguccucauuugauacaugaaaaaacugaggccuggugagguggugauaaaguccaggucaccccggguacuuauuucuaaucaguaguaggcuuaccac

SEQ ID NO: 4112108 - RNA, 78 nt, Human
guggaaccagcucguucguuccugacagugauaaaggcggcaguuggauuucaucugugaauaaugaacugguuucac

SEQ ID NO: 4112109 - RNA, 65 nt, Human
guggaacuggugagaguucacgggaggaggucagaagcucuccaggugaugaucugaccggccgc

SEQ ID NO: 4112110 - RNA, 57 nt, Human
guggaagaacaaagaagaaugguucuuucuggaaccucuaguuuguucuuugagcac

SEQ ID NO: 4112111 - RNA, 77 nt, Human
guggaagauggacauguaaauggcaauuauggugcagagugauaaaccauuauuagccauaauaguaagcuuugcac

SEQ ID NO: 4112112 - RNA, 106 nt, Human
guggaagauugggauucuaguggcuuaaaaugauguggagugaaauuguuuucaaugaaaauauuuaucaaaguuauaucaugaguauaucuaacccuauguuuac

SEQ ID NO: 4112113 - RNA, 71 nt, Human
guggaagccuuccugagugcaaggccugacacuuguugcggagccaugacuggggaugcauuugaccccac

SEQ ID NO: 4112114 - RNA, 61 nt, Human
guggaaggccaggccuagcacggaggcugugagggcgcccugcccugggcccggccugcgc

SEQ ID NO: 4112115 - RNA, 125 nt, Human
guggaaguguagcuauccucauucccuugggagagguaugugucagugcuuauauauauucaaaaugcaagugucuuuccaucuacucauucuaauucuaugaauucacacagcuguacuuuuac

SEQ ID NO: 4112116 - RNA, 69 nt, Human
guggaaucguauuaccuuugggauuaggacauuucauugucauuauucaccaguguaaaacacuuuuac

SEQ ID NO: 4112117 - RNA, 102 nt, Human
guggaaugaaaugcaacauuugcaugcuuuauuagaaagaucaaaagucuuaaaagaaagaucgacagucuuaauaaaaaugucaagcuugcagugggccac

SEQ ID NO: 4112118 - RNA, 107 nt, Human
guggaaugcuaaguaaaaaaugugauguaguguaguugcaaaggcguuagcuguauucuaauuccagauuugccacuuacucguugaauugacuuugggcaauccac

SEQ ID NO: 4112119 - RNA, 87 nt, Human
guggaauucaggcaguauuucagauucagaaauguaggucacaauuucuuaucugcaguucggaagccugaaaagcacugaaaacac

SEQ ID NO: 4112120 - RNA, 62 nt, Human
guggacaggggcagggaggauuguccucaaagacaacagcauuuccugcccuuugucaucac

SEQ ID NO: 4112121 - RNA, 79 nt, Human
guggacaucuacgaaggcuguuugagcaaaaaaccuguacuuaugcaucuuucugaaacauggucuuuguaguggacac

SEQ ID NO: 4112122 - RNA, 71 nt, Human
guggaccaggccuggcccaggagcuugucggcaaggcagagccgcauccaggcucccggaccaggauccgc

SEQ ID NO: 4112123 - RNA, 70 nt, Human
guggacccugaagcaacagggagcuggggcacuuauacaccaacuccaucagcuguugguugagggcugc

SEQ ID NO: 4112124 - RNA, 71 nt, Human
guggacuucaccucauccacuuuggccaccauguuuuuguugugugucagcaggggagggaacuuacccac

SEQ ID NO: 4112125 - RNA, 91 nt, Human
guggagaagcgggggaagcagaaggaugaggauaggugggguuggggcucagcucugcgcccacagaccuuggcuuccaccuggucucuac

SEQ ID NO: 4112126 - RNA, 55 nt, Human
gugaucuuuucucucuugcuuuuuguguguccuagagcacugaagaguuggucac

SEQ ID NO: 4112127 - RNA, 81 nt, Human
gugaugagaggaugccuuauuguaaucuuuccauuggguagucuaacauggcacaaagaguauagugagguucuuccucac

SEQ ID NO: 4112128 - RNA, 80 nt, Human
gugaugagcucuacaggucaagcaguagcucugcuccacacagucauucagggagcuaagcugaccuguuccuuugucau

SEQ ID NO: 4112129 - RNA, 83 nt, Human
gugaugagggcuuggccauuuagggaggcaaggugauuugcucaaagucacacagcuaguaagggccgaggcggaacucaugc

SEQ ID NO: 4112130 - RNA, 82 nt, Human
gugaugaguucauacuuucaguaccauccaaaagugccuauuaaauuggaguucaggguaccuagagucuugacuugaucau

SEQ ID NO: 4112131 - RNA, 57 nt, Human
gugauggagggaguuuuuguugacuugguaguuccugucugcagaccccuucauugc

SEQ ID NO: 4112132 - RNA, 69 nt, Human
gugauggaugucacuucuaagauaauguuauaaaaagauugucuucugucuuaggugaucucucauuau

SEQ ID NO: 4112133 - RNA, 65 nt, Human
gugauggcaccuggcccugggaccuuaagaaaaucacuuuaccucucagggcuugguguccucau

SEQ ID NO: 4112134 - RNA, 60 nt, Human
gugaugggggcaggauuugaauuucaauauauccaacuucagaauccagucucuuauuac

SEQ ID NO: 4112135 - RNA, 103 nt, Human
gugaugguagagguuuuagaucuaaugucuuacuguggaaccuuuuuuguuaugcuaggggucagaggagaaguugggaaaauugcagaccuacucacaucau

SEQ ID NO: 4112136 - RNA, 130 nt, Human
gugaugugugcaaagcuagugagagaggcaguguaugagagcuuagggauuugaaaugucacaacauauggcaggcccagguguucauuauaaguuacaaacucucguccugcuuggaccauucguaugc

SEQ ID NO: 4112137 - RNA, 75 nt, Human
gugauuacauaggauuaucuuuuagugcaauauuuguuuuuguauucuauugaaugauaaucuauauaugguuac

SEQ ID NO: 4112138 - RNA, 66 nt, Human
gugauucaagaggaacaaugaagauccuuggaaaguaacagcaaucuuuaacccucuugaauugac

SEQ ID NO: 4112139 - RNA, 76 nt, Human
gugauucaucagaauaggaguuuugcaaaaucccacgcauaugcuguugagcaaaacuugcuauggcugaaaucau

SEQ ID NO: 4112140 - RNA, 74 nt, Human
gugauucucugccugggccggccacccucuguccugaggacgcuggagccuggcccggcccuuggcagccccac

SEQ ID NO: 4112141 - RNA, 55 nt, Human
gugauucugccuggaagguccuggagucacaggacuuaaaaccagacagcgucau

SEQ ID NO: 4112142 - RNA, 95 nt, Human
gugauucuuuucuucccuaaggaagcugaugcaaaggguuccucagaaguaguuaauugaacccucugcaucagcuucuuuagggaaggaaucac

SEQ ID NO: 4112143 - RNA, 78 nt, Human
gugauugccugaaaaagucuuugacagaaaucuuguuuacuugagauaacuauucugucaacucuugcaguaauucac

SEQ ID NO: 4112144 - RNA, 68 nt, Human
gugauugcuaugugcuaggcacuggacaacgugcuguucaggaaucaaccaagucauuuaguucucac

SEQ ID NO: 4112145 - RNA, 68 nt, Human
gugauugguagccaggcgaggauggguuuuggaauuaacucuuccuacagucugcuaugcauuaucac

SEQ ID NO: 4112146 - RNA, 120 nt, Human
gugauuguaacuugugguuguaaccugucgugauuguaacuugugauuauaaucuguugugauagcaacauguuaugaugguaaauugugguaacccugguuguaaccuguugcaauggc

SEQ ID NO: 4112147 - RNA, 69 nt, Human
gugauugucauagcuucauggguagcaugucuguauugggaaggcuauuuccaaagcugcuguucucac

SEQ ID NO: 4112148 - RNA, 101 nt, Human
gugauuguuaaacacgauacguguguuggagguccccgagauccuccccaugguggauuugcuagggagacucgcaggacucaacauguaguuguugucac

SEQ ID NO: 4112149 - RNA, 55 nt, Human
guaagcauucauugucuguauagucaggcugacuguacagguuuucagugcuugc

SEQ ID NO: 4112150 - RNA, 57 nt, Human
guaaggaccacacaaucugccauguaaguuauuggccugagugauggaucuccuugc

SEQ ID NO: 4112151 - RNA, 77 nt, Human
guaaggaguucuguuaaguauuacgcugcaucugacagggcauccaggcagcaagauuauuuaauccaacaucuuac

SEQ ID NO: 4112152 - RNA, 68 nt, Human
guaaggauauauuucagagcuucuagggcuauauccauuuccuacuuuccucuuaaauugucucuugc

SEQ ID NO: 4112153 - RNA, 95 nt, Human
guaaggcacugagcuagccaaugagggaaaaagacaugugauagacaucgguuugcacuuuauuuccucucacacgucugucgucagugccuuau

SEQ ID NO: 4112154 - RNA, 80 nt, Human
guaaggcauucuauggaaguacagucaggcacgcaauucaaccaaagugggcaaaggaaggcuuccaggagggcugauau

SEQ ID NO: 4112155 - RNA, 93 nt, Human
guaagggaaggaagguggacgggaggauugugaggguuauaaggguuguaauaaucgcuaauucacaauucaaacuguucagaacuccuuuac

SEQ ID NO: 4112156 - RNA, 88 nt, Human
guaagggcaucuucuguagccaucucauaaaauuggauuguauaacuguuuacucaaggugaaggagaggcugagaagugauucuuac

SEQ ID NO: 4112157 - RNA, 66 nt, Human
guaaguauaugcuugugcaugucuuugugugcauguuguaugcaaaggcaugugaguauauguggc

SEQ ID NO: 4112158 - RNA, 80 nt, Human
guaagugaaaucagaagugcaauuuaaauuaggguggucaagucaggacucccuacgaaguugacuuuugagcagagugc

SEQ ID NO: 4112159 - RNA, 57 nt, Human
guaaguuccuccugcuaaaugaauuuguuuugcuucaugcagagaaggacugcuuac

SEQ ID NO: 4112160 - RNA, 73 nt, Human
guaauaaaugcuguuacuguuggcccagggugagguagggacucaccugugcccagguaauaugauccauugc

SEQ ID NO: 4112161 - RNA, 130 nt, Human
guaauaaauuauuauuuacauuagucagcagcccuguuuaugccacaucaugagccuuuccucauguaauaauauagugaguauaaugauuaguggcugcauaauacugcaguaaguagauacaucauac

SEQ ID NO: 4112162 - RNA, 64 nt, Human
guaauaggagggagucugcuuugaguaauccagugccuucugaaaguuucucccuaauuguugc

SEQ ID NO: 4112163 - RNA, 64 nt, Human
guaaucccagcuacuugggaggcugaggcaugagaaucgcuugaacccaggaagcggagguugc

SEQ ID NO: 4112164 - RNA, 76 nt, Human
guaaucccauugagaauucuuucuuuguaguccugaacaaugacguguucuuugacuccaagaaaguagggguugc

SEQ ID NO: 4112165 - RNA, 110 nt, Human
guaaucugcauagagcaaggcaaacaaauaaugaucuuuauuuuaauuugcaguuucauuacuuuagcaauuauuaaggguugaugucuuugcuuucugaugcuaguaac

SEQ ID NO: 4112166 - RNA, 56 nt, Human
guaaugaaugaaagaaacugggugaaggguggguacgcaggaucuuucuguauuau

SEQ ID NO: 4112167 - RNA, 79 nt, Human
guaauggucaccagaacaagacaggagaauaucaagauaagagaaauguucuaugucuugaacuuuggauuaugguuac

SEQ ID NO: 4112168 - RNA, 68 nt, Human
guaauguauaaaccuucaugauggucauuauuauuuauuuguuuuggugaaccuuggagggacauuau

SEQ ID NO: 4112169 - RNA, 66 nt, Human
guaauguccauuagggauaaagguggugcuagcaaaagacaaaucuggaauccuuguggacaauau

SEQ ID NO: 4112170 - RNA, 111 nt, Human
guaauuaaaucuugucagaccugccuucugaugaugauguuuggcaugcaugcauugaguucugaugcaguuuuaaaucauuucagaaagccagaggugcaagugaauugc

SEQ ID NO: 4112171 - RNA, 59 nt, Human
guaauuacauuaggguaaauaagguguccgucaccucuagcauuuauccuuuguauuac

SEQ ID NO: 4112172 - RNA, 65 nt, Human
guaauuagguagaaaucuauuuuaaccaagcugcaguaugcaguugaguauauuucuuccuuugc

SEQ ID NO: 4112173 - RNA, 64 nt, Human
guaauuccagcuacuugggaggcugaggcaggugaaucgcuugaacccaggaagcggagguugc

SEQ ID NO: 4112174 - RNA, 65 nt, Human
guaauugaacauuaaguugaaggaccagacccagaaaaaauucuuucagcuuaugugucacuugc

SEQ ID NO: 4112175 - RNA, 57 nt, Human
guaauugcagaacuuugggaggccgagauggguggaucaccugaaguuuuggaguuc

SEQ ID NO: 4112176 - RNA, 112 nt, Human
guaauuggaaagcuuuuaucauuuuuuguaggggagagggaaaugagaauaggcuuaaaauugcuucuuuacuauaggcaauuaacaaacauaaaggcugucauuauguuac

SEQ ID NO: 4112177 - RNA, 89 nt, Human
guaauuggguggaguguuguacaaaauaucagugaggcuaaguugguauuagguuucuauauccuuugucuacuuauuucuucaauuac

SEQ ID NO: 4112178 - RNA, 64 nt, Human
guaauuucucagggaucuagucccaucucuuuauuccuuuacucguucccugggauauaauuac

SEQ ID NO: 4112179 - RNA, 94 nt, Human
guaauuugagugagauguguaaucaggggugaaguccaauuuuuguuuaccuauuuuaaauugcaacucuauacaaauuuuauuuucaaguugc

SEQ ID NO: 4112180 - RNA, 75 nt, Human
guaauuugggaguauaucguguaucauaugcauacucacauguaucauauacauacaguaugauucguaaauugc

SEQ ID NO: 4112181 - RNA, 61 nt, Human
guaauuuugauguaucuuuguagcugcgguuguuuccuuaguuauuuuacguuaauguuau

SEQ ID NO: 4112182 - RNA, 106 nt, Human
guaauuuuguuccagcccuugccuggacuccccuuccagaccacaacuuccccggugauaugggacccuggaggaggaagucuacaaugugggagagaugaguuac

SEQ ID NO: 4112183 - RNA, 79 nt, Human
guacaaaaggcagaagaauggugucugagcucaaaaugcaggcagagagugaguucagccuuccuccaucucuuugugc

SEQ ID NO: 4112184 - RNA, 71 nt, Human
guacaaccauuucuuucaaagcccuagggaggcacaggagcauccaggagguuuggaggaagcaaaaguau

SEQ ID NO: 4112185 - RNA, 93 nt, Human
guacaagcugcuuuccugggguggcuuguccuuuugcaguuaaccgagaugccuggggagaagagcuucccccaacaggauggcaggcgaugc

SEQ ID NO: 4112186 - RNA, 95 nt, Human
guacaaguuugaacuacauagaugaauuagcaauuaucuuucuaauauuggaaaagaucuuuuucauucguauguguagcuucugauuaugauac

SEQ ID NO: 4112187 - RNA, 64 nt, Human
guacaauagcaguuuucccuuuaucugccuaaggaaucuacaaguuggaagauuggcuaugugc

SEQ ID NO: 4112188 - RNA, 74 nt, Human
guacacaggcagagcugaagauagauggauauacauauuccaauugcaagguuucagcuccgccugcaugguac

SEQ ID NO: 4112189 - RNA, 102 nt, Human
guacagaacuguacuuucugaauaucauuuaucauuggcgaugauguaaggcauuggagcaaaucaaaugaauaaguauuuauugagugcuuaguucucuac

SEQ ID NO: 4112190 - RNA, 72 nt, Human
guacagaggucagguaggagcucaggaaugcaagcgacagucucacucccuccaaaucugcacagucuguac

SEQ ID NO: 4112191 - RNA, 61 nt, Human
guacagcuggacugguagcugugggagucccgagaaucccacagcccucccgucccuguac

SEQ ID NO: 4112192 - RNA, 55 nt, Human
guacaggacauagacagaguagagcuucuaauauuuacuuugcuauaaauuguau

SEQ ID NO: 4112193 - RNA, 72 nt, Human
guacagggcugugauccuugagagaagguaaaucaguaaugugggcccuaaaaugaucucagcuuucuguac

SEQ ID NO: 4112194 - RNA, 76 nt, Human
guacagugucuccugguacccaguucuccugccuggauauaucaggucccaugcucuguggcaggaggucuugugc

SEQ ID NO: 4112195 - RNA, 63 nt, Human
guacauaauuuucagccaguuuuugauuauucaaagaccuucugaucuuuggauuuuguguac

SEQ ID NO: 4112196 - RNA, 98 nt, Human
guacauagucaguagaaaaugaguccccccagggcaucuaguaaaauaaaccauuccuacccaaagauccccaggaccauccuucugugccugugaac

SEQ ID NO: 4112197 - RNA, 56 nt, Human
guacauaucauuauguuaugagcacauacauguauguguuaugcguauguguguau

SEQ ID NO: 4112198 - RNA, 75 nt, Human
guacauauuuauuuggagagauuuaggucucagucauuuucugauuuaagcuuaaaauucccaguuuaaguguac

SEQ ID NO: 4112199 - RNA, 57 nt, Human
guacaucucagaacugaguaaccggccaagcauccgcugcugggcucugagaugcgc

SEQ ID NO: 4112200 - RNA, 57 nt, Human
guacaucucuaauuccuaaaccuucacuaagagggaggugaagggagucaggugugc

SEQ ID NO: 4112201 - RNA, 86 nt, Human
guacaucuguaaacaccauguuagagugacccucugagaauaauuaguugaaauuuuauuacuguguguuuauuagguuguuuugc

SEQ ID NO: 4112202 - RNA, 87 nt, Human
guacauguaguuaggcugggaauuggcuaggauacacugcucuaacuguaccgcuuguugccauugucagcccugauuggacuguac

SEQ ID NO: 4112203 - RNA, 95 nt, Human
guaccagguauaggaguuuuggacugacagaacuuuacacuaaacaagauguaaaaguuuuaguuguacauaaauuuaaaaugaaccugccuuac

SEQ ID NO: 4112204 - RNA, 55 nt, Human
guacccacugucauauucaggguaucuaguacccugggucauauacaguguguac

SEQ ID NO: 4112205 - RNA, 75 nt, Human
guaccuugugcaccuacucuauccuuucuuugucuaagccccuuccuagaaaaaauacagaagguggcaaaguac

SEQ ID NO: 4112206 - RNA, 97 nt, Human
guaccuuuaucuguacuuauggcaaguuugugagguuaaucccuuuguugaaauuaaagugaaauagacacagacugcccguucaugauaagaguac

SEQ ID NO: 4112207 - RNA, 63 nt, Human
guaccuuucucugugugugugacagcauuuauaauagugugacuacauuacaagaguuggaac

SEQ ID NO: 4112208 - RNA, 81 nt, Human
guacggcauacacacuucugcugccgccucggcacagacccucugugcagccccaggggcgguagauccuaguguccgugc

SEQ ID NO: 4112209 - RNA, 61 nt, Human
guacggccaugggauggggcagucacucaacugacccagugacucgucucuguggccgugc

SEQ ID NO: 4112210 - RNA, 84 nt, Human
guacggcuaugagauuccuguggacauucuguguggaauugcugauacuacucagaaugcuacaaugaggucucuugguuguau

SEQ ID NO: 4112211 - RNA, 120 nt, Human
guacuaccuagaucacagcuauggggcugugagacuacaggaucuccugagaaggaagaguccaaagaauuguaguccagaucauucagccauuuacuagcagagaucuuagguagucac

SEQ ID NO: 4112212 - RNA, 60 nt, Human
guacuaguugagcucugaauaaacugggugaaauuuucuaguaucaugcccaacuauuac

SEQ ID NO: 4112213 - RNA, 88 nt, Human
guacuauuacuuuaucacagaagaaucaugcuguguuaguccauucucacaaugcuguaaagaugcuaucugagacugaguaauuuac

SEQ ID NO: 4112214 - RNA, 90 nt, Human
guacucaguauccaacucaguuaucauguguccacaaacaguguucuagcugccuguguuaacacugcaugauaauggaaagcugagugc

SEQ ID NO: 4112215 - RNA, 61 nt, Human
guacucaguuguaaaacaacgguuuacaagugucagagacagguguuuuacaacuucguac

SEQ ID NO: 4112216 - RNA, 83 nt, Human
guacucauuaaagcuagaauuguuccagcaaguucaaauuacauauuuguucaauguaaauaauuccuaggcuuuuugagugc

SEQ ID NO: 4112217 - RNA, 65 nt, Human
guggcuagaaaaauaugggugcccauguagccuccuggaagcaccuguaugacuuuucuagaagc

SEQ ID NO: 4112218 - RNA, 81 nt, Human
guggcuaggucggggagaguggacagucaauguggaguuucucucccacaucucgguccccucuuugcuugaccuggaaac

SEQ ID NO: 4112219 - RNA, 88 nt, Human
guggcucaggcuuggaauccuggagcuuuugugggggccaaggugagaggaucacuugagccugggaguugagaccagccugggcaac

SEQ ID NO: 4112220 - RNA, 57 nt, Human
guggcuccagauuuccugcugcaaugaaauuauauuggggcuaucgcuggagcacac

SEQ ID NO: 4112221 - RNA, 65 nt, Human
guggcucccaacacagaacccagcacuccagguguugagugcacagcgugauguauuggggccau

SEQ ID NO: 4112222 - RNA, 83 nt, Human
guggcuccucccugggcagcuguggguuccaagucuaacacuuugguuaguacccuuggaaaugcagugcccuggaaacccac

SEQ ID NO: 4112223 - RNA, 67 nt, Human
guggcuccuuuauaaaguaauaagaacacaaacuaaauuuguguuccuaaauaugaauggagaaagc

SEQ ID NO: 4112224 - RNA, 79 nt, Human
guggcugaaaccaggauaguaugaguagggauagcgagaaguugucagcucuugcauauauuuugaaguuagaauccac

SEQ ID NO: 4112225 - RNA, 66 nt, Human
guggcugcagagccagcaagcuccuuggaguugcaugagaaggacagguuugcaugguugcagaac

SEQ ID NO: 4112226 - RNA, 129 nt, Human
guggcugccaggcugucccccacagcgccucccucaaggcuagaggagcggcgagcugagcuggccguacuaccggcugcguccuguguuccucgaggucccaggaggccggggaccgcauucacccac

SEQ ID NO: 4112227 - RNA, 81 nt, Human
guggcuguaggauaagcauuguuucugaggauggucauuauaugaauguuaugucaucugcacucauuguccucucgccac

SEQ ID NO: 4112228 - RNA, 55 nt, Human
guggcuuacuugucauuucuuuaggucuugccuucccaaguagaucaugagccac

SEQ ID NO: 4112229 - RNA, 79 nt, Human
guggcuuagucuugugccacccacuagaccuugcauuucacuuuuaauugaucucuuguguaugguagaaauuagccau

SEQ ID NO: 4112230 - RNA, 66 nt, Human
guggcuuaugagaauugaguguggguagcugcuaaguuccuuuggacacauuuuuuauaagccuac

SEQ ID NO: 4112231 - RNA, 56 nt, Human
guggcuucacauggcauuuggcccuugcccuucugccuucugccaugugagggcau

SEQ ID NO: 4112232 - RNA, 64 nt, Human
guggcuuccaagacuaagucacaaaagauaauacaguucgugaccuacuuaugucuuggaucau

SEQ ID NO: 4112233 - RNA, 65 nt, Human
guggcuucuggcugggccucagccaacugcuggauggcugccugcaaggcccugcgggaggcugc

SEQ ID NO: 4112234 - RNA, 57 nt, Human
guggcuuggugggugcuuguggaagucaugaaaacgcaauaaacucucucaagccac

SEQ ID NO: 4112235 - RNA, 84 nt, Human
guggcuuuucugugagaucacagucccugcacucgguugggggcacagacgaugacagcagcuguggcucacggagacaaccac

SEQ ID NO: 4112236 - RNA, 130 nt, Human
gugggaaauagagguggcacaagccucagcuggcauucuucuuuccacuucugggccaaauucugccccaggcugcagagguguacagagggaggccagcucagggagugugucaucugucagggcccau

SEQ ID NO: 4112237 - RNA, 114 nt, Human
gugggaaauugugacggagaauauucaagagugggugugggucuguuugauuucagguguagcuguguaaauaguuagcccugcauauauuuuugucuacucacaacugccugc

SEQ ID NO: 4112238 - RNA, 83 nt, Human
gugggaacuccagcaggaaggugagaaaccuggguuccagcccuugauuuuuacuuuccuguuccgggcuucaguuuucccac

SEQ ID NO: 4112239 - RNA, 64 nt, Human
gugggaagacauguguacauaucgcagcggcagcgggcuucagcgauauuauucaugagcuggc

SEQ ID NO: 4112240 - RNA, 115 nt, Human
gugggaaggagaaaguauaccguaaguuuauagauucuuuuugcuuuuacuguauuuuauuguacaugacaaaaugcacaggauuaaaaugguuuugcuucagacuccuuuccuc

SEQ ID NO: 4112241 - RNA, 82 nt, Human
gugggaagugaguuauccugcaaguuggauauuuaguuuuaggauuaaacuaaauagccucugguaguugugcacuuccuac

SEQ ID NO: 4112242 - RNA, 70 nt, Human
gugggacuggcucaguucuugguuuucagcuuggaugcccugauugacccagaacuggucaaaguuccac

SEQ ID NO: 4112243 - RNA, 66 nt, Human
gugggaggaugcguaaguguuuggagacgcuuucugcucuggcuuugcucaugcauccauuucugc

SEQ ID NO: 4112244 - RNA, 62 nt, Human
gugggaguaggaggggucugaguuugaauccuuuuaaucuagcaggcuuucuuuucucucac

SEQ ID NO: 4112245 - RNA, 68 nt, Human
gugggagucgcgggaaggauagaacugcccuuucuuuuucugguggcuuuuaaaccugugacugccgc

SEQ ID NO: 4112246 - RNA, 64 nt, Human
gugggauggaacuuggggagauuaugauauauguguuauguacucugcaauguuugaauuuuau

SEQ ID NO: 4112247 - RNA, 60 nt, Human
gugggauuaaugugcaguaauuagccuguuuuggucuaggaugacugauagugauuccau

SEQ ID NO: 4112248 - RNA, 85 nt, Human
gugggauuccaaggucaggguucuuucaguuaaguugucauuguuguaguaauugugcaaucuguaagucccuggccuauccugc

SEQ ID NO: 4112249 - RNA, 64 nt, Human
gugggauuggggacuccaaacucagggucauccugccugcccugagccgcugcuccaaccucac

SEQ ID NO: 4112250 - RNA, 80 nt, Human
gugggauugguuuucuuuguccagacagcucuccuaaccagaaaggcuagaccuguuuguuaagaaagcuucuauccugc

SEQ ID NO: 4112251 - RNA, 82 nt, Human
gugggcacuagcagagaaagugguugccucugugcagaaugcauuuaugaguagaggcuccaccuucucuguccauguaaac

SEQ ID NO: 4112252 - RNA, 55 nt, Human
gugggcaggagugagcaacaggcauuucugagccguucuccuuguuucuugccac

SEQ ID NO: 4112253 - RNA, 55 nt, Human
gugggcaggccccaaagcagggcugaggauggcccuggccgagggaccugcugac

SEQ ID NO: 4112254 - RNA, 78 nt, Human
gugggcagggcccugggcagcacagcucugacccagagucaggucucugggccagcaauugcugcucaguugacccac

SEQ ID NO: 4112255 - RNA, 81 nt, Human
gugggcagugccuuacucagaaaggugccagucacuuacacuacaugucacuguguccuuucugcguagaguaaggcucac

SEQ ID NO: 4112256 - RNA, 74 nt, Human
gugggcauagcugugcccgccacccaacguucugaaccaugggcuugacauaaacugggcauagcugugccugu

SEQ ID NO: 4112257 - RNA, 64 nt, Human
gugggccaguuccucacagguauaggauuuuuuaauuuccucucuuggagacucuuggccacau

SEQ ID NO: 4112258 - RNA, 130 nt, Human
gugggccuuagggcaaugggcugaggaggccacucagccuuuauuuaguuuuggcuuaggccagaggugcugggagaggucuguaguucaagugggcuccugggcagcucaccugggccaggggguccac

SEQ ID NO: 4112259 - RNA, 57 nt, Human
gugggccuuguagaucgaguguuuaugauuuuagacauucuugauucaggccuuagc

SEQ ID NO: 4112260 - RNA, 59 nt, Human
gugggcucuccugcuuauaacacagaacaaugaacuugggagugagcagagagcaucac

SEQ ID NO: 4112261 - RNA, 127 nt, Human
guggggacagaggaugguggcgcacgaguugaggcggcucagggcuaaggcugaggggcucuccuguccgaggucccucaccagcccugggcccaccccgcggggccccaccuguccuuggccccac

SEQ ID NO: 4112262 - RNA, 63 nt, Human
guggggagggagaugcugaagugaccaaacuugcacagacauuauucauuucccuaucccuac

SEQ ID NO: 4112263 - RNA, 103 nt, Human
guggggcaaggugggccaguagagcugugauuggugucucacuuugauguguaggagagagaacaaaucacaagucauucucuggaaaggagccaugguccac

SEQ ID NO: 4112264 - RNA, 82 nt, Human
guggggcagcacaguguagcaugguagcaaugagagcagcuucugcagccagacuaccuugauugucacccagcuccuccac

SEQ ID NO: 4112265 - RNA, 94 nt, Human
guggggcagcucggccagcucccgguuccccugcccugcacgggugcccgugcuggaggggccugaccaggaggccuggcugagguugugccac

SEQ ID NO: 4112266 - RNA, 83 nt, Human
guggggccugugacuauuuuuaucuaacuggguuagaguuggacuccccauagacccaaaaguauaggaaucuagaucaucau

SEQ ID NO: 4112267 - RNA, 81 nt, Human
guggggcggguagggguucagcccacagagggggccggcgggaagcugcaccugcuggucgggcugcaucuuccggcccac

SEQ ID NO: 4112268 - RNA, 123 nt, Human
guggggcuuucuuuccccagaucucaggugaaacuucuagguugacagcaaaauccuccuuucauuuauaaauggacuauguuugcucuggaagcaucugagaggauaaauaugggaucccac

SEQ ID NO: 4112269 - RNA, 58 nt, Human
gugggggacgguggcaggggcccuguguugccagcugcggcugcugcuccucccucgc

SEQ ID NO: 4112270 - RNA, 71 nt, Human
gugggggcagugggcuucgagcguagccagaaggagcuacucugaucucaaggacccaccugacuccccac

SEQ ID NO: 4112271 - RNA, 66 nt, Human
guguauguguuuauagggagguggaaaguuuuccuuuguaaaaucuccuuguaaaauauagaacau

SEQ ID NO: 4112272 - RNA, 55 nt, Human
gugucaaauccacuccucuuuugaaauauaucaagggagaaugguauuauggcau

SEQ ID NO: 4112273 - RNA, 69 nt, Human
gugucacacuaugcacuaagaauuuuagaaaauaaggacauugugacauuucgguguaugugaugaugc

SEQ ID NO: 4112274 - RNA, 68 nt, Human
gugucacagguuugauuaagaagcccuuacaauuuuguaauagcaccuuagccugaauuuguguacac

SEQ ID NO: 4112275 - RNA, 78 nt, Human
guggguugugucucucauuccuccaucagcaguggcagccacaguugcuggagcggaggugagccaggcacuuccugc

SEQ ID NO: 4112276 - RNA, 124 nt, Human
guggguuuuagcaaaggcuuguaaaucagaugggcugcgugcagugacugaagaagucuccugccuggauucggauccugccuucauuacuugcucguagcacaggcuuuccacugaagagcau

SEQ ID NO: 4112277 - RNA, 101 nt, Human
gugguaaaauaugcauaacauggaguuugucauuuaaccauuuuuaaguauacaguucaauggcauuaaguacguuugcauuguugugcaaccaacaccac

SEQ ID NO: 4112278 - RNA, 85 nt, Human
gugguaaagaugauaacagguugaauccgaauguucucgauaacaugucuucuuguucaaccugacuuuauuuuccucugaccac

SEQ ID NO: 4112279 - RNA, 82 nt, Human
gugguaccuguauacuucaggggacugccuaacccauuguuuauuucaaaaggagaggcaggccccugagaauagacaucgc

SEQ ID NO: 4112280 - RNA, 66 nt, Human
gugguacuuugguugcagcacuagauaccuaauaucccuauauagugcuuaacacaaagugauugc

SEQ ID NO: 4112281 - RNA, 64 nt, Human
gugguagagucaggcuugggaugcaggucuauguaguuccaaagccuguauucuuauccaucac

SEQ ID NO: 4112282 - RNA, 93 nt, Human
gugguaguauuagguuggugcaaaaguaauggcaguuuuugcaaauaauggcaaaaaccacaauuacuuuugcaccaaccuaauagcugccau

SEQ ID NO: 4112283 - RNA, 85 nt, Human
gugguauguggagggggugggagcagugaggugaaagggaagauccaggagcccagcucccauguucuccaauuuuccauuccac

SEQ ID NO: 4112284 - RNA, 71 nt, Human
gugguauucuuguggaauuuucucacuugucugcccuuucaagacagugauuaguuacuauaaaucuucac

SEQ ID NO: 4112285 - RNA, 57 nt, Human
gugguauugaagucuaaagaagguaguuaccaaccgaucuucuagaccuuauaccac

SEQ ID NO: 4112286 - RNA, 90 nt, Human
guggucaauaaugcaauaugggacgugagaaugagauuggaauguauaggaaggugauuuugagguuucaggucuuguguuuguaaccac

SEQ ID NO: 4112287 - RNA, 57 nt, Human
guggucauuugucugagcuccagcuagugaaguaugaguagaacggacaugcaccac

SEQ ID NO: 4112288 - RNA, 65 nt, Human
gugguccagaaaggccaaucccuaaagacuuccuaaacuuuuggauggagccacuuugaaaccac

SEQ ID NO: 4112289 - RNA, 60 nt, Human
gugguccucuucuucuguuuggucacuccuaggucaccgcaucggaaacaggaggaucac

SEQ ID NO: 4112290 - RNA, 67 nt, Human
gugguccuguccugacggcuucuuaccugaugauugucagagggaugaaguacaccaggaaggccac

SEQ ID NO: 4112291 - RNA, 88 nt, Human
guggucgggaccuccagggggcggauccggggccucccccguggccgggguggcccaucacguuucgccuucgugggcuugcggccac

SEQ ID NO: 4112292 - RNA, 79 nt, Human
guggucucuuaugggcaggagcacagacuucagccaaaauaaaacuaugaauaccauugugucucugucccaagaucau

SEQ ID NO: 4112293 - RNA, 71 nt, Human
guggucuuuccuucauuguccagucccacgaugaugaccgugugcucuggaagcgucggaggaagggcagc

SEQ ID NO: 4112294 - RNA, 64 nt, Human
guggugaacacaucacauuuuacagugggaaaggcccuguggucaguggacagugucgcaucac

SEQ ID NO: 4112295 - RNA, 61 nt, Human
guggugagaguagguguccucuuuuucuugaucuuaagaggaaagcauucauuuuuaccau

SEQ ID NO: 4112296 - RNA, 77 nt, Human
guggugauacuagcaaugguggugguagucuccugauggagcagccaggcccagaucaugcugugcugguucaccac

SEQ ID NO: 4112297 - RNA, 107 nt, Human
guggugaugguggcacaacguugugaauauacuuaaugccacugaacuguauacuuaagaacaguuaaaguggcuuauauuauguauauuuugucauacacacacac

SEQ ID NO: 4112298 - RNA, 59 nt, Human
guggugcauccuugaguaagcuucauaauucaugugcaaagcuugguuuggaugaucac

SEQ ID NO: 4112299 - RNA, 111 nt, Human
guggugccacacacguguuauagccccaucggcaggaagagucuuuugcuuggcaucugggcugaggaugccuucauugcauggccugugacaucucuuauauggcaccau

SEQ ID NO: 4112300 - RNA, 90 nt, Human
guggugccaggauucaaguuggggcagaaugacccuggaguuuuuggccucaagucaauucugucucgcaaauuggauuucuugaauuau

SEQ ID NO: 4112301 - RNA, 59 nt, Human
guggugccauuuauguuaaugaacauuaaaggauuaaugaaacaucacaaugguaccau

SEQ ID NO: 4112302 - RNA, 69 nt, Human
guggugcccgugggugggguacgggcuggccucuguggccaggcccugcuccucacaccacaggacugc

SEQ ID NO: 4112303 - RNA, 92 nt, Human
guggugcugucagcuuucaucagugacacucauuuccaugacauucuagcuuaacagauauggugcaccagaaagcugccuagcaauuucac

SEQ ID NO: 4112304 - RNA, 65 nt, Human
gugguggaaaauauuucuuguccaucuucgugccucccauaaugugacuuugugucuuccaucac

SEQ ID NO: 4112305 - RNA, 65 nt, Human
gugguggaugaggagcucuggccuugggcucugcacaccugggcuccggcugcuccucucccuac

SEQ ID NO: 4112306 - RNA, 56 nt, Human
gugguggcucacgucuguaaucucaguacuuugggaggccgaggugggccgaucac

SEQ ID NO: 4112307 - RNA, 56 nt, Human
gugguggcucaugccuguaaucccagcacuuugggagucugaggcgggucgaucac

SEQ ID NO: 4112308 - RNA, 57 nt, Human
guggugggcgugguguaugccuucaccuucugaggacggcacacccugcaccaccau

SEQ ID NO: 4112309 - RNA, 92 nt, Human
gugguggguuuuagguaauuugaauaagaauuuagaauuagaaaaaaauuauuugaaauuucugcauucaaauuaugugagaaauccaucau

SEQ ID NO: 4112310 - RNA, 67 nt, Human
gugguguccagcuugcuccucugcaauggacugaggguucaagcaaaguuuagcugguuaacaccau

SEQ ID NO: 4112311 - RNA, 61 nt, Human
guggugucuuuguaauugugagccagcuauucuccugccuagcaggcuuuagggacaccac

SEQ ID NO: 4112312 - RNA, 62 nt, Human
gugguguguaaagugagacccacgaauggcuggguuuccagagaucauuuacauaacaucac

SEQ ID NO: 4112313 - RNA, 64 nt, Human
gugguuacccagucgcuggaguucugcucgaugccugagccuggcguguguggguuguagccac

SEQ ID NO: 4112314 - RNA, 113 nt, Human
gugguuaggguauuguaaccuaauaggacucauucuggaugacuuucuagagacaagcucugguuuucauauccugaaugcuccuguucuguuaggauaauacacucaauugc

SEQ ID NO: 4112315 - RNA, 66 nt, Human
gugguuaucagagcuauuuugggaaguggcuugucuccagccuccuggccuugcuccugaugccac

SEQ ID NO: 4112316 - RNA, 69 nt, Human
gugguuaugguaauuuuaaaaugucuauugguuuguaccuaacagauaauaggauguacccuguuccac

SEQ ID NO: 4112317 - RNA, 76 nt, Human
gugguucauucucaugaaacucgcuuccucucacuggauuucugcccugggggaugugggguucaagugaaaacac

SEQ ID NO: 4112318 - RNA, 55 nt, Human
gugguuccucaagcgcuggcggcagggcaagguuuugcccagcgaaggggaugac

SEQ ID NO: 4112319 - RNA, 83 nt, Human
gugguuggucauugauucugcucagucauguuggauuguuaacaacaacauccuaaguacuggguaguuuuagagaucaucau

SEQ ID NO: 4112320 - RNA, 79 nt, Human
gugguuguggggcugaguggagccagaagggcuggaucuuguaccucucuuccauguuucagccccauccuucaaucau

SEQ ID NO: 4112321 - RNA, 75 nt, Human
gugguuucugggaaauauaauaaagugguuacccagauuguggaaagccacugugggguguuugccagcaacugu

SEQ ID NO: 4112322 - RNA, 97 nt, Human
guguaaacagagaguccauuggagggaaaagcaucugcaauugcuuuaaauuccaacgcaaugagauggaauucccgccuagggucuuugccagcac

SEQ ID NO: 4112323 - RNA, 79 nt, Human
guguaaauagacacaugcguucauaugugugcuugucugugcacaugauuaugugugugcguguguguuuucccggcac

SEQ ID NO: 4112324 - RNA, 101 nt, Human
guguaaauauuugucuuuuggucuuuugcuagccagagagcucuugucagagauauuagcucugcuuucuaagcagaaguuucuguaggcagagacugcac

SEQ ID NO: 4112325 - RNA, 68 nt, Human
guguaacauuuaguuuuaagaugguaucuuuaaauagauaccuuagcuguuaaaacuaagugauauau

SEQ ID NO: 4112326 - RNA, 55 nt, Human
guguaaguguaggaaacagagccagaaugcagggguucaaauccugacacuacac

SEQ ID NO: 4112327 - RNA, 128 nt, Human
guguaauacugugaauucuguaguaucuauauacaagguagguuuagguaauauauugcuuaauuuuucuaaauuguuuuuaucaccugaaaccaacuuguguacugguaucacacucauguuaacac

SEQ ID NO: 4112328 - RNA, 64 nt, Human
guguaccucuguggccugccuccucauuuuguucacacagaaaagaaaggacauagaguagcau

SEQ ID NO: 4112329 - RNA, 62 nt, Human
guguacgucuuucaagguggcauuaguauuucugaccagccaccaccaggagaucguugaac

SEQ ID NO: 4112330 - RNA, 79 nt, Human
guguagaaagaucggugugaaggggcugguccccgcgcuugagcccaggccagcugcccucugcuggucccuccuacau

SEQ ID NO: 4112331 - RNA, 59 nt, Human
guguagaaguuuagaagugacagguuuaaauuaaaaccucuuccuuuuagauuuuaaac

SEQ ID NO: 4112332 - RNA, 74 nt, Human
guguagagcuuguguguacugguuaugggcacaccugucugugugcguccugugcgcacacugcugcccuacgc

SEQ ID NO: 4112333 - RNA, 108 nt, Human
guguagauuucagauggucaaggugccaugagggagggguggugccgcacaacagugcugucauucauccuuuccuuucagcaucuuaugacgguuugcaguuuauau

SEQ ID NO: 4112334 - RNA, 79 nt, Human
guguaggucugugagccaguucgacuguuucuagcacauuuauagaagcaaggagagcuggccuggugggacagagcau

SEQ ID NO: 4112335 - RNA, 60 nt, Human
guguauaugcauauaaagcuuuuagucauguugggugacagagagugacaugcauugcac

SEQ ID NO: 4112336 - RNA, 128 nt, Human
guguauauguagcauguuuucuuuauccauuuguuuacugauggacacuggguugcuuccaagccuuggcuauugugaauagugcuguaguaaacaugggaaugaagauaucucuuugauauauucau

SEQ ID NO: 4112337 - RNA, 77 nt, Human
guguaucagaggcuguguuauaaucuugcaacgcuuguucaauuguauuuugcuugaauuggcaugcuuugauacau

SEQ ID NO: 4112338 - RNA, 78 nt, Human
guguauggcaauucuaacucucuccaccuucacugccuacucacagccgugugcuggggaccagauuagaccauggac

SEQ ID NO: 4112339 - RNA, 92 nt, Human
guguauguguguguguagugagggagcccagucugggucuccuggacaucugaccaccacugggcuucacuuggcacaucuggcacaugcau

SEQ ID NO: 4112340 - RNA, 73 nt, Human
guguauuugagauuuuucacacauguggcuugaucacuugugaucuuucacuuuuuguggaugaucaaugcac

SEQ ID NO: 4112341 - RNA, 72 nt, Human
guguauuuguuuacaguccuuuuugcuuuuaaccugaggguagaaagucaaaacacuguguuuaagagacgc

SEQ ID NO: 4112342 - RNA, 97 nt, Human
guguauuuuuucaugaucuuagggcuaagauaaggagagugcuaguaaaauuuacugaugcaaauuuauuucaguaauaaagauuauggaggaacac

SEQ ID NO: 4112343 - RNA, 62 nt, Human
gugauuuagagaguguaaaaauauauccuuacugggaaguauuuaggagcuguuuaauucau

SEQ ID NO: 4112344 - RNA, 84 nt, Human
guguguaagcauauguguguguauaaacaagagucuguguuugccuuuaguaccuacauguuuaauagacacaaguauacacac

SEQ ID NO: 4112345 - RNA, 101 nt, Human
guguguacacgugugugugugcacguguauguacccaugaaagauguacaugaguaggugggugcaugugagcacgugcaugugcaggcgaaugaacgcau

SEQ ID NO: 4112346 - RNA, 57 nt, Human
guguguauacauacauauauuuacaugaacuauauguauauguguguguauuuacau

SEQ ID NO: 4112347 - RNA, 56 nt, Human
guguguauauguguguguguguguguguauguauguacaugcacguguguauauau

SEQ ID NO: 4112348 - RNA, 128 nt, Human
guguguauguacauauacacguguguguauguacauauacacguguguguauguacauauacacguguguguauguacauauacacguguguguguacauauacacguguguguguguguguguguau

SEQ ID NO: 4112349 - RNA, 72 nt, Human
gugugucauuugaaugagggaaccacaguuggucuccugagaaacuguucuacccuucauuucaugauacac

SEQ ID NO: 4112350 - RNA, 68 nt, Human
gugugucugugccaccucuccaguguccagaaugaagccuggaucucagucccuggcauggaaugcac

SEQ ID NO: 4112351 - RNA, 74 nt, Human
gugugugagugauugcuugcuuaaggacaccuccccucuccaucuuguaugucucugugggcaauccugcaggc

SEQ ID NO: 4112352 - RNA, 62 nt, Human
gugugugcacugaugauaacaggaucuuggaugauaggcuccaucaacucuugugcucacac

SEQ ID NO: 4112353 - RNA, 55 nt, Human
gugugugcagggcugcgagcgcuggcaggggcaucuggcugcccgaggcacacac

SEQ ID NO: 4112354 - RNA, 59 nt, Human
gugugugccaucaagagcuuucacacacugauggugggaguuugguuugguacaaccac

SEQ ID NO: 4112355 - RNA, 120 nt, Human
gugugugcccccggccggccggccggggcucuccgugcggggccugacccggaggggucacauguguuuccuggcagcccgcaggugcugcgcugggcggggcggguggugggcgcaggc

SEQ ID NO: 4112356 - RNA, 66 nt, Human
gugugugcuguugggcugguacaaaaaagaaucauccauguacucagcccacuucccagcaccuac

SEQ ID NO: 4112357 - RNA, 68 nt, Human
guguguggcauugugaaaauaugagccagguaaaugaguauuugaaaucaugagauagugucacagau

SEQ ID NO: 4112358 - RNA, 75 nt, Human
guguguguacuuuguggaggggagguuuugccucuccaugguaccuagcccagcuccuccacagaauagacucac

SEQ ID NO: 4112359 - RNA, 126 nt, Human
gugugugucuaauuaaugaggguagagguuaaaaaauauuuguugaauaaauuaguauuaacauuuuuauugcuaauaugcuucaggcaaaacuauaggcccugaugauacaauaacaaaauacac

SEQ ID NO: 4112360 - RNA, 72 nt, Human
gugugugucuccucuguccugucaggaauaauaauuacuccccacacagauacagaguagcgcaguucacac

SEQ ID NO: 4112361 - RNA, 122 nt, Human
gugugugucucguguuaggagaaagguccgugguugccgucucagcugguuugcuuacucucugcccccaggagaaguuugcucacuugggacaccagcgacccuccucaccuccaccucac

SEQ ID NO: 4112362 - RNA, 56 nt, Human
gugugugugccugcacacacacacaugcacaugcgugugugcgcacacacacacac

SEQ ID NO: 4112363 - RNA, 59 nt, Human
guguguguguccucaguaguggcaugguucuuaagcugugaaucuaugacauauagaac

SEQ ID NO: 4112364 - RNA, 84 nt, Human
gugugugugugugcacaugugugugucugguuguguguagaagagugcaggugacugagcauaaauauguguccacauagauac

SEQ ID NO: 4112365 - RNA, 60 nt, Human
gugugugugugugcgcgcacgcauaugagugugugugugugugugugcacguaugugugc

SEQ ID NO: 4112366 - RNA, 67 nt, Human
guguguguguguguaugugugcgugugugugcgccugcacacauauguaugcaucaugugcacgugc

SEQ ID NO: 4112367 - RNA, 66 nt, Human
gugugugugugugugaucauugcuauucaccugugguggggggaagucuugaaacacaaacuagac

SEQ ID NO: 4112368 - RNA, 83 nt, Human
guguguguguguguguauguguuuguguugcagcucuuguguuuaagggcuucaauagcagaggcgugaaucaaauucaucau

SEQ ID NO: 4112369 - RNA, 68 nt, Human
gugugugugugugugugugugugaauucuuuuuaauucuaagacuuucauacagaaacaucacuucau

SEQ ID NO: 4112370 - RNA, 58 nt, Human
gugugugugugugugugugugugugcacgugugcacauguaugugugcaaacacaugc

SEQ ID NO: 4112371 - RNA, 74 nt, Human
gugugugugugugugugugugugugcuuaaaauaaaauccaaugguaaagcauauuugcauuaaaauauuacgc

SEQ ID NO: 4112372 - RNA, 81 nt, Human
guguguguguguguguguguguguguguauaaugccuauauauauggggauagacagauacaaauauacaaauacaaacau

SEQ ID NO: 4112373 - RNA, 56 nt, Human
guguguguguguguguguguguguguguaugcacauguguucacgugcacaugugc

SEQ ID NO: 4112374 - RNA, 64 nt, Human
guguguguguguguguguguguguguguguguaagccacauucagggcagaccacucauuucau

SEQ ID NO: 4112375 - RNA, 62 nt, Human
guguguguguguguguguguguguguguuacuauacauauacauacauguacacauaaauac

SEQ ID NO: 4112376 - RNA, 105 nt, Human
guguguguguguguguuuaauauagagacacucuaucacccuccugucuccaccacaucucagaugggaagggagaguguccuggauuagccgcaggccaagcau

SEQ ID NO: 4112377 - RNA, 60 nt, Human
guguguguguguuugcguguguguuccuguaucucaucauaucugcaaacaaucacauau

SEQ ID NO: 4112378 - RNA, 55 nt, Human
guguguguuggggugucaguauucaagcacaugugcuggaugcuaaaacacacac

SEQ ID NO: 4112379 - RNA, 60 nt, Human
guguguguuugcgugcaugugugugugcccguacaugcacaaagcauucuagacgcaaac

SEQ ID NO: 4112380 - RNA, 85 nt, Human
guguguuuaugugucagccuccucucuuagaacacagccagcuaguuaucaacugucguuccggagccuggcauaugagacgcau

SEQ ID NO: 4112381 - RNA, 88 nt, Human
guguguuuccucuuuacaaguauguuugcauuucaguccugcaaugauagcacaggaacugggcucagcaaacaucgccugugcacac

SEQ ID NO: 4112382 - RNA, 75 nt, Human
guguguuucugagcacuuuuauugcauucacacaucuacuaguuuuuguacgaagagugccucagaucauuacac

SEQ ID NO: 4112383 - RNA, 74 nt, Human
guguuaaaugagauguuuugguuuguuuugauggguacuuauaaaggcaauacacagcauuucacacuuagcau

SEQ ID NO: 4112384 - RNA, 60 nt, Human
guguuaagacaacauaugaggagcaaguucccuuguucacaagcagauguugcuuuccac

SEQ ID NO: 4112385 - RNA, 84 nt, Human
guguuaaggagccauuauacugggccaagugugucuuucaagaggauagacuugaggauauaaugaaugauuucuccauaacac

SEQ ID NO: 4112386 - RNA, 58 nt, Human
guguuacauauauacccacaccuggaugaugacuggggagaagguauuguguauauac

SEQ ID NO: 4112387 - RNA, 59 nt, Human
guguuacugcuuuuaucuaccaagagcucucauccugaggcucaugaaagcuguggcau

SEQ ID NO: 4112388 - RNA, 68 nt, Human
guguuagagucuugugcucauuugcugacaugcuuagauuugguaaugagauggaggacucuuaauau

SEQ ID NO: 4112389 - RNA, 56 nt, Human
guguuagcuauuugcccuaaaugagaaaauccauucuaggaguaaugagcuagcac

SEQ ID NO: 4112390 - RNA, 89 nt, Human
guguuaggaagugcuaagagaacaucauuugcaaaggggaugagaaaccccuuuuaucuuggccuguuucuuuuaagcaguucuuccac

SEQ ID NO: 4112391 - RNA, 57 nt, Human
guguuaguuugcuaaggauaauggccuccagugcauccaugucccugcaaauaacau

SEQ ID NO: 4112392 - RNA, 89 nt, Human
guguuaucaaugcuuauucaagauguugugaacucucagcaaaaucauuccauucuuaggagggugcagcuuugaaagcauguaaacac

SEQ ID NO: 4112393 - RNA, 60 nt, Human
guguuaucucucugccuggauuaacugcaaguuuucuccgcaguuaauagcagagcacac

SEQ ID NO: 4112394 - RNA, 56 nt, Human
guguuauuugagugggagcgugucgucuuuccguagcccucgccucuuaggaacgc

SEQ ID NO: 4112395 - RNA, 83 nt, Human
guguucaaaauggauaacugagagcaaucuuucuuuccuaaagaaagaaagauauguuuuauaguuauuaaaaccaagagcac

SEQ ID NO: 4112396 - RNA, 109 nt, Human
guguucaaagugucuuugaagucuaaaauauacggucccuaacaguccagccucaggcucaggaugauuguauuuguguauuuagaaugggagggucacuuauggacau

SEQ ID NO: 4112397 - RNA, 57 nt, Human
guguucaagguuaagugcuugccuaagaucacuuagacagagcugggauuugaacac

SEQ ID NO: 4112398 - RNA, 64 nt, Human
guguucauuuucauuuguucaguuucuuuugucacucagaaaacaugauauugaggcugggcac

SEQ ID NO: 4112399 - RNA, 90 nt, Human
guguuccaguucucugugacagcugcucuauaucucagccuucaaagugcugggucugagagcagcugaacagagagaagucuguggugc

SEQ ID NO: 4112400 - RNA, 61 nt, Human
guguucccauacaguaucagugcuccaaaggcgggaccgugauaccuaauguauggaaggc

SEQ ID NO: 4112401 - RNA, 93 nt, Human
guguucccccagcaagggcaggcaguggagguuugagugagacuuuugcacucucugcgcugccuugauccuuggcuucacucuagggaaugc

SEQ ID NO: 4112402 - RNA, 56 nt, Human
guguucggcuucuuuucgggggggaaaacaacugcccucccuuccaaguugaggac

SEQ ID NO: 4112403 - RNA, 91 nt, Human
gugucagaacuuuugggcauucauuagaauagauauguacucaguuucucuggguauuugugguagucagugcuaauaaaagggcucuuac

SEQ ID NO: 4112404 - RNA, 57 nt, Human
gugucagauccaggcaacaguggagcaacugaacacaccaggccaggaggcuggcac

SEQ ID NO: 4112405 - RNA, 62 nt, Human
gugucaggcagaguuagugauuuaggcagugguucugccugaggcuuaaucugucccaacac

SEQ ID NO: 4112406 - RNA, 71 nt, Human
gugucaggccaacugcauggugaccaaguuacccugguugauggucgugaugagccaguaguugccaauau

SEQ ID NO: 4112407 - RNA, 68 nt, Human
gugucagggaggccuggcaaccacaguguucuuucuccuguuuauuuguucuuggaucuuccugaagc

SEQ ID NO: 4112408 - RNA, 70 nt, Human
gugucaggugggguuguugaggaagagaaauuccuaaauuucuaugccauguucagcuacuaucugaaac

SEQ ID NO: 4112409 - RNA, 61 nt, Human
gugucagugguucagggccgggggucuccccaaccacggccccggcaccuccgcugcacac

SEQ ID NO: 4112410 - RNA, 88 nt, Human
gugucauauagcuaaugaaugauagagcugccuucggauccuagguugccuggcuccagagccuauauguucaacuuucauaugauac

SEQ ID NO: 4112411 - RNA, 68 nt, Human
gugucauuaaccaccaugcaaauuaauuaauauuacauauuauggacuuuguaggugacuugaugaau

SEQ ID NO: 4112412 - RNA, 70 nt, Human
gugucauucacuuauuguccugacucauggccuggucuuaggucacagucaaggagaaugucacugauac

SEQ ID NO: 4112413 - RNA, 69 nt, Human
gugucauuucugucucaaaaguccuguauuuugucuugcaguucagagacuggagaugggcagugucac

SEQ ID NO: 4112414 - RNA, 66 nt, Human
guguccaucagcagccacuguggaaccuauuaugaaccuagcacagugcuuggcucugaggggcau

SEQ ID NO: 4112415 - RNA, 91 nt, Human
guguccaucugaaagaagggcagucuuuuuugaauaugcacaaggcuucaagucaugggcccagggggcugcaucugucuacagaggacac

SEQ ID NO: 4112416 - RNA, 72 nt, Human
gugucccacucuggaggugaagauccaagagcagggcggcucugcagggcguggccucugagggcaggacac

SEQ ID NO: 4112417 - RNA, 65 nt, Human
gugucccagcagcacauuggcuccaggagaaguugcucuugucugcucugccugcugcugggugc

SEQ ID NO: 4112418 - RNA, 55 nt, Human
guguccccacccaaaucucaucuugaauuguaaugccagauguugguggggagac

SEQ ID NO: 4112419 - RNA, 69 nt, Human
gugucccuacucaaaucucaucuugaauuguaaucugaauuguaauccccagguuugggggagggacau

SEQ ID NO: 4112420 - RNA, 70 nt, Human
guuauguugaucucuggguccuguuggccucccuucugaggcuacaagcuccaugagagcagccuuugac

SEQ ID NO: 4112421 - RNA, 59 nt, Human
guuauguuuccuuguguccauuugcccagcgcuggaaucuguggagcaggaagccuggc

SEQ ID NO: 4112422 - RNA, 55 nt, Human
guuauuaacaugcauuuagcauuugggaauucugugcuuaauacaugucaauaac

SEQ ID NO: 4112423 - RNA, 124 nt, Human
guuauuaggcugacgugcaggauauucucaggacuugguuaguguuuuguaccuguguugcagucacuggcuggaguuuucauuacaugucuuucagagucaccauauaaaaauguuuaaugau

SEQ ID NO: 4112424 - RNA, 77 nt, Human
guuauuaguugacuuuuacuaaaacaugcaccuuuacgaugguguuuuuguagaaacauaaguagucaaauaguaac

SEQ ID NO: 4112425 - RNA, 120 nt, Human
guuauuauauugugaaaaaccuggccuuggucacaaugcaaacaaaaguacagaugaaagugcuuuuuggacaguuugcaaauuguguuaaagcuacggauuuuuuuuaaaguguucagc

SEQ ID NO: 4112426 - RNA, 73 nt, Human
guuauucaaggcuguuuuguauaaacuggauugaugcauaaucuuaaguuaugcuggaauagcuuuuuuuaac

SEQ ID NO: 4112427 - RNA, 66 nt, Human
guuauucuuuagcaacuuggauuuagccacuuaaagaaguagcgagaucuaugccugaagacaaac

SEQ ID NO: 4112428 - RNA, 67 nt, Human
guuauugagauuauggcaugcuaaaauauuugaguuugcuuaaauuucagcagcuuaauuuuguagc

SEQ ID NO: 4112429 - RNA, 89 nt, Human
guuauuggccuguaacucugccaagaaggcucagaaagucauaaaucugaugugaauuuauaguggcagacuuaaguguagucaaugac

SEQ ID NO: 4112430 - RNA, 79 nt, Human
guuauuguaauccagccacuugcacaguuaaauuuuguauuugauuuucagcaauaguggcucugugguuacaagaaac

SEQ ID NO: 4112431 - RNA, 62 nt, Human
guuauuucagaguguauucugcaguugcagaagucucguggcugucaugaacucugggaaac

SEQ ID NO: 4112432 - RNA, 83 nt, Human
guuauuugccuuuuucacugugauggugcagaggcagugauggguaaaacugccagcaccuuagcaugaaucaaagcaguggc

SEQ ID NO: 4112433 - RNA, 90 nt, Human
guuauuuggcuaaaaauauuuguguugggugaugucccuacccuguccuugcacccaggaacuuuacucaacaaauauuuauuaaaugau

SEQ ID NO: 4112434 - RNA, 111 nt, Human
guuaauucagcggguaacaagcacauggucugggcccagaguccccugagcauuccaccaaguagacugugucuagcaccacgugucuuggacuugcuauaagaagagagc

SEQ ID NO: 4112435 - RNA, 70 nt, Human
guuaauucagucaacauaaauccaaggucuuaagguuauuaaggacuuuggaaauuaugugugaaauaac

SEQ ID NO: 4112436 - RNA, 69 nt, Human
guuaauuggcaguuagugacgaggcugcaggucuuuguuacccagccuuucagcuaacugaucauuaac

SEQ ID NO: 4112437 - RNA, 100 nt, Human
guuaauuuuguuagaugugauaauggcaugacaguuauauauaaaacaaauaugucauuggggugcauauugaagaauuucauaauccugcaaaaauaau

SEQ ID NO: 4112438 - RNA, 105 nt, Human
guuacagaaauuuuuaaauggaaucgaaacugucauuggaugcauuugguucaucagauccagauucaguucgaugugcaguucugguuccuuaucagauguaac

SEQ ID NO: 4112439 - RNA, 56 nt, Human
guuacagagcugcuaugugugcgugcccacggccccaacacaccagugccugugac

SEQ ID NO: 4112440 - RNA, 124 nt, Human
guuacagcguauccaggugagauuaugacucaacuauuuagcaccuccaucucaacauguacuuccccaacggucauggcagaggaagagagggcuggaaaauugagcacuggcaaugacauau

SEQ ID NO: 4112441 - RNA, 59 nt, Human
guuacagcucuuuggugcauucaccuuaacucuaggacauuuaccaaaggaguuaugau

SEQ ID NO: 4112442 - RNA, 77 nt, Human
guuacaggcgaccugcagcugagaaaaugacuggcccauccauucacuucuccaagcuagcagaaucaugccaugac

SEQ ID NO: 4112443 - RNA, 67 nt, Human
guuacaucaacgaagauggaaaaggaaagagacaaagucucuuugccuaacuguuuucaauuguuau

SEQ ID NO: 4112444 - RNA, 130 nt, Human
guuacauucaauauauucuauuuaagaacauaaggaucauguauauguuuaagaagacuucuacuuaaucuagcuaauacauuaugguuccaguguuugaccuuuacuuauauggaaauuuaaaccaccc

SEQ ID NO: 4112445 - RNA, 59 nt, Human
guuacauuuauuagaggucucuggcuucuugaaagauggagacuuuauaaaugucaagc

SEQ ID NO: 4112446 - RNA, 77 nt, Human
guuaccaaugcgguuuacauguacucauuauacuagauguaagaauaacaaguugcuauggguauauguaauguaac

SEQ ID NO: 4112447 - RNA, 60 nt, Human
guuacccagagaccaggauggcacugugcaggagacaguacuguccuuuuguuggaagac

SEQ ID NO: 4112448 - RNA, 81 nt, Human
guuacccagucuuggguaaugucuuuauuagcagcaugagaacagacuaauacagacaacuugccaaauuagacgggcaac

SEQ ID NO: 4112449 - RNA, 110 nt, Human
guuaccuggcuuguaauaggccuuaaguugucugcuccuauaaaggaaucuccagaauauuccucacagaguggcaggcaauguuaaaaccucauuaguaccaguguaau

SEQ ID NO: 4112450 - RNA, 60 nt, Human
guuaccuguggggucugagcgcugaugguuuguuuauccaauucuggaaacccagguaau

SEQ ID NO: 4112451 - RNA, 62 nt, Human
guuacuacauuucauggucuuguucaaagaauugcagagcaaaauugucgaacaguaguaac

SEQ ID NO: 4112452 - RNA, 92 nt, Human
guuacuggauggcaggaggccaggggucagcaauuggcuaugugaaucagggcaaguuacuuuauucucuggucuucuguuuucucuucuac

SEQ ID NO: 4112453 - RNA, 76 nt, Human
guuagagguaaacacugucucugguauugaagaggugaauauguuuacaaaccaaggaacagugauccacuuuaac

SEQ ID NO: 4112454 - RNA, 61 nt, Human
guuagaugaagaccaagggcaaauucacaccucuggggcuugcucugguguuuuauuuaac

SEQ ID NO: 4112455 - RNA, 59 nt, Human
guuagauuucuuguuucugcccugaauuggaggaaggggagcuacaaugcgaagcuggc

SEQ ID NO: 4112456 - RNA, 59 nt, Human
guuagcaauugcuuaagacuaggcuaagaaauuacuuccucuugagaacaauuucuggc

SEQ ID NO: 4112457 - RNA, 90 nt, Human
guuagcauauuaauacauaucuuagcaugcauguauaaauauaugcuuguguguauacguguguggcugugccugcauagauaugcuaau

SEQ ID NO: 4112458 - RNA, 85 nt, Human
guuagcaugcaucagaaccaguggggacauuuguaaaaaugcagacugcuacuuuccaccacuagaguuucugauucaugaagac

SEQ ID NO: 4112459 - RNA, 62 nt, Human
guuagccaaccucuucaccgagucccucugcaccucgagggacccugggaggcuggcgcagc

SEQ ID NO: 4112460 - RNA, 57 nt, Human
guuagcuacugccaccaagucugcauuaagcagcagcugucuguggugucagcugac

SEQ ID NO: 4112461 - RNA, 55 nt, Human
guuagcuagugaugaggucaggguccaugguugggauuugaauccagcugguaac

SEQ ID NO: 4112462 - RNA, 71 nt, Human
guuaggaaucauccuuagcacccaccaaggacuuccuaagugcuggacccugugcuaagccuguuuccugc

SEQ ID NO: 4112463 - RNA, 91 nt, Human
guuaggaauuacugggaagugagaaaugacaaaugugucgaugcccugaagucuugaccacauugauuucucauccauucaguuucuuggc

SEQ ID NO: 4112464 - RNA, 91 nt, Human
guuaggaggcuauuacagucacccaugcaagauguauagaagacuugaauugcaacuauguacugauuguggucacugcugaggcccuggc

SEQ ID NO: 4112465 - RNA, 68 nt, Human
guuaggagucuuguuaguaagugacaaaaauccaacucaaauuggcuuacacuaaacaaguuuccugc

SEQ ID NO: 4112466 - RNA, 87 nt, Human
guuaggauucaucaggaagacacaagaauaaugaugaagguuggaaaaauaauuuuccagauuguuuuugucuuuucauuuccugac

SEQ ID NO: 4112467 - RNA, 78 nt, Human
guuaggguucuguuagaauuuugaaaauagcaaaugucuugcugugucaguguccauuuuugcauauuuuacccuaac

SEQ ID NO: 4112468 - RNA, 65 nt, Human
guuagguuguuugcugaacugacuguaaagugucauagucaauauucaaguguaaauagcagggc

SEQ ID NO: 4112469 - RNA, 69 nt, Human
guuaguaagcaugcuacagcccaacugugaaguuugagcucacagagcacguaucaugccugugcuggc

SEQ ID NO: 4112470 - RNA, 129 nt, Human
guuaguggucccucaucugggcaaagcagacccaagguggugcugagugcagagugcagagcauucuugugcucuccucucauggcuggaacuaucugggcuuugcgcccugguccagugcuacguauc

SEQ ID NO: 4112471 - RNA, 84 nt, Human
guuaguguacaaaaugauagauaaauauuugcuguugcuaaaagcaucuuagugauaaccuuuguacuaugguuuuucacuaac

SEQ ID NO: 4112472 - RNA, 67 nt, Human
guuaguuaaaauucugcugacauaauucugcagcuacuucagacagaaugauagucagaaaacuagc

SEQ ID NO: 4112473 - RNA, 73 nt, Human
guuaguucccucugagugcuuugagggagaaucuguuucaugucucucuccuaguuuuuagugguuugcugac

SEQ ID NO: 4112474 - RNA, 127 nt, Human
guuaguuggcucugcugcuauuauaaaagggauuuccuuuucuuucccuggagauugggugcccaucuuuuucccuacauuucugauaguaaaggucuuuuuauucucacagcaugaguuucuggac

SEQ ID NO: 4112475 - RNA, 58 nt, Human
guuaguuguauggcaccaacagccugcuggcaaacaguaugugcaaauacuugcugac

SEQ ID NO: 4112476 - RNA, 58 nt, Human
guuaguuuacuuuucauggagcauauuaagggaucauguuccagaaacagugaugaac

SEQ ID NO: 4112477 - RNA, 83 nt, Human
guuauaaacucaguuacauauuagaauaaugcaaaaauugaaagugcuauucugugugauauguaaaugaagcauuuuauaac

SEQ ID NO: 4112478 - RNA, 60 nt, Human
guuauacguaacaucacagggacaggcagcccccuauaaccugggagaauuggguguggc

SEQ ID NO: 4112479 - RNA, 68 nt, Human
guuauagcagcgacuaaugaauaaguaccuacugugugucaggcacuggucugagugcuuguuguagc

SEQ ID NO: 4112480 - RNA, 78 nt, Human
guuauaguaauacaguagcuuuuacacaggaacucaaacuuucuguugugaauuuaguuaccaauguauuacuguggc

SEQ ID NO: 4112481 - RNA, 87 nt, Human
guuauaguuuauucagccuuaagaagccaccuuuuuggcuacaaaaauacccagaaagacuuuuuagguacguagggaaacuguaac

SEQ ID NO: 4112482 - RNA, 130 nt, Human
guuauauagccuugggaggaaauaaauauauacaaggcaagcaaugugaauguuuaccaaccugaaauauguauaacagucaaaguuugguuccuuguguguugaugugauggaaggcuauguuuucaac

SEQ ID NO: 4112483 - RNA, 79 nt, Human
guuauauaggaagaucagaguaagcuuuuuagaaaagacugaccugccucuugaaaguuaucuagauucugaauauagc

SEQ ID NO: 4112484 - RNA, 73 nt, Human
guuauauuacuauauuuaauuaguugcuggaugggauaucuaaauuuauaacugguuaaauuuauguugugac

SEQ ID NO: 4112485 - RNA, 58 nt, Human
guuauauuccuuggcuaaggacaauuucacucuuguucauaacucaaggugauauaau

SEQ ID NO: 4112486 - RNA, 100 nt, Human
guuaucaaacuaaaagcauguaauccauucuaugcuuacauuuauauuaaaagccucacaauaugaagacuaaugugaaugggauauguaauuugaugau

SEQ ID NO: 4112487 - RNA, 69 nt, Human
guuaucaaggcuggaagaauuuauguuaaagagaaagaauuucuuuguaagaaauucuuccguuuuuac

SEQ ID NO: 4112488 - RNA, 64 nt, Human
guuaucuuugacugccauucuugaccacguaaugugucagucaucacugguagcaaagauuuac

SEQ ID NO: 4112489 - RNA, 90 nt, Human
guuaugaagagagacauauuggcuugcuuuaauuuacuuauuuaugaaauuaaagcaugaauaauauguauaauuugaauuuuuugugac

SEQ ID NO: 4112490 - RNA, 68 nt, Human
guuaugagauggcaauaugugagguucaugauggcauauauuaagaacugguuauguuaucuugcaac

SEQ ID NO: 4112491 - RNA, 81 nt, Human
guuaugaggagcugccugugugccaugauguagaaauaaugggaaguaugcaucacauguaggcagcaucaccauuuuaac

SEQ ID NO: 4112492 - RNA, 63 nt, Human
guggcagucaucaaggacagauuccacauucccccauuucuuugugauuugaugaucugucau

SEQ ID NO: 4112493 - RNA, 84 nt, Human
guggcauaagaccauaaauguucauuucucacucacaucaauguucaucacagauuggugagaaaguggugaucuaugggccau

SEQ ID NO: 4112494 - RNA, 82 nt, Human
guggcaucagaauuuucuggaauggagcaauguuuaugugaaauuaaguuuuaaaaacuucaugagugauucugaugcacau

SEQ ID NO: 4112495 - RNA, 93 nt, Human
guggcaucuuugggacucgaauaaaaucuugcuguuuucaagccuguacucuuggcugcgaagccacaacuuuuucuuagcagucucagccac

SEQ ID NO: 4112496 - RNA, 61 nt, Human
guggcaugaaagcaucugugauuguuagugguguuauaaucacagguacagcuaaugcuac

SEQ ID NO: 4112497 - RNA, 75 nt, Human
guggcauguaggaguacuucauucuauuuuauuaccaaacaauauuuuacugaaugcaguacugauacaugccac

SEQ ID NO: 4112498 - RNA, 58 nt, Human
guggcaugugguuaggaacagcucuucagacucagacugagagccuccaaccggcuac

SEQ ID NO: 4112499 - RNA, 121 nt, Human
guggcauugccuggggucuuccuuuuuucagaugugauucuucccucagcuauuccuggaggggcugcugagagauagaacuauauaagaggaagagagaaacaccaaaggccauggccgc

SEQ ID NO: 4112500 - RNA, 79 nt, Human
guggccaagcuuguuucuccugggggugcucuuccgaggauaucugggcugccuccggagucgcagugucuugggccgc

SEQ ID NO: 4112501 - RNA, 55 nt, Human
guggccaagggacucuaaggcagggguguccaaucuuuuggcuucccugggccac

SEQ ID NO: 4112502 - RNA, 66 nt, Human
guggccaagucaagggguaccagggacauuauaccuuagaaccucccauagcucuuguugguccau

SEQ ID NO: 4112503 - RNA, 129 nt, Human
guggccagguggggacacagugcucagggucuggguccccaggcagccugcggucugcacagaugaggcugugccugcuagaugguugucggccgcugagcccuggggauugcagcccugucugugccc

SEQ ID NO: 4112504 - RNA, 68 nt, Human
guggccaucugcuggggcugcagagcuguucuacucuagagugccauguaguccagcagaacagacac

SEQ ID NO: 4112505 - RNA, 64 nt, Human
guggccaugcaggucugguaggucccauucccauugggcaggacaccccuagacugcugggcau

SEQ ID NO: 4112506 - RNA, 65 nt, Human
guggcccagcagcugguggagaagggcgccaacccugaccaccucagcgugcuggagaagaccgc

SEQ ID NO: 4112507 - RNA, 71 nt, Human
guggcccagggucucugcugccugagacuuggccauugaggacuugcaucugggguguagacuugggccau

SEQ ID NO: 4112508 - RNA, 56 nt, Human
guggcccccuugugugugcugggcucugaaguccuggaggcacucgcuggggcugc

SEQ ID NO: 4112509 - RNA, 70 nt, Human
guggcccuccacugagcaguagcugcgucgucuucuagaugcuugcagccucugucucacguuuggcugc

SEQ ID NO: 4112510 - RNA, 91 nt, Human
guggcccugcaugacacagcuugccucccccucuuaggaacugugaguaauaaacuguucuuucaaaggcagcuguuucugugucugucac

SEQ ID NO: 4112511 - RNA, 58 nt, Human
guggcccuggaguugugacacugcaaaauggcagugucaggagccuuccaugggcugc

SEQ ID NO: 4112512 - RNA, 82 nt, Human
guggcccuggcuuuacacauccacugccugugagcagcuucaugccccuggaagccaggcagggaguagacccauguuccac

SEQ ID NO: 4112513 - RNA, 69 nt, Human
guggcccugggcgaggagccggcccgaggugagugucugcugcccacuccccuuccuccccagggccau

SEQ ID NO: 4112514 - RNA, 101 nt, Human
guggccgcgaaguggaggcacacgggaggucugagagccgcuuucccccagagacugggcggggcggcuccgggccacggaagcagccucgaaccagccgc

SEQ ID NO: 4112515 - RNA, 76 nt, Human
guggccggucugcguucugucugccuugucucuggaaagaacgagagaacacaagacagaggcugaggcuggccgc

SEQ ID NO: 4112516 - RNA, 56 nt, Human
guggccguagcugcuugaccaggcaguggguaggcccgugcucggcuauggaccac

SEQ ID NO: 4112517 - RNA, 59 nt, Human
guggccguguaacuugaguacaaauuucugguuccuuuuguucauaguuauccggccac

SEQ ID NO: 4112518 - RNA, 78 nt, Human
guggccuaaauguaagugcagucaagagauuuccuccaggaguaggagaauuagaggccauguacuuguuggguuuac

SEQ ID NO: 4112519 - RNA, 73 nt, Human
guggccuauaccauuuuugaaugaaugaaugaaaaauagaaagucaugauagucaguuccuaagggaggccgc

SEQ ID NO: 4112520 - RNA, 61 nt, Human
guggccuccuccguccgccucucagagcuuugcuguggccuuggggaccgaggcuugucac

SEQ ID NO: 4112521 - RNA, 58 nt, Human
guggccugaugccagcccuguguacacaccaacaccagguggcaggccuuaugcacac

SEQ ID NO: 4112522 - RNA, 72 nt, Human
guggccuggauagacuccaucuacccaaaggacccauucuguccaucucauugauaguuuauccagugccac

SEQ ID NO: 4112523 - RNA, 60 nt, Human
guggccugggguuuuugaggcugucagagagaaacugaauucuuaaauccccagggccau

SEQ ID NO: 4112524 - RNA, 97 nt, Human
guggccugguauggcccuucuauugcuugcacccugcucugugggcuauaucaccaugagucagugggcuuggcacagaaaggcacauuccagcuac

SEQ ID NO: 4112525 - RNA, 56 nt, Human
guggccuuuguauuccugacugaucccugacaaagcagaauaauagaaaggcacac

SEQ ID NO: 4112526 - RNA, 72 nt, Human
guggccuuuucaaguaggguaucauguaguauucugcagguuuacagucaguauccugcaaggaaaggugac

SEQ ID NO: 4112527 - RNA, 61 nt, Human
guggcggagcuggcgucuguguggacacacggugcccggggcgcacggcuccccuggccgc

SEQ ID NO: 4112528 - RNA, 61 nt, Human
guggcggcauggaggcagcagcuggaggcugcugcuuuaguucaacaugccaaagugccau

SEQ ID NO: 4112529 - RNA, 66 nt, Human
guggcguuuauucccuuaguauguaggugacccaggguggcuuugcuuuggcaagggagaagucac

SEQ ID NO: 4112530 - RNA, 87 nt, Human
guggcuaggauauguggcuuuuccuggguuccuaaauguuuuaaaucaccagcagcaggaguaggauaagcacugcucucagcacac

SEQ ID NO: 4112531 - RNA, 76 nt, Human
guggcucagauuuggacacaggaacuuuaacucagcaugggggggucucugagcuuccaagauaucacugaggcac

SEQ ID NO: 4112532 - RNA, 77 nt, Human
guggcuccuguaggcugaagagaaaagacagcuccuacaaaguacaucuuucagcucuucaggacccaggagacugu

SEQ ID NO: 4112533 - RNA, 58 nt, Human
guggcucugugcuuugccaaggaugcagucuggcgccccagcagggacacagggucac

SEQ ID NO: 4112534 - RNA, 56 nt, Human
guggcugcagcucugaacggacucaaagugagugucuguaaauccugcucagcaac

SEQ ID NO: 4112535 - RNA, 77 nt, Human
guggcugcauugaaaaucauuauguauucugagugaaacacccagaauuuaaguggauuauucuugagugcagucau

SEQ ID NO: 4112536 - RNA, 66 nt, Human
guggcugccuggggaaugugaggauugucccaaagcacaaucacuggcuccucacggcaaggccau

SEQ ID NO: 4112537 - RNA, 65 nt, Human
guggcugcuacagagcuggaggggguaaagcaacaguguuuucucaguugugcgagcagcauuac

SEQ ID NO: 4112538 - RNA, 111 nt, Human
guggcugggcaugguggcucaugccuguaaucccugcaacucuggaggcugaggcaggaggaucgcuugagccccggaguuucaggcugcagugagcuaugaucacgccac

SEQ ID NO: 4112539 - RNA, 77 nt, Human
guggcuggggagggaugugggaacugcagguuaaagccaucgcuugagcccucacggucugggucccacccaguuac

SEQ ID NO: 4112540 - RNA, 68 nt, Human
guggcuggguagacauggggcugguguugaacacaacugaagagcgccaggcuccggucuguggccac

SEQ ID NO: 4112541 - RNA, 74 nt, Human
guggcuguauuggaauaggauaaaaugggaccaaagauggucugagcauugaauuuucuuccacacucagcuau

SEQ ID NO: 4112542 - RNA, 62 nt, Human
guggcugugguggcacagcgggcugggggaagccccucuggcacugccggccccgcagcugc

SEQ ID NO: 4112543 - RNA, 98 nt, Human
guggcuguucucagugacccuagucccuggacauugguaacaccaucuccuccaaugguuccuucaguccaggauugggagugacuuccugcugucac

SEQ ID NO: 4112544 - RNA, 61 nt, Human
guggcuguuuuuauaaauagugccuauuuuuguaaauaguguuuuauuagaacacagccac

SEQ ID NO: 4112545 - RNA, 116 nt, Human
guggcuuaaacaacagaaauuuauugucucagaguuuuagaggccagaagucugaaaucgagauauugacaggguugccucugagugcuccgaagagaaacucuguuccaggcuac

SEQ ID NO: 4112546 - RNA, 62 nt, Human
guggcuuagcuggguugcuugggcuccgauucucacauggagcugcagucaagcugggccac

SEQ ID NO: 4112547 - RNA, 69 nt, Human
guggcuucaugaacacugaugaaccaaacacuccccuuaccauggugugauggguguugauggagacgc

SEQ ID NO: 4112548 - RNA, 56 nt, Human
guggcuuccuggacagaugcggugcuaggagacuucaccuggcucucaggagcaac

SEQ ID NO: 4112549 - RNA, 57 nt, Human
guggcuucugaacuuguugggaauucugcauuuccaaacugccaauucagaaguagc

SEQ ID NO: 4112550 - RNA, 56 nt, Human
guggcuugaccaucccugcuacuggaaguccauccagcagacagaugcacgcacac

SEQ ID NO: 4112551 - RNA, 72 nt, Human
guggcuugcuggaaggguaguauuaacuauuuaacauguaaugguguacuucacucuuaccuagcacgcugu

SEQ ID NO: 4112552 - RNA, 77 nt, Human
guggcuuggucaggugguggugcuuguuguaggugagaaguuaguuauaccugcaguggccacuccuaaucucccac

SEQ ID NO: 4112553 - RNA, 55 nt, Human
guggcuuuauaggaagaggaacagagaucacucuuucuccaccaugugaggacac

SEQ ID NO: 4112554 - RNA, 75 nt, Human
guggcuuuggcuuucauggcgcuguucucucccugugucucucaauauggaaucucaguuucaugggccaucuac

SEQ ID NO: 4112555 - RNA, 88 nt, Human
guggcuuuuaauuuucucaggauucuuggggcugacaggaccuuuucccaguccagguccacacagucaguuuccaagaauuagucac

SEQ ID NO: 4112556 - RNA, 59 nt, Human
guggcuuuugauuggacugggcugucucugagcuggagcagaaguuaaucgaaggccau

SEQ ID NO: 4112557 - RNA, 130 nt, Human
gugggaaaaaacuuuaucagcaagaucauuaauaacuugggacucagcuuuucaaguuacaauuagcugcucaacagcugugaccuucaagagcuacucauuauuguugguccugauuguucacucccac

SEQ ID NO: 4112558 - RNA, 118 nt, Human
gugggaacuggcacagguggggaguggguaaaggaguccagcaggcugaaugccuucaacaaucauuuuaccacaugguccucauuuacucucagcugccucauaugugucaccucac

SEQ ID NO: 4112559 - RNA, 106 nt, Human
gugggaagccggucccccugguggguuacucauguccaucccccguuugcaagcacugauggggaugagaagugagcagagaacagggugggccacgaaguccagc

SEQ ID NO: 4112560 - RNA, 100 nt, Human
guuauuuucuuauauucuucuuuaugaccuguauuuuuccaaagauugggaagcaaaaaugucaaggugauagaugcauauagauagguaaaaagaugac

SEQ ID NO: 4112561 - RNA, 84 nt, Human
guuauuuugcuucucuucgccuagguccuuaucuguaaaaaggagauaaggaugcuuaccuugaagggauauccuaaaaaugac

SEQ ID NO: 4112562 - RNA, 78 nt, Human
guucaaaaucauucgauguggugacaagguacguuauuauugcuagaucaugugcuguaauccauugaaggagauaac

SEQ ID NO: 4112563 - RNA, 69 nt, Human
guucaaacucaaagucagaucagagaugaaaccccagcuccaucucuuucuauaugugagucuuugggc

SEQ ID NO: 4112564 - RNA, 60 nt, Human
guucaaacuuucccacagugacuccagagaaaacuuuucucugcaauuugugggaugggc

SEQ ID NO: 4112565 - RNA, 62 nt, Human
guucaaagggaaaagcaggcuggccaacccacgugauggcucuugaagcuucucuuuugaau

SEQ ID NO: 4112566 - RNA, 57 nt, Human
guucaagauccagcacaacagugauaggacuuccaucaguugauagagaucuugagc

SEQ ID NO: 4112567 - RNA, 112 nt, Human
guucaagcaauccucccaccucagccuccaaaguagcugggacuacuggcccugcucauacuauuuuuuguagagacaggcuuccacuauguugcccaggcuggucuugaac

SEQ ID NO: 4112568 - RNA, 73 nt, Human
guucaaugauuaacuagaggaggccaucucuggaggacagaaagagucuucugaucugguuagccaugcagac

SEQ ID NO: 4112569 - RNA, 59 nt, Human
guucacagguucucuuucuaagaaauuuuagaaaaggaguuagaggguugccuguaaac

SEQ ID NO: 4112570 - RNA, 84 nt, Human
guucacugaaguccucaagaauuuccagacaaccuggcauaacagcagaaaccaggaggucuguguuuucaggccuuuguggac

SEQ ID NO: 4112571 - RNA, 77 nt, Human
guucacuuccuggagugggaauuccuacacugcagaucaugagaaugcugaggagucaguuccacucaggugugagc

SEQ ID NO: 4112572 - RNA, 55 nt, Human
guucagacacauaccaagaucuauucuaugaagguucuggguuguuaaucugaac

SEQ ID NO: 4112573 - RNA, 60 nt, Human
guucagcagcagugauuuuguggcuaacacauucuucuauuuucaucauugcugcugggc

SEQ ID NO: 4112574 - RNA, 56 nt, Human
guucagcuuccucucucccugcagugcuucuccuggaaugagcugggaagcugagc

SEQ ID NO: 4112575 - RNA, 62 nt, Human
guucaggagcucauguggcugccuguggagccuauccauagauugccuaagacuccaugaac

SEQ ID NO: 4112576 - RNA, 64 nt, Human
guucagguauaugugcauccauagacgugcuugguuucauaauugucuuacuauaaaccugaac

SEQ ID NO: 4112577 - RNA, 62 nt, Human
guucagguuaaaucacagauugcuuucacuuaaauaagguaguuggugggugugagcuggac

SEQ ID NO: 4112578 - RNA, 77 nt, Human
guucaguaaugcuaugcucagucucaaaugaaauaaaguuguucauaacaucagaaagagauggcuaagugcugaac

SEQ ID NO: 4112579 - RNA, 55 nt, Human
guucaguagacaaaggacacguuuugccuugggagaggucacuguguuucugagc

SEQ ID NO: 4112580 - RNA, 74 nt, Human
guucagugaaauaauacauagaacauguuuaaugucaugacugacauacagcauggucuaugaaaguauuggau

SEQ ID NO: 4112581 - RNA, 129 nt, Human
guucauaaucgagucuuuguuuuaguggcugugguuggcauggcugcaguugggcccucagaucuugcagauuaugaccaggcagcaggcucgccaagccgugggcacuaacucaagcuccccuggagc

SEQ ID NO: 4112582 - RNA, 95 nt, Human
guucauaccacuguugagcucccugaggcaucuaacagagaucuuuacugguaggguagggguucuuggaagcuugagguuaacaauuugggaac

SEQ ID NO: 4112583 - RNA, 55 nt, Human
guucauccccgcgucucaaguccccagcacagggcuuggcacagggaagaugcac

SEQ ID NO: 4112584 - RNA, 71 nt, Human
guucaucucuggcuccacuucauccuccaauuggcugcucacugggagagucagaacuggugcagaugaau

SEQ ID NO: 4112585 - RNA, 92 nt, Human
guucaucuuccaaagcuguagaggcaguacauuuucugggaaaaagccucaguacagaacaugccagcacugcuuuucagagaaagauaggc

SEQ ID NO: 4112586 - RNA, 75 nt, Human
guucaugaguagauugaaccuuuugaauaaggaccaaagauuuccuuuggucuugggugaggugcuugcaugaau

SEQ ID NO: 4112587 - RNA, 63 nt, Human
guucauggcccaguagugugcuagaggagcaguagaauucuagaaggcaggcugggccagagc

SEQ ID NO: 4112588 - RNA, 76 nt, Human
guucauguccuauuuuccgcagcaggaaguaugucuguuaacaagauugcauccugaauguggcaaguaaucaagc

SEQ ID NO: 4112589 - RNA, 90 nt, Human
guucauuaaagacuguuccuucucuacaaauccaggcacuuaaaacaaucuucuugguuuguguuugauuuggaaaacagcuuugagaau

SEQ ID NO: 4112590 - RNA, 96 nt, Human
guucauuagaugcguguacauauuacagacaaagcuugaaaccccaauugaguuuaaagaaauuguacuuaauaugugacuugugaaagaaugagc

SEQ ID NO: 4112591 - RNA, 63 nt, Human
guucauuaggagagcugaguuuguucacaccaacaaaucucaacuaagccuaacuuuuugaac

SEQ ID NO: 4112592 - RNA, 59 nt, Human
guucauucuggauguagguuugaguuucuguugggggcuaauuuacucacagaaugaau

SEQ ID NO: 4112593 - RNA, 72 nt, Human
guucauucuuuuguggaugaagaaauggagccuucgaaagcccgucccuuucucccacagguugauaugagc

SEQ ID NO: 4112594 - RNA, 97 nt, Human
guucauuucuguaucuccagcacucaauacaaugguuggcacauauaacaguagugcucaauaacuauucauugaaugaaugaaugaaugaaugaau

SEQ ID NO: 4112595 - RNA, 60 nt, Human
guuccagaaccugagagcacaauccugugugaucucacugcagggccaggauucuggaac

SEQ ID NO: 4112596 - RNA, 59 nt, Human
guuccagggaagggaaggcagaguugaucaaaagagacccuguuccugucccaugaagc

SEQ ID NO: 4112597 - RNA, 56 nt, Human
guuccaugggcagcugagcggcgugcucucuugugcuagccagugccuguggcaac

SEQ ID NO: 4112598 - RNA, 61 nt, Human
guuccauucuuuugcuucaguguucagguuuucucuggauuauggagaagaacaaugaaac

SEQ ID NO: 4112599 - RNA, 60 nt, Human
guucccaagcucugccucuuggcauggcaccagaccaguccugccaggaagcauggggac

SEQ ID NO: 4112600 - RNA, 117 nt, Human
guucccaagggcugguggagccagagaauuccugagggccccagaggaggcuucucgggggggucaguggggccccagggggugaugguuuagagaucgcuguccaagcuugggagc

SEQ ID NO: 4112601 - RNA, 91 nt, Human
guucccagauuugucuuaauccagugguuucugaacagugugccaaggcacccuggcaugcugcagcaaacucacaggagggcugugggac

SEQ ID NO: 4112602 - RNA, 57 nt, Human
guucccaguugcaaucccagucccgucaaacccacggggagcuggaaacugggugac

SEQ ID NO: 4112603 - RNA, 108 nt, Human
guucccauucccccuguuuaguuuacuguugucaggcugcuuuggaucuugaaaccagaaagauaaccaagcguauuacaauucuggauaaagucagaagaaaugagc

SEQ ID NO: 4112604 - RNA, 75 nt, Human
guuccccucagccuggcugcucagccacucacacucgagggugugcaauugcagggucagcagccgggagugaac

SEQ ID NO: 4112605 - RNA, 68 nt, Human
guucccucguccaaggaugcaggaugcuguuucuuucacagcgcauuauucauuucuuggcagggaac

SEQ ID NO: 4112606 - RNA, 60 nt, Human
guucccugaagaaccuaauugucgaugcuagugcaucuaaacagguguucuuuagauuac

SEQ ID NO: 4112607 - RNA, 64 nt, Human
guuccgggagcgccaaccccuccagguuaggaaucugagaguacgggcugcgcgcaccuggggc

SEQ ID NO: 4112608 - RNA, 102 nt, Human
guuccuaaaagugucuuuguagcaauuuugcuuuuucuguuggcuucuguaaugaaacugaagcuuagguacagaaguuaagcuauaagacacaguagaaac

SEQ ID NO: 4112609 - RNA, 76 nt, Human
guuccuagcagcugccugggcuuguacaccucauacucuacguggaagguccucgacgcccagcaguuaugagaau

SEQ ID NO: 4112610 - RNA, 55 nt, Human
guuccuaucuuauuggcaaaggcagguauguacauaauguagaaaagauaggaau

SEQ ID NO: 4112611 - RNA, 69 nt, Human
guuccugcacauuuaugggcugggaggcauccguguggaauugcgugcagccugugugugugcuggcac

SEQ ID NO: 4112612 - RNA, 87 nt, Human
guuccugccaagaucaagauacauauucuggguuucugcaguugaaggaggaauuccugcagccaucgcagagucuguaguaggagc

SEQ ID NO: 4112613 - RNA, 127 nt, Human
guuccugggccaaagcugaacaaaaguuuccaaguuacaccauuaacuuuucucaagucagagccuguacauagugaagugacacugcugagauuuaaguucaggacuauaugcuucaucccaaugc

SEQ ID NO: 4112614 - RNA, 79 nt, Human
guuccuggugcuguggcagauacagaagaucaaaaggaaacuguugcugaguugacauucuuucugucauaaccucaac

SEQ ID NO: 4112615 - RNA, 75 nt, Human
guuccuguuggaaaggccaggcuguggcggggcaucuagacagcuuaccguagcagcucuuuacuaaccaguaac

SEQ ID NO: 4112616 - RNA, 67 nt, Human
guuccuuagagugguugugcuauggguguuugaccaaggauagcaugguuugaugacuggaaggagc

SEQ ID NO: 4112617 - RNA, 65 nt, Human
guuccuucauccauucauucucuaagucgauugaguaccgacuguguggcaggcagugaaggagc

SEQ ID NO: 4112618 - RNA, 61 nt, Human
guuccuuccuaucccgagagccugugacucugggcuucuuaauuugagggagaggaggaau

SEQ ID NO: 4112619 - RNA, 67 nt, Human
guuccuucucuuguuccuguauuuggcaaauuuguauguuaggaugugcauauauaugggagggagc

SEQ ID NO: 4112620 - RNA, 67 nt, Human
guuccuuggaagacagccgucuuuauuucuuagugcugggaaauucaggacaaauguuuucaagaau

SEQ ID NO: 4112621 - RNA, 65 nt, Human
guucggcaccgcacgucucagccuguaucacucuagaaagcagggccugagaccguggcuugaau

SEQ ID NO: 4112622 - RNA, 59 nt, Human
guucgggcuguuccccugauuaauaaagucguaaacacagucaggagcagcuucugaac

SEQ ID NO: 4112623 - RNA, 124 nt, Human
guucuaaaguagguuaaccuagaggagcaaaagcugucaauguaucuagucuaaaugguauucacucccuguaggguagcuuuuacugaauggcucuuuguuucgugaugccugccaucuguac

SEQ ID NO: 4112624 - RNA, 61 nt, Human
guucuaagggcuggaggauacaucagagagcaagauagccuucccucugccuuuguagagc

SEQ ID NO: 4112625 - RNA, 71 nt, Human
guucuaauuaggagaaaacuguugucuugaaacuggacaaauugaggauaaauaccuucuccgauuagggc

SEQ ID NO: 4112626 - RNA, 79 nt, Human
guucuacaauauuugggggcaguuuguuuuuccuuauugccaggauuucauggacuacagacuguauucaaaguaggac

SEQ ID NO: 4112627 - RNA, 66 nt, Human
guucuacacagaagccagaaggccugggucugaaucccagaucuaucuagcugugugaccuugagc

SEQ ID NO: 4112628 - RNA, 90 nt, Human
guucuaccuugaggguccugcagcugcagaccuggggaggagcuaauguucuaguuugagugucaugcagcugcagacccggggaggagc

SEQ ID NO: 4112629 - RNA, 108 nt, Human
guucuagucccaccagguggcgcccgcguucggcauucugagaacguuuggugucuucuggacuccagaaucuggacgguccgaccgccucgugcuugguggguuuac

SEQ ID NO: 4112630 - RNA, 59 nt, Human
gugggaagggaaaauucauucggcuuccacccugggaacugggcacagucuguucccac

SEQ ID NO: 4112631 - RNA, 60 nt, Human
gugggaagucucucggaggaagugccaggucauaaauuucacccaacaagaggcucccau

SEQ ID NO: 4112632 - RNA, 105 nt, Human
gugggagcagccaggcaggccgaucguccugaaccggcagaugcagucagugccacugccucuccagggccauccugcgccuguccaguugcugguuucucccau

SEQ ID NO: 4112633 - RNA, 55 nt, Human
gugggagcuuuggcaucaggcucauaucuaaagaugaguuuauaggaguucucau

SEQ ID NO: 4112634 - RNA, 103 nt, Human
gugggagggguugggaccagccuucugcugcccugggugcuggggaucccggggcuuuccaggugcucggccuccaaggugcgcgguccucagcuccacccgc

SEQ ID NO: 4112635 - RNA, 57 nt, Human
gugggaggguaaguggauggaaggaacacucucuacuccugcagaaugccuuccuac

SEQ ID NO: 4112636 - RNA, 77 nt, Human
gugggaguuaggaaagaagcagcuaggaguucuccugggauucuuacccgaugucuuucuugaaacuguuuuuccac

SEQ ID NO: 4112637 - RNA, 125 nt, Human
gugggaugaccuccauacucccauggggcagugcugagcacaccuuggagcaggagccuguucugcacacccaauagugugugcagaaaugccagcugggagccuauuuaacggagccauuucau

SEQ ID NO: 4112638 - RNA, 97 nt, Human
gugggauggguuggggguguuuuuugagggauugcaccagaagagacacaaaaguuccucuuugcuuucucuuauaagccccucuuccuuuucuuau

SEQ ID NO: 4112639 - RNA, 64 nt, Human
gugggauuggguacuccaaacucagggucauccugccugcccugagccgcugcuccaaccucac

SEQ ID NO: 4112640 - RNA, 66 nt, Human
gugggauuguggugagaaacugguagauugguaacucccagaucccucaguuucucauccuuccac

SEQ ID NO: 4112641 - RNA, 100 nt, Human
guucuguuguaggagguccuggaaccacaccuugauaaauguggcuuugaagaauaugaagaagugugguuuaggcaucuuuuauguuaaggaacagaac

SEQ ID NO: 4112642 - RNA, 92 nt, Human
guucuguuuuugcagcugcuuuaucugacuuggcgcugggcuuaauggcuuugaggcaguguugaucagauaggguggugcuauggugggac

SEQ ID NO: 4112643 - RNA, 108 nt, Human
guucuuagagggaagagugcccaggcaagacugagaaccccugcauuaaauggugaugcagagccugacgggauuuuucucugugccuuugccuuuccguuuguaaac

SEQ ID NO: 4112644 - RNA, 65 nt, Human
guucuuauuacagaaucaggcauaacuguuuaauaaauaugccuugauuuuguaaagaagagagc

SEQ ID NO: 4112645 - RNA, 65 nt, Human
guucuuccagagauagggccucaagugaggaguuuagcguggcccuuuacauuuacugggugaac

SEQ ID NO: 4112646 - RNA, 62 nt, Human
guucuucuaucugagugguuauucuuugucauuuuggcaaagaaucucagaauuagaaauac

SEQ ID NO: 4112647 - RNA, 55 nt, Human
guucuugaauaugcuuugcaauccuaagccccuggcuguugccaaauuugaggac

SEQ ID NO: 4112648 - RNA, 72 nt, Human
guucuuguuugaacuggaaggguggccugucugagcuaucaacauccacauuuauucagucauauagguaac

SEQ ID NO: 4112649 - RNA, 78 nt, Human
guucuuuaagcauuuauuuccuugucaguguuacuaugucagcaaauaugugugggugguaaggaaggcccugggaau

SEQ ID NO: 4112650 - RNA, 105 nt, Human
guucuuuagaggguggcuuaugaccugacuuuaauauuuauuuuaauuuccuuuguauuacagcuagccaauuauuuagcuauauccucaucucaguugaaggac

SEQ ID NO: 4112651 - RNA, 79 nt, Human
guucuuucugccuuucuauaucauggaguguuucauuucauuucauucuguuuggaaagguggguggauaggaaagaac

SEQ ID NO: 4112652 - RNA, 77 nt, Human
guucuuuuaagauugacaugagaagcauugaugggcaguaaguaaacaucagugcugcuuuaugacaguuucugaac

SEQ ID NO: 4112653 - RNA, 70 nt, Human
guucuuuucugugagucacacuggcaaaugugacauauuaucagcugguuuugaggcacaugauaagaac

SEQ ID NO: 4112654 - RNA, 60 nt, Human
guucuuuuuccuucauauagaugccauauauauauggcaguagaaugggggaaaaagaac

SEQ ID NO: 4112655 - RNA, 70 nt, Human
guugaaagucuguauaaggagccaugagaaccccagauuaccuccugaagauccauuauagacacucaau

SEQ ID NO: 4112656 - RNA, 69 nt, Human
guugaaauaaggugccgaugaugguuuuaugugucaaacuaucuaaacuauaguaccuagucauucaau

SEQ ID NO: 4112657 - RNA, 74 nt, Human
guugaaauucucauuuauggaauuaguuuaggaugugaauuuaugcauucagaauuggaacgugaagauucagc

SEQ ID NO: 4112658 - RNA, 80 nt, Human
guugaaccauuuuuaaucuuggaacuuauuauuguagaaaaaaauuuuuccugcauauuugcaagguuaggaauguuaau

SEQ ID NO: 4112659 - RNA, 58 nt, Human
guugaagauguuaagccgacccauuuucucauaagauguauguuucugcaucuucaac

SEQ ID NO: 4112660 - RNA, 86 nt, Human
guugaagugaauguccugaaaugugcacaugacauuggguauacaucaaaguuuguuguacauguuaguaucauuuauguugcagc

SEQ ID NO: 4112661 - RNA, 60 nt, Human
guugaauacauguaugaugugacucucccauuuggagcucuuauaucauaaugugccaau

SEQ ID NO: 4112662 - RNA, 71 nt, Human
guugaaugccagccccugggggcaggguaagagccaagucggcuucagcucugcaccaggugguuuucagc

SEQ ID NO: 4112663 - RNA, 76 nt, Human
guugaccauauacugaagaucaacagcaguaguuuucaaugaguacugucugcuucuuauagcuuuauggaacagc

SEQ ID NO: 4112664 - RNA, 79 nt, Human
guugacucuaagagccuucccuccacaccucaaagaccuuaguuagggucccaugaaagagggaggccuugauuucaau

SEQ ID NO: 4112665 - RNA, 60 nt, Human
guugagacguguauuggaaucucugacuagucagaauacguucuuaguuauauucucaau

SEQ ID NO: 4112666 - RNA, 55 nt, Human
guugagacucccccugcaugggccccaacaaacccccugcuuggggcagaacaac

SEQ ID NO: 4112667 - RNA, 89 nt, Human
guugagagguggcaagaauaucaccauuuauguaccugagauuuuuacagauggguacacagauuuuacauguuaugcuuaaucucaac

SEQ ID NO: 4112668 - RNA, 105 nt, Human
guugagauggagucuugcucugucacccaggcuggagugcaguggcacgaucucggcucacugcaaccuucgccucccggguucaagugauucuccugccucagc

SEQ ID NO: 4112669 - RNA, 72 nt, Human
guugagcccuaggaaauugucacuacuggacuuguuugaucuacauaaaacagcaguuuccuaugguucagc

SEQ ID NO: 4112670 - RNA, 83 nt, Human
guugagcugcauggugagccgugggcuucccuggugucagguuugagcucugccauggcucccaccucgcaaaugcagccaac

SEQ ID NO: 4112671 - RNA, 63 nt, Human
guugaggcucuuagauuauaaauuuucaaagaucccugauauuuuaucaucacgagcuugagc

SEQ ID NO: 4112672 - RNA, 85 nt, Human
guugagguguucuauuuuagcccuuugauccuggaaugucacucgagugagcaccaggaaagaaggggccaguggauucuucaac

SEQ ID NO: 4112673 - RNA, 81 nt, Human
guugagugaugugcauuguacugcucgcauuggguugaguuucccuuaaagugucuucaguaaaauacacuaugauucagc

SEQ ID NO: 4112674 - RNA, 79 nt, Human
guugauaaacacaauguuucuuuguucuuuguuuucuuuguguauguaaagaauuagaagccauuugugucaagguaac

SEQ ID NO: 4112675 - RNA, 63 nt, Human
guugauacaccucaugguuacuguugccauagcaacuaccucccuguaaccauguguaccagc

SEQ ID NO: 4112676 - RNA, 58 nt, Human
guugauauauuauggaaaugcuuucugucauuaugcacuuuuccauaauguauguaac

SEQ ID NO: 4112677 - RNA, 90 nt, Human
guugauauuucacuguguuugcuccauugcccacucucuaggcuuuuucuggauauuuggagagcaagucgcagacaugauaauaugaau

SEQ ID NO: 4112678 - RNA, 58 nt, Human
guugaugcagguccaaacgcuaguguuuacaagacucacguagugguuuugcuucaau

SEQ ID NO: 4112679 - RNA, 75 nt, Human
guugauggcaguguuugugaugaacagacaaagguuuguacagaccaaucuguccauuuacagauaugcagcaac

SEQ ID NO: 4112680 - RNA, 83 nt, Human
guugauggcuugccuucuguuccuauagaaagaggaaaacagagcucuugcuagguggaggcagagauggcacagcaagagac

SEQ ID NO: 4112681 - RNA, 70 nt, Human
guugauuaguugauuaagagucagacugccuggguuugauccugacucugacacuuauuagcugugugac

SEQ ID NO: 4112682 - RNA, 62 nt, Human
guugauuuguaggaguuuguuuagacacauaagugcuuuuggauaaaauacuuacauucaac

SEQ ID NO: 4112683 - RNA, 55 nt, Human
guugcacaauuccaugggacagcccugugaacagggucccccggaguugggcaac

SEQ ID NO: 4112684 - RNA, 63 nt, Human
guugcagacggggugcacugaaacuccuuacaaaagagucacuuacgaaacccaguuugcaac

SEQ ID NO: 4112685 - RNA, 95 nt, Human
guugcagagcugcagagagggaaugucuagcuuugccaggccccacagaaggcucacauuggcucagcaagacauugaccuccacugccuccaac

SEQ ID NO: 4112686 - RNA, 63 nt, Human
guugcccacgugcgaggaccgggcaggggcucagccccuaggccgcccggugcguggggcggc

SEQ ID NO: 4112687 - RNA, 129 nt, Human
guugcccaggcuauaauaaagcagaguuuuggccaggcacggugaaucaugccuguaaucccagcacuuuugggaggcugaggcaggcagaucacuugaagucaggaguucaagacuagccuggccaac

SEQ ID NO: 4112688 - RNA, 66 nt, Human
guugccucagcaguagaaaauggcuuagcaggcuacauacuugcagauucaacaugcugaggcagc

SEQ ID NO: 4112689 - RNA, 70 nt, Human
guuccucaucuguguggcccauucucaaaguguuccuucugacacucaucugagccaaacgaugaagagc

SEQ ID NO: 4112690 - RNA, 84 nt, Human
guuccucuguuuggaagcuuuucucuguauuaccuguuauaaacaaaugggucaucuggagaacgguccuuugcagcguggaac

SEQ ID NO: 4112691 - RNA, 67 nt, Human
guuccugacuuccagcaacuuggugcuaugguauuuguaugauaaaucaagaggcuuggaaaggaau

SEQ ID NO: 4112692 - RNA, 64 nt, Human
guuccugagguucaaaugcaagagaugcugccccuacaccggucucaggcauuuggaccggaau

SEQ ID NO: 4112693 - RNA, 58 nt, Human
guuccuggaucaucccaagcccuuucccaccucagggccuuuggauauauucagggau

SEQ ID NO: 4112694 - RNA, 61 nt, Human
guuccuggccaacccccucagcuucccaccagaguuugccaaggcuuggcuuggcaggaac

SEQ ID NO: 4112695 - RNA, 75 nt, Human
guuccuguagccaguguuuccccagaagagagcauguuaaaugcuuacgggaaacaguuuggucaguugaggagc

SEQ ID NO: 4112696 - RNA, 64 nt, Human
guucgaaggagccaccuucaacucaggaauugauaaaauucucccaguggaaguggcuuagaau

SEQ ID NO: 4112697 - RNA, 76 nt, Human
guucgcauuuagucuggugggauuccaaguggccaugagccacugauuauucagcagacacuaaagacgugugagc

SEQ ID NO: 4112698 - RNA, 60 nt, Human
guucggugggcuuuuaaguggcauuuguuaacugacaugcaacuaaagggugccacgagc

SEQ ID NO: 4112699 - RNA, 108 nt, Human
guucguguggcugugguggcuaacaaguucaaacucuauaagaacuugccaauaggcugaaaguucacauaagaguugauguagucuugagucccagauucacagagc

SEQ ID NO: 4112700 - RNA, 83 nt, Human
guucuaagaguaaaggcccuagacuggggcuaaggaauaaaucauauuaaaaggccuggagcuccagggucuccucuuggcac

SEQ ID NO: 4112701 - RNA, 95 nt, Human
guucuaaugguucaagcaggguccugaggugagucaguggcaggccuuggaaccgggacgucuggcugaccugaggaguccuguggauuagcagc

SEQ ID NO: 4112702 - RNA, 67 nt, Human
guucuaccacuaauuuuuccaugcagagcuauagaaguuaacagcauaugaaauuacuggcaagaac

SEQ ID NO: 4112703 - RNA, 99 nt, Human
guucuacccaccuggaagauucaccacuaccacuauuuuuuagggccaccccgaguaggucuguagguaguggccaguacuucugguugguuccagaac

SEQ ID NO: 4112704 - RNA, 87 nt, Human
guucuauguacacuucuagugaauuauugaaacugaguguguuugggggaacuccccaaacuugcauuugguuucagaagugagaau

SEQ ID NO: 4112705 - RNA, 66 nt, Human
guucuauucuccaguuacauauuuugaagcgugguuacuguauguuuacgcugguagaauuagaac

SEQ ID NO: 4112706 - RNA, 85 nt, Human
guucucacuugcuuggagggcagcuguauuugcaacugguagaacucagcuuugcuuuuaggugucuaacaauaaguguaauaac

SEQ ID NO: 4112707 - RNA, 68 nt, Human
guucucaggacuccugccugcuuaggacaaguaaaagcuuccaucucaagaggcaggacuucaggagc

SEQ ID NO: 4112708 - RNA, 66 nt, Human
guucuccgugccccaugcugggcccuggaaauaccacccauggguuaacaugguccauggaagagc

SEQ ID NO: 4112709 - RNA, 56 nt, Human
guucucugaguccuggcaaaauucuuuaccuguggauacuugugaggaaagagaac

SEQ ID NO: 4112710 - RNA, 72 nt, Human
guucugaauucagucugugagauguccuuuggagauuaaauuaucuuugaaauucuucagcugaagcagcac

SEQ ID NO: 4112711 - RNA, 55 nt, Human
guucugaguggcccaagcccugaugugucgcacacaagggcuaggcacauagggc

SEQ ID NO: 4112712 - RNA, 108 nt, Human
guucugauuuuucuuuuuagucaaacuagguucugauuuccaagauaaggcgaaauccagagcaguuugggaaaugaaggaaucugacugaacaauaagagucagaac

SEQ ID NO: 4112713 - RNA, 85 nt, Human
guucugccaaccccucccaaagauaauagauuuuugauagcuuuacuucccaagacaauaauuuuugggcagggcacagcagaac

SEQ ID NO: 4112714 - RNA, 94 nt, Human
guucugccaaguaaaacagcugcaauaguuuagaauaauuguaggaugaaaauaguuaagaaauaaauuaaugcacuuaguuauauugaagaac

SEQ ID NO: 4112715 - RNA, 81 nt, Human
guuuaacuucaaauauccaguagagggcaugaaaggaauugguuuuguuugggcucacuaugcugaagauagaauuugaac

SEQ ID NO: 4112716 - RNA, 99 nt, Human
guuuaagauuuaguaagacagucauugcauguuaauuaaacagcaauggaucauuuaccaaccuguuuaaugagguguaacaacuauugaauauaaaac

SEQ ID NO: 4112717 - RNA, 74 nt, Human
guuuaagugauaccuaggaaaucaagguuuaauauuguaggaaaagcuuuguauuucauagguacacagaagac

SEQ ID NO: 4112718 - RNA, 88 nt, Human
guuuaauaaguugccuguugaaucauaaguuauaugggagaauaaaagcaaaaauauagagagaaugguguuaauaugcaacuuuugc

SEQ ID NO: 4112719 - RNA, 106 nt, Human
guuuaauauuauuuacagccauuugaaaagcuggcuaaugaucuuagaguaaguuucugaacugcuauuuuagcagcuuuuaaaugguucuuuugaguaguaaagc

SEQ ID NO: 4112720 - RNA, 94 nt, Human
guuuaauggggaucauagucacugccuuccauuugugaaaaucaauugugauaaugucuaugacaaauggaagguguucucuuccccugaugac

SEQ ID NO: 4112721 - RNA, 77 nt, Human
guuuaaugugggcucaucuuuaaauuuaugacguuaacuacguacaucauuuuggagaugagcauugcuauagaaac

SEQ ID NO: 4112722 - RNA, 68 nt, Human
guuuaauguucauuuaguucuuucauguccacuuacuguggaaaagaaugacugagaugaauggugac

SEQ ID NO: 4112723 - RNA, 112 nt, Human
guuuaauugcaaacacaaucuuugacuuuuaucaugggaccugaauuuuaugcuguguucaaaugaaucagaaaaccuagguagaguucuugacgguguucuguuuuuaagc

SEQ ID NO: 4112724 - RNA, 88 nt, Human
guuuacaauugccaucagaaagcacugugagaucuuguugcaguaguaagguuuuguauuguuuggacacauggcuggcaaauggugc

SEQ ID NO: 4112725 - RNA, 80 nt, Human
guuuacacuuuguuauucucauguucauucguuucaggagagccuggcagccacaucucguggauuuaacagagguaaau

SEQ ID NO: 4112726 - RNA, 120 nt, Human
guuuacagguucccgcuguggugaaugagugggugacagugaacacguacccacuguggugagugagugggugacagugaacagguuaccacugugaugcaugagguggggacagugaac

SEQ ID NO: 4112727 - RNA, 87 nt, Human
guuuacauauauacagugcaugugagggugugcguguguguguguacacgcgcaaccaggcaugcacauguaucuguaugugucugc

SEQ ID NO: 4112728 - RNA, 64 nt, Human
guuuacaugaacugacuuuuaggggaauuagcuccagguuccagagucaggagcucaugugaau

SEQ ID NO: 4112729 - RNA, 80 nt, Human
guuuacuggcuucugugugugagucaucuguugcccaccggcuuuaaugaagucacgcaaagcaauaagucacccaaaac

SEQ ID NO: 4112730 - RNA, 75 nt, Human
guuuacuuuccucauuguggauuuuucauuacaguauagaguuuugcagaagugagucaugaggaauagguaaau

SEQ ID NO: 4112731 - RNA, 72 nt, Human
guuuagaauggcaaaauuaagucaugaacaaaaaccaguccauaaugacuaccgaucuuugccaauuuaagc

SEQ ID NO: 4112732 - RNA, 62 nt, Human
guuuagaugaaaguuuguuucaacuauuuuugacaauuagagugggacugacccaucugagc

SEQ ID NO: 4112733 - RNA, 100 nt, Human
guuuagcaaauauccacucuuacuaccagcccuccuccaucagaggaguuuacuugcucacuccauugauggugggcuuggucaugugaguugcuuugac

SEQ ID NO: 4112734 - RNA, 93 nt, Human
guuuagccagaaagggauguauucagcuguuucuuccagauguagagaaaagagccuuggacucaggaagaaagcagcugguucuggugcuac

SEQ ID NO: 4112735 - RNA, 56 nt, Human
guuuaggagauaaauuucaggcauaggggaucuuuucuaugcuccuaucucugagc

SEQ ID NO: 4112736 - RNA, 61 nt, Human
guuuagggugauguaugugcagcaaucauuauugacagcuggagaagugcaucacuuaaau

SEQ ID NO: 4112737 - RNA, 66 nt, Human
guuuagugugucccuggggaguguuggggcgacgguuacaggcuguuuauggugacaccacuagac

SEQ ID NO: 4112738 - RNA, 65 nt, Human
guuuauaagccugguucauaauuugcugaucugucguaggaaguaaauggcccaggguuaucagc

SEQ ID NO: 4112739 - RNA, 56 nt, Human
guuuauaagguaaaggagagagagcaaaaucucucccucccuuugucuuuaugaac

SEQ ID NO: 4112740 - RNA, 62 nt, Human
guuuauccuaguaagucuucuauguuuauucagagguauggaagauaagagauugggaaggc

SEQ ID NO: 4112741 - RNA, 99 nt, Human
guuuaugaaugauaguguuugaccuaccuugaagcaaggguauccuguuagauguuaacaugcagguuuuaggguugccagagaaacuaucaaauaagc

SEQ ID NO: 4112742 - RNA, 107 nt, Human
guuuaugaauuuuuuaaugucuauuuaaaaagauaaagaaauugagaaugucaauaccauguuucaggaccuaucuuuuagaaaagcaauggagaggaggaauggac

SEQ ID NO: 4112743 - RNA, 130 nt, Human
guuuauggaauguuaauauaaaucaaauguggugcaugaaacaaaaauuaggauaguaaugaugguaucaauaaaaagaauaauaaccaacaugcuggguguuuuugauguaucagauauauuucuaaau

SEQ ID NO: 4112744 - RNA, 81 nt, Human
guuuauguaccuucagauucuuaaaacugucucauauacaguaugaguaaaauaggugagaaucaaaugaaggauaagaac

SEQ ID NO: 4112745 - RNA, 83 nt, Human
guuuauguuuucugaaagcauuauaagaaaggaaauugcuaaucaguuaacucauuuuauaaugcccaucauaaagcaggaau

SEQ ID NO: 4112746 - RNA, 58 nt, Human
guuuauuaacugucaagugauuucauuaaaaaaggaacaaauuuggcagaugaugaac

SEQ ID NO: 4112747 - RNA, 78 nt, Human
guuuauucugugaucacugcccauuuuggaggucacaagcucuggagcuuacaggaacugggcaggacauuaaaaagc

SEQ ID NO: 4112748 - RNA, 61 nt, Human
guuuauugaguaucuacuaugugucagacacuguguuaggcacuggagaugcauagugagc

SEQ ID NO: 4112749 - RNA, 76 nt, Human
guuuauuuguguguuuagcauuagcagggggaacagaaaacugucucuccuuuaggcugagcacuugggaauagac

SEQ ID NO: 4112750 - RNA, 59 nt, Human
guuucaaaggugucaggcaguuuuuauucccacucugauuaccacacaccauuugaaac

SEQ ID NO: 4112751 - RNA, 64 nt, Human
guuucaagcaguuaagcagucuccaugcagcagcaugguggaggcuccuaagcugacuugacac

SEQ ID NO: 4112752 - RNA, 62 nt, Human
guuucaauauugagaaccagcauguuuucagagaucaaugaaaauaauuucaguguugaaau

SEQ ID NO: 4112753 - RNA, 75 nt, Human
guuucacagauggggagacacgguuuauuuuuauugucacgggaaccuuuugucuccucauucuucagugucuac

SEQ ID NO: 4112754 - RNA, 71 nt, Human
guuucacagucugcagaauuuuauuuccacacagccuuacugguuccaacagaauuuuuggauuguguaac

SEQ ID NO: 4112755 - RNA, 82 nt, Human
guuucacaguucuauuacucccugcuucuucaugugaguugccucaugaagacgaacuaguagggugguaaagagaaagaac

SEQ ID NO: 4112756 - RNA, 118 nt, Human
guuucaccaagaccauguguuuucacccuuucucguuugucuguuuaagcagggagacugaucuccaaauuaaaucauacagacaggcucccaaagaugaaagcgaucaaggugaagc

SEQ ID NO: 4112757 - RNA, 65 nt, Human
guuucacccagcagcacuuaagacuauucuuuuaauaguuucaaagacagugugcuguuggaaac

SEQ ID NO: 4112758 - RNA, 71 nt, Human
guuucacuuaaaagucuuggggaaggccagguauuguggcucaugccuguaaucccagcacuuuuagaggc

SEQ ID NO: 4112759 - RNA, 66 nt, Human
guuucagacuauucuguuucuguagcugccauuuaaagguagaucagaagagagguagacggagac

SEQ ID NO: 4112760 - RNA, 65 nt, Human
guuucagaguagaaccucaaggagcuuuugcagaauuccacaucguucucuuuucucucugaaac

SEQ ID NO: 4112761 - RNA, 106 nt, Human
guuucagaucagcugaauagaaauuagcagguggugaccacauuuuauaauaugauuuuugaagaaguauaacuauuugcuuucuucaauuuaguuuuuuaaaaac

SEQ ID NO: 4112762 - RNA, 81 nt, Human
guuucagauuaauacagaggcacaugcaauuuuccaucagcaacugaggagaaacacacguguccugaggaauuggggaau

SEQ ID NO: 4112763 - RNA, 67 nt, Human
guuucagucaugguuucuguuacaggcagcugaaaacauccagcuguacagcagccuugcuagaaac

SEQ ID NO: 4112764 - RNA, 66 nt, Human
guuucauaugcaguuaacagcauguaaauuuccuaaacgugauuaacaguuucaugcaugugaaac

SEQ ID NO: 4112765 - RNA, 65 nt, Human
guuucauauguucuguagucagaggauuugagaacacuuugacaauaauugcauuuauaugaaac

SEQ ID NO: 4112766 - RNA, 58 nt, Human
guuucaucuaugugccuuuguauagaaaucuuuucuauccaaugggacauggaggaac

SEQ ID NO: 4112767 - RNA, 77 nt, Human
guuucauugacuuuguuuugguaauccucugggagugaaggaggguuuagaaguaaaggcaugcaggugaauguagc

SEQ ID NO: 4112768 - RNA, 69 nt, Human
guuuccaaaggaguaccacgcauuccccuuugcgauuguaauaaaaugcuuggaugcugccaugggaau

SEQ ID NO: 4112769 - RNA, 59 nt, Human
guuuccaagaugcugccaucagcggauccaaucuucacugccuguggcagaguggaaac

SEQ ID NO: 4112770 - RNA, 75 nt, Human
guuuccaagccuguucuccuccaucauuugcucagagaauaauauuacagguguugggagagcugguuuuguaac

SEQ ID NO: 4112771 - RNA, 64 nt, Human
guuuccacaacuggcuuuuuagcuuguuguuuccacaacuggcuuuuuagcuuguuguugaaau

SEQ ID NO: 4112772 - RNA, 73 nt, Human
guuuccacucuccugcuuuauuuuaggaaauaaugauguuucuggaaccacaaaaguaugaaagcaugggaac

SEQ ID NO: 4112773 - RNA, 61 nt, Human
guuuccacuugagaggacuccucccuuuuuuggggguauguccucccucaggaggguuaac

SEQ ID NO: 4112774 - RNA, 58 nt, Human
guuuccagagcaggugucuacacaguuggucauggugaccucuguuuguucugggagc

SEQ ID NO: 4112775 - RNA, 68 nt, Human
gucuggagaagaaacuugcucugggaagugaugagaagccauccagaucaagguguuucauccgagac

SEQ ID NO: 4112776 - RNA, 59 nt, Human
gucuggaggaggaagaaggcacucgcuggcuuuuguuugcuuucugcucuuguccacac

SEQ ID NO: 4112777 - RNA, 81 nt, Human
gucuggcauacaggaagcacucaagaaaugcuggcucugacuguaaucgcccuggcuauuuucugcuugcuguugccugac

SEQ ID NO: 4112778 - RNA, 59 nt, Human
gucuggcauaugcaaagugcauaaaaauccuuagcaauuuguuaaauaaugugucagau

SEQ ID NO: 4112779 - RNA, 91 nt, Human
gucuggccagaccucaguuuuaagacuacucuuuucuuagcuuugcagauaugcucuggagaugccagcuuacacugggaacugguuaggc

SEQ ID NO: 4112780 - RNA, 68 nt, Human
gucuggcuccccagacagugauuuacuuaaugcuuugcauuuuaagugacaucaucuguuuuccagac

SEQ ID NO: 4112781 - RNA, 55 nt, Human
gucuggcuuugaaacuugcugcagaugagccaccugcagauaauugaaagcugac

SEQ ID NO: 4112782 - RNA, 66 nt, Human
gucugggagguacugggaggugucucagcaggagauaagcagcggggacuugccgucuuccuagau

SEQ ID NO: 4112783 - RNA, 64 nt, Human
gucugggcagaccucuccagccccacaaggcugccaguggggguugugggaggcugcagagggc

SEQ ID NO: 4112784 - RNA, 78 nt, Human
gucugggcugaauucugagaccacagaauccuggaauauuagagccagaaggaauuuuacaucucagagagcuugagc

SEQ ID NO: 4112785 - RNA, 69 nt, Human
gucugggcugguacaaauccuaaggcgauuguaagaaaugaauaguuuucaguuuggaccagccccgac

SEQ ID NO: 4112786 - RNA, 70 nt, Human
gucuggggaggggugcguugugaaugaaggucuaucuaagacagcauuauccaacagcacuuuccaugau

SEQ ID NO: 4112787 - RNA, 70 nt, Human
gucugguacagcuaagaauuucaucuuugucaugcguaagcugaaagauuaaauucauacuguacuggau

SEQ ID NO: 4112788 - RNA, 62 nt, Human
gucuggucccugcucacuucuuguucagaaucccuguccugaggaccucucaggggccaggc

SEQ ID NO: 4112789 - RNA, 94 nt, Human
gucuggugaggauucauugcuagagagguagugugauccuuuggagguauugaaucacucuggcuuuuuauacaguuugaguucuugcauagau

SEQ ID NO: 4112790 - RNA, 87 nt, Human
gucuguacuauuuuccacaguggcuguaguucuguaaauaauuaaugaaugaguccuuccccagccccuuggagacuggcugcugac

SEQ ID NO: 4112791 - RNA, 68 nt, Human
gucuguauaguuuaauggucaacuaaugacggcucaagcuucguucaaacaccuugaaccuauuagac

SEQ ID NO: 4112792 - RNA, 57 nt, Human
gucuguccagcaacacaggaguagggugaagcccauuucuguggccacaggacagau

SEQ ID NO: 4112793 - RNA, 82 nt, Human
gucuguccucaggacacuuuacucuucauaugugacacaaaauguucugucauauagacgaagugauaaugucaggauagac

SEQ ID NO: 4112794 - RNA, 84 nt, Human
gucugucuggucuagggggacucaacugggacagcuugucuuuguucgucuuggucuuucauccuucaacagacuagcacaggc

SEQ ID NO: 4112795 - RNA, 64 nt, Human
gucugugaaauguguguauaauuaauuucuuuuaaaauuacauuguuaaugcauuagcacagac

SEQ ID NO: 4112796 - RNA, 74 nt, Human
gucugugagcugggugaaugguagggcaggguagcaccaacagauuucccagcccuugggccccagcucagggc

SEQ ID NO: 4112797 - RNA, 91 nt, Human
gucuguggaaaaccuuguugcugaauucaggauucuuucuuccagagaagauuugggcuuguguuugcaacagccuuggacagcuacagac

SEQ ID NO: 4112798 - RNA, 68 nt, Human
gucugugguagacaggaaggcaugauuuauuuaccugccagccuccuccacuccuguuuaucauugau

SEQ ID NO: 4112799 - RNA, 67 nt, Human
gucugugugggauaguuugaggaauguaaggaagauuucccucucuccugaauuucccagcaugaac

SEQ ID NO: 4112800 - RNA, 78 nt, Human
gucuguguguugaaggccaggcagggagcugugaacuguaggauguuuagcagcaucccuggccuguacccauuagau

SEQ ID NO: 4112801 - RNA, 77 nt, Human
gucuguuacuguuuuuuagacucaugguuugauuauuaaaccccugauaggagucauagucaaggcaggaaacagau

SEQ ID NO: 4112802 - RNA, 69 nt, Human
gucuguucaguaagucagucauuuuugagccaucaugauuuucauuccuuuucugauuuauuagcagac

SEQ ID NO: 4112803 - RNA, 76 nt, Human
gucuguugaguguauggaagugaaggauuggccaggcacaguggcucaccccuguaauuccagcacuuagcgagac

SEQ ID NO: 4112804 - RNA, 70 nt, Human
gucuguugcauuaaucugcucaggcugccaugacaaaaaucucacagacuggguggcuuaaacaagagac

SEQ ID NO: 4112805 - RNA, 126 nt, Human
gucuguuggauuuugcucagagcugccuuaugcacuugggauuucagaugcugugcaauaaaacuuugccaguuucccaggaaugcauuauaggagagccagccuacuuaagggcgaagucuggau

SEQ ID NO: 4112806 - RNA, 61 nt, Human
gucuguugguuauacaucaacucaguaaauacuuacagaacaacaagguggaccagcggau

SEQ ID NO: 4112807 - RNA, 70 nt, Human
gucuguuucagaacaccccauuugggguauauaaaauguaugcugccagcaggaguuucugagacaagau

SEQ ID NO: 4112808 - RNA, 71 nt, Human
gucuguuugacuuuguaagucuuucuccaagauauggcauauauuuuggagcacugcaagguugaguagac

SEQ ID NO: 4112809 - RNA, 74 nt, Human
gucuuaagugagccaguggaagauggcaguuuauucaugaauuguugguuaucugcugcuuaacuacuuaacac

SEQ ID NO: 4112810 - RNA, 93 nt, Human
gucuuaauaacugaccuccauggaggucugugauuagcacugggggacauaaucuucuugggccaaggcagaucuccaaagggcaaaggagac

SEQ ID NO: 4112811 - RNA, 60 nt, Human
gucuuaccucugcuccaugaugucuggggccucaacuggagcacaugagggcugagggac

SEQ ID NO: 4112812 - RNA, 67 nt, Human
gucuuagcaugucagcaccggguuuauaacaccuugaugguguaauccacacaucuggcaugugagc

SEQ ID NO: 4112813 - RNA, 117 nt, Human
gucuuauccauaaugacuauucaaaugaaaaguacaacaacagcugcuaaagaguugguaagaaguggugauucaagauugguuagcuguuaguuuacauagucauuaaaauaagau

SEQ ID NO: 4112814 - RNA, 86 nt, Human
gucuucauaaugacugugcuauuguuuauuuugaaucuacuaaacacaguugauauguaauaugcaaugccacaggggauggggac

SEQ ID NO: 4112815 - RNA, 80 nt, Human
gucuuccacuuagauucaguaauuguuaacauauuagcauauuugugucagcaugugacaauauuuggucuuauggagac

SEQ ID NO: 4112816 - RNA, 79 nt, Human
gucuucccagagagugcucagcuauuggugaagcaggcaucgucuauucuucaagaagacagcagagcaucaggaaaac

SEQ ID NO: 4112817 - RNA, 62 nt, Human
gucuucccuuggugaacagagcaugacucaugucuaugcagucuaagcauguaaggguugau

SEQ ID NO: 4112818 - RNA, 71 nt, Human
gucuucuuaaauguuggcauuggaggccgggcacaguggcucacgccuguaaucccagcacuuugggaggc

SEQ ID NO: 4112819 - RNA, 59 nt, Human
gucuucuuccuguguucuggugaaggcacaauguauuaaugaggaagcaggaggaaggc

SEQ ID NO: 4112820 - RNA, 58 nt, Human
gucuugaauaaguuucaugagcugccuuaugcauuagcucuuguuuuuguuuaaugac

SEQ ID NO: 4112821 - RNA, 77 nt, Human
gucuugacaucauuucuaguuccugucaucaaccugggcacuguucaaacuuggaagaacaagaaaugagucagggc

SEQ ID NO: 4112822 - RNA, 59 nt, Human
gucuugacuugaaaauucuucagggucauagaggccuaaguauuuucaguguuaacgac

SEQ ID NO: 4112823 - RNA, 67 nt, Human
gucuugcagagggcccuucugcugcagacccagagccuugcaguagcuuccugaccucuugcaaguc

SEQ ID NO: 4112824 - RNA, 58 nt, Human
gucuuggagacuaccugaacuuguaguugaugucacaaaugaggguggucuuggagac

SEQ ID NO: 4112825 - RNA, 62 nt, Human
gucuuggaggguuguuguuuugaagcugcugacacccucaugcaacgauccuccaaauggac

SEQ ID NO: 4112826 - RNA, 128 nt, Human
gucuuggcugugugaaguuugagaggcuuaauagacaucuugguggagcuuuaaagcaggcaguuugauacauaaggcuaaaguucuggggguguuucugggcuggaugauguuuacagccaaaagau

SEQ ID NO: 4112827 - RNA, 58 nt, Human
gucuugggaucaccuccuggcuuguccaucaucaucaaguacuuugggauucuaggac

SEQ ID NO: 4112828 - RNA, 83 nt, Human
gucuugugucagaacuuuuacaguacagaaaauaacagaauagccuucuguaaugaggcguuuguuagaguuuugcaugagau

SEQ ID NO: 4112829 - RNA, 89 nt, Human
gucuuguuagaacccaggcgugguugaggcgagcauagcacagagcuggcugaguuucaugcaucaugcacugaagggguuucagagac

SEQ ID NO: 4112830 - RNA, 70 nt, Human
gucuuuauauguuucuuacaaaauauuacguacauacauggugcagaguugaggaacauguuugggaggc

SEQ ID NO: 4112831 - RNA, 85 nt, Human
gucuuuaucuucuguuagcuaaaaugcaauguagugugcuguguacaaggacaugcaauuuggauuucuaaaagaguauuuggau

SEQ ID NO: 4112832 - RNA, 67 nt, Human
gucuuucaggaucaaaugaaaucgucuucugugucagcugaauacgagcucccuugaccugaagccc

SEQ ID NO: 4112833 - RNA, 88 nt, Human
gucuuucgggggccagauggucaggguaagucugugugcucaaguuagagauguggauuugggagugaucagggcucaauagaaaugc

SEQ ID NO: 4112834 - RNA, 80 nt, Human
gucuuucuccacauccucuccaacacuuauuuuuugaaauguucucaggagaaaccuguaaggaaggaagugagggaagc

SEQ ID NO: 4112835 - RNA, 60 nt, Human
gucuuucuucaugucggcggcucucgggggccagccuccgcccgcacguauggaguggac

SEQ ID NO: 4112836 - RNA, 65 nt, Human
gucuuucuucauucugguuccucagaggcauuuuaguaucauggaaacucagagaugaaaaagac

SEQ ID NO: 4112837 - RNA, 86 nt, Human
gucuuugaaggugaugauuuaugaagugaccacauugaaucuucucuuggaauaaguguuuauggaaucuuaguuaucucaaagau

SEQ ID NO: 4112838 - RNA, 68 nt, Human
gucuuugaugucaguucucacuuacauaaaaauauuuuuagguaggccagaacuagaggucuaaugac

SEQ ID NO: 4112839 - RNA, 82 nt, Human
gucuuugcuauugugaauagugcugcaauaaacauacaugugcaugugucuuuguagcagcaugauuuauaaucguuugggc

SEQ ID NO: 4112840 - RNA, 56 nt, Human
gucuuugcugauccagaaacccagagcugagcuuugggguuggcaagagcagagac

SEQ ID NO: 4112841 - RNA, 78 nt, Human
gucuuuggcugcucuuuugguuccccgcuaucagcuugaauuuuuugagagcaggguuccaggaguugcagaaaaggc

SEQ ID NO: 4112842 - RNA, 62 nt, Human
gucuuuggcuuagcuaauaucucauccccugggaaaagugauuggucuaaaguuaagaagau

SEQ ID NO: 4112843 - RNA, 56 nt, Human
gucuuuguucugucacuaaaaaugucuuuacugcauauaugugacagacaauaggc

SEQ ID NO: 4112844 - RNA, 72 nt, Human
gucuuuuacauuuguuauagaaaugaagccguauaucuaaugcaucacuggcugcugacagaugauaaaggc

SEQ ID NO: 4112845 - RNA, 99 nt, Human
guuuccagcucuaguaguaguaguaguagcaguaguagcaguagcaguagcagcaacagcaacuccugcuucugaguauuuacuacaggcaugugaagc

SEQ ID NO: 4112846 - RNA, 64 nt, Human
guuuccagcucuuagcaaaggcagaacaauaaaacaucaaggaugucuuucuaaggcugcaaac

SEQ ID NO: 4112847 - RNA, 64 nt, Human
guuuccaggagaaagagagccuugaagugagucuucaaggaaacuagaaguuuuccugguaaau

SEQ ID NO: 4112848 - RNA, 101 nt, Human
guuuccuaagccucaauauucugauuuauucauuguucacuaaauuguccauuguauacuaggcacuguggauaagucagagauguaugaggauugcuaac

SEQ ID NO: 4112849 - RNA, 70 nt, Human
guuuccuacacuguaguauuaucuaguccaaaaugugaauaugcugagguuaaagcugaaguuaggaaac

SEQ ID NO: 4112850 - RNA, 79 nt, Human
guuuccucauuccugguggcaucuugagaugguuugguaacauccaagcugugcagauguuaccacggagcauggaggc

SEQ ID NO: 4112851 - RNA, 72 nt, Human
guuuccucuccuuaaagcuguuagaguaguaagagugccccuuuuaguagacagcuuugaugaagauuaaau

SEQ ID NO: 4112852 - RNA, 59 nt, Human
guuuccucucuugcaguccaggaggaccuucgaggccccuggcuguuugagcggggaau

SEQ ID NO: 4112853 - RNA, 57 nt, Human
guuuccucuuauaagcuguucuagggagggacguccuucaguuucagggcaggaaac

SEQ ID NO: 4112854 - RNA, 57 nt, Human
guuuccuggaaacugcuccacuccucccuuuggaggcagcauuuuaugguaggaaac

SEQ ID NO: 4112855 - RNA, 114 nt, Human
guuuccuuugcuagaaaagcccaggugucuggacagugagccagguguacucccauuguuagguucagcugccaguuccugcucuuggugcuacuacuugaacccagaggaagc

SEQ ID NO: 4112856 - RNA, 75 nt, Human
guuucuaauuggaaaagcacagucagaauauaaagagaaucuugcuuuucacugaaguuucuuccauguagauau

SEQ ID NO: 4112857 - RNA, 69 nt, Human
guuucuacucucagaagaaucagcagcuauugccaauguccauuuagcugccagucuucugaaagaaac

SEQ ID NO: 4112858 - RNA, 72 nt, Human
guuucuagaaugugaaaauaguaaccuggcuaguuaauuuaauuaaguccuugguaauuuucuuuuagaaac

SEQ ID NO: 4112859 - RNA, 68 nt, Human
guuucuaucugucaugccacaggacuuggaaaauaauuucauacuguaacauguaugggcuaagaaac

SEQ ID NO: 4112860 - RNA, 68 nt, Human
guuucuaugguauuacagcauuccauauuucugcaaguguuaauaggaauuuguaaugcuuggauaac

SEQ ID NO: 4112861 - RNA, 79 nt, Human
guuucuauuuuaaaaauaaaccuguccuacucauucuuggagucaggugugggaacuacagguuuuuaauggaagaaac

SEQ ID NO: 4112862 - RNA, 82 nt, Human
guuucuauuuuugcuuucaucuguguucuauuucgauauagucauuagagauaacuugaacauggagaguaaguagccuagc

SEQ ID NO: 4112863 - RNA, 83 nt, Human
guuucucagcuguugaaaguagaugcuauuuggugggaaacauucuaaauacucaaauguucacuugcauggcacugaggaac

SEQ ID NO: 4112864 - RNA, 113 nt, Human
guuugaaguguauuuuuaggaauguagauuauuuuuaggaauguagagguaaggaggcagcauccacauuucauccauuaagaguacucuccauuuuuaaagauguuucaagc

SEQ ID NO: 4112865 - RNA, 72 nt, Human
guuugacauuaguacuuuuacagcaggugacuccucuugucaaauugcucuuuaaaaguacuguauucaaau

SEQ ID NO: 4112866 - RNA, 61 nt, Human
guuugagaaccauugaagggagaggcuuuuauucuuuuacuucucccugcccaucucagau

SEQ ID NO: 4112867 - RNA, 75 nt, Human
guuugaggagguauaguaagauuugggcauuuugaacuuacagugcuggagcaacauuauugugccuuguccaac

SEQ ID NO: 4112868 - RNA, 79 nt, Human
guuugaggggcuuucuguuguauuuuuucccuuccauauuugagagaaacacagguacugcagaagugguucagcagac

SEQ ID NO: 4112869 - RNA, 85 nt, Human
guuugcaaccuugacuauaaaaaaugugcauuucuaguacgcaccuucagagguucacauuuaauugguuuaggguggagcaggc

SEQ ID NO: 4112870 - RNA, 65 nt, Human
guuugcaccauuucacuuccauuaaauauguaagcaggguuaaaggacuguggguguguggaaac

SEQ ID NO: 4112871 - RNA, 56 nt, Human
guuugcaccccuugauugagccuucuuauggaaagugaggcccagagaggugaagc

SEQ ID NO: 4112872 - RNA, 66 nt, Human
guuugcagaugaucaagaauuuuguauuccagcaggaguucaaaucuuuuggaucuucucgccaac

SEQ ID NO: 4112873 - RNA, 62 nt, Human
guuugcagcaagaugugagcauuagaagaaaaauguuagacucacaucuauguuaagcaaac

SEQ ID NO: 4112874 - RNA, 64 nt, Human
guuugcauauuugcacaggaauauaagcauuuguuaauugguuucuguguugauauauacaaau

SEQ ID NO: 4112875 - RNA, 55 nt, Human
guuugcauugaaugcacauuuuuauaaaguacugugaaaaugaaauagugcaaac

SEQ ID NO: 4112876 - RNA, 64 nt, Human
guuugccugucuaaauugccaagcuuuuugauaaagcuggcagugugaaugacaagccgcaaac

SEQ ID NO: 4112877 - RNA, 64 nt, Human
guuugccugugauguacauuucucaugaaguuaccugggauaugcuacaccaacacaggggaau

SEQ ID NO: 4112878 - RNA, 68 nt, Human
guuugccuuucuggugaagauaccaugcaugauaacauuucaacuuauuagggccaggacuggcaaau

SEQ ID NO: 4112879 - RNA, 84 nt, Human
guuugcgcaugggcaguggggggacguuggucacuuugugguaucguugcagauggccaggguccccugcaccacggcgucugc

SEQ ID NO: 4112880 - RNA, 81 nt, Human
guuugcugacugaauacgcgaagaaggaccugaugggcucauaugcaccacugccaucacaguccccaucgugaugcaagc

SEQ ID NO: 4112881 - RNA, 67 nt, Human
guuuggaacagaaagcaauuuaacacagcaacuaauagcaugggcucuagauucugucuguccaaac

SEQ ID NO: 4112882 - RNA, 88 nt, Human
guuuggaaugcgggcuugucagccaauuguggauuuccuucuaaugcuggagagaaaggcucagaugaggcccuggauucuuccagac

SEQ ID NO: 4112883 - RNA, 61 nt, Human
guuuggacagaaauacaucuucacuugaguaaaagguucaagaguuuaauuuugucuagac

SEQ ID NO: 4112884 - RNA, 57 nt, Human
guuuggaguagaaaaaauacuccaaaacacaggaggaauuuguuucuacucucugac

SEQ ID NO: 4112885 - RNA, 84 nt, Human
guuuggauggugcuggguagaauuggagccauuuuggaccuggagccagguccccuggcaccuaguccuacuccacugccaagc

SEQ ID NO: 4112886 - RNA, 62 nt, Human
guuuggcucauucuacucucccugggucuuauugacuuucagggagccuagaagagcuggac

SEQ ID NO: 4112887 - RNA, 62 nt, Human
guuugggaaggaauuccaagacuaaagugaaugacacuuaagcaaaauauucuuucacaaau

SEQ ID NO: 4112888 - RNA, 86 nt, Human
guuugggaccaguaaguaggaauuaugaugcuaucaagguucucguccauggcaaugacaucauuucuaguuguaugaucacagac

SEQ ID NO: 4112889 - RNA, 77 nt, Human
guuuggggaauauuguggggugauuugccacggggguugugccucugucugccuguguccccaccucuuccccaaac

SEQ ID NO: 4112890 - RNA, 63 nt, Human
guuugggggcugguaagauagcaaagauuucccuuguugauguucucuuguccaggccuuaac

SEQ ID NO: 4112891 - RNA, 58 nt, Human
guuugguagcagcaaagcccaggagcacauuuccaaagaggcugcugguuacagaggc

SEQ ID NO: 4112892 - RNA, 93 nt, Human
guuuggucaguaaggaaguagguuauagggugaucacagaauauuauuuucaucguuuuuguacauucugaaucuguccuugccggcacgaac

SEQ ID NO: 4112893 - RNA, 113 nt, Human
guuugguggaauacacacguuucccaaggcagggauuuucugcugcuuuguuuacuacucuuaucugcagcagcuagaauagugccugguacagaggagguguucuguggaau

SEQ ID NO: 4112894 - RNA, 99 nt, Human
guuuggugugugacaaagaguuggcaguugaaacuuuuuuuauguauuaacaugcaaaaauguuaucuacuguccgaacuauuccacaacauaccaaau

SEQ ID NO: 4112895 - RNA, 97 nt, Human
guuuguaauuuauuguucaguccacaacgcuaaucaugcugcccuagacacaacagaugaucaauaaaaggcuggcuggaugaauggauuaauuaac

SEQ ID NO: 4112896 - RNA, 55 nt, Human
guuuguaguuuuguguaguuugguacaauuaaacuuugcauaacuaacuacaggc

SEQ ID NO: 4112897 - RNA, 73 nt, Human
guuuguauucccaggcuccacccaaaucucccaaggcugugagagugagauuuguugugagcaggaauagaac

SEQ ID NO: 4112898 - RNA, 66 nt, Human
guuugucacaucuuggauuacaauuuuacuuggucaaguaaaauuguaagccaagaugugaccaau

SEQ ID NO: 4112899 - RNA, 106 nt, Human
guuugucacugcaacuuuucucuucccacuuucuguauuuuuuuaagaagcuaggagccccucagguggaaaucgggaaggacgaggaagguaugcugugcugagc

SEQ ID NO: 4112900 - RNA, 62 nt, Human
guuugucaugcuuuccuuauggacuucugguuaugccuccuuaaggaugugggcugagggau

SEQ ID NO: 4112901 - RNA, 66 nt, Human
guuugucccacuucuggcagaacugugcccaccugacucagagauuccccggcaguguggacagac

SEQ ID NO: 4112902 - RNA, 87 nt, Human
guuuguggaugagauaacuguagaagaauaacacaaagauuaaaauccagaauaauugugcaaguuucuaagguuuuuaucugcuac

SEQ ID NO: 4112903 - RNA, 93 nt, Human
guuuguguuuguuguuuuuugaaauguaucaguauaggugucaggcauuuuacugucuauucacucacauuucuuuauuugacaaauauuuac

SEQ ID NO: 4112904 - RNA, 87 nt, Human
guuuguucugugaccuucuccucuugcauucuaucccuccaggcacugaccugcugggucuaugcaaguggagcacuuagaauaagc

SEQ ID NO: 4112905 - RNA, 70 nt, Human
gucuuuucccucuuucccagguaacucauaugccucccagauguuuauauuuggaaagagggaagaagac

SEQ ID NO: 4112906 - RNA, 65 nt, Human
gucuuuugucagggaucagaucgguaucgggaccuccugcugccuuugcauuuccugcaacugac

SEQ ID NO: 4112907 - RNA, 62 nt, Human
gucuuuuuauuauagaguggaggaaaucccaguggucuucuugacucauuaaaugagaagac

SEQ ID NO: 4112908 - RNA, 57 nt, Human
gucuuuuugugccauuccuuuuggggcccaggaccuaagcaggaacuucaaagggac

SEQ ID NO: 4112909 - RNA, 61 nt, Human
gucuuuuuuacaccuuacaucagaagcaccaugguaugguggauuuuggugucagagagac

SEQ ID NO: 4112910 - RNA, 86 nt, Human
gugaaaagguuagaguagugggagauguuacaugucucugagagucagaggcccaguuauccuacuuguuccccgaucuuuugcac

SEQ ID NO: 4112911 - RNA, 64 nt, Human
gugaaagagaaaaugaucuguacaugcagauauggauguagcagaagauguuuuccuaaaucgc

SEQ ID NO: 4112912 - RNA, 62 nt, Human
gugaaagagaaaaugucagacuuggucgcaaaagugaaaaggggugauauuuuugaucucac

SEQ ID NO: 4112913 - RNA, 66 nt, Human
gugaaagcacugaacaaaguaacaaaagugcugagaaguugugcuuugugacagauuaguuuucau

SEQ ID NO: 4112914 - RNA, 76 nt, Human
gugaaaguuccuagagccugccucuagucucuagagggaaaacugagggaaaucuauagggagguacgagcuguac

SEQ ID NO: 4112915 - RNA, 93 nt, Human
gugaaauccaaggaaacucuguagaguauaccaaugucaauuuccggguuuuaauauuguaucuacuucuauaagauguuaccuggggaaaac

SEQ ID NO: 4112916 - RNA, 112 nt, Human
gugaaauccccuaaauugcuauucuucaguauguguggauuguuccagguccuugccuaucaauuuguugacaucuagaaaauagcuugcugaauuuugauugggauuucau

SEQ ID NO: 4112917 - RNA, 60 nt, Human
gugaaaugauggauaugugaauuugcuugacuguggugaucauuucucuauguauuucac

SEQ ID NO: 4112918 - RNA, 67 nt, Human
gugaaauggaacugcuaauaauaguugcuucauaaggugauagcuauuguugguaguuacccauuac

SEQ ID NO: 4112919 - RNA, 85 nt, Human
gugaaauguguaucuucucucuuacugccaugcugucagguagaaagccagugguaugagagaaaaggcaguuacacaguguuac

SEQ ID NO: 4112920 - RNA, 67 nt, Human
gugaacaggagguggagauaugcaggaaaaagcccccauaaacuguuucuaugucuugugccuucau

SEQ ID NO: 4112921 - RNA, 61 nt, Human
gugaacauugaggcagaaaggaaacuggccucaccagacucuuuuucauccucaauucuac

SEQ ID NO: 4112922 - RNA, 72 nt, Human
gugaaccagaaggaaucugagcugagggccugccaagccauucuccagcaucagauuucuuccucggcucgc

SEQ ID NO: 4112923 - RNA, 56 nt, Human
gugaacuaaggauucaaacuucagauuucaaaguccaaagugaaugcuuuguucac

SEQ ID NO: 4112924 - RNA, 62 nt, Human
gugaacuauuggguaucauaaaagcacuuagugugcaccagucuguguucuaaauaguucac

SEQ ID NO: 4112925 - RNA, 99 nt, Human
gugaacugagacagaaucagggaacaagaugagaauggaguuuguggacagagaauucagccugcggucuugucacccauguccuugugcucagauuac

SEQ ID NO: 4112926 - RNA, 76 nt, Human
gugaacugcaggaccuauaaauauauuuuaaacauguuuuuaaaauguagcuucuaggcugggugcaguggcucac

SEQ ID NO: 4112927 - RNA, 115 nt, Human
gugaacuugaacuagaaggaaaggauuuucaauagcauaagaugucaaauagaagaggcuuuuuaauuucuuuaugcuggguacaugauaguucuuuacucucagccauucucac

SEQ ID NO: 4112928 - RNA, 78 nt, Human
gugaacuugcugugugccaucagggcuguauuugaaauaaaauucuggccugagaauggaacaguuagcauuguucac

SEQ ID NO: 4112929 - RNA, 77 nt, Human
gugaacuuggacuuggugaccauagaguagaguuuccuucuuguccaaggaauagcuuuggucaccaucuggagcac

SEQ ID NO: 4112930 - RNA, 63 nt, Human
gugaagaaagugaacguguucaguuuacauuuguaagguagaccgugcguucccuuuuuacac

SEQ ID NO: 4112931 - RNA, 61 nt, Human
gugaagacagugugucaggcagguguuguuguacaucuggcuagcuaucauugugauucau

SEQ ID NO: 4112932 - RNA, 57 nt, Human
gugaagaccagggaacgcuggcuuuggugaagccaguccugccacccugucuaucau

SEQ ID NO: 4112933 - RNA, 80 nt, Human
gugaagauucaauuauauagaagagacaugugcauagcaguuacacguggcuguucauuccuucuguaccuugccuucac

SEQ ID NO: 4112934 - RNA, 61 nt, Human
gugaagcacaugggcguuggguuugcucaucacaagcugccugcugcugaugcuguuucac

SEQ ID NO: 4112935 - RNA, 81 nt, Human
gugaaggacagggcagccucucagccuaggugacagagggacagugucgcuggggaccacacugagcugcgcugcuggcac

SEQ ID NO: 4112936 - RNA, 55 nt, Human
gugaaggagcuacugcucugggugcuaacagcagacaccagagcuggcuccucgc

SEQ ID NO: 4112937 - RNA, 82 nt, Human
gugaaggauguccucuggggugagugggccacuuuagggcccuggugggaguggcuugcucugccucagccuccaccuucac

SEQ ID NO: 4112938 - RNA, 58 nt, Human
gugaaggcagugaaugaaacagaggcuuccaaggccucgguguguucucugccaccac

SEQ ID NO: 4112939 - RNA, 114 nt, Human
gugcacugggcggugaggacucgaacgagcucgucccggggcuggcgcacucacuucggagaaaccccugcucccgggacgcguucacuccggccgcgcaggcagcccgggcac

SEQ ID NO: 4112940 - RNA, 81 nt, Human
gugcacugggguggacagagcccugggccgggagacauuugucgugggcucuggucccagcucugccaccaauucuuguau

SEQ ID NO: 4112941 - RNA, 55 nt, Human
gugcacugucuggucaagagcaguguccaugugcguuucuguggcagcagugcac

SEQ ID NO: 4112942 - RNA, 121 nt, Human
gugcagaagugacuuagaugugauagcggcuugguccugcucuggcccagguuuguaccagcuauagaaaugagccaugguagagccuaaaguagcaugaucacuggagaaaauucugcgc

SEQ ID NO: 4112943 - RNA, 114 nt, Human
gugcagacaguacccugggcuguggcagcauccgcccggcacccuccagcgugcuuuagcugaaggagcuggggucgggaaggucccugcaguacuugggucuuaugucuguac

SEQ ID NO: 4112944 - RNA, 76 nt, Human
gugcagagagagggagucugugcaaagaauucuccgcacuugagagcuuccaagcauuucccucgugucuuuguac

SEQ ID NO: 4112945 - RNA, 59 nt, Human
gugcagagaggaccuuggggaggacccacgaagcuguccuuccccaggcuggucuguau

SEQ ID NO: 4112946 - RNA, 68 nt, Human
gugcagagcucaggcagaauccaguugcccaaaacagucaggcacuuucuguuccucuagcuuugcau

SEQ ID NO: 4112947 - RNA, 58 nt, Human
gugcagaggcugagaaacccucuucugugggauaaaggcaggagaucagucugggcgc

SEQ ID NO: 4112948 - RNA, 83 nt, Human
gugcagaguguugcuagaugcccucgcugcuguuuucuuuugcccaggucuggugggggaggcugucuagcagggcuucgcau

SEQ ID NO: 4112949 - RNA, 80 nt, Human
gugcagauucugauuuuacaccucuuguuucuccuuugcagaggcauguaagaaucagucuuuaaugucaacaucugcac

SEQ ID NO: 4112950 - RNA, 62 nt, Human
gugcagcaaacuagugcgagggucaugucagcucccuauuuucuaucucuaguccgcugcac

SEQ ID NO: 4112951 - RNA, 77 nt, Human
gugcagcaauuugcaguaauuuaugguuguuacguaagaucuuuaagccuugagucugugcuguaauuugucugggc

SEQ ID NO: 4112952 - RNA, 69 nt, Human
gugcagccaccauggguucucaccuuuaucuuuacagcaaagcagaaaguggcccugguguggcugcac

SEQ ID NO: 4112953 - RNA, 59 nt, Human
gugcagcuuuaaacauuggaaauauggucauauggcccuauuucuauuauuauggccac

SEQ ID NO: 4112954 - RNA, 55 nt, Human
gugcaggagccagggguaggaacauuuacuaacaugagccacccaggacuuggac

SEQ ID NO: 4112955 - RNA, 68 nt, Human
gugcaggcaggagaggaggauuucuggaauuucuaaaguuggcaggagucugccuguucuaccugugu

SEQ ID NO: 4112956 - RNA, 62 nt, Human
gugcaggcucucuccuaguccuugccucauaccugaaguuacuagggacugagaguaaacac

SEQ ID NO: 4112957 - RNA, 55 nt, Human
gugcaggcugggaagagggacaacuuccaaguccucccuaaauccuagacugugc

SEQ ID NO: 4112958 - RNA, 57 nt, Human
gugcaguaggauuuaucagaggacaaauguuuguuccucugugacuucuaccuucac

SEQ ID NO: 4112959 - RNA, 58 nt, Human
gugcaguggggggaccuccagaaugccuuggcuucuuggaagucguccuuccacacac

SEQ ID NO: 4112960 - RNA, 62 nt, Human
gugcagugugcaaccuccuguguuuggaauuagcaggcccagggguaaggcgcagcgugcau

SEQ ID NO: 4112961 - RNA, 89 nt, Human
gugcaguuagaggguuuccuaugaagaguaggauuagauaguacugcuucauuauuccaguucaccuuuucaucauucccuucacucac

SEQ ID NO: 4112962 - RNA, 69 nt, Human
gugcaguuuaaacuuggcaacuugaugcccugguguucccugggggaguuagggaguuuauauuugcac

SEQ ID NO: 4112963 - RNA, 58 nt, Human
gugcauagcaagcguucccaagccacuggcagugugaccuugcuacguugcugugaac

SEQ ID NO: 4112964 - RNA, 56 nt, Human
gugcauauuuugcacacagauguguugcacauuugugcaugugcaaacgugugcac

SEQ ID NO: 4112965 - RNA, 55 nt, Human
gugcaucagaguguccuagacaaggggguagcuuggccuauugcucucugggcac

SEQ ID NO: 4112966 - RNA, 118 nt, Human
gugcaugaucauggauagaucaaagugugguugcaagugaaaugggauaaaugacaaaaugacaguuuuauaaaguuaagccugaaucacauuaauucuguaucuucuagacaugcac

SEQ ID NO: 4112967 - RNA, 67 nt, Human
gugcaugccauaaugcuuaauucaauacuguguccauggacgcugguucuaaguguuuggugggcac

SEQ ID NO: 4112968 - RNA, 65 nt, Human
gugcauuaggcuggaauguugauaugcgaaggauuuguaaagaaauauauuucuaguuagugcau

SEQ ID NO: 4112969 - RNA, 86 nt, Human
gugcauugcccaccucacuccaguccugguccugcccuagagaaacccagcuccuggaucugggguagagcagugggccaaggcau

SEQ ID NO: 4112970 - RNA, 74 nt, Human
gugcauuuccuucucuaucuuuggcacaucaggucaaacuccuguguucccagagaaugaggaaugaagugcau

SEQ ID NO: 4112971 - RNA, 57 nt, Human
gugccaacaaugagaagucacucucuccagccaggauuucccucauuguguuggcac

SEQ ID NO: 4112972 - RNA, 84 nt, Human
gugccaauaauauuuuuaaaauugcuauacauguggaagaaaaauucuuucaagucaauuuuugaaugacuguuuguuagguac

SEQ ID NO: 4112973 - RNA, 76 nt, Human
gugccacaauuucugggcaguggcucagguaugaaaguucucaugucaaaugcaucuguccaguaauuccuggcac

SEQ ID NO: 4112974 - RNA, 56 nt, Human
gugccaccaguagaucugcaaguugagaaaagcagcucaggugacacacguggcac

SEQ ID NO: 4112975 - RNA, 60 nt, Human
gugccaccauagcuucuggauuguauuuauaauccacucuaagaucuguggugcuagcac

SEQ ID NO: 4112976 - RNA, 72 nt, Human
gugccacguugcuuuccccgggucugccaggaccgcucaaaggccuguguccucagggaagcagagaaucac

SEQ ID NO: 4112977 - RNA, 64 nt, Human
gugccagaguuugaggacaauuuuguaugacuuacugguuccauucuguuguucuugucugcac

SEQ ID NO: 4112978 - RNA, 66 nt, Human
gugccagauauugucuguugguauagagaccauucugaccuuucugugcucuucucaguaucacac

SEQ ID NO: 4112979 - RNA, 82 nt, Human
gugccagccauggcugauuugagagaggguguuuauaucccagugguguagaaagcucuucugaaauccagaggccgggcac

SEQ ID NO: 4112980 - RNA, 59 nt, Human
gugccaggagaggcccuggccugggaaggccccuuucucccagggcuggcuccugggau

SEQ ID NO: 4112981 - RNA, 75 nt, Human
gugccaggcaucuuuauaagacuguagugaguauuagcauaauuaauccucgcaauaauccuauuaguuaggcac

SEQ ID NO: 4112982 - RNA, 67 nt, Human
gugccagggccuguccgcucccgcccgccugcacgagggcccgggcagccgggucagccgcuggugc

SEQ ID NO: 4112983 - RNA, 73 nt, Human
gugccaguucucauaaaugacagagaagcuuucaggauagaaauccugggaguaauugagucaugauuggcac

SEQ ID NO: 4112984 - RNA, 80 nt, Human
gugccaguugcuauuugguaccacacucuacaaaagcuuaauuacuuuacuugaugcugguugcuaagcagcgauuguac

SEQ ID NO: 4112985 - RNA, 73 nt, Human
gugcccaccaguuucuuaggaaauuuuacuggucugggcgaagcccaggacuugggaauuuucauggaggcac

SEQ ID NO: 4112986 - RNA, 66 nt, Human
gugcccagcagguccauguuucuaucccggagacccuuggguuaggaaauauugauugcucuguau

SEQ ID NO: 4112987 - RNA, 71 nt, Human
gugcccauucccaccagguaugugccaugugccugcaugcacaggggcacauguaugugggagugugccac

SEQ ID NO: 4112988 - RNA, 80 nt, Human
gugcccauuuaaaauguagguuucugacccacccaguggcgucugagucaggguccuggaaucugcauuuuaacaagcac

SEQ ID NO: 4112989 - RNA, 56 nt, Human
gugccccuuugccugauuuaaauaucuacucaauauuuuccuggcaacaggggaac

SEQ ID NO: 4112990 - RNA, 84 nt, Human
gugcccgagcaagucagcaggacucagauuugcuugcaguuguuagccaagcugaucuccugcugacacguuuagcucggggac

SEQ ID NO: 4112991 - RNA, 73 nt, Human
gugcccuaguucacaggguuaggaaucacuauauuauuuaguugguaauuuuccuuucuguggcuucuggcau

SEQ ID NO: 4112992 - RNA, 97 nt, Human
gugcccugucuagggcagggguauuuuuagagcuggcugcacacuguuuacaaggaagccagucccuugagcgugcccucgcccuacagggaaacac

SEQ ID NO: 4112993 - RNA, 57 nt, Human
gugcccuuauaaacaaggcuucagagagcuuuugccccuucugccaugugagggcac

SEQ ID NO: 4112994 - RNA, 67 nt, Human
gugcccuugaggacagcucccagggaagccaguuccccacugccagcuuuguccuccccagggguac

SEQ ID NO: 4112995 - RNA, 57 nt, Human
guucugagggagguucucugggaacauauuagguucugagggaaguucuuugggaac

SEQ ID NO: 4112996 - RNA, 89 nt, Human
guucugccaaauagacugaaaccaugcuagcaucaaaauguuagugauucugugcauuuugaucauggucucuguauuugcugaggaac

SEQ ID NO: 4112997 - RNA, 67 nt, Human
guucugccuuugauuguuuaaauguggggccuggaaacucagaauuuguucacaaucagggcagggc

SEQ ID NO: 4112998 - RNA, 68 nt, Human
guucugcuaugugaggauguaaccagaagucagcagucugugaccuggaagaugguccucaccagaac

SEQ ID NO: 4112999 - RNA, 72 nt, Human
guucugcuucuccacugugaggagacguggccccacggugggguugccaccucagcauggcaggagcccagc

SEQ ID NO: 4113000 - RNA, 64 nt, Human
guucugcuugauuuccccucgucuguuuuucuccaggaaguagaccagguugaccagguaggac

SEQ ID NO: 4113001 - RNA, 77 nt, Human
guucuggauguuucuagggaugguagguacaaacauaauguuuuagcacacuuucuuuagcgacaacaucauagaau

SEQ ID NO: 4113002 - RNA, 76 nt, Human
guucugggaagauucagacaugguccuugccccccagaguaaaggggggcaaggacucccugggucauucuaggau

SEQ ID NO: 4113003 - RNA, 93 nt, Human
guucugggaggcugaggguuagagagucaaagagcgagagagagcaacagccuauugagcaaugacuuucuggacuuucacuuguuaagguac

SEQ ID NO: 4113004 - RNA, 89 nt, Human
guucuggggauauaauucagaccuucgcuuuuaauuuccugaaaccaauuucagaauagcaaagcaagcuagauuauuuucugccaaac

SEQ ID NO: 4113005 - RNA, 90 nt, Human
guucugguggcacaccucugucugcccucacaugcacucuucccaacagaaguuaguagcagagagggcagccauguaagucaacagagc

SEQ ID NO: 4113006 - RNA, 66 nt, Human
guucuguagagagugcaacuuugcuguuagucaaacugcaaauguggcuuccuuucuagcagcugc

SEQ ID NO: 4113007 - RNA, 59 nt, Human
guucuguagugggaaauaguaaaaggauucuucacucccuuuucuuuuccccucagcac

SEQ ID NO: 4113008 - RNA, 76 nt, Human
guucugucacugaaccugaaccaauacucagauuggcaaaucuauuagagaaaugaugguuggguucuggcaagac

SEQ ID NO: 4113009 - RNA, 70 nt, Human
guucugucccucuagagaaccauaacuauuacagacuuugguaccaggagugguucuagagaaacagaau

SEQ ID NO: 4113010 - RNA, 76 nt, Human
guucugugcauagaguauauaggccuuuguguacacagaguacacagacauuuguauagcucugugcagaguagac

SEQ ID NO: 4113011 - RNA, 75 nt, Human
guucuuaaacugguagcaauuuaagggugguugauguauaaccuuuaaacaaauugaugcaagcuuuuuaagaac

SEQ ID NO: 4113012 - RNA, 72 nt, Human
guucuucaaagugcauaauaacucccaaguugcaguuuaagcagugggaaauuagaaugaauuacggagaau

SEQ ID NO: 4113013 - RNA, 56 nt, Human
guucuucaggcugagcagagaggcuccuguacccucucucucggaaucugaagagc

SEQ ID NO: 4113014 - RNA, 125 nt, Human
guucuucauccaguuuagggguggaccugaugucccugaguguauguggugaaccugaauuugccuuggguuuccucauauucauucaggagugucaguugccccuucacgcgacguuggagagc

SEQ ID NO: 4113015 - RNA, 74 nt, Human
uacaaauauucugggcuuuuauagguuuauuacacuguacuguugacugcuggaaacccagaaugguuucugua

SEQ ID NO: 4113016 - RNA, 59 nt, Human
uacaacaggaauuucaacuuugucuucaauuuauggcaggguuuagaaucucuuuugua

SEQ ID NO: 4113017 - RNA, 74 nt, Human
uacaacaugggccagaacuuugggccaggcuuagguggagccucugcucaguguguucaagggcucaucaugug

SEQ ID NO: 4113018 - RNA, 129 nt, Human
uacaagaagucaugauggaaagaaggagguuuggagaggggcugaguugggucggucuuuggcccuugccacaguccacucacucuuagucacucaaccuccauuuccaagcugcauucccuucuuaaa

SEQ ID NO: 4113019 - RNA, 77 nt, Human
uacaagcgcuuguugucuuucccauggauuguaguacucauggcagagaacaaagcaacaaguauuaaggcaaugua

SEQ ID NO: 4113020 - RNA, 130 nt, Human
uacaagcuuugggaguaauuauuaauuuuucauuuaacuaaaucaaggauauauagaggcauaagaauaauucuuggagacucuuguauauuuguuaaauagggaaauuaccuauccuaaauaguuugua

SEQ ID NO: 4113021 - RNA, 66 nt, Human
uacaagguugauucuggcaucuggauaaccaagaaagcugcuuuuaggugucuggacaacuuugua

SEQ ID NO: 4113022 - RNA, 71 nt, Human
uacaauaugugaacuuugguguguagcuuauuucacuuagcauaauguuuuuaagguucauccauguugua

SEQ ID NO: 4113023 - RNA, 71 nt, Human
uacaauauguggccuuuugugacuggcuuuuuucucuuagcauaaugucugcaaggcucauucuuguugua

SEQ ID NO: 4113024 - RNA, 57 nt, Human
uacaaucacccaaaaguggcucuggcuugggcagagagaaagguuugggugguugug

SEQ ID NO: 4113025 - RNA, 59 nt, Human
uacaaucuauuucuuggucuaacacugacaggcgguacaaugccaggaagaggaaugug

SEQ ID NO: 4113026 - RNA, 64 nt, Human
uacaauuggcauagguuaaacagcgguugcacaaaauuguuuacuaagaaccuggucaucugua

SEQ ID NO: 4113027 - RNA, 66 nt, Human
uacacaacacucacauacuaaauauuaucuacaaaacagguagcguuaucaauuugagugugugug

SEQ ID NO: 4113028 - RNA, 59 nt, Human
uacacaacugacaaccauucugauuagucagaauuagugccuguguugaucgguuggug

SEQ ID NO: 4113029 - RNA, 56 nt, Human
uacacaccugccugcagacucuggaacaugccaucauuuugccuugcagcugugug

SEQ ID NO: 4113030 - RNA, 86 nt, Human
uacacacuucuaaacacauagacguuugauaucagugauugaauuuuucacuuuugauccagauguuuuuguguuaauuaguugua

SEQ ID NO: 4113031 - RNA, 104 nt, Human
uacacauacacacugugauaaugaagcauaucagggauuauauccuucaaaauguguaggaucucuaguuuuauggaugcaucauauuccaagguguauaugua

SEQ ID NO: 4113032 - RNA, 62 nt, Human
uacacauuacauaauacuaucuaguaaauaugcccuagagauugugugugugugugugugug

SEQ ID NO: 4113033 - RNA, 72 nt, Human
uacacauuccugggcuuaaccccagacuuacugaugcagaaucucuggggauaagacccagguauuugugua

SEQ ID NO: 4113034 - RNA, 74 nt, Human
uacaccuaugacaaacccaggauguaacacuccuucuagauggguuuaaugguguuggcuuggguuuuauugua

SEQ ID NO: 4113035 - RNA, 64 nt, Human
uacacuggauuagcuguccuacagcuuauuguuggugaagcaaaggaaaacugauuauagugua

SEQ ID NO: 4113036 - RNA, 60 nt, Human
uacacuggccaaaugccuuuggcaccccaugcuugcugaagaucauaaaagggucaggua

SEQ ID NO: 4113037 - RNA, 66 nt, Human
uacacuucagggcccucacuugcauaggccccacucaugguccugagagggggcccuagaaaugug

SEQ ID NO: 4113038 - RNA, 60 nt, Human
uacagacauuuacuccacuccuucuagggcacagugcugcaggcaguguagagaugagua

SEQ ID NO: 4113039 - RNA, 78 nt, Human
uacagaguauuuuuaauaugguuaucugauuuauucacauggggauugauaugucugcuagguugaaaauaaguugua

SEQ ID NO: 4113040 - RNA, 69 nt, Human
uacagcaaagccaguuagcacaucauugcaaugcaugguuguuacagcaggaagcuacugugcucugua

SEQ ID NO: 4113041 - RNA, 61 nt, Human
uacagcagagaccuggcagccaccuggaacaaaucuuaccagcugccuguuucuguaagua

SEQ ID NO: 4113042 - RNA, 78 nt, Human
uacagcguccaguuugcuuucauuuuauauuuucuguuucuggaaaaugaugauuaaaaugagguagaaaggacugua

SEQ ID NO: 4113043 - RNA, 57 nt, Human
uacagcugcaaggguuucugggagaaaauauuuuugacugagcacauugcugcugug

SEQ ID NO: 4113044 - RNA, 58 nt, Human
uacagcuuagauuccccagagccaaauccaggccugacaagaggcagaaucagcugug

SEQ ID NO: 4113045 - RNA, 56 nt, Human
uacagcuuauccagcuugauaggcagcuagccugaaucuuggcuagaugggcugua

SEQ ID NO: 4113046 - RNA, 59 nt, Human
uacaggcuagggagagugacugcuuggguuuaaccucagagucgguuuacuuaucugua

SEQ ID NO: 4113047 - RNA, 80 nt, Human
uacaggcucacuuucucagucacacaaaauauauuucaagugcucaauauccacauguggcuagagaguagaguauugua

SEQ ID NO: 4113048 - RNA, 57 nt, Human
uacagggucacagaggaccugugcucaaggcccugcccacuuucucuguuccuugug

SEQ ID NO: 4113049 - RNA, 130 nt, Human
uacaggugagaaaaccaagguguagggaguuuuaacaacuuacucaagguugcauggcuaguaacugauagagauggaauuaaaagucaaguaauguaauucuaucacccugguuauuaaucaaaaugua

SEQ ID NO: 4113050 - RNA, 67 nt, Human
uacagguuacacuuuuaaaaguuauggagcaaaugaacguacaucugauacuugaguguacccugua

SEQ ID NO: 4113051 - RNA, 106 nt, Human
uacagguugggagcuuagagaauagucuaggcucagaguaucuaguuggggcucaucaucuucuggaagacguuugaagccaugggucuaguugaguuuaccugua

SEQ ID NO: 4113052 - RNA, 56 nt, Human
uacaguagaaucuuauagcccagagcauguuuugggaaauaugccucucugcugug

SEQ ID NO: 4113053 - RNA, 80 nt, Human
uacaguauauugaaaagaauuagagauauagcaugagaaauauuuuauuugaauccugguucuucaguuuaauaucugug

SEQ ID NO: 4113054 - RNA, 55 nt, Human
uacagucuuaagucucccuuuuucauguguaagacaagggagaauaaugauugua

SEQ ID NO: 4113055 - RNA, 108 nt, Human
uacagugcaauuuguucucguuuaugugggguuuacaugguuuugagacugaaagucacacauucuuaaagccugacuguggacuacaaacgaaucuuuugcucugua

SEQ ID NO: 4113056 - RNA, 61 nt, Human
uacagugcuuuuugguggagaaggggcaugugaucagugucucuguagagacagcacugug

SEQ ID NO: 4113057 - RNA, 55 nt, Human
uacaguggggagcucaggagagugggaaaaggaccaaucauagcagcucacugua

SEQ ID NO: 4113058 - RNA, 55 nt, Human
uacaguuagccugucuacucccuagaccaugagcuaguaaaggguagagacugua

SEQ ID NO: 4113059 - RNA, 68 nt, Human
uacaguuuauaggacaucugauaggaaaaauaacagcuuuuauuccuguacauuagcugugaauugug

SEQ ID NO: 4113060 - RNA, 116 nt, Human
uaaauucauagucuaaaugagcauuuuuggucuaauacaggcacuagucuugggcauuagacaugccuuuaauaguucuguguagcucaagaguuguucuuuagcuuaggacuuua

SEQ ID NO: 4113061 - RNA, 62 nt, Human
uaacaagucauuuuaucagcaggccugagcuucagccagcugucauuaagagugucuuguua

SEQ ID NO: 4113062 - RNA, 84 nt, Human
uaacaauuauaguguauguucagcuuauauggaacaguccaguuucaccucaucauaaagcugaauguagagggauaauuguug

SEQ ID NO: 4113063 - RNA, 81 nt, Human
uaacacagcaaucgggugauaugcaauuugccacuuguacuuucaauuuacagaccuauugcaugccacuuguguugguua

SEQ ID NO: 4113064 - RNA, 73 nt, Human
uaacacagugguugucagcaacaauaugagcuagcgcuuauaucauguucucugugugucaggcauuguuuua

SEQ ID NO: 4113065 - RNA, 94 nt, Human
uaacacuccauuuagucacccuugauaauguucuucuuuccagagguguagugagagaagcagcuuucaaggugauuucucugcauggagguua

SEQ ID NO: 4113066 - RNA, 57 nt, Human
uaacacugugucugccauauccuaaucuuuccaauagauggcagauaauuuguguua

SEQ ID NO: 4113067 - RNA, 123 nt, Human
uaacagagaagacaucacugaugauaccaacagagagaccagaaacaggccaucuggaagauggagauaguguguuuguuuguuuguuuguuuguuuguuugugguagagucucacucuguug

SEQ ID NO: 4113068 - RNA, 82 nt, Human
uaacagagucucacuauuuauggcaguuuugucucauaaagucacugugaacacugaaguagugaauacugaaacauuguua

SEQ ID NO: 4113069 - RNA, 69 nt, Human
uaacagauacuuucaucacucaccaggugauugucaugauuaacugcucagaggaaggaaugucuguug

SEQ ID NO: 4113070 - RNA, 78 nt, Human
uaacaguaaugaacaaaaacaaggccuguucucacagggauuagagagaauggggcuuguuuuuguucguuaccguua

SEQ ID NO: 4113071 - RNA, 66 nt, Human
uaacaguaaugugguguuggguuagaauauuggcacaguaucuggaauccagcaucaguucuguua

SEQ ID NO: 4113072 - RNA, 74 nt, Human
uaacagucacuuggaaauggagccccauguuugcuuagaaagacaauggagugggccaauuuuagugaagguug

SEQ ID NO: 4113073 - RNA, 113 nt, Human
uaacaguguuugggaaaauuugaaagauaagauguaaucagaaaaacacacuucaguaaaguuuauuugaacaucucuuguuuucuugugaauuuugaccucaaguuacuuua

SEQ ID NO: 4113074 - RNA, 67 nt, Human
uaacaucaaaguugguauauuugcaucucuguauaaagagaguuugcaaauaggaauuuagguguua

SEQ ID NO: 4113075 - RNA, 55 nt, Human
uaacaucugggcugcguccugacgucagggcuguggugaugaaguccagauguua

SEQ ID NO: 4113076 - RNA, 61 nt, Human
uaacaucuuaacuggauacuucugacucagagucucccaggagguugcagucaagauguug

SEQ ID NO: 4113077 - RNA, 58 nt, Human
uaacauguucaaugcaugucuguaucauuuucaagauuuacaugcauauggacaguug

SEQ ID NO: 4113078 - RNA, 56 nt, Human
uaacauguuugagugguacuuaaagacccaaucuuuggccaauuuagaacguguug

SEQ ID NO: 4113079 - RNA, 68 nt, Human
uaaccagacagaaacagcuagagagaaaggaagaaauaacucuguauuagcuggacuguucaagguug

SEQ ID NO: 4113080 - RNA, 129 nt, Human
uaaccagucgugaagauucuuguuaguggggcacuuaugaugugccacaugcuuuacgugaauuaucuccuuuaacuuucacaguggcccaacaauacagugccuauuaucauccuugcuucaugaaga

SEQ ID NO: 4113081 - RNA, 58 nt, Human
uaaccauagccaucaauugucugauuuuauaaucuauuuacugucauggcuaugguug

SEQ ID NO: 4113082 - RNA, 73 nt, Human
uaaccuacaaggguaacucguuuugaugucuuucgaaagaaaggugucuggccauuugcccauugugauguug

SEQ ID NO: 4113083 - RNA, 78 nt, Human
uaacgaugauauaucuacacauuauauggcuggcuaucuuuaguuuguuuuuauauccuguggagugugacaucugug

SEQ ID NO: 4113084 - RNA, 78 nt, Human
uaacgguaacgaacaaaaacaagccccauucucucuaaucccugugagaacaggccuuguuuuuguucauuacuguua

SEQ ID NO: 4113085 - RNA, 92 nt, Human
uaacuaaauugccuaaaguuacauagcuaguagauggggaagcugagauuuaauuucagaaaaccugacucuagaacugguaguuguaguua

SEQ ID NO: 4113086 - RNA, 73 nt, Human
uaacuauaguugcagcuauuuucucauuaaggauccccguaaaggaaauuguuggugaaaaaugggugaguua

SEQ ID NO: 4113087 - RNA, 71 nt, Human
uaacuauaguuuguauuuggcuuugaauguuguguuuauaacuccaggccugacuauaaauguaucaguua

SEQ ID NO: 4113088 - RNA, 97 nt, Human
uaacucagccuuucaauuucucagcaggcagaaaucugcagaacuuuucugaagguuacuucugcucagaaggcuuuaaaauugaaaagcagaauug

SEQ ID NO: 4113089 - RNA, 57 nt, Human
uaacuccacaccccucuuggugcuggucaugauuaguuuaggagaggagugggguug

SEQ ID NO: 4113090 - RNA, 86 nt, Human
guuguacccacaugcaagucuuaauaguuuaggguuaauaaaauguuucuaaaaaaaugaguugagauucugauacaugcuacaac

SEQ ID NO: 4113091 - RNA, 65 nt, Human
guuguagaaauacuuguaauuagcuaaauaaaucucaaauguuuucuacaggcaguuucuacaau

SEQ ID NO: 4113092 - RNA, 69 nt, Human
guuguaguugaagcacauuagaugugucuucguguucugcacucugaagacaucguguggacuaacagc

SEQ ID NO: 4113093 - RNA, 57 nt, Human
guuguauauguagagaauggucuuuuuaaagauuauauuuuaaaaugcauaugcagc

SEQ ID NO: 4113094 - RNA, 99 nt, Human
guuguauuuacuugcuagucacagcuuccauuagaaugagauagacaguguuaucacacaaagcugauggaaguucagugcaaagcauacagaugugac

SEQ ID NO: 4113095 - RNA, 62 nt, Human
guuguccagccacccuggaggcacgcggcgucaggccugaacugcacaguggcuggauuuac

SEQ ID NO: 4113096 - RNA, 67 nt, Human
guuguccuccacauggccucuccacgagcccaaccuagccacacggagaagccaugugguggagaac

SEQ ID NO: 4113097 - RNA, 74 nt, Human
guugucuaacuggugaguugguugaguggaagcugguugagaacuuuuacugcaaaccauuuacaguagaccac

SEQ ID NO: 4113098 - RNA, 60 nt, Human
guugucuucccuccaccaccuguaccagagauguuggauauguuggaggugaaggugugc

SEQ ID NO: 4113099 - RNA, 62 nt, Human
guugugaauagugccgcaauaaacacaugugcaugugucuuuauagcagcaugauuuauaau

SEQ ID NO: 4113100 - RNA, 64 nt, Human
guugugaauagugccgcaauaaacauacgugugcgugugucauuauagcagcaugauuuauaau

SEQ ID NO: 4113101 - RNA, 64 nt, Human
guugugaauagugccgcaauaaacauaugugugcaugugucuuuauaguagcaugauuuauaau

SEQ ID NO: 4113102 - RNA, 83 nt, Human
guugugaaucagggcuggguccugcucucccuaagaucacagucuaaugagggugaaggcccagaacuaccugaugacacagc

SEQ ID NO: 4113103 - RNA, 68 nt, Human
guugugaauuaugaaagacauuucuguuggguuacugaaugucccuugggguuuuuuucauuuauaac

SEQ ID NO: 4113104 - RNA, 65 nt, Human
guugugcaccacuguugauugacugggcccuuugcuuguguacagcacucuacaguguguacaac

SEQ ID NO: 4113105 - RNA, 95 nt, Human
guugugcaugcucagaagacagagcacuucucuugucagucacaauggcuuggguaggacuaagugcuguucuguguguucuuggagugugcagc

SEQ ID NO: 4113106 - RNA, 60 nt, Human
guuguggaaugauuaauggucguuggugaaguaaccaucagcuucauugucuucuauggc

SEQ ID NO: 4113107 - RNA, 77 nt, Human
guuguggcaaugacuaguuaauaagugcucgguaaaugcucauugaaaugagacuaauugauugauaggugccuaau

SEQ ID NO: 4113108 - RNA, 62 nt, Human
guuguggugucaaagcaaggauuaaauguauucauacaucuucaaagugcuuugcaagcggc

SEQ ID NO: 4113109 - RNA, 120 nt, Human
guugugguuauuguuauuauaguugauauauuuaugguugauuuuccacaaauauuuagauauucugguuaucuguucuuagcuauagaugugaauccuagccugaaugaaaaucacugc

SEQ ID NO: 4113110 - RNA, 72 nt, Human
guuguguaaaaccugugaucuuuucuucuauagcauuucaugagaauuaaaggucuuaagguuaagcaggac

SEQ ID NO: 4113111 - RNA, 76 nt, Human
guugugugcacagcaucugcauaaugccuucccaauacaagcauugggcugggccucugggauguguguccaggac

SEQ ID NO: 4113112 - RNA, 68 nt, Human
guugugugugugugugugaaacucuaaagccccuggaauuuaggaaacagugcauauauagucauaac

SEQ ID NO: 4113113 - RNA, 64 nt, Human
guuguguugccaggaagaugacacugccauuugacaucccaauaauuuccuugguaacauaugc

SEQ ID NO: 4113114 - RNA, 72 nt, Human
guuguguuuaucuuugagagggaaaauuaucucuggucucuaccuggauaauuugauaccucaaucagcaau

SEQ ID NO: 4113115 - RNA, 80 nt, Human
guuguuaaaacugaaauguuccggguaaggagaaaugacaaaugucuuucugaacacagcucuggacacacuuuaauaac

SEQ ID NO: 4113116 - RNA, 80 nt, Human
guuguugauguuaaugugucuuguuucguaaaggaagacuuggccuuuauuuaccaaaugagacuauuguuaugaacaau

SEQ ID NO: 4113117 - RNA, 59 nt, Human
guuguuggccaagacucauguccuaugucaaaagcaugaacauuugguuuggcagcagc

SEQ ID NO: 4113118 - RNA, 74 nt, Human
guuguugguagaauucaguuccuugaggguauaggacugagguucuguuuccuuacuagcugucagccaagggc

SEQ ID NO: 4113119 - RNA, 114 nt, Human
guuguuguauaaccuuuugcuucuuuuuccucaucugucaaaugggcauaaggauagugucuaccucaugaaguugcaaugaggaugaaaagugugaaaaguauuuauaauagc

SEQ ID NO: 4113120 - RNA, 65 nt, Human
guuguuuauauuuuaaaaaaucuuacauagacacacaccaguaagacaaauggaguaugagcaac

SEQ ID NO: 4113121 - RNA, 58 nt, Human
guuguuugcucacucccuuuguuuaacuagauagcuuaaaaggaggcaggugaacagc

SEQ ID NO: 4113122 - RNA, 70 nt, Human
guuguuuucagggugucauucacaggcauuaacuuauguugugauauuuucugcaccuugaccucacaac

SEQ ID NO: 4113123 - RNA, 66 nt, Human
guuguuuuuguuuaaaauccuggauggcaggauaaauuucugucauuuucacacauaaauagcaac

SEQ ID NO: 4113124 - RNA, 57 nt, Human
uaagccuaaugcccaggacacagaugcccaggagacagaugcugggcauuaggcuua

SEQ ID NO: 4113125 - RNA, 63 nt, Human
uaagcuccuccuccugagggccguaacgauucacuaaaugcccaucauggaucagguaguuua

SEQ ID NO: 4113126 - RNA, 58 nt, Human
uaagcuuaaauaggcuauauauauuuuguuaggaagaguguuuccuguuuauggcuug

SEQ ID NO: 4113127 - RNA, 76 nt, Human
uaagcuugcccugcuaaccuugguuccaccucuggucaugcuauuucuugcugugggaccuuuggcaggucacuua

SEQ ID NO: 4113128 - RNA, 71 nt, Human
uaagcuuguuggggaauuuagugcugcuuuuagaugaacaaaguggauucugaaauucucguauuaguuua

SEQ ID NO: 4113129 - RNA, 79 nt, Human
uaaggaaagaggaggcaggaagucuaugggaagauccuggaaaaucucuugaaauggaugucacugucucuggguuuug

SEQ ID NO: 4113130 - RNA, 61 nt, Human
uaaggaacucaagagaggagcguuuccucagaaugcuuucuuuagcuccugagucuccuua

SEQ ID NO: 4113131 - RNA, 111 nt, Human
uaaggaauuuucaaagacaaggauguauucagaauguacugauagaacaguaauaacuaauauguauaguguucuuacuaaguaccugaaauauuuuuguaaaacuucuua

SEQ ID NO: 4113132 - RNA, 80 nt, Human
uaaggauaacaaaacccauuucagucucaauuuaaguuuaauucccagguggaacuugaaaugaggcuguaaugaacuug

SEQ ID NO: 4113133 - RNA, 86 nt, Human
uaaggaucauguagugcauucuccaucaucuagggccauucugaggacuguaaugauacugaagggugacaugacaugcaucuuua

SEQ ID NO: 4113134 - RNA, 89 nt, Human
uaaggaugaguccauugucaacugaaaaccaagacacgccaccuuuagucugucaguucaucaguuggcuaaaauguauuuauuacuug

SEQ ID NO: 4113135 - RNA, 57 nt, Human
uaaggcaagagcagggucuuugggaaugaaugcacuuuaggcaccucucuugccuua

SEQ ID NO: 4113136 - RNA, 62 nt, Human
uaaggcagcugagcuucuaacagcucauauggagucuagaaagcccuguguucacugccuug

SEQ ID NO: 4113137 - RNA, 66 nt, Human
uaaggcauaaggccagaggcuaguuuaggcaagaaggaauaaacuagccucuggccuuauaccuua

SEQ ID NO: 4113138 - RNA, 56 nt, Human
uaaggcaugaguuuauuucauauacuuuccaaguggugaauuaauuauaugccuua

SEQ ID NO: 4113139 - RNA, 56 nt, Human
uaagggcaugagaagcuugaaaggacacuguccaggcacgguggcucaugccugua

SEQ ID NO: 4113140 - RNA, 81 nt, Human
uaagggcguuccuguuguucgccugcgauggauggcaucuugagcucacaucuagcguuaggccgagaaauggggcccuua

SEQ ID NO: 4113141 - RNA, 73 nt, Human
uaaggugcacuuuggcugggcaucucucuccaugugguaacucauuauagagcagucuagaccaggcuccuua

SEQ ID NO: 4113142 - RNA, 77 nt, Human
uaagguguaucuagcauuguguaguuauguaaugaguuauauucaguauucugcugcauaauacuuuuaaugucuua

SEQ ID NO: 4113143 - RNA, 77 nt, Human
uaaggugucuggcacacagagaagacacuugaaaauuuucugugucugaauaacucuguguuugcuaagaucuuuua

SEQ ID NO: 4113144 - RNA, 62 nt, Human
uaaguacccugcugauuccaagggcagcauuucagcagcagcccuggcaggcggguuacuua

SEQ ID NO: 4113145 - RNA, 103 nt, Human
uaaguaccuacugagugaaugagcggccuugaaauuguuuucugaggcuggggaacucuugccaggaauuucaagagccacugcuuuuacacuuggccacuua

SEQ ID NO: 4113146 - RNA, 68 nt, Human
uaaguagaaauuaucauccuuggagauguaccacaaggaauauugacaagaaagauauuuuuaacuug

SEQ ID NO: 4113147 - RNA, 56 nt, Human
uaaguagaauaaaacagcacaguauucguuuuucugugacuggcuuauuucacuua

SEQ ID NO: 4113148 - RNA, 59 nt, Human
uaaguaguagggccagaauuugaaacuaggccugucugacuuuugugcccaugcucuua

SEQ ID NO: 4113149 - RNA, 73 nt, Human
uaaguauaccugcuuugauagguuguggagaagauucaaugaguaacucuagaaugaauuagcgcagggcuug

SEQ ID NO: 4113150 - RNA, 66 nt, Human
uaaguauuuauuaucucuccuguacuuccaguucucuaaccuggacuaaaggagggaaauagcuug

SEQ ID NO: 4113151 - RNA, 114 nt, Human
uaagucacaaaauauuaguuaaauauuuuugcucaagguucaguugcagagacuggaaugcucuugaaugaauuugagcagagauagauuuauuacagcauauuuaaagacuua

SEQ ID NO: 4113152 - RNA, 130 nt, Human
uaaguccugcucucaucuggcccuaaagaagccaucagcaggaggugacagcgaccguaauucuguuuuuaugauuacugagcaacggucauuucaggcugaguggugcugagugauggguggugauuua

SEQ ID NO: 4113153 - RNA, 60 nt, Human
uaagugaaggaaguguguuuacaaaugucauuuuugucugauuucacuuaccuucauuua

SEQ ID NO: 4113154 - RNA, 57 nt, Human
uaagugaauccuugagaagaaagcaaagguuaccuucuuuguucuuguggguacuua

SEQ ID NO: 4113155 - RNA, 63 nt, Human
uaagugaauuguccgaggacacacagcaaauaagacagcuugauuccucugaagguucuuuua

SEQ ID NO: 4113156 - RNA, 56 nt, Human
uaagugagaaagacauuaacugcuuaacugauagcagcugguauuuccuucacuua

SEQ ID NO: 4113157 - RNA, 86 nt, Human
uaagugauuuccauggguagcccugguugagaaucccugcucuacucuucugccacaggccuccacuggggcuucccagguccuug

SEQ ID NO: 4113158 - RNA, 75 nt, Human
uaagugauuugaagcagugccugauauucaugcaagaagcuagaaaugucaguugcugcuugagguaaacauuug

SEQ ID NO: 4113159 - RNA, 93 nt, Human
uaaguggaccagauauaguucuuagggucuguaauuuuaaugcuuaaaagaggaugggaaucagagucccaagaucuguauauggcacaguua

SEQ ID NO: 4113160 - RNA, 85 nt, Human
uaaguggauuaguauaaagggagaaaaaguuccacuuuuaaagaaaaguggaaaacaaagcucucauuauuaccaaaugcauuug

SEQ ID NO: 4113161 - RNA, 76 nt, Human
uaaguguauugauggcuuuuuggcagagcuuuauuauugugaaucucucacuugaaaagcguauuuccgacauuug

SEQ ID NO: 4113162 - RNA, 88 nt, Human
uaagugugaugugguagauguuaacuuuuggaaaaccgugguuuugaaaaggucaaauaguugacauuaacuugacucagaacauuua

SEQ ID NO: 4113163 - RNA, 60 nt, Human
uaaguguuugagggaggauauuaguuucauuucugacuuuuauucaacuuuaaaaacuua

SEQ ID NO: 4113164 - RNA, 85 nt, Human
uaaguuaaaacauguaauucugcuuaagaucaggucucaaauagcuaagaccaaguucuggaguuaguuauaaugguuuaucuua

SEQ ID NO: 4113165 - RNA, 76 nt, Human
gugcucuguagcaaguuauucaauaaaugugaguuaaguuggugaaacauuuaauggaaaacauggugcuaaguau

SEQ ID NO: 4113166 - RNA, 84 nt, Human
gugcugaauauucuagaugaaaguguuuaaguuuauguugcaugacagcagaggcucuuuaaugcuuagcaucuagugcagugc

SEQ ID NO: 4113167 - RNA, 108 nt, Human
gugcugaggcucaggcuguggggucguggaagggaugcaggaaagaagguucuagaccagggcuugacacuucacucucuggggccacaugggcugaggccugggcau

SEQ ID NO: 4113168 - RNA, 57 nt, Human
gugcugagucuccuacuauacguuucacgggcucccugugauuuagggauccggcac

SEQ ID NO: 4113169 - RNA, 65 nt, Human
gugcugaugucaggacagaguccacaagaaugaaguggccuggcucuggcagcuugugucagcac

SEQ ID NO: 4113170 - RNA, 65 nt, Human
gugcugccucagacuugauaauuggguucaucaacagagccuugaaaaguuuggguagagaccac

SEQ ID NO: 4113171 - RNA, 59 nt, Human
gugcugcucugcuggagggaaagagaauucugggcugaauuuaacagucauggcgguau

SEQ ID NO: 4113172 - RNA, 66 nt, Human
gugcugcugccgcggccgcccugcucguggaagggaggaggaggaauguggaagguggcggcgcgc

SEQ ID NO: 4113173 - RNA, 59 nt, Human
gugcuggaagagaauacugguggauauaaucuuuucauggggaauaauuuucuaagcau

SEQ ID NO: 4113174 - RNA, 78 nt, Human
gugcuggagaaguuagaaauaagggcucuccagaccagccugaccaaccuggagaaaccuugucucuacuaaauacac

SEQ ID NO: 4113175 - RNA, 55 nt, Human
gugcuggcccggcugccuggucauuggggaaugacauagaggccaaggcuaaugc

SEQ ID NO: 4113176 - RNA, 56 nt, Human
gugcuggcuggggcaucaggcagcccuggagaggagguggccauccggcccagcac

SEQ ID NO: 4113177 - RNA, 81 nt, Human
gugcuggggaggggcuguugccuagcaguaggccgcggggucccugcaggcucccuaagucagcagcccccucacccacac

SEQ ID NO: 4113178 - RNA, 62 nt, Human
gugcugggucaggcaucugcagaacugguuccuauucuccuuucugauggucugcuuagcuc

SEQ ID NO: 4113179 - RNA, 86 nt, Human
gugcugggugaacacauaggagucuggccccauacagagggucugcagauguagacugugggauggcugacuucacgcuuaugcac

SEQ ID NO: 4113180 - RNA, 61 nt, Human
gugcugguggagaaaguggaggugccuagcagaaauuuaggguagcagcacccaccagggc

SEQ ID NO: 4113181 - RNA, 63 nt, Human
gugcugguguuggagcaaaugcaggaggccuuuuuucacugcuugguugcaacauugcagggc

SEQ ID NO: 4113182 - RNA, 64 nt, Human
gugcuguaucagaaucugcucuggucccugagagaaaccagagagauuuucugagagauggcau

SEQ ID NO: 4113183 - RNA, 98 nt, Human
gugcugucucacuuccggaggcggcccagggaggcuggccgcccugcggggccucgccugcucccaguuggcgccuccagacccuaaggggacagggc

SEQ ID NO: 4113184 - RNA, 65 nt, Human
gugcugugaugagauguacauggacucuauaaaccugagugauucccguauaucugcacauauac

SEQ ID NO: 4113185 - RNA, 72 nt, Human
gugcuuaaaaacuaagugcucuaacagucaaaaaagguuagcuauuacuuugggcauuaguaaguuaagcau

SEQ ID NO: 4113186 - RNA, 79 nt, Human
gugcuuaaugugcuucugcuuuucucugucugagugguccuuugacagcuuugauggucaaggcagaggcagaagguac

SEQ ID NO: 4113187 - RNA, 124 nt, Human
gugcuuaggaucugugcaggggauguggagccagacugccuggguucaaguccuguugcuaccauguauuagcugugcagccuuggguaacugacuucaccucucuguaccucaaguuccucac

SEQ ID NO: 4113188 - RNA, 107 nt, Human
gugcuucauuuucccaguugauacacaucaaccuggcuuuggccauaaauauggaauaugcugauuggccaggccuaggucaugugccuucccuuggaacugaggac

SEQ ID NO: 4113189 - RNA, 70 nt, Human
guuguuuuuugucuuucaaguuuugcuccagggcagaguucccaaaaguagagcucaaggcaaaaauaau

SEQ ID NO: 4113190 - RNA, 75 nt, Human
guuuaaaaugccugccauuuagaagucuugcaacaagaaacucuuacaagcugcuaaugguagagucaccagaac

SEQ ID NO: 4113191 - RNA, 91 nt, Human
guuuaacugcuuugcugagucuugccugugcugucucccagccaccuaucauagugccugacauaugguaagagcucaacaaauguuaaau

SEQ ID NO: 4113192 - RNA, 58 nt, Human
guuuaacuuugggcaagugagcaaaucuccuuaaugcucacauuucucauggguaaau

SEQ ID NO: 4113193 - RNA, 68 nt, Human
guuuaauacuuuucaagcugguuuuuggacagucuacauuuggacagaagcuagcaggaaaguuuugc

SEQ ID NO: 4113194 - RNA, 77 nt, Human
guuuaaugggugaaauuuaaaaacauaauguauaggcaaaaagcuaaaacacugguugguugaauuuacuauuaaac

SEQ ID NO: 4113195 - RNA, 58 nt, Human
guuuaauuuccugaugggggugcugguuacauguguucucucuacaggaauuuauuac

SEQ ID NO: 4113196 - RNA, 72 nt, Human
guuuaauuuuagguugucaagccagccuuaugcaucacaacuuuuaggccucuugucuugcuuagaauagac

SEQ ID NO: 4113197 - RNA, 63 nt, Human
guuuacaaaaugaccaccgcucaugugauccaagcuggucuacagauggagguuauuaugaac

SEQ ID NO: 4113198 - RNA, 130 nt, Human
guuuacagaaacauuacacagacucugaugucagucaugauguuucagccucugcccuuuuccuguaucaacccugauggauaauagggcguggguucugucuguuaucagggugugguccccugugaau

SEQ ID NO: 4113199 - RNA, 86 nt, Human
guuuacagaugaggaaagcaaggcuuggagagaaugccauacaguuauuaguguggcggagccggccuuugcaccuggcuguugac

SEQ ID NO: 4113200 - RNA, 63 nt, Human
guuuacgcagguccuuagcaaucaucauugaagcauugaugagugcaacagaucagcaugggc

SEQ ID NO: 4113201 - RNA, 62 nt, Human
guuuacuacaauuacucagcucugcuguuuauacugcagacaaagagugugguuguguguuc

SEQ ID NO: 4113202 - RNA, 85 nt, Human
guuuacucaccagaugauacauaguugugugugcauguuguguguagacauguguucauguauguauacauauguguuaguaaau

SEQ ID NO: 4113203 - RNA, 75 nt, Human
guuuagaaggcgagccgcuaagccgggugggagacauugguggcuggcaguaggcuaguggcagcugacuugaau

SEQ ID NO: 4113204 - RNA, 68 nt, Human
guuuagacagucugggcacacaugaaaaguauaauuacauuuuuacccugaggccuagcuguaaagau

SEQ ID NO: 4113205 - RNA, 59 nt, Human
guuuagccgccugcguccccuuucccggacugggguagggugacuuaggcuggcaaagc

SEQ ID NO: 4113206 - RNA, 77 nt, Human
guuuagguuguuaaggaggccaauaagaauacuuaagugcacacugaaguuguccuuggcucuuugauaaauacaac

SEQ ID NO: 4113207 - RNA, 75 nt, Human
guuuaguacuaccauuucacagaugagaaaauugaggcuuugaaagccugaauaauuugugaaaagauacaaagc

SEQ ID NO: 4113208 - RNA, 82 nt, Human
guuuagucuuggucuugugugaaaucauaugcuguauguguguuuauacauauauuuucacacaugguuuuuccuuuugaac

SEQ ID NO: 4113209 - RNA, 96 nt, Human
guuuaguuggagauauugcgagaguacaguucuaccuaacggacacagcuccgggugggugugccauauuccauuucguacgagucucuuagaaac

SEQ ID NO: 4113210 - RNA, 99 nt, Human
guuuauaguuuucagaauuuuugcucaguuuuggaauaguaccgauuaccaaagguaaaccugacccuuaaugagcaaguaaauuuguaggcuguauac

SEQ ID NO: 4113211 - RNA, 124 nt, Human
guuuauaugcugauaucaacucugcccugguugauuuuuauucuaggguauuugcagaguucccacuuucaaaugcacguagagaaaauaauccccaucaggacaucuggcauuguuuuuaaac

SEQ ID NO: 4113212 - RNA, 77 nt, Human
guuuaucaaacccuagcguagugcuggcacauggcaauucucagugugagcacuggcugggaaagugacugaugaac

SEQ ID NO: 4113213 - RNA, 78 nt, Human
guuuaucaguaaccuuuagcacaguugaauguuuauuuugcuaauuuagcuucaggugcuaugguuaucauuauaaac

SEQ ID NO: 4113214 - RNA, 91 nt, Human
guuuaugaaaagaggccugguucuggguguagauggaaguuuggccugauuaauugguccuuaccggcagcccagagguuucuucaucaac

SEQ ID NO: 4113215 - RNA, 76 nt, Human
guuuaugaaggucugagaacuaccuauaggcuuuguuacauucuucacauuuguaggauuucucagcaguaugaau

SEQ ID NO: 4113216 - RNA, 55 nt, Human
guuuaugcacuugguuugugucaauuuuccaugacacacaucacguugcaaaaac

SEQ ID NO: 4113217 - RNA, 99 nt, Human
guuuauugaccauauuuucuugaaagagcccugguugaaaauaacuguccccaguacaacaguuguuaucagaaaggucucccuuugaauaugauaaac

SEQ ID NO: 4113218 - RNA, 105 nt, Human
guuuauugcugugaucgcuuuuuugaagaaauuacugcucuugaagaaacaaacacgcacugguuuauuuaagaacaagcagcgcagaguuacagaauuauugac

SEQ ID NO: 4113219 - RNA, 84 nt, Human
guuucaaaaagaacaauugccccaaagcuuggauauagccacagaacuuauuccgagucacaggggcaauuuuuuauugcuuac

SEQ ID NO: 4113220 - RNA, 92 nt, Human
guuucaaucaauguuauauaauguucagugaccuggaacccugaggcuaaguuuugucccagauacuggacauagauauauuguuuaaagac

SEQ ID NO: 4113221 - RNA, 67 nt, Human
guuucacacauccugcacauagcugaaaaaauuagcagcuauguaacccauggggauguauugaaac

SEQ ID NO: 4113222 - RNA, 62 nt, Human
guuucacacugucccggguggaaaaugcaaacccuguggauuuucacccucucaguguugac

SEQ ID NO: 4113223 - RNA, 79 nt, Human
guuucacaggcucauuucucacuccagcaacuuucuaacacuuccuaacgagaaagcuggagccugaggacuguggggc

SEQ ID NO: 4113224 - RNA, 57 nt, Human
guuucaccauccuuggcuuuccuguuacuccacugaggaaagaucugggauugagac

SEQ ID NO: 4113225 - RNA, 70 nt, Human
guuucacuuuacuuguccuguuagccaugacuuuuggucuugaaagucacauauaacaagggcaugaaac

SEQ ID NO: 4113226 - RNA, 58 nt, Human
guuucagaaauguucuccugcucagugaugugcugggugaaugaguauuuuuugaaau

SEQ ID NO: 4113227 - RNA, 57 nt, Human
guuucagauucuuccucaggaacaaauguuaauuuuaugggagaagaacacuggaac

SEQ ID NO: 4113228 - RNA, 59 nt, Human
guuucagcaucuggcaagcaaucccucucagagcccugagcuggcagaugucuugagau

SEQ ID NO: 4113229 - RNA, 126 nt, Human
guuucagcuucuccuuccaacuugucugaaauuuaaacuguugauuuuaugaaguugguguguuuauuuuacuucuucacccugcauuaauaguuugauagaaugaccaacuggggaagcagagac

SEQ ID NO: 4113230 - RNA, 56 nt, Human
guuucaggcccaugggguguggggagagguggucccagaggagcagggcgugagau

SEQ ID NO: 4113231 - RNA, 119 nt, Human
guuucaguuagauuacuuuguggcauagacaacuugguaacuuuuuaauugcuuaucucaccaaaagaaguuuaaaagggguauuaaguccauuuauugccauuacaucuauagcaaac

SEQ ID NO: 4113232 - RNA, 88 nt, Human
guuucauacuugaggagaaauuauccuugguguguucgcuuuauuuaugaugaaucauacaaggacaauuucuuuuugaguaucaaau

SEQ ID NO: 4113233 - RNA, 55 nt, Human
guuucauuagcugugcaacaguuagggccuuuauguuuacuccagcugauggaac

SEQ ID NO: 4113234 - RNA, 70 nt, Human
guuuccaacccugggcucccgacuuacgcccuaugugagugugaggaguaggcugagggugugguugaac

SEQ ID NO: 4113235 - RNA, 76 nt, Human
guuuccaagcuccugaguagcuuuacucaucaaguagaggcauuuugguacaagcagacucagcagagguggaagc

SEQ ID NO: 4113236 - RNA, 57 nt, Human
guuuccagagugagggcacuugcuccucagcacaggcaaagcccuuucaauggaaau

SEQ ID NO: 4113237 - RNA, 57 nt, Human
guuuccagccuccuggguaaaggagcagucuccucccuugcuugggacucuggacgc

SEQ ID NO: 4113238 - RNA, 59 nt, Human
guuuccaggcugggcagcgagcagccccuuuagaaaggaccucuuguucuuagugaaac

SEQ ID NO: 4113239 - RNA, 58 nt, Human
guggguuggguuuuugaagggaagccagucauggaagcuuuucuagucccagccccgc

SEQ ID NO: 4113240 - RNA, 56 nt, Human
guggguuuuuuuuccaucucugauaggugaagucagagaagggggaaagaucucac

SEQ ID NO: 4113241 - RNA, 91 nt, Human
gugguaaaaauuuacagaauguugaauuugggugguguuuauaaucuauaacucuaacaagucccaaucuaauauuuuauaagaagacuac

SEQ ID NO: 4113242 - RNA, 64 nt, Human
gugguaaggaggcagaugcuuggcuguagggagaauccucagaguaagcacuugccuuuaucac

SEQ ID NO: 4113243 - RNA, 85 nt, Human
gugguaaggccaggcucucacuauccuccuagcuguucuucccuccuagcccaggaggagggagagguuaauugguuuuacucac

SEQ ID NO: 4113244 - RNA, 75 nt, Human
gugguacacguaaacacucugugaggcauguaauggagccagcauguuauguggagugccguguaaccaacccac

SEQ ID NO: 4113245 - RNA, 71 nt, Human
gugguaccagcugcaugcagauguagccagcaagauaaggcaguucaaugucugcggcuagcuggaaacau

SEQ ID NO: 4113246 - RNA, 69 nt, Human
gugguaccaggguuggcaagcaaggcuucagcgaauagcucaaaggcuggcgauguguagcccugccac

SEQ ID NO: 4113247 - RNA, 67 nt, Human
gugguacucuaagagccaagacugucacucagguuuccugacucccaucuugcagcuccuguaccau

SEQ ID NO: 4113248 - RNA, 66 nt, Human
gugguagagucccagcuggugacuguuuuucaggcauuuacgguagccaccucaaucuucuagcgc

SEQ ID NO: 4113249 - RNA, 81 nt, Human
gugguagcaaaauaguuuauauagcuuaaaauacugaaaauaauguauauguagaugucauauaaauuguagugcugacac

SEQ ID NO: 4113250 - RNA, 65 nt, Human
gugguaugaaggaggccggcagccagguuugcacuuucacuuguugccuuugcaucuucauccau

SEQ ID NO: 4113251 - RNA, 90 nt, Human
gugguaugcaaaugacugguauguuuuauaauaaaugguauccuggauuuagugaaauuaggcaaauuaguuauaaggcauagaauucac

SEQ ID NO: 4113252 - RNA, 65 nt, Human
gugguauuauuuuacagagaugcuuagaauaccguuucuuuaucugugguaaauaacauugccau

SEQ ID NO: 4113253 - RNA, 65 nt, Human
gugguauuuaugacagugcccgucucugggcagcugggcuuugggggcgugucauggagggccac

SEQ ID NO: 4113254 - RNA, 55 nt, Human
guggucacuugaaauauuuggcagcuugagcucucaaauaaggagucaugaccau

SEQ ID NO: 4113255 - RNA, 58 nt, Human
guggucagugacauggcuccuugaacccccuuccaguccagaggccucucuuggccac

SEQ ID NO: 4113256 - RNA, 116 nt, Human
guggucagugugggagcuuggaggggccaugcacuuccggagaagaccaccgacucguggcuuugguggaggggugcaggcagauuuaguuaggcucucccccaucccugacacac

SEQ ID NO: 4113257 - RNA, 60 nt, Human
guggucaugugcucuuucauagugaccaugccaccgugaacucuccaggcaaaugaucac

SEQ ID NO: 4113258 - RNA, 56 nt, Human
guggucccugguguuuugaugcagagaucguucauaguaaacaggcaagggaccac

SEQ ID NO: 4113259 - RNA, 57 nt, Human
guggucccuguguggagaagcuguggggucaagaugcccgggcuaggcaaggaccac

SEQ ID NO: 4113260 - RNA, 66 nt, Human
gugguccgugagacaggaaggcacgggucagaggcugacagauggucuuucugcugcacggacugc

SEQ ID NO: 4113261 - RNA, 76 nt, Human
gugguccucugagcacgccaggcacgagugugcagggagcugcugcaaaugccucggugugcgggugagcuuccgc

SEQ ID NO: 4113262 - RNA, 68 nt, Human
gugguccugaugucuucuauaaugacucgauguuuuuaggaaucagaguccuggacacagagacacau

SEQ ID NO: 4113263 - RNA, 65 nt, Human
gugguccuuucuugcuaagaguuuauguuuuguaccucauucaugcgcaugaguaagaaaaucac

SEQ ID NO: 4113264 - RNA, 75 nt, Human
guggucugaauuacuggacccuguuucccuaggucccagccccugggaggucagggaagguccggcugcagccau

SEQ ID NO: 4113265 - RNA, 87 nt, Human
guggucuguuauuggaggaggcauuggaggauucuccugagugaaaacagccagguuauaaucuucauguccucucuaauucaccau

SEQ ID NO: 4113266 - RNA, 59 nt, Human
guggugaagccccaucucugcuaaaaauacaaaaauuagccaggugcaguggcacacac

SEQ ID NO: 4113267 - RNA, 56 nt, Human
guggugacgcauggaaugugccuuaaacugcuuuggcaccagucaugagucaauac

SEQ ID NO: 4113268 - RNA, 64 nt, Human
guggugacucacagaaucucugauaagucuggaaauccaggcuuggagguucuguagccagcac

SEQ ID NO: 4113269 - RNA, 65 nt, Human
guggugagauggaguuggugucuuuugguuuuauuaaccuagggacuauuuacccaucucacuau

SEQ ID NO: 4113270 - RNA, 57 nt, Human
guggugaggaggugacuggaaggguggagugcacuugaccagcccauaguccaucac

SEQ ID NO: 4113271 - RNA, 55 nt, Human
guggugaguucaggcuggggugucauauuguaaccccugguuccacugucaccgc

SEQ ID NO: 4113272 - RNA, 108 nt, Human
guggugauaguuugugggcaguuaacagugguggagggcuguccugugcauuguagcaaguuuagcaggaucccuggccuccgcccacuuagaugccauuagcaccac

SEQ ID NO: 4113273 - RNA, 68 nt, Human
guggugaucaguguugguucuaucuacacauuuugcugggaauagaaaagagcuaauauuauuucuau

SEQ ID NO: 4113274 - RNA, 65 nt, Human
guggugcaugcaugcauauguauauaucugcgucuauguuuguauauaugcauauauguauacac

SEQ ID NO: 4113275 - RNA, 106 nt, Human
guggugcgggggaagcugggggcagggcagggaggacagggcaccgcucccuucuggaucucccaggcugcccuguggaccccacuggcuacccucccuccaccac

SEQ ID NO: 4113276 - RNA, 130 nt, Human
guggugcugggaggugaagguguugugucacuugagcuuggccagcucuggaaagugguagauucuuccugaaggccagugcuuguggagcuggcaggggucaguguuguguguagcgagccagugcugc

SEQ ID NO: 4113277 - RNA, 78 nt, Human
uacucuugucacuguuuccuauuauauuugggugauucaguauaacagaagaauguaauaggaaacguguggagggug

SEQ ID NO: 4113278 - RNA, 71 nt, Human
uacugaaauauuuucugucacuaauguucuucauaaaaaauugaaggaggggcauagaaauguaaucagug

SEQ ID NO: 4113279 - RNA, 72 nt, Human
uacugaagggccuacccaguucaguguuuaaaaacuaacauagguuucagugauuuuggggagguuucagug

SEQ ID NO: 4113280 - RNA, 57 nt, Human
uacugacacaaagccaaucccuuggcacuucccaugggauacacugaugugauagug

SEQ ID NO: 4113281 - RNA, 67 nt, Human
uacugaugauuuaagggaaaaaaugaaucaagacucuauugauuaaauguuccuuaaauuauaugug

SEQ ID NO: 4113282 - RNA, 77 nt, Human
uacugcaaaauguuggaggaaauauuauacacuaucuaaaugugaaauuaauguuuuucucaacauugcuguaagua

SEQ ID NO: 4113283 - RNA, 71 nt, Human
uacugcagaaauucagaaagcauaaggcauaaagaugagugcuaauuaucugaccugaauuugcuguggug

SEQ ID NO: 4113284 - RNA, 98 nt, Human
uacugcauuaaccuggaaaaucaagcaagaaggcuuccugagggagucuuggcaggcaaggugcucuugcucuauuguucauuguuuuugucauagua

SEQ ID NO: 4113285 - RNA, 85 nt, Human
uacuggaaauggagacuugggugaggcuucuucuugccuccaggaggggugaaauggcccaaacacccagugucuuugugcagua

SEQ ID NO: 4113286 - RNA, 66 nt, Human
uacuggcuugugcauuucauuccucagguuguuugggcuugauaaguguaaauuacguagccagug

SEQ ID NO: 4113287 - RNA, 58 nt, Human
uacuguagauagugcuguguaaacuuaauauuaagguacaaaguauuauuuaaaagug

SEQ ID NO: 4113288 - RNA, 70 nt, Human
uacuguaugauuucauguauaugcacuuugaaaacagacaaaccaauauauaacagaagucagaauagug

SEQ ID NO: 4113289 - RNA, 67 nt, Human
uacuguuuauugagcaaucugccagaccccuaggguuggagucugguggauugaucaauaaauagua

SEQ ID NO: 4113290 - RNA, 56 nt, Human
uacuuagagcgauaauuuauacauauauauauguauggcuuacagugcuuuaggua

SEQ ID NO: 4113291 - RNA, 74 nt, Human
uacuuagcuguuagagagcuuuaggauuuggaaacuuccagugcauauuuuagcaguucucuaauuucaaggua

SEQ ID NO: 4113292 - RNA, 93 nt, Human
uacuuauaugggauuuuacuauaggauugguucccauuuuacuugcagaaaagcuaaaguguggacaguaucuauaccaagucaguaaaggua

SEQ ID NO: 4113293 - RNA, 69 nt, Human
uacuuauugguucagaaguuuagauuuuauaggugagcugggugcuagacuaguggugccauuuaagua

SEQ ID NO: 4113294 - RNA, 130 nt, Human
uacuucacgggauuucugagauauaugccuucuagacuuucauguuggugaaggguucauaaaguugguccugaauuuauccuaccaugaaaggcuucuggagugugguucuuggaaauuccuugaauua

SEQ ID NO: 4113295 - RNA, 56 nt, Human
uacuucaugaguuaauaugcagcuacuaaaauaguguauauugacagauugaagua

SEQ ID NO: 4113296 - RNA, 68 nt, Human
uacuuccuguuuuugauuucagaagugcaaccaugcagugcuucuaugaaaaacugaauaguugagua

SEQ ID NO: 4113297 - RNA, 91 nt, Human
uacuucuuccuugcaaagcaaaacauucugugaacucucaauuuuugagaaaauaguucgaauguucuugcuggagugagucagcaaagug

SEQ ID NO: 4113298 - RNA, 55 nt, Human
uacuucuucucccuucaacugguuacuaaaucuggccaaauguggagaaaaagua

SEQ ID NO: 4113299 - RNA, 68 nt, Human
uacuucuuugagacucgauauucucauauguauaaaaaggagaugaugaugguagccucauagaagua

SEQ ID NO: 4113300 - RNA, 55 nt, Human
uacuugcuguuaguauuuuacagcuauacuugcuguaaguauuuuacagcaagug

SEQ ID NO: 4113301 - RNA, 55 nt, Human
uacuuggguuuuaaucagaguugauuuuuuuaaacauuugaaauaaacucaagug

SEQ ID NO: 4113302 - RNA, 56 nt, Human
uacuuguugcuuuugugauccaggaguuguagggacuccaaaagcaauuccaagua

SEQ ID NO: 4113303 - RNA, 80 nt, Human
uacuuuaaccuuuugacuucagcagauucaaaaguuuguuuuauucuuuccaggucuagaugaaauuaaauguuagggua

SEQ ID NO: 4113304 - RNA, 73 nt, Human
uacuuuaaucuuuuuucaguuuuccagguagccggucacuaugagccaccaaggaaauugagaccauaaagug

SEQ ID NO: 4113305 - RNA, 56 nt, Human
uacuuucagaagauguguaguaauuuucucaccaacuccacaucuuuugagaugug

SEQ ID NO: 4113306 - RNA, 55 nt, Human
uacuuuccaccagcuuuuugaaagauccucauaauuaaagcagccguggagggua

SEQ ID NO: 4113307 - RNA, 65 nt, Human
uacuuuguauaagacaauaaagaaauccaagcuaugcuaagaccgucuugugucugugcagagug

SEQ ID NO: 4113308 - RNA, 91 nt, Human
uacuuugugcaauuugguauaaacauggagugcauucuuuaccuuggcaaugucugcccugagauugggcucuauggugccacaggaggua

SEQ ID NO: 4113309 - RNA, 65 nt, Human
uacuuuuuauuccuauuuucaaugccaaaggagguauguauaucugaaaguuggagucaaaugua

SEQ ID NO: 4113310 - RNA, 128 nt, Human
uagaaaaauuagccggacaugguggcgcaugucuguagucccagcuacucaggagacuaaggugaaaagaucaucugagccugggaaguuguggcugcagugaguugugaucaugccucuguacucua

SEQ ID NO: 4113311 - RNA, 118 nt, Human
uagaaacacuaaggcuucaaacacuacaagugacuauuugaguacaucaaaaaggaaaguucucuuaacauggugauuugaauaccacaugugaugacaauuuuaugccccguuucua

SEQ ID NO: 4113312 - RNA, 56 nt, Human
uagaaacauauaggauggcaggucuccaaggccuggccugaaucacuguguaucug

SEQ ID NO: 4113313 - RNA, 82 nt, Human
uagaaaccuuucaacagucucaaugcagucaggcucauuugauacgaguuuuaugauuacaaaagauuguuugaagacucug

SEQ ID NO: 4113314 - RNA, 62 nt, Human
uagaaacucaggauacucuuccauggaaagagauggcagagaaaguuuuguccucaguucua

SEQ ID NO: 4113315 - RNA, 81 nt, Human
uagcagagcagcaguguggcuuagggaauaggccugugcuuuaaagucagacaggccugaguuugaacucuagcucugcua

SEQ ID NO: 4113316 - RNA, 75 nt, Human
uagcagauuuucauauuuugagguuguaucuaguuuuuuaaaagaacuagaaauuacucagaauaaaauauguug

SEQ ID NO: 4113317 - RNA, 82 nt, Human
uagcaggaagcauaauggaacaacucuuaguuaucauuauuuuguugauguuucaagaguuucuuuauuaaccuuuguguua

SEQ ID NO: 4113318 - RNA, 70 nt, Human
uagcaggugguggggcuaugaucuaaacacaggcauucuggguccagguccaugcucugaaccucugcug

SEQ ID NO: 4113319 - RNA, 63 nt, Human
uagcaguacugggcauguguuuguuguuguuguuuuucuuagccucagauucccaguuugcug

SEQ ID NO: 4113320 - RNA, 60 nt, Human
uagcaucuugauuucagaccagcauaucagccugucagaauuguuugaaucauaaugcua

SEQ ID NO: 4113321 - RNA, 56 nt, Human
uagcauggaaucguuuaugcucuggguuuugauggcucagacuugauucuaugcua

SEQ ID NO: 4113322 - RNA, 61 nt, Human
uagcauucacccacauacccagggccuauggagaaccagguugggaugagugggugagcua

SEQ ID NO: 4113323 - RNA, 59 nt, Human
uagcauuugaucuccugaauaaacagauagccuuuguuugugacuccagaucaaagcua

SEQ ID NO: 4113324 - RNA, 118 nt, Human
uagccacacucaacuacaagggaggcugggaaauguauuccagcucuugaugaccaggagaaaauugaaagagucugguagacaccuagccaaucccuacuccagugaauguggucua

SEQ ID NO: 4113325 - RNA, 86 nt, Human
uagccagccagcagugguagcuuugcacuucccugggauggagcuccccaggaaagggaugggcugccaccuuugcuguuuggcug

SEQ ID NO: 4113326 - RNA, 57 nt, Human
uagcccagagagccaggggcuugcuauaaucaaggaagccaguggccagcuggguua

SEQ ID NO: 4113327 - RNA, 93 nt, Human
uagcccauccuuggagugacuuuuggaccucacuguccacuugagggaaggccaguccacaggaaggaggccccagagcacccaguguggcua

SEQ ID NO: 4113328 - RNA, 76 nt, Human
uagccucacaucuacuugacguuuggcagaaugaagucccagagugcccagcugucaaaguagauaagucuugcua

SEQ ID NO: 4113329 - RNA, 121 nt, Human
uagccucacuugggaagauucuucaaacacagaugaccaggcuccacccagaggaaucaaaucagaaucacugagguggggccugggcaucaguguuuuuuaaguuccucagaugaggcua

SEQ ID NO: 4113330 - RNA, 66 nt, Human
uagccugcuaggcuccaagagcgaacucagaucugccuugagaaagcagggagccugaagacgcug

SEQ ID NO: 4113331 - RNA, 57 nt, Human
uagccuuucauucuauuauuuuggagcuaaaggcuucagcaugaagagugaaggcug

SEQ ID NO: 4113332 - RNA, 58 nt, Human
uagcuacacuagaguugcaauggaaauuccuuuguuucuauaaagcuuuaguuaguug

SEQ ID NO: 4113333 - RNA, 88 nt, Human
uagcuacagccuuagcugauuugucaaaauguauuauagcaacucuguuuuaauaucucaccaugacaaagcaguaaagcucugguua

SEQ ID NO: 4113334 - RNA, 77 nt, Human
uagcuacccuggaaaugugagacugaguuuuccuguuuguacauggauuugucuuucauuuucuggggaaauaguua

SEQ ID NO: 4113335 - RNA, 63 nt, Human
uagcuagcugaaccaaccccugcaacuaaauaguaauuagcauggggcagguuuuuauggcua

SEQ ID NO: 4113336 - RNA, 78 nt, Human
uagcuaguuauucauagagcuguggcuggaauuagguuucuugacugauucuguaaacaugucuuuagugcuaugcua

SEQ ID NO: 4113337 - RNA, 63 nt, Human
uaaauugccaggaggguugagaauacguagauuguguauguuuuugagacuuuuuggaguuua

SEQ ID NO: 4113338 - RNA, 83 nt, Human
uaaauuguacaaggggaagggaguccaaguguuacuacaaguaauuaaugugcgucuucucucccuggucacccuuugauuug

SEQ ID NO: 4113339 - RNA, 81 nt, Human
uaaauuucauugaaaccuaacauaggcuggauuagcaaauauagaaagacaauguagccugucguggucucaaggaaucug

SEQ ID NO: 4113340 - RNA, 66 nt, Human
uaacaagccuacacaguuuugcucccaugaugggguauguuuaucaaggguaagcuguguuuguua

SEQ ID NO: 4113341 - RNA, 57 nt, Human
uaacacuuucuauuauuaugguuuguuuauugggagccaagagggaugagaguguua

SEQ ID NO: 4113342 - RNA, 76 nt, Human
uaacagcuccagagggagaguuucaacauggcccugcagggcuaagugaagauugcuccauuuucuuuauuuguua

SEQ ID NO: 4113343 - RNA, 84 nt, Human
uaacaggagaauaguucuggaacucuacagcaaccacaaugccuuugucaaguucuuuugaagaguccagaguacagccuguua

SEQ ID NO: 4113344 - RNA, 57 nt, Human
uaacagggccuggcuccaaaagaugacaggccgcccaucaucugccggccucuguug

SEQ ID NO: 4113345 - RNA, 59 nt, Human
uaacauagucauauacuugcuugaguuuucacauagggcacaggaaaugacucauguua

SEQ ID NO: 4113346 - RNA, 77 nt, Human
uaacaucuacaccucaggguggcacucagcgcaucuuuaugaacaugcuuugauguauuuugcagguauauuuguua

SEQ ID NO: 4113347 - RNA, 74 nt, Human
uaacaugcuauuuuccaauaauguaauauuuacuugggcagcacaaauccuauaguauuggaaaaaguucguug

SEQ ID NO: 4113348 - RNA, 62 nt, Human
uaacaugguacugagugaggaaauuucaugccucuaagucucccccuccaauugccauguua

SEQ ID NO: 4113349 - RNA, 57 nt, Human
uaacauucccuuugugccaagggaccaagauuucccuugugcagagcaggaguguua

SEQ ID NO: 4113350 - RNA, 56 nt, Human
uaacauuucauuggaagcuauguucugcaaacagcacaugcuuucuuggaguuuug

SEQ ID NO: 4113351 - RNA, 81 nt, Human
uaaccagcccaucaaaucuaucgauuuuucaaaauuaguauaucauuaaaguuuguagcaauugauauagugggaugguua

SEQ ID NO: 4113352 - RNA, 56 nt, Human
uaaccuauugucaggcagaggcaggagaaucgcuugagcccaggaggcagagguug

SEQ ID NO: 4113353 - RNA, 59 nt, Human
uaaccuuuggugaaauauuaacuuacuguaccaugcauugauaauguccccagagguua

SEQ ID NO: 4113354 - RNA, 118 nt, Human
uaacuaaagcauuaguuucugaauuugugcuucuuuaugauguaugauuauauauuugugcuuauacauuuuaauaaagaguguguuuugauguaaacagugcugauguauuugguua

SEQ ID NO: 4113355 - RNA, 110 nt, Human
uaacuaagaacuugcuucugcaaagucuggcaugcuaauacagccugucagccagggaacccagugaagcugugcuuagcaaccagucccuuugcuaucuauuuugguua

SEQ ID NO: 4113356 - RNA, 66 nt, Human
uaacuaagacauuugaaaugugaucccaucuugggagcacugaugucaugaugucucccacaguua

SEQ ID NO: 4113357 - RNA, 59 nt, Human
uaacuacaaacuguccagcccagagguuuccaaucugugggucuagauuuuugauguug

SEQ ID NO: 4113358 - RNA, 78 nt, Human
uaacucuaguaucacaguuacucaaauaaugacuagcugguuugcuuucaaucuguuaaaacugcgagcuguggguua

SEQ ID NO: 4113359 - RNA, 92 nt, Human
uaacucugccuuuuccaggcgggcuagggcccugcuggagaggacccuaugacuugccuucucuguucuuuagccugcuugaggcaaaguug

SEQ ID NO: 4113360 - RNA, 69 nt, Human
uaacugguaggugaguuuggggaagauagacaaaguacgguuuguucuucuuuagaauucauucaguug

SEQ ID NO: 4113361 - RNA, 82 nt, Human
uaacuuauucugaaggacuaaugguauuuuacuuuuugaauagagauguagggacccacagucuauauuuuggggcaaguua

SEQ ID NO: 4113362 - RNA, 68 nt, Human
uaacuuauuucucaguacauuauacaugcauaauauuguacaccaguuaugugcugggcaauauguua

SEQ ID NO: 4113363 - RNA, 73 nt, Human
uaacuugacaccuggcucugggcuaagcucccacccugaucuugugggaucuucccaagagcccugcagguug

SEQ ID NO: 4113364 - RNA, 75 nt, Human
uaacuuucccacgcugagcccauggaggacuaauauccacaaaucuuuaauuguacucccugugggaaaauguua

SEQ ID NO: 4113365 - RNA, 115 nt, Human
uaacuuugaaaaacuaagucuguggcaguguuuguauagaauaugcagcuuugaauaaucaaaaggacugcauucauuuuuuauaauauuccauccagcuuuuuguugaagguug

SEQ ID NO: 4113366 - RNA, 64 nt, Human
uaacuuuggagaacuggcauuuuuaaugcuguugagucauuaaauauguguuaguuuccuguua

SEQ ID NO: 4113367 - RNA, 76 nt, Human
uaacuuuguuaaugucacuuuauguggcuucuucccauauagggaagucaguagugacauuacaaaacuuuaguua

SEQ ID NO: 4113368 - RNA, 98 nt, Human
uaacuuuguucugaggucuuaacuuaguuuagguaaacccagcagcaguuagggcucugguguuuucaugugcauaaacugcaccucagaggaaguua

SEQ ID NO: 4113369 - RNA, 77 nt, Human
uaacuuuuuuguucauuuugagcucaucaucaucucauuaaugcgugaauguagcuucacgaugacaguccauguug

SEQ ID NO: 4113370 - RNA, 63 nt, Human
uaagaaaagucaucacuccucugaacuugcaacagcaagcucugcucaugaugacguuucuug

SEQ ID NO: 4113371 - RNA, 69 nt, Human
uaagaaacucugaugcuuauugggaaucuauagacuuaguucuccuugauauuuuguuagaguuacuua

SEQ ID NO: 4113372 - RNA, 95 nt, Human
uaagaacaacucuacaagagguauauagaaacagcucugggcauggaggucaugcaacauuccugccuuuauagccucuuggagguuaguucuua

SEQ ID NO: 4113373 - RNA, 73 nt, Human
uaagaacaagggcucugagcuggaccaccuggguacaaauccaagugcucucguucacggcugugugaucuua

SEQ ID NO: 4113374 - RNA, 57 nt, Human
uaagaacuuggcagcaagaaauugccuuuaaagggaaaaccuuguggccaguuuuua

SEQ ID NO: 4113375 - RNA, 56 nt, Human
uaagaaucagaauaauuagauuucagaucacuagaucugagcuuuucugaguuuug

SEQ ID NO: 4113376 - RNA, 99 nt, Human
uaagaaugauccuuccuacccuggguuccucagcccuuacuuagcccuagucaagggcuaaguaaucggggcggggcggggcgggaagcguaacucuug

SEQ ID NO: 4113377 - RNA, 76 nt, Human
uaagacagccagaguggcccguuggccugaacccuugcauaggguucugauuggcaggcggcaucuggcauucuug

SEQ ID NO: 4113378 - RNA, 62 nt, Human
uaagaccucauggaauuaaagcagaagugaaacaccuuuuauucuguagucuaugaggcuua

SEQ ID NO: 4113379 - RNA, 83 nt, Human
uaagacucacauucccagggauaaaccccagcagaugggaugcuaauccaucacaaaggguuuucucugagaaggagauuuua

SEQ ID NO: 4113380 - RNA, 69 nt, Human
uaagacucauauucacacuguuuaguuacagaaacccucuacuuguggcaguuugaauuuaaggucuua

SEQ ID NO: 4113381 - RNA, 56 nt, Human
uaagagaacuggauagauaggauagauaaaaggauucuuguuaaacagggcucuug

SEQ ID NO: 4113382 - RNA, 113 nt, Human
uaagagaucagagagggguauaaaaaaugcuuugacuauaucuauaauauuugauuuauuaaucuggguuuuggguauagagguguucauuauauuuuucuguacaucuuuua

SEQ ID NO: 4113383 - RNA, 77 nt, Human
uaagagcauguuugaaagcuguacaugugguacaauguucacauaugugccuuguacagcauucaaacguguucuua

SEQ ID NO: 4113384 - RNA, 56 nt, Human
uaagagguaguuaaguuucagucacaguugagugauuuacccguaacuauuucuua

SEQ ID NO: 4113385 - RNA, 56 nt, Human
uaagauaaggaacauucugugauguguucuaucacaccaugaugauccuuaacuug

SEQ ID NO: 4113386 - RNA, 56 nt, Human
uaagaugaaggcucaccuagaacucaagugaccauucagagguuagcaucaucuua

SEQ ID NO: 4113387 - RNA, 96 nt, Human
uaagaugagcuccugcuaggugggcacugggagguggacagaagguaggaccaagagccugacugugccacugccccaggccucaggggcuccuug

SEQ ID NO: 4113388 - RNA, 68 nt, Human
uaagauggcagguaguggucucaucaggcagaccccuauagagguggguacuacaucugucacucuua

SEQ ID NO: 4113389 - RNA, 74 nt, Human
uaagauuuucaguccagcacauacagucccagugcccagcacaccggaaguuuguauacuggccucuuaucuug

SEQ ID NO: 4113390 - RNA, 119 nt, Human
uaggucuuacuucaauugaauguuccuagugcaacuggagggcuucugcagguuacaggagacugacaaucuggacccagucuucauccaggugccuaauagucaaugcucauuuccug

SEQ ID NO: 4113391 - RNA, 118 nt, Human
uaggugauggggaaagucugcccaugacuucggaagucugaguuuaguagaugaugcuacccaucagaauuuagagacaggcuucccaaggagugguagcuaucacuccaucucccua

SEQ ID NO: 4113392 - RNA, 62 nt, Human
uagguggaggucauucagcuuaacuucuauaaaauggacagcagauaagaccucaucauuua

SEQ ID NO: 4113393 - RNA, 85 nt, Human
uaggugggagacugguucuucaguaaaauuaaauguauguuguuaauauauuucuuaugauugaaguaauaaaacuuccaauuua

SEQ ID NO: 4113394 - RNA, 70 nt, Human
uaggugucuguggcugccucugugcuaccaugauagaggugagcagagaccauauagcccagaaagccua

SEQ ID NO: 4113395 - RNA, 129 nt, Human
uagguguguuaggacauuuuuucccucuucuugccacuuauuuggauucuuauuuagcacuguguauuaaucaguguucuccagagaaaccgaaccaguaagaggagaaagagagagacagacacagaa

SEQ ID NO: 4113396 - RNA, 68 nt, Human
uagguguuuaaugauuucagcaaguaaacauuuaugacuguugauuugccuugugaauuggauauuua

SEQ ID NO: 4113397 - RNA, 58 nt, Human
uagguuccaugagggaggcaaacaugaauaagacauuguccccacagagaggggcuua

SEQ ID NO: 4113398 - RNA, 64 nt, Human
uagguucugccagguaaacugcaggaauugaguaugucagauuuugguauacguggagauccua

SEQ ID NO: 4113399 - RNA, 78 nt, Human
uagguugaaccauaugaaaugacugguauuuggccauuuuugaccaaugaacacagcaauuucauagaguucuaccua

SEQ ID NO: 4113400 - RNA, 77 nt, Human
uagguuggugcaaaaguaauugcaguuuugucauuacuuuuagugacagaaaccacaauuacuuuugcaccaaccua

SEQ ID NO: 4113401 - RNA, 78 nt, Human
uagguuggugcaaaaguaauugcgguuuucacaauuaagagugauggcaaaaaucacaauuacuuuugcaccaaccua

SEQ ID NO: 4113402 - RNA, 76 nt, Human
uagguuggugcaaaaguaauugugguuuucaccauuaaaagaauggcaaaaucacgauuacuuuugcaccaaccua

SEQ ID NO: 4113403 - RNA, 81 nt, Human
uagguuuguguuauuuuaacuucucaguaauucccaaguauguaugaugauugcagagaaauuagagcuaaucauaacuua

SEQ ID NO: 4113404 - RNA, 129 nt, Human
uagguuuucaagaaauuaagugugguauuacguauuauuaugaaauuuuaagcuauugcuguuuaucagguuaauggcauugauuacaugaaaguaacacguucgauucuacauacuauuuguugaccg

SEQ ID NO: 4113405 - RNA, 127 nt, Human
uagguuuuuacauggacagagcuggguugaaaaguggguuugacuguugcuagcuuugucaucuugggcaggcucuuuaacuugucuaaauucuugauuccucaucucuguaaaauggaaagaccua

SEQ ID NO: 4113406 - RNA, 63 nt, Human
uaguaaaaccugcuuuucaacaccauugaucaaauacuggcucggugacaguagguuuuauua

SEQ ID NO: 4113407 - RNA, 84 nt, Human
uaguaaugaugacagugauaauagcauuuauagaacaccauacgugaagagccuuacaugcauauugucauuuaguccuuacug

SEQ ID NO: 4113408 - RNA, 58 nt, Human
uaguacagaauuaauaauugugucuguuugcuggcacaguuuuaugguuauuguacua

SEQ ID NO: 4113409 - RNA, 76 nt, Human
uaguacaguggagagcaaagaauacaggccuuggauuuacacauccaggaucauaucuuggcucugccacuuauua

SEQ ID NO: 4113410 - RNA, 64 nt, Human
uaguacccugguguuaucauaggucaugccaucccuuuggcaucacuuuauauauuagguacua

SEQ ID NO: 4113411 - RNA, 102 nt, Human
uaguacugauuuauuuacaucuuuacuggauuuagaggcuaacaccaauugguaaaguucuauuugaauuuagguauuuuggaguaaguauuauuauuauua

SEQ ID NO: 4113412 - RNA, 83 nt, Human
uaguacuuaaaccucuacuguaauagaugaauuugaugccugagaugagagucaauuguuuacagucauggagugggugacua

SEQ ID NO: 4113413 - RNA, 71 nt, Human
uauaauuccauuuauauaaaauguccagaacaggcaagccuguagagacagaaaguagaaugguaguagua

SEQ ID NO: 4113414 - RNA, 82 nt, Human
uauaauucggcuauggacucguucauaguuccaauuugcuaggcagaauaguaaggaugaagugaguccaugggcauuuaug

SEQ ID NO: 4113415 - RNA, 59 nt, Human
uauaccaaaaccaagccauuaucuucaaucugaggagaagggaacugaguuuuugugug

SEQ ID NO: 4113416 - RNA, 65 nt, Human
uauacuaucagacuccuggacacauagcuagauggagaaagguggacagugaaucuggagguaua

SEQ ID NO: 4113417 - RNA, 76 nt, Human
uauacugaggaauuuuucaugacucaggaauaaauuuccaugaaacaucagagauuucucuagcuaauagggugug

SEQ ID NO: 4113418 - RNA, 69 nt, Human
uauacuguuucuccuguaguguaaggaccuuacaauguaagucaucacauugcagagauuaucaauaug

SEQ ID NO: 4113419 - RNA, 67 nt, Human
uauacuuguucuuagcaggagcaucuauucuauucuugaauggauaaaaugaagaggaaagagugua

SEQ ID NO: 4113420 - RNA, 60 nt, Human
uauagaaguugcucaauaaauguuugugaggguuaauaauacuuguggguaaguucugua

SEQ ID NO: 4113421 - RNA, 72 nt, Human
uauagagaauuugcuggcuucauugugaguucauaaacaugaccagcuuugccccaguagguuuaucaugua

SEQ ID NO: 4113422 - RNA, 59 nt, Human
uauagguugaacaauuuguagauuauggauuuucuauaauuuauagugaucaauuuaua

SEQ ID NO: 4113423 - RNA, 75 nt, Human
uauagguuuggaccacuuuucaugagucuguuauggguuggaucuugaggggcucaugaaagaccagcauuuaug

SEQ ID NO: 4113424 - RNA, 64 nt, Human
uauaguacauggaaucuucauagcagaaacugagguugugauaugaaaucauuccaauacugug

SEQ ID NO: 4113425 - RNA, 59 nt, Human
uauaguccuucuaaagguccuuucuccauagagaaaggugccccauaggcaggaacaua

SEQ ID NO: 4113426 - RNA, 74 nt, Human
uauaguuaacauaggcuuagggguuuggaaaaucuugaggaagaccagagcagaagccuaggcugugaacuaug

SEQ ID NO: 4113427 - RNA, 78 nt, Human
uauauaauuguucugaaguguuuagaauuaaaggggcaugauuucugcaacacucaaaugguucauaacaauuaugua

SEQ ID NO: 4113428 - RNA, 62 nt, Human
uauauaauuuucugccauaucccuaauaucuagauuagcaucuggcauguggaaauugugua

SEQ ID NO: 4113429 - RNA, 84 nt, Human
uauauacaagauacuugaaucagagguauaacucuguuauuguuaugagcuggagauuagguaugguuuaaguagauguguaug

SEQ ID NO: 4113430 - RNA, 66 nt, Human
uauauacacauguguauacauuuacauaauguauaaauuauaaaggugugugugcaugugugugug

SEQ ID NO: 4113431 - RNA, 56 nt, Human
uauauacuaugcgauuccugccuuaaaaacugcaggaauggcaccauuagcauaua

SEQ ID NO: 4113432 - RNA, 61 nt, Human
uauauagcacuuguuuugcaugucugauugucagcucuugacaaggcagaacugcugugug

SEQ ID NO: 4113433 - RNA, 58 nt, Human
uauauauaugcacacacaccuagacccacguauguccauguguguaugcauaugugug

SEQ ID NO: 4113434 - RNA, 59 nt, Human
uauauaugcgcaggcacccagcugugagggggagcacuggguggggcuguggguaugug

SEQ ID NO: 4113435 - RNA, 108 nt, Human
uauauauguguguauaugugugugcaugugugugugccugcuugugaauguguguaaauauguguauagaugcaugcauauaugcauauguagguggauguguauaua

SEQ ID NO: 4113436 - RNA, 86 nt, Human
uauauauguugugugugugugugugugugugugugugugcaauuuuauguuaaaaaucucauaaacacacauauaugauaugugua

SEQ ID NO: 4113437 - RNA, 78 nt, Human
uauaucucuuuugcuauaaaagggucacacgaucugagaaaauuauguguguaauccaguuguagcaaaucagaaaug

SEQ ID NO: 4113438 - RNA, 86 nt, Human
uauaucuguguugcuagugaauuucugccacugaaacuucaacagcucuacuaguuucaggccuaauuucuagccccagggauaua

SEQ ID NO: 4113439 - RNA, 62 nt, Human
uauaugcaugcacauguagguaugguauuuggggguguccauuugaaaugugcaugcagaua

SEQ ID NO: 4113440 - RNA, 62 nt, Human
uauaugcuuguguguauguuaauguguguauauuauacacacagaguuuauacaggcauaua

SEQ ID NO: 4113441 - RNA, 57 nt, Human
uauauggcugaauaauauucuguuguguggguauaccacauuuuacucagccauuua

SEQ ID NO: 4113442 - RNA, 69 nt, Human
uauaugggcuccugggagauagaggucauaaauauauaauuuauugcaaugggaucagggguagguaua

SEQ ID NO: 4113443 - RNA, 62 nt, Human
uauaugguuguuucacuagcucuaaucuuauguacaguuuuuagucaguugacagccauaua

SEQ ID NO: 4113444 - RNA, 59 nt, Human
uauauguguguuguuuuaagccacuaugucuguggaaauuuguuaagcagcaauauaua

SEQ ID NO: 4113445 - RNA, 71 nt, Human
uauauuacauccauuugacauaauuucagccaaacauauauuuugcuggaaaugauuaaauggugagugug

SEQ ID NO: 4113446 - RNA, 71 nt, Human
uauauuaugaaagacuggccuggcauuuuuguuguuguuuugugcuauuugugucaucuuuuaauaaugug

SEQ ID NO: 4113447 - RNA, 107 nt, Human
uauauuccauaugucaaagaugcugugcuaugucuacagaguucugagcuuaauaauacauaguucuugucuguggacauguauauuguugguacagugggaauaua

SEQ ID NO: 4113448 - RNA, 60 nt, Human
uauauucuuaccaguguauguaaguguauguauugugugcauguauuguguaaguguaug

SEQ ID NO: 4113449 - RNA, 87 nt, Human
uauauuguguggucuuuuagcauuuauuuguauauaguaaauaugcuguaaauaugaagaauauaugcuuuucuccucauugaugug

SEQ ID NO: 4113450 - RNA, 65 nt, Human
uauauuugacaacucuuaccuaaaacagagccagagggucucuacagggucagaguuucauggua

SEQ ID NO: 4113451 - RNA, 75 nt, Human
uauauuugcuuuugugauuuuuagccagaaacacagaaaccacucuaaaugcuguuaucaucaggaggggauaua

SEQ ID NO: 4113452 - RNA, 92 nt, Human
uauauuuucugucaggugcuuucagauucauuuuagaucaaguaacugaaucagagcugcauuuuagagcccuauuugagucagauuauaua

SEQ ID NO: 4113453 - RNA, 57 nt, Human
uauauuuugucagguuaguaaucugaaaucaucaaauugcuaaugugcgaaugugua

SEQ ID NO: 4113454 - RNA, 123 nt, Human
uaucaacccugauccccuggcagcauguccccugcaguccuuucuuggcucuagguuugguggccaggacauugccaggcacuucaggacauaagacaaagccaggagccaugggggaagaua

SEQ ID NO: 4113455 - RNA, 65 nt, Human
uaucaagaguuucuuuagggauguguuaaguucaauuuaagaugucuaagaggagaugcugggua

SEQ ID NO: 4113456 - RNA, 81 nt, Human
uaucaaguggagguaguaguuucuaacauauagcauugguuaugaggaucaagugagaaaaugcaugccaaccacuuaaua

SEQ ID NO: 4113457 - RNA, 70 nt, Human
uaucaaguuuucuuaguugacuguuuggcugguugucuccgcugguuguaguuggguagaggacguggug

SEQ ID NO: 4113458 - RNA, 70 nt, Human
uaucaauguccgggccccauuccagucaaacagggugagaauuucuuggaaggaggcccaggcauccaua

SEQ ID NO: 4113459 - RNA, 75 nt, Human
uaucacuucuuuugugauucuucaguuacuucaggccaucuggauguauacgugcaggucacaggggauaugaug

SEQ ID NO: 4113460 - RNA, 74 nt, Human
uaucagcagagaaauagaugcaaagagacaagccuuuauuuggcuacuuauuugcccauguuucuuuauuauua

SEQ ID NO: 4113461 - RNA, 57 nt, Human
uaucagcaggccaaagcugcaaggucacagacagauuguguuuugggccuguggaua

SEQ ID NO: 4113462 - RNA, 101 nt, Human
uaucaguaucacggccagaaaucucagaaacugguggauuucauauuugcuuauauaaauacauuuuugcuucuaguucuggaaauacugugaucaagaua

SEQ ID NO: 4113463 - RNA, 101 nt, Human
uaucaguccugauagaacaaauucuuucugccuauuggagucuagauaaaauugacagauuggaugaaggcagaaggaggugagcuagaaugacgaugaua

SEQ ID NO: 4113464 - RNA, 62 nt, Human
uauggcugaggccuccguggccacgaacaggaguagggcugcgcaaaggaggccaggcugug

SEQ ID NO: 4113465 - RNA, 59 nt, Human
uauggcuucuuuugcaacuacuuaaccauuuuugccaugguaguacaaaagcagccaua

SEQ ID NO: 4113466 - RNA, 70 nt, Human
uaugggauaauaaacacagccggagucugaagcaccuugagggacauccugcugugcuuauuauccugua

SEQ ID NO: 4113467 - RNA, 70 nt, Human
uaugggcagcacagacagugaaggccaggaucauuuuccuugucaauuacaaacuguggcugugaccaug

SEQ ID NO: 4113468 - RNA, 65 nt, Human
uaugggcuucgugggacugucaguugggggacccugcccucucuuggccaagauacgagcacaua

SEQ ID NO: 4113469 - RNA, 88 nt, Human
uauggguuguuugcacauucguuucaauagaauucuacuuuuauugcuuuuuaaaaauagugugcacagcaugaaaauaaccaucaug

SEQ ID NO: 4113470 - RNA, 55 nt, Human
uaugguagccacuagcaauauauagcugcuauauccuugagacguggcuacugug

SEQ ID NO: 4113471 - RNA, 113 nt, Human
uaugguagcccauuuaaaaggcagagagccuggaauuaaggaaaugcaguguugaauaguuauugcacuauuuucaggcuuugugaccugggcauuuuaaaaaggagaucaua

SEQ ID NO: 4113472 - RNA, 73 nt, Human
uaguagagagaaauagguggcaacaaaauaucucauuuggcuuuuucucacagcauuuguuagcuuucuacug

SEQ ID NO: 4113473 - RNA, 116 nt, Human
uaguaggccagaaaauaauguuuuacuaagcaggcugcccuagcuuggacauuuaaagggaagccguauguugaaggaugaagggcaguugaaguuuugugaagaauggccggcua

SEQ ID NO: 4113474 - RNA, 61 nt, Human
uaguaggugcugaauaaauacuaguuaguauccuggcugguccaauacucaguaaaaacug

SEQ ID NO: 4113475 - RNA, 71 nt, Human
uaguaguaaaaggucuuccuuuguuugaguaaacacucuuugucuaagcagaagaggucuuguugcugcug

SEQ ID NO: 4113476 - RNA, 95 nt, Human
uaguaguaaugcugcgagguagaaggcauaaaaccaauuuuguucuucagaacuuaaaauucaguguuucuuucacuuguguguagcaccugcug

SEQ ID NO: 4113477 - RNA, 64 nt, Human
uaguaugaagaagccauugauaguuguaauaacuuugcauuguuaauugguaucuuacaaauua

SEQ ID NO: 4113478 - RNA, 57 nt, Human
uaguaugguugaguguaaaacacacuggguguccagugcucauucaaguccuuauug

SEQ ID NO: 4113479 - RNA, 59 nt, Human
uagucaagauuggaauaauguacuguacuuaggcuguacuuaggguuuagaucugacug

SEQ ID NO: 4113480 - RNA, 55 nt, Human
uagucaaucaguauguauuggacacuuuuuacaaucugguacauucugaucacug

SEQ ID NO: 4113481 - RNA, 95 nt, Human
uagucacuguuucucacuugcacuuuuccaucucucacagggaaagccucuagaucugggguugcagagguggaugcaauuggggaaagugagua

SEQ ID NO: 4113482 - RNA, 56 nt, Human
uagucaguugggucuaguggcauuaggccugcccagcuccagaacccaaacugcua

SEQ ID NO: 4113483 - RNA, 58 nt, Human
uagucccugcccuuaaagggugcagcccacauucugcaaccugagacccacgggacua

SEQ ID NO: 4113484 - RNA, 68 nt, Human
uaguccugggagaacugcuggguuggagcacugguuggcuuaaccguauccaaagauuuuccaggcug

SEQ ID NO: 4113485 - RNA, 63 nt, Human
uaguccuuacuuacuagaauaauacuauagagggaaagaauauucuagaaaaguaugggacug

SEQ ID NO: 4113486 - RNA, 60 nt, Human
uaguccuugguaaaauucuauggaucaccuguuguauauagagauuuaacccaaggccug

SEQ ID NO: 4113487 - RNA, 63 nt, Human
uagucucucuggacuugaguaucagccauguucuuauguugaugccaagcuccugggugauua

SEQ ID NO: 4113488 - RNA, 58 nt, Human
uagucugauucuagaaucuggggucuuaaaaaaaugacgccuggguccacucagacua

SEQ ID NO: 4113489 - RNA, 69 nt, Human
uagucugguuuuaagcugucagagagcaaagcacucaggcgcagcucuuuggggcuggaagccuagcug

SEQ ID NO: 4113490 - RNA, 58 nt, Human
uagucugguuuuauugaggacauucucaagcuaaagaauuucaaaaggaagccagcua

SEQ ID NO: 4113491 - RNA, 60 nt, Human
uagucuucaugaggauguuuaccauuucugaaguuuugcguaaauuagccuugaagauua

SEQ ID NO: 4113492 - RNA, 60 nt, Human
uagugaaggucaugaugcaaaagcaaugcuaggcuuuugcaauaguccuggccuguacua

SEQ ID NO: 4113493 - RNA, 56 nt, Human
uagugacagaacagaaagaacucaaguguacucugaaaucuaaugcucuguggcua

SEQ ID NO: 4113494 - RNA, 78 nt, Human
uagugacgucaaucaauuggaaguaggaguuuaucaaugaauugcuugacauccaucauuuccuguugacaugagcua

SEQ ID NO: 4113495 - RNA, 75 nt, Human
uagugacuaauaaugcugagcucuuuuucaugugcuuuucuuugugaagugucuguucaaguauuuuuuucgcug

SEQ ID NO: 4113496 - RNA, 84 nt, Human
uagugagagggguuaugcuugacauuuggaaaguucuuaagugagccaugccggagugagaagcugaauaacauccuuacgcua

SEQ ID NO: 4113497 - RNA, 83 nt, Human
uagugaucauccuggugugaggcgggaguguaguuaagugauuugacuaaaagagaacguucgcacgacucagaugaugacug

SEQ ID NO: 4113498 - RNA, 97 nt, Human
uagugauucugugcauuuguuggaguguucggauuuaucaaacuuucugauuuuuguaacaucccaacaaauuuccugucugcacuaguaauuacug

SEQ ID NO: 4113499 - RNA, 81 nt, Human
uagugauucuugaaugugacugaauauuuacucuacaugagacuugagaguguaauuaccagauuauaaugcaaaucacua

SEQ ID NO: 4113500 - RNA, 73 nt, Human
uagugcagucuaaguccauaauggcaguaaauaauugauuuauuuuugucauauuauggauaaacaugcauua

SEQ ID NO: 4113501 - RNA, 130 nt, Human
uagugcccuccaaggcucugcauucauggauccaauuacguuuuuugucaugguaaaagccacaguggauauauuaaaugagagugugguuuaagaaugaaggcccaggagucuggagaucugguuucua

SEQ ID NO: 4113502 - RNA, 91 nt, Human
uagugccuauuucauugggcuauuguaaggauuaaaugugugaguacauguaaagcacuucauaacagcacccagcaugaauuaagcacug

SEQ ID NO: 4113503 - RNA, 64 nt, Human
uaguggacacagcacuguacaaggaauagaggacaccuggguuucaguguagucugugcuauua

SEQ ID NO: 4113504 - RNA, 59 nt, Human
uaguggacagagcuagaaaauguguaucucucauacacuccucucucucugucuugcug

SEQ ID NO: 4113505 - RNA, 61 nt, Human
uaguggagaguuguuuugugcauuguggaauauuuagcacaucacugagcucuguucacua

SEQ ID NO: 4113506 - RNA, 70 nt, Human
uaguggauaauggauaacauugucaacaaauguugauuuaaaagaaacauugucuguauauugucuacua

SEQ ID NO: 4113507 - RNA, 68 nt, Human
uaguggcaggggcgggcuguuccggguaucauaggaugcuucgcagcauauccgaccucugcccacua

SEQ ID NO: 4113508 - RNA, 74 nt, Human
uaguggcuuggucuauacauaagaugaauaagagauuggaaauauuauuguauuauaauuaggccaaagcccug

SEQ ID NO: 4113509 - RNA, 58 nt, Human
uagugggaagaucagaacuaacgucugucugacaccaaagccucugcccuucccacug

SEQ ID NO: 4113510 - RNA, 96 nt, Human
uagugggauauuuuuaaauacaaaguuauucuuucagaggagaucaggaacaugauuccuggggacuugacauuguauuuaauaggaaguucacua

SEQ ID NO: 4113511 - RNA, 71 nt, Human
uagugguaugcugaagccagcucgcauagaacagugauagcugauugcagccucuuguuucagccccacua

SEQ ID NO: 4113512 - RNA, 75 nt, Human
uagugguuccggaagugacugauccgcacauguucauccauguagguguggucgaaguucucccggagccagcug

SEQ ID NO: 4113513 - RNA, 76 nt, Human
uaguguacuaguccaguaguguuugcauguggaugucuguggaugacaguuauuguagcacuuuggcagugcacua

SEQ ID NO: 4113514 - RNA, 59 nt, Human
uaguguagcagggaagaugaucagaauaucagagaagguguuuuucucucuugccacua

SEQ ID NO: 4113515 - RNA, 65 nt, Human
uaguguauuaauauugguucauuagcuguaacacauguacauagcaauguaagauguuaacacua

SEQ ID NO: 4113516 - RNA, 62 nt, Human
uaguguccagcuauauguguauguguguguguacacgugcauguacacacagcuguacagug

SEQ ID NO: 4113517 - RNA, 87 nt, Human
uagugucuuauucaccuuuguugugauaauggucugcacugaauagaugaucaguagaugcuugcagacagaaugaauaaaccacua

SEQ ID NO: 4113518 - RNA, 81 nt, Human
uagugugcagccacaggacuggcuggacagugggcaguggacagggguccauugcacccuccucgccccuggcagccacua

SEQ ID NO: 4113519 - RNA, 61 nt, Human
uaguguuaauucaguuuauaauuggcaaaggaaauugcugaguaaauaggaauuaauauua

SEQ ID NO: 4113520 - RNA, 82 nt, Human
uaguguuguauuuaugcaacaggugagcagacagcuuuugccaggauguuggcugcccguguugcacgaauuugauuagcua

SEQ ID NO: 4113521 - RNA, 67 nt, Human
uaguguuugggaauuguagagaguucauucauuuguuuuaauaacugcaaauuccauuuaaacacua

SEQ ID NO: 4113522 - RNA, 83 nt, Human
uaguuaaaguauaaaucagggagucaucugcgaggaaaaugaaugucacucacaguaguuguucucuguuucugcugucauua

SEQ ID NO: 4113523 - RNA, 64 nt, Human
uaguuaagcaguuuuucaacuguuuagguuguagaaaucugaacucuuuaugacagcuuggcug

SEQ ID NO: 4113524 - RNA, 55 nt, Human
uaguuacuguaaggugaugcagcuguggugaagcuguaaaacacuguaguaucug

SEQ ID NO: 4113525 - RNA, 87 nt, Human
uaguuagccugacucacugguagacuauaguggagggaggcuucccuggcuuuacugaggguguaucuuagugcauucagguugcua

SEQ ID NO: 4113526 - RNA, 65 nt, Human
uaguuagcugccagccaggccagguaggcagcucugcuucuguggauuggcuggcuuguuggcug

SEQ ID NO: 4113527 - RNA, 79 nt, Human
uaguuaguacaccugggacccauccaagaccaacugaguuggguuucuagguguggggcccuggcaucugugcucucug

SEQ ID NO: 4113528 - RNA, 87 nt, Human
uaguuaucacauaaauaaacaagcaauuugcucagaaauaaaugugucauuguaaacaaauugcuugucuguaguggacuuuggcug

SEQ ID NO: 4113529 - RNA, 66 nt, Human
uaguucaaagucugucaaaggaauuaagcaucucuggauugcucuuaugaaaagcacuuagaacua

SEQ ID NO: 4113530 - RNA, 81 nt, Human
uaguucauggaacauacaaaaacaggcagcagacugaaucuggcucauagccuggaguuugccaaugccugccgugcacua

SEQ ID NO: 4113531 - RNA, 85 nt, Human
uaguuccgaaaugaauccaaaucuuuagaggaggauauuuacuccacauauucuccucuaaagauuuggauucauuugggaacua

SEQ ID NO: 4113532 - RNA, 60 nt, Human
uaguugaaagggauuauugugggagaaauuauccuuccagguaguuuuccuuuguaacug

SEQ ID NO: 4113533 - RNA, 59 nt, Human
uaguugacgcaagauuguguauguuaagcucuggugaucaugcagucuuguggcaacua

SEQ ID NO: 4113534 - RNA, 75 nt, Human
uaguugagagguccauacagcuauucuacauuccugcugaagggccugaagaaaauugguagggauuuuucacug

SEQ ID NO: 4113535 - RNA, 76 nt, Human
uaguugauuuuucuuuauucugacuaauguauaacucugaaguuauugaguccacauuaguugaugaugucgacua

SEQ ID NO: 4113536 - RNA, 58 nt, Human
uaguugcaggcugugucccugauuucacaugcagaccaggagccagccugucagucua

SEQ ID NO: 4113537 - RNA, 61 nt, Human
uaguuuacuguucacuuugcccccuagacacuaggcauagacaacaugagcaagugaacug

SEQ ID NO: 4113538 - RNA, 64 nt, Human
uaguuucaguaccaugagcaucauguuuuucccucuagagauccgugcaguaugguagcuacua

SEQ ID NO: 4113539 - RNA, 96 nt, Human
uaguuugguauaaaaaauguucauuaagggccuguuggcugcagucuccuuucaaaauagcaaaccggccaaaacugaauguuaguguccauccua

SEQ ID NO: 4113540 - RNA, 82 nt, Human
uaguuuuaaauggucuuggucuaaccccuaguggauacuugaguauauuacaaaauuuuggaacaggauucaauuaaaggug

SEQ ID NO: 4113541 - RNA, 95 nt, Human
uauuuccugaaauucucucuuuggaguuauaacaguuacuagauuaaacugguaauuuaauucucugacuugaagaagugguauuucuggaaaug

SEQ ID NO: 4113542 - RNA, 68 nt, Human
uauuuccuuugagacugagcucuuuuagaaucuuuuauagauucagugcacaguacugagacuaaaua

SEQ ID NO: 4113543 - RNA, 63 nt, Human
uauuucuaaaggaagcuaugucugguauaaaaggcaaaagagaaaacuggcuucccagagaua

SEQ ID NO: 4113544 - RNA, 62 nt, Human
uauuucuaccaccugacuucaucuauaaacuccguggaugugucuuucaagguauagaaaua

SEQ ID NO: 4113545 - RNA, 97 nt, Human
uauuucuguuuucaucaaguacuuuccauuucaaguaacagauugcuucauucccccuuuaagcaagaagggagaguauuuuaaggguacagagaua

SEQ ID NO: 4113546 - RNA, 87 nt, Human
uauuugaaaagccacuuucauucauauacuuuaguucacauauuuaugagaagcaauguguuaaugaaugaguuaaaguuuuaagua

SEQ ID NO: 4113547 - RNA, 84 nt, Human
uauuugauaaacugaauacucagaaagaaagcagaaaugguuugggacuucauauccuguuuucccuggaguucagcauaaaua

SEQ ID NO: 4113548 - RNA, 55 nt, Human
uauuugcaucaguugcuaaauccuguugguuagcaaagcccuugcuguguaagug

SEQ ID NO: 4113549 - RNA, 86 nt, Human
uauuugcuagaguuuagagcagcaaagggaggguaaaucaaagaccacugauuuggacucagccuucuugcucugcucugcauuug

SEQ ID NO: 4113550 - RNA, 66 nt, Human
uauuugcuuagcauuguauuuccagcauuuagacaaugcuggaauguauuaaguauugaguaaaug

SEQ ID NO: 4113551 - RNA, 77 nt, Human
uauuugcuuuaaaauggcuaagucuggaguuuuuacguauugaucuuucuaaacuuggaucacuuuuaaagcuagua

SEQ ID NO: 4113552 - RNA, 81 nt, Human
uauuuggaaaaugugcucauuuauaaaaguuacagugucuuuuuaaaguuugcugaaguaaaugaagcauaucgucaagua

SEQ ID NO: 4113553 - RNA, 75 nt, Human
uauuuggacuuccucuuucaaugaguaugagaggacaaacuccauuacugaaauaaagagaauaaaguccuaaug

SEQ ID NO: 4113554 - RNA, 70 nt, Human
uauuuggggagacagcacaggccacugggagcacuaauggucuaagguggcauguguugcacuccaaaua

SEQ ID NO: 4113555 - RNA, 100 nt, Human
uauuuuagccucaugcuucuauucaguucaccucuguaugaugaauucuugauguguaacucuccuauagauacuggguauggagaugaaaaagaaaaua

SEQ ID NO: 4113556 - RNA, 103 nt, Human
uauuuuauugugguaagaacacaacaugagaucuacccucaggaaacuuuuaaguguacaagaccuuauuguugccuguauguucuauauuguaaugcagaua

SEQ ID NO: 4113557 - RNA, 76 nt, Human
uauuuucagauacuccuggucucaggaggaggaguguuucuggucuuucucucugaggaaggagcaucugugaaug

SEQ ID NO: 4113558 - RNA, 96 nt, Human
uauuuucauccaucaucagaacuuagacuuguuucuugguaccuucuaccaugucuucaauaagucuaggauuagcauuuggguugggugaaagug

SEQ ID NO: 4113559 - RNA, 72 nt, Human
uauuuuccuuuuauacucgucugaaugauucuuugaaagagaauguuuucaugagaaugaauaggggaaaua

SEQ ID NO: 4113560 - RNA, 64 nt, Human
uauuuucuguugcuauugauagucauuguauuacuagaaaugaacuguugaugaauagaauaua

SEQ ID NO: 4113561 - RNA, 87 nt, Human
uauuuucuuagucuauaaauauuuaccaaaagcaaucuauuuacugaagcgguaccagacauuuuggaaaguauuacuuugaggaug

SEQ ID NO: 4113562 - RNA, 103 nt, Human
uauuuugagauacagguuugucguauucucugauugaaaguaacuuguacauguuugguuuucauuuacauuagggaagauggcagcaaguauuccuagagug

SEQ ID NO: 4113563 - RNA, 72 nt, Human
uauuuugccuaagaaucucucugauuauccgacacuuggagguauucucgagagauucauagcagcaaugua

SEQ ID NO: 4113564 - RNA, 57 nt, Human
uaggccaacguggaaggguccagaagaaccauggaggacccccuuuccucuggcuug

SEQ ID NO: 4113565 - RNA, 69 nt, Human
uaggccuucggugugugcuugguagguugaucaaugugaagccuuuuuccgaguacacuugagggcuug

SEQ ID NO: 4113566 - RNA, 56 nt, Human
uaggcgcuguggcucuguuuucagucccugaugggagaaaccagaacgcagcccug

SEQ ID NO: 4113567 - RNA, 77 nt, Human
uaggcgguccuuauuguuacuccuccgccuuuauaguuguggaaacugaggcucagaagugccaagugaccugccua

SEQ ID NO: 4113568 - RNA, 64 nt, Human
uaggcuacagaacugcaggaggaaaagcaauacuagcuugcuaccuagaacauucuguccccug

SEQ ID NO: 4113569 - RNA, 74 nt, Human
uaggcuauagaaguaagcauugugaugggggaagagccacucguuuuguaacaaaugccuuguuccauugucua

SEQ ID NO: 4113570 - RNA, 69 nt, Human
uaggcucuuucuaguucuuacaugaugugagucuauauaaugcacauuugaaggaauuagcauugccua

SEQ ID NO: 4113571 - RNA, 55 nt, Human
uaggcuggagcuucggugugugcuuuugcuauacagcuuacaguucuaaugccug

SEQ ID NO: 4113572 - RNA, 94 nt, Human
uaggcuggugaauucuuuaggugaauuucuacaagcaacaccuggagcuucugacaucuuagaaauucaaugcucugaguaguuggcuagccug

SEQ ID NO: 4113573 - RNA, 65 nt, Human
uaggcugguuuuauaggugaaauauuacucuuggaaaagacugguuuuucucaugaaaaugcuua

SEQ ID NO: 4113574 - RNA, 83 nt, Human
uaggcugugcgaggucucagagucucugacaagucccucauuagcucauccuuguuugcaugcucugugaccuguacaguuug

SEQ ID NO: 4113575 - RNA, 80 nt, Human
uaggcuuacuacaucuugcauaucuauaaccacucuggaggaauuuggaggaguaaggaguguguggauguauaugucug

SEQ ID NO: 4113576 - RNA, 126 nt, Human
uaggcuugagagaaugguuauuguuuuuucaauaauugcuuuguaucuucaguuugucuuuccauaaaaugggaauguaaucauggaaugcuagcaauacaaaauuugaaggcuucuacaggucua

SEQ ID NO: 4113577 - RNA, 68 nt, Human
uagggaaaauccuuccuucauuugacaggugaagaggggacucaagcccagaaaggggaggauccuug

SEQ ID NO: 4113578 - RNA, 56 nt, Human
uagggaaauuguggaacuuuuaaaauacagagggguuccagagauuguuucaccug

SEQ ID NO: 4113579 - RNA, 106 nt, Human
uagggagaagguaaaacuuuacugcagaugucucaauuuuauucagauguuucuuuugaguauaggcccuuuuugcaaggauaaguauugcuuuuuuuucccccua

SEQ ID NO: 4113580 - RNA, 76 nt, Human
uagggagaaugcaauauagggaagauagauuauuaacuuucuaaaaaugugguucaucuuuguauugcuuccccua

SEQ ID NO: 4113581 - RNA, 68 nt, Human
uagggagcaugccaggaacaaacaguggugcccacucacugggcccauuucuugaguucagcucuuug

SEQ ID NO: 4113582 - RNA, 87 nt, Human
uagggagcuuuaggaaaaucaugagagaugaaagaauuugaaaaaagugaaguuacauuuuuacagauuguucugaggucucagcua

SEQ ID NO: 4113583 - RNA, 55 nt, Human
uagggauagaagugacuggagcaaagaaauuugcugucaguuguuuuugucucua

SEQ ID NO: 4113584 - RNA, 56 nt, Human
uagggauggaaacccguuuucuagacacucuaacacacauaagguuuccauuuuua

SEQ ID NO: 4113585 - RNA, 56 nt, Human
uagggauugauuaccaugguugauauguauaauggagaacuguaauuaauacccua

SEQ ID NO: 4113586 - RNA, 62 nt, Human
uagggccaugucugucuuguucacuuguauaugcccagggcccagcacagagcuuggcucua

SEQ ID NO: 4113587 - RNA, 66 nt, Human
uagggcucgggcacaggacaggcgauuugacaucagaaaauccugcaggggcuggccuggccucua

SEQ ID NO: 4113588 - RNA, 115 nt, Human
uagggcugacugaguuggggaguggguggaguguaaaauggcagcuugaccaggcugggccauagccacucaucugaccacuuuaucucucaccucuucccccacuuuggccuug

SEQ ID NO: 4113589 - RNA, 56 nt, Human
uagggcuguggucaguccucuaccuugucauauagcacaguguaccacagucccua

SEQ ID NO: 4113590 - RNA, 85 nt, Human
uagggcuuuaccccauagggccugcuggugcuuccauugagacauccacucucacaacaggaaggaccagcuggccucagcucug

SEQ ID NO: 4113591 - RNA, 69 nt, Human
uagggcuuugauggcauucucauauugcuucacagugguaagaguauaaaugauggaaucauagcuuua

SEQ ID NO: 4113592 - RNA, 61 nt, Human
uagggcuuugcgauggcuauucccucucucuggaauacuuuucuaucacagaucugcccug

SEQ ID NO: 4113593 - RNA, 78 nt, Human
uaggggaccgugauuucuggcuuucuauauuugagagcuuccagaugaagagagaacagugaguucuggacaucccua

SEQ ID NO: 4113594 - RNA, 62 nt, Human
uaggggaggguguccauuugugauuugacuaauggagauucacaaagucacccuuacaccug

SEQ ID NO: 4113595 - RNA, 108 nt, Human
uaggggcuugcuguaaugcagucacuuggugaacacauuaugugcuucugggagauaauaagcuacaucgauggucagccgaggagaucugcuccacagagaccccua

SEQ ID NO: 4113596 - RNA, 79 nt, Human
uagggggagggcuacuggcaucuacaguggaucuacaguauauaggccaagaucuuaugaugcacagggcagcccccua

SEQ ID NO: 4113597 - RNA, 58 nt, Human
uagggggcuuugcugcuugacacaggcgcucccuaccauggcacccagagucccccug

SEQ ID NO: 4113598 - RNA, 97 nt, Human
uaggggucacaucaccaaauaugagaauauuguuuuaggccccgcaaugcuuucucagcuguguggugucugacagcucacccagguugcgccccua

SEQ ID NO: 4113599 - RNA, 62 nt, Human
uagggugacccuguuucuacaaauaauuuuuaaaauuagcugggcauagcggugcacaccua

SEQ ID NO: 4113600 - RNA, 58 nt, Human
uagggugacugcuccuuucuugacuuuguaguggaaagguauaaggaaugucauucug

SEQ ID NO: 4113601 - RNA, 66 nt, Human
uagggugcaguuaagugguccucucuucagaggagcuucagagaccacuuaacuuugaccacuuua

SEQ ID NO: 4113602 - RNA, 74 nt, Human
uagguaggcagucacuaguaaauacaggugccagagaacauggcagccuggagacuuugugaaauggcugcuua

SEQ ID NO: 4113603 - RNA, 62 nt, Human
uagguagggaaaugguuccugucugaaaagcaaagggaggaaagccaaucucucuugaccua

SEQ ID NO: 4113604 - RNA, 78 nt, Human
uagguaucuguucacuuaagcuuauugugacaaauaauuuauaaccaauuucacaauuguaucagaaaauaguaccug

SEQ ID NO: 4113605 - RNA, 57 nt, Human
uagguauuaaauauuaggauauucagagaccugaguuauaaugaauauuugaaccug

SEQ ID NO: 4113606 - RNA, 101 nt, Human
uagguccuggcaggccccauggucacuccugagcccuggggucagugugggaggccacacaguaccccaaggcugggcuccugggagucagccccgaccua

SEQ ID NO: 4113607 - RNA, 65 nt, Human
uaggugagaggaaccauguuuagacgagcaacccaaguuuccuaacaauggacuccucuuagcua

SEQ ID NO: 4113608 - RNA, 69 nt, Human
uaggugucuuguguaugguacaaguuugaaaguguuuaugugcacuaccuguuccauucaucauaucua

SEQ ID NO: 4113609 - RNA, 61 nt, Human
uagguuaccaccuaaccccuaauugugugucuuaccacauaaugcaaguggugguaaucug

SEQ ID NO: 4113610 - RNA, 67 nt, Human
uagguuaguguauuuucaaauguagagcauuccaaguucuacauguucacaugaauguacuuucuua

SEQ ID NO: 4113611 - RNA, 74 nt, Human
uagguucacacaucuuccagaucuacugauccuuaagaacaagggcaggccaaguugaaagaugucagagccua

SEQ ID NO: 4113612 - RNA, 107 nt, Human
uagguuccgauuuaguaggucuggaugagacucagaauugcuaacaaacucucagaugcuggcaguucuacuuauccauagacaucguuuugaacaccaaugaccua

SEQ ID NO: 4113613 - RNA, 79 nt, Human
uagguugaugcaaaaguaguugcaguuuuugccauuuaaaaguaauuccaaaagcagcaaauacuuuugcaccaaccua

SEQ ID NO: 4113614 - RNA, 82 nt, Human
uagguuggcuucauguuauugacucauaauaucauggccaacugaaauauuuugaaguuaauaauguguaccucuaacacua

SEQ ID NO: 4113615 - RNA, 61 nt, Human
ucaagacaggguuuaagguugagaguuuggaacuacucacuucaaccuggcucugccuuga

SEQ ID NO: 4113616 - RNA, 61 nt, Human
ucaagagauauaugcugguuuaagauacacaaaaacuugaacaguacuugagaucuuuuga

SEQ ID NO: 4113617 - RNA, 56 nt, Human
ucaagagcauguaucucccuaaauuggauuguaauuuggggauucccuguuuuugg

SEQ ID NO: 4113618 - RNA, 78 nt, Human
ucaagagcuuaaugcccuggagucagaggucugaauuccaucagggcuuuugaauuccaaggcauuaggacuauguga

SEQ ID NO: 4113619 - RNA, 73 nt, Human
ucaagaggcuagccggcucacuaauuagaccuugcaacacugguucuuuuuagcuuagcauggcugcuuagga

SEQ ID NO: 4113620 - RNA, 124 nt, Human
uauuuuuucccuucuauaauugaaauguacaagacugugcucuaagagugguguuuauuuaaauuuccauuuuaaaauagucuauguuuauaaucagcauuuccaauuaugaagauuuaaaaua

SEQ ID NO: 4113621 - RNA, 71 nt, Human
uauuuuuuggaccauuuauuaguucuuaagaugguaaugccaggcuuaauuuuuguaguagauggaaaaua

SEQ ID NO: 4113622 - RNA, 129 nt, Human
uauuuuuuuauugcuggcuggaucuuaggcaaaauaagccucuccuguuuccccaguugaggacaauugagaaaggcuuauguuugccaaagaauaucucaugcuagcaacaaaacuuuuaaggaaaua

SEQ ID NO: 4113623 - RNA, 70 nt, Human
ucaaaaauaaugaggucaugagggcuguuucaaaauuaauacaauucucucauaucuuauuacuaaguga

SEQ ID NO: 4113624 - RNA, 63 nt, Human
ucaaaacucauuuuggaaguaagcaguguaucccagggcugagguuccaaaaucaggauuuga

SEQ ID NO: 4113625 - RNA, 87 nt, Human
ucaaaagagacaaacuuaagguuguuugugaugcaaaauauuuaguuuugaccuaugaaacaaaccaguaauuuuguuggccuuuga

SEQ ID NO: 4113626 - RNA, 79 nt, Human
ucaaaauaauucuccaauuuuuguuguugcugaucacacugacauugcaaacuuuagaaguaaggaugaguugaguuga

SEQ ID NO: 4113627 - RNA, 62 nt, Human
ucaaaaucaaugauugaaguggugaacucuuaacuuuuucaucacauaugucaugauuuggg

SEQ ID NO: 4113628 - RNA, 65 nt, Human
ucaaaaugugcuucuuacucucaaugcaaauuauuuccagagcugggggcacaucauucuuuuga

SEQ ID NO: 4113629 - RNA, 57 nt, Human
ucaaaauuauuuagagcagacaguucuauauggagucuaaugcucaaauacuuuuga

SEQ ID NO: 4113630 - RNA, 57 nt, Human
ucaaacaccaucugaccuuaugucaaucaucugcuucauuagguuuaugguauuuga

SEQ ID NO: 4113631 - RNA, 62 nt, Human
ucaaacuaccucugugagccccauucaggcaauaggaguuuggagcagcugaacagaguuga

SEQ ID NO: 4113632 - RNA, 68 nt, Human
ucaaacuauguggcaacaaaagagccuaguguaccucagaauacacuuuggaugccacuggucuauga

SEQ ID NO: 4113633 - RNA, 68 nt, Human
ucaaagauuugaaagacuucuccugugaaaacauuagaaccuaauaaugcuuuggagaagcucuuuga

SEQ ID NO: 4113634 - RNA, 64 nt, Human
ucaaaguaccauuaucaguggacacccacuccacguggcacuacugugagaauggaaaccuuga

SEQ ID NO: 4113635 - RNA, 74 nt, Human
ucaaauacaagguuuuugguuuguguaucugaaagugcuuaguauauaugaggaaccacaaaccaaguguauga

SEQ ID NO: 4113636 - RNA, 130 nt, Human
ucaaauaccuuuuacuucuuugaaaaauguaguacuuauugugauaccaugcaguaguccugaaaaugcuucaaaaggauuccaaguacuuuauguuacuguaaacugcaccaugaauguggaaaguuga

SEQ ID NO: 4113637 - RNA, 69 nt, Human
ucaaauacucuggauguguuugugaaucugugugaaucuauaucacuacauaaccauccugauauuuga

SEQ ID NO: 4113638 - RNA, 76 nt, Human
ucaaauauguucaaaauagaucacuaguacagaugcagcaaaggcaaaaacaguaggaucuguugaauaaauuuga

SEQ ID NO: 4113639 - RNA, 76 nt, Human
ucaaaucagagauaccaugucacuuuaacaaauuaguguuacugcauuugguuuuaauagugacauccugauuuga

SEQ ID NO: 4113640 - RNA, 79 nt, Human
ucaaaucugcuccagcgggccagucuagccccaaagggauaaaggaguugaggguaggcugcuccuggggcccuccuga

SEQ ID NO: 4113641 - RNA, 56 nt, Human
ucaaauguguugguauggcuuuugaauaaaagaguugucccauacugacauauuga

SEQ ID NO: 4113642 - RNA, 64 nt, Human
ucaaauguuuguuuauguauauauacgugugguguuauguaugaaugcugggacaaauauauga

SEQ ID NO: 4113643 - RNA, 98 nt, Human
ucaaauuucauuuugcccaggaaaugaacuucugauuuuugcaguuaguaauuuacaacuaaucaagguucuucuuggggaauuugccaucaauuuga

SEQ ID NO: 4113644 - RNA, 100 nt, Human
ucaaauuuuguaucaaaauuuaaagucuaguguagcaugaccuuuaauaaucauugcaguucuucauguaugcuuugauuuuagauguuugauaauuuga

SEQ ID NO: 4113645 - RNA, 126 nt, Human
ucaacaaaacagaaaugcacuaguucaaauuuugaagguuaucuuuuucuaauggaagguauggaaacuuuguucuauuuuagagaugaaagcuuagagucuagaguauuaugauuauggugcuga

SEQ ID NO: 4113646 - RNA, 66 nt, Human
ucaacaauaauguauugccaaaagucagccauauuguuguguguagcugcaguucguuaguguuga

SEQ ID NO: 4113647 - RNA, 56 nt, Human
ucaacacucuuuggcacaguuacacggccaaagugauuaggugcuaagagugugga

SEQ ID NO: 4113648 - RNA, 78 nt, Human
ucaacacuuuuauagcuauuuauugagcuccauuguguacaagguacuuuaauaagcguagaagguauaucagguuga

SEQ ID NO: 4113649 - RNA, 129 nt, Human
ucaaccaccacccucuuaagcugagcuaguagaacaagugaggaucugccuguaauuacugcuuaauucauuugcauguggauguucucauuauaaugucauuagcauggggagggagucugguugcca

SEQ ID NO: 4113650 - RNA, 96 nt, Human
ucaaccaccuuuggugcaggaagaaaacuaauuagaugggcaaugcuguaagccauaucuauuuguuuuagauuuucuucagucuaaaagaguuga

SEQ ID NO: 4113651 - RNA, 63 nt, Human
ucaaccaucgccucccugcaccccggcccaggccccuaccugggaguggagagcaauggauga

SEQ ID NO: 4113652 - RNA, 62 nt, Human
ucaacccaaagacaugaggcauguaaccaggacaagaauuucagacuguacuuugggguuga

SEQ ID NO: 4113653 - RNA, 67 nt, Human
ucaacuacauagaaauuaguauuugccauaaaagguacagauacuauggaauuuuaugagagguuga

SEQ ID NO: 4113654 - RNA, 59 nt, Human
ucaacugauaaaguugccuuagauguuccuuuugucugagggacaauuuugaugguaga

SEQ ID NO: 4113655 - RNA, 69 nt, Human
ucaacugguuauaggaugauuucuucuguguaguuauuugaaugcuauauucauuuuaaagccaucugg

SEQ ID NO: 4113656 - RNA, 85 nt, Human
ucaacuucagccucauuuguuggccuagagugguugcuugauagcguuucacaucuauacccaauaauuugaaggcaggagauga

SEQ ID NO: 4113657 - RNA, 60 nt, Human
ucaacuuggcuuuuuaaaguccuguuuacauuuuuaacaacuuuauugaggcauaguuga

SEQ ID NO: 4113658 - RNA, 61 nt, Human
ucaacuuucuaucucuauccuguuuguuuguuuaaagaggcuggauugagcauagacauga

SEQ ID NO: 4113659 - RNA, 55 nt, Human
ucaacuuugaaaccauagugaaaucuguauucuagacuaaugguuucaaaguuga

SEQ ID NO: 4113660 - RNA, 62 nt, Human
ucaacuuuggauggcuguguguuuauuucaaaaugauaucacaguugcccaaauauuuuuga

SEQ ID NO: 4113661 - RNA, 88 nt, Human
ucaagaauuuuccaguuucauagcuacgauuuugggugaucuugucaagagcuuccaguuucauagcuaaggaacuguuuauucguga

SEQ ID NO: 4113662 - RNA, 55 nt, Human
ucaagacucugggaguugaauccuauguuggaaaccauucucccuagaauuuuga

SEQ ID NO: 4113663 - RNA, 108 nt, Human
ucaagaggggcuuggagauguagauguuuggguauugcuucaggauauagcucuauuauuuuuguuuguuuguuuuagccagagauccaucccuaggaccuuucuuga

SEQ ID NO: 4113664 - RNA, 70 nt, Human
ucaagauauauaucaaagaaucaagauagugagguucacagcuucuugauagguuuuauguauaguuuga

SEQ ID NO: 4113665 - RNA, 130 nt, Human
ucaagauauugguaauacugucauauuuuuggaauggugcuguacagauuauucagugaaaauaauuauucucuguucaggaauuuacaguuuagcauuucaaguugacaguuuagcauauaauccugua

SEQ ID NO: 4113666 - RNA, 103 nt, Human
ucaagaucugugacuaaagccaggguucagucugugacugggauuugguauuugaugcucugcuagaaacagcauauauuagcccuccuuagucugguguuga

SEQ ID NO: 4113667 - RNA, 59 nt, Human
ucaagauguccagugccuauaaaaugaacuguaaugaccuuggguaaauggcauuuuga

SEQ ID NO: 4113668 - RNA, 61 nt, Human
ucaagauuucauuucaguggcacagaagaugaagcacauccuuuguguccuaguguuuuga

SEQ ID NO: 4113669 - RNA, 59 nt, Human
ucaagcaguuuuuauaacacuggaauaugaaaacgauauauucauuagagacuguuuga

SEQ ID NO: 4113670 - RNA, 79 nt, Human
ucaagccaguauucaagccaaauucaagccaguauuaauaauauaauggcuuuaaaaugguuugguauuccuggcaugg

SEQ ID NO: 4113671 - RNA, 80 nt, Human
ucaagccguugaaauguguucaguuaaagccaguggccauaaacgugacccaugagcuucaacugacacagaaacuuuga

SEQ ID NO: 4113672 - RNA, 86 nt, Human
ucaagcuuagcaacuuuucuuucucugugcugccaaaggacaggaggagauacagagaugugaaaagcucuaauucuuuagcauga

SEQ ID NO: 4113673 - RNA, 70 nt, Human
ucaagcuuguuucuccugggggugcucuuccaaggauauuugggcugccuccggaguugcagugucuugg

SEQ ID NO: 4113674 - RNA, 98 nt, Human
ucaagcuuuuguucuuuugaggccugguuuccagcauccuugcugcuaaauuuggagaggaucagguugccaggacucgggggccaggagagucuuga

SEQ ID NO: 4113675 - RNA, 60 nt, Human
ucaaggaagggauauucuugaaacaaccuguuuucccagcuguucuuucccauuccuuga

SEQ ID NO: 4113676 - RNA, 78 nt, Human
ucaaggacaauuuuguugggagaaacauuauuuuauuucauugaaaaugaguguaucugcgacaauguuuguuuuuga

SEQ ID NO: 4113677 - RNA, 80 nt, Human
ucaaggcagcaugaaggagggaaagcagugcuucucugcuaccuugcuuagaaaugcugcugacccugcugcugccuugg

SEQ ID NO: 4113678 - RNA, 91 nt, Human
ucaaggccaagaaugacuuucuuuaaaauauuuuugugaaaaaggaagaaacaaguaaauguccuuagagaaaagucagugcaugguguga

SEQ ID NO: 4113679 - RNA, 85 nt, Human
ucaaggcuuuuagaaucuuauuucuaauaauauaucccccaaaaccccuaggauaauguuuagaaaauuaggaaaagaguuuuga

SEQ ID NO: 4113680 - RNA, 65 nt, Human
ucaagggcuuuaaugauuauuuucucuaacaaccagauuuuagagacucauaagaagccacuuga

SEQ ID NO: 4113681 - RNA, 88 nt, Human
ucaagguacacaaugugaugauuugauaaacguauugggaaaugauuaccacaaugaaauuaaucaacacauacaucaguacacuugg

SEQ ID NO: 4113682 - RNA, 71 nt, Human
ucaaggugccagauagauuuggugucugguugauaugguuuggcuguguccccacccaaaucucaucuuga

SEQ ID NO: 4113683 - RNA, 55 nt, Human
ucaaggugccagcaaguuagagccuggucucugugcuuccaagauggcaccuuga

SEQ ID NO: 4113684 - RNA, 125 nt, Human
ucaaguaaacagauagauuugggccagguaaguugauuuuggagagaugaaguucuguguagggauuucccuuuauuaagcucaugucuuuagugccacuuuuguguccugauuuucuaacuuga

SEQ ID NO: 4113685 - RNA, 106 nt, Human
ucaagucucugaaucugugucuccaugacugaaagcuuuguaaauaaacagguguccacuuaucccaaugugaauuaaaguuucauggagccagagggagaguuga

SEQ ID NO: 4113686 - RNA, 60 nt, Human
ucaagugagauggcuggugagguuuggugguugagaagucaucaguccuuuucauuauga

SEQ ID NO: 4113687 - RNA, 57 nt, Human
uaguauucagcuucucaggcaaaggauguauaaacuaggcaggauaggcugagacua

SEQ ID NO: 4113688 - RNA, 118 nt, Human
guugguccaaguucaguaugugaauggccuguggagaagcuggcaccugcaccaagcagguaaacccacaccugaggggcugcaggccagcucaggccccaugccuacaggagccggc

SEQ ID NO: 4113689 - RNA, 73 nt, Human
guuggucuuugguuucugagugucaccuggcuuagcucuuucauuaccaggcauuuagagaguaaaaauuagc

SEQ ID NO: 4113690 - RNA, 71 nt, Human
guuggugcaaaaguaauugugguuuuggccauuacuuucaauggccaaacugcaauuauuuuugcaucaau

SEQ ID NO: 4113691 - RNA, 129 nt, Human
guuggugcuaacaaaacugccguuuuugccauuauggcaaagauaauggagacugacacaaagauacuuuccaaaguaucuuuguaucaaucuccauuauggcaaaacccgcaauuaguucgcaccaac

SEQ ID NO: 4113692 - RNA, 82 nt, Human
guugguggggauuggggagagcuaauauuuuauagucuuucuguagaauaugauuaauuuucuuaaaaaaaaccccaaaaac

SEQ ID NO: 4113693 - RNA, 69 nt, Human
guuggugguggcagggcaaugcucccucuggaggcuuugaggaggaaucuauucccugccucuccuaac

SEQ ID NO: 4113694 - RNA, 60 nt, Human
guuggugugccaguggguagucuugcuucuggucugagaaaucccaaggcaucaaccagc

SEQ ID NO: 4113695 - RNA, 80 nt, Human
guugguuaucguuucuguauucugguucccugguacaauaucugagccauaagaguacaggagauauuucuuaaauuaac

SEQ ID NO: 4113696 - RNA, 68 nt, Human
guugguuccccagcauccauucugcuacagcccuguugaguagcagcagugugguuuggggaauugac

SEQ ID NO: 4113697 - RNA, 77 nt, Human
guugguugcucauguaguccguagaaagccaucuuugaauaggugacaaaguuugaaaugucugcaagggaaccagc

SEQ ID NO: 4113698 - RNA, 74 nt, Human
guuguaauagaauaguggaaacauugacuacagcacguuuuauugcugaaugcaauuuucagcuauuuugcaac

SEQ ID NO: 4113699 - RNA, 87 nt, Human
guuguaauaucauuuuuucagaaaggcuuaucaugcuauaagaagacuuauggaagggagcuggaauuuggaggauaauuuugcaau

SEQ ID NO: 4113700 - RNA, 119 nt, Human
guuguagacuaguuaauugugcugugucaaucaauuucuugguuugauaauacgcuuuaguuaugcauguuaccauugaggggaagcugggugacaggcacaagggacuucucugcaac

SEQ ID NO: 4113701 - RNA, 60 nt, Human
guuguagcauguaauuucauuuacuuuucaucaagguaaauguaaauggcgucuugcggc

SEQ ID NO: 4113702 - RNA, 77 nt, Human
guuguagucugcguuagucuuggcugaucuugguuggauuuacucguguuucaguuagcugacaaguaggcuagagc

SEQ ID NO: 4113703 - RNA, 78 nt, Human
guuguaguuucugugacucagggaucugggccuggcuuagcuaggugcucugcucacaggucucucccaagcuacaau

SEQ ID NO: 4113704 - RNA, 83 nt, Human
guuguaugaaagcagagucugugugcacuuuaguuuauccuuuuauuuucaaagccuaacauagacucugcaacaucauagac

SEQ ID NO: 4113705 - RNA, 58 nt, Human
guuguaugggggagucaugcagacuuggauuuaaaucuggaugccaccacauacuaac

SEQ ID NO: 4113706 - RNA, 57 nt, Human
guugucaagaaggggacugucacaccugcuaagcagguuaagcuuguuuuugaaagc

SEQ ID NO: 4113707 - RNA, 94 nt, Human
guugucaauauguaguuagaagggcauacuaacauaauuuaugcaacucuuugcauuguauuaaaauguguuucuguuuuagcuuguugaugac

SEQ ID NO: 4113708 - RNA, 71 nt, Human
guugucagcaaacagaugucuccuuuagccuaaggcacacucagagcuacuagggcagcuguugcuaugac

SEQ ID NO: 4113709 - RNA, 74 nt, Human
guugucagggagagccugucugacgugaggccuggaaagccccgcuccaggucagcaugcuccucucuguugau

SEQ ID NO: 4113710 - RNA, 79 nt, Human
guugucaucucuaggggaauugcaguguguccauccacccuugaggcauggcaaggugaacaucccuuggacugaagac

SEQ ID NO: 4113711 - RNA, 73 nt, Human
guugucauuacuucucaugcuucaugcccaucacagacaugggggugucagcagaaggggcagagaugaugac

SEQ ID NO: 4113712 - RNA, 75 nt, Human
guuguccaguuugcagauggcagguaguagaacuucucagccuccauaaucauguaaguaaauucucuggagaac

SEQ ID NO: 4113713 - RNA, 83 nt, Human
guugucuaaguggagggcuaagcugagggauaggugccuucuugccuccuccugagcucuggccuuuccagagcuaagacagc

SEQ ID NO: 4113714 - RNA, 77 nt, Human
guugucuucugcagucuagauguuuccuguuggauuggcccaagugggauagguaggcagggagcagagaggauagc

SEQ ID NO: 4113715 - RNA, 64 nt, Human
guugugaauagugccgcaauaaacauaugugugcaugugucuuuauaguagcacaauuuauaau

SEQ ID NO: 4113716 - RNA, 64 nt, Human
guugugaauagugccgcaauaaacaugcgugugcaugugucuuuauagcagcacgauuuauaau

SEQ ID NO: 4113717 - RNA, 77 nt, Human
guugugacuaaauuuaucacuugcaggaguuucaauucucaaacaugagcuccuguaguugcuaaguuuguuucuac

SEQ ID NO: 4113718 - RNA, 58 nt, Human
guugugauuccaugauguuuucucuaaaacacugaggaaagggcaugggcaugacaac

SEQ ID NO: 4113719 - RNA, 62 nt, Human
guugugccagccucuggcugugucuuugugccuggaguacuucuggccaggcuggccacugc

SEQ ID NO: 4113720 - RNA, 57 nt, Human
guuguggagcgggcagguaggacuauuguucccguugcgucuuggcugcugugcgau

SEQ ID NO: 4113721 - RNA, 74 nt, Human
guugugugguaaccacacuuacaguuuuauaagaaaucaccaaauuguuuuucauugugacugugccacauaac

SEQ ID NO: 4113722 - RNA, 67 nt, Human
guuguuaucguuuuguccagagagugguuuaagaagcagugcuggucucugagcccaauguagcaau

SEQ ID NO: 4113723 - RNA, 69 nt, Human
guuguucagccuagagugcaguggcaugaucauagcucacugcagccuugaacucugggcugaagcuac

SEQ ID NO: 4113724 - RNA, 81 nt, Human
guuguucuccaugggaggcaguggagaagguuugugacagacccugugagccuucauuuauggcugccacggauuacacac

SEQ ID NO: 4113725 - RNA, 66 nt, Human
guuguugaagcagauggucuggucauugccuggacucuccaaacaguaggccuucugcuuuaaaac

SEQ ID NO: 4113726 - RNA, 79 nt, Human
guuguuuagcauuggcauuucuccagcggaauacuagccagugguccagucauguguggaggaggucaugcugauuaac

SEQ ID NO: 4113727 - RNA, 77 nt, Human
guuguuuauuauuucuuccagugcuuccuaaacuuuuccacugaaguacugacagagaagaaugaaagcuacacaac

SEQ ID NO: 4113728 - RNA, 66 nt, Human
guuguuuguaaugacaggagacaaagaauggcugcugagagugaucucuuguuuuacaagcucggc

SEQ ID NO: 4113729 - RNA, 78 nt, Human
guuguuugucauaauaucauuacagauguuuucacucguaauccauuuauuugguaaugauccaguaugauuuauaau

SEQ ID NO: 4113730 - RNA, 108 nt, Human
guuguuuguuucauaggucagauucaagcaaugcccugguauauuaauagacuuaugaaugcuaauauuuucaagggcauuauuugaagacauauuuuuucagauuac

SEQ ID NO: 4113731 - RNA, 80 nt, Human
guuuaaaacugagucucccagcguuaaaccuaaugagcaccugcuaagagagagcugcgggaagacugagacauuuagau

SEQ ID NO: 4113732 - RNA, 81 nt, Human
guuuaaaagcagcagcuauauagaagcaggggaaaggguacucauucuguuuucuccucuacauagacugugccucuaagc

SEQ ID NO: 4113733 - RNA, 99 nt, Human
guuuaaagggcccugugugaagaaaauggcugagguuuucccaaaauaaaagauguuuggaaauggcuguaguuaugaaguuucgcucaccuaaugaau

SEQ ID NO: 4113734 - RNA, 75 nt, Human
guuuaaaugcauauuccugggaccccuuucucacaucaagaagcaggguagaucccaggaaucugcauuuuuaac

SEQ ID NO: 4113735 - RNA, 84 nt, Human
guuuaacaauaagacugguuuacugagguuaggcucaauaaaacuguuugggccugcuauuggugggcagacuaauugcacaac

SEQ ID NO: 4113736 - RNA, 90 nt, Human
guuuaacuauuguauagugaagaauauagauuuuuugaagucuuuauuaaacauauuagggucucuaaauucuagcuaacaugguaaagc

SEQ ID NO: 4113737 - RNA, 111 nt, Human
guuuaacucuaagaaacucacucauacuuaagcagugcuaguugagagaagcuauggagaaagugacaaccaguauguuuaggaggugaguuaguuuuuggcaguucuaac

SEQ ID NO: 4113738 - RNA, 74 nt, Human
guuuaagaaggcuguuugcuagaccuuugccacucaaaaugugguucaauguuuuagagcagugcuuuucaaac

SEQ ID NO: 4113739 - RNA, 64 nt, Human
guuuaagagcaacauauggugacauuuccuuuaaaaaaguguuaucacaauauugcuuuuagau

SEQ ID NO: 4113740 - RNA, 129 nt, Human
guuuaauaagugucaggcacuguucuaaguccuuauaaaauuucugugaauuguauagugggauaauaauaauacccacuucacagaaauuuuaugaggacuuagaacagugccugacacuuauuaaac

SEQ ID NO: 4113741 - RNA, 69 nt, Human
guuuaauauuccaagugggggaagcugagucuuugcagucggaccuggcuuccaaucuaggagcuaaac

SEQ ID NO: 4113742 - RNA, 56 nt, Human
guuuaauauucuuaaaaacccugucuuggaaaggacaguuaguuaggaaguuuuac

SEQ ID NO: 4113743 - RNA, 58 nt, Human
guuuaauucccacaccugcccuagaaggcacuuccuagggucgguauagggauuaaau

SEQ ID NO: 4113744 - RNA, 70 nt, Human
guuuacagugacucacauuaacaacugagguuugaaucacaaauuguuaauaagaguuugcgcuguccac

SEQ ID NO: 4113745 - RNA, 98 nt, Human
ucaagugugguuuacuaucuugcagaggccagcaaccacaguaaauuggaagauccuggguauuucuggugcucagagcaagaaugguucauauuugg

SEQ ID NO: 4113746 - RNA, 60 nt, Human
ucaaguuuagucauggugguagugguggugaugugauacugcugucuuugaagugcuuga

SEQ ID NO: 4113747 - RNA, 58 nt, Human
ucaaguuucaugauguaauuauugcuuggcaaaguaaaagaugggucuggaaucuuga

SEQ ID NO: 4113748 - RNA, 56 nt, Human
ucaauaaaucccucugacccuggaugucauccccaggguuuuuccaguuuguguga

SEQ ID NO: 4113749 - RNA, 73 nt, Human
ucaauaagcgauuggcuguuguuggccaucagcuguaggaauagucagcaauaguuaguuuacaacuuuuuga

SEQ ID NO: 4113750 - RNA, 80 nt, Human
ucaauaccagugauuugcccaacaccuucagugaagccucugcucucugagggucuaaggagucacucgcugguauuuga

SEQ ID NO: 4113751 - RNA, 86 nt, Human
ucaauacgaaugguaccaacaccaaagucuuuaucuaggauuccuucaaagaguugggugucugggcaacacucauuuguguuaga

SEQ ID NO: 4113752 - RNA, 66 nt, Human
ucaauagcaaucaagccuuccaagcauggguguuuuaaugcuggcuggaggcugaaugcagucuga

SEQ ID NO: 4113753 - RNA, 130 nt, Human
ucaauaugcaccuguuugaaguaauuucuuuaguaagugaaucugugccacaauaguuacguguucauaacauuauuuucugaagauaucaaaguguuauaucaaaacugcauguuuagcugucaccuga

SEQ ID NO: 4113754 - RNA, 68 nt, Human
ucaaucacagagauugcuuuuaaaaacaaaccucgguuuugaaagguagauucucugcuacugauugg

SEQ ID NO: 4113755 - RNA, 73 nt, Human
ucaauccucucaggcccuucucccaggacucccucuugagucugaguucuggucagcagggcagccggguuga

SEQ ID NO: 4113756 - RNA, 59 nt, Human
ucaaucuguguaugcugggaguaguaaaaucacaaugcagcucuaaagccacagauuga

SEQ ID NO: 4113757 - RNA, 61 nt, Human
ucaaugaagagauuuaaaucauuugguaguacccaaaugauguugggaucacuuuaauuga

SEQ ID NO: 4113758 - RNA, 82 nt, Human
ucaaugaauguuuguugagugaagaaaugagaacuugagaaaugaaggaauucagcuccuucacucauucagcauucacuga

SEQ ID NO: 4113759 - RNA, 57 nt, Human
ucaaugagcuggggacguguacucuuucuguucuguuuccgcccgucagcucgguga

SEQ ID NO: 4113760 - RNA, 57 nt, Human
ucaaugagguaaucagucacccacaaagcauggagucaaugaaaaggccucauuuga

SEQ ID NO: 4113761 - RNA, 79 nt, Human
ucaauuuguccuuuaaauggauguucaacugauuaagagaagcuaaucaucaguuacgaaauccauaaggcacagauga

SEQ ID NO: 4113762 - RNA, 74 nt, Human
ucacacagauugguagagcugagaucugauauggcccaccugaguccaaagcucacgcucuuuuaacuauguga

SEQ ID NO: 4113763 - RNA, 73 nt, Human
ucacacaggcucucuauugagugcaguuuggaagcggauuuuggcuggaggacuagaaagaggcuuguugugg

SEQ ID NO: 4113764 - RNA, 78 nt, Human
ucacacccagauauaugucuuuaauagccaccauggccacaauguggagauggguuaauggagagaaucuuggugugg

SEQ ID NO: 4113765 - RNA, 93 nt, Human
ucacacuaucacacccaggcuagagugcagguguaugguuacagcucacuguugauugcacaccugcacucaagccaugaugugacagaguga

SEQ ID NO: 4113766 - RNA, 62 nt, Human
ucacagaaacagaauggcacagcugugccuauaugcccagaaaagccaucgaguuuugguga

SEQ ID NO: 4113767 - RNA, 62 nt, Human
ucacagaagcaucauacccggaagaugcacauuugaaaugcuauauggugguguuucuguga

SEQ ID NO: 4113768 - RNA, 59 nt, Human
ucacagagagguuaagcaguugcaaacaugaaggcaacuaguuccuguucuccugcuga

SEQ ID NO: 4113769 - RNA, 68 nt, Human
ucacagcagaggcuguguaggcagacugccugggauugagccccagcugugccacugccucacuguga

SEQ ID NO: 4113770 - RNA, 63 nt, Human
ucacagcuccagacugcaacuccuggugugaucuagccuacagaggcacucgggagucugugg

SEQ ID NO: 4113771 - RNA, 65 nt, Human
ucacagcugggguuuuggcagccuguccucggguuguucagccuggugacccuagccgccuguga

SEQ ID NO: 4113772 - RNA, 71 nt, Human
ucacaggaaggguaaauauuuaacauuuauuauguauuuuuauuuguucaaauguugcccuuuauuguaga

SEQ ID NO: 4113773 - RNA, 55 nt, Human
ucacaggagaauguacuuaccaauuacaacauuuugauaaggcauucuuauguga

SEQ ID NO: 4113774 - RNA, 55 nt, Human
ucacaggccuggggcagagggccuggccccugcccucgccccuggggcccuguga

SEQ ID NO: 4113775 - RNA, 59 nt, Human
ucacaguuauagucuguagaaugucaagauagccaagaucucugcagacuauauuguga

SEQ ID NO: 4113776 - RNA, 68 nt, Human
ucacaguuaugaggccuacguucuuugucucgaaaauagggacaauuacccuggcuugauaaaaguga

SEQ ID NO: 4113777 - RNA, 71 nt, Human
ucacauagcaaaauauuuuguuuucuugcuguaaaguguaugcaguaaagccugagauauaugcuaucuga

SEQ ID NO: 4113778 - RNA, 74 nt, Human
ucacauaggcaagaugagguuuuuauucagcucuaaaaaucaaaugauaaaaguuuccaaucaugccuguguga

SEQ ID NO: 4113779 - RNA, 79 nt, Human
ucacaucaaugucauauauuuuggcagugaucacuuauuaaugguguuugauuaaguucaaaauauagaaacugagugg

SEQ ID NO: 4113780 - RNA, 57 nt, Human
ucacauccuaucagucacgguuucagauaugaaacuagagcaugugagugggaguga

SEQ ID NO: 4113781 - RNA, 99 nt, Human
ucacaucucaguuagcuauuuuuaggaucaaaugaaauauuuugauuugcugaaaucaagcuuaauguuuaugaucugugaggcacuaacuaaauguga

SEQ ID NO: 4113782 - RNA, 94 nt, Human
ucacaugcacauacuuccugugugggcauggagaccacacgcccaugugcccgugacuccaugugcauaccugugagugaguaugugcuugcga

SEQ ID NO: 4113783 - RNA, 80 nt, Human
ucacaugguauacuagauagacaguaucaaggaccaacuuacuggaugauacuuaacaaugucugaaugcugugauguga

SEQ ID NO: 4113784 - RNA, 84 nt, Human
ucacauucucauuuccaugccuaagagccugaagcuugaacaaagggcuucaguuaguuucaugugagccaaaauggaauguga

SEQ ID NO: 4113785 - RNA, 63 nt, Human
ucacauuucuagacuuagaacucuuaggaaaaugauccauaaaaggucuaguuuggaaauuga

SEQ ID NO: 4113786 - RNA, 62 nt, Human
ucacauuugauaaugcccauuggccaaagcaagucccauggccaagggcacagucaguguga

SEQ ID NO: 4113787 - RNA, 61 nt, Human
ucaccacccccagacaggaaaaugcaggcaaaaaugagacuggauucccugggaguggugg

SEQ ID NO: 4113788 - RNA, 66 nt, Human
ucaccacugaaaaauauguuuuggagaagacuucaucuaguuauucuggcuguuuuacaggggugg

SEQ ID NO: 4113789 - RNA, 57 nt, Human
ucaccacuggaggucuuggcuuuuuuucaucauaaaggaacccccucggguggcuga

SEQ ID NO: 4113790 - RNA, 64 nt, Human
ucaccaggagccauagagucaggcugggcaagaagcacaaccggguccugaccaucuucuguga

SEQ ID NO: 4113791 - RNA, 55 nt, Human
ucaccaggcuccuguuaagaugcuauugcagaauauuucccagagccaugaguga

SEQ ID NO: 4113792 - RNA, 62 nt, Human
ucaccaucuguaucugacaaauucuugcugcuuugcaacggaagcauuucgauaagauggga

SEQ ID NO: 4113793 - RNA, 73 nt, Human
ucaccaucuuuauuagcuuuaauggggagcauuuuauugaguuagguccagaaaaguugauuuagauugguga

SEQ ID NO: 4113794 - RNA, 76 nt, Human
ucacccaucuaugaagccuucccaacuuuugacagagcuggcucuugaaaggagauuggaggcacaguggauguga

SEQ ID NO: 4113795 - RNA, 55 nt, Human
ucacccccugcccuacuccagggcccaggccaggccuuagggcucuagggaguga

SEQ ID NO: 4113796 - RNA, 82 nt, Human
ucacccucagcucccuccacccagaccagacaaacuucagguuaguuuguaggagggugcuggagguaagggagcagggaga

SEQ ID NO: 4113797 - RNA, 75 nt, Human
ucaccugacaggcuugcuaagacauagauaucugggucccacaaccagagugcugauccaggaggucugucguga

SEQ ID NO: 4113798 - RNA, 69 nt, Human
ucaccugaggugucuuagcugauaaaugcccaagcuagucugucugaugcugagacgcaaccucaguga

SEQ ID NO: 4113799 - RNA, 106 nt, Human
ucaccuggagagcuuuuccagcucacacaggcaggaucccuuccccucucaguaaggcugguggguggggcugggcguguguacugggcuacagcuccccagguga

SEQ ID NO: 4113800 - RNA, 111 nt, Human
ucaccuggagggcuugucaaaacacagauuucuuggcccacucucagauucugcuucaguaguucuguggugaggccugagaaauuguguuuccaauaaguucccagguga

SEQ ID NO: 4113801 - RNA, 58 nt, Human
ucaccuggcccagcuccagugcuuccucccccgggaagcccucccugagcgccgguga

SEQ ID NO: 4113802 - RNA, 101 nt, Human
ucaccuggcucuuuuugcuggauguaaagggugaagaaagagaaagaguuucuauuccguaucccauacuccuaccccauuagacagaaaaguagaggaga

SEQ ID NO: 4113803 - RNA, 89 nt, Human
ucaccugggaacuugcuaaaauacagacucuuguagcguaaauuugagaugaacucugagucugguauuucuaacaggcuuccauguga

SEQ ID NO: 4113804 - RNA, 89 nt, Human
ucaccugggagcuuuuagaaaugcagucucucagacuccaccaaauuuacugaaucaaaaucugcauuuuaagaaaauccuccagguga

SEQ ID NO: 4113805 - RNA, 55 nt, Human
ucaccuugugauccacccgccuuggccucccaaagugcugggauuacaagcguga

SEQ ID NO: 4113806 - RNA, 63 nt, Human
ucaccuuuauuuuccaugugaagcagauggcaaagccaccuucccacagcgaagacaaggugg

SEQ ID NO: 4113807 - RNA, 73 nt, Human
ucaccuuuuuaccagaauugccaccagaaaacuauuaauucuuuucugggaggcagugguaugagggaacuga

SEQ ID NO: 4113808 - RNA, 71 nt, Human
ucacgacacuggggauugguuuuuccuuccugcuaagacugggcuggcacugagggccacuuccaucguga

SEQ ID NO: 4113809 - RNA, 62 nt, Human
ucacgggcagauugggaagguucaucacucuaaauagguaugagcauuuuuaauuucugugg

SEQ ID NO: 4113810 - RNA, 62 nt, Human
ucacggggguauccagaggauuaaaaaauagauuuuuauaaagcucuuuggagauccuugga

SEQ ID NO: 4113811 - RNA, 117 nt, Human
ucacguauuuuggccaguggaaugugaguagacgugaucuaguaacauccaaggagaauuuuguggugcuugauuugucugcuugcacucuuacugucauccaugagaaauguauga

SEQ ID NO: 4113812 - RNA, 84 nt, Human
ucacgucaucuucuagcacugugauuaugcucaucauagcaugugauuaugcacccuuaugaauaugaucucauggaaauguga

SEQ ID NO: 4113813 - RNA, 64 nt, Human
ucacguucucucaugaucuucccgaaauguuauccuuaagcuucggggagaggugagcaacgga

SEQ ID NO: 4113814 - RNA, 69 nt, Human
ucacuaaaaauguaccuucaaucauggagaugauuucgauugccgguugacagauauacauuguaguga

SEQ ID NO: 4113815 - RNA, 63 nt, Human
ucacuauauucauuuuugguagauggaggauccagagugugacagaaauaugaaugaugguga

SEQ ID NO: 4113816 - RNA, 63 nt, Human
ucacuaugaugagguccuguaucaaguacaauuaaucuuuguacuuuacaauuuacauaguga

SEQ ID NO: 4113817 - RNA, 91 nt, Human
ucacuauggaauacugaacuuaguuaagauuaagucuccuaaaguauugggggaauugagguaugcugggcuuaccuuguucucauuuuga

SEQ ID NO: 4113818 - RNA, 77 nt, Human
ucacuauuagcaguaugauugccaguucuaucuuggugcugagaugaccaaauggcagucaucauuuuuauguuuga

SEQ ID NO: 4113819 - RNA, 68 nt, Human
ucacuauuuauggauuccuuuuuggguauaguuauuuucuacaugcucagaacaucccagauaguaga

SEQ ID NO: 4113820 - RNA, 70 nt, Human
ucacucacagaugugguuaacauguacauagccuacuggucuauguuacacuguuucacguuccagcuga

SEQ ID NO: 4113821 - RNA, 65 nt, Human
ucacuccccugccccgugucccuucaugcagaaacacgcaucagggcaugaagcagaggacgugg

SEQ ID NO: 4113822 - RNA, 71 nt, Human
ucacuccucaggcuagcaucaucugggggccgcauacacaucugguaaauugauguugaccuaaguaguga

SEQ ID NO: 4113823 - RNA, 92 nt, Human
ucacucucuacaaagcugcuucacaacugaaucaaaccaaacaaacagggcagcuggacugguuuucuggugguggcaguggguggggguga

SEQ ID NO: 4113824 - RNA, 91 nt, Human
ucacucugacuucucuguagcagacagacccuagguaagcagcaauagaacugugaaaccuguuaaaaugcuguuacagggauccagguga

SEQ ID NO: 4113825 - RNA, 61 nt, Human
ucacucugugauugcagcauuccacuguccagggaaaucaagccuugcugucagagaagga

SEQ ID NO: 4113826 - RNA, 76 nt, Human
ucacucuguugcccaggcuggaguguaguggcaugaucuugacucacugcaaucuccaucuccuggguucaaguga

SEQ ID NO: 4113827 - RNA, 76 nt, Human
ucacucuguugccuaggcuggaaugcaguggcaugaucucggcucacugcaaccuccgccucccagguucaaguga

SEQ ID NO: 4113828 - RNA, 76 nt, Human
ucacucuguugucuaggcuggagcauagcagugcaaccauggcucacugcugccuccaacuccugggcucagguga

SEQ ID NO: 4113829 - RNA, 57 nt, Human
ucacugaccugaccacuuaaccuauugauaagcuggcaaggauggagcaggcgguga

SEQ ID NO: 4113830 - RNA, 94 nt, Human
ucacugacguagcuugccucauauucuaagggcugacaaugguuauuuccugaaggcccugcugaguggaguggaggcguggguuaggucagga

SEQ ID NO: 4113831 - RNA, 68 nt, Human
guuuuaaacacaacuuugugugaauaaaaugaugugucugcaucucuccaggaagcaguguuuggagc

SEQ ID NO: 4113832 - RNA, 58 nt, Human
guuuuaaaggcuagagcaguuggggcaauauuuauucaucuguaacagccuaugaaau

SEQ ID NO: 4113833 - RNA, 61 nt, Human
guuuuaagugaugagcacaguaauuagcuugcugcugagugcaggaguucacauugagaau

SEQ ID NO: 4113834 - RNA, 57 nt, Human
guuuuacacagaaacgcaggcuuggccagacauaagacugucuuuucugagugacgc

SEQ ID NO: 4113835 - RNA, 78 nt, Human
guuuuacagugguuuuauaucuaagcuugccuuuggcaucuuaccucgcuagauguuaaaaaaaacuauauguaacac

SEQ ID NO: 4113836 - RNA, 84 nt, Human
guuuuaccuggggguggcugagcuagcuaucucagucugugaucaccuaucauaaacucuagggcgcccacuccugggugaggc

SEQ ID NO: 4113837 - RNA, 66 nt, Human
ucagcagcagcucagcauguuuacugcuuaaucacuucaugcccaagaacacgugggcuguacuga

SEQ ID NO: 4113838 - RNA, 93 nt, Human
ucagcaggcagauuuggggaagagggagcuggaaugauguacaugugaaucaucucaguugcuuucuuuuccugucugcucuucuucugcuga

SEQ ID NO: 4113839 - RNA, 80 nt, Human
ucagcaggcuuucucccucauugauuacacucauucaucucagauggagggguggucgcgaagagcaaggaagggacuga

SEQ ID NO: 4113840 - RNA, 59 nt, Human
ucagcagggccuccuugugcagaaaguaauuuguaccagcgucccugaggcccugcuga

SEQ ID NO: 4113841 - RNA, 87 nt, Human
ucagcaggguuguugguuuagcaacuuccugugucuccagacaagaguauguggagagugugccuagcccagccaagcuuugcucga

SEQ ID NO: 4113842 - RNA, 106 nt, Human
ucagcauacuuuuggucuauaaaauaaaauacuccucugaaaaucuuuuccuagguauugauauaguuuucaagagaguguucuauguuguauuaguuuuggcuga

SEQ ID NO: 4113843 - RNA, 84 nt, Human
ucagcaucucaaacaucuuugaccauagaaacuucauucgucuuggaggacuaauguuguacagauauauuuggguaaugcuga

SEQ ID NO: 4113844 - RNA, 92 nt, Human
ucagcauuuuucuucuuucuaaauguaaauaguaugaugcaguguccuguaaaugaugcuguuuaucauauacugucagaagaugcugcuga

SEQ ID NO: 4113845 - RNA, 56 nt, Human
ucagccacuuugcucugcuguggaacagugccacagcagcaggcuguguggacuga

SEQ ID NO: 4113846 - RNA, 75 nt, Human
ucagccacuuuugcuggggugugaaaucugaugauaguucaucuaacuuauguuuuaccaaauuagcauggcuga

SEQ ID NO: 4113847 - RNA, 68 nt, Human
ucagccauuuagagaagauuacaaggacaugaagcucagucacuguaggaaucucuaaauuggguuga

SEQ ID NO: 4113848 - RNA, 57 nt, Human
ucagcccggguucgcaaacacucggccccgcacaaagauggcguggagccgggcugg

SEQ ID NO: 4113849 - RNA, 63 nt, Human
ucagcccucacugggaagggaggggagcagagccccguggcucccaccccggucaagggcuga

SEQ ID NO: 4113850 - RNA, 76 nt, Human
ucagccugcccgcugcuagagaggccgaggugguccggccagccgugcgcugcugcuggugucucugugggcauga

SEQ ID NO: 4113851 - RNA, 59 nt, Human
ucagcgccuaaguuuuaagccagugggaauacucugcugccuggcuucacaggcacuga

SEQ ID NO: 4113852 - RNA, 103 nt, Human
ucagcgcucuuucuaggcuggaggguucagccuguccuuguaucucccacauacucuagaacagugcugagccuuuggcaggaguucauuacauauuuguuga

SEQ ID NO: 4113853 - RNA, 62 nt, Human
ucagcgcuggcuggcgcuccuuccugggaggcugacugccggaagaggcccagcccugcuga

SEQ ID NO: 4113854 - RNA, 80 nt, Human
ucagcgugccaggaaguggcugggcuggguugguggucuaucuuacgcccaggcucgcuccgucacuuccacaucgcuga

SEQ ID NO: 4113855 - RNA, 62 nt, Human
ucagcguuaguuuuucaucuaaaccuggggugccuggcccagcacuuagagcuacauguuga

SEQ ID NO: 4113856 - RNA, 77 nt, Human
ucagcuaccgugcuugcacagggcuggaauguccuugguauaacaagacaugcaauaaugugcacucauguaguuga

SEQ ID NO: 4113857 - RNA, 72 nt, Human
ucagcuauauggucaguaacauucuagaugugaaguuucuaucugggucucagagugaccauguguagcuga

SEQ ID NO: 4113858 - RNA, 62 nt, Human
ucagcuauguuuuggaacagggagcugcuaaaaagacuuugcuuccuuugaauaucaguuga

SEQ ID NO: 4113859 - RNA, 69 nt, Human
ucagcuccuccguggacacagugcagugcaaauaucaugagcuuuggagucacacaggccuggagcuga

SEQ ID NO: 4113860 - RNA, 80 nt, Human
ucagcuccuuuuauucaaauaguucacacucuugauguaaccccaggaguugcaacucacugaacaaaaugauuggcuga

SEQ ID NO: 4113861 - RNA, 129 nt, Human
ucagcucgaugacguccuggcuugccucccgcaugccgccggugaacauggcccugaagggcagaaacacaacguguggcuggcaguggcugagggguguuuuggccagccaggaaugaucuggccugg

SEQ ID NO: 4113862 - RNA, 65 nt, Human
ucagcugaggacauacacauugugcaacuccaauuuuuugccauucuguguaugucuacaaauga

SEQ ID NO: 4113863 - RNA, 81 nt, Human
ucagcugccacuugacgacuucuccccgucucucugaggcccggaaaccacggcuggagguggggaggggauggcggcuga

SEQ ID NO: 4113864 - RNA, 60 nt, Human
ucagcugccuuucccaugcuagcuucucugaaacaccaggccagaggaagggagagcuga

SEQ ID NO: 4113865 - RNA, 60 nt, Human
ucagcugcuuguacaugaccacaucccuauuucuauugguguagguaagcaugcagcuga

SEQ ID NO: 4113866 - RNA, 75 nt, Human
ucagcuggaugauagcuacuuaucuuccaagacuuacauuuucuccaggaagauuucaguuaaguaucuaucuga

SEQ ID NO: 4113867 - RNA, 62 nt, Human
ucagcuggcaucggcucacccacacaccccacccugguaccaggaggagccaggugccuuga

SEQ ID NO: 4113868 - RNA, 63 nt, Human
ucagcugggaggucuuggagaauuuugcagagagagaggauguggcugagacuucugggcuga

SEQ ID NO: 4113869 - RNA, 92 nt, Human
ucagcuucauggggaaaauggacuguuuagaacacggaaauacugagccaaaugcuacagcaaugguucuaagagucaagucucagagcugg

SEQ ID NO: 4113870 - RNA, 87 nt, Human
ucagcuugagguauuaugaggaauaacuaucugauccaaaucugugguggacaauuagaucauuccuuugauaauauccauaucuga

SEQ ID NO: 4113871 - RNA, 57 nt, Human
ucagcuuguuuaugauaagcaguccaaaaugaccucaaaaaucguggacaagccuga

SEQ ID NO: 4113872 - RNA, 65 nt, Human
ucaggaaagguuuguugaauggggaacuaagaagugaauucguucguucgacaaacguuuccuga

SEQ ID NO: 4113873 - RNA, 58 nt, Human
ucaggaagcugcucugggugguagcuuuaggaucuacacccucagcaaggcuuccuga

SEQ ID NO: 4113874 - RNA, 85 nt, Human
ucaggaccagcagaggggcggagugcagaagcucugugucccugagcucugagcugcucucuccacccccuugcugcuuagcuga

SEQ ID NO: 4113875 - RNA, 63 nt, Human
ucaggacccugcagccacccgacaugugaggccugggcaugguggggcagggcaggggccugg

SEQ ID NO: 4113876 - RNA, 58 nt, Human
ucaggagauggucuuuauaggcuuaauuuuuaggaagguccagagagccggcuccuga

SEQ ID NO: 4113877 - RNA, 74 nt, Human
ucaggagcaguaugcauugacauuuugaguaaauauuucaguuuuaugucgaauguauacucaguugcuucuga

SEQ ID NO: 4113878 - RNA, 59 nt, Human
ucaggaggaugucggcaaauuuaaagggacaggauuuauuuugucgccaucuuccuuga

SEQ ID NO: 4113879 - RNA, 59 nt, Human
ucaggaggcgugcugggguacaccaggugaaugucugcccugccccaguccgcucuuga

SEQ ID NO: 4113880 - RNA, 57 nt, Human
ucaggaggcugagguugcagugagccgagauugugccacugcauuccagccugguga

SEQ ID NO: 4113881 - RNA, 66 nt, Human
ucaggagugcggaggcuggugguucuuaggugacaagagccaccuggggaccugccucagcccuga

SEQ ID NO: 4113882 - RNA, 64 nt, Human
ucaggaguuggcagguauauaauucuggaugauagcaugugcuguguguacucuccaguccuga

SEQ ID NO: 4113883 - RNA, 61 nt, Human
ucaggauaccucaguuuuagcugugugcuuuuguguagugaaaugcagugaggucuuguga

SEQ ID NO: 4113884 - RNA, 86 nt, Human
ucaggaucuccuggaggguuuauuaaaacagacuucuggguuccaccucagaguuucugauuuaguaggucugcagaugggacuga

SEQ ID NO: 4113885 - RNA, 65 nt, Human
ucaggauugaagaucagggaaagauucucuucuccugaggaacuguccgaggucuuccauuguga

SEQ ID NO: 4113886 - RNA, 56 nt, Human
ucaggcacguugaugccuagcuugugaauugugaagcaacauauaucaaugccuga

SEQ ID NO: 4113887 - RNA, 58 nt, Human
ucaggcauguugggggagggugcaguggcaagcucugaauggacacuccaguguuuga

SEQ ID NO: 4113888 - RNA, 71 nt, Human
ucaggccacuucacaggugauugaaaccgccucaaucuauagccuagccaaucacuuaugaauugcccugg

SEQ ID NO: 4113889 - RNA, 62 nt, Human
ucaggcuaacccuaggcagaaguauuaauagucgcuaacguucgcucuggguuaagcacugg

SEQ ID NO: 4113890 - RNA, 60 nt, Human
ucaggcuagauuggggccaguagggucuagugguuuuagggcccacauaucuagauuugg

SEQ ID NO: 4113891 - RNA, 78 nt, Human
ucaggcucaguauagcuggcaagucaauauuaucaacaguaaucaaaacugccagcaaugugaaagaaaucagucuga

SEQ ID NO: 4113892 - RNA, 76 nt, Human
ucaggcugggcaauucaggaucaaguugccaguagauuuggugucugcugauggcuguuuucugcuuccagaaugg

SEQ ID NO: 4113893 - RNA, 55 nt, Human
ucaguuauuguuauucuuauggaaacaacccaugggaaauguagccuuggcauga

SEQ ID NO: 4113894 - RNA, 55 nt, Human
ucaguuccucugcccaaggcagccuccucccuggggugccuguguggaggacuga

SEQ ID NO: 4113895 - RNA, 85 nt, Human
ucaguucucagaggucaagagcagagcuuuccaagucagcuaaauggacuuccaccuauggcacugcuccuggcgucugaccuga

SEQ ID NO: 4113896 - RNA, 56 nt, Human
ucaguucuuauuuucaugaauagugacuguccaccagcagcgaguuuaagggcuga

SEQ ID NO: 4113897 - RNA, 63 nt, Human
ucaguucuuuucuagauucuggaucuaaaucucaucuuagaaggaauuuaaagaggaauuaga

SEQ ID NO: 4113898 - RNA, 60 nt, Human
ucaguugcaugggaaguucagacaaauuugccaacugaaacucacccccaaaguagcuga

SEQ ID NO: 4113899 - RNA, 66 nt, Human
ucaguugcucaauguggcuguggagcugcagaagcaaucacgcugcuuucacagugagcucacuga

SEQ ID NO: 4113900 - RNA, 80 nt, Human
ucaguuguacuucuacuuucaugacccugacacuuucaaagacugcaggcaguuauuuaguagaaucucucucaauuuga

SEQ ID NO: 4113901 - RNA, 130 nt, Human
ucaguuuaccuucccuauuuuuuaccauuuguaaaacuaaggcucagugauguaaaauauaacacauucugugcuguggcauaacugcagcuuagguuuuuauauucaagacaagcagagguauagcuga

SEQ ID NO: 4113902 - RNA, 60 nt, Human
ucaguuuccugguuuuaauauuacuaugauuauguaaaauauaaccuuugggggaacuga

SEQ ID NO: 4113903 - RNA, 65 nt, Human
ucaguuuucacacucaccaaaaggggcuaucacuaccugucuccuacgguuaaugugagaacugg

SEQ ID NO: 4113904 - RNA, 90 nt, Human
ucaguuuucacucugucaauauguaauaacugaaucugucuuuguggugaggauucagugaguuaacauauuugaagugcuuaaaaauga

SEQ ID NO: 4113905 - RNA, 79 nt, Human
ucaguuuucaggagcacaucugucaucauuauguauauaauuaacacagugucuuagguagugucaucugaauuacuga

SEQ ID NO: 4113906 - RNA, 95 nt, Human
ucaguuuugaucauuuauauaucugcaguacugaagaacuugccugguauuaaguguccaguaaauaucuguagaacgaaugaauaaaugcauga

SEQ ID NO: 4113907 - RNA, 55 nt, Human
ucaguuuuuaagaguuaugcgacuugaauagugauuugcaaauucuaaaaacuga

SEQ ID NO: 4113908 - RNA, 82 nt, Human
ucauaaaaauugacugccacagaaacccaccaagucaucaucucaucauauguugauucaguugguuuuguucaguucuuga

SEQ ID NO: 4113909 - RNA, 96 nt, Human
ucauaaaaguuaaaaugccauaagaguguguuccccaagaaagaaauaauuuucuuuucauugagaacacacuggaggacauaauauacuucuuga

SEQ ID NO: 4113910 - RNA, 78 nt, Human
ucauaaacaauccaggaaccuguuuauccaucugauauuccagcuuggcaaguaaauaaguucuucauuguuuguaga

SEQ ID NO: 4113911 - RNA, 95 nt, Human
ucauaagcuuuggaagcccuggcuccugugcaggucucgguugcuguuccagccacuggcugucagcaggacucagaggcucccauggcuaguga

SEQ ID NO: 4113912 - RNA, 102 nt, Human
ucauaaucaaugcaccuguagcuuccagaaagugucuuuguuuuacugaaaagccaaccagagaaaaaacauuuaucugcugagauguguaugugauuuuga

SEQ ID NO: 4113913 - RNA, 78 nt, Human
uacaaaugggauguggcauuuuggaaaaacuugacaacuuauccuucauuuuacagaaaguuucccaugccguuugug

SEQ ID NO: 4113914 - RNA, 70 nt, Human
uacaacaccugauauuaucucuuucaagacaaaaugucuuucuagaaauagagauagaguuggccuugug

SEQ ID NO: 4113915 - RNA, 91 nt, Human
uacaacuauuagacuuugaaaagaugaggaacuugaacaguuaacagaaacugagaagauucucacucuuaguuauaagcagauaaaugua

SEQ ID NO: 4113916 - RNA, 61 nt, Human
uacaagauaagaauuggcaaggaccauuggguaugaccuucccauccucuuauuuucugua

SEQ ID NO: 4113917 - RNA, 62 nt, Human
uacaagcugaauggugcuggggggggucaauccgcccuucugagcuucaauuucagucugua

SEQ ID NO: 4113918 - RNA, 71 nt, Human
uacaaggauucacuguuggguggaagauuugcugggaacaaggguuauuuuugcagccacagugccuugua

SEQ ID NO: 4113919 - RNA, 65 nt, Human
uacaaguggaaagaaggcgguaucacucucugcaauagaggucacuccaccuucuucucuuugua

SEQ ID NO: 4113920 - RNA, 66 nt, Human
uacaauacucuguugggacaugaacauuuuuagaagagaguggacaaccaugcugagauuauugua

SEQ ID NO: 4113921 - RNA, 73 nt, Human
uacaauguuaauggauuggagguuucaauauuguuaagauguugauuucucaaaaaaucucaauaaaauugua

SEQ ID NO: 4113922 - RNA, 57 nt, Human
uacaauuacuacagcuaauaaagugcaacugaagagcacauagcagcaguaauugug

SEQ ID NO: 4113923 - RNA, 67 nt, Human
uacacaauuucugaguaaugaugcacgagaaugcucagguauucauagaauucagagagggggugug

SEQ ID NO: 4113924 - RNA, 64 nt, Human
uacacagauaugugaucaaucacauuauuucuuugucuuucagugauuggucacugcaugugug

SEQ ID NO: 4113925 - RNA, 125 nt, Human
uacacaguaggugcuuuauaauguuuuguugaauaauggaaugccucacauguauuuucuuagcuaagaaugauaaacacaaggugauuucauguauucccaacaugugaguuuuucucugugua

SEQ ID NO: 4113926 - RNA, 58 nt, Human
uacacauguccaaggugucaccuaggugcaugaaaccagguuuugcauugacugugug

SEQ ID NO: 4113927 - RNA, 69 nt, Human
uacacauuauauuaagagauguaugaagagaaaacuguuuauuuucaccuucucuggauauuuugugug

SEQ ID NO: 4113928 - RNA, 129 nt, Human
uacaccuaucugcucauuuuguuguguuagcuuuucugguuuauuucauaguuuguucuugcuauuuauuaagaacagaauaucaaaagauuaugaauagccucagcucuagaaugcuuaccacuguua

SEQ ID NO: 4113929 - RNA, 73 nt, Human
uacacuacagauaagcaaugaacaauuuuguuuccugggggaaaugcagaauuuucuguuuucuagagaugug

SEQ ID NO: 4113930 - RNA, 61 nt, Human
uacacucuuaggaauugguuauaucacaauuuaaauguugguaaucuagcuucagagugua

SEQ ID NO: 4113931 - RNA, 64 nt, Human
uacacuuauaacucugugugugugugagagugugugugcgcacacgcgugggggugugugugug

SEQ ID NO: 4113932 - RNA, 84 nt, Human
uacacuucuucaaauagcagggagucaaccaaguaaaguaauuaaaauauguaaaugaaucauuuugcuguuugaacaagugua

SEQ ID NO: 4113933 - RNA, 84 nt, Human
uacacuuguucaaacagcaaaaugauucauuuacauauuuuaauuacuuuacuugguugacucccugcuauuugaagaagugua

SEQ ID NO: 4113934 - RNA, 84 nt, Human
uacagaaauauugacagugacuauugguagcauacauuuuucuugaauguccuaccauagcacugucugguaaaaauuucugug

SEQ ID NO: 4113935 - RNA, 70 nt, Human
uacagaaauauuuggagauggagagagggcauuaaacuagaagcauucugcauuuucaaagaaguuugug

SEQ ID NO: 4113936 - RNA, 59 nt, Human
uacagaaguugguuuuaguuuacuaauuuguuuagcuggcuaauauacccagcucugua

SEQ ID NO: 4113937 - RNA, 64 nt, Human
uacagaauguuaugaagcauagcauguaaaaauuauugucuuuccccuucauggauauucugua

SEQ ID NO: 4113938 - RNA, 79 nt, Human
uacagagaauugugagcauaacagacugauuuuuaaaugcaauuguauuuuagggcaguuuguuacacagcaacaugua

SEQ ID NO: 4113939 - RNA, 129 nt, Human
uacagagggaaguuacuuuauugcuuccaugcaaaggcauucucuggaagaagauaaaaacuccaagcuaagcaguuauuaacuucuucccagagacacugcuaagugguaagaaacacugccucugua

SEQ ID NO: 4113940 - RNA, 67 nt, Human
uacagcacagcaaagaggacggcuuccuuucucccaaccaucuagccgaguccugagcucugcugua

SEQ ID NO: 4113941 - RNA, 58 nt, Human
uacagccucguucugguagggcagaucccacaugaugucgcccugagaugaugcugug

SEQ ID NO: 4113942 - RNA, 76 nt, Human
uacagcuagcccagcaggagagaacauuucccucugguucagggauguuccuuuguuuccugcucugucagcugua

SEQ ID NO: 4113943 - RNA, 98 nt, Human
uacagcuuucugaacuuaguauuauugacauuuacuuggugcaguuaacuuuuuuguuaaaggucuguugucaagcauuuaaguaauuuguaguugua

SEQ ID NO: 4113944 - RNA, 57 nt, Human
uacagcuuugucaguaggugugcugacuuccccggcccauuauuguaaucagcugua

SEQ ID NO: 4113945 - RNA, 55 nt, Human
uacaggaagucucaguacaguaagccuggacauggccuaccuggugcuuccuuua

SEQ ID NO: 4113946 - RNA, 62 nt, Human
uacaggacauggcuucugugacgcugaugcauuuagaggaauguggcaaagccgugccugug

SEQ ID NO: 4113947 - RNA, 90 nt, Human
uacaggagggaagucaguaggagaaagguugaaucaaaguuuuccccccuuuggggaaacagcugcacugcugaugucccuugccuugua

SEQ ID NO: 4113948 - RNA, 80 nt, Human
uacaggcuccucuguguuacugacugggggcuuuguaaagaucacaaggaacugacucagcagugacaagagaguaugug

SEQ ID NO: 4113949 - RNA, 62 nt, Human
uacaggcucuugucagacguauccguggccucuugaggauaucaaggaacugagagcccgug

SEQ ID NO: 4113950 - RNA, 66 nt, Human
uacaggcuguuggaggauuuuuugagugcauaaaucucaaagucuguuuucaugauagagucugua

SEQ ID NO: 4113951 - RNA, 61 nt, Human
uacaggucugcugauucaugguucaaacaucaccaaaccaccuguggaucagauucuugua

SEQ ID NO: 4113952 - RNA, 74 nt, Human
uacagguguaacacagggggcugcacauguuuacuaaaguggguuugaaaugcuuucaccuguuugcacccaug

SEQ ID NO: 4113953 - RNA, 67 nt, Human
uacaggugucugggcuuuggagucaaguauaguugauacuacugagucacagucuagucacuuagua

SEQ ID NO: 4113954 - RNA, 63 nt, Human
uacagguuuacgcacuuccugucugucuccucuaugagaauggagucugcggcagacacugua

SEQ ID NO: 4113955 - RNA, 108 nt, Human
uacaguaacauguuguacaagcuuauagccugggagcauuaggcuaugccauauagccuaggugcacaguaggcuauacaaucuaggcuuguguaaguauacucugug

SEQ ID NO: 4113956 - RNA, 62 nt, Human
uacaguaagaugaaauagcaaugcugugccuaaaacagcucaaguuuaaucacuugucugug

SEQ ID NO: 4113957 - RNA, 78 nt, Human
uacaguaguaagaaugccuuauuuuuuacaucuuuguucuuuaaauuacucagauugcuauggggcauuuuuguugua

SEQ ID NO: 4113958 - RNA, 57 nt, Human
uacaguaugugaugcaacggaauacacugaguguauuaguuuccuaucgcugcugua

SEQ ID NO: 4113959 - RNA, 77 nt, Human
uacagucagcuugucucuaggguuguuaaaucuuuauuguucggacauaauuaaccuugaagacugagcugaccgug

SEQ ID NO: 4113960 - RNA, 130 nt, Human
uacagucugugaggcuuugagcacuuccuuggacuccaguucucuuguuuauaaaaugggauaauauuugguaugagaaugacaggagacaaugcuguggagcucuggguacagugcuuggcacagagua

SEQ ID NO: 4113961 - RNA, 66 nt, Human
uacagugacccuauuuccaaauauaagauuacauucugagguacugagguuuagggcuucauugua

SEQ ID NO: 4113962 - RNA, 74 nt, Human
uacaguggccuucugucaguccugugcagaacucauagggguucucugugcagaacucacagaaggccacugua

SEQ ID NO: 4113963 - RNA, 55 nt, Human
uacagugucugcaacugcacaccuaggauacaagguggagacagagggcacugug

SEQ ID NO: 4113964 - RNA, 77 nt, Human
uacaguuuaguuucuguuacauuuucugaaucacuacuugacugaaauaucagagaaaauggaaacuuuuaucugug

SEQ ID NO: 4113965 - RNA, 56 nt, Human
uacauaauugucuuuguccucaaacugcccagaagucuguaggacagaauuaugua

SEQ ID NO: 4113966 - RNA, 67 nt, Human
uacauaucuuaugguuuucuaaguuuaggcaucugucccugcuuagaaguuccuauaaaaugaugua

SEQ ID NO: 4113967 - RNA, 76 nt, Human
uacaugaaccuuuaugugugauaaaauugcacuuaguccuggugcagguacacacucacacaaaagagugcaagua

SEQ ID NO: 4113968 - RNA, 74 nt, Human
uacaugaaucaaagaggccaaagaaucuacaagauuuuuacaauagugagauucauggccuuuaaaaauaugua

SEQ ID NO: 4113969 - RNA, 93 nt, Human
uacaugagcuuagcuaguugcucagaggaggccuuuaccuaccugcaggcuauguuagguacccucuucuguguuauuguaagacucuaugua

SEQ ID NO: 4113970 - RNA, 75 nt, Human
uacaugauuuagagcacaggcucuggagucuaauuagcugaguuagaauccagauucuaugcuaacaaacgugug

SEQ ID NO: 4113971 - RNA, 57 nt, Human
uacaugccuguguugucuccauggcuaaauacuaagcccccugaggccaggcaugug

SEQ ID NO: 4113972 - RNA, 63 nt, Human
uacauggauguuauccuuacugcuaugaauaucaaacuauugcuugaggauugagguccagua

SEQ ID NO: 4113973 - RNA, 110 nt, Human
uacauggcccagagcauugcuucugccacuuccaaggcaacagccuaggcuggggaccccucaauacccagcccugugggccuuguggcacgggcacucugugccgugua

SEQ ID NO: 4113974 - RNA, 60 nt, Human
uacaugguuggcccauucuucugagaugaugagacgggcagaaaauaggccagccaggua

SEQ ID NO: 4113975 - RNA, 68 nt, Human
ucaugguuugguuaagauuccugccacuuccaaccuggaaggcagaccaugaaucaugaccuuccuga

SEQ ID NO: 4113976 - RNA, 123 nt, Human
ucaugugaaacagugcuaagugcucacgugaaacaguacuaagugcucacaugaaacgaugcuaagugcucacgugaaaugaugcuaagugcucacgugaaacaguacuaagugcucacauga

SEQ ID NO: 4113977 - RNA, 61 nt, Human
ucaugugaaauugcugacacuugaccauuuuugacuuacaaaaaauggcaguuucauauga

SEQ ID NO: 4113978 - RNA, 66 nt, Human
ucaugugucugccaguguuuaugcaaaauauuacuuugaccugugugccuuggcaaaugaccauga

SEQ ID NO: 4113979 - RNA, 101 nt, Human
ucaugugugcuuuacccccaugauguuaucuaaaucuggucucaucccaaggcaaccacccucugauagcaucacauuggggauagggcuucaacguuuga

SEQ ID NO: 4113980 - RNA, 62 nt, Human
ucauguguuuggagccaggcccuggcagggagugaccagugcccggggugccagacacaugg

SEQ ID NO: 4113981 - RNA, 72 nt, Human
ucauguucugcuggcuccagugacaagucgaugaaauucuaucacucguccgacaggagaccucagaaguga

SEQ ID NO: 4113982 - RNA, 77 nt, Human
ucauguuggcugcuagguggcagcacuccgagguaucuaaaggguagaccuggaccugccaccuaugaguuguguga

SEQ ID NO: 4113983 - RNA, 80 nt, Human
ucauguuuacauugaggucauauauauuuggcaggaacaccucacccugccaaggauacaugaccuaaaucuuaacaaga

SEQ ID NO: 4113984 - RNA, 128 nt, Human
ucauuaaaaugggaacagcaguuuaugcaguuugaagaagauucuagaguaacuggaugauuaguaucagaaguauugggucugagagucuuucuucaagugaugaacauugcuguuaauaucaauga

SEQ ID NO: 4113985 - RNA, 96 nt, Human
ucauuaaccucugucaguugucucaaugccaaaauaaugacaauaucaaucaagucaacuuuacagggguguggaggcaaucacagacauuuaugg

SEQ ID NO: 4113986 - RNA, 59 nt, Human
ucauuaacugguuaauaacuauuuaugaccccaggauguaguuucuacccaguuaaugg

SEQ ID NO: 4113987 - RNA, 67 nt, Human
ucauagaguuaagugaaauguaauaaugaaacuaaucucacaguuugguuacacuucugcuuuguga

SEQ ID NO: 4113988 - RNA, 74 nt, Human
ucauagaguuuacaacaucuuguccuucaauugcagucagucucugucuugaacuggauuugugagcuccuuga

SEQ ID NO: 4113989 - RNA, 58 nt, Human
ucauagaugugcugugcacaaacgagagaugcuugguauaaagcacacacaucaauga

SEQ ID NO: 4113990 - RNA, 63 nt, Human
ucauagcuaagguucuucuuugauuucauaaguuaauaauaucgaagaagcaauaagcuguga

SEQ ID NO: 4113991 - RNA, 80 nt, Human
ucauagugugaugguuuaaaagccuggauacuaucauuaaauugauuaaauuugauucuagcuuugccauuuaauuguga

SEQ ID NO: 4113992 - RNA, 89 nt, Human
ucauauaacucuguuuuuuucaugcauuuaauaauuguucuugcugcugugucuuuaucuucuuguaugaaaaggaauagauugaauga

SEQ ID NO: 4113993 - RNA, 115 nt, Human
ucauauaguucaucugcuucugcuuuuugcuuuauguuuuaucauguucauuuucccgugucaacaaauguguauaugaaacaugauguguaagggcugaauagucacuauguga

SEQ ID NO: 4113994 - RNA, 61 nt, Human
ucauauaugggauuaucacuuauaggggcuucucuuaaaagucugaugauuuacaugaugg

SEQ ID NO: 4113995 - RNA, 76 nt, Human
ucauaucacauuauaguugcuacagaguaucuugaaacagacucacuacucucuggaaauuauagugaugaguaga

SEQ ID NO: 4113996 - RNA, 87 nt, Human
ucauaucuacgcacuccuuguaccaccugcugccuuauggaauuuacuuaucuccacugcaguggugggacaguggaaaagguauga

SEQ ID NO: 4113997 - RNA, 68 nt, Human
ucauaucuuucacagagaauauugccuugaaaugguagucaaagcuauaagcucuuugagauuaguga

SEQ ID NO: 4113998 - RNA, 67 nt, Human
ucauaucuuugucuaccaggaaauauaaucauuaaaaugaacguccuggaacauggauaaagaauga

SEQ ID NO: 4113999 - RNA, 64 nt, Human
ucauauguguguaauauauuaguguuuugacuuaaaaugagagauacaauacacaugcauauga

SEQ ID NO: 4114000 - RNA, 90 nt, Human
ucauauuguagucucucaaagugcucuagaaauagucagugguuuacaagaaguggccacgggugucuggagcacccugaaacuguauga

SEQ ID NO: 4114001 - RNA, 109 nt, Human
ucaucaacauugcccaacagaugcagcacugaucuuuagccagagaacucucuggaaucauuaaagagaucgugaggacugccuagucugugggcuguaguguugaugg

SEQ ID NO: 4114002 - RNA, 68 nt, Human
ucaucaauacaucaggucaaaaugugacacaucaacaaugacaucacaggagauugaucuauuggugg

SEQ ID NO: 4114003 - RNA, 57 nt, Human
ucaucaauguggccuacaaagagaauugucaugcuaugguccaggcuggauugauga

SEQ ID NO: 4114004 - RNA, 65 nt, Human
ucaucacaaauguaauaaugucuaccaggaagaaagugggaaaugguagcagcaauuugggauga

SEQ ID NO: 4114005 - RNA, 68 nt, Human
ucaucaccgacgcuuggcaugguccuagcuguguuuuggucuccuucgccugccuguguuugugauga

SEQ ID NO: 4114006 - RNA, 65 nt, Human
ucaucauuguguuaggguguucaauaagccuaaauuugaagggaggacauuguaauuaaugauga

SEQ ID NO: 4114007 - RNA, 70 nt, Human
ucaucauuuccuccggaagcuuuauaucaaccuuugacccaaagcagaaaaguucuggagaaaauaauga

SEQ ID NO: 4114008 - RNA, 95 nt, Human
ucaucauuuuucuauaaagguuugguuuuuuaggaaacaaguuuugauuauuaaggcacuuuucuaaagaccuuguuuugaugggcgagugauga

SEQ ID NO: 4114009 - RNA, 77 nt, Human
ucauccaauaaugggcacccuagaguaacuguggaagaaaugaacacagugcuuccugccuggugccuuuauggaga

SEQ ID NO: 4114010 - RNA, 57 nt, Human
ucauccaucuuugauuucauaguaagacuugcuuaaugugugagucaucauggguga

SEQ ID NO: 4114011 - RNA, 66 nt, Human
ucauccugacuggguaaagcuuauccaaacuguacugucugcugcucuaagcugacccagggauga

SEQ ID NO: 4114012 - RNA, 59 nt, Human
ucauccugccgcugguacaaacacggcagaggccucuuuguaaagaagugguagguaga

SEQ ID NO: 4114013 - RNA, 76 nt, Human
ucauccuuaagccaggccagcuucuacccucuguuguggugaccauggaacacagggcagcugcugggaaggauga

SEQ ID NO: 4114014 - RNA, 56 nt, Human
ucauccuuuugcaugggaaggcuucuauacaagcagaaaacaugcauaaacgaugg

SEQ ID NO: 4114015 - RNA, 80 nt, Human
ucaucgcaugugaauuccaaagcuagguuauaaagcucauugcagcuuccaucuggcucccuuggaauccguggcucuga

SEQ ID NO: 4114016 - RNA, 96 nt, Human
ucaucgccucucuccuccccucuaccuuucucccugguuuccauagagcagaaaucugggucaagguggagugcauuggaucaagaguugcuauga

SEQ ID NO: 4114017 - RNA, 105 nt, Human
ucaucguagguguauaacuaauuuugcauuaccauuuaugagugauauaguuguguucuuuuuaaaguguguaugcaauuaguagugguuauauucauuucguga

SEQ ID NO: 4114018 - RNA, 99 nt, Human
ucaucguuggguagcagcggggaggcgugggaggaucugaggccugcggugggccuuggucccuucucuccccgccccgaagccgccugcucaaccuga

SEQ ID NO: 4114019 - RNA, 90 nt, Human
ucaucuaggcccugggaauguaagugggcagaagacagacagagugcugguugucauggagcuuauauuccagguggagaaaauagauga

SEQ ID NO: 4114020 - RNA, 60 nt, Human
ucaucuauugaaaauuuguauguggcuaugugugccuauguauuuaaauuucagugauga

SEQ ID NO: 4114021 - RNA, 70 nt, Human
ucaucuauugguguguuuuguuaggcaguugaauucaaaccugaagagaaacagaauaugcugguugugg

SEQ ID NO: 4114022 - RNA, 60 nt, Human
ucaucucauuuauuccaacucagggagauuguucccaguuggauaucucaaguguuguga

SEQ ID NO: 4114023 - RNA, 70 nt, Human
ucaucuccagcgcagcagccccgugguaggugaagugcuauucuucacugccuugcaugugggaguuuga

SEQ ID NO: 4114024 - RNA, 88 nt, Human
ucaucucuaguuucucaucagcuguugaguuugggggaaaguauuucccuggagcuguaacagcucuccauguggggaaagggagugg

SEQ ID NO: 4114025 - RNA, 63 nt, Human
ucaucucucaggauaccagcagugucucugaccaugggcaguguugggaauugugaguaaugg

SEQ ID NO: 4114026 - RNA, 95 nt, Human
ucaucucucccuuaggccagcccuuaguccugucuucuauacaaagcacuaacuggaaggaaucacuuagcuuggccuccagaggggacagauga

SEQ ID NO: 4114027 - RNA, 58 nt, Human
ucaucugaaauuguauauguagugcuaacuuuggugcuaauguaucuuuuucauauga

SEQ ID NO: 4114028 - RNA, 100 nt, Human
ucaucugugacuagugaucuaacagaagaccagagagcuaacuugugaccaguguuagugaaucuguggccuaacuugugaccaguggucuaacguguga

SEQ ID NO: 4114029 - RNA, 78 nt, Human
ucaucuucagagcuuguuaaaacugugcuuuccgauguauuuccucaaggacagucacuagcaguuguucugaaauga

SEQ ID NO: 4114030 - RNA, 58 nt, Human
ucaucuuuaaaaugggaacaacaguaccuugcaugguuguuguaaaguuuagagguga

SEQ ID NO: 4114031 - RNA, 62 nt, Human
ucaucuuuaccccuugcuucaaguugaagaacuugucuaacuugacucaaggcuagaaaugg

SEQ ID NO: 4114032 - RNA, 86 nt, Human
ucaucuuugcaauggucccuuaaaacauuuuuggugaucuguauucuuacuagaaucuggaaggggcuauucuguaagcggaguga

SEQ ID NO: 4114033 - RNA, 86 nt, Human
ucaucuuuugcucccuuaggacuuuuucacuuaaaaacuugaugguguuugggguaaaaugucguaagagacauucuagcacauga

SEQ ID NO: 4114034 - RNA, 71 nt, Human
uccaaaauuccaacagacaaaguuagacagguuaagaaagucuuuauuuaagucuguuguaauggguagga

SEQ ID NO: 4114035 - RNA, 59 nt, Human
uccaaagaaccuggcuacuguccuuucuggggcgugugauggagagguuagaauuugga

SEQ ID NO: 4114036 - RNA, 77 nt, Human
uccaaagaagaauagucucugaugucaaggaguuuccaucuagcugggaauucucagggaguauuuucuauccagga

SEQ ID NO: 4114037 - RNA, 66 nt, Human
uccaaagaaucuugcuuucauggaagucuugggaaaugccaauacuucuuuaagaguaagucugga

SEQ ID NO: 4114038 - RNA, 61 nt, Human
uccaaaggccugagaacugaggggauuguugguauaaaucccugaguacaaaggccugaga

SEQ ID NO: 4114039 - RNA, 91 nt, Human
uccaaagguaagcugcaauuggcucuugcucuaaugcuggacugacuggcugucggcugcaugccucaguguaagaugcuaagccucugga

SEQ ID NO: 4114040 - RNA, 56 nt, Human
uccaaauaguucuggaagacuguguacaggagcugggauuucaugagcuauuugga

SEQ ID NO: 4114041 - RNA, 61 nt, Human
uccaaaucaguucacguucugagguccuggccauuaggacuucaacauaugaauuuuugga

SEQ ID NO: 4114042 - RNA, 67 nt, Human
uccaaaugcaucagcucauaagagauuccaccuaaggaucuaaacugcuagcugacugagaucugga

SEQ ID NO: 4114043 - RNA, 69 nt, Human
uccaaaugggcuuucuuggacaggaguuuuaucuugaauaccaaaaugcuucugucccagaaaccagga

SEQ ID NO: 4114044 - RNA, 76 nt, Human
uccaacagugaguugaugacugaauuaaaaaccgaguguagauuugacugauuuaaucaucacugcucaacuggga

SEQ ID NO: 4114045 - RNA, 125 nt, Human
uccaacucauuuacuaagugccuacaacaccaggcccugggacacaacaccgaacaagauagacacaaucuccgccuuuuggugcuuauguucuaggacggugugcaugugacagaugauaugga

SEQ ID NO: 4114046 - RNA, 60 nt, Human
uccaagaaguuuauguuguuucagcuaaucaagugagaugacauuauuuucuuuugugga

SEQ ID NO: 4114047 - RNA, 95 nt, Human
uccaagacuggcugacuucauuugaaaugguugaaucugcuguguaauaaagugguucaaccaugauuaggaacugaaauuuaguagaagaggga

SEQ ID NO: 4114048 - RNA, 70 nt, Human
uccaagacuuuaguuguaaacacaucuauugagaaaucauuggaaaugcuacaaguuagacuucuuguga

SEQ ID NO: 4114049 - RNA, 74 nt, Human
uccaagagacaggauguauuggcaagaggaacuauuaagaccauuguuacuucuguuuaagcaucuguccugga

SEQ ID NO: 4114050 - RNA, 61 nt, Human
uccaagcccacagaauguacagcaucaagagugagcccagauaugaacuguggacuuugga

SEQ ID NO: 4114051 - RNA, 64 nt, Human
uccaagccugccccuuccugggcagggugcuggaagcuagcccugcccaucggggcggccugga

SEQ ID NO: 4114052 - RNA, 60 nt, Human
uccaaggaagucauuuaaacugaccauuuagcucaguagauagcaaauaacuuccuggga

SEQ ID NO: 4114053 - RNA, 64 nt, Human
uccaagugggacuuuguugcugcauccucuggaggggacagacacuguguccucacuuaaugga

SEQ ID NO: 4114054 - RNA, 107 nt, Human
uccaaguucagaucuuugaucagaguuuauaacaucaaucagaguuaauagucugaugauuuuugucacucuauaauguuuucagcuuucgaggcaugaauuaugga

SEQ ID NO: 4114055 - RNA, 77 nt, Human
uccaauaauaaaauccauuuuugcaaaguuguucaacuuuuucuuugggauacauuucuagaaguggaauuguuggg

SEQ ID NO: 4114056 - RNA, 112 nt, Human
uccaauauggucuguccucaaucuuccuucacuuucucccacuucugcuucauauuccuuuaaguucugcccugugggaggugggaaggggugugaggaaacagacauugga

SEQ ID NO: 4114057 - RNA, 96 nt, Human
uccaauauucauaccacagaggaaaugacuuucuuagguuugucccaaauugagagaguuugcguuuucucuucuugccuuuuaugacugaaugga

SEQ ID NO: 4114058 - RNA, 61 nt, Human
uccaaugacaggugaaaggauuggucuuaauagaagagacacuucacccauugugauagga

SEQ ID NO: 4114059 - RNA, 68 nt, Human
uccaaugcuuccuccucaccucaggucaggugacaggaacccuucugagggcuugaggggaaguagga

SEQ ID NO: 4114060 - RNA, 80 nt, Human
uccaauguuagucaucacuguaucauugauagaaggugauuucuucuauuuuagaaucaauaggguugcugcaguaugga

SEQ ID NO: 4114061 - RNA, 63 nt, Human
uccagcagggcucauucuaguacaauuaaauaacgguugugcaaacacuggggucugucuggg

SEQ ID NO: 4114062 - RNA, 55 nt, Human
uccagcauggcaccugagaugagacagggagucaacauagaggagccauucuuga

SEQ ID NO: 4114063 - RNA, 59 nt, Human
uccagccagcuggcacugugaguagagaagcucugacucuccaagugcuguagguagga

SEQ ID NO: 4114064 - RNA, 56 nt, Human
uccagccaucuugcugugagaggacagggcauggacucuggaguuugaaggcuggg

SEQ ID NO: 4114065 - RNA, 56 nt, Human
uccagcccucagccaaguggaauggauggugcuugcucauguugggugagggugga

SEQ ID NO: 4114066 - RNA, 77 nt, Human
uccagcggccuauggaugugcacagaucaauaaggccuggggaaucucagguagugcacacgcauguagcaguuggg

SEQ ID NO: 4114067 - RNA, 94 nt, Human
uccagcucagcaaaagucccucugcacuucaccuuagcuccucaggacaagggaguggaggcugaggcugcagagaucccagaccugagaagga

SEQ ID NO: 4114068 - RNA, 94 nt, Human
uccagcucucccugccggcugcucccagggacucuggcuggagucaaagcuuuuggccagaggcuuccuggagggcuccggcuggggggcuggg

SEQ ID NO: 4114069 - RNA, 58 nt, Human
uccagcugccaaccgggccccgggacccucagacucugccgccugggggcagcuugga

SEQ ID NO: 4114070 - RNA, 57 nt, Human
uccagcuggcccggccaugaaucuauuuccccaugggauuggcuucugcuagcugga

SEQ ID NO: 4114071 - RNA, 64 nt, Human
uccagcuugccuggucuuuugggacuccugaaggaagggagcaccaaaacuauagguguuagga

SEQ ID NO: 4114072 - RNA, 63 nt, Human
uccaggaacucuugauggugauucagcaguguguucugucauggcuaggaaagaguucuggga

SEQ ID NO: 4114073 - RNA, 89 nt, Human
uccaggaagucagccuggcuaaauucucccaugggcugauagagcugccagggguuuggcucagacuggaacucaagaugcuuccuggg

SEQ ID NO: 4114074 - RNA, 58 nt, Human
uccaggagcaggagcugcagcugcuguccaugcaguagcuugagcccugguccugaga

SEQ ID NO: 4114075 - RNA, 56 nt, Human
uccaggagucuagccucaggccugaucccacggggagcucuggagcagacacugga

SEQ ID NO: 4114076 - RNA, 81 nt, Human
uccaggaucuaaaguguuuauuuagaguaggccaugggcucuuuccccaggccagccuuguaaaugccucuggcucuugga

SEQ ID NO: 4114077 - RNA, 84 nt, Human
uccaggcagguacagcaagaggacaaaggacaacaggcaaagaauacugggauccuguuugucccugccccugcuugcuuguga

SEQ ID NO: 4114078 - RNA, 56 nt, Human
uccaggccccacugaagccccuugcaaacuucuggggcaguugauggaggucugga

SEQ ID NO: 4114079 - RNA, 61 nt, Human
uccaggccuggcuccauucagucaaaacagcguacggcugucuccagggccaggugcugga

SEQ ID NO: 4114080 - RNA, 60 nt, Human
uccaggccuugacaggucaguuugcuagaagaggagaauggccccuucucugggccugga

SEQ ID NO: 4114081 - RNA, 56 nt, Human
uccaggcuagagugcaguggcccgaucucggugcacugcaaccucugcuucccggg

SEQ ID NO: 4114082 - RNA, 66 nt, Human
uccaggcuagguuuacaggacaaaacugcauucaggcaggugugcacuggaaccugacgugcugga

SEQ ID NO: 4114083 - RNA, 64 nt, Human
uccaggcuggucugaauuucuagugccuguaucuggcuucucuucuauuuucacuagccuguga

SEQ ID NO: 4114084 - RNA, 65 nt, Human
uccaggcuuuccugucacucaugcugauauuagccugaugagcaagggagagcaagagagcugga

SEQ ID NO: 4114085 - RNA, 77 nt, Human
uccagggcacucuugcccuaggcuggcauuugcaugauccauuaguauucgugcccacagcucagggcugcucugga

SEQ ID NO: 4114086 - RNA, 62 nt, Human
uccagggcacugaguggaugaugcaggcugugcacagccgcugcacacccuggugccacgga

SEQ ID NO: 4114087 - RNA, 130 nt, Human
uccagggccccacaccugcagcauagccugggacgacucuguacccuuuccaggacgaggaggagcacggcgucgagggcuuggagagcgucccggaggagggcguccaggaggcauggggcugcugcgg

SEQ ID NO: 4114088 - RNA, 59 nt, Human
uccagggccugagguugaaguguuaauuuucaacacagaugugcuucuaggcuccugga

SEQ ID NO: 4114089 - RNA, 58 nt, Human
uccagggcugagacuguauuggguuuggugguuaauucuucagccuuauagcccuggg

SEQ ID NO: 4114090 - RNA, 79 nt, Human
uccaguaccccaaauguguagaggggagagccgcaccagggcuggcauggcuucagacuucugcuacguggcuacuggg

SEQ ID NO: 4114091 - RNA, 55 nt, Human
uccagugaccucucuuuauccagaauguugugacugagccauaagggaggcuggg

SEQ ID NO: 4114092 - RNA, 55 nt, Human
uccaguggagguauuugcuaaaaucacacagguugucagaaauaccaguauugga

SEQ ID NO: 4114093 - RNA, 56 nt, Human
uccaguggcaucugugcuaugauaggaaauauaaggggcacuggaagcacacagga

SEQ ID NO: 4114094 - RNA, 55 nt, Human
uccaguguggaccccugcagucauaucauauuccugagccagggccacacaugga

SEQ ID NO: 4114095 - RNA, 58 nt, Human
uccaguguggagacuccaagcacagucaucauugccugcuacggucuucacuggugga

SEQ ID NO: 4114096 - RNA, 59 nt, Human
uccaguucacagguuaugcaguacacaguggcacuugcugagguagccagugagaugga

SEQ ID NO: 4114097 - RNA, 118 nt, Human
uccaguuccuccccacacaagcucuggcacuuagauuccugguaccuccgcugcuucaucuguaaaauggaguaacaauaggaauacuuuauagaguuguaaggauugaguggcugga

SEQ ID NO: 4114098 - RNA, 78 nt, Human
uccaguucucucucugugggucuggggcagaccagcaucagccugauuuacccguccaggcccuaguggagaaauggg

SEQ ID NO: 4114099 - RNA, 93 nt, Human
uccaguuguacauuuuccuucauucuccuuaugaaauggugaguucaauacucuucuauuuugaagggaauugaaguucauggaacaaaaggg

SEQ ID NO: 4114100 - RNA, 65 nt, Human
uccaguuuauuaugcauuuacaacuccuuuggacauggggucaugugguugccuagugugcugga

SEQ ID NO: 4114101 - RNA, 63 nt, Human
uccaguuuauuuuuggcagggucuauaaacccaaauuucauuucuuugcuaaacuggacugga

SEQ ID NO: 4114102 - RNA, 56 nt, Human
uccaguuucucuucuuguaaaaugcaaauaaauugaggucaagagagaugacugga

SEQ ID NO: 4114103 - RNA, 58 nt, Human
uccaguuuuggagguagagagugugugauuucucuuccccuuuccuuuaacagcuggg

SEQ ID NO: 4114104 - RNA, 61 nt, Human
uccauacauugaaauaccauucaccuguuaaaagagggugguguggcuuuauguguaugga

SEQ ID NO: 4114105 - RNA, 57 nt, Human
uccauacccagcauuuccugagcuucuacccugugccaggcucugcugggugcuggg

SEQ ID NO: 4114106 - RNA, 77 nt, Human
uccauacucccucaagucacuuuaguuuaguuaauauuauuugugugacaaaaguguuuugaacaaggaaaaaugga

SEQ ID NO: 4114107 - RNA, 68 nt, Human
uccauaggaaauccauagaauaaaauugcaggaaaaguuauccagcaacaaucuauggcuccuacgga

SEQ ID NO: 4114108 - RNA, 68 nt, Human
uccauauaccugcagccugguuuuuccaagagagcaaaaaggacuaagcuaguugcuuguguaauggg

SEQ ID NO: 4114109 - RNA, 129 nt, Human
uccauauauuccagucucuuguugcugaccagcugauaaggcauauaauugcucuuaacaauugggcauaauuuauuccugccuuagguggcuguuaccugcagcaauuaaagcauagugacugauggg

SEQ ID NO: 4114110 - RNA, 94 nt, Human
uccauaugaauuuuagaaucagacuguuaauuucaauuaaaaauccugcugggauuuugguugggauugcauugaauuuauagaucaauuugga

SEQ ID NO: 4114111 - RNA, 68 nt, Human
uccaucaccugucaaagacuaagguucuuaagaucuguuuaagcacuagagucuugacaagaagugga

SEQ ID NO: 4114112 - RNA, 60 nt, Human
uccaucaucuggguucucagauggauaugguucccauguccauugccaaucagaagugga

SEQ ID NO: 4114113 - RNA, 59 nt, Human
uccauccaggccagcaguaaucacggcaacugggcuggcagcugcuggcucuggcugga

SEQ ID NO: 4114114 - RNA, 76 nt, Human
uccauccauucauuagagauuauaaaaugaugacauucugugucuaucauuucuucuucucuuacugguuggagga

SEQ ID NO: 4114115 - RNA, 60 nt, Human
uccauccauuuuccuuggcagcaggacaugccgaugccuaugaacaggaaauggaacgga

SEQ ID NO: 4114116 - RNA, 129 nt, Human
uccauccccauuccgcugugugaccuuggacaagucucucucccucucugagccucaacggccucagcugugaaacggagucagggaaggucugcugagaguucgcacagaccgagguuuggggaagga

SEQ ID NO: 4114117 - RNA, 105 nt, Human
uccaucccuucuccauuuccacugguccugcaguaauagacaucucaccauuuuucaaguggauuacuaugcuauaggacucugugucuguggacuuaaaaugga

SEQ ID NO: 4114118 - RNA, 58 nt, Human
uagggcaguuauaacauuaguggaauuauaaaucccaugaauguuuuccucuguucua

SEQ ID NO: 4114119 - RNA, 60 nt, Human
uagggcgucucgcuuguugcccaggcuggucuugaacuccugggcaaagugaucguccug

SEQ ID NO: 4114120 - RNA, 68 nt, Human
uagggcuggcgugcucagggaagguagaugaaauguucugaggguccuauggaugcacuccaccucua

SEQ ID NO: 4114121 - RNA, 83 nt, Human
uagggcuguuuugaagacuaauuuagauaauguaacuaggguaggcaguuccaugucugagucaugguacuucugaaccccua

SEQ ID NO: 4114122 - RNA, 60 nt, Human
uagggcuuugcucauccuagguauaaccaauguguguucagcauaggagguaaaguccug

SEQ ID NO: 4114123 - RNA, 60 nt, Human
uaggggcagguggcaaggccuggcugggccuuccuuccuggccucagccaccuggcucug

SEQ ID NO: 4114124 - RNA, 113 nt, Human
uagggggauaguguccaggcaguggggauguagugggauaagccaugggaaggcucauugugguuccugguaacaaucucaaaguaugccucagcuuccuauaauccaccuua

SEQ ID NO: 4114125 - RNA, 61 nt, Human
uaggggggcccaggcaccaccugugagcaagacaccauucaggguauaugggccucacuug

SEQ ID NO: 4114126 - RNA, 72 nt, Human
uaggguaguacagagaguguccuaaagggccaagcacacaggugagauuaugacacuccugugcgcacccug

SEQ ID NO: 4114127 - RNA, 84 nt, Human
uagggugaccaaguguccugauuugccugggacuuuucugggaauugcucgguccugggcaaagaggggcaguggaucacccua

SEQ ID NO: 4114128 - RNA, 65 nt, Human
uagggugaucugauaaauagggauuucugcauagagcucugaaucaaucagauaagguaccucua

SEQ ID NO: 4114129 - RNA, 81 nt, Human
uaggguggucaggcugggguggaggagcuccccuggaauguuccagagcuucccccacuccugccguucugagucacccug

SEQ ID NO: 4114130 - RNA, 66 nt, Human
uaggguuuauuucauuuucuuaguaucucaugcuauuggugacucugagcuguggaauaaacacug

SEQ ID NO: 4114131 - RNA, 82 nt, Human
uagguaaccucaagcagugacguuauaucugaaaaaagugacugagguucacuuuuaaguaggcagcgugcuuugaggccug

SEQ ID NO: 4114132 - RNA, 81 nt, Human
uagguauauuucuguuuguaguagagagggguggcuuucaaacugagccaugauaacauuucaacaggcagagaagacuua

SEQ ID NO: 4114133 - RNA, 62 nt, Human
uagguauccaggaaggauggcauugagcugacacaguggagaugcagaucuugguuuaccug

SEQ ID NO: 4114134 - RNA, 93 nt, Human
uaggucaaugauauagcacagacaguaaauaguguggcugucuaagggggcagaaugaacaaggcacugugacuguuaaauguuauugaugua

SEQ ID NO: 4114135 - RNA, 98 nt, Human
uaggucggaaacuggaugcaguuuuucugcuaacuggaaaauccccuggcaaggauuccaggcaaagcagagaagaguauguugauguuucaggcgua

SEQ ID NO: 4114136 - RNA, 128 nt, Human
uaggucuccuccaagauauucuuauguaacuacucuacuugucaccuggacaucaggacuuuggaaaacuucccaaguguuuccauugugcaggcugucaugagaauauccucucucgggaagacuua

SEQ ID NO: 4114137 - RNA, 61 nt, Human
uccuauaagaacaucuguccccagauuuagggcucucucuaaauccagaaugaucuuggga

SEQ ID NO: 4114138 - RNA, 62 nt, Human
uccuauaauaugaaaagaagucaccauuggggaacuagagaccccagaccuuuucauaugga

SEQ ID NO: 4114139 - RNA, 67 nt, Human
uccuauauugugaguucagacuaaaaacuggugugaaucugguuuauaguuaggaauucucaaagga

SEQ ID NO: 4114140 - RNA, 108 nt, Human
uccuauauuuuaacaucuuuuugguauauuuguuagcuguuuauagggaauaauuuuucuuaauagaauagcagcuggugcaacucuaagaacaugucaaaucuagga

SEQ ID NO: 4114141 - RNA, 70 nt, Human
uccuaucauauaguaaauaaugucuguggagccuuuuacuauuuuccagaacauucacucauauguggga

SEQ ID NO: 4114142 - RNA, 87 nt, Human
uccuauccaaauuaaauguauauuucuuauugagauggcauauauugugugucauauuaguauugagaguucauuauaaucggggga

SEQ ID NO: 4114143 - RNA, 65 nt, Human
uccuauugaacuauaauuaugauuugauuuuagauggucaacuugucgcauuuuggucaauagga

SEQ ID NO: 4114144 - RNA, 61 nt, Human
uccuauuuaggagcccucucugcuuaguuuuguagaggcucucauggcuccagaauagcga

SEQ ID NO: 4114145 - RNA, 73 nt, Human
uccuauuugugaaaguguccccuacagaggcauucugcauuuaccagauguccaggggcaucacaaguagaga

SEQ ID NO: 4114146 - RNA, 82 nt, Human
uccuauuuuauagacaaacugauacuuggcgaguuaaugugauuuguccaaggucccacaguuaguaauuauaaaagcaggg

SEQ ID NO: 4114147 - RNA, 122 nt, Human
uccuauuuugaaaaagaaaaaagucuauuacuauuaaauauaucuguuaguugaauaucaaucacuuuuucuaaaggguagauuuggccaaugagugauuuuuuuuuuuuuuuuuuuuugga

SEQ ID NO: 4114148 - RNA, 71 nt, Human
uccuauuuuguauauuauuuucccuggaguuguauuugaaagaauauaaaauauggaagguauauaaugga

SEQ ID NO: 4114149 - RNA, 79 nt, Human
uccucaaaaccacccaggcccaguuauuuccucaguuuacagauaggaaacagagugaagcuugggaagguuaagaaga

SEQ ID NO: 4114150 - RNA, 96 nt, Human
uccucaagaaucgcugguccagccacucaccuuccagcagguaaguuaacagaccuguugggccagaaggugguuggagggcagcaucguugauga

SEQ ID NO: 4114151 - RNA, 65 nt, Human
uccucaaggagacagaaagcaauggaccuuagauucugcgccagcugcucucuucuccgccaggg

SEQ ID NO: 4114152 - RNA, 58 nt, Human
uccucaauuugaaaaacagcuagcuuguagaagagaguccuuuuuauaaaauugagga

SEQ ID NO: 4114153 - RNA, 64 nt, Human
uccucacaagcauccugucucaggcacaauccauagacuggcugugacaagaaugcagguagga

SEQ ID NO: 4114154 - RNA, 125 nt, Human
uccucacaccuucaaggcuguaaaaggauuuugaggugaccugugcauuuuuuugagaucagccucaguuauugcuuaagaagccacacaccucuuucaaugccucaguuauagacuuaaaggga

SEQ ID NO: 4114155 - RNA, 67 nt, Human
uccucacagaacucauggcugucauuuguguucacaauggcuauacaacaugaguaugcugucagga

SEQ ID NO: 4114156 - RNA, 93 nt, Human
uccucacccacccucucuaagccuguguccucugcagagugggagggaaucuguccuggagagccgcaugcagaguauuaagugggauguuga

SEQ ID NO: 4114157 - RNA, 84 nt, Human
uccucacucauuuuuaggaagcuuuggaggccaggcacagugccucaugccuguaaucccagcacuuugugaggucgaggaggg

SEQ ID NO: 4114158 - RNA, 57 nt, Human
uccucagaaaccccugugagguggaaauuauuauuaccuccaauugguagaugggga

SEQ ID NO: 4114159 - RNA, 56 nt, Human
uccucaggaugugggguagaaucugguugugguuuugguuucuaccucccugauga

SEQ ID NO: 4114160 - RNA, 68 nt, Human
uccucaggcugugccaccugugugacauccaugccagcccucugucccauguaggcacaugccuggga

SEQ ID NO: 4114161 - RNA, 57 nt, Human
uccucagggaagaugagccucacugaggaaggugacauuuggcuaaguccugaagga

SEQ ID NO: 4114162 - RNA, 60 nt, Human
uccucagggcggccuccgucuuagguuagaagauaaaaagaucugaugccacccugaggg

SEQ ID NO: 4114163 - RNA, 55 nt, Human
uccucaggugacuagguaucuugaggccccaggguauauaaaagcaccuugagga

SEQ ID NO: 4114164 - RNA, 80 nt, Human
uccucagucacgguagcacauuuaagggcucaacagucacacguagcuaguggcuaccauauuguuugaugacugagaga

SEQ ID NO: 4114165 - RNA, 78 nt, Human
uccucaucgaggugguggggguggaaagacauucacaggcagcagacauucucauccauccucgccuuugcuugagga

SEQ ID NO: 4114166 - RNA, 60 nt, Human
uccucauguuccuuacugacuucacaggugagcauuguguuuuggaaggaacaugcaggg

SEQ ID NO: 4114167 - RNA, 69 nt, Human
uccucauucuggaguaugugugaacggugagcucccugucucugccccacuuugcuccuagagggggga

SEQ ID NO: 4114168 - RNA, 59 nt, Human
uccuccaggcaccucacuggcuccgugucccagaggaggcaagugacuugcuuggaggg

SEQ ID NO: 4114169 - RNA, 94 nt, Human
uccuccaugaacuaauuagaguaaugacuauuugcagacauuuccacacagguaauuauuuguaagcaaguuaacauuuuuuuagaggggaggg

SEQ ID NO: 4114170 - RNA, 118 nt, Human
uccuccauuaauuuucuucucuugcaucccgcuuucuucaaauuuauccugcaugcaaguaucucaggaaauaggauuugaguuggggcuugaugugagagacugagaagauguggga

SEQ ID NO: 4114171 - RNA, 84 nt, Human
uccucccuccacuguggaucugaagagcaaugaaauaugagauauauauucaauuaucaggauguaaggggaauuaagggagga

SEQ ID NO: 4114172 - RNA, 74 nt, Human
uccucccuuuuggugucugcauaggccuagggaaggaucuacaagaaaaaugcuaggcuuugaaggagggagga

SEQ ID NO: 4114173 - RNA, 78 nt, Human
uccuccucagagucagggccacauuuagcugguucuguaagaagggccugauggcugucugggccugaaacaggagga

SEQ ID NO: 4114174 - RNA, 55 nt, Human
uccuccucagucuggucagggcucucaaaagagugaccaacaaugcugagaagga

SEQ ID NO: 4114175 - RNA, 73 nt, Human
uccuccucauucuucguguugaauuucacccuuuucugaggauaucugagucucugcacuaaggagaggugga

SEQ ID NO: 4114176 - RNA, 70 nt, Human
uccuccuguccaucuccaccaucugggaggacagguccuccugggagcagggauggauggucuaggagga

SEQ ID NO: 4114177 - RNA, 129 nt, Human
uccuccugugugggcauaugaggaggguugguaaugaugagaugcuuuguguauagacaagauuuuugguuuugguuuuaauggcagagguuuuauuaaugcuuuuacuugauuuaaaguguaggagga

SEQ ID NO: 4114178 - RNA, 85 nt, Human
uccuccuguuucucugugccuacuacgaggcucauccucacaccugaggacugucuccuugcugguaggcucaccgcguggagga

SEQ ID NO: 4114179 - RNA, 83 nt, Human
uccuccuuuucagccaaugguuuguaccuguccuuggccacaagaugucacccaaggaacagcaaagccggggccugggagga

SEQ ID NO: 4114180 - RNA, 68 nt, Human
uccucgaaguguuugugggccacauuuaggaagccacacugaguuuggcuccaugaaaauuacgagga

SEQ ID NO: 4114181 - RNA, 63 nt, Human
uccucuagcuuugagaucaguagccagggccuuucgguaaucagcagcuuacaguuaagggga

SEQ ID NO: 4114182 - RNA, 70 nt, Human
uccucuaguuuaagaucuguuagucuguuauucuguuacuuauaguugaaaauauuccugaacuagugga

SEQ ID NO: 4114183 - RNA, 106 nt, Human
uccucuauucacauccaucagggagaggaguaggcugauggugccagcuaaggaccucggcacuccuagaccuauuccugaaccauuaauggcucugaauuuggga

SEQ ID NO: 4114184 - RNA, 107 nt, Human
uccucucaguucguuagcugaauugcuaggcugcauguguccagaggcauuauucuagagaccugacagauacagugcaguggcagagaggcugaaauuugagugga

SEQ ID NO: 4114185 - RNA, 99 nt, Human
uccucucuguagcucccaaggccacccuggaggugcauggacuagcggauguggcaggcuggcucaggguggucugggucugccaagcuacguagagga

SEQ ID NO: 4114186 - RNA, 64 nt, Human
uccucucuuuccugucccacugggguccuaccauucugggauccugugcauggggugaugggga

SEQ ID NO: 4114187 - RNA, 59 nt, Human
uccucugaaaucuagauugugaugcaauguauacguucucuaaaucagauuucugagga

SEQ ID NO: 4114188 - RNA, 57 nt, Human
uccucugaggucuaggaccauggcuuauuugccauucuauuccccaggcccagaaga

SEQ ID NO: 4114189 - RNA, 65 nt, Human
uccucugauauggaugccucauuguccucuacaugagggcagucagggaccuccacauaugagga

SEQ ID NO: 4114190 - RNA, 59 nt, Human
uccucuggaaagaucauuaaauccaaauucugaauagggaaauggagacuuuccaagga

SEQ ID NO: 4114191 - RNA, 111 nt, Human
uccucugguucuguagagcugacaauucauuaaugugagguagucaauaacaaauauauuuuaugucaaguggugauggguucuaugaagaaaaaugacucaauaagagga

SEQ ID NO: 4114192 - RNA, 65 nt, Human
uccucuguggggccagguggcuugcucagggggaaucugagggaguuccugagcccaccugagga

SEQ ID NO: 4114193 - RNA, 83 nt, Human
uccucuuaccucuccaggcucguccaagaucgacauccaucccuucuugaaguugagcagaucgggcuguggggagaugagga

SEQ ID NO: 4114194 - RNA, 59 nt, Human
uccucuucaaacccagauuaaaugcauguagauacaggcuacaugcaugguuuacagga

SEQ ID NO: 4114195 - RNA, 77 nt, Human
uccucuuccacaugccuuuucggguacuucucugcuuuuuugcagaagcacuagaggguauggaagcuggaagggga

SEQ ID NO: 4114196 - RNA, 67 nt, Human
uccucuuccacuuaucuuacuuccccuucauguugaaccaacguuaauaggugcaagguaaggagga

SEQ ID NO: 4114197 - RNA, 61 nt, Human
uccucuucccaccuucuccucuguuaacuuauuuucuuuacagcaggccuuggggagagga

SEQ ID NO: 4114198 - RNA, 77 nt, Human
uccucuucuauuuuauuaugcuugcacuaaaugaggcagaaacaccuuagcagagugauuggccaugagggagggga

SEQ ID NO: 4114199 - RNA, 57 nt, Human
uccucuucuuuccuuccuccaguggcucaggggccugcuguugagggaagagcugga

SEQ ID NO: 4114200 - RNA, 72 nt, Human
uccucuugaauagcaaguagugcagauguacauagaaccuguugccugccacgcuugcuaccacaaaaagga

SEQ ID NO: 4114201 - RNA, 56 nt, Human
uccucuuucucaacauuaguuagcaugggaaaguuaacaugaugugcuucagaggg

SEQ ID NO: 4114202 - RNA, 86 nt, Human
uccugaaaauucuguuucucuggagccacucucaguacaaaaaucuauuuuagucaguguucuccggagaggcacaaacaauagga

SEQ ID NO: 4114203 - RNA, 102 nt, Human
uccugaagcagcaaccucucgaaguggggaagcaacaggagaacaucuugcucucuugagcgucucccacaaagugagcugguuacggcgcugacucuagga

SEQ ID NO: 4114204 - RNA, 62 nt, Human
uccugaagcaguuagcaugagcaaaaaaggaguguggaugcuuuuccacugcuuuucuugga

SEQ ID NO: 4114205 - RNA, 80 nt, Human
uccugacacuccauugaguaggauuccugcaaugaagaccauacaguacagcacaggaaugaucugcugagugaucagga

SEQ ID NO: 4114206 - RNA, 95 nt, Human
uccugacccugaggcagugugagauaauaaauguuugcuauuuuaagcuaugagauaauaaauguuugcuauuuuaaagcuccuaauuuguggga

SEQ ID NO: 4114207 - RNA, 75 nt, Human
uccugaccucuugaaugaauaguugcuagaaggggccuaagagcuucgagaggagaaaaauucauucaaucagga

SEQ ID NO: 4114208 - RNA, 58 nt, Human
uccugaccuugugauccagccaccuuggccucccaaagugcugggauuacaggcauga

SEQ ID NO: 4114209 - RNA, 72 nt, Human
uccugacuguggcucaucaggcuggugcuaccaucugugguuguaaagguccaaagagggcuacggaaagga

SEQ ID NO: 4114210 - RNA, 60 nt, Human
uccugagaaggcacagcuugcacgugaccuccugggccuggcggcugugucuucacagga

SEQ ID NO: 4114211 - RNA, 90 nt, Human
uauuaaaagauugagaggacaagauuaaccauaguuaagucuuuuuaccucugauuuaggaaauggaagauuuugcuuaauuuuuuaaua

SEQ ID NO: 4114212 - RNA, 102 nt, Human
uauuaacaugcacauuagcaucaucucauugguucuuccugcugcuccaccuuaggggcagcaguaggagcuaaucuuauugcucccaugcgcauaauaaug

SEQ ID NO: 4114213 - RNA, 84 nt, Human
uauuaacuugugucauaugaaauugccauuuuugagggucaaagauggucaaauauuggcuauuucacauggcucauccuaaua

SEQ ID NO: 4114214 - RNA, 82 nt, Human
uauuaagagacuaaugaaguaagauauucaacuaaagugaauuagcauugauucaugcaaguuaaauaccugucucuuaaug

SEQ ID NO: 4114215 - RNA, 88 nt, Human
uauuaagcaccuuugaucuaggauuuugaaaugugccacauuguaaaauuuauucagugcauauauuaaaaaucaaaggugaaaaaua

SEQ ID NO: 4114216 - RNA, 83 nt, Human
uauuaaggcaguuaaacagguuuuugaauggccccuuuuaacuuuugggucaggcugucacuucuuauuucucugcucuaaua

SEQ ID NO: 4114217 - RNA, 61 nt, Human
uauuaaguccuaauggcagaagucuuugaaaaggcauuucuggacuugggaucauuuaaua

SEQ ID NO: 4114218 - RNA, 84 nt, Human
uauuaaguugaaccauuugaaaugaauguuuuuauagguuaaagauggugaaagauugacaauuucauaugguuccacauaaua

SEQ ID NO: 4114219 - RNA, 91 nt, Human
uauuaaguugcaagccacugcugugcagacagacucucuuugugaagaugagaguuagccugcauaguucaauggcugacauccucagaua

SEQ ID NO: 4114220 - RNA, 60 nt, Human
uauuacaaaggcggaguuaaaaugauugauuuuaagcaagcaugaucugcccuuguaaua

SEQ ID NO: 4114221 - RNA, 80 nt, Human
uauuacacaaguagcuaaucaccccaaagugaugauuuugaauggucagcacucuucugugauaguuguauguuguuuua

SEQ ID NO: 4114222 - RNA, 68 nt, Human
uauuagaaacacuugcaaaaugguuccuuacugcugacauaagugaacaagucgcgauguuuuagaua

SEQ ID NO: 4114223 - RNA, 62 nt, Human
uauuagaauuuugguuugagagcuggccuccaagaguuugcauuuaagcuaagauacuagua

SEQ ID NO: 4114224 - RNA, 55 nt, Human
uauuagcgucaggaggugaguauuaguuuaaauauugaccucuguuauguuaaua

SEQ ID NO: 4114225 - RNA, 56 nt, Human
uauuagcuauaugcuaugugccaggcacaauccuagguacuagaaauauagcaaua

SEQ ID NO: 4114226 - RNA, 83 nt, Human
uauuagcuugcugcaaaugugagugcaguucuugccauuaaaaguaaugcaaaaacugcacuuacgcuuacaccaaccugaua

SEQ ID NO: 4114227 - RNA, 92 nt, Human
uauuaggaugucauagguuauguacuuuuuaaaucuuguaauagauugccagauugaacuaaagguuauaucauuuuauguaucuccuagua

SEQ ID NO: 4114228 - RNA, 79 nt, Human
uauuaggcuagugcaaaaguaauugcggguuuugccauuauuggcaaauugcugcaauuacuuaugcaccaaacuauua

SEQ ID NO: 4114229 - RNA, 74 nt, Human
uauuagguuagugcaaaaguaauugccguuuuugccauugaaaguaaugcaauuauuuuugcaccaauguaaug

SEQ ID NO: 4114230 - RNA, 84 nt, Human
uauuagguugaccauaagaaauugcuuucuuugauaaaaccaaaauugugaaauauuggcaauuucauauggugcaaucuaaua

SEQ ID NO: 4114231 - RNA, 83 nt, Human
uauuagguugaugcaaaaguaauugcaguuuuugccauugaaaauaauggcauaaccugcauuacuuuugcaccuacuuaaua

SEQ ID NO: 4114232 - RNA, 71 nt, Human
uauuagguuggugcaaaaaguaauugugguuuuugccauuaaaagcaauuauuuuuugcgccaacuuaaua

SEQ ID NO: 4114233 - RNA, 59 nt, Human
uauuagguuggugcaaaaguaauggcaaaaaccacaauuauuuuugcaccaaccuaaua

SEQ ID NO: 4114234 - RNA, 83 nt, Human
uauuagguuggugcaaaaguaauugcaguuuugccauuacuuuuaaauggcaaaacugcaauuacuuuugcaccaaccuaaua

SEQ ID NO: 4114235 - RNA, 83 nt, Human
uauuagguuggugcaaaaguaauugcaguuuugccauuuaaaaguaauggcaaaacugcaauuacuuuugcaccaaccuaaua

SEQ ID NO: 4114236 - RNA, 101 nt, Human
uauuagguuggugcaaaaguaauugcaguuuuggccauugaaggcaacggucaauugaaagcaauggccaaaacugcaauuacuuuugcagcaaccuaaua

SEQ ID NO: 4114237 - RNA, 84 nt, Human
uauuagguuggugcaaaaguaauugcgguuuuugccauuacuuuuagugccaaaaaucgcaauuacuuuuguaccaacuuagua

SEQ ID NO: 4114238 - RNA, 65 nt, Human
uauuaguguggaagauucuaauugggcuuccuauguagccgaagaucaaauacuuccaacuagug

SEQ ID NO: 4114239 - RNA, 75 nt, Human
uauuaguuuggugcaaaaguaauugugguucuugucguuccuuuuaauggcaauuacuguugcaccaaccuaaua

SEQ ID NO: 4114240 - RNA, 75 nt, Human
uauuaugcugggaacugcagguguuacauaaauaagguagacaguuuguguccucaugagguuugcaggguaaua

SEQ ID NO: 4114241 - RNA, 79 nt, Human
uauuauguugauagcuacaagucaucagcuaucagucggaagacugauccacauauuuguagcugaagguaacguagua

SEQ ID NO: 4114242 - RNA, 55 nt, Human
uauuauucacaauagccaagguauggaaacaaccugugucuguugcugaauaaug

SEQ ID NO: 4114243 - RNA, 88 nt, Human
uauuauugacaccacuuuuauggaucauuucuuacuguguuucccuuagggaaacacguauaaugugacagagagguugguaaugaug

SEQ ID NO: 4114244 - RNA, 68 nt, Human
uauuauuggaauguuuuuaggaauguuaugaauaagguaauguaugagauccuggagacacaaugaug

SEQ ID NO: 4114245 - RNA, 56 nt, Human
uauucagaaagcacuugcucuuuaaaaaagaacugaggacaggaacuggcugaaua

SEQ ID NO: 4114246 - RNA, 66 nt, Human
uauucaugagauaggcaguuuuaugggguuuguguaugagccugaagagugaguauuuccugauua

SEQ ID NO: 4114247 - RNA, 93 nt, Human
uauuccaaauaugaaccgaucuguaaaugagaauauaaauuuuauaguggaauuuaauuuacauuugacagaggguaucuguaucagugaaua

SEQ ID NO: 4114248 - RNA, 73 nt, Human
uauuccacuuaaaauucagagguaguagcagaguugagaauuaucuagauucuguuuccucugguuuggauua

SEQ ID NO: 4114249 - RNA, 59 nt, Human
uauuccaugccagaguuuauugcuccuuuauacugcaagaaacuugauggcauagaaua

SEQ ID NO: 4114250 - RNA, 77 nt, Human
uauuccgucuuucauaugcuguuuggguccaguugccuaauaauuaccacuuaaucaacauauguauuuaugggaua

SEQ ID NO: 4114251 - RNA, 103 nt, Human
uauuccuucaauuuuuaauucuuuucugcuugagagaauugcuguuggugucucaauuggugcucagcauuuucuuaauguaggugaguuauuuggaagaaua

SEQ ID NO: 4114252 - RNA, 93 nt, Human
uauucuaagcagccuucucugaucacuccacagggacugcuucugucuucuagagcaucucugggagucauccgucacuuggcacuuagcaua

SEQ ID NO: 4114253 - RNA, 71 nt, Human
uauucucacaccuccagguauuacuguuuucccaucauacagauggcaaaaccaaggcuuggagaggagua

SEQ ID NO: 4114254 - RNA, 69 nt, Human
uauucugagccaacaugucaauuuuguauuguaaauguauaaugcacaugccacaugugguacauggua

SEQ ID NO: 4114255 - RNA, 94 nt, Human
uauucuuacuaaauucagaaguuugcaauuguuuauuucagugugaaaccauuuguguagugauuaauuguaaaaauucugaaaucagagaaua

SEQ ID NO: 4114256 - RNA, 92 nt, Human
uauucuuauaagcccaguuuuuagauuaguugguggaaaacuggcaauauuucacugaauuaaaaucaaagcugcuggguucuauaaugaua

SEQ ID NO: 4114257 - RNA, 66 nt, Human
uauucuucauccauaugcagagagcuuccuuuauacagugaacuuugcugaauggaguggagaaua

SEQ ID NO: 4114258 - RNA, 64 nt, Human
uauucuuggaauugacaguguuguacccugcuagcacuuacaugauguguuaauuccaaugaua

SEQ ID NO: 4114259 - RNA, 56 nt, Human
ucuauuucuggguuugugugguuaaguauaaucacauauaugcaccaagacauaga

SEQ ID NO: 4114260 - RNA, 57 nt, Human
ucuauuuggccauagugcaguuacauguccauauuuagcugcaagaggguccaagga

SEQ ID NO: 4114261 - RNA, 65 nt, Human
ucuauuuugggauuugacauguugguccccugcaauaacugugagaugcaaaucccaaaaucagg

SEQ ID NO: 4114262 - RNA, 72 nt, Human
ucuauuuuguauacccauaacuuucucucugggauggauacauauuagagaaaagauggaugugagacugga

SEQ ID NO: 4114263 - RNA, 71 nt, Human
ucuauuuuuauaagagcagcagaguugucuucucaaaacggcugccaagcucugcuucuugggaagaugga

SEQ ID NO: 4114264 - RNA, 79 nt, Human
ucuauuuuuugcuuugguuucuaugcuuuuggggucuuaaucucccccaaaaagucauuuuccagaccaguauuauaga

SEQ ID NO: 4114265 - RNA, 84 nt, Human
ucucaaaugggagguaauauauugaagcauuuacucauggacagucagaugguaaaggcucugauaaguacugcuauaauggga

SEQ ID NO: 4114266 - RNA, 70 nt, Human
ucucaagcuucagcuuucucugauuucccuuuuugucacccguuggaggaagcucucugcuuuuaagaga

SEQ ID NO: 4114267 - RNA, 68 nt, Human
ucucaagguaacaucauccucguuuuaggguugguccuaaauccaacgacagguguacuuauaagaga

SEQ ID NO: 4114268 - RNA, 130 nt, Human
ucucaagguuaaaugaaaucuuucauguaguccuccagucauagucugucuuguucuccucggaaaugaguggauacacaagacgugacauauaaaacuugaaaaugugaauuugcauucaaucuauaaa

SEQ ID NO: 4114269 - RNA, 69 nt, Human
ucucacaccuuuuagaauuacuauuaucaaaaagaugaaagauaauaacugucggcaagggugugguga

SEQ ID NO: 4114270 - RNA, 74 nt, Human
ucucacagacugugagucucauuuucuacauauacaaaaugaagaagauaauuccuacuuauaacguugugaga

SEQ ID NO: 4114271 - RNA, 55 nt, Human
ucucacagaucagcagggggcucuaaaggcugcuccucccacccuggucuggaga

SEQ ID NO: 4114272 - RNA, 67 nt, Human
ucucacagcucuccgcuccuucucagacacgcaguaaucugagucucaagcaccgaaagcugucagg

SEQ ID NO: 4114273 - RNA, 60 nt, Human
ucucacaggugguuaugaggaaggugacuguguggucaucuagagguggccaccugugga

SEQ ID NO: 4114274 - RNA, 75 nt, Human
ucucacaguuucccccuagggcagcacaucucuucagaaaugccaacccaguggagggaaagcagcccugugagg

SEQ ID NO: 4114275 - RNA, 88 nt, Human
ucucacauugggccuacaucuggucuccuggaaauaugcccauauccuuugucuggacaauccugagacagacccagcccaaugcaga

SEQ ID NO: 4114276 - RNA, 106 nt, Human
ucucaccaacaucacauucuuuuuuccauguauugucucuuccauggauggcuauuuggaaugauguuaagaagaggcaguacuuauggggugguggagggugggg

SEQ ID NO: 4114277 - RNA, 56 nt, Human
ucucacuccccaggcugggauggcugcaauggugguagacccucuggggagggagg

SEQ ID NO: 4114278 - RNA, 65 nt, Human
ucucacuuaacauuuaguguaccccuguuuggaccaggcaaagggaauauguguuaauuagggga

SEQ ID NO: 4114279 - RNA, 57 nt, Human
ucucacuuugcacagccagaauuccaguggcacagggcugggcugugccaggugaga

SEQ ID NO: 4114280 - RNA, 63 nt, Human
ucucagaauaaucuugggccugcuuuucuuccuuuccugcaaguagauaacacuguucugaga

SEQ ID NO: 4114281 - RNA, 130 nt, Human
ucucagaggguccaaagucacagucacagcagugagugggaggaccauggaucaaaacccacaguucagaguuucaggccugguuccacuuccgcucuugcugcugaccucccguauggccuuccgaaga

SEQ ID NO: 4114282 - RNA, 55 nt, Human
ucucagaguaauucuuuaagguaagcacauguuuaguuugaugcaauuucugaga

SEQ ID NO: 4114283 - RNA, 69 nt, Human
ucucagaguuucuguggccaggagucugggcauggcuuagcugaguucuccacugcagagucucucagg

SEQ ID NO: 4114284 - RNA, 129 nt, Human
ucucagauauaagccagaugcucuccuguggauugcauauuaauauucacagauagaagguucuguuuagacagaagcguuccauuugauggguuauauaugcaguaagcagagaaacuggcuuagggg

SEQ ID NO: 4114285 - RNA, 62 nt, Human
ucggggaggaaauuggcuugacuugucuacuuaccaagucagggaaacagguuuucccuuga

SEQ ID NO: 4114286 - RNA, 61 nt, Human
ucgggggagugauauaaaacagauucuuauauucauugccucuguuucuuccuccaucuga

SEQ ID NO: 4114287 - RNA, 92 nt, Human
ucgggugggcugcagggcgccggacugcugcagcugcuagcggcugcggcggcgguggcagcggcggcccggcgacugccugccacgcccga

SEQ ID NO: 4114288 - RNA, 60 nt, Human
ucggugauggucuggguacuugcuccucauacaggagauauccucagggcaucagucugg

SEQ ID NO: 4114289 - RNA, 92 nt, Human
ucggugccacugcauuuauggagcaaggcaguggaauaugacccuuaucacacuccugaucaucuccuuagccuccuguagugguccacuga

SEQ ID NO: 4114290 - RNA, 70 nt, Human
ucggugcgugaggccccugagcgaaucauaaaaggggcacuaagucuguucgugcaggggcccagaugga

SEQ ID NO: 4114291 - RNA, 74 nt, Human
ucguagcaaaauggagauuucccugugcugaagcagacaggugacuucagacuuaaaagaucccagcgcuaaga

SEQ ID NO: 4114292 - RNA, 102 nt, Human
ucguaggguccaggagggaacaggggcaggcaggacccuuuggcccagguccaaagacuucuguuuccacuuccaauuauagcuuccuuugugacccuagga

SEQ ID NO: 4114293 - RNA, 67 nt, Human
ucguccugggcugcaggcucugcaggaauugcugaaacccagccaguuugggcugcucccgggauga

SEQ ID NO: 4114294 - RNA, 58 nt, Human
ucgugcagcugggccggcucgggcccuguagacucggccauucuggucuugcugccga

SEQ ID NO: 4114295 - RNA, 72 nt, Human
ucguguaagauugccugaaaauagagaauuucaagcaguagauuuuauucuguauuucagguauguauuugg

SEQ ID NO: 4114296 - RNA, 130 nt, Human
ucgugucucauuuccgcuugcuaugguccuuauggccgugauaucuaaauccuuucauuucuuucaguaaggagcuggugcugcugccagcaggauccuggucacaaagcuggaguggagagaagcagga

SEQ ID NO: 4114297 - RNA, 79 nt, Human
ucguguugucgaaagcagguuuuaaccacaacuacggcgucuccguguaugaagguuuaccugcuguacuacaaaacga

SEQ ID NO: 4114298 - RNA, 73 nt, Human
ucguucugucacccaggcuggagugcagugacgugaucgcagcucacugcaaccuccucccggguucaagcga

SEQ ID NO: 4114299 - RNA, 71 nt, Human
ucguugcccaggcuggaguacaauugugugaucuugacucacugcaaccucugccuccuggguucaaauga

SEQ ID NO: 4114300 - RNA, 76 nt, Human
ucguuugaacccgggaggcagagguugcagugagccgagaucuugucacugcacuccagccugcgcaacagaauga

SEQ ID NO: 4114301 - RNA, 87 nt, Human
ucuaaaaauuggaaaucccuguuuuaaguugauauugaaaaacagaacuguuucagggacuugaauauagggaguuuuaaaacuaga

SEQ ID NO: 4114302 - RNA, 85 nt, Human
ucuaaacauuuaguaugagucucuguaaccuuaacaauaaaauuaggguuuuggauacagugauuucuacugguguuuucaaaga

SEQ ID NO: 4114303 - RNA, 94 nt, Human
ucuaaagcaguucuauuaucuaguacaauuuuagcaagaugauuuaaagaaguuuguuguguagcuguagcuuugcaguagaaucugcuauaga

SEQ ID NO: 4114304 - RNA, 122 nt, Human
ucuaaauaauguguuguauucauaaaaaucuugcccuuccaaauuucugaaagcauuuacgaacauuaauuaagcuucaggauaguggugaguggcauuuguuauuacucucaucuuucaga

SEQ ID NO: 4114305 - RNA, 92 nt, Human
ucuaaauuacugggcuugcauaucacaaacaagucuguacuuguccuccuacucuacaaauauaaauauaguaugugauguaggccuuugga

SEQ ID NO: 4114306 - RNA, 89 nt, Human
ucuaaauuuuucuaagaaaacuuagcuaggcaaguuuuaguacuaaguggguaagaaaauguaaagcuugaguguagcaaagagaugga

SEQ ID NO: 4114307 - RNA, 81 nt, Human
ucuaacucaaaauccauaaaaucagguuggcgccccaaaucugccacuaguuaccucuuucuauggauuuuuugggccagg

SEQ ID NO: 4114308 - RNA, 76 nt, Human
ucuaacuucucuacuccgagcaagaagaggccuugggcucaaagguucauucccaaauuuggagagggaaguggga

SEQ ID NO: 4114309 - RNA, 65 nt, Human
ucuaacuuguaaacaucuguugcuuagacuucuuagucuuugcaguugauguuuugcauuuuaga

SEQ ID NO: 4114310 - RNA, 59 nt, Human
ucuaagaaugcccuuccaggaauccaggcacugcaucccaggacccaggcauucacaga

SEQ ID NO: 4114311 - RNA, 57 nt, Human
ucuaagaauugaaguggcucuuugggggaaugggaugaggagcuaaggauuccugga

SEQ ID NO: 4114312 - RNA, 57 nt, Human
ucuaagccuaggaaaugaguuuagggaacuuuccaagccaucucccugagguaggga

SEQ ID NO: 4114313 - RNA, 71 nt, Human
ucuaaggagccccaaauuagaaccagaagccauauugucaaagcaaguucaaggcucuagaguuccuuaga

SEQ ID NO: 4114314 - RNA, 72 nt, Human
ucuaagucauggccagagaaggcagggucacauggcauacaguggccgccagagccuguggcuaugaaggga

SEQ ID NO: 4114315 - RNA, 97 nt, Human
ucuaagucauugacuagagaaaacuguguaucuuggagugggcaaacacguuaucaccugucuaggauuaugguuaucuuucaagucuagaacaaga

SEQ ID NO: 4114316 - RNA, 128 nt, Human
uauugaaaguuucuugggaagucaucuagccucuuggugcucaaagucuguggauccauagcacugguaucaccugagagcuugcuagaaauguagacuuuuaggccucucccaaaaucuauugaaua

SEQ ID NO: 4114317 - RNA, 74 nt, Human
uauugaaauuuuagaucuuccauacugcucuguggcaagguauguaugggagugaauggaagcugggaucaaug

SEQ ID NO: 4114318 - RNA, 82 nt, Human
uauugacaaaaccucagccguaaugcagauagcucucacguuuuuauuguguucauguugauucauagcgguuuugucaaua

SEQ ID NO: 4114319 - RNA, 111 nt, Human
uauugacgaaagaagagaaacagagacacggaagcuaaagaguugggaauccuaaaggucaaaggauguuucucaguuacucugauguccuguguuuucuuucaguuggua

SEQ ID NO: 4114320 - RNA, 67 nt, Human
uauugacugucuccugucaugagggauaucauccugcuuaguauccuucaaugaggagaaguuucua

SEQ ID NO: 4114321 - RNA, 130 nt, Human
uauugaggcuauaauuauacugagugugagucucuugcacauuguauuaaaaagaagcagacucacaauuauuuuuaaaaacauugaauuaggaugcaguuuacacuauguauacauauggacauugaua

SEQ ID NO: 4114322 - RNA, 61 nt, Human
uauugagucccauuugagcuauucuuuuuccugaaaaauggcacuaagagggagcuggaug

SEQ ID NO: 4114323 - RNA, 69 nt, Human
uauugauauuugcaucaugauggugucugagccaaaguucuuauagaaauaaucugaugcaauucaaua

SEQ ID NO: 4114324 - RNA, 56 nt, Human
uauugaugagaugaugccuuggcagcccauguaugugccaggcacuguucucaaua

SEQ ID NO: 4114325 - RNA, 62 nt, Human
uauugauugagcaucaauuaagugaguuucuaaaaugugagaaauuagauguuuaaucaaua

SEQ ID NO: 4114326 - RNA, 73 nt, Human
uauugcaaaaaguuccaguuuuugcauuuucucaguuuuuuaaagaggaagaugugcaaaguuggaagcagua

SEQ ID NO: 4114327 - RNA, 64 nt, Human
uauugcaguguuucagugcuuuuucucuccccuggagauaaaacugagccugaacauucuggua

SEQ ID NO: 4114328 - RNA, 79 nt, Human
uauuggaaagauaaaguuugauugaauauagggaccacugacagagucuguacuuccuuuaaacuuuagauuacuaaua

SEQ ID NO: 4114329 - RNA, 91 nt, Human
uauuggguaacuauauaaucugaaagugaaaaauucucuguuugacagugcagauggugguucuauuucauauuaauaguugaaucuaaug

SEQ ID NO: 4114330 - RNA, 65 nt, Human
uauugguaugguaagaauugaagagggcaaugaaacaugcccuaaguucuucucccauauccaua

SEQ ID NO: 4114331 - RNA, 67 nt, Human
uauugguuaugugcaggcucuggaguaggacuaucuggcuuuaauccuggcucugcacuugcuaaug

SEQ ID NO: 4114332 - RNA, 71 nt, Human
uauuguaaaacuuuuuuccauucacugucauguuauauuauuuuuaauauuugccagugugugguacagug

SEQ ID NO: 4114333 - RNA, 69 nt, Human
uauuguaucuuaccacauguauagaggaccuaacacuugguuuuuucccugugugcuaggacuacagug

SEQ ID NO: 4114334 - RNA, 62 nt, Human
uauugucaugucuguaaauacaccaucgaaccauaaaaauuggcacuacagacaagacaaug

SEQ ID NO: 4114335 - RNA, 56 nt, Human
uauugucauguucugucucuuggaacuugagcaagauacagaucuacgugucaaug

SEQ ID NO: 4114336 - RNA, 130 nt, Human
uauugugcccacuuacaaauaugggauccuaaggcucagacaggaaaaguaacguccacaaaaccauacaauguucacagauccuugaagccaggauaacacaauucacuauaacaaaaucagugcaaug

SEQ ID NO: 4114337 - RNA, 63 nt, Human
uauugugcucaccauuacauccccaugacaaacauguggccuguacaugguagacgcucaaug

SEQ ID NO: 4114338 - RNA, 57 nt, Human
uauuuaagaugugucauaaagaauacuuagggaucuuuauggcagcauguuuaagua

SEQ ID NO: 4114339 - RNA, 56 nt, Human
uauuuacccuggcagcuguagcauuuuagccuuccauuagcugacagaggugaaua

SEQ ID NO: 4114340 - RNA, 83 nt, Human
uauuuagcugaugguagcuguccacaucaggaaugauuagaccacgugauuuucccauggggccagccgccaucaguuaaaua

SEQ ID NO: 4114341 - RNA, 64 nt, Human
uauuuaucgagugucuacuaugugcaaaauauuuuucuaggcacugaggauacauugaugaaua

SEQ ID NO: 4114342 - RNA, 63 nt, Human
uauuuauguuuaggaaagugcuggccagcuggaaauaagagcucuuucucuaauuuauaagua

SEQ ID NO: 4114343 - RNA, 56 nt, Human
uauuucacaguuuucagacgcuggaaagucagugucuagggcgagaauguguagua

SEQ ID NO: 4114344 - RNA, 56 nt, Human
uauuuccuguggauacuuuuagcuuucuucugccaacguaucuauaaguggaaaua

SEQ ID NO: 4114345 - RNA, 59 nt, Human
uauuucuaagcuguaagucugaagucgggaagaauggcgggcuaacaguuguggaggua

SEQ ID NO: 4114346 - RNA, 60 nt, Human
uauuucuauuccccaggcaaguaaauugagcuuccaagaauuuagugggggauagagaua

SEQ ID NO: 4114347 - RNA, 90 nt, Human
uauuugaaauaauguguuucccuuugaagucaggaagagggaaaaguuaucuugucuuaacauaaaaggaaaucacguuugauauaaaug

SEQ ID NO: 4114348 - RNA, 61 nt, Human
uauuugaagauucuucugaugugaucacuuuucuagauacagucucaggacucuucagaug

SEQ ID NO: 4114349 - RNA, 110 nt, Human
uauuugauagaagaggggauuauauugcuaauuuguauaaugaaaauugcaaggaccaauuuuucaugagguuacacagcugguauuacuuucccuuuaacuaucaaaua

SEQ ID NO: 4114350 - RNA, 58 nt, Human
uauuugaugcugugcggucauccugauucuggaggaugauguuuuugguagucaaaug

SEQ ID NO: 4114351 - RNA, 57 nt, Human
uauuugcaacauaaaacucugaaauauuucuucuuuugagaguuaugguuguaaaug

SEQ ID NO: 4114352 - RNA, 65 nt, Human
uauuugcaagagacagacaugacucaguuggucuaaaugacucuagaggaacugcucuugagaua

SEQ ID NO: 4114353 - RNA, 93 nt, Human
uauuugcauacauuugcauugcauuaaguauucuaaguaaucuagagacgauuuaaaguauacgggaggauguguguagguuguaugcaaaua

SEQ ID NO: 4114354 - RNA, 127 nt, Human
uauuugcugagcaaggacuuuccagcuaggauuggauaaagcaguagcuagguucgagaguaagaguuuuauugcuaucauuuagaguauuucuucauucguucaugcaugccuuugcucauaaaua

SEQ ID NO: 4114355 - RNA, 62 nt, Human
uauuuggagugauggaaauguucuauaucuugauucuagugauaauuccaugacucuaugug

SEQ ID NO: 4114356 - RNA, 73 nt, Human
uauuuggugcaagaaugcaaaugcucccugagagaaaagcaucccaggcagaauuaguguuucaugcuagaua

SEQ ID NO: 4114357 - RNA, 82 nt, Human
uauuuguauucuaguagaaucaaccuaugagagagucuguuaagacccuauaacacuuuccguagguuuaguaauaaaaaua

SEQ ID NO: 4114358 - RNA, 65 nt, Human
ucuaucccaaggugaacuugcuguacagcuugacugauggcaugcacaguuuuucaccucauaga

SEQ ID NO: 4114359 - RNA, 89 nt, Human
ucuauccuccugcacacuuggauguguggccuugaccuguggagugggcugccuaaagggagaagguccaugccugucaggacugugga

SEQ ID NO: 4114360 - RNA, 79 nt, Human
ucuaucuaucuaugaugaaugcuacugaaucauuuuuuaaugaugguaaacaaagacauuuauuugugaaagugauaga

SEQ ID NO: 4114361 - RNA, 94 nt, Human
ucuaucucugacauggauauuauauuacuaauugacacugacacauaaaacaccagagaugaguaauagcuaaugguucucagauagagauaga

SEQ ID NO: 4114362 - RNA, 56 nt, Human
ucuaugaggaaggugcaaggaagccacaaaauacuuccagggcuaauuccugugga

SEQ ID NO: 4114363 - RNA, 89 nt, Human
ucuaugagugauugcaguggaagcuggcugugaagaacuauacaauuucuagcucuacaaguuuaauuccacuuaaauuacaucaugga

SEQ ID NO: 4114364 - RNA, 75 nt, Human
ucuaugcauuaugguagggcuguacaaauuagguuuuuucaacauauauuuauugagcaccucccauaugcuaga

SEQ ID NO: 4114365 - RNA, 127 nt, Human
ucuauggaggaggcggggcugcugugaccuguuucucgggccucccagcagccugggauggaccagcaagcugcuucuuuccuagaggcugaugagucgagaaccagggcaccuucucgucuauaga

SEQ ID NO: 4114366 - RNA, 80 nt, Human
ucuauggaugaguugagugguucugccaauuugggccauguguggcugauccuggcagggccugcucaucauccagcagg

SEQ ID NO: 4114367 - RNA, 81 nt, Human
ucuauguaagugguuggcgaacucuagacuguggaccaaaucuagcccaacaucuguuuuugucaauuacauuuuacugga

SEQ ID NO: 4114368 - RNA, 57 nt, Human
ucuaugugcccuuugugugaugugcaaauugcucauaucauauauagagcauguagg

SEQ ID NO: 4114369 - RNA, 62 nt, Human
ucuauguguucaauaugguuugggggaguguccucucugggaucguuuugggcucccauaga

SEQ ID NO: 4114370 - RNA, 73 nt, Human
ucuauuguucuuggaaacugggaguuaaauguagagauaugguuacauucaggcucaguuuuuuugacaaaga

SEQ ID NO: 4114371 - RNA, 81 nt, Human
uauuuuuuagagcugcauacuaaaguauuuagggaugaaaugucaugucuguaguuuacaguauuucagcauaaaaaaaua

SEQ ID NO: 4114372 - RNA, 69 nt, Human
uauuuuuucacuguuaggaguaugcuacauucucauuagaaguagcagcuccuaaacagugguguagug

SEQ ID NO: 4114373 - RNA, 70 nt, Human
uauuuuuuucuccuuuccuuuggcuuaucuuuccuugcacuggaaugcuaggaaaggaagaacuuugaua

SEQ ID NO: 4114374 - RNA, 77 nt, Human
ucaaaaacagaaagggagauggaauagauucugacuuucuucagggaagcagaucaccacuuuguuacuguauuuga

SEQ ID NO: 4114375 - RNA, 62 nt, Human
ucaaaaagcuggagaauaggaauuaguguagcuccccuauacuaauuaucauccaguuauga

SEQ ID NO: 4114376 - RNA, 111 nt, Human
ucaaaaauaugggggggaaauggucuacuuuagcaagauaacaguaauuuuguucauuguuuaucaagaaauuuguguuauuugugguguuccauaacugcuucauuuuga

SEQ ID NO: 4114377 - RNA, 62 nt, Human
ucaaaacuuacagaggccggaugucuuuuuucucauacaucuggcuuugcuggaaguuuuga

SEQ ID NO: 4114378 - RNA, 94 nt, Human
ucaaaauguaauuuuaucuggaaaaggcaggcaguggugcucuguuuaauuaugaauuacaagccuuccuuugcaggucaggucaacaugauga

SEQ ID NO: 4114379 - RNA, 63 nt, Human
ucaaaaugucuacgucuaaauuuggagguagaauugucucuagauuuagugguggaauuuugg

SEQ ID NO: 4114380 - RNA, 55 nt, Human
ucaaaauucuagggagaaugguuuccaacauaggauucaacucccagagucuuga

SEQ ID NO: 4114381 - RNA, 96 nt, Human
ucaaacaggauaacuaaagcuuauuaucuuaucaagcuuguucccuugcagacaagauugaucaauuaucauaggcuuucuggguguucuuucuga

SEQ ID NO: 4114382 - RNA, 99 nt, Human
ucaaacuaaacaaagauaauuuccugagguagugauuguagaagugacaaauuaucucaccacccaagcacuggucucaagauugucuuuuggggauga

SEQ ID NO: 4114383 - RNA, 59 nt, Human
ucaaacugaacuaagauccaacuguccaaugaacucaugagcuggguuuuaggguuugg

SEQ ID NO: 4114384 - RNA, 89 nt, Human
ucaaacuggaugauuucaacagaucugucuucagguuugcucauucuuucuucugccagcuugaaacuacuguugagacccucuaauga

SEQ ID NO: 4114385 - RNA, 77 nt, Human
ucaaacuuuugaggaguucaggaauagcuauuucuuuuagcaagcucuccaugaaacacuuagauauuaaaguuuga

SEQ ID NO: 4114386 - RNA, 97 nt, Human
ucaaagaaggugaaugaguaagaccauaauuuuuguaacauuaaacauaagaaguccuagaucuauuaugucuugcuuauguaucaauuaucuuuga

SEQ ID NO: 4114387 - RNA, 56 nt, Human
ucaaagaagugcaaaccucaucagaugccagauuggguuguucccacauucuuugg

SEQ ID NO: 4114388 - RNA, 120 nt, Human
ucaaagacauauucagaaaaaaauuccaugauguacauguuuaagugaaggauaacuguauguccuuacauagugcugaaauauguagaacauuauagagcucauggauauaaaauuuga

SEQ ID NO: 4114389 - RNA, 65 nt, Human
ucaaagagaaguuuuucuuauuacauguaauacauaguucaugacggacaaagacuucucuguga

SEQ ID NO: 4114390 - RNA, 84 nt, Human
ucaaagaggaaggauuuaguuugaggguaaauucuccugugccucauuacaguccucaccaaggcugcgauccuucccuguuga

SEQ ID NO: 4114391 - RNA, 65 nt, Human
ucaaagauugaaacuaaggagaaacaacaauuccacgcaacuugagauccugguuucaauccuga

SEQ ID NO: 4114392 - RNA, 55 nt, Human
ucaaagcaucagucaauuuaggaggguuguuuuaucuggacuugagcugcuuuga

SEQ ID NO: 4114393 - RNA, 55 nt, Human
ucaaaggauaacugagggcagucaaguaaggcuccauguaggugguauccuuuga

SEQ ID NO: 4114394 - RNA, 58 nt, Human
ucaaaggcgguccaggaauaaagggagcccuucccagggauucuaggauggccugugg

SEQ ID NO: 4114395 - RNA, 56 nt, Human
ucaaaggcugcuugucuucugggucacguuguuucuuugacaggccaugcuuuuga

SEQ ID NO: 4114396 - RNA, 68 nt, Human
ucaaagguccccuguaagaacuggcugauggggcagauaauuuacugguuacagugggaccuuccuga

SEQ ID NO: 4114397 - RNA, 61 nt, Human
ucaaaggugguuuuugagcaaugcagugaugugggcaaagcauuguuucaagauuaacugg

SEQ ID NO: 4114398 - RNA, 59 nt, Human
ucaaagguuuuuauuuauccuggagcccacugggcauccaagaucaauugaaccuuuga

SEQ ID NO: 4114399 - RNA, 76 nt, Human
ucaaagugaauucugcacuacugaagggggagggaggauuuccugugccuucaguuaguuuagaaucuaauuggga

SEQ ID NO: 4114400 - RNA, 55 nt, Human
ucaaagugaguuauaaacaucuucaacauuggaggauaaacuaaacucauuuugg

SEQ ID NO: 4114401 - RNA, 65 nt, Human
ucaaagugcucuagaaauugucagugguuuacaugaaguggccaugggugucuggagcacccuga

SEQ ID NO: 4114402 - RNA, 57 nt, Human
ucaaaguuggaaaagcuggcccuuuucuaggaaaucuucagauuuuucuaacuuuga

SEQ ID NO: 4114403 - RNA, 94 nt, Human
ucaaauaauuugugugcauauagucuuacaucugcauuaauuaauuaaaaaguugguggcagagacauaggacauaauauaacaaauaauuuga

SEQ ID NO: 4114404 - RNA, 95 nt, Human
ucaaauaucuuuccacugugcuuacuauggaggauguguccucccagcaggagagacauuuguuccucuaagugacauuuuaaaaaaguauuuga

SEQ ID NO: 4114405 - RNA, 82 nt, Human
ucaaaugugaauggcagagcugaauuugggugguggauauaagaguguucacuauaaaguuucaacuuuucuguauauuuga

SEQ ID NO: 4114406 - RNA, 76 nt, Human
ucaaauuaagaugaggucauccuggauuaggguagauccuaacccaauaauugguggccuuagaagagaaauuugg

SEQ ID NO: 4114407 - RNA, 69 nt, Human
ucaaauucauagucuaucuuuaguauaucaauuuaugaacaguaugagauuuggauucagugaauuuga

SEQ ID NO: 4114408 - RNA, 84 nt, Human
ucaacaacggauaguuuuuuucauguaagaauguuccaguauugcaugggaccaacgcaugcaaaaaauguauuuguuguuuga

SEQ ID NO: 4114409 - RNA, 60 nt, Human
ucaacaagaagggugauuaggggcagaggccugcaagaggcuucauggcccacccguuga

SEQ ID NO: 4114410 - RNA, 127 nt, Human
ucaacaggucccucggagagaaccuuccagagcucugccuguggauacaugcucugaucacacagcucaucaagcacuggggccacagacacggacugggagguggguccccauggcacuuguguga

SEQ ID NO: 4114411 - RNA, 65 nt, Human
ucaacaguggcaucuacuuaaucuggacucuuuugguuguaguggguaaguggagucauuuggga

SEQ ID NO: 4114412 - RNA, 61 nt, Human
ucaacaugaagguggguugcauguuagccacaggccuggcacaacuccaccucagcguugg

SEQ ID NO: 4114413 - RNA, 58 nt, Human
ucaacauugagucccugggucuccacaucugggaaaaucaggcaaaacucagucuuga

SEQ ID NO: 4114414 - RNA, 62 nt, Human
ucaacauuggaggcaacauucacugcaaugugugaaugccaguacuugcauccagaugcuga

SEQ ID NO: 4114415 - RNA, 58 nt, Human
ucaacauuuuggcuuuguuuggacagcuuuugugcaagugcaaacacagaguguauga

SEQ ID NO: 4114416 - RNA, 58 nt, Human
ucaaccucugaaggcaggauggaucuggagggauaaacauaaccugcccagaggauga

SEQ ID NO: 4114417 - RNA, 70 nt, Human
ucaaccugcagcuguauggccaauucuugccuggccagaaugggccuugguguuggcauauggugguuga

SEQ ID NO: 4114418 - RNA, 70 nt, Human
ucaacuaaggcacaaucucuaauucuguaucugcauugaugacucagugauuuuagagguugugaguuga

SEQ ID NO: 4114419 - RNA, 57 nt, Human
ucaacuacucagcaaguggacaucuuuuacaugaagauuucugcuccugagagaaga

SEQ ID NO: 4114420 - RNA, 96 nt, Human
ucaacucacagaguaagaacguuaugccuuacacucaauuucuaaaacauagaagcuugcagugguuggcaugaccaagaauuugucgauauuuga

SEQ ID NO: 4114421 - RNA, 74 nt, Human
ucaacucaguccauagcacaggggaagagaguuuaugcaagguuucuguagugugguauguaggcaagagauga

SEQ ID NO: 4114422 - RNA, 70 nt, Human
ucaacuccuacccuaguaauguguagucccaggccugggagccaggucauggauuaaauuauuaaguuga

SEQ ID NO: 4114423 - RNA, 57 nt, Human
ucaacugguggucaaccuucuguacaugcuguacaagguuuaaauagccaucaguga

SEQ ID NO: 4114424 - RNA, 56 nt, Human
ucaagacagugugauacuggccuaggauagacauagggucaauggcacugacuuga

SEQ ID NO: 4114425 - RNA, 80 nt, Human
ucaagaggugucugcuuuuuccccuucuggcgagcucuauaaaucagcaauucagugaaguggaaaagcauagccucuga

SEQ ID NO: 4114426 - RNA, 56 nt, Human
ucaagcagcagaucaagagcuagauaccagagccuggucuuggucugacagccugg

SEQ ID NO: 4114427 - RNA, 73 nt, Human
ucaagcagggaagucugucuuagaauaaggggugagggauaaccucaaaugagagaggggacugccugcuuga

SEQ ID NO: 4114428 - RNA, 65 nt, Human
ucaagcaggguuuaugcauggagcccucauacagagggcugaccuucagauacucugacacuuga

SEQ ID NO: 4114429 - RNA, 96 nt, Human
ucaagccaggcuucacccccggccccugccaccucacccuccgucaucagacacagaggacuguagcggggaguguuugggagguguccuggcuga

SEQ ID NO: 4114430 - RNA, 104 nt, Human
ucaaggaagagaaugagcacccuuuucugaaccacuuaaauaaaucugaaugcagacuguguuugaaaagagcugcuucaaggggcucaucugugauuccuuga

SEQ ID NO: 4114431 - RNA, 73 nt, Human
ucaaggaaguccucaaaggaauguaaauucaaaggaaaagugagugaugccaucccuugggaaacuuucuuga

SEQ ID NO: 4114432 - RNA, 58 nt, Human
ucaaggaagucuuauugcacaggaguauccuggaacccagugcaauugauuuuuuaga

SEQ ID NO: 4114433 - RNA, 79 nt, Human
ucuaucuauccuguuuaucuaucuagagaugucacaacaggguggcaucucaggacaggaaaaaagggacuagaauaga

SEQ ID NO: 4114434 - RNA, 77 nt, Human
ucuaucuuauuguuucugaauuuuccacagauuuggauguccauuucuacauucugggaaaucagaugguagguaga

SEQ ID NO: 4114435 - RNA, 77 nt, Human
ucuaugaauggggauuuguuucuucauuuagaagcuucuaacugaugcuuuuccaggagaaauauaugccauguaga

SEQ ID NO: 4114436 - RNA, 109 nt, Human
ucuaugacacauugaauuuggcugcacauuuaugaauguuauguaaagggaaagagugaccauuuccuugcaaauagcuuucugaguugccacaagaucaauaucgaga

SEQ ID NO: 4114437 - RNA, 73 nt, Human
ucuauggaggucagugguuccugugagcaucauaaugacuaauguucacaguaaugauucugagucucuagga

SEQ ID NO: 4114438 - RNA, 61 nt, Human
ucuauggcaucagcauccgagaccugagcuucuagggcacagaacguggcugagccauaga

SEQ ID NO: 4114439 - RNA, 62 nt, Human
ucuauguaaagccauauugauaaaguggguuuuuuuacauucaauauucuggcuuuaaugga

SEQ ID NO: 4114440 - RNA, 108 nt, Human
ucuauguacauguuguuuuuauuuccaguuugugguauuuuauuauaaggaauuauuuuaacuugaaaauagguacggauuagaauguaagaaucaauuugucauaga

SEQ ID NO: 4114441 - RNA, 89 nt, Human
ucuauuaaacuccagugaauacuagaauuucuuauauuaaaauuauuaggaucucauguguucuggugauuucuacuguguauaucaga

SEQ ID NO: 4114442 - RNA, 77 nt, Human
ucuauuauugucuuuaugauuaugauuuugucuugucuuauagaugaggggagaguuaaugugaaugugaugaugga

SEQ ID NO: 4114443 - RNA, 68 nt, Human
ucuauuccaaaccccuuccccucucugugucuccuuucucacuguugaaagaagggcuuugaaguaga

SEQ ID NO: 4114444 - RNA, 59 nt, Human
ucuauuccuugaggcuugcucaguggcaaaugcucaccauuggaggccucaggaaaaga

SEQ ID NO: 4114445 - RNA, 59 nt, Human
ucuauugcaugcaccuaacaaauuauuuuauuagaauaauuuguguguguauguuuaga

SEQ ID NO: 4114446 - RNA, 73 nt, Human
ucuauuguugaccuacuuucuuuuugucuuaagggauuuuuuugcagaaugggaagguaguuguaaauguaga

SEQ ID NO: 4114447 - RNA, 69 nt, Human
ucuauuucuguaguccacauucuuucuauuggaucacccuggagggaaaggaacucauggaaaccuagg

SEQ ID NO: 4114448 - RNA, 60 nt, Human
ucuauuuuaguaauguguaguucucucagacagacagaaauacaaaguacuaagauacga

SEQ ID NO: 4114449 - RNA, 101 nt, Human
ucucaaaaacuuguucacuaaacaccacaugcauagccagcauuguauguguuacacacguguguucugugugugugcagugugaacaggcucacaugaga

SEQ ID NO: 4114450 - RNA, 70 nt, Human
ucucaaacaggccuugguccugaccuaaccuauccuguucaguuaggucaggaccaaggccuauuugaga

SEQ ID NO: 4114451 - RNA, 87 nt, Human
ucucaaacaguaacacucuaaagggaugcacgaucuuuucuuuuauacaacagacagugcuuccaucuagagggucacugccugaga

SEQ ID NO: 4114452 - RNA, 62 nt, Human
ucucaaauguaaagcaugauuugaaagagaucaguaacaacaguuaugcauuacauuugagg

SEQ ID NO: 4114453 - RNA, 90 nt, Human
ucucaaauuagcuauuguuaacauguuuucuuugucuuucuuucuugggaaaauaaacaaugaagauaauguugcagugcccuuuagaga

SEQ ID NO: 4114454 - RNA, 103 nt, Human
ucucaagaaugacugccagggcuucaguucugaccaucuucauuccagagagcaggaaagaagcagaauagaggcccuucccagcucugucagcucuuuaaga

SEQ ID NO: 4114455 - RNA, 85 nt, Human
ucucaagcugugacugcaaagggaagcccuuucuguugucuaaaagaaaagaaagugcuucccuuuggugaauuacgguuugaga

SEQ ID NO: 4114456 - RNA, 85 nt, Human
ucucaagcugugacugcaaagggaagcccuuucuguugucugaaagaagagaaagcgcuucccuuugcuggauuacgguuugaga

SEQ ID NO: 4114457 - RNA, 87 nt, Human
ucucaagcugugagucuacaaagggaagcccuuucuguugucuaaaagaaaagaaagugcuucucuuugguggguuacgguuugaga

SEQ ID NO: 4114458 - RNA, 77 nt, Human
ucucaaucgugagcaccaggcaaaaccacaggagcaguaccauuguucuggagaguuuagucuggggccuacuggga

SEQ ID NO: 4114459 - RNA, 71 nt, Human
ucucaauucaguuuagcaaauuuguaucaaguauccccuaugugcaaaaugcuagacuagguacagugaga

SEQ ID NO: 4114460 - RNA, 104 nt, Human
ucacuuucucuuagguuuguagaggauuucuucauuuguggugaaugagauguguuuuuauugcauuacaugaugaaggagcaugaggacaugggaggcaguga

SEQ ID NO: 4114461 - RNA, 72 nt, Human
ucacuuuuccuucacguuguguucucuguuuccuuuuccuuguggaagucacaggguacacaaggauuguga

SEQ ID NO: 4114462 - RNA, 129 nt, Human
ucacuuuugguuccuugguuugcgauuauuuucccccuuuuugugcggacugugcccucgcugcucucacugcccucaccuugagggggaaaauaauccggaguuggguaaaaaagaaaaagaaagaga

SEQ ID NO: 4114463 - RNA, 94 nt, Human
ucagaaaaauuacuagagacuuucucuucacugugugccucacaagcucuuaauauugcuguagcacauuugaagagaagcacuuucuuucuga

SEQ ID NO: 4114464 - RNA, 71 nt, Human
ucagaaaaucuuuguauuuuaaaauuuucucaucucaaaagaggaaaugucauagaaauauaaggcucuga

SEQ ID NO: 4114465 - RNA, 64 nt, Human
ucagaaagguucuauguuuuacucaauacaguggguagauaucagaaauagaauuuagaucugg

SEQ ID NO: 4114466 - RNA, 81 nt, Human
ucagaaauucgcuucagcacugucuauuagugagaacuggaagugguuuucacuaaauaugcugauaacuaugcuuuuuga

SEQ ID NO: 4114467 - RNA, 89 nt, Human
ucagaacaucugcaccaguaacaugaagagacauggauuggugcggaaaaugugccucuaugucaauuccaugccuggcaguggacugg

SEQ ID NO: 4114468 - RNA, 59 nt, Human
ucagaagcugguguccuuugaaaaauaucaccuagaaacuucagaguucacugcuauga

SEQ ID NO: 4114469 - RNA, 130 nt, Human
ucagaagcuucauacucaggcugcuuaccaaaccccaccauguagaaacugagaaagcuuacuaauuuuuuuaaguuguguguguguguguguguguguguguguguguguguguguguuauuauucuga

SEQ ID NO: 4114470 - RNA, 79 nt, Human
ucagaagugugcaguaggacauuucauuuguuccuguuuugucucuuugugauugauaguguuuuacuuagacuucugg

SEQ ID NO: 4114471 - RNA, 67 nt, Human
ucagaauaccugggcagugcuggaguugaagaguuuccuuuuuaagaagcuguccaggugcagcuga

SEQ ID NO: 4114472 - RNA, 95 nt, Human
ucagaauauguuuagauauaaugucuuuguugaaaucugguaaaauguucagaugacuaacauaguauugcugucuucaaggaaauaauguuugg

SEQ ID NO: 4114473 - RNA, 75 nt, Human
ucagaaucacaguagacuucucaagagcaucaugagaugcuaaaugauguuagagucacaacuguaauacucuga

SEQ ID NO: 4114474 - RNA, 65 nt, Human
ucagaaugagagacuguguguugggaguugggggacugcuugugugaaacacuucucucuucugg

SEQ ID NO: 4114475 - RNA, 65 nt, Human
ucagaaugauauauuagcagauuuuagauacagcuuuacaaaugcugacugauuuaucagacuga

SEQ ID NO: 4114476 - RNA, 77 nt, Human
ucagaaugcucagccuugcuucuggacugguggucauucacugagccagggauaaaaggaguaauacugaguucugg

SEQ ID NO: 4114477 - RNA, 79 nt, Human
ucagaauucuugcuuucuuucucuuuuugcaaauguuuuuugcuuucaaagagcucggaaaguguugaagaaaagcuga

SEQ ID NO: 4114478 - RNA, 71 nt, Human
ucagaauuuagaaaugauuuugaugcuucauaggccauauggucucuguugcaucuagucaauucuuauga

SEQ ID NO: 4114479 - RNA, 101 nt, Human
ucagacagauacuagguuggugcaaagguaacugggguuuugccauugcuuucaguggcaaaaacugcagcugccuguguacaaaucuaaugcaugaguga

SEQ ID NO: 4114480 - RNA, 87 nt, Human
ucagacagugaugcaucugccugagucuagguuuucuuaacucuaagacagcacucccaucucagggaaguugugaagcugucauga

SEQ ID NO: 4114481 - RNA, 90 nt, Human
ucagacauccugcugcaaaauggcuguggucuggcaaggcugggaacagcuuuuguggguuugcagugauauuugaaguuugaugaauga

SEQ ID NO: 4114482 - RNA, 59 nt, Human
ucagacauggggagagagaccuggccuaggccuguagaguuuuuaagcuucaugacugg

SEQ ID NO: 4114483 - RNA, 75 nt, Human
ucagacauguguaagaugugauauauguagaauuacuuuuauggaaauaguauacagauacuuagacgugccugg

SEQ ID NO: 4114484 - RNA, 89 nt, Human
ucagaccucuaaaccaccagcaccagcucugugccuguuauauggcaggcuuucgaugaacgcuugcugaacuggaucuggggguuuga

SEQ ID NO: 4114485 - RNA, 55 nt, Human
ucagacuggauuuucacguuuucaaauuugaaacucauggaaaaugccagacuga

SEQ ID NO: 4114486 - RNA, 63 nt, Human
ucagacuguucucuuccacggcgcucggagguuuucauccuuugggacaagagauagcucuga

SEQ ID NO: 4114487 - RNA, 88 nt, Human
ucagacuucagagcaccaggcgcuggaugcugacaguggccagaucccacuguccaagcaugccuggcuuucuuuggaaaaugucuga

SEQ ID NO: 4114488 - RNA, 58 nt, Human
ucagagaaguaggcuaaugguggggaagcauuucccugcugauguucgugcuuccugg

SEQ ID NO: 4114489 - RNA, 87 nt, Human
ucagagacaccucucauuucuccucaaugccacugcacugaugucaacugacuuagggcaggcaugagagaacugagguuuacaugg

SEQ ID NO: 4114490 - RNA, 85 nt, Human
ucagagagagcaagccaguccucuacugggcaccagaagacaaugcaacugggaguccaaggagaggaugaggggcucgauuuga

SEQ ID NO: 4114491 - RNA, 63 nt, Human
ucagagcacuggugcuaccuugugacugacggugaugagcauuucuguagcgcguguuauuga

SEQ ID NO: 4114492 - RNA, 74 nt, Human
ucagagcaucguguccaggagccccugggaaaaggcaacuucuuccugaggaggaccaggaccacagauccuga

SEQ ID NO: 4114493 - RNA, 59 nt, Human
ucagagcaugugggcugcaguuccccucgaccaccaaagcuagccuggccuugcucugg

SEQ ID NO: 4114494 - RNA, 66 nt, Human
ucagagccagaaauggaaguucugguuuaauaaguuugaguuagaaguuccguuucuuuucuuugg

SEQ ID NO: 4114495 - RNA, 79 nt, Human
ucagagcccaggaugaugaggccaugaggcaggggacgccaguacuuugccucacaauucauccauaacagggcuuugg

SEQ ID NO: 4114496 - RNA, 78 nt, Human
ucagagcuaaaggauuuuaauuuuauagaggaugggaauacucgcauauuguaaaagguugaaucccuagcagcauga

SEQ ID NO: 4114497 - RNA, 63 nt, Human
ucagaggagaugguuaccagggccccuucuaacacaccauucuggaugugccuuccuuccuga

SEQ ID NO: 4114498 - RNA, 64 nt, Human
ucagaggauuggacuuuuauguuuaaaaauaaauuuaauguaagaugaaauuccuguuuucuga

SEQ ID NO: 4114499 - RNA, 87 nt, Human
ucagaggggacauacccagcugucacagagaguucuagguugcucuaaucucacauuucauugacagcuggggcauuuuaccucuga

SEQ ID NO: 4114500 - RNA, 62 nt, Human
ucagaggguagaagacaggguugcucgucuuaaccgggcagugucuacauuuauuacuuuga

SEQ ID NO: 4114501 - RNA, 129 nt, Human
ucagagguggaugcauguugcuuucucuggagucaucucagcugagaggcagcuucuccauccuugccuggucuaguuuuagguggcuuauucuagagacaggcauucauguugucaugauccacuaga

SEQ ID NO: 4114502 - RNA, 60 nt, Human
ucagaguaucccagggccagcaagauggggcugucaggaggcccacccuggcuagucuga

SEQ ID NO: 4114503 - RNA, 84 nt, Human
ucagaguggggcccugcaggccaggcaagggcuucaaaguuugugcugagagagcccaggagcaggggcaggguuuugugcugg

SEQ ID NO: 4114504 - RNA, 55 nt, Human
ucagaguuacccaaaacauucucuguuuaacccaagucuguuaggaugacucuga

SEQ ID NO: 4114505 - RNA, 59 nt, Human
ucugccuagguuuccaaugugcuuauuaauuaaugaucacauuucuguacuuagguaga

SEQ ID NO: 4114506 - RNA, 89 nt, Human
ucugccucucaccugugugcugguccucuccagcaggcauucucuuugagaaugcuugaaugggauuagagacaaccgagaagagcaga

SEQ ID NO: 4114507 - RNA, 57 nt, Human
ucugccugagcagagggaggccagucaaguccagccucuccugcuccuguaggcaga

SEQ ID NO: 4114508 - RNA, 106 nt, Human
ucugccuuaauuuccuuccaggccaggguaagaggagagcgaguguaugauguuaugguuaucuguuuucccuugccucugucccugguuccaaguguacugcaga

SEQ ID NO: 4114509 - RNA, 80 nt, Human
ucugccuucacaguuugcugggacaggaaaucugaauagggggcagagcaaaguccaguccuagaaacuggagagaaaga

SEQ ID NO: 4114510 - RNA, 129 nt, Human
ucugccuucccacaccugauccauggacugugucuuuccaggccagaccuuucaaucuuucucucugggaagaugggcucuaugucuaggagaugccaauggagccgugugagcgagugugaauggagg

SEQ ID NO: 4114511 - RNA, 76 nt, Human
ucugccuugggaggaaggugagcagggcacuggugucccagaaaaugccccuggcuggccagcuccuccucguaga

SEQ ID NO: 4114512 - RNA, 66 nt, Human
ucugccuuuguugaagaauccacagguggcaggaaucaccugacaaagaggaacagcaggggcaga

SEQ ID NO: 4114513 - RNA, 78 nt, Human
ucugcgggauacagugggaagggcagaggcuuuggugucagacagacguuaguucugaucuucccacuaaugcguaga

SEQ ID NO: 4114514 - RNA, 83 nt, Human
ucugcuauucucugggcugugggaauucaacagugagcaagaugcgaacuguacccuuuagaagcucauaguccaaugggagg

SEQ ID NO: 4114515 - RNA, 56 nt, Human
ucugcuauugcccaagucuuggaaagugcaggcuccaggaaaaggguggugguaga

SEQ ID NO: 4114516 - RNA, 63 nt, Human
ucugcucaguccuccugcagugccacagggguguggcaugggugguguggaggugcugagaga

SEQ ID NO: 4114517 - RNA, 78 nt, Human
ucucaauucugccucuaaauauuucuggagaagaauggaggaaaaggaauccagagauauuuaugaguagaauugaga

SEQ ID NO: 4114518 - RNA, 92 nt, Human
ucucacagaaacauccagcucucuuucuuguugcuguugugaccagagaaacaucauggcuccaagauggagagccagcuguuucugggaga

SEQ ID NO: 4114519 - RNA, 129 nt, Human
ucucacauaugcaguaaggguuaggggagaaggucccagcuccucuugucucuagcagaguguaaacuggcucugcugaggagguggcugugcuuuuauuccuucuccugagaacuguuuauauauuaa

SEQ ID NO: 4114520 - RNA, 72 nt, Human
ucucaccguugacagcauccaagagggagggagcuucgggacuccagucugcaggguugucgagaugggaga

SEQ ID NO: 4114521 - RNA, 60 nt, Human
ucucaccucccaguuccaauccagaaugaauuuguccugagugagagcugggaggugagg

SEQ ID NO: 4114522 - RNA, 78 nt, Human
ucucaccuuccuagaaugcuauuuccuuguguuuugcuuuuuagcagaagagaugaaauaguauuaaagacuguaaga

SEQ ID NO: 4114523 - RNA, 69 nt, Human
ucucacuccaaaccccaggcuuguacaaacagaucaucaucauauaaguucucaggguuuggagucaga

SEQ ID NO: 4114524 - RNA, 73 nt, Human
ucucacuccugcaaaauaucuuguccagggcaguuuagaaguaaagcacugcuaggauagcaugcaagugaga

SEQ ID NO: 4114525 - RNA, 63 nt, Human
ucucacugauuugagaccaagguuaagcaagccugacaaagugguucaucaaaucagagaaga

SEQ ID NO: 4114526 - RNA, 71 nt, Human
ucucacugggucacagcagaggaucccccagccccaggcccaaggagugucugugugaccacacagugagg

SEQ ID NO: 4114527 - RNA, 65 nt, Human
ucucacuguccugggucccugcuagaaggcggucugcuuuccagcacacgcuccggauagagagg

SEQ ID NO: 4114528 - RNA, 65 nt, Human
ucucagaacagagccaggacucaagcuaggucugagcaacagaccugggucccuggccuguggga

SEQ ID NO: 4114529 - RNA, 64 nt, Human
ucucagaagaacccagggucccauggcuggccugucagguuguagagccuuuguucuucugagg

SEQ ID NO: 4114530 - RNA, 91 nt, Human
ucucagaaggaauuuuauucuaauguucuuucaaauaauaaaaccuuuuguuugaaaggaauuaggaugacaaaaaccuaagauuaugaga

SEQ ID NO: 4114531 - RNA, 65 nt, Human
ucucagaaucaggaccuacuucacgaugcagagugguuuagcagggagagaggccuuggaugaga

SEQ ID NO: 4114532 - RNA, 91 nt, Human
ucucagacuccuuuggaauugaaagagaauguagcucuuuagggacagcugaagauaaacucuugauuucugauuuccagagcaguuugga

SEQ ID NO: 4114533 - RNA, 81 nt, Human
ucucagagacaucauguugagugaaagaagccagauucaacagaacuguacucugucauuucauucauaugaaguuugaga

SEQ ID NO: 4114534 - RNA, 83 nt, Human
ucucagauaaucauguaacuggaaucacauggcauauaagcuuuugugucuggcuuucuucaguuagcaugauguuuuugaga

SEQ ID NO: 4114535 - RNA, 88 nt, Human
ucucagauacugccccagaccuacugaaugggaaucugcauuuucacaagauuccccaggagauuugggagcacacugaaguuuggga

SEQ ID NO: 4114536 - RNA, 55 nt, Human
ucucagauggcaucagcuagagucaguuuugcucgcuguaguugaugguuuguga

SEQ ID NO: 4114537 - RNA, 78 nt, Human
ucucagauggccagagaggccagccugguaaaguaauugagugaagcaugccaaguuggagcuauggccagcuugaga

SEQ ID NO: 4114538 - RNA, 84 nt, Human
ucucagcaccucacucugugcucauucagucauucaacaaacauugaguauccuugcuggauggguccuagaccagugcugaga

SEQ ID NO: 4114539 - RNA, 66 nt, Human
ucucagcacuucaaugagcauuucaccuguggcaacaaugacagugcacacuuggggagcuaaaga

SEQ ID NO: 4114540 - RNA, 68 nt, Human
ucucagcagaaguccgacuccagucauugugauuuacucacaggcaggggauggggguuuuggugaga

SEQ ID NO: 4114541 - RNA, 72 nt, Human
ucucagccauccuugaaguuuuuugcauggucuuagugagucugugugagcaucacuucagauguggugaga

SEQ ID NO: 4114542 - RNA, 56 nt, Human
ucucagcucuuugggaggccaaggcgagcagauugcuugagcccaggaguucgaga

SEQ ID NO: 4114543 - RNA, 63 nt, Human
ucucagcugacagcaaaggccaguggcucaucagugagaacaucauaccucugucagagggga

SEQ ID NO: 4114544 - RNA, 64 nt, Human
ucucaggacuccucuggccauaggcuccaggaaagcugguggaaaccuuggggcucacugaaga

SEQ ID NO: 4114545 - RNA, 129 nt, Human
ucucaggcugcucaagccagcacacugggcuuuccgcacugggcagcagcucgagccgccguacgggggguguggacggcugugccaguggaagcggugacggcaccuguguggcaucgagugccuggg

SEQ ID NO: 4114546 - RNA, 87 nt, Human
ucucaggcugugucccucuacagggaagcgcuuucuguugucugaaagaaaggaaagugcauccuuuuagaguguuacuguuugaga

SEQ ID NO: 4114547 - RNA, 60 nt, Human
ucucagggaguugaggcugccugaaaacgccuugcagguggccucagccaacccaugggg

SEQ ID NO: 4114548 - RNA, 58 nt, Human
ucucagggcagcaaggaagcauaguccaaggagagaccuguuccuugcugcucuugga

SEQ ID NO: 4114549 - RNA, 58 nt, Human
ucucagguaagcuucuuugauguagagacaauaauauuucacaacugcuuauuugaga

SEQ ID NO: 4114550 - RNA, 59 nt, Human
ucucaggugcagcauuuguaagcagcucccuggcugguucugauuuugcugcauugaga

SEQ ID NO: 4114551 - RNA, 58 nt, Human
ucucagugacugcuggguccccacccuguucaggacuggauuucagcagacacagaga

SEQ ID NO: 4114552 - RNA, 60 nt, Human
ucucagugcaaccaaagugaucuguaaaaaauacagaucagaucuccuuuugcauuagga

SEQ ID NO: 4114553 - RNA, 68 nt, Human
ucucaguuccacaaaauguacccaguuccuacuauguuggacucugagcacuguguuggacucugaga

SEQ ID NO: 4114554 - RNA, 113 nt, Human
ucucauaaaaaugauacugggcacuucugauaccagcuuuucaaaccucuaauugguucacagacaaagcuuugaaagcaggugugggagggucacgaucagagacagugaga

SEQ ID NO: 4114555 - RNA, 72 nt, Human
ucucauaacuuauuguggcuuggccaguuuuaccuuuuaauucuauugaucucugcuuuguaaguugugagg

SEQ ID NO: 4114556 - RNA, 81 nt, Human
ucucauaaucaaacugccaaugguuuuuauaacugguuguuucuagucuauauaaaagauauugagcaguguuucuggaga

SEQ ID NO: 4114557 - RNA, 69 nt, Human
ucucauagggcuguugugaggauugagcacagugguaugcuggucaguguuuaacaaccagcucugagg

SEQ ID NO: 4114558 - RNA, 67 nt, Human
ucucauauuuaguaggugagagacuuuaggaaaguuauuaaaucgguuucuuaucuguaaaguggga

SEQ ID NO: 4114559 - RNA, 122 nt, Human
ucucauccauggaucuuagccucuuuugguggcagaaugucuccugaaacuuaaguauuuccuugaacuucaguguuagacaaguuuggaagaccacgagucuaaauuuauggaaacugggg

SEQ ID NO: 4114560 - RNA, 125 nt, Human
ucucaucugcaggugguuuaagugugaagguuuacugaagauuuaaagaguguuaucacaguugggaugauuuaaacuaacaguacacguugcauuuuaagaaaauaauuaauccucagaggaga

SEQ ID NO: 4114561 - RNA, 56 nt, Human
ucucaucugcgagcucugccaguguauccagcgcucagaggauauggagaaugaga

SEQ ID NO: 4114562 - RNA, 56 nt, Human
ucucaugaaaggucucuccugggagguaacauuugggaugagacccaugcaugaga

SEQ ID NO: 4114563 - RNA, 71 nt, Human
ucucauguaguuuacagaagaggagcaacaauuacuggcauguuguuacuugcauguagacuaacugugga

SEQ ID NO: 4114564 - RNA, 78 nt, Human
ucucauucagcagcacgggcuguuuccaugcaaaaggggcuccuuagcugggucaggggccugggccugcuggauaga

SEQ ID NO: 4114565 - RNA, 106 nt, Human
ucucauucuguaauacuuuuugauaagccaaaggcauuaccuaaguuugggacauuuugugcuguccuguaauuguaaaugguuacuaggaauuauuagaaugaga

SEQ ID NO: 4114566 - RNA, 65 nt, Human
ucucauugagagaaucacauagaagugaccaagucaccuguuuaucauuuuccucaaacaugaga

SEQ ID NO: 4114567 - RNA, 66 nt, Human
ucucauuuacacuucacaaauggaagucaaaaaauaccaccucuauuauggagaugugaaaagaga

SEQ ID NO: 4114568 - RNA, 61 nt, Human
ucucauuuauuaacugagacuugccuggagaaggaggcaagucagagccaagucaaugaga

SEQ ID NO: 4114569 - RNA, 67 nt, Human
ucucauuuuaggucuccuuaggguuuguuucuucuaagaauuuacucugaaauagaggcugguggga

SEQ ID NO: 4114570 - RNA, 55 nt, Human
ucuccaaagcuggacugauguggggaaaacaccuuucccuucugguuuugagaga

SEQ ID NO: 4114571 - RNA, 61 nt, Human
ucuccaaauaguuauauuuagagccccugaaggcugggacuucaacaugugaauuuggggg

SEQ ID NO: 4114572 - RNA, 79 nt, Human
ucuccaagcccuggaacuuuccuagccacccacagccacucuggaacgguucagggcucagagcuuccggguaugggga

SEQ ID NO: 4114573 - RNA, 61 nt, Human
ucuccaauaaccacaaucagauagacaaccugcuucuguuugaaacuuuugguuauuggga

SEQ ID NO: 4114574 - RNA, 77 nt, Human
ucuccaaucuaucuggccacugcugaucaguaagaaacucccuuaucugagaaagaagcaccagagaaguugguagg

SEQ ID NO: 4114575 - RNA, 76 nt, Human
ucuccaauuauacucuuacugcagggccuauaaauguuagauacaggccuggaaaggaaggaguggaaugaggagg

SEQ ID NO: 4114576 - RNA, 79 nt, Human
ucuccacaacacccuguguggccgccacuuggggcaggcccugugggccccacccagccuggcugaggggcgguggaga

SEQ ID NO: 4114577 - RNA, 64 nt, Human
ucuccacugcucagcauauccaaaaaccuaccuaauugucauggucagugccuugcauguggga

SEQ ID NO: 4114578 - RNA, 122 nt, Human
ucuccacugucacacgggcccacgggaggacaacugagccccugcacuugugagaacacuucaggcucacuggggucgccugcagugguuuagggaccugcuucccacuguacagauggaga

SEQ ID NO: 4114579 - RNA, 73 nt, Human
ucuuaucagguaugugagcuugggcaggagauuuguugcuaagagccucaguuuauacaccuguaaaauagga

SEQ ID NO: 4114580 - RNA, 70 nt, Human
ucuuaucuugguggcgcuagugaguaauucaauuggcauccagucuccacaguuuugccacuagcugaga

SEQ ID NO: 4114581 - RNA, 79 nt, Human
ucuuaugaaaauacugaacauguuugcagucaauuccaugacuccuuggugauuuagauauuuuaguuaaagcagaaga

SEQ ID NO: 4114582 - RNA, 94 nt, Human
ucuuaugaagcaggugcagaaguaacaauuaaagaagcuaugauuuauguuaccuaauuauuuuuuacuuuugcuucuuaccucuauauggaga

SEQ ID NO: 4114583 - RNA, 58 nt, Human
ucuuaugacaagguggaguaugaguggaagcauuuaaauacccuugacugucauugga

SEQ ID NO: 4114584 - RNA, 80 nt, Human
ucuuaugaucuugaaaugacaaagguuuuucuuagcaugucacaaaugcaggagaccaaguaugucacaaauccaggaga

SEQ ID NO: 4114585 - RNA, 68 nt, Human
ucuuaugggaugugacagaggcaucucggaauuuuaucugaaggaaaucuuuguaacaucuuuucaga

SEQ ID NO: 4114586 - RNA, 93 nt, Human
ucuuauguguggacauucaggaaaaaugccaggagucagcuacuuugacagcagcaugacccauuuuucuugcugugucuaccaaaccuaaga

SEQ ID NO: 4114587 - RNA, 76 nt, Human
ucuuauucaauuuguauacaauaugauucugucacauagauaccuucauuuauauuguguaauaagugaaguggga

SEQ ID NO: 4114588 - RNA, 75 nt, Human
ucuuauuuccccaaaggcggaacugagucucuagggagacacccagaagagaucacaccugcccugggcauaaga

SEQ ID NO: 4114589 - RNA, 86 nt, Human
ucuuauuuggcagcuuuaccuuuaggaguaaccuugacaauugcaagccgugacuaccaauggagguaacagaaaagcuagaaaga

SEQ ID NO: 4114590 - RNA, 60 nt, Human
ucuuauuuggugagcuuuaaugaaacacuugcacuggaauucagaguacaccagauagga

SEQ ID NO: 4114591 - RNA, 73 nt, Human
ucuuauuuguuugguuaaaaucaaauuaaucagggcaaguucccugaaagaugacuuugaaagagaaaugagg

SEQ ID NO: 4114592 - RNA, 60 nt, Human
ucuucaaaauugauuggagaagaaaauugccuuuucucuccugccuuuucauuuugagga

SEQ ID NO: 4114593 - RNA, 55 nt, Human
ucuucaaagcauaugcaggcauuuaauuauaugaugguauacggugcuuuggggg

SEQ ID NO: 4114594 - RNA, 72 nt, Human
ucuucaaaucgucagcuccuugagggugggguguguaucuccacccagaccagggaucuggggauuccuaga

SEQ ID NO: 4114595 - RNA, 56 nt, Human
ucuucacaggagccugccugccuuugguggguacugagucaguguucuuuugaaga

SEQ ID NO: 4114596 - RNA, 58 nt, Human
ucuucacauggaacaugaagcuaaugaccucugcuucuauuucuuagggaugugaaga

SEQ ID NO: 4114597 - RNA, 59 nt, Human
ucuucaccuguacgcuggagcuaauaaugacgguggcugccugaucgagcaggugauga

SEQ ID NO: 4114598 - RNA, 69 nt, Human
ucuucagaggcugccagccaugugcaaccagagaugauguauuccacuguguagcuggagcucugacga

SEQ ID NO: 4114599 - RNA, 58 nt, Human
ucuucagaguaggauacuagcuuaguuaagauuguugggugcuaaucugcucugugga

SEQ ID NO: 4114600 - RNA, 64 nt, Human
ucuucaggugcgagagaggcuggggucagcgaccuggggcuuucuuuguaucauuuuaugaaga

SEQ ID NO: 4114601 - RNA, 86 nt, Human
ucuucaguagagcuaaggcuccuuuguaguucuuuugggaauccucaaaccaccaugugaagaagcuugggcuagccuguuggaga

SEQ ID NO: 4114602 - RNA, 62 nt, Human
ucuucagucaauccagauguuuggcaucuuguagacaaaacauccagaugauuaacugaaga

SEQ ID NO: 4114603 - RNA, 112 nt, Human
ucauucagcuccucucugucaaugucucuuauagacacucuucuauauagaaccaggagcacaaugguuauagacugucuguaagaaacauugacagagaggagcugaauga

SEQ ID NO: 4114604 - RNA, 114 nt, Human
ucauucagguguucaucaucaucgacaaaggaugauuguuggcucucuugaugaaagauagaaacaucugggauaguaaucaucguuagugauaucaggaauuauuuagaauga

SEQ ID NO: 4114605 - RNA, 114 nt, Human
ucauuccaacaaugacauuacuuaugcagaaagcggcaaacaggugacauugagaucgaaggcuuuccaucugcaggugcugcuacuguguugugggcuuguccuugggaauga

SEQ ID NO: 4114606 - RNA, 129 nt, Human
ucauucccaagaguugguagucaugggguugucucccaugaaaccuauuaagaaacuuaagaaaccuaugcaagauacauaauagguuucaugggagacaacucaaugacuaccaacucuugggaauga

SEQ ID NO: 4114607 - RNA, 59 nt, Human
ucauucccucaugcacucaaugcuuacuuauugagcaccugcuaugugucagggaucga

SEQ ID NO: 4114608 - RNA, 62 nt, Human
ucauucggcaauaguguguuagauagugaaauaccauggaaagacacugcaauugccaauga

SEQ ID NO: 4114609 - RNA, 70 nt, Human
ucauucuccaucuguguuccagcacccugcucugcacagaggaggggcucaagcaguguggucugaauga

SEQ ID NO: 4114610 - RNA, 55 nt, Human
ucauucucuacccacucagaagaguugcucuaauagccucugugggagucaguga

SEQ ID NO: 4114611 - RNA, 57 nt, Human
ucauucucugggaugcaguuuguccaugugugaacugaagucguuccagaguaguga

SEQ ID NO: 4114612 - RNA, 76 nt, Human
ucauucuugcagaugacaauggcuuaaugauaccuuaucaaaaugguaauguguucauuagucauucucaagaaga

SEQ ID NO: 4114613 - RNA, 72 nt, Human
ucauugaaauguuuccuuuuguaugcuguauuauuaauaauugcaaauaccuaaaugggaacauuuaaauga

SEQ ID NO: 4114614 - RNA, 83 nt, Human
ucauugacacucuacuuggggaguuuucuuuauugcuuuauuuuggugaguacagaaaguacccauagaagagaaauuaaugg

SEQ ID NO: 4114615 - RNA, 78 nt, Human
ucauugagguccuguuauccucagcucaccucuagaugcgaaacuagaggccgaaugcugagcugggagggccugugg

SEQ ID NO: 4114616 - RNA, 66 nt, Human
ucauugauggugaagggcagaaugcccagacacaguugcugguauuuaagacuucacuccuaguga

SEQ ID NO: 4114617 - RNA, 62 nt, Human
ucauugauuuggaugauauuucaucucugaaggaguugacuggguuauucagacgcauauga

SEQ ID NO: 4114618 - RNA, 95 nt, Human
ucauugccccugcugacagccagucaacccguaaaaguagagcugccuagcugacuauuucacagcgugguugacugcaaacacagaagcaaaga

SEQ ID NO: 4114619 - RNA, 60 nt, Human
ucauugcuacucuugcucacaaacugcuaugcacacaggacugggcagguucaguaaugg

SEQ ID NO: 4114620 - RNA, 65 nt, Human
ucauugcugccacuggauauuucauuccuuggauaaucucauuuugaaacauuggcagcaacuga

SEQ ID NO: 4114621 - RNA, 58 nt, Human
ucauuguauucagaacugaagagaccucauccaagagguggcuguucaauacaauaga

SEQ ID NO: 4114622 - RNA, 66 nt, Human
ucauugucugagccccuagaacugagcgugggcagcccugcuacagagcgggggcucaguagauga

SEQ ID NO: 4114623 - RNA, 79 nt, Human
ucauugugaacaugcuuugauaaauaaaagaccuauagaaaagaguuuuguauuauugucaaagaugggaccagaauga

SEQ ID NO: 4114624 - RNA, 71 nt, Human
ucauugugcagcugccgaucagauagggucaguaggucucuagucuauaauuggcacucguaaauuaguga

SEQ ID NO: 4114625 - RNA, 63 nt, Human
ucauuuaaaauguaccaggauuaaaggucauuuaaaugacucaucucuggaaacauaaaguga

SEQ ID NO: 4114626 - RNA, 65 nt, Human
ucauuuacacaguuccauuuaagccaguuucauugaucaagaagccaggggaacugaugaaguga

SEQ ID NO: 4114627 - RNA, 114 nt, Human
ucauuuaccuucugaagucuuuaaugaaagcucugucaucauuccuguuuuauugaugaggaaacuaugcugucagaguugaguauuuauaaguagagcugcugaaaauuguga

SEQ ID NO: 4114628 - RNA, 69 nt, Human
ucauuucaaaagaauugccagaauugaaaaccuaacaaucgggugcauuucugggaaugcuuaaaauga

SEQ ID NO: 4114629 - RNA, 81 nt, Human
ucauuucaauguaguuuccuccuauaguuaaaucaccauuucaaaauuuaacauugaguuagggagcguauagauaaauga

SEQ ID NO: 4114630 - RNA, 62 nt, Human
ucauuucagaauguccuaauuuagccugauguaaacguccugagguaaaauauucugaagga

SEQ ID NO: 4114631 - RNA, 69 nt, Human
ucauuucccugguuccaagaaucuugauaggaaaacaacgcuccuuuuauuuggauuuuaguggaaaga

SEQ ID NO: 4114632 - RNA, 82 nt, Human
ucauuucuuccugugcuuucaggccgcuguguauuugcagagccugcaccagcagccuagagcguucuuaggaacuugguga

SEQ ID NO: 4114633 - RNA, 62 nt, Human
ucauuucuucuaggacuaauaagagagcuucauugcugauaccucuggucucagaaggauga

SEQ ID NO: 4114634 - RNA, 98 nt, Human
ucauuugauuuagaaaauuuaguaacccugugaguagcuguuauuauccucaauacacagaugagggcacagaggauuccagagcuagagucaagugg

SEQ ID NO: 4114635 - RNA, 64 nt, Human
ucauuugcuggaaccagacccacuuaacauuuuaauaagugcuugucagugucuucaguaguga

SEQ ID NO: 4114636 - RNA, 69 nt, Human
ucauuugcuuuuagacccacauuuugaaucagacaauauuagauacaaugguggugucagaagagaugg

SEQ ID NO: 4114637 - RNA, 63 nt, Human
ucauuuggaggggaacuaaucccgugacuucuagguuaucucuuaguuucuucucuggaauga

SEQ ID NO: 4114638 - RNA, 71 nt, Human
ucauuugguauuaauuuucagaaccuguuguucuaaaaccuuaauacaguuugaagauuaugccagaguga

SEQ ID NO: 4114639 - RNA, 77 nt, Human
ucauuuguuuacauacucucugugacugcuuuccacacugcucuaggcaaguugaaacagaguaguugaaacagaga

SEQ ID NO: 4114640 - RNA, 58 nt, Human
ucauuuuuaaccagcuagggacccaauauguguugaguucuauuaugguuagaagugg

SEQ ID NO: 4114641 - RNA, 65 nt, Human
ucauuuuuauacauuccugcacugcugaugaagcuugaacggcugcagggaauguauggauuuga

SEQ ID NO: 4114642 - RNA, 74 nt, Human
ucauuuuucauugaagacuuacuggcuucaguucucaagucagagugugcaauguaugucucaaugauuauuga

SEQ ID NO: 4114643 - RNA, 63 nt, Human
ucauuuuuuauguggggaacaacaggcuuugugacaagucaaauguuccaagcuaaugaauga

SEQ ID NO: 4114644 - RNA, 55 nt, Human
uccaaaaagaaaugcugguuuagcggggagugaagacaaugcagucuuuuuugga

SEQ ID NO: 4114645 - RNA, 74 nt, Human
uccaaaacuaaggaugcauauguuuuguuuguaagcuauuuucaacaagauagauaucacuuaggucacuuggg

SEQ ID NO: 4114646 - RNA, 77 nt, Human
uccaaaauugagaaaaguacacagcccaaacauccguggcagcagaaguuuuaagaguguuuuuauucaauugggga

SEQ ID NO: 4114647 - RNA, 106 nt, Human
uccaaaauuguaaaaauaugaaaggagauagucaagagacuuaaaauauuucagcugcugaaaugauuaugaucuugaguaagcaucucuuauuaacaauuuagga

SEQ ID NO: 4114648 - RNA, 73 nt, Human
uccaaacagcuuguaagguguaauuaggauuuacuucaauuuaacaaaugacaccuugccaaguacuaaggga

SEQ ID NO: 4114649 - RNA, 68 nt, Human
uccaaacuaguaucuuccgugccaugcaauaagagcuacauugcaaggcugcagagggugcuacugga

SEQ ID NO: 4114650 - RNA, 58 nt, Human
uccaaagaagucacaaacgaagcacuuaguaaauguuaguuguuuguucugcuuugga

SEQ ID NO: 4114651 - RNA, 69 nt, Human
uccaaagagcaagaguguuggacuuugaauaaucugaguucaaaucuuugaccacuuaugugacuugga

SEQ ID NO: 4114652 - RNA, 84 nt, Human
uccaaagaggagccuuugaagcccucagagaucuucagagcaaagugcugggugaggucagggcauucaagaggccuggaugga

SEQ ID NO: 4114653 - RNA, 57 nt, Human
uccaaaggcaauguucuugucaucauacuuugaugcacaaagucagcauccucuggg

SEQ ID NO: 4114654 - RNA, 94 nt, Human
uccaaauagaagcaguuuggcuuaacuuacaugauauucauucacaucaaggagaaaugcaugagaauuguagcuaaucugaauucccuuugga

SEQ ID NO: 4114655 - RNA, 56 nt, Human
ucuugggaaagugucuuaacuuuggaagcaguaaagguugaacacuuucuucaagg

SEQ ID NO: 4114656 - RNA, 60 nt, Human
ucuugggagcuggaggugacaacugucugaguugacagcaucuccuggcagcuguuagga

SEQ ID NO: 4114657 - RNA, 81 nt, Human
ucuugggcucagccucauuuucugcucuguccugcacuagaagauucacuuagcaaaugagggcugaucaagagcccagga

SEQ ID NO: 4114658 - RNA, 130 nt, Human
ucuuggguaccaggaaagcccaugucugaagugcuggcaggaauaugagcugcugcaguguuuuucucucuauugaugccucagaguugcuauucucagcauuugggaucugcuuuucggaauacucagg

SEQ ID NO: 4114659 - RNA, 72 nt, Human
ucuugguauacgcauggcauugguuccaggaucguccauauaugcucaaauccaauccaugcauacucaaga

SEQ ID NO: 4114660 - RNA, 75 nt, Human
ucuugguuaucucuuuucauguguaaaugagguucuagguugaacaguauugguaucugagacagaguuucaaga

SEQ ID NO: 4114661 - RNA, 70 nt, Human
ucuuguaguugcagaauauucuggugacaaugccauuuacagggcaguuauuaagaaaauuuugccagga

SEQ ID NO: 4114662 - RNA, 55 nt, Human
ucuuguccugcugagcgguucuuucuguagagcauccaucggccaggacccagga

SEQ ID NO: 4114663 - RNA, 63 nt, Human
ucugucauuuguaccuaaaagaguucugaugaaaacaagaucucauggccagcaaguggcaga

SEQ ID NO: 4114664 - RNA, 87 nt, Human
ucuguccaugcuauaaaucaggguggggaaccucuggcccacagcccagaucuggcccucagcuugauucaucuggcauguggggga

SEQ ID NO: 4114665 - RNA, 67 nt, Human
ucuguccauucagccauccaucugaauauauuaagaguuuuacagaauguaggcugaccuggacaga

SEQ ID NO: 4114666 - RNA, 60 nt, Human
ucuguccuguuggggccacuguaacaaaauaccauaaagcagugguuuauaaacaacaga

SEQ ID NO: 4114667 - RNA, 95 nt, Human
ucugucucagcucaaaauugcuccuguuuucuuccagaaaugccauucauccagaaugccauucugugagagaagaagggagagugaggggcaga

SEQ ID NO: 4114668 - RNA, 86 nt, Human
ucugucucauguuucuagaauaagagcuccgugaagaaagagacuuguucuguuuuguucaugccuauauucucagcaugagaaga

SEQ ID NO: 4114669 - RNA, 81 nt, Human
ucugucucucccuagguggggcuggaagugugcccuccugucugccccugacauccagcaccaccacagggaagaugcaga

SEQ ID NO: 4114670 - RNA, 71 nt, Human
ucugucucucuuagucugcuuuuuuuccaccgauguaacagaccuggagccagcaggacucagaggaaagg

SEQ ID NO: 4114671 - RNA, 63 nt, Human
ucugucugcaagcuaaggaagcaucugacccuaauauugucagggaccucuucuugcagcuga

SEQ ID NO: 4114672 - RNA, 58 nt, Human
ucugucuguaguuuuacaugauuuugaucauauaauacauguaaaauuauaaggcuga

SEQ ID NO: 4114673 - RNA, 72 nt, Human
ucugugaagauaaggaugcugcagucuuggucuuaaaugcucugagaacugcgugccuuguuuucuuauaga

SEQ ID NO: 4114674 - RNA, 66 nt, Human
ucugugaauguuauaucucaauggaaagcugacugucagucacauaaaggaaguaacguacacuga

SEQ ID NO: 4114675 - RNA, 66 nt, Human
ucugugaccugugcaguugguccagcaggacaguuucagggugcugaccaauuucagaggugcaga

SEQ ID NO: 4114676 - RNA, 64 nt, Human
ucugugacuugcgggaggagaaugugugggauuuuugacauugguuccuucuucagaugacaga

SEQ ID NO: 4114677 - RNA, 72 nt, Human
ucugugcaagcccaagauaaaacccaaaacaacuuguuuuuuaaugguuugguuuugccaggcuugaacuga

SEQ ID NO: 4114678 - RNA, 73 nt, Human
ucugugcgggagggcaacgcggcauuuucccgcuuucuacgaaaaucuguugaugcaaaccucccgcuucaga

SEQ ID NO: 4114679 - RNA, 56 nt, Human
ucugugcuagaggaguuggccacugaccaagaagugggcucuccuaauuucacaga

SEQ ID NO: 4114680 - RNA, 74 nt, Human
ucugugcucuacaauguuacgaucaacaacacauacuccuguaugauugaaaaugacauugccaaagcaacagg

SEQ ID NO: 4114681 - RNA, 87 nt, Human
ucugugcugaacugggugauggugaggcaaaguucaagcugaaaccaugguuuggggcugcauuugcccacuaaauuagcagucaga

SEQ ID NO: 4114682 - RNA, 62 nt, Human
ucuguggacacaggagagagaacugcugggaacggauccccagccaguccuguuucuacagg

SEQ ID NO: 4114683 - RNA, 58 nt, Human
ucuguggacugugugagaggugggagacagagaagcccuccuaggcauuguccaaggg

SEQ ID NO: 4114684 - RNA, 79 nt, Human
ucuguggaucuuauguacagccuggugacuauaguuaacaauacucuauuguuuacuugaaaugugauaagagagcaga

SEQ ID NO: 4114685 - RNA, 60 nt, Human
ucuguggcagaguugcugacuagaaugugcuacguauuuaaguuuuccuuugcucauggg

SEQ ID NO: 4114686 - RNA, 70 nt, Human
ucuguggcauuuugcaucgucuuauuaauaggaacugacucuuugacaaacccugcaaauagcucacaga

SEQ ID NO: 4114687 - RNA, 84 nt, Human
ucuguggccaggcagacacacuguccagaggacccugugaccaagggaacagggcuccuagguggugugcuuucugguaccaga

SEQ ID NO: 4114688 - RNA, 55 nt, Human
ucuguggcuuucguguaagauggcgguauagggccauggacaccaaugccaaaga

SEQ ID NO: 4114689 - RNA, 79 nt, Human
ucuguguaagucccagcggggcauuuccuggccaugugagccaucugagugucagugcuuggggcuacaucugcgcaga

SEQ ID NO: 4114690 - RNA, 55 nt, Human
ucuguguccugcuagcugucuucacacagacaagcagcucccaucagggcacaga

SEQ ID NO: 4114691 - RNA, 70 nt, Human
ucugugucucaaucccaugcugcaaccggggguguccuggagcaaaucagaugugaggaugaaucauaga

SEQ ID NO: 4114692 - RNA, 67 nt, Human
ucugugucucuaaagauagcugccucgagauccuguacucagggaggugucugccagagaauucaga

SEQ ID NO: 4114693 - RNA, 96 nt, Human
ucugugugccuugguuuccccaucuguaaaaugggagugaauaauagagcuucucucccagauuguugauggcuuaaggaaaacaaugcauauaga

SEQ ID NO: 4114694 - RNA, 69 nt, Human
ucuguguguggcagauaggguauuaggaguaaugacaaaauuauucugauuguaucuguaacauaugga

SEQ ID NO: 4114695 - RNA, 56 nt, Human
ucuguguuacccgccagggccucuuuguugaaaggggagguuacaggugucacaga

SEQ ID NO: 4114696 - RNA, 61 nt, Human
ucuguuacuaggaacauauuaaguaauaugaauuauuauuugucuuuggaccugugagagg

SEQ ID NO: 4114697 - RNA, 80 nt, Human
ucuguuaggacuuguaaacauaccagagccaaguccucugaacuucgcgaacugauuugguguguuugcugguacccaga

SEQ ID NO: 4114698 - RNA, 81 nt, Human
ucuguuauaauguuugcucugaaaauguugacuuuguuucaauacaauugauauguuagggaacaauuugagcauaacaga

SEQ ID NO: 4114699 - RNA, 64 nt, Human
ucuguucacugagcaauggcaaagcuauuaacaugcuugauauuaaccugcuaagugagucaga

SEQ ID NO: 4114700 - RNA, 115 nt, Human
ucuguucauauuuaauuauaagaacugucuuaauaacaaaagcugcuguuuuuauuucaucuuucagaggcuaaaugcuacuugagauuguucuuuaugaaaugaaaugaacaga

SEQ ID NO: 4114701 - RNA, 75 nt, Human
ucuguucauuugggaugagucagaagucaacacgccacaauaaagacgacuuuaugcuauuucucaguggaaaga

SEQ ID NO: 4114702 - RNA, 77 nt, Human
ucuguucccucaggcagagcuguggagcucuucaucauuaaggccuucuuugcagccugccucucagccugggcaga

SEQ ID NO: 4114703 - RNA, 70 nt, Human
ucuguucuugucacuguaauuugcuggcuuuaggguaagcagcaacugcuagaguggcacaagauacgga

SEQ ID NO: 4114704 - RNA, 68 nt, Human
ucuguugaauggaugcugcuucuauuaucucuucccagagaaaagaggcaaaaaucuauggcaacaga

SEQ ID NO: 4114705 - RNA, 70 nt, Human
ucuguugcaguuucuggaugccuucuuuuuccauuaaagaaagcauuuauguccagagaagugcuuuaga

SEQ ID NO: 4114706 - RNA, 73 nt, Human
ucuguugcuccagggaacacagauggccaauagcuagagauaaggucagcucuguguccuccuggaccacaga

SEQ ID NO: 4114707 - RNA, 70 nt, Human
ucuguugcuuugauucuuggcuuaucagaauuucucuguaucugagcugaagucaggagucagcuucaga

SEQ ID NO: 4114708 - RNA, 122 nt, Human
ucuguuguaggccccucugcuguuggugaugaagggccuguugggcauugagacuccugagaacacaggcaacuucaaaucucacuuaggcauugguuuuccucacaauggcuucaaucaga

SEQ ID NO: 4114709 - RNA, 80 nt, Human
ucuguuuagaugcuuuaucuguuaggauuguaugcauuaaaaauaaauuguaugcauuaagaaaaguauuugaaucaaga

SEQ ID NO: 4114710 - RNA, 69 nt, Human
ucuguuucacguccugaaucucacuucagcccgcauacagcugcuuuaggagacagagacugaaauaga

SEQ ID NO: 4114711 - RNA, 61 nt, Human
ucuguuucuuggcuagccucuuagcauugaacaugaaagaggcugaaugagaaaguacaga

SEQ ID NO: 4114712 - RNA, 55 nt, Human
ucuguuuguacuccuaaaggugucucaugagacaacuuuggagaaagcuaacaga

SEQ ID NO: 4114713 - RNA, 57 nt, Human
ucuguuuguccaacuugucccgaagacaucagguccucgggguugggacaaugcuga

SEQ ID NO: 4114714 - RNA, 65 nt, Human
ucuguuuguucucaugggaguuagaaucuacagcgagauguuaacugccagcagcgaugaacaga

SEQ ID NO: 4114715 - RNA, 76 nt, Human
ucuguuuuagcauuuggugugccuauuauacauccucaugaugauguugaauagguagccagauauauaaaucuga

SEQ ID NO: 4114716 - RNA, 120 nt, Human
ucuguuuuccaugucagccauacugauuuggugagaaagcacagaaauugucaugucagcuguguccaucauucuguucuuuauuuaccauauuauguuaauguugauuaagagaaaaga

SEQ ID NO: 4114717 - RNA, 95 nt, Human
ucuguuuugaacauaugaaaaccaucugagucaagauguauuacauggugauuacagucugacagauguuuugaaguuguaauguguucaucaga

SEQ ID NO: 4114718 - RNA, 55 nt, Human
ucuguuuugugaauuguuucuuuggauuuuuccgauuagcucuuuauaaaacuga

SEQ ID NO: 4114719 - RNA, 64 nt, Human
ucuuaaacugacuauuacggccacgaauuuuauuaagaacuuuugcuguagugguuucuuaagg

SEQ ID NO: 4114720 - RNA, 72 nt, Human
ucuuaacaauuugcuuaacugguagaaugcgguggagaugacauugcuugacuuaugagguagacuguaaga

SEQ ID NO: 4114721 - RNA, 78 nt, Human
ucuuaagcaaaauagggcgugucuagacucacaauucuuaccuugcuuaauugaagugagucuugccuuugcugugga

SEQ ID NO: 4114722 - RNA, 70 nt, Human
ucuuaagcucuuuuguuugcaagauugucaauucuaacucaaguuauugcaaauaacaaggaguuuaagg

SEQ ID NO: 4114723 - RNA, 67 nt, Human
ucuuaagggcaaauggauccauguuuugguucacaccauuauguccagagaacauuugcuuuaugga

SEQ ID NO: 4114724 - RNA, 110 nt, Human
ucuuaaucaaaaguccccaguaagagccaggcuucucucaggagcaucagccucagcgacagucccugggcuggaguugcugagaagguguguuugccuuuuggcugaga

SEQ ID NO: 4114725 - RNA, 86 nt, Human
ucuuacaaaccauuuguuucuucuuuaaaauguuaaagguuuguaaggaaugccuuuggccgcuuuauggaggacuggagugggga

SEQ ID NO: 4114726 - RNA, 102 nt, Human
ucuuacauauaaaugauaucagugugaauaaguaaugcuuuuguagauaacuuauguuuuguauugcaaauagccuauauuuauagugauuauguaucaaga

SEQ ID NO: 4114727 - RNA, 130 nt, Human
ucuuaccuuguuccuuguguuuuucggauucagcugcuggaugcuugauuuugagguguuaccaugcuacugccuccaucuguaucugucugggagaaaagcaauagugaagaugagaaagaagggagga

SEQ ID NO: 4114728 - RNA, 63 nt, Human
ucuuacucacaagaggcuagguggcaggcaaugcauuugaugccacaagaucugugaauaaga

SEQ ID NO: 4114729 - RNA, 72 nt, Human
ucuuacuugugccuuucauagccucacuauauagaaaucuauggcucagaagaaaagguaaacagguccaga

SEQ ID NO: 4114730 - RNA, 67 nt, Human
ugaaaauguauuuuugauuuguuagaaagaaaaauaacuggcaaaguuuaucaggaauauauuagca

SEQ ID NO: 4114731 - RNA, 67 nt, Human
ugaaaaugucacaaggccaugaaaagaaauugauagaaaauuucagaguuccuuguugauauuuuga

SEQ ID NO: 4114732 - RNA, 62 nt, Human
ugaaacaggcaaaacugcagaugcugugcaaaaucacaccucuagucuguuugcuugauuca

SEQ ID NO: 4114733 - RNA, 80 nt, Human
ugaaacugcugccuugaguagccagugagacccagaaauacacuuaacuaucucuuagucucuggcuuaggaaaguuuca

SEQ ID NO: 4114734 - RNA, 62 nt, Human
ugaaacuuuuucuuagguaugucuguauucauauggacauaacacuuugaaagagaauuucg

SEQ ID NO: 4114735 - RNA, 79 nt, Human
ugaaagagaugucaaggaagugugaucugaauaaucugaaggaagacugaagagcuuuuugacaucucucuauuuuuca

SEQ ID NO: 4114736 - RNA, 80 nt, Human
ugaaagaguacauaacaagaauaccagauuuuuaaaaagagauugaauuucuuguucugguucuguuagcaauuguuuca

SEQ ID NO: 4114737 - RNA, 86 nt, Human
ugaaagagucaaaaguucucguacccugaguuuuucuccccauuaaccacaggaaaucucuggucacagaacuuaaaugaaaguca

SEQ ID NO: 4114738 - RNA, 85 nt, Human
ugaaagcagaaggaaagguugcagcaguguugaugacugauucauuuuauucauacaccucucagcccuucucuugcugucuuca

SEQ ID NO: 4114739 - RNA, 67 nt, Human
ugaaagcaggacauugcugcugugucaagaacaaacuguguucuuauacagaagauguuuaauuuca

SEQ ID NO: 4114740 - RNA, 68 nt, Human
ugaaaguaggucuguuaguuuauaaaaugauagucaucuuggggucuuaauuagcagacuuccuuuca

SEQ ID NO: 4114741 - RNA, 101 nt, Human
ugaaagugaauauauaugcuauguugaauaauuugaguaauuugcaugguucagggccuuuaguuugcaaauaguuuuucauguauuauauaucucuuuua

SEQ ID NO: 4114742 - RNA, 56 nt, Human
ugaaagugcugggauuacaggcgugagccaccacgcccagacucccauacuuugua

SEQ ID NO: 4114743 - RNA, 114 nt, Human
ugaaauagaaugaauuccaggcucauucucccuucuaucccugugaugacaucccaaccaaaaaugcaucacuuuuaaaggugaucgaaguggaaguggguucaucuacaguca

SEQ ID NO: 4114744 - RNA, 58 nt, Human
ugaaauagcacuuuguauccuuguugcccagaugccucacaggaugccugccauuuca

SEQ ID NO: 4114745 - RNA, 70 nt, Human
ugaaauagucaaguauuugaacuaugggcaagcaguucugccauguccccuucugugcuugucuauuuua

SEQ ID NO: 4114746 - RNA, 64 nt, Human
ugaaauauacaugaagucggcugaaugcagacaaaauugcaccauuuacugcaugaauauuuca

SEQ ID NO: 4114747 - RNA, 129 nt, Human
ugaaauauaucaaaauacuaagagaacaaucuguucucauucagcauuuccuaagaaccuacuaagggccagagauuagggaauguugacugagagcaggcugcucucuuuggcuuuucauaugguuca

SEQ ID NO: 4114748 - RNA, 57 nt, Human
ugaaauauccagcccagcaggacagaagauuugagauuuggcugguuggaaguuuua

SEQ ID NO: 4114749 - RNA, 75 nt, Human
ugaaaucaccuuugacuccuuugugaaaagaguaaugauaaaaguuuugacuucuucuuaucaaggaggauuuca

SEQ ID NO: 4114750 - RNA, 73 nt, Human
ugaaauccaugaaaaugucaaguucugcugaauuagguaauaaugguaauaccugaaauuuguauggcuuuca

SEQ ID NO: 4114751 - RNA, 76 nt, Human
ugaaaugaagguggacagauuuuuuuggcuuuccaucaaauugaguaaagaaaagguaaccgcuuaucuaauuuca

SEQ ID NO: 4114752 - RNA, 106 nt, Human
ugaaaugagagaugguaccugacugauucagugucaaagcuaaguauuuauuuguacccauuugccuguuuuccuacuguaucaucaaauacacaugauuaauuca

SEQ ID NO: 4114753 - RNA, 82 nt, Human
ugaaauggguugugcagaaggcagaaaguccagguaucuuggcuagauccagaggcacugcccuuugugcaccuagaccuca

SEQ ID NO: 4114754 - RNA, 67 nt, Human
ugaaaugugggucaugacccauuagugagcuuugaaaucacuuuaguggguugugaccugaauuuua

SEQ ID NO: 4114755 - RNA, 68 nt, Human
ugaaauuagugaaguuacaguuguguuucaaaugaauugagggacaugguuuggcagcauuaauauca

SEQ ID NO: 4114756 - RNA, 77 nt, Human
ugaaauugcaaaauugauuguggugaugguugcacaacuuugugacuauacuaaaaacaaucgauuuguauauuuua

SEQ ID NO: 4114757 - RNA, 76 nt, Human
ugaaauugcugggucggaggguaagcagauuuugcauuuugucacauauuguaaacugcuucucaccaagguuuua

SEQ ID NO: 4114758 - RNA, 59 nt, Human
ugaaauuucugcacgcaguagguagguaggcacuugauuacuauguguugaaagcugca

SEQ ID NO: 4114759 - RNA, 76 nt, Human
ugaacaaaauaguccugggaauaguacugucuucagaagucugauacauggugggcuauuguaggucuauugauca

SEQ ID NO: 4114760 - RNA, 67 nt, Human
ugaacaagcaucaggaaaaauugugaaaggguuugaaauaggccuaaaacauuccugggugucuuca

SEQ ID NO: 4114761 - RNA, 98 nt, Human
ugaacaaggugauaggagagccuguuuuagaugcauugaugauagggaggaauaauggcucaucaguuaugaaauaguuccaaauuaccuugcuuuca

SEQ ID NO: 4114762 - RNA, 66 nt, Human
ugaacaaugaacaagaugagauauguagaaagcaugucacauauauaauguucaauaaaauguuca

SEQ ID NO: 4114763 - RNA, 68 nt, Human
ugaacaauuugggaucuuaaagaguuuuagucauguguucucuuuuuaaaaagcucuuaaaugguuca

SEQ ID NO: 4114764 - RNA, 58 nt, Human
ugaacacagcauauuuuguuaccucaucaagaagcagaggaagauuauguugugauca

SEQ ID NO: 4114765 - RNA, 70 nt, Human
ugaacaccauggaugugagcauuaugauaaaauaacaaggugcuuucacauguaugcacaaagauguuca

SEQ ID NO: 4114766 - RNA, 126 nt, Human
ugaacagauaacuuucaucaauuaggauggcuggcuaguggcagggacuucauauaaagaaaucuuucccagaauuguuuuuccacauugccuucuaauuugaucacucccuauaacagauguuca

SEQ ID NO: 4114767 - RNA, 62 nt, Human
ugaacagcaugcaugcaagacuaaaugcuagcguaauagcauagauuuuugccugcuguuua

SEQ ID NO: 4114768 - RNA, 84 nt, Human
ugaacaguguuuguugucaugauuuuacuuuguucuugaccacauuggucccagagaaagucaaggucuucagccacggauuca

SEQ ID NO: 4114769 - RNA, 61 nt, Human
ugaacauaacaggugcccaggaaggagauaaaaccugcuucacuggaaucuguaauagucg

SEQ ID NO: 4114770 - RNA, 126 nt, Human
ugaacauagagagaauugaauuuuaauuaauggucauaaguaccauuuugggggcaaauguugcaugugugucauuuaggguggagcugaccauaaagacauuuuauucauuuuuauuuauguuua

SEQ ID NO: 4114771 - RNA, 75 nt, Human
ugaacauauggauacauuucuguuagauuuaugucuacaaguggaauuggugagucagaggaguacauauguuca

SEQ ID NO: 4114772 - RNA, 68 nt, Human
ugaacaucuuuaggaaccuaaccuauuaauaaacaaaugaauuaacaggauccuagagaaagaguuca

SEQ ID NO: 4114773 - RNA, 72 nt, Human
ugaacaugcaggaugagcaggugugagugugucaguggugugcacauaccuguguauccacaagcgugucca

SEQ ID NO: 4114774 - RNA, 81 nt, Human
ugaacauuacaucagacaaugauuauuccaugauauuuuaauuaauuaagggaaagccaggugcucuggugucucaguuua

SEQ ID NO: 4114775 - RNA, 65 nt, Human
ugaacccaccaggcucuguccgagcggcauugaaauggccagagugggacaggcuggugcccuca

SEQ ID NO: 4114776 - RNA, 73 nt, Human
ugaacccuuguagaggauggagaugcuuuguguagaaugaagccaccuucauuccucucccacagaggguaca

SEQ ID NO: 4114777 - RNA, 84 nt, Human
ugaacgguccugugcugugaaagcugccacacuguucuagaucacacggaauauucaguggguuaguuuuuaaagggacacuca

SEQ ID NO: 4114778 - RNA, 59 nt, Human
ugaacgugcccaguccccaucugauguaauuggucuggagaggggugugggcaucuuua

SEQ ID NO: 4114779 - RNA, 80 nt, Human
ugaacuauuagagacuauguuuuaaacaagcagagaauuauuuaaauuuguagcuauguuagacauucucauuuugguca

SEQ ID NO: 4114780 - RNA, 121 nt, Human
ugaacuccugaagcauuugccuugcucauuccuuguucacacaccugacauuucugaagcaccuucugaguggcaggcacugugacggaaauagacaaagucuuugcccucauggagcuca

SEQ ID NO: 4114781 - RNA, 59 nt, Human
ugaacugggacgugcaguaagugauguaaaauacaugcuaauugcaaagucuugguuca

SEQ ID NO: 4114782 - RNA, 66 nt, Human
ugaacuguaaggacuucacagcuaauauaugccccuggguaauguuacauaguccuuauuuguuua

SEQ ID NO: 4114783 - RNA, 76 nt, Human
ugaacuuacaaaggagauaaauuggaggcugaugauuagcaucacaaaaugauuauucccuuuguaaaaggcuuca

SEQ ID NO: 4114784 - RNA, 78 nt, Human
ugaacuuagaaucuagccugggcuaauccucaguggugucacacuagagaaacgcccaggcucagacuuugacauuua

SEQ ID NO: 4114785 - RNA, 77 nt, Human
ugaacuuccuguauuuacaucuuagucuacccagugauucccacuggaauguaaacucugugaggguggggagcuca

SEQ ID NO: 4114786 - RNA, 93 nt, Human
ugaacuugcccaaagcuaaugagccauuguuucuccaaggugacagagaacagcuagaaauucuaagcaucaauagcauugagguuagguuua

SEQ ID NO: 4114787 - RNA, 71 nt, Human
ugaagaaauggacagaaaugccauauuuguaaauaagaagauauaucugguaaauauguccauucucuuca

SEQ ID NO: 4114788 - RNA, 57 nt, Human
ugaagaauuccauggcuuccaugucucagcagcucaaggccaaguuggauuucuuca

SEQ ID NO: 4114789 - RNA, 124 nt, Human
ugaagacaagcaaaguaugagaaagaccucuugguucacauuagauuuccuucuucccugaagggcaaucugauagaaccuuuagaauugaaggggaagcauuucauucauaaauugugcuuca

SEQ ID NO: 4114790 - RNA, 59 nt, Human
uccaggcugccacagugcaacgacagguaaaaggugggacuguuucgggcacgucugga

SEQ ID NO: 4114791 - RNA, 64 nt, Human
uccaggcuuucaaggaauuugguauuuucuugaugagaacaugcagaauucuuagagagcagga

SEQ ID NO: 4114792 - RNA, 69 nt, Human
uccagggaagaggcaggcggcucccucacuuccccuuggaaggcagcaugaaucccuguacuuccugga

SEQ ID NO: 4114793 - RNA, 77 nt, Human
uccagggccuagggugcugagugagcuagaggcugcugggaggacagcagcuagcuauucagaccgugggcuaugga

SEQ ID NO: 4114794 - RNA, 55 nt, Human
uccaggucccuggaauuuaugaguagguuacuauauauggcaaaagggacuuuga

SEQ ID NO: 4114795 - RNA, 64 nt, Human
uccaggucgccagcaggaacgucacaggagagccccggucgcucgucaggcgggcggcccugga

SEQ ID NO: 4114796 - RNA, 94 nt, Human
uccaggugcaagaggacacuccagcuuuuggcucaagcagaaaauuaugauugaaagaagaagcugcgauguuuaaauucacccgcaaucugga

SEQ ID NO: 4114797 - RNA, 62 nt, Human
uccaggugggcugcacccaggcuggacguuauuccgaccucggugaagggaguccggcuggg

SEQ ID NO: 4114798 - RNA, 80 nt, Human
uccagucacaucagaaaguugagugcugaucugauuauuucacuuaauugcauaaaauucaacucugugacaucccugga

SEQ ID NO: 4114799 - RNA, 75 nt, Human
uccagucaugcuguuugugguaucugcugccucuugcuccugguagcuugaguguuucauaaauauagauugcga

SEQ ID NO: 4114800 - RNA, 75 nt, Human
uccagucggggcugccugcucaggugcggcgccuccaggguugcuuguauaagaaggugcagcagaccggcugga

SEQ ID NO: 4114801 - RNA, 83 nt, Human
uccagucuauaguaaagcaugaauuggagagagagacuugaggucuaaacuucacuuuaagugcuugaucuauaaugauggga

SEQ ID NO: 4114802 - RNA, 65 nt, Human
uccagucuauugccuaacagagaggugacuucaucagaguuuaccugucuuagggaaagacugga

SEQ ID NO: 4114803 - RNA, 64 nt, Human
uccagugaggcugaauggccacucauccugcauuaaucucagccagggcucuggccucaguggg

SEQ ID NO: 4114804 - RNA, 56 nt, Human
ugacuguuuguaaagagauugcuaagcaauguuaaagugcucuuuauaaagaguua

SEQ ID NO: 4114805 - RNA, 80 nt, Human
ugaaauggcuccaguugacuuuuuagagaaauacauagcugcauuugugaaaaacaggaaguuaacugcagagccucuca

SEQ ID NO: 4114806 - RNA, 67 nt, Human
ugaaaugguuuugcuuuaguauucuacucuaauuagaaagaauacaccacaggccgaaauaguuuca

SEQ ID NO: 4114807 - RNA, 63 nt, Human
ugaaauguagugaagcauggaagacacugcauucaacuauuuccauagcaauacugcauagca

SEQ ID NO: 4114808 - RNA, 102 nt, Human
ugaaauguauucuaugggcucauguauucagcaggcucuuccugagccuguuaggaggcagcccugugcuggaugcugggcccaaaaacaguuggcaaguca

SEQ ID NO: 4114809 - RNA, 57 nt, Human
ugaaauguccugagauucaacuuagaugccaucuggggcugagcuuuggacauuaca

SEQ ID NO: 4114810 - RNA, 63 nt, Human
ugaaauuaucagaaauucaaagggugaccuguuaauggcacugguugaaguucuguaugguca

SEQ ID NO: 4114811 - RNA, 66 nt, Human
ugaaauucuaggcuaaugcugcuacccaugcaaaguccuggaggcagcaugagccuggugaauuca

SEQ ID NO: 4114812 - RNA, 88 nt, Human
ugaacaaugccaaagcccaaguucaucaguuaaaccaguuaaucuccauuggcccuuggugucaacuuguucuuuggacaaaguguca

SEQ ID NO: 4114813 - RNA, 84 nt, Human
ugaacaccuugacuuucacuuuucucaaagucagugccuccaccauuaagucaacauucugaaagagugcaagucaaggaguca

SEQ ID NO: 4114814 - RNA, 62 nt, Human
ugaacacugccauauuuaagaagguagagaaacacauaccaccucuugauaggggaguguca

SEQ ID NO: 4114815 - RNA, 69 nt, Human
ugaacagacugaccucugaccuugccuuccaugacaugguugcuggcuucuuagagaucaucugcuuca

SEQ ID NO: 4114816 - RNA, 77 nt, Human
ugaacaucuggcuuugugaaauugagcccugugucugaaugacacaacagaagagcaauugcaaaguccuguguuca

SEQ ID NO: 4114817 - RNA, 73 nt, Human
ugaacaugaacagucuggcugggggcuuugaagcaguaaauauuggaaaccccagcagauuguaaagugucca

SEQ ID NO: 4114818 - RNA, 58 nt, Human
ugaacauuaguugaguaaaguccacagaauggugcuaucuuugcuccauuaaugauca

SEQ ID NO: 4114819 - RNA, 74 nt, Human
ugaacauuuaggaauguucugcacaaaugcauguaaauagauuuguuuugugauuccuauuucuaagucauuca

SEQ ID NO: 4114820 - RNA, 70 nt, Human
ugaaccagaagucaucagagcugaggcauggccuugaacaugucacucagucucuggggcuucuguuuca

SEQ ID NO: 4114821 - RNA, 65 nt, Human
ugaacccaucaacugauaguaacgcuugauuuuugguucacagauguaccuuagugauggguaca

SEQ ID NO: 4114822 - RNA, 61 nt, Human
ugaaccccagggcuugagucauccauguguucauguuugguuaacaggcucugugguugca

SEQ ID NO: 4114823 - RNA, 83 nt, Human
ugaaccucuugcuauugguuucagcgggggagggagcucacugggguuuccucugucaugacagcugacaagcaaacucauca

SEQ ID NO: 4114824 - RNA, 62 nt, Human
ugaaccugggauuugggggcucuuccggauuacauccacucagccugaaucccaccaguuca

SEQ ID NO: 4114825 - RNA, 68 nt, Human
ugaacuauguuuggcucugugagugauggcugagauuuaccauacaaauagagauucaaauaaaguca

SEQ ID NO: 4114826 - RNA, 86 nt, Human
ugaacuauguuuugcuuccuuuuaaugguacuguuuccccucaucuuuuaacagugaucuuuuaaaaagaagugugauucuguuca

SEQ ID NO: 4114827 - RNA, 59 nt, Human
ugaacucaguccaaaguuuuauguaagucaugaggcucuuucuuuggacuucagaguca

SEQ ID NO: 4114828 - RNA, 77 nt, Human
ugaacuccaaauacugcugauucacagugucucuuucacuuaugacccugaccuaucuaugcagaauuugggguuca

SEQ ID NO: 4114829 - RNA, 85 nt, Human
ugaacuccucuccuuaaaaaucuauguugaacugaugcacuguaucuuguuucugcaacuaguuuuaagcuccuugagguauuua

SEQ ID NO: 4114830 - RNA, 100 nt, Human
ugaacugaauaccagaugugcagggaccaaucaccgacaggcuuucagagaagugacaugauuggucauuggucgugauacacaucuguuauucacauca

SEQ ID NO: 4114831 - RNA, 81 nt, Human
ugaacugaccaguugcuuuuguacuuuccagcauccuacaauucagccuacauugucauaaaaucaacuggcuccaguuua

SEQ ID NO: 4114832 - RNA, 89 nt, Human
ugaacugaggucacugguagaugcuuaagguguacauaugugugugugacucaguacaguuuucaguguucacugaacacuucaguuua

SEQ ID NO: 4114833 - RNA, 78 nt, Human
ugaacugcagaauauucugauuuucugugaauuaacaugaaguuaauucacauuuagacaucagguagcaagccuuca

SEQ ID NO: 4114834 - RNA, 57 nt, Human
ugaacugugccagccacagggcucaggggacuggcucuguugugcugagccagggca

SEQ ID NO: 4114835 - RNA, 55 nt, Human
ugaacuucagugauuugcugcagcucugcauuaacagaaaaucacugucaguuca

SEQ ID NO: 4114836 - RNA, 81 nt, Human
ugaacuugcagaaggccuugguucugagcaauaagagugacuaugucugcuaagacccaggugcuaaaucaggugaguuca

SEQ ID NO: 4114837 - RNA, 100 nt, Human
ugaacuugcagcuugguucucagcuuccaguaacucuugaaaggcaauuccaugaccuugggacccugcuggagguuacaaaucccaaguucaagauuca

SEQ ID NO: 4114838 - RNA, 130 nt, Human
ugaacuuuuuaguguaaauuuaaagauuugcuggcccacaaacauugguauaaauagaaauggguuaacuugcuaguuuccauguuauacaguuuuuuggguuugucaaguuauuuauauaguuaguaca

SEQ ID NO: 4114839 - RNA, 71 nt, Human
ugaagaaacgcagagagguaggcuguuugaccaugggagagccacuucacccuucugaaucaguuuuuuca

SEQ ID NO: 4114840 - RNA, 129 nt, Human
ugaagaauguagucuuauaaucauuuuugucaacaugguuuugaagggaggucaaauuccugcuaauaauauguugguuuugaaucuuuauaaagacaugacagcaugauuuucaagaacuuuuuuuua

SEQ ID NO: 4114841 - RNA, 70 nt, Human
ugaagaaugucuagacauguuaaugcaccuuaauguaguacuguagcaugaauuagaccacaauucuuua

SEQ ID NO: 4114842 - RNA, 92 nt, Human
ugaagaauuggucucgagagaaaaugcuucacugaaauaauucaggaaacugcccuuauggcaaguggggcagauucucuuccuguccuuca

SEQ ID NO: 4114843 - RNA, 78 nt, Human
ugaagaauuguggguuuguagguuaauuuucuuugaacagcuacaaaguucuuuuucuauaaaucccaauuaguuuca

SEQ ID NO: 4114844 - RNA, 62 nt, Human
ugaagacaagugugcugguguuugccauccacccaacuuuguaauuugccaguauugcuuca

SEQ ID NO: 4114845 - RNA, 59 nt, Human
ugaagagauagaaguacaugcuguagguuguacagcagaacagucuucuaguucuuuca

SEQ ID NO: 4114846 - RNA, 62 nt, Human
ugaagaggcuccagucugaaccuuggggccugauagcgcccucggugcuggcagccucgacg

SEQ ID NO: 4114847 - RNA, 69 nt, Human
ugaagagugaggacuuuagcaaguuuagagaaugaauugucuuacuguuuugguaccucauugcuuaca

SEQ ID NO: 4114848 - RNA, 65 nt, Human
ugaagauaugaguaugagaggagagagagauauauauauaccucucaggacacacaugucuauca

SEQ ID NO: 4114849 - RNA, 118 nt, Human
ugaagcaacauuuuaggucuucauugauuugcuuugcaauuuccuucauagaugacuggaacauaaaucuucaguuagggccaguucaaaguuuuccugacucaaaauauugcauuca

SEQ ID NO: 4114850 - RNA, 70 nt, Human
ugaagcacuuacuaaguguaaggcagugugguugagcccacuguucauauucuuagaaauuguaaauuca

SEQ ID NO: 4114851 - RNA, 61 nt, Human
ugaagcagagaauuugacagucaugacauuauauugugaaccuuuaaguuuuacugcuuua

SEQ ID NO: 4114852 - RNA, 109 nt, Human
ugaagccacuguagcuuuugugaguccaggaguugggugacauuauuaaacccucguggcagugucgcugaaguucaugaguuuccaaaaugaagguuccaggugcuca

SEQ ID NO: 4114853 - RNA, 61 nt, Human
ugaagcggcaguauuugaacucagacaguggcucuuaacuguucuucuagauugccuuuua

SEQ ID NO: 4114854 - RNA, 62 nt, Human
ugaagcuauauaaguuacagcauguguugagauucagacuugcuaguagguuguguaguuca

SEQ ID NO: 4114855 - RNA, 84 nt, Human
ugaagcucuagaugaaaucuguuuuaaaguuugugccuguaauacaguccgugauauacuggaaggcagaacaauuaguguuca

SEQ ID NO: 4114856 - RNA, 62 nt, Human
ugaagcucucaaacucuccccuucauccgucccagauagaaguggaggggcuuggagacuca

SEQ ID NO: 4114857 - RNA, 108 nt, Human
ugaaggaaaagagcuucuacucuugguguuaacuugaaugaaaccaacugaugacuaaaaacuagcucuuaguguugaguucaaacauuguaaaguuuuaaaacuuca

SEQ ID NO: 4114858 - RNA, 100 nt, Human
ugaaggacuugcagcuucagagcacaugacuucugggucacccuucugcucagggucaucccugaugacccaagguguccucuggaggcuuguuaacuca

SEQ ID NO: 4114859 - RNA, 57 nt, Human
ugaaggaggaauguggccuccagcuugucauagauugguggaacugcaucuccuuua

SEQ ID NO: 4114860 - RNA, 78 nt, Human
ugaaggaucagaauaaguuaugaaaugaaggucaggaaccuuuuguacauaguuucuuauuuggaaugauguucuuua

SEQ ID NO: 4114861 - RNA, 77 nt, Human
ugaaggaucuaaaugguuacaaugcuuugcuuuugaaaacauugagugcaucguggccauuuuaaaagauugcuuca

SEQ ID NO: 4114862 - RNA, 67 nt, Human
ugaaggcaaccucugugguccuguucuacccccaccugcgguuuugcggccaaggaguuugacuuua

SEQ ID NO: 4114863 - RNA, 66 nt, Human
ugaaggcauugaugaaggaauccuuagggccccuucuaguuccaaauuuccacgucuaugccuuua

SEQ ID NO: 4114864 - RNA, 73 nt, Human
ugaaggcuuagcugguuucucagcuucauguuuaacaggcccaaaaucaagcuguuggcuggcugagcucuua

SEQ ID NO: 4114865 - RNA, 67 nt, Human
ugaagggaagagccuguagggacaccagccuaagccuugguucuuuugcccuggggcucuucccuca

SEQ ID NO: 4114866 - RNA, 126 nt, Human
ugaagggagaaaaaauuugggcaagagacagagaugguuuaugagauuuuggaggggaauuuugcuccauaaaugaaauagaacgcucucauugaagccccacaaaacuuucaacaaaaaucuuca

SEQ ID NO: 4114867 - RNA, 64 nt, Human
ugaagggugcaaagcacucuagcugcugaccaguggcaguucagagaccauucugcucccuuca

SEQ ID NO: 4114868 - RNA, 62 nt, Human
ugaagguauuccuuaccaaauagaaaacacuauuaccaagccuauuuguuggguugccuuua

SEQ ID NO: 4114869 - RNA, 62 nt, Human
ugaagguccagcguggccaagucuuccugaucuuucaggggcaaaggaaaucuggauuuuua

SEQ ID NO: 4114870 - RNA, 66 nt, Human
ugaaggucuauggagaagacugaggaugggaauuguacuauacauccuuagccaaaugugccuuca

SEQ ID NO: 4114871 - RNA, 65 nt, Human
ugaagguugucuaaguuccucugcaugugaacuaacaccugcagaguugcuuugauagucccuca

SEQ ID NO: 4114872 - RNA, 94 nt, Human
ugaaguauacaucagugagauguuuugggauuuucacacugcugauaucaauuuuuguggaagugccaaugacaaauuuuugguguguucuuca

SEQ ID NO: 4114873 - RNA, 65 nt, Human
ugaagucacaggguaucugggauggaucugcucaugggguucacgugagauagcccuaguguuca

SEQ ID NO: 4114874 - RNA, 78 nt, Human
ugacuuaauuuucuggcaguggaugagggcagccuggucacaacaucugcuacccuuuugauugccaggguugauuca

SEQ ID NO: 4114875 - RNA, 58 nt, Human
ugacuuccagcaccucaagcggaacuauguacuugugguuaccugaauugcugaagca

SEQ ID NO: 4114876 - RNA, 72 nt, Human
ugacuucuaaugauuuucugauaaagaacugguuuuucacguuguggaaauuuagugaucagaaagagguca

SEQ ID NO: 4114877 - RNA, 60 nt, Human
ugacuugauuuaaucuucuugauguucauguuuggacaguaagagaagauguagauguca

SEQ ID NO: 4114878 - RNA, 81 nt, Human
ugaauauuguuuuaucuuucuacagacucucauaucagcagccagaucacuuagggucuugaaggaguuuagauuuauuua

SEQ ID NO: 4114879 - RNA, 64 nt, Human
ugaaucaccauguccgaguuuguuccauuauguaugauggcucauguuuggggaugaugaauca

SEQ ID NO: 4114880 - RNA, 57 nt, Human
ugaaugagaacacugaaagaggauuauugcauuggacuuuuagugucuucuuauuca

SEQ ID NO: 4114881 - RNA, 62 nt, Human
ugaaugagucaaucauuuagcugucaaaugauucaagaaugcagcaauugugaacuuauuca

SEQ ID NO: 4114882 - RNA, 129 nt, Human
ugaaugaucagccaagccgcgauuggaucuuuucaguggcaguuccagaauuucaguacaugccgugucugauuggaagaaugggaacuggacuugaagaguacuuucucgacaugguguuuucauuug

SEQ ID NO: 4114883 - RNA, 69 nt, Human
ugaaugaugaggggagaauaauagaugucuuucaugccuuucuccaaucucuucuuuccucauuaauca

SEQ ID NO: 4114884 - RNA, 68 nt, Human
ugaauggauuuuucacucaugcaugauuuuguaacaucuugcauuggucauuugaaaauaucaguuca

SEQ ID NO: 4114885 - RNA, 66 nt, Human
ugaaugguucugacaagcugggaugguuuauccugagccuucccaucuguggacaccuugcauuca

SEQ ID NO: 4114886 - RNA, 57 nt, Human
ugaauguuauguauccagucacauguaccuuggcacauguaaggauuagagcauuca

SEQ ID NO: 4114887 - RNA, 86 nt, Human
ugaauguuguggccuccaucugucuguucaccauaucuuagugccagaacuguauuuccaacagacaaaugagacagaaugauuua

SEQ ID NO: 4114888 - RNA, 125 nt, Human
ugaauguuucuuaguauaaaacuccauuuucucacuaaauaccggauuaaugcuguuuaaauugcauugcuggaaugagucggggaggggagaauuaaugaacuucuacuaagcaaaaauguuca

SEQ ID NO: 4114889 - RNA, 72 nt, Human
ugaauuaaagacauguuuuaagaauauuugugguuuauaaaauacagaguuauuugacguguuuuuaauuua

SEQ ID NO: 4114890 - RNA, 118 nt, Human
ugaauuaaugcuucccuaggucuaugagagcuguuauuuagaacauggaaucuuggugcuccuggguuccaucuuuaauaacacacucucucucucccuuucaauagcaauaaugaca

SEQ ID NO: 4114891 - RNA, 67 nt, Human
ugaauucaccugaaagucuggaguccagcugacugcugcugaauccaggcccacucagcugaaauca

SEQ ID NO: 4114892 - RNA, 63 nt, Human
ugaauucaucgucuuagcugccauuuguucuguauuuacauccuggggcuaagugugaauuca

SEQ ID NO: 4114893 - RNA, 65 nt, Human
ugaauucuagcuguugcuguuuauagcaagaaauagcaucccagcugaggcagcacagcuaguca

SEQ ID NO: 4114894 - RNA, 72 nt, Human
ugaauucuuagguccuuucuuaaauuccugcuuugacaaggaaaaggcagaauguuggaaaggaaggacuca

SEQ ID NO: 4114895 - RNA, 127 nt, Human
ugaauugauuaucuuuuagagaucaauagaacauuuugaaaauuuuuucucuacuaaauuacacuuuuccuuagguuuccaggagaagagauuuguguuuuauugcaauaaaagugacagcauuuca

SEQ ID NO: 4114896 - RNA, 63 nt, Human
ugaauuggugucuuuugcccuguugccacagaguggaguccagaggcaucggauucaacauca

SEQ ID NO: 4114897 - RNA, 60 nt, Human
ugaauuguagggauugcugguauacugaauauuaguucuuugcuuguaauaccugcuuca

SEQ ID NO: 4114898 - RNA, 67 nt, Human
ugaauugucuaaugagcuccacuucagaccccuggggcuugacuggauugucauuacgacguuguca

SEQ ID NO: 4114899 - RNA, 67 nt, Human
ugaauuguuugugugguugaacaaaccaaacaugaugagugcauuuuuccacacagugugcaauuua

SEQ ID NO: 4114900 - RNA, 75 nt, Human
ugaauuucaugcucacaaaagauggcaaacugauugucuaagagaaauuugcccucuauuuguggaacagguuua

SEQ ID NO: 4114901 - RNA, 103 nt, Human
ugaauuuggugugcguaaguauuuucauucugugugacugugcauauuguuggcugucuuugcagacgugcaugagugaggaaggguaugaacaugaaaauca

SEQ ID NO: 4114902 - RNA, 102 nt, Human
ugaauuuuaauuggcacguaggcuucaccuuaguuucaauauuugcaacaaaguaguguuaaacucguagguuaggcuuguaguucuuuagguuagaauuua

SEQ ID NO: 4114903 - RNA, 76 nt, Human
ugaauuuucucuacagcacccgcaugcuacacgggaccuacuccggugcccaugucuuugcuaguagagccucuca

SEQ ID NO: 4114904 - RNA, 60 nt, Human
ugaauuuuguguguacaaagguguguguuugugugugcguguguguaugcauaaaauuua

SEQ ID NO: 4114905 - RNA, 70 nt, Human
ugaauuuuuuauccauauuaagaugccucuggggaauccaguagacacauuaauauggaacugaaucuca

SEQ ID NO: 4114906 - RNA, 104 nt, Human
ugacaaauuaacgacuugaucguccucgucugugaaauugggauaagaacgccuaguucuuaaggcuguugcagaaggaaugacaugucguguuauuucccuca

SEQ ID NO: 4114907 - RNA, 64 nt, Human
ugacaacacaggucuaacucuccucagauacccugauugauggaauguuuaccugugaauguca

SEQ ID NO: 4114908 - RNA, 58 nt, Human
ugacaacaucauuuuuguguggagcuccuuauugcaaauagucaaaugauguugguca

SEQ ID NO: 4114909 - RNA, 92 nt, Human
ugacaagauaagauauucuggaaucuuuggagaaugugggagcaugaagucuucauaugacuugaaaguucuugaguaacuuauuucuguca

SEQ ID NO: 4114910 - RNA, 71 nt, Human
ugacaaguauuucuuuaucuggucagaaaauggaaauucuguuuucugagccagccaagauaccagguaca

SEQ ID NO: 4114911 - RNA, 70 nt, Human
ugacaauaagauugucauaguauggacauggaauagaauauauucaacuggccaguggaauuuuauguca

SEQ ID NO: 4114912 - RNA, 129 nt, Human
ugacaaucugaguuacacuaauuucacuuaccucugauacugaaaauccugccuguccucacuugacucccaugaugaaugauuugucagucacaggaaugguaauaauuaauaaaauuuaugauguca

SEQ ID NO: 4114913 - RNA, 61 nt, Human
ugacaaugcaugauggaauugccuucacuauguuaugaagguauaauugucauuauuguua

SEQ ID NO: 4114914 - RNA, 55 nt, Human
ugacacaguaucaaacaugauuucagaugaaaugggugguguuaauauuguguua

SEQ ID NO: 4114915 - RNA, 60 nt, Human
ugacacauuugcauaauaccucauauaauguugaugugaggauuaaguaaaugauguaca

SEQ ID NO: 4114916 - RNA, 57 nt, Human
ugacacccucuccuggagagaggcucacagcguagcuguucccaggaaaggggugca

SEQ ID NO: 4114917 - RNA, 83 nt, Human
ugacacguguucugggggagccuggcuggggaccugaccggguguggugggggcagccaggcugucaaggcagggcuguguca

SEQ ID NO: 4114918 - RNA, 84 nt, Human
ugacacucgcagaggcacgagugcagaaaugauccgaagccccguccaagucaugauuucuuauuaugugcucugugaauguua

SEQ ID NO: 4114919 - RNA, 64 nt, Human
ugacacugaccuaaagaccuggaacuaaaaauaauacccacgguaaucuuaaggugagugccca

SEQ ID NO: 4114920 - RNA, 64 nt, Human
ugacagaaagagccaagauccuuguccuguggaaagcaauacagguccuggacugcucuuguua

SEQ ID NO: 4114921 - RNA, 69 nt, Human
ugacagagcuggagaauaauuuuaggaaaacuaaaucucccuguugcuauguuugugccagcuuuguca

SEQ ID NO: 4114922 - RNA, 128 nt, Human
ugacagauggaauucagaauauagauaggaaugaagacauugagauccagaaguauguugaaaccugauaugguuuggcucugugucuccacucaaauaucaucuugaauugcaauucccauguguca

SEQ ID NO: 4114923 - RNA, 92 nt, Human
ugacagauuuguugugcuugucaucacaaaggcugcuucaugauuuuauaagaaaauaaagcaagccuuuguuccugcaaacaauucaguca

SEQ ID NO: 4114924 - RNA, 56 nt, Human
ugacagcaauaauuuuaucuucccuccaaagguaggauugaauccauuguuuguca

SEQ ID NO: 4114925 - RNA, 58 nt, Human
ugacagcauaacacuggucuuguuggauacccaacaagaagagugaauaugcauguca

SEQ ID NO: 4114926 - RNA, 66 nt, Human
ugacagcugcucaccugugagcccagccggcuacugggcugauggccagugaagucaaggcuguca

SEQ ID NO: 4114927 - RNA, 62 nt, Human
ugacagcuuugucauuugauuugggacaugccgauggcuccacaucaagggcagagagguca

SEQ ID NO: 4114928 - RNA, 84 nt, Human
ugacaggaagcugugaaggagacggagaaaccugaacacuauaugccaacauuugggcuagcugcuuuuacacauuuccucuca

SEQ ID NO: 4114929 - RNA, 60 nt, Human
ugacagugcggguacaucauaggacacuggaggaaaguccuuugaauguaaagcauguca

SEQ ID NO: 4114930 - RNA, 58 nt, Human
ugacaguuugacugcaaccuuugagaguccuuagccagaggcacccaguuaagcugca

SEQ ID NO: 4114931 - RNA, 84 nt, Human
ugacauagaguaaacacagauauuuaagagcuuuuguguucaugagcacagauaguuacuuaaggauccuacucaaacauguua

SEQ ID NO: 4114932 - RNA, 75 nt, Human
ugacauaggauaaacuguauuugggauuguguaauaaacacacaguaugaaaagucuaguuaauccuuuauguca

SEQ ID NO: 4114933 - RNA, 58 nt, Human
ugacaucugggcccucagcuaaaagauggaguccucuaccgguuggugcccacuguca

SEQ ID NO: 4114934 - RNA, 125 nt, Human
ugacaugaaacaaagacaagcacacugaggcauuuggcccaggcugcaugaguccauggaaguuaauuguuuggugauuuccuguaccugaggcacaaaugcuuccuuuuccaauuauagacuca

SEQ ID NO: 4114935 - RNA, 68 nt, Human
ugacaugagugcugggaccuccagcagcauccacaaggcucuguggaaggacuuagcgauacauguca

SEQ ID NO: 4114936 - RNA, 67 nt, Human
ugacaugucugggagcuagugagcuggagcuacaacccaggauuugacagaccuucccagacaguca

SEQ ID NO: 4114937 - RNA, 60 nt, Human
ugaccaaugagaugugugaggaagucugcagggaccuucaagaaacauuuccuuggcuca

SEQ ID NO: 4114938 - RNA, 60 nt, Human
ugaccacagaaucuaaauacaugaccugguaggagcauuucuguguaaagucugugguca

SEQ ID NO: 4114939 - RNA, 78 nt, Human
ugacccacaugcaagcagccgugcagaucauccagcgcuuccucauggguacauaucugcuuguugcaugucuguuca

SEQ ID NO: 4114940 - RNA, 119 nt, Human
ugaccuaaaucuccauuuugaauacuuggcauauuacuuccagcaaucugcauauuuagaaugggaugaauuuguguguguguuggaggugguagugguguuggaggagguggugguua

SEQ ID NO: 4114941 - RNA, 82 nt, Human
ugaccucacugcuucaugaggcugagagaagggaggaagggaucuucuugaaguccuccagaaguugcaccgagugggguua

SEQ ID NO: 4114942 - RNA, 79 nt, Human
ugaccucuccucuguuuuuagaacaucauuaaggaagaucauuucuuucacuaaugauuuugaaagaagucguggguua

SEQ ID NO: 4114943 - RNA, 112 nt, Human
ugaccucugagagcagcuguccaggcaggcacagcucuccaugagggaugccuguggcaagcucucuaacaguggcugcugccugucguggacagcuagcuuccagaucuca

SEQ ID NO: 4114944 - RNA, 85 nt, Human
ugaccugggggaggcagugaucaugccgucuuaccucaucacagcugcccacgagcagaugcauguuuaugucuuuccuaauuca

SEQ ID NO: 4114945 - RNA, 60 nt, Human
ugaccuucucaagcccauuguaaacugcccacugccuucacagggcuucagggaggguua

SEQ ID NO: 4114946 - RNA, 82 nt, Human
ugaccuuuaaauccucgugcaguucuaaaauuccacugcugaauucacaauagcagcuugcaugguggagggagagagguca

SEQ ID NO: 4114947 - RNA, 63 nt, Human
ugaccuuuucauagcuggauauuuuauuugauguuggaauguaaucagaauaugaaaauguca

SEQ ID NO: 4114948 - RNA, 98 nt, Human
ugaccuuuucuuuuuaucuuuauucucuucucuguugccucuguuguuccagugacuucagagacaaccugguagagaaaugcaaggauuaggccuca

SEQ ID NO: 4114949 - RNA, 79 nt, Human
ugacgagacucucaacguuuguuaaaugaguauauauauauuuuuaauggucaaucagacaagguuuagaguuuguuca

SEQ ID NO: 4114950 - RNA, 74 nt, Human
ugacguugcuuuauucagucucugccaucccaugagaggagagcuggggcccguaaagccagguuccaacguca

SEQ ID NO: 4114951 - RNA, 71 nt, Human
ugauauaggcagaaaggaaggcaaguuuuuauaacuuugucuaaaugaacuuucuaaaugccugaguauua

SEQ ID NO: 4114952 - RNA, 71 nt, Human
ugauauccuuguuuuaaacuguuguggcuugcugaaucaaagccgcugaauuugaaacaagcucaauguca

SEQ ID NO: 4114953 - RNA, 64 nt, Human
ugauaucugccuguacuauaacguagcauuugaggagugcuguguuaaauacaagcaugaauca

SEQ ID NO: 4114954 - RNA, 70 nt, Human
ugauauggcuuauguaggacacugugcauggagaaggggagaaccugcuuugcugccuacuaagcccuca

SEQ ID NO: 4114955 - RNA, 56 nt, Human
ugauauguuagaaucuugcaagauguuacuaucuugccauauuauugagcauauua

SEQ ID NO: 4114956 - RNA, 81 nt, Human
ugauauugcacuggaagagcaucugagccagcgugcuccuuguugcuccauuugacucaugcucucuccaguuaucuauca

SEQ ID NO: 4114957 - RNA, 61 nt, Human
ugauauuuaagcaaaaauaugggacauccuuccucaccaaauauuuuuguuuggacuguca

SEQ ID NO: 4114958 - RNA, 98 nt, Human
ugauauuuuugagauggcacuuaugauccuaaauugcaggugaucuaaacaucuuguuauaagagauaaugggcuucauguaauuucaguacauauca

SEQ ID NO: 4114959 - RNA, 67 nt, Human
ugaucacuguuagccuuaauuucccuuuuugaugaggauuuaauaaggucucaaucucaggugguca

SEQ ID NO: 4114960 - RNA, 71 nt, Human
ugaucagggugucaauaaauagcggugugguauucaguauuccacaaguuuguugauugaaaccuuuuaca

SEQ ID NO: 4114961 - RNA, 123 nt, Human
ugaucagugagugaaaagauguugggagggaagcugaggcagggcuugcaugucuggcuagacuugcuggcuccuugcuucuagcacucccacuaugcuaauguuucucauucacuugauaca

SEQ ID NO: 4114962 - RNA, 65 nt, Human
ugaucauaccaguuuccaucaggauuuaucagaucugaaacauccugcagauaagcugguugaca

SEQ ID NO: 4114963 - RNA, 63 nt, Human
ugaucuacgacuucaugaauuuauuuggcuccuccucggggccagggugagugucauggguua

SEQ ID NO: 4114964 - RNA, 59 nt, Human
ugaucuaugaaaggauuuggaguuguuccacagagcauucagaagcuuuuuauuaauca

SEQ ID NO: 4114965 - RNA, 71 nt, Human
ugaucucagcucacucugcuuccugggugcgggcgauucuccugccucagccucccgaguagcugggauua

SEQ ID NO: 4114966 - RNA, 88 nt, Human
ugaucucuaaaccucucugugcccugacuuuucuaucuuuaaaauggacguaacaacagagguuuaauaauaagagguuuggagguua

SEQ ID NO: 4114967 - RNA, 85 nt, Human
ugaucuguggcagguguuuagguuucauggaugguaaagaguaagucugagcuauccaugaucaauuuauuacuaauacacauca

SEQ ID NO: 4114968 - RNA, 65 nt, Human
ugaucuguggucaagcugcugugacuuaacuuucucuguuuagaucaguggcugauaacaaauua

SEQ ID NO: 4114969 - RNA, 98 nt, Human
ugaucuuguccacaguuuucaaguacauguugcucaacagccacauguucucaucuaugagguugacagcagcaugaacuacgaacucguucagauca

SEQ ID NO: 4114970 - RNA, 72 nt, Human
ugaucuuuucaaagggaaguuaugaaguaacccugcaagguuccccagcuuccaagccccuuuucaaaggca

SEQ ID NO: 4114971 - RNA, 70 nt, Human
ugaugacaauguugcugcaauaaaugcaauaauaucucucugcacuguuauugcaguaccauagucauua

SEQ ID NO: 4114972 - RNA, 89 nt, Human
ugaugacuugaagacuggaagccuguguugcucuggcgauagacaguugaguuuauuggaagugaacaccaggcuuucaauucacauca

SEQ ID NO: 4114973 - RNA, 84 nt, Human
ugaugauauuuuagcaaguucucugagagaaaaguuuuuuaaaaucucuuuuuucccccaacauggaaaaugcugacauccuca

SEQ ID NO: 4114974 - RNA, 57 nt, Human
ugaugauggaggcuugugcaagccaugauaaggaaagcagaauagucucugucuuca

SEQ ID NO: 4114975 - RNA, 95 nt, Human
ugaugauugugagaauggaaugagaugguucacagagaaggcuugagggcagugccuggcucacgcauuucaaguguuuguucucaccguuauua

SEQ ID NO: 4114976 - RNA, 57 nt, Human
ugaugccacaaacauucacugagcacguucuaugugccaggguuuguuugugguuca

SEQ ID NO: 4114977 - RNA, 70 nt, Human
ugaugcuauuaauauccagucugauuuuacucgucacugaaauuguauucagaauauauugauggaauca

SEQ ID NO: 4114978 - RNA, 61 nt, Human
ugaugcugagccugggacugacacgggcccaugcuggggccaguuaccauggccagccuua

SEQ ID NO: 4114979 - RNA, 55 nt, Human
ugaugcuguguaccucaugggauuuggugagaacugaaugaguuacacuguguca

SEQ ID NO: 4114980 - RNA, 62 nt, Human
ugauggacaauaguguuuuaagaaccagacacaaacucugccuuauucacuguuauuuauca

SEQ ID NO: 4114981 - RNA, 57 nt, Human
ugauggagggcagccccacuaaagcaucgugugcaguggguccugcgucugccagca

SEQ ID NO: 4114982 - RNA, 59 nt, Human
ugauggauucuaacugaacagaauaugaaagauucacugauacgguuuuagaguccaca

SEQ ID NO: 4114983 - RNA, 72 nt, Human
ugauggcauuuguuggcauggccccuaccacucauuuuuguaugugagcugcaagucugccaacaacuauca

SEQ ID NO: 4114984 - RNA, 58 nt, Human
ugaugggaaaaugaggccuggggauggccaggaacuugccugagguuuuuuccaauua

SEQ ID NO: 4114985 - RNA, 102 nt, Human
ugauggggaaggaggcgcgcggugcccagggcuuuuuauuagcugccucgacuucucgagccucagcccgaacgucugcaccugugcacccccuuucucucg

SEQ ID NO: 4114986 - RNA, 83 nt, Human
ugauggggacaaguaggugcacuucaauagaaucaggucacgacuuugcuauaagaauugugcaccuacaaaccaccccuuca

SEQ ID NO: 4114987 - RNA, 129 nt, Human
ugauggggcaggauuugggcagaugugggggcggagcuguucugagaugcccggcuuuggccuguggggcagcuggcugaagcugggcucuccucugccuuucuguccucccuuccugcgcaacuccca

SEQ ID NO: 4114988 - RNA, 55 nt, Human
ugauggugaugguugcacaaugguguguauguacuuagcgcgaccaagcuauaca

SEQ ID NO: 4114989 - RNA, 83 nt, Human
ugauggugcugucucuagagaaacagugcucugaacagaaggaauaaaugcuuaagguuguuucuuuggaagacggauugaca

SEQ ID NO: 4114990 - RNA, 79 nt, Human
ugauguagcagauacauggugguggcacuugacuuucaaaagcaaagucaguggauuuaccaugcgugcuucuaaguca

SEQ ID NO: 4114991 - RNA, 71 nt, Human
ugauguguggaagcugauauuaauuuaguacuuugagugucaaugugcaauguauaagauuucacacauua

SEQ ID NO: 4114992 - RNA, 60 nt, Human
ugaugugugguaucaguauuggggagaaacuuguaauaacuucaaaauugccacauguua

SEQ ID NO: 4114993 - RNA, 71 nt, Human
ugauguuggagucguaaggcauggagcugcagaccaugauguagaggaucaugcccaggcuccagauguca

SEQ ID NO: 4114994 - RNA, 68 nt, Human
ugauuaaagagauuaagauuugauacagugcacauaaagccuguaucaaaccaaauuaauucuaguca

SEQ ID NO: 4114995 - RNA, 65 nt, Human
ugauuagguuucuauugggaacuuugccaacaugcagcucccccucucuuugggaacauuaauca

SEQ ID NO: 4114996 - RNA, 60 nt, Human
ugauuauauucuaacuucauaacccuuuaacugggguuugugaagauaggauguauauca

SEQ ID NO: 4114997 - RNA, 66 nt, Human
ugauuaugcuaguauaguccuuagagucauuuacucauuucuuuagacucuucgggagcaaaauca

SEQ ID NO: 4114998 - RNA, 61 nt, Human
ugauucaauaggaauugaguagacucuguaagggagaguugucuugaaaucuuuugaauua

SEQ ID NO: 4114999 - RNA, 80 nt, Human
ugauucaauggggucaagaugaaccaggacauucauguucuaagcugcaugggauguccuguaccuacuuuauugaaaca

SEQ ID NO: 4115000 - RNA, 61 nt, Human
ugauucaauugaugguuucagaaaagcauucuggcugcugaauggaaaauggauugaauca

SEQ ID NO: 4115001 - RNA, 70 nt, Human
ugauucacuucagaauuccucagccucagcacuguugacauuugggguuggauaauucuuuguugaaugg

SEQ ID NO: 4115002 - RNA, 59 nt, Human
ugauucaguuaguagauuuggucaauuuaugcuaauuggcaaguaauacaauagaauca

SEQ ID NO: 4115003 - RNA, 68 nt, Human
ugauucucuuccuuuuuuccucugggcgguuaguacugcaugcaggaggagggaauaagaaagaguca

SEQ ID NO: 4115004 - RNA, 59 nt, Human
ugauucuucucuccuuauacccauccccagauggccucuuguaagaaguaggaggguua

SEQ ID NO: 4115005 - RNA, 70 nt, Human
ugauugcagauguguccugaucaauugagcugguuuuauuggccagaucugaggauacugagcagaguca

SEQ ID NO: 4115006 - RNA, 74 nt, Human
ugauugcuucuggcacuugagggggucugguaauggccauguguacuacuccgugagaaccagaaggcagauca

SEQ ID NO: 4115007 - RNA, 68 nt, Human
ugauuguauuuugucuuauagauugcggugaagacuggauuucauuaucuuuagacaggaagcaauca

SEQ ID NO: 4115008 - RNA, 107 nt, Human
ugauuguuuugauuguuugauaaauugguauauguguuagcacaaguguauuuauuauugcaaggcacaauaccuaaaaagccuuauugagauaauuaaaauacuca

SEQ ID NO: 4115009 - RNA, 60 nt, Human
ugauuuagcgggagcuuaauggugucacauguaagaaacacugcaguccccucugaauca

SEQ ID NO: 4115010 - RNA, 69 nt, Human
ugauuucaaggaguuuucacaguggaaauguacagacagcaaguauacuuugcagagccccuugaaaca

SEQ ID NO: 4115011 - RNA, 60 nt, Human
ugauuuccuuugcaaagacugugccuccaaauaaggucacauucuaagcaaugggguuua

SEQ ID NO: 4115012 - RNA, 59 nt, Human
ugauuucugaggcucugcccagacagcagugauugugccugggcuuucucucaaagaca

SEQ ID NO: 4115013 - RNA, 56 nt, Human
ugauuucugcaggauggacccugcucacucgacagaaucuacacccucagaaauua

SEQ ID NO: 4115014 - RNA, 78 nt, Human
ugauuugaggugguuuucaaggggauuuaacugaauucaggugucugauuuacguucccgaugaaagacuuaaaauca

SEQ ID NO: 4115015 - RNA, 55 nt, Human
ugauuuuaauugcucuauauaggaauuaagauuugugaagagaguaauaaaguca

SEQ ID NO: 4115016 - RNA, 98 nt, Human
ugauuuucccuucagagguguagauugcguaccuugcgugcagagauucaacguagucacucugcaagaugcaauauuaggcucugaaccacauuuca

SEQ ID NO: 4115017 - RNA, 60 nt, Human
ugcaaaacaaguguggcaaacucaugcaaauauccaucagaagccaccuuuuguugggca

SEQ ID NO: 4115018 - RNA, 109 nt, Human
ugcaaaaguauuuucuuugucaaaauguuuguauauuuacugagugcauuuucaaaugaccccugacacuuccgguaaaaaaugcuucuauuuugagaggguuuuugca

SEQ ID NO: 4115019 - RNA, 57 nt, Human
ugcaaacaggcauuucacaaacgguugguuucguguguuugugugggugcgugugca

SEQ ID NO: 4115020 - RNA, 102 nt, Human
ugcaaacuccuuuccaguugcaacuugaucagcauaugaguaagaagcaaguuaauugcuuuccgucaugugcuaaugaugcaucuuguaaaggacucagca

SEQ ID NO: 4115021 - RNA, 61 nt, Human
ugcaaagcacacccucagaguuucaagagaaacuuaccagacucugagagugugcuuugca

SEQ ID NO: 4115022 - RNA, 60 nt, Human
ugcaguguuccuguggguuuauauaucauuuuauauggacacacauaaauaccucuugca

SEQ ID NO: 4115023 - RNA, 90 nt, Human
ugcaguugggcagaaacauuggucagaguaaauuuauuucagggcugcuaguagccaaaugucuuucuuuuucagucucugcacacugca

SEQ ID NO: 4115024 - RNA, 75 nt, Human
ugcauaaaacagaguauuccucagucauuuuguaaaccuuuguucaacaaaagaaugaauacauuguguugugua

SEQ ID NO: 4115025 - RNA, 62 nt, Human
ugcauaauacguuuccuauaacuggggcugaaagagcuuaaauuagaguuagcuguuaugca

SEQ ID NO: 4115026 - RNA, 56 nt, Human
ugcauacugaaucugccaucacaucauuaaaugacaccaguggcaauuagaaugca

SEQ ID NO: 4115027 - RNA, 83 nt, Human
ugcauacugugcgaugauauugcauuuaggugaauuacucauaauuuaguaguuuagaauguugcaauacagcauauuacaca

SEQ ID NO: 4115028 - RNA, 69 nt, Human
ugcccuugaagacacuaaggcccagggaggggacaggccucccccaggucacucagcgucaagagggca

SEQ ID NO: 4115029 - RNA, 74 nt, Human
ugcccuuuggcugucccaaucauauuuguaggucaaaaaaagaccccauguguggagggcaugcauggagggca

SEQ ID NO: 4115030 - RNA, 67 nt, Human
ugccgcaagaccuaucuaguugcugugaauuaugccagggcgacaauggagagcguuuuuaauggua

SEQ ID NO: 4115031 - RNA, 76 nt, Human
ugccgcccaucccugagguuccuccugagcucugggcccagggcuuuagguccugcuaggguauguggccuuggca

SEQ ID NO: 4115032 - RNA, 105 nt, Human
ugccgggcauaaugggagauagcaaugacaaauauggaagccugauaauggaacaucuggucgggauugcagauguuauggaauggcaucccuauggugauggua

SEQ ID NO: 4115033 - RNA, 56 nt, Human
ugccgugucccauugugcucuggcugugaguuggagcuaguuuuagagcauaggca

SEQ ID NO: 4115034 - RNA, 86 nt, Human
ugccuaauaugggauuagugagaaagaaaucccuagcacucugaacccucagugacuacuggauuuguuucuccugcccucaggua

SEQ ID NO: 4115035 - RNA, 57 nt, Human
ugccuacauuccuugcuuaugggcucuuccuccaucuucuaagcuagcaguguagca

SEQ ID NO: 4115036 - RNA, 72 nt, Human
ugccuagcauaguauuugucacauaguaaucacucaauaaaucacauguugaauaaauaaaugugcuuggua

SEQ ID NO: 4115037 - RNA, 63 nt, Human
ugccucaggcaagucacuuaacaucucuugcucccccaggauguugggagaauuugugaggua

SEQ ID NO: 4115038 - RNA, 55 nt, Human
ugccucccuuuugcucuucuuaucucccuucugagaagccauagucugggaggca

SEQ ID NO: 4115039 - RNA, 78 nt, Human
ugccuccuuguuauugcaaaugguuuggucaucuucauucuuugcagaucacagucaauugcaaguuccaugggggua

SEQ ID NO: 4115040 - RNA, 67 nt, Human
ugccucucuucugcuguauguggaaggaaaccuauuucacauaccacagagugugcccugagaauca

SEQ ID NO: 4115041 - RNA, 71 nt, Human
ugccucuucucccaucuccaggcagguguaugccucacacugccuaggaaaagaauggaaacagaaaugca

SEQ ID NO: 4115042 - RNA, 55 nt, Human
ugccucuuggagccuuuccucuagucacuuccuaagaaaggauauaugggaggua

SEQ ID NO: 4115043 - RNA, 56 nt, Human
ugccugacucccaaagaggacgcguggcagaagagcugaucuuaagggagaaggua

SEQ ID NO: 4115044 - RNA, 69 nt, Human
ugccugaggauggugaaaguaauuuguauguguguauacauaauccugcuuuuucacuauuuccaguca

SEQ ID NO: 4115045 - RNA, 65 nt, Human
ugccugauauugccuguggaaaauaauuggacaaacauugauuuuuuauguugcuauaauaggua

SEQ ID NO: 4115046 - RNA, 57 nt, Human
ugccugccaggugcuucuucauuaucccuuccaugcaaugagcaacuuuagcaggcg

SEQ ID NO: 4115047 - RNA, 78 nt, Human
ugccugcucaauacacacucuucuugaacuuggaguacgcaaguagcaacagaaaauaggagugcagguagcagagca

SEQ ID NO: 4115048 - RNA, 58 nt, Human
ugccugcucuuaccacucuccccucuguguugcuggggcugggauggugggggaggua

SEQ ID NO: 4115049 - RNA, 86 nt, Human
ugccugcugcccccuuacugauaacugccagaggacaacauuauguuucaagucaguagcuaaucaugagaggcugguaguuggua

SEQ ID NO: 4115050 - RNA, 83 nt, Human
ugccugcuggggagugggcuaggaggagggcagcauguaggcuugggagcugccaucucucuucaacccuuaacuagcgacca

SEQ ID NO: 4115051 - RNA, 91 nt, Human
ugccuggaugcagcacuuuauaguagaaagagcauugaacugaaaagccauguccugaugcuuccacuaaugagcuguguuauccuaggca

SEQ ID NO: 4115052 - RNA, 66 nt, Human
ugccuggccuccugauucccuccuguccccuucucauuccccaggggcuuaucugaggccugggca

SEQ ID NO: 4115053 - RNA, 60 nt, Human
ugccugggaagcauggugaugguauuuugaaaaaggguaacauuuacaguuccuagagca

SEQ ID NO: 4115054 - RNA, 60 nt, Human
ugccugggacuguacuaaauuuggaaauaucgagacauacaagacuaguauccugaggca

SEQ ID NO: 4115055 - RNA, 64 nt, Human
ugccugggaucugugcccuuugcucuggaaacucuccaaauuaaaguggcuagaauuuuaggua

SEQ ID NO: 4115056 - RNA, 55 nt, Human
ugccugggugcccaaugaugagaccuccugcccgucucaugauggugcccaguca

SEQ ID NO: 4115057 - RNA, 60 nt, Human
ugccuggguguaaagggccaacaguuuacuaguuuacugggccccuaaaaauuuagagca

SEQ ID NO: 4115058 - RNA, 56 nt, Human
ugccugucacuugagaguucuguggcugugggccaaggacguacaggagauaauca

SEQ ID NO: 4115059 - RNA, 94 nt, Human
ugccuguggccaaauggaagaggugccacccagcuuuugugaugcagaaacguuuaaaggcuucggagugcacacuuuuuacaaaguuaaggca

SEQ ID NO: 4115060 - RNA, 95 nt, Human
ugccuguggggccaccuagauucucugcuggcugacauggacacauuuccaauggacagugugaagcagauagagcagaguguggauuacaggca

SEQ ID NO: 4115061 - RNA, 60 nt, Human
ugccuguguugauuacuuugucuaaaaagugauuugaaugaucuaggauuuauacaggca

SEQ ID NO: 4115062 - RNA, 73 nt, Human
ugccuguuuuguucacugcuaugaugaugauauuuauaaaagugccuggcacauaguaaguacuuaauaggua

SEQ ID NO: 4115063 - RNA, 91 nt, Human
ugccuuagagugcuaagaacagucuacccuccuuacgagacugaguguuuccugaaggcaggagcuguaucuuauugaacucuccagcgca

SEQ ID NO: 4115064 - RNA, 58 nt, Human
ugccuuagcuaccagguccuccaggaaacguucacacuggggaccugacuaauuggca

SEQ ID NO: 4115065 - RNA, 55 nt, Human
ugccuuaggaagcgggguguguccuugggcaaggcagcucuuuuuagcuaaggua

SEQ ID NO: 4115066 - RNA, 129 nt, Human
ugccuuccugagcaugugauuguacucuaguuggcucaugauacccaaguaccuagaaauauuuuugaagcuaugugucuguaugugugucuggguauguguuaggguuaagaaauguuaaggaauaca

SEQ ID NO: 4115067 - RNA, 77 nt, Human
ugccuucucccuggcuucugcacacggacgggucucuuuuggagcugaaagugugugaaaguuauuggagaauggua

SEQ ID NO: 4115068 - RNA, 55 nt, Human
ugccuucuuaauugagccuuucugggagcugcacaggcuggcuggaggagggaca

SEQ ID NO: 4115069 - RNA, 122 nt, Human
ugccuucuuccuggcuccggcugucaucacaguugagcagccuccgcucguggcccugccuguggcugcucuaauaacugugauucaaacagaaaugcugagaaagaucaggauucuaggca

SEQ ID NO: 4115070 - RNA, 94 nt, Human
ugccuugagaagagaagauggugaggcccgugaauaaucccuaaaggaaacuggauuuccuggcauuuacaaacccacccucuuugaaaaggca

SEQ ID NO: 4115071 - RNA, 74 nt, Human
ugccuugcagguuuuaaauacaucucugacaugcaaaauaaaucaaugucauaucauuuuagagcuugaaggua

SEQ ID NO: 4115072 - RNA, 77 nt, Human
ugccuuucuaaucgacugccauguuuagcgauuacuaugcgccaagcgcuuuacaggcacucucauuaaaauaggca

SEQ ID NO: 4115073 - RNA, 83 nt, Human
ugccuuugaagcaggagcucuuaaggaugugauuaacuuuucuuaacacagcuuuguguugcuccacuuguuauaaagaggua

SEQ ID NO: 4115074 - RNA, 61 nt, Human
ugccuuugcugauucucugcccuagggcccucccuuggggaucugaguugucaggaaggca

SEQ ID NO: 4115075 - RNA, 80 nt, Human
ugccuuugggagcuggaugcccuaaacugggguggcagagccaggucugucugcccuggggcaucaguuucccaucugca

SEQ ID NO: 4115076 - RNA, 67 nt, Human
ugccuuugguauuuuacaaugucagugagcuuuaaagagcuuuuaaacaaauaggauugccuaggca

SEQ ID NO: 4115077 - RNA, 104 nt, Human
ucgcuaagcagaugcauguaaaugagcuauuuucuaugcauggcuuccaaaagugcuaauuaaauaguugguauucaaggcuaugcucgcucauuguuuaguga

SEQ ID NO: 4115078 - RNA, 55 nt, Human
ucgcuacacucuugagucaauaugcuuaaugcguaagacacauuggaguagauga

SEQ ID NO: 4115079 - RNA, 63 nt, Human
ucgcuaggcccaguuccgccucccggaagccuuuccuccuucugagacgcuggggccugguga

SEQ ID NO: 4115080 - RNA, 116 nt, Human
ucgcuauuaaccagcauuuacaagggugugcugcuugggggugucugggcucccagggucuucucugaggugugcagucugcuaggcagggcauuuuuaugugguguauguacuga

SEQ ID NO: 4115081 - RNA, 76 nt, Human
ucgcucagucgcccaggcuggagugcaguggggcaaucuuggcucacugcaaccucugccuuccggguucaagcga

SEQ ID NO: 4115082 - RNA, 75 nt, Human
ucgcucuaucgcccaggcuggagugcagugaugagaucucagcucacugcaaccuccgccugcugguucaaguga

SEQ ID NO: 4115083 - RNA, 76 nt, Human
ucgcucuguugcccaggcuggagugcaguggcgcaaucuugggucacugcaaccuccaccucccggguucaagcga

SEQ ID NO: 4115084 - RNA, 76 nt, Human
ucgcucuguugcccaggcuggagugcaguggcgggacuucagcucacugcuaccucugccucccggguucaagcga

SEQ ID NO: 4115085 - RNA, 76 nt, Human
ucgcucuguugcccaggcuggagugcaguggugcaaucucggcucacugcaaugucuaccuccuggguucaagcga

SEQ ID NO: 4115086 - RNA, 121 nt, Human
ucgcugccgaaacgaucacccagucgcagucacuuugcucugauacacauuuuaaaaauguuauuggugucagugguaagguugggaguguguguauaucguguguuuaggaggguagaga

SEQ ID NO: 4115087 - RNA, 128 nt, Human
ucgcugcuugccaaaaauaagccgugaaacguauuucagaguagaucguuauuuacaugcuggcgaggagccacagaauaccauuuacauuugaaaauagagugcugcgaaguuuuuauaaguaguga

SEQ ID NO: 4115088 - RNA, 128 nt, Human
ucgcugcuugccaaaaauaagccgugaaacguauuucagaguagaucguuauuuacuugcuggcgaggagccacagaauaccauuuacauuugaaaauagagcgcugcaaaguuuuuauaaguaguga

SEQ ID NO: 4115089 - RNA, 95 nt, Human
ucgcuguagcaucugaaguugcucagagaguuucacaaguuuccguuuuaaugggucuugauuucucuaaggacugggggugguaggaacaguga

SEQ ID NO: 4115090 - RNA, 74 nt, Human
ucgcuucuguaguauucuuuuggucacagaggucagcuugauucagugugggaggaaacuacagaaauguguga

SEQ ID NO: 4115091 - RNA, 76 nt, Human
ucgcuugaacccaggaggcagagguugcagugagcugagaucaugccacugcacuccagccuaggugacagagcga

SEQ ID NO: 4115092 - RNA, 76 nt, Human
ucgcuugaaccuggaagguggaggcugcagugaggugagaucacaccacugcacuccagccugggugacagagcga

SEQ ID NO: 4115093 - RNA, 68 nt, Human
ucgcuugaaccugggaggcagagguugcaguuagccaaaauugcaccacugcaccccagucuggguga

SEQ ID NO: 4115094 - RNA, 68 nt, Human
ucgcuugaaccugggaggcggaaguugcagugagccgagaucgugcuacugcacuccugccugggcga

SEQ ID NO: 4115095 - RNA, 76 nt, Human
ucgcuugaagccgggaggcgaagguugcagugagccgagaucgcgccacugcacuccagccucggugacagaguga

SEQ ID NO: 4115096 - RNA, 76 nt, Human
ucgcuugagcccaggagguugaggcugcagugagcuacgaugaugccauugcacuccggccugggugacagagcga

SEQ ID NO: 4115097 - RNA, 73 nt, Human
ucggaaaugucagaaacgccgcagucugcgccacuuugaaaaaggggccucacagaugggcuuuucugccuga

SEQ ID NO: 4115098 - RNA, 129 nt, Human
ucggaaucaacuugggagcauuagaaaaguacugaugcuuggguccuaaccgagauauuuugauuuucuugguccuggggugcaggcugaccaaugggauuuuauuuaaaguguccuggguuauucuga

SEQ ID NO: 4115099 - RNA, 83 nt, Human
ucggaaugagcuagacuggaccugacccaagccuggccacggaauauguauggcaggguggagaggcuaaguccagugacuga

SEQ ID NO: 4115100 - RNA, 84 nt, Human
ucggacagcagagcuugaguuuaggcagcagugcuaugauucuucuuugaagaucaucaaucuacuuugccucucaguuuccga

SEQ ID NO: 4115101 - RNA, 79 nt, Human
ugcuuaagauaagcccauuaauuuuaccuuuguaaacauguuucagcaugacugugugauuaaggcuucauucugugca

SEQ ID NO: 4115102 - RNA, 66 nt, Human
ugcuuaaucaagaagccuauuuaauaauuucugagcacuugaguaggagauugauugauuaaugcg

SEQ ID NO: 4115103 - RNA, 76 nt, Human
ugcuuauagaucuuccauucauuuaagagaacuucuuauuacuagaaaguuggauggauuggaaugaaguauagca

SEQ ID NO: 4115104 - RNA, 96 nt, Human
ugcuuaucugcccugccuaauuucuuuuacagguuaccaaguuucaaaugaaggcacaggcagccuuguagaagaaaggggcaggaauaggaagca

SEQ ID NO: 4115105 - RNA, 66 nt, Human
ugcuuaucuuuucucucacuaggcuggagcuuaaguccacuuaugaggagaaaauauauaaaagca

SEQ ID NO: 4115106 - RNA, 77 nt, Human
ugcuucagcuauugacacugucccacagaauucgagggaccucaccuccucguuuuuggacgacagaggcugaaaca

SEQ ID NO: 4115107 - RNA, 78 nt, Human
ugcuucaggaagaaacgccagguacccagaagcaaguagaaaaguaaugaauauuaaugguguauuuaucuuggggcg

SEQ ID NO: 4115108 - RNA, 66 nt, Human
ugcuuccuagcaaucuucagccgcccagccagcaaagagggcugagcgcaugguugcuggggagca

SEQ ID NO: 4115109 - RNA, 129 nt, Human
ugcuuccuaucaagcagagugugccaaguucuccuuaaacuuuaucuugugagaauggagauugauaaacagagaaauaccuguuucaaaagaugaauaagguugauugcccgccagcaugaccaagca

SEQ ID NO: 4115110 - RNA, 56 nt, Human
ugcuucuaggacagcacaacuguaaaacuuuccagauugaggcaugucuagaagua

SEQ ID NO: 4115111 - RNA, 75 nt, Human
ugcuucuccauugaugcuaaguaugaagugucauuuauauugaaucugcacuaguauuuuucuuggaguaaagua

SEQ ID NO: 4115112 - RNA, 83 nt, Human
ugcuucugcuuuggucuagagucuaguguauacaaaguggcccacagagugggagaucaugaggacucagacuaacugaagca

SEQ ID NO: 4115113 - RNA, 60 nt, Human
ugcuucuggaaacaguggcuguuaggaaggcugccacccuacuguguuuccagaaaagca

SEQ ID NO: 4115114 - RNA, 67 nt, Human
ugcuucuuuguguaaauagcuuucauuuucuccaucuggaagugauuucugccugcauguuggagca

SEQ ID NO: 4115115 - RNA, 61 nt, Human
ugcuugaguucucuccccugcuguucaguuaauaagcuuaaaaguaggcugagauugagua

SEQ ID NO: 4115116 - RNA, 56 nt, Human
ugcuugauacucauugcaaggcuaaucauauuuggcuuguuucuauuuaucaagua

SEQ ID NO: 4115117 - RNA, 61 nt, Human
ugcuugauuagggaagucacaucuucaguuuuacuagauagugacuuuucaagucuuugua

SEQ ID NO: 4115118 - RNA, 59 nt, Human
ugcuuggcuucauuuaaguuuuagcuaauacuuauuaagcacagacacugagccaagua

SEQ ID NO: 4115119 - RNA, 97 nt, Human
ugcuugggaaaauagcugaaccaccuaaagcauauuuuaauuagccacaguggagcaaacacuaaauuaugcuuugggcucagcacaccuugaagca

SEQ ID NO: 4115120 - RNA, 58 nt, Human
ugcuugguugacaucugcaugcucacaggaucuuggaaagguaggucaguaccaagca

SEQ ID NO: 4115121 - RNA, 79 nt, Human
ugcuugugugggaugcuuaggaucuugcccuuaugguauaggcacaagaagggcaggcuccaagcauccuaugaaccca

SEQ ID NO: 4115122 - RNA, 87 nt, Human
ugcuuuaaaaaucucuuuucggauagacuggauauuuguagucuccaugucacagaugaggaauuuauuugguguagagauuuagua

SEQ ID NO: 4115123 - RNA, 70 nt, Human
ugcuuuaacauaagauaucuuuuaaauacuguauauguguuacugauagaaggguguuuuauguaaggua

SEQ ID NO: 4115124 - RNA, 90 nt, Human
ugcuuuaaucaggguuccugcaauuagcguauuaguuuauugguaaauaagcacugguuuguuaauucccucuagaaaucuuguuuagua

SEQ ID NO: 4115125 - RNA, 61 nt, Human
ugcuuuaccuuccauuuaaggaggaccagggaguuaggaacuucuugaggaaaguaaggca

SEQ ID NO: 4115126 - RNA, 79 nt, Human
ugcuuucaaacugcaacauguugcuuuaauaauauuuaacagaauauuuacgggacagcaguucuaguuguggaaugca

SEQ ID NO: 4115127 - RNA, 78 nt, Human
ugcuuucccugggugcugauuucacaggucuugguaacaccaugaaaugaaauagcaccaagguuuaacuuggaggca

SEQ ID NO: 4115128 - RNA, 71 nt, Human
ugcuuucuauccauugcccugcauuucuagugggugucuaaccuugauuccuacucaggcaaugagaaaca

SEQ ID NO: 4115129 - RNA, 62 nt, Human
ugcuuucugcucuggaaacaggacugggcaugcucuguguucuguaucuuagcagacaagua

SEQ ID NO: 4115130 - RNA, 79 nt, Human
ugcuuucugcuuugggaagaggaaucucuggaaagcuucauccaauucacaagaauucuagcucugcccaaggcaggca

SEQ ID NO: 4115131 - RNA, 55 nt, Human
ugcuuucuucaaccucauucugcagaaacaauugcugcagguguuggagaaggua

SEQ ID NO: 4115132 - RNA, 70 nt, Human
ugcuuugaaauagauuucucuggguuuguccuauauaggguuugcaaaccuucuugaaucugucucugca

SEQ ID NO: 4115133 - RNA, 56 nt, Human
ugcuuugaauaucacaaacuuucaauaaacuugagcccauaguggaguucaaagua

SEQ ID NO: 4115134 - RNA, 75 nt, Human
ugcuuugcacugugcuagaagccaggggcauagaacccuguccugugaguuuacauucuggccagagacaaagca

SEQ ID NO: 4115135 - RNA, 69 nt, Human
ugcuuugccugcuuugacucauuugauauuuacaaauaacuuaugauguaaagguaggauucaaaugca

SEQ ID NO: 4115136 - RNA, 80 nt, Human
ugcuuugccuuucuguaacaugggaggauugaggggcgugcccccagaaacaccuggauucuguuaauuaagguaaagca

SEQ ID NO: 4115137 - RNA, 61 nt, Human
ugcuuugcuuuauggucgcuuccuggauuacaaaaucagauagcguuugagagcauaagua

SEQ ID NO: 4115138 - RNA, 75 nt, Human
ugcuuuuaauaaucuaagagcuacgugucuuuaauauuuuaguggaccaagggagacucugggauuuugaaagca

SEQ ID NO: 4115139 - RNA, 89 nt, Human
ugcuuuuuagggcgaucuauaccauuucuuaggcauguuguagaugggaaucauacauguaacuaaguaaaagaucguauuaacuagca

SEQ ID NO: 4115140 - RNA, 55 nt, Human
uggaaaaacugagacuuagacacagguaagcugguccagagucuacuuuuuuuua

SEQ ID NO: 4115141 - RNA, 71 nt, Human
uggaaaaagaguucuaugaucuuuccagccacacaugugggaagggguggagggaguggaaauucgagcca

SEQ ID NO: 4115142 - RNA, 68 nt, Human
uggaaaacaggucucucagacccacccugccaagacccaggguggcucagugucaggcccugcgucca

SEQ ID NO: 4115143 - RNA, 68 nt, Human
uggaaaacuuuucuguguuguccgggauccaacauaggacauaucagcauucuggacagcagaaacca

SEQ ID NO: 4115144 - RNA, 72 nt, Human
uggaaaagcucauugauaaaaaguccugugugagcagagacuuuaaguaagucaaggagccagauuuaucca

SEQ ID NO: 4115145 - RNA, 105 nt, Human
uggaaaaggagacagauacccucuagucuuucucccuggcuuuggagaugaggaccccaaggcccagagagccaguuaguggcagauccccugccucccagucca

SEQ ID NO: 4115146 - RNA, 81 nt, Human
uggaaaauagguaguuuucugaaaauuacuuugguucucuaaaguacuaaugaauauuuugcagaaaaugaacaccuucca

SEQ ID NO: 4115147 - RNA, 72 nt, Human
uggaaaauuuuugugacuucuauagagucuguaaccaagaacaguauaccuaagaaauccagagauuuccca

SEQ ID NO: 4115148 - RNA, 65 nt, Human
uggaaacacucaagcuuauauuguaaauuaaauuaaagcaaugcagucuuuaugagguguuucca

SEQ ID NO: 4115149 - RNA, 55 nt, Human
uggaaacucagggccagaaggagauuucaaucauccucuugccuuugagugucua

SEQ ID NO: 4115150 - RNA, 58 nt, Human
uggaaacugugguauuucuuuaucucuucagaaugacauaaggauaccugaguuuuca

SEQ ID NO: 4115151 - RNA, 65 nt, Human
uggaaagaacucagccagaagcuucagagucacucucauggcuugucauguugauguucuuucua

SEQ ID NO: 4115152 - RNA, 90 nt, Human
uggaaagguaggaacuaagcaggcaggguggagaguuuucuguaagacaaaaacugucuggacacugcugcgguucuguuacaaagacca

SEQ ID NO: 4115153 - RNA, 61 nt, Human
uggaaauaaaugugccaagaucaagguuagggaaugaucucaggcaugguuuguucaucua

SEQ ID NO: 4115154 - RNA, 60 nt, Human
uggaaaucaugggagaguuggaaguacuguuggagcauuccaucuccuccuggcuuucua

SEQ ID NO: 4115155 - RNA, 77 nt, Human
uggaaaucauuucuuuaagugaaaggggauuaaaugguaccuauguaaauucuauacacuuaaaagauuaauuucca

SEQ ID NO: 4115156 - RNA, 68 nt, Human
uggaaaucuacuuuggguuagacacugugauaaaugucagugucugaaaagccuggaguugauuucca

SEQ ID NO: 4115157 - RNA, 65 nt, Human
uggaaaugccaucccucugucaccaauccacaguggguuuggggaggaggcauggccaacaucca

SEQ ID NO: 4115158 - RNA, 68 nt, Human
uggaaauuaaaauuccucuuaaaauagauccuuaguuuuuugaguuccuuaggagguuuuaauuugua

SEQ ID NO: 4115159 - RNA, 100 nt, Human
uggaaauuucuaaugcccuacugacauuuuucccuaagcauuuauacucccucuauaaauggagagaccauguccugugaugggauauaggagucagcca

SEQ ID NO: 4115160 - RNA, 59 nt, Human
uggaacacuuuguugaaaugcaaauagucucuggagaucacuuuuuaacaaagucuccg

SEQ ID NO: 4115161 - RNA, 55 nt, Human
uggaacagaggauguuugaaauucagaauucacuucugaauuaugccuuguucua

SEQ ID NO: 4115162 - RNA, 125 nt, Human
uggaacaugcaguguucuuuuuuccuuggcuuggguucuagagaauguuguuuccucauuugguaauuggagaguuaauaggguucuuugugaugcuaccguggaagagagacuguuuuauucca

SEQ ID NO: 4115163 - RNA, 59 nt, Human
uggaacauucaugcaccuuccuauccaccccacuggguaaagugcaugguuaugugcua

SEQ ID NO: 4115164 - RNA, 130 nt, Human
uggaaccgcauggggggcagcaggcaucagguggggagacccaggagcucugggguccucugcccccagggugcagucauuccacccuccugccccaugggauugugugcacccaaccccgcugugccca

SEQ ID NO: 4115165 - RNA, 80 nt, Human
uggaaccuuauuaaaaugaugauguagacauauauucaauuauauggaagcaaaauacauuaauuuuuaaaagguugcua

SEQ ID NO: 4115166 - RNA, 61 nt, Human
uggaaccuuccugccauuaaggugaggugacuuuucucuccugucuggugaggggguugca

SEQ ID NO: 4115167 - RNA, 57 nt, Human
ucucuuugucugcucuuaguugagcuucccuguaaagacugagucuagaccaagagg

SEQ ID NO: 4115168 - RNA, 75 nt, Human
ucucuuuuuagcuuuuauugaacagaauguaaauucauacuuuuaaauauuuuguucauaauggcaaagagaaga

SEQ ID NO: 4115169 - RNA, 74 nt, Human
ucugaaaacuucacauaaauagaucacaucaucccugaugauggugguauuuuuauaugugugguguuucuaga

SEQ ID NO: 4115170 - RNA, 95 nt, Human
ucugaaaauuuauuaaaaaucauugaguugcacuuuuacuaggggugaauuuuaugguauguaaauuguaacucaaaaaguguuaaaaaugaaga

SEQ ID NO: 4115171 - RNA, 129 nt, Human
ucugaaaucaacccugucuucuggggacucuuuaaaguguucauuuauucauucacucagucaauauuuauugaauagcugcuaugagaaaggcacugugauggcuguuagaggcaugagguuaaaaga

SEQ ID NO: 4115172 - RNA, 111 nt, Human
ucugaaauggaaagugucugauugguacauuacaguuugauugccaguauuuucuuguucuuagugguacaucaaaucaauguuccaguuuacaaucaaagucaucuuaga

SEQ ID NO: 4115173 - RNA, 58 nt, Human
ucugaaauuccuuccagacuuucaguucagaugaccuuugggacuuuggagauucaga

SEQ ID NO: 4115174 - RNA, 91 nt, Human
ucugaaauucuguaagucuaugguuguuuuguuccuggacccaguaaaaacaugcagaacagaauuaccgaagaucugacaaauuaucaga

SEQ ID NO: 4115175 - RNA, 55 nt, Human
ucugaacacugagugucaucacuugauuuucagcaucaagcacacuguguuuaga

SEQ ID NO: 4115176 - RNA, 57 nt, Human
ucugcucaauacugcucaugaacaccugucucuuguucauguugcaauuugagcgga

SEQ ID NO: 4115177 - RNA, 89 nt, Human
ucugcucaccagagcgccuugccacuagcaugcugucugggugugccuggcagucagagugugcaggccggcuuugacaaagugacaga

SEQ ID NO: 4115178 - RNA, 130 nt, Human
ucugcuccuguauuuucuacucagauguuaggcaguuuucuucauucugcugagcuucagaaucucagcugugaaauggggaugacacaaacuuccuaagguuuugguaaagacuugaugaaaugacgga

SEQ ID NO: 4115179 - RNA, 74 nt, Human
ucugcucuacuagauccaguuuguuuauuuucuugaaauaguugaugcaaauaaacagucuaguugaaaacagg

SEQ ID NO: 4115180 - RNA, 120 nt, Human
ucugcugagugauucuucugaaccuuguaauguuaacugaagccauucucggguauucaccuggccgacagacuaaagccucacuuagcuauauggcucagaagauuugacuuagccaga

SEQ ID NO: 4115181 - RNA, 57 nt, Human
ucugcugcaaaaggguugacugaugcucuacacaucagcaugacagucugcagcaga

SEQ ID NO: 4115182 - RNA, 77 nt, Human
ucugcugcuggcaugaauaccugaaaauccugggacugugggaugugguccaggcucucaggugucagcaucgcagg

SEQ ID NO: 4115183 - RNA, 56 nt, Human
ucugcuggcaauauugagaaaagaagcucucuuuuuccucaggaaugcuaagcuga

SEQ ID NO: 4115184 - RNA, 68 nt, Human
ucugcuuacucuuuugaugagcucaggggcugagaauuaugcacccagcugguaaaggggaaagcaga

SEQ ID NO: 4115185 - RNA, 58 nt, Human
ucugcuucuccuacuucaugggccaauguuucugagacacacagugggaggagaaaga

SEQ ID NO: 4115186 - RNA, 62 nt, Human
ucugcuugugucuguccagccucuggcuccacugcuuggcugagauccuggcccauaguaga

SEQ ID NO: 4115187 - RNA, 67 nt, Human
ucugcuuuauuacacuagccaaccuaggugccaccuggaguaauaggaaucuacugagugaaggaga

SEQ ID NO: 4115188 - RNA, 111 nt, Human
ucugcuuugggucaccucaccugaggacuacaucucaccuuccaggacacgcaggcaauggcuagugucuuggugagguguggggcucccugaacuggccucugcugcagg

SEQ ID NO: 4115189 - RNA, 93 nt, Human
ucuggaaaugaagcccugugauagguccagauuccuaugauaucaaagacacuacuaggcuuggaagaucuaacagaggcaucauagacugga

SEQ ID NO: 4115190 - RNA, 90 nt, Human
ucuggaagcaggcuggucccagagcauugccuaguacgcccauccuggaaaagcacuugagccuugggccgaccuggagguucuuccaga

SEQ ID NO: 4115191 - RNA, 55 nt, Human
ucuggaaguuagaggaggaaagauuagcauuuucaauuucugcugacuuaucaga

SEQ ID NO: 4115192 - RNA, 64 nt, Human
ucuggacaaagcagacaagauaauucaccuggaugugguggaaaaggucacugcuuugugagga

SEQ ID NO: 4115193 - RNA, 69 nt, Human
ucuggacuauaggcugccaagugcugcauaaauaaaucaucaagucauuuuggcauccugugggccaga

SEQ ID NO: 4115194 - RNA, 129 nt, Human
ucuggacuugccugggacaaauguaguagagggagggggcucgggccccacugagcucagggcuauucuuggagccugagucagcggaggcaaaggauuccugcccugcuuguccaggcagcaguuaga

SEQ ID NO: 4115195 - RNA, 60 nt, Human
ucuggagagucacagugccagaggaagcggagcagagggacuggcaguguggcuuccaga

SEQ ID NO: 4115196 - RNA, 59 nt, Human
ucuggagcauuuucugcuucugcuagaacaggcuagggaaggcaccaugguguuccaga

SEQ ID NO: 4115197 - RNA, 84 nt, Human
ucuggaggccuuuuacagaccauuaauugguagggcuauuacuaugcucucaguuaauggauucugucagauucaagcuccaga

SEQ ID NO: 4115198 - RNA, 76 nt, Human
ucuggaggcuggaagucugagagcaaggcauuagcagggcugguuucuccugaggccucucuucuuggcuuguaga

SEQ ID NO: 4115199 - RNA, 55 nt, Human
ucuggagggggaugccucaucccugacagaugugggucauggcugucccuccagg

SEQ ID NO: 4115200 - RNA, 59 nt, Human
ucuggaguaauuacagugacugccauucaugccuguucaguugcccugauuauuccaga

SEQ ID NO: 4115201 - RNA, 70 nt, Human
ucuggagucucugcucaggcaccagcccuggcaggcaucugacacaggguugggcucuggcauuuucaga

SEQ ID NO: 4115202 - RNA, 62 nt, Human
ucuggaguugagagugugcgagugaaaaccagcuucaucgcauuucccucuguagcuucaga

SEQ ID NO: 4115203 - RNA, 70 nt, Human
ucuggaguugcauguuuuggcuaacucaugccggcauguauacugcaaacaaaaccugcuuaacuucgga

SEQ ID NO: 4115204 - RNA, 101 nt, Human
ucuggauccuuucuacaggugaucugugugguaguuucagugaacagcaccagcacuguucaaugaagcuaccacacaaauuaccuguagaauccucuaga

SEQ ID NO: 4115205 - RNA, 60 nt, Human
ucuggaugcucugagcccaaggaauaaguaacucauuuccugggcucaugguguuacaga

SEQ ID NO: 4115206 - RNA, 58 nt, Human
ucuggauguuaagacaggggaacaaccgcaaguuccccauuuucauguuaacuccugg

SEQ ID NO: 4115207 - RNA, 86 nt, Human
ucuggauuacggugagugucaguuugcuaugugcuaaguaccacaaccuggguaucuucaacaacaaauugccucaaaguucugga

SEQ ID NO: 4115208 - RNA, 79 nt, Human
ucuggauuuguugauugacuuuagaauagcacugcugucacuccugcagugcugugggaggagucagagauuaugcaga

SEQ ID NO: 4115209 - RNA, 62 nt, Human
ucuggcaaauguggauguuuucauuguuuuauucauuaggaaacaguucucauuuguuuaga

SEQ ID NO: 4115210 - RNA, 79 nt, Human
ucuggcauauagucaaccuuguaauuagccaugugauucuaguuuaaaugucuaauuuagugguugauuuuagacuaga

SEQ ID NO: 4115211 - RNA, 74 nt, Human
ucuggccaacugcuugcagaagauugugagggccaaacacuacaaauauuugucugaggcgguuguuauccaga

SEQ ID NO: 4115212 - RNA, 68 nt, Human
ucuggccaugauuagcugaucucaguugagcuuauucauauaucugaggucaauuaaucaacaacaga

SEQ ID NO: 4115213 - RNA, 55 nt, Human
ucuggcccagccccugaggucagguggaugaucuaugcugguugguuggacuagg

SEQ ID NO: 4115214 - RNA, 81 nt, Human
ucuggccccaaaugucaauaguacugagguuaagaaauccugcuacagucugauuguccauuuggcuacuuuuggcccaga

SEQ ID NO: 4115215 - RNA, 80 nt, Human
ucuggcggcaccaucuuggcauuuacacucuacagaaaagguaccugaggagaaagaugguccaaguuacuugccacaga

SEQ ID NO: 4115216 - RNA, 86 nt, Human
ucuggcuaaggcuauugggaagaaaaauguuugcuauuuguuuucguuuaacuggcccaucauucuccuaaauagcuuuagagaga

SEQ ID NO: 4115217 - RNA, 71 nt, Human
ucuggcuccaggcauagaaggcacgcacugggcuaagaaaccugggugugaauauaugaccuggggcaaga

SEQ ID NO: 4115218 - RNA, 80 nt, Human
ucuggcucucugucuguuauugguguauaagaaugcuugugauuuuuacacauugauuuuggauccugagacuuugcuga

SEQ ID NO: 4115219 - RNA, 56 nt, Human
ucuggcugauuaucagaaucugagacccaacccugagaaauuuugauucaguagga

SEQ ID NO: 4115220 - RNA, 95 nt, Human
ucuggcugcacugggguagaggguguuuggcagagcauggggaugacauugucaucagagcucccccaaacgucacucccugccucccagcuagg

SEQ ID NO: 4115221 - RNA, 63 nt, Human
ucuggcugccauuugccccagcacugucuccauggaggucaauguacuguaauggcuaucaga

SEQ ID NO: 4115222 - RNA, 59 nt, Human
ucuggcugcugcgugagugcuuuauugauuacagagcaccgaucaaauuagcugucaga

SEQ ID NO: 4115223 - RNA, 56 nt, Human
ucuggcugucauuggaggccccccuauuuugaggaccuggcuuuggaacagccgga

SEQ ID NO: 4115224 - RNA, 105 nt, Human
ucuggcuugguuucuaagagcuuuuuggcuuuuaugcagcuuagguggucuauuucaucuagauuagguauaagagcuucaaaagcuaauggcagggcugccagg

SEQ ID NO: 4115225 - RNA, 69 nt, Human
ucugggaacagcuuagcuccagcgcaggaccuccaugaggcagcggucaaggggcaggcugaguccaga

SEQ ID NO: 4115226 - RNA, 62 nt, Human
uggaacugguuugcuucagacuucaaaaccacuugugacaucuguggcaaacacagugacca

SEQ ID NO: 4115227 - RNA, 130 nt, Human
uggaacuuugaaagugugagaaaaaucucaaaucacuuugacagcauuuuaauuauaguugauuuguuugccgcuaauagugaaaaugcugucagcaugauuugagauguuucuuccacucaaaauguua

SEQ ID NO: 4115228 - RNA, 59 nt, Human
uggaagaauguucauuaaacuguugaagacaguuauuucaggaguguagcauuuuuuca

SEQ ID NO: 4115229 - RNA, 98 nt, Human
uggaagaccaguuccaggaauucagcucucagucacgaccuggggcccgucucagccuggagaugcugagaugcuguuuccuggaaaacaggguccca

SEQ ID NO: 4115230 - RNA, 57 nt, Human
uggaagagaaaauccacccuuacuccaucaggguauuggccuucuguuuucucucca

SEQ ID NO: 4115231 - RNA, 61 nt, Human
uggaagagaccucaugaguugugccguccaucaccuuggcauaacaucauggcucuuucca

SEQ ID NO: 4115232 - RNA, 69 nt, Human
uggaagagugucacugaauuuaugcauguucuaaagacaggauuuucauaugaaaguagacacuuucca

SEQ ID NO: 4115233 - RNA, 56 nt, Human
uggaagaugcuugagaacuguuugaauugaauuucauucaaggcugguaucuuuca

SEQ ID NO: 4115234 - RNA, 63 nt, Human
uggaagcaaguaaaauuuuacuagguggccuuagagggaacccgugguuuuauacuacuucca

SEQ ID NO: 4115235 - RNA, 55 nt, Human
uggaagcaucuguagauauuaggcccccugggauuauguaugcaaaugucuucca

SEQ ID NO: 4115236 - RNA, 71 nt, Human
uggaagcauguugauuuucgcugggguccucccuaauucccccuggcccuguuaaugucaaccugccucua

SEQ ID NO: 4115237 - RNA, 75 nt, Human
uggaagcuguccugugaccuggcaccacagcaggcugugugcugccuccucgugugcgcaucacaagaagcuccg

SEQ ID NO: 4115238 - RNA, 83 nt, Human
uggaaggagaauaauagugucuguccaucaguaacuaggucucaugcuuuacaaaguucacuggauggaagauuuuccuuuua

SEQ ID NO: 4115239 - RNA, 94 nt, Human
uggaagguggcagugaaugagagacuguucugcuccugguuguggccaauugugcuuugucuguagcuguggagcagaggucucccgcucucca

SEQ ID NO: 4115240 - RNA, 83 nt, Human
uggaagguuacugucuugcuaggagcuauggaagacagaagagaaaucuaaguuuucucugcuucugagaaaguuacagucca

SEQ ID NO: 4115241 - RNA, 91 nt, Human
uggaaucuccuggauauauauuauaauuaaaauuuuggaggcagaugaguuccuccagagagaauauguaguauggaaauagaagaauuua

SEQ ID NO: 4115242 - RNA, 63 nt, Human
uggaaucucuuugucccugaguuucagaagcaaauagugaagcuuugggcagaagaggauuca

SEQ ID NO: 4115243 - RNA, 67 nt, Human
uggaaucugcuguugugaagauucucacuaccaaggaugaggagccacucuagcagucagaucucca

SEQ ID NO: 4115244 - RNA, 85 nt, Human
uggaaugugccuaugccuguuaaugucuuaugcuauuuauagcuuguucuugcauaauacauguaacugcauuguaaucauuuua

SEQ ID NO: 4115245 - RNA, 126 nt, Human
uggaauuaaauugaaugcaaugaauugagugaagagggaugauaaagugugaggaacccugcucaacaccuuccuuuuaguauccuaucucauuuaauccauuuaaucauuuaauaauuuaaucua

SEQ ID NO: 4115246 - RNA, 87 nt, Human
uggaauuaggagcaucuucugaaacuagugggaaagagcugaaucuaucagaacuucucaguugcaagugucagaaaccuaacucua

SEQ ID NO: 4115247 - RNA, 70 nt, Human
uggaauuauaaaugccaggacuuuagaucccauaagcaauggggucagguggagggcauauaugguuuca

SEQ ID NO: 4115248 - RNA, 59 nt, Human
uggaauuaucugaagugauuugaugacuuuucacauuaguuuucauuucaguaaaucca

SEQ ID NO: 4115249 - RNA, 60 nt, Human
uggaauucaguggccagacaugaugcuuguuggcaucacauaguggggcauuggaaucca

SEQ ID NO: 4115250 - RNA, 74 nt, Human
ugcaaaaaguuaccucuguaauauaagauuuuguauaaauuuuauaaauuugugucauaggguaauuuugucca

SEQ ID NO: 4115251 - RNA, 76 nt, Human
ugcaaaagcaggacguauuucuauccuagcaacaggguguuuucacaggauagucaauauguucucagucuaugua

SEQ ID NO: 4115252 - RNA, 77 nt, Human
ugcaaagaaagcacgauaguagcaaaagugacuguuaauaauuugugacuacauuguucuuuucuuuuccuuuugca

SEQ ID NO: 4115253 - RNA, 99 nt, Human
ugcaaagaagaguuguagauugaaugaucacugcaguugaugaggcauuucucauugccuacugcagaaaugauuuuccuaucuaccauuguccaugua

SEQ ID NO: 4115254 - RNA, 80 nt, Human
ugcaaagauuauuuugacuauuaaaccaacagaaucuuaucagagacccauguggcaaauggucaggaagaaagucugca

SEQ ID NO: 4115255 - RNA, 63 nt, Human
ugcaaagcugugcaggaacugcuugcuuggaacuugcuuccaaggcagaugcagagcuaugca

SEQ ID NO: 4115256 - RNA, 97 nt, Human
ugcaaaggagaaugagaagagugugguucuugcccgcauggagcugugucaggcaucaugcuaaaugcuggggguacauccucauuuuacucuugca

SEQ ID NO: 4115257 - RNA, 77 nt, Human
ugcaaaugaucuaucaguuuugggggacauacugacucaaugaagauccaguguugucuuucaaaauuucauuuaca

SEQ ID NO: 4115258 - RNA, 89 nt, Human
ugcaaauggagggcagacugagagugcaucacccucucacaucucagagucuaaaaggcggccuuucagugccuucuguucaaauugca

SEQ ID NO: 4115259 - RNA, 94 nt, Human
ugcaaaugguauuuugcuauuuguuucuaaaaguugaaaaugaccuugcacguuaaaaaucaucaguuuagaaaaaauaugaagucuguuugca

SEQ ID NO: 4115260 - RNA, 68 nt, Human
ugcaacaccaguucagaagaaucuguuuccccaguaacucagaauucuguaauugaacuguguugaca

SEQ ID NO: 4115261 - RNA, 88 nt, Human
ugcaacaguaucuaccauuguuugaacacaacucagaaugcugguaaaaggauuacugauucugaaguguuugugauauugaauugca

SEQ ID NO: 4115262 - RNA, 123 nt, Human
ugcaacauuuguuucauaagugcuuuguguuuagcaacacuguauucacgaccuuguuggcuugcauuugcauguuuuauaccaaagcuuauacuguacuaugugaagccaucagaagucgca

SEQ ID NO: 4115263 - RNA, 71 nt, Human
ugcaacuccuaagauguggggacagagcccagaacaaaguaggguagacuguuauauucuagggagcugca

SEQ ID NO: 4115264 - RNA, 73 nt, Human
ugcaagacacauugcuuccugucugguuuauacucucuacagugagucaggcauagguaggauguuucuagua

SEQ ID NO: 4115265 - RNA, 63 nt, Human
ugcaagaccauccuaaagauagacaucugggucaucagcugugugugcuugggauuaugugcg

SEQ ID NO: 4115266 - RNA, 64 nt, Human
ugcaagaggauuguaucaauaagggacuucagaucuugccccugagaaauauacucuuuuugua

SEQ ID NO: 4115267 - RNA, 83 nt, Human
ugcaaggcuguaugaguaauuuauccagugaaguaaugcccuuagcaucucuuacugucuggcaauuaagaaucacccuugca

SEQ ID NO: 4115268 - RNA, 61 nt, Human
ugcaagggugugaaccaaugagauucuacugugugucaugcagguuuguuauagacuugca

SEQ ID NO: 4115269 - RNA, 92 nt, Human
ugcaaguacuuuuugagugucggcccauauuuuauuugucaugucccacgggucaaggcaagucauaugggcaagcagggugggaaguugca

SEQ ID NO: 4115270 - RNA, 56 nt, Human
ugcaaguagaguucacuugucuuugucuugaaagcaaagauuucuuuucucuugca

SEQ ID NO: 4115271 - RNA, 55 nt, Human
ugcaaguccucaaagggcucugcuuuucauaggaagcaaaauccaagcacuugca

SEQ ID NO: 4115272 - RNA, 63 nt, Human
ugcaagucugucugcuccugugugucugcccagaggacaccucuagagaaugagagauuugca

SEQ ID NO: 4115273 - RNA, 71 nt, Human
ugcaaguuuuccuggacacucauagaaauuguugagcagcaaauacuuucuagguguucacagagcaugca

SEQ ID NO: 4115274 - RNA, 58 nt, Human
ugcaauagaagauuucuggcuuauugaaauaccaauuggcuuccauuuucuguuugua

SEQ ID NO: 4115275 - RNA, 65 nt, Human
ugcaauagaguaguaucuagaucauucauaacagaaauagcugaaugauuugggugcauucagca

SEQ ID NO: 4115276 - RNA, 121 nt, Human
ugcaaugacuuaaaauuguauuaccugaauagucuccauggugaagugucagaaaaggugaaauaauaaauauuuuccacagcaccauaagauuuuauaaaauacuauuucaguuaaugua

SEQ ID NO: 4115277 - RNA, 64 nt, Human
ugcaaugcaaugcaaugcaaugcaaugcaaugcaaugcaaugcaaugcaaugcaaugcaaugca

SEQ ID NO: 4115278 - RNA, 78 nt, Human
ugcaauuaucguucucuuugucuuuaugguuuuuaugcucaggauaagaagcuauacagcaggagaauggaaagagca

SEQ ID NO: 4115279 - RNA, 86 nt, Human
ugcacaaguggaagagaguuuaacacaagaaaaguuaggaaaaucugauuuggcuuggaugauuaaacacuuuggacaacuuugca

SEQ ID NO: 4115280 - RNA, 58 nt, Human
ugcacaauuuaaauaaauacuugaggccagugguuuucagaguguggugagaugugca

SEQ ID NO: 4115281 - RNA, 86 nt, Human
ugcacacacgcucgagucuauuuauagacagauccuaaugauauguauugcauucugaacguaaaugugaaaugugugugugugca

SEQ ID NO: 4115282 - RNA, 106 nt, Human
ugcacaccuaagauuuggacaagcuggucuccaggugauauuuugacauucuucagcugaagaguguguucuuuaugcugugaucagaaugucccucaugugagca

SEQ ID NO: 4115283 - RNA, 66 nt, Human
ugcacaccucuccaccacucuccacuauaucuccagugcuuguugggugggggugggaggggugca

SEQ ID NO: 4115284 - RNA, 98 nt, Human
ugcuguaagaauggcaguuccagagugucaccuggaucacgaaagaagcacuuguguguuaaggcacugauaucugagaguuguuuuuuauugcagca

SEQ ID NO: 4115285 - RNA, 68 nt, Human
ugcugucuccauagaagagacugcaguuggcuuccagaaacgggugcagccugacuaggagaagagca

SEQ ID NO: 4115286 - RNA, 58 nt, Human
ugcugucuguguuaaaguguuuuuuaaugaauuauagacauuauaacacagagcugua

SEQ ID NO: 4115287 - RNA, 59 nt, Human
ugcuguggcuuaggaggauggcagggcgcuccguguccuggcauccgugggucugugca

SEQ ID NO: 4115288 - RNA, 56 nt, Human
ugcuguguaccacuagaaugcaagcucagugaggcaggaacucaggguaggcagca

SEQ ID NO: 4115289 - RNA, 56 nt, Human
ugcugugucuuucugugaaaagagaaacauuaucucuuuuuacucguucauaugca

SEQ ID NO: 4115290 - RNA, 61 nt, Human
ugcuguuagguuccuggucucaugcuaccuacuucucaaaaggcucagagaucaaacagua

SEQ ID NO: 4115291 - RNA, 71 nt, Human
ugcuguucagaagagccucugugggagaacccagggugggugcggaggggauacauuuucugaacaaagca

SEQ ID NO: 4115292 - RNA, 71 nt, Human
ugcuguucugauucuguccugcucuugauggaaaugaguuauucaagaggcaagauuaucagggcauagca

SEQ ID NO: 4115293 - RNA, 78 nt, Human
ugcuguugugaauagugccgcaauaaacauaugugugcaugugucuuuauagcagcaugauuuacaauccuuugggca

SEQ ID NO: 4115294 - RNA, 66 nt, Human
ugcuguuuccagccuagagauggugaggggacuuuuccuuggcucuuuccuggccugcuagcagca

SEQ ID NO: 4115295 - RNA, 73 nt, Human
ugcuuaaaaugaugauuauuuuagguauucauagaaaauaucuacauggaaaaagugaugauuauuuuaggca

SEQ ID NO: 4115296 - RNA, 60 nt, Human
ugcuuaaagcugcucaguuguaggguuaaauuaguuccuucagucugaguacuuaaagua

SEQ ID NO: 4115297 - RNA, 68 nt, Human
ugcuuaacagagugccuggcauguagcgccacgcugcggacugucggccacugcuguuccuacccgca

SEQ ID NO: 4115298 - RNA, 77 nt, Human
ugcuuaagacugucuuuaagggacugaauuuggcaauacacagaugaaaugucaaauugggauccucagacaaagca

SEQ ID NO: 4115299 - RNA, 74 nt, Human
ugcuuaagagaaugucaggaguggauugucccugugacuuuaaugguaauucaucuuugagacacuuucaagua

SEQ ID NO: 4115300 - RNA, 57 nt, Human
ugcuuaauauugugauguaauauuuggcuaauguauguguauauugcaauguuagca

SEQ ID NO: 4115301 - RNA, 56 nt, Human
ugcuuagccauugucagcacauggcuuucgccuuguguuuuaagauggcugcugca

SEQ ID NO: 4115302 - RNA, 90 nt, Human
ugcuuaucacuauuauugugcuuaaaucuaaaugucauauacuuagcaaaaggagauacugcuaaguuagagguuaggcacuuaaaagca

SEQ ID NO: 4115303 - RNA, 71 nt, Human
ugcuuaugucaugcauuucagagacucaaucugagcaaaaauuucucagugaagaguauaacaaauaagca

SEQ ID NO: 4115304 - RNA, 66 nt, Human
ugcuuaugugaaugcauguaugcguauguguauauauacauaugcaugcauuguuuaucaugggua

SEQ ID NO: 4115305 - RNA, 63 nt, Human
ugcuuauugauuaauacuuuugacguuuauuuucaucguuaagguguuuguuuucagaaagca

SEQ ID NO: 4115306 - RNA, 68 nt, Human
ugcuucaaccuugaaagcauggaguucucugcuuucagggaacuccagaugacucaggaacagaagua

SEQ ID NO: 4115307 - RNA, 69 nt, Human
ugcuucagacugcagauuuugaugaauguggaaaaauuuucuuggagcucuuagggucguuuuggagca

SEQ ID NO: 4115308 - RNA, 80 nt, Human
ugcuucagcccaucccaguacaucgcauggugaccaaaagauguagucguccuggcacaguggguguggggcaggaagca

SEQ ID NO: 4115309 - RNA, 89 nt, Human
ugcuucaggaaccauuuaaggguauaaagcccauuuuaaagucuuugcugccaaaaugggcuuuauaccgucagcugauuccugaagua

SEQ ID NO: 4115310 - RNA, 76 nt, Human
ugcuucaguuucuguggucucuuuucauccugcuugaagauucggaguguggaaggaggcuaggaagucuggugca

SEQ ID NO: 4115311 - RNA, 70 nt, Human
ugcuucauuuccuuauauuguaaaaaugucaacuguagugagacaccaaaugcugugaggaaugacagca

SEQ ID NO: 4115312 - RNA, 68 nt, Human
ugcuucauuuuuuuguaugucauuauuguuuuuacuuaagcaaagcucaugacauuacaggaggagca

SEQ ID NO: 4115313 - RNA, 72 nt, Human
ugcuuccagaccuuuagugucauguuauauuugaccugggauauucauaugauguugagggacauggaaaca

SEQ ID NO: 4115314 - RNA, 80 nt, Human
ugcuucccaucucccucccaccuccacucaagguacuuggaagagggcuuuuucgaggugugaggaaugaauggggagca

SEQ ID NO: 4115315 - RNA, 108 nt, Human
ugcuucccugaguuaauuuuaugccaggugaggucuuuuauagugugucaguuuguuugcuggacccuaagaagaccuucuggcauguaauaccguuaacucacagua

SEQ ID NO: 4115316 - RNA, 64 nt, Human
ugcuuccugggauccagucaaaguaucuuaaauaacaauuccacuuagacuuuuccagcaggca

SEQ ID NO: 4115317 - RNA, 71 nt, Human
ugcuuccuuguagauauaaucuaaaauuguucagcagagcaaauggguuuauauuugacaacuagggagca

SEQ ID NO: 4115318 - RNA, 81 nt, Human
ugcuucgcggccugauccugucuccgcaccguguugcuaggugauucucaacaccgcgggguuuagggaaacaugggggca

SEQ ID NO: 4115319 - RNA, 92 nt, Human
ugcuucuccuaaauucuggggcugguuauuuugauuaauauugagaagcugugggaaugacuucccuagaaaucuugacuagguuagaagca

SEQ ID NO: 4115320 - RNA, 83 nt, Human
ugcuucucucauauuccuucuuugagaauaagcacauaaugauauauuugcuugaaagugggaaggaacaaaugagggaagua

SEQ ID NO: 4115321 - RNA, 66 nt, Human
ugcuucugacugggucaguugaacuagcaauucucuagcugacacaauacuuccuuguuagaggca

SEQ ID NO: 4115322 - RNA, 71 nt, Human
ugcuucugugcucgagccaaccacacguauacuugaacacgaaggaaugugcuugagcauuaaggaaugua

SEQ ID NO: 4115323 - RNA, 69 nt, Human
ugcuucuguuaacuuauguucccagcuucauuuuauuauugggaaugaccuuaauaaguaggcaggaca

SEQ ID NO: 4115324 - RNA, 71 nt, Human
ugcuugagcccagguugaggcugcagugagcuguaagcaugccacugcacucuagccuaggugacagagca

SEQ ID NO: 4115325 - RNA, 76 nt, Human
ugcguggccugcuggccaggcauccccugauccuagcaugguugcuggagggaugcucuguggugccugucaugca

SEQ ID NO: 4115326 - RNA, 76 nt, Human
ugcguggugucuuuguggaagccuguggaagaaauuucugcucuuaguagaaaauggguuucuucaaccucaugca

SEQ ID NO: 4115327 - RNA, 75 nt, Human
ugcguguauugacugcaccugcagggguauagcuggagaacacccagugagcaucuucaggagccaagucacgca

SEQ ID NO: 4115328 - RNA, 70 nt, Human
ugcguuacguaccugcagggucaugggccaccugugagggugcugccucaacugucaggaacaggacgua

SEQ ID NO: 4115329 - RNA, 67 nt, Human
ugcuaaaagucuugauccagaugaaaacuccgaauuguucuggcauugcauuaaggcuuugauagua

SEQ ID NO: 4115330 - RNA, 91 nt, Human
ugcuaaaauauaaauuugacacagugaagcucagcauaaauuuauucaauagauuugucagcucagucuuuauugucagguucuuguagca

SEQ ID NO: 4115331 - RNA, 65 nt, Human
ugcuaaguacuuugaaggguuaauauggaaauuccuauaggaaacuugcuguaaaguucuaggca

SEQ ID NO: 4115332 - RNA, 74 nt, Human
ugcuaagucuuucaaaguuugcuuuggauuaaaagaacaaaaagaguuguccaggagcaaaugaugagacagca

SEQ ID NO: 4115333 - RNA, 99 nt, Human
ugcuaauacaugccuuuggagaauccaacaugcaaacaagaaaauauacacuucuggcaauguggucuucuucaguuuggcagauaaauagacuuagca

SEQ ID NO: 4115334 - RNA, 59 nt, Human
ugcuaaucagauuaaaauaugugcaaggaaauuauacuuaugcauuuuaaucugaggca

SEQ ID NO: 4115335 - RNA, 75 nt, Human
ugcuaauguuucauuuuuagauuuacaaaugaggggaaccuguaaaaggaggauugaaaauggaaaacauaagua

SEQ ID NO: 4115336 - RNA, 92 nt, Human
ugcuacagauaccacacagauuugugaacuagaaaaaucaugaacacuaguugcuuuaagacacuaaguuugaggugguuugucuuguagca

SEQ ID NO: 4115337 - RNA, 82 nt, Human
ugcuacaucaaguggccaucccucagguaggcagguucccuuagccgccagccagagaggcaugguuagguucugauaagca

SEQ ID NO: 4115338 - RNA, 69 nt, Human
ugcuaccgaacagauucaucuaguggcuacaucagcaccuugugcuuucagauaucuguuucaauggca

SEQ ID NO: 4115339 - RNA, 72 nt, Human
ugcuaccuuacucagcuaaugagauauucaaauauauaguuuugugaauauguuucaaguuguaagguauca

SEQ ID NO: 4115340 - RNA, 63 nt, Human
ugcuacuacuugucaacggucacaauacaccaaauuuaggacuuuaaguggcaagugcuagua

SEQ ID NO: 4115341 - RNA, 119 nt, Human
ugcuaggauggcuuacagaacacaggaagacacucauuaucacugguuuauuauaaaggauuuaaaugaauagccagaugaagagguccuuaagcugaaguccaggaggguuccuagca

SEQ ID NO: 4115342 - RNA, 95 nt, Human
ugcuaguaaauuauagaaguggaagccaaagucuugacagugaccuucaauguccuucccgacuggcucacuccacuccuaugacuuuucugaca

SEQ ID NO: 4115343 - RNA, 77 nt, Human
ugcuauauuugacaaaggaaaaaugcacauaccuaaaauucaaaggcauugcauuugcucauuugauaugcuuagca

SEQ ID NO: 4115344 - RNA, 58 nt, Human
ugcuaugaggcuuuuuugaugaaguuuaaaaagcuucuucaauaaauucccauaagca

SEQ ID NO: 4115345 - RNA, 92 nt, Human
ugcuauggaguguuaauaggcuucuaacauagcugucauuucaaguaauaggugccaagcuuucagcagcuuauuaacacauuauaacagca

SEQ ID NO: 4115346 - RNA, 84 nt, Human
ugcuauggcucaauucauagaguugacacaguuuaacagguggacaguaucauguaucuaagauuagucauuguuguuauagca

SEQ ID NO: 4115347 - RNA, 57 nt, Human
ugcuauuaucagaccuuuaaauuuuugcuuuaaauuuuuuagggguaugaaguggua

SEQ ID NO: 4115348 - RNA, 77 nt, Human
ugcuauugugaauagugccgcaguaaacauaugugugcaugugucuuuauagcagcaugauuuauaauccuuuggua

SEQ ID NO: 4115349 - RNA, 78 nt, Human
ugcuauugugaauagugcugcaauaaacauacgugugcaugugucuuuauagcagcaugauuuauaauccuuugggua

SEQ ID NO: 4115350 - RNA, 78 nt, Human
ugcuauugugaauagugcugcaauaaacauacgugugcaugugucuuuguagcagcaugauuuauaauccuuucggca

SEQ ID NO: 4115351 - RNA, 102 nt, Human
ugcuauuuaauaauuugcaaauguuauacugccaguugauauuuuauaacuaccaaauuuaagugcaguaaaugggcauuaugcuuguuuaaaugucuggca

SEQ ID NO: 4115352 - RNA, 92 nt, Human
ugcuauuucuaauugguuuuguuaucuccauucuuuguguuguauuucccugagguguggagaaguuaaggccagaguuaacguuuauagca

SEQ ID NO: 4115353 - RNA, 65 nt, Human
ugcuauuucucugcuguaaaauugaccauuuaacauggaaaaauuauucuugcuggcagggagca

SEQ ID NO: 4115354 - RNA, 78 nt, Human
ugcucaagagauauaaaaaugugggccauauguagccccaagaaaugcauuuuaucacauuuucauauucucugagca

SEQ ID NO: 4115355 - RNA, 76 nt, Human
ugcucaagcuuguaauagauaggaucaaaugaguaauuaaucauuaauuuggcuucucuaauacuauagcuugaca

SEQ ID NO: 4115356 - RNA, 63 nt, Human
ugcucaauacuuaagcuuaauucuacuuuuacuugcuaagguggaauguagcaaguguuguca

SEQ ID NO: 4115357 - RNA, 59 nt, Human
ugcucacagcccagaacauaauaacuuuucuuuuauucugguacuauugcuguugagca

SEQ ID NO: 4115358 - RNA, 57 nt, Human
ugcucagacuagcuccagggaaggucugugucucuucccucagaugagcuccuagca

SEQ ID NO: 4115359 - RNA, 63 nt, Human
ugcucagcagucaaggucauagagccuggagucguccuagaaaauagacuuacugcuggggca

SEQ ID NO: 4115360 - RNA, 66 nt, Human
ugcucaggugccuuggcugcuguguucaaagcuagccuggacaaggacagcuccugcacuugagua

SEQ ID NO: 4115361 - RNA, 61 nt, Human
ugcuccaggagcacuuuccauucauacucuaggcccugguaaaauggaugcaccuagagca

SEQ ID NO: 4115362 - RNA, 75 nt, Human
ugcuccauaugagagaggaaagauuuuaaaauaugucuacauuuuaacuguuguauuauuuucuuuaugguugca

SEQ ID NO: 4115363 - RNA, 58 nt, Human
ugcucccgccccgacccugcagccagcgccuccccugugccaggcccgggugggugug

SEQ ID NO: 4115364 - RNA, 66 nt, Human
ugcuccuacucacuucuucccuugcacauaugggaugccauccugaugaaagggaaaaguggagca

SEQ ID NO: 4115365 - RNA, 65 nt, Human
ugcuccugccucuagaccuagguuggguuguucaggagcugggucuggaagcagaucagaaagca

SEQ ID NO: 4115366 - RNA, 95 nt, Human
ugcucuaugguaauaugcauguauacauguguaaacuagacagugaugucaaggauauaauagccuguacauaugcaaaguauaauucuagagua

SEQ ID NO: 4115367 - RNA, 130 nt, Human
ugcucuauuaguaaaaucauuuugaacaugcaccacagauaucugcguauuuauucacugaugauguuuaugcaauaguguguguguguguauuguuuacuguauuuauagugaaauuucuaauagaagg

SEQ ID NO: 4115368 - RNA, 127 nt, Human
uggcauuuauuuagcucacauuucugugagucaguuaguguuuaucuaaucuagacuagucuaggcuauuuuacuuugugaauauugacugggauuucuuaaauauuuguggguugacuaagaguca

SEQ ID NO: 4115369 - RNA, 72 nt, Human
uggcauuuggcuuacuuauguuuucuuacagucaauguaguaagcuggcugaaagcauggaagcuggugcca

SEQ ID NO: 4115370 - RNA, 59 nt, Human
uggccaaauuggccugauguauuuuaagcuuuuaucaugcaacauugccaguaugggca

SEQ ID NO: 4115371 - RNA, 64 nt, Human
uggccaaugaaguaggacugaacuugggggaauuuuccuucaacagacccuucuuucuuuccca

SEQ ID NO: 4115372 - RNA, 60 nt, Human
uggccaauggcuccggccucaugguuccucaaggaggccaggguaccaucaacauggccg

SEQ ID NO: 4115373 - RNA, 63 nt, Human
uggccacacugcccccacuggggucguuugcugaauucccaugaccuggcgggcacugggcca

SEQ ID NO: 4115374 - RNA, 91 nt, Human
uggccagaaaaggggccuuaaaagcccaccuaaccugcucaccuuauagauaaggccagagagggaggguggggaugcccagguucaguca

SEQ ID NO: 4115375 - RNA, 97 nt, Human
uggccagaaugaugcagucacuacucugcuuaauuaaaaccaggccuguguacgugguuuuaauuaagcagaguagugacugcaucacuagaggcca

SEQ ID NO: 4115376 - RNA, 77 nt, Human
uggccagacugucacaagacauugaguggcuuuugaaaaugagccauguuaaauggacuugauggggguuacaacca

SEQ ID NO: 4115377 - RNA, 66 nt, Human
uggccagaggcacagcuucuuuuaauauucagguuguuaguauuuggcgaagccugccucuuucca

SEQ ID NO: 4115378 - RNA, 59 nt, Human
uggccagcagaguucacucucuaccugauccuuuagagaaaagcugucccuguuggcca

SEQ ID NO: 4115379 - RNA, 64 nt, Human
uggccagcucuuguccacggaggggauuccuguguaaccucugugucagggaagagacuggcca

SEQ ID NO: 4115380 - RNA, 57 nt, Human
uggccagcuuugacuguaaaccuucuucuuccucugguucaaccugcagguuggcca

SEQ ID NO: 4115381 - RNA, 59 nt, Human
uggccagcuuuuuguagugcuccuucuggcucugggagaugugcugccagcggcugcca

SEQ ID NO: 4115382 - RNA, 64 nt, Human
uggccaggaucggacugggccugguccagucuuggcuccaggccacaaguuggguucaaggcca

SEQ ID NO: 4115383 - RNA, 80 nt, Human
uggccaggcacaucuggguggacagagggguuccagccacucacagagcccucucagucagagccagauaagccugggca

SEQ ID NO: 4115384 - RNA, 84 nt, Human
uggccaggcuuuaaccugcuuacugggagagcgaccagauucuuaaaacuaaggauccuacauccggugcacugaagcaagcca

SEQ ID NO: 4115385 - RNA, 66 nt, Human
uggccagggcacugccaggccacaacagcagccuuccccucccucugcuggcaaaugcuuuggcca

SEQ ID NO: 4115386 - RNA, 62 nt, Human
uggccaguguuuuuccugggcuggcauagccuuggucagcuagagcugagaagcacuugcca

SEQ ID NO: 4115387 - RNA, 79 nt, Human
uggccauagaccucagagucagcuagucuugggauuuggaucuuagaucuccugcucacugagcucaugaccuuggcua

SEQ ID NO: 4115388 - RNA, 55 nt, Human
uggccauaugaccaccuuugaucaaugaaaugugagcagaggugauauaugccca

SEQ ID NO: 4115389 - RNA, 79 nt, Human
uggccauuuucauuuuucccuggacagccuugccugggguacugccugcugccggugaggguugcuaggaaaccggcca

SEQ ID NO: 4115390 - RNA, 92 nt, Human
uggccauuuuggcaaauuuaaguuagaaagcaauaugcucuaguuaaauuucuaaaucuguugccugaccuggaccuuuagccaagggguua

SEQ ID NO: 4115391 - RNA, 65 nt, Human
uggcccagaagaaaaagcugguauuagaaccgaagaugucuaaugaaguauauuuuucuuagcca

SEQ ID NO: 4115392 - RNA, 77 nt, Human
uggcccagccagcccagcccucgaggcucgaugccugugccaaggccaggggcagccagagggcagcuggauggcca

SEQ ID NO: 4115393 - RNA, 56 nt, Human
uggcccgaccucugcucaugcaguauucaucugcacaccaggagccgucugggcca

SEQ ID NO: 4115394 - RNA, 88 nt, Human
uggcccucuggucucagagucucccccaguuugggcagcagauuccaagggcccaggagagacucuggagagcccagccaaagggcca

SEQ ID NO: 4115395 - RNA, 65 nt, Human
uggcccugguggcacagccugcuacacgccgaggcugugugucacagccugcugcuccagggcca

SEQ ID NO: 4115396 - RNA, 55 nt, Human
uggcccugugacugaguucuagugcaagaaauguaagcagaagugacaugggcca

SEQ ID NO: 4115397 - RNA, 65 nt, Human
uggcccuguggaggucagugagcuccugaagcaacccuucccuccuguccuuucacagugggcua

SEQ ID NO: 4115398 - RNA, 66 nt, Human
uggccgcccgggacgagcucggccucggcggggauucucuugaggccaugcccgugccggccgcca

SEQ ID NO: 4115399 - RNA, 73 nt, Human
uggccuaugcuuugcccucaggaguugugaucuguuuuaguaaagaccucaauucaauggcaaaguauuguca

SEQ ID NO: 4115400 - RNA, 109 nt, Human
uggcuuuuugugaaacugugccuuuuguuuucuguaggccuuuccugugcuucagcucccuggaaacuggcacugcagaaggaggcaaggguguuaaaacgaggaggca

SEQ ID NO: 4115401 - RNA, 70 nt, Human
ugggaaaaucagagaccggucaagucaugccuccaagaagggcuugaccagggugggcuuugugguccca

SEQ ID NO: 4115402 - RNA, 89 nt, Human
ugggaaacucaaaccuucugcuucacagccaaggccuggcaguccauucugccagcagcagugacagccgaaagcccuugaccauccca

SEQ ID NO: 4115403 - RNA, 78 nt, Human
ugggaaagauaaauuaugaccuguuucuagucgaggaaaaaauucaggcuaagaaaaauucauguauauuugaacuca

SEQ ID NO: 4115404 - RNA, 62 nt, Human
ugggaaagcaauuuguguaaucugugcucgugugcagaggacagaaccagauggcuuucgca

SEQ ID NO: 4115405 - RNA, 77 nt, Human
ugggaaaucugcuuccuagggcuguuagaaggaaauuggucuccuuaaauuacgucagcaucugaggcaguuuccua

SEQ ID NO: 4115406 - RNA, 63 nt, Human
ugggaaaugcugcauugggcaaaacagguuccuuaaacacaguacugcuuggagcauuuacca

SEQ ID NO: 4115407 - RNA, 67 nt, Human
ugggaaauguaaguauauguucugugugcauagaguaaaagaucuaugagucaucugcuacaaccca

SEQ ID NO: 4115408 - RNA, 71 nt, Human
ugggaaauucugggauauauuuagauucucugcucuuaacuggacaagaacaucuaaauaucugagaccca

SEQ ID NO: 4115409 - RNA, 101 nt, Human
ugggaacacuaacccagaccuguuugacuaccauccccaagggagacucaguuucuccaggugagggugguuagagaggcacuacugggugggggugccca

SEQ ID NO: 4115410 - RNA, 71 nt, Human
ugggaagcaguuucccagaagaauucaguggauggaugguauggauuccuuuggugaacugccgaggucca

SEQ ID NO: 4115411 - RNA, 71 nt, Human
ugggaaguagugggguagaguggaaaaagcaaggcugaucugaggacaaauucuagcucaucuacuuucca

SEQ ID NO: 4115412 - RNA, 107 nt, Human
ugggaagugucugggagccaugccuuggagugccucacugaucacaaagccauccaguguggccuuugauuccugggccccugguguccugcucacuuuacccccca

SEQ ID NO: 4115413 - RNA, 64 nt, Human
ugggaaguuagugaaccaguacaugcucauaccuuaggaaagcaaauacuuuucacugagccca

SEQ ID NO: 4115414 - RNA, 130 nt, Human
ugggaaucugggguauauaaauuguucucaagagggacuucuauuagagugaggaauguggaguuaaguccuggcucuucagagguuccuauggucuugagcaaguugucuaauucaguguuaauucuua

SEQ ID NO: 4115415 - RNA, 80 nt, Human
ugggaaugaaacagagauuuaauucaguuuauuccuuuuaagcaauugagugaaaccucuuuauuaguuuuccuuuccca

SEQ ID NO: 4115416 - RNA, 55 nt, Human
ugggaaugcaaggaaagcuguuucagaaaugaucuacagauuugaugcaauccca

SEQ ID NO: 4115417 - RNA, 65 nt, Human
ugggaaugcccugcuccaggagaauacccugcagaucugcggguggcuacgagacagggagccca

SEQ ID NO: 4115418 - RNA, 74 nt, Human
ugggaauggggccagcuggggaaucuccacucggagccccacccacaaccagcuggcugugcccauggcuccca

SEQ ID NO: 4115419 - RNA, 63 nt, Human
ugggaaugugauuagccucuacuggagcaaacccaaauuccuguucacauagucaaauucuca

SEQ ID NO: 4115420 - RNA, 60 nt, Human
ugggaauuauucauugguaggcaagcuaaauaggcgugccauucgaugugauaaggacua

SEQ ID NO: 4115421 - RNA, 96 nt, Human
ugggaauuuucagcauaagugccaagaauaguuuuacuuuucuauguggucaaagggacccaugcaacugugauuauucucuuuugcuuggaccua

SEQ ID NO: 4115422 - RNA, 56 nt, Human
ugggacacagaaaaggcagguuauaauacugcuuggaaccuugccguuugugcuua

SEQ ID NO: 4115423 - RNA, 68 nt, Human
ugggacagacaacuggacuaagaucacccagggccugagugaccuugggcaguuaucuaaccuuccca

SEQ ID NO: 4115424 - RNA, 64 nt, Human
ugggacaguuaccauaucuucacugucaacuauaacaugacaugaagaaaauaugauuacccca

SEQ ID NO: 4115425 - RNA, 99 nt, Human
ugggacauucaguccuuggucuacuagagaaaaagacuuagaaaucuaggcucuuaaagucugagugaagcuaagggcaaguacagaggggaugaccca

SEQ ID NO: 4115426 - RNA, 76 nt, Human
ugggacauuuugguaagagucacaaauuuagcuuguugcagaaggcaggacugaaaaugaguucuucuaaauccca

SEQ ID NO: 4115427 - RNA, 95 nt, Human
ugaacaagcuacugacaaaugugauuuuauugaaucccaacccucucuucuguagguuguccuggagguuaauagaguuacuucuagccaguuca

SEQ ID NO: 4115428 - RNA, 73 nt, Human
ugaacacaaauauuuugggguucuugauaauguaucugcaaguaaaauccacucacuccagaaguuguguuca

SEQ ID NO: 4115429 - RNA, 76 nt, Human
ugaacagagccuccugaauucuauaagcuuuaggccccacauaaccuucagcuauggagucuuaguuacucuguca

SEQ ID NO: 4115430 - RNA, 58 nt, Human
ugaacagcacaaugauaaggaaugacaauauguuuuacccuuucuggagugcuguuca

SEQ ID NO: 4115431 - RNA, 62 nt, Human
ugaacagugugagggugugaccaaggccuucagaagcaaggcucuccauccucugcucuuca

SEQ ID NO: 4115432 - RNA, 74 nt, Human
ugaacauacuugggcuuuauacuuagggacuuugauucaguagguccaggaugaagcccagugauuuuguuuca

SEQ ID NO: 4115433 - RNA, 57 nt, Human
ugaacauuuaugaugcaauaccuacugguuagcagguuuugcugaauggaugcuuca

SEQ ID NO: 4115434 - RNA, 57 nt, Human
ugaacccugaccucuggaaggagacuguauucaccaagucucccuaucaggaauuca

SEQ ID NO: 4115435 - RNA, 130 nt, Human
ugaacguuuccaaugacucgcugggccugucuacuuagaugucuuaacaaaguaaagucauaauccuuuuguucuggagauugagaaggcauugcugagagaugguuaaggagacaaaacugaggcuuca

SEQ ID NO: 4115436 - RNA, 57 nt, Human
ugaacguuuuuauggcuuuugguacauauuaccagauugcuuuccaaaagcguugca

SEQ ID NO: 4115437 - RNA, 65 nt, Human
ugaacuaauuccugcuuugggggaaguauacagcagcugugcucccagcuguaggaauguuuuca

SEQ ID NO: 4115438 - RNA, 86 nt, Human
ugaacuaggccgggcacaguggcucacaccuguaaucccagcacuuugggaggccaaggcagguggaucacgaagucaggaguucg

SEQ ID NO: 4115439 - RNA, 58 nt, Human
ugaacuauguaaugcauggguaguuauauggcgugcauuauauguauaacauaguuca

SEQ ID NO: 4115440 - RNA, 70 nt, Human
ugaacuguacaucccuaaccuaaaucagcuggagacaggggaagaaaguguuagauucuuacucaguuua

SEQ ID NO: 4115441 - RNA, 76 nt, Human
ugaacuuaucuggaccucaguauccuccauuguaaaagaugaauuacaagguuguucugaggauuuaagauaugca

SEQ ID NO: 4115442 - RNA, 93 nt, Human
ugaacuuccuacuauaaacauagcaagaucacauucuguauuguuuuauuuauaauuuuacauuuuaugauuuugcaguguagagggagcuua

SEQ ID NO: 4115443 - RNA, 129 nt, Human
ugaacuugggagcucaaaugauuugcccuccucagccuccaaagugcugugauuacaggcaugagucaccacacucggucugugccuuagacuuuagagucggaaagcuggauuugaauccuggcuuca

SEQ ID NO: 4115444 - RNA, 83 nt, Human
ugaacuuuuuuaaagauuaugaauuuuuguuaguguuuuauaaggucacagauaagaacucgugaucauuugaaaauuuguca

SEQ ID NO: 4115445 - RNA, 119 nt, Human
ugaagaaacaguucaaagaaacuauugcuuagacuauagcucacagugcuucaggugaaugcaacuaguaauuggaaguagugagacuauggacuaacgcuuucauuguaagcccuucg

SEQ ID NO: 4115446 - RNA, 69 nt, Human
ugaagaaagcgaguccauggaaaacugauaaucaagaagcuuuauuacuuccaggauugcuuauuuuua

SEQ ID NO: 4115447 - RNA, 62 nt, Human
ugaagaaucagauuggccugcgauaggucuccccauucugccugagcaggcacugauuuuca

SEQ ID NO: 4115448 - RNA, 81 nt, Human
ugaagacaugcacacauucccagagucuagaguuuaaauguucaagacaguuucuggauucugggcuguuugcauuuauca

SEQ ID NO: 4115449 - RNA, 86 nt, Human
ugaagacuguuggucaaggcagaauggaugccaagggacauuccaguucuucuucuggcauuuucuccuuugaguuuuugucuuca

SEQ ID NO: 4115450 - RNA, 57 nt, Human
ugaagaggccaaacuaucauugaagugggugucaaugagugauaguuuggccuuuca

SEQ ID NO: 4115451 - RNA, 78 nt, Human
ugaagagguaggcaugcuuaguauagacuggauauuuucuuggauauuaauuauuuacacaugagugucuguccuuca

SEQ ID NO: 4115452 - RNA, 59 nt, Human
ugaagagugcuugagauuuuaauguuggaaaacaagaugaaaauuuugcagucuuuuca

SEQ ID NO: 4115453 - RNA, 90 nt, Human
ugaagaguucugaaauaggugcugucugcccauaagucauccuucaaaccuuuguauuuacaggacagcuuggcauuuuucuucucuuca

SEQ ID NO: 4115454 - RNA, 99 nt, Human
ugaagauauaccaaauguagcaguuuauccucauaauggaauuauagacuuaaaauauuucccauauuauggggaaaaacugcaugugggguaucuaca

SEQ ID NO: 4115455 - RNA, 120 nt, Human
ugaagauauuuaaaguuacucuuuuaaaaaauaacaucauguggcuuaugugggccgaaaacaagauccuauucaagcuagaugacguuauuuuuucaggggcaauuuuuaauuucuuua

SEQ ID NO: 4115456 - RNA, 76 nt, Human
ugaagaugaagacaaagcagugcugugagaacacuuccaaaagugacuuaaaggaacuuacugcugccaucauuca

SEQ ID NO: 4115457 - RNA, 129 nt, Human
ugaagauuaauguuccuuacauguuaaguuuaggaaggauggcuuuuuccugcugacuacuuuuaugagauggcaugaauuuagcuuuccauuuugaacuuacuguuuauguacagugcauuuuguuca

SEQ ID NO: 4115458 - RNA, 56 nt, Human
ugaagauuuagaccucuuugcccuuuucuuggggccuuugagaguugggauuuuua

SEQ ID NO: 4115459 - RNA, 62 nt, Human
ugaagauuuggguccagguugcugaguuuaaugugaauucucagcaaaaugcaagauuuuca

SEQ ID NO: 4115460 - RNA, 62 nt, Human
ugaagcaccugcuugugacuagggauuuguuggggucccagcuaacaguggggggugauuca

SEQ ID NO: 4115461 - RNA, 73 nt, Human
ugaagcacuuucaagaucuuccaaaggauacauauuuuuuguuguuguucuuauauugacuugggagguuuua

SEQ ID NO: 4115462 - RNA, 57 nt, Human
ugaagcagcuuagaaaaaugaaauugggguugccuucuucauuuucagaguugagca

SEQ ID NO: 4115463 - RNA, 95 nt, Human
ugaagcaggauaaucgcuugaacucaggagguugcagugagccaagauggugucacugcacuccagccugggugacacagugagacuccgucuca

SEQ ID NO: 4115464 - RNA, 59 nt, Human
ugaagcagggaccuaugacgauggaaauuucugacaauuucaccccaauccuugcuuua

SEQ ID NO: 4115465 - RNA, 61 nt, Human
ugaagccaggaucacgauucuguuccuagcaccuggaacaaugucugcuauuuggcucuca

SEQ ID NO: 4115466 - RNA, 80 nt, Human
ugaagccgaggcagcccucucagacguacccuguguccaacucuccugugacauucuugagaagcggcugucucagcuca

SEQ ID NO: 4115467 - RNA, 92 nt, Human
ugaagcuauuauuucugaugaaguucacuuuguuuggauuuagaaaauccacucggagggaauguuuaccuuuccuuuaauaauaugcuuua

SEQ ID NO: 4115468 - RNA, 66 nt, Human
ugaaggacacauuuucuaacagggaucacuguguaaaaaaacuggugguagaaaaugugugcuuua

SEQ ID NO: 4115469 - RNA, 55 nt, Human
ugaaggagauuuuuagggaggccugguggcugugggacuucccauaucuucuuca

SEQ ID NO: 4115470 - RNA, 93 nt, Human
ugaaggaugccaguacuaaauugcaauagauaugcuugucgugcagacccagugaucugauaacaaccaugucuggcauguaguuaucuuuca

SEQ ID NO: 4115471 - RNA, 68 nt, Human
ugaaggcagaaagggaugugaguggggaaaugaggaguuuauucucacagucauuuacuuugccauca

SEQ ID NO: 4115472 - RNA, 69 nt, Human
ugaaggcauaaaucuugggaacaacccggcaccuaggcagcuguaacauuucccaagauuucuguauca

SEQ ID NO: 4115473 - RNA, 73 nt, Human
ugggaccuggagccagggaggcaaggccagcagagugucugcuggaggaguuuacuguggccccaagagcccg

SEQ ID NO: 4115474 - RNA, 59 nt, Human
ugggaccuuccugagagcagcucucaguagcagcuucuaccaucaggaaauugguucca

SEQ ID NO: 4115475 - RNA, 74 nt, Human
ugggacugagcccugccucuugucacugcuguguaucugauagcagcaaguguugugccugcaggcuugucuca

SEQ ID NO: 4115476 - RNA, 63 nt, Human
ugggacuuugcuucuccaaccugcucaucacacagaugaaggaauggaggaucagagcguuca

SEQ ID NO: 4115477 - RNA, 87 nt, Human
ugggagaacuacauauaggguagaacaggaaauuggcauaucaguugagucuggacucgauuuuccucuacccuguuguuuucacca

SEQ ID NO: 4115478 - RNA, 57 nt, Human
ugggagaagagaaauuacugcccuaacuccagggagagauuacacauuguucucccg

SEQ ID NO: 4115479 - RNA, 87 nt, Human
ugggagaaggaagcugccugggaugggaaaucuguccaguucugaggguggcuuuccuacuaccaguguacuuccagucuaacucca

SEQ ID NO: 4115480 - RNA, 58 nt, Human
ugggagagauaggcuucuggaccuuacuuugcuaccucuaaugcuuccucucauccca

SEQ ID NO: 4115481 - RNA, 63 nt, Human
ugggagaggcuuggaaguggcagaacugggauuugaauccagggcugucuccaaaggccccca

SEQ ID NO: 4115482 - RNA, 75 nt, Human
ugggagauagagagaaauggaggaggaugggauuugcugcagccaaucucuuguauuuccuuugacauucuccca

SEQ ID NO: 4115483 - RNA, 73 nt, Human
ugggagaugcaaagauaaaacagacgcaggcugcccuccaggagcucgugcucugaucugucugacaucccca

SEQ ID NO: 4115484 - RNA, 79 nt, Human
ugggagaugguguggaaguggcccugagcuuuccuuacugaaaggccagaaagcuggggcauuuauccacuaacuccca

SEQ ID NO: 4115485 - RNA, 59 nt, Human
ugggagccacguagugggaugaguugcugcacaaacuuuucacagcuagugagcuucua

SEQ ID NO: 4115486 - RNA, 65 nt, Human
ugggagccuggcaggccagagggacauucacauaucacaccugucuggcuauaugcuggcuucca

SEQ ID NO: 4115487 - RNA, 71 nt, Human
ugggagcuaauaaauuguagucauuaagagagggaccucuggagucaaugucuagaguuuuaagcuuacca

SEQ ID NO: 4115488 - RNA, 69 nt, Human
ugggagcucaucuguucccuugacuucucuuuuuccaguucuuuggcaaggccacaggugcaguucuua

SEQ ID NO: 4115489 - RNA, 60 nt, Human
ugggagcuccuucaagaccccaacaggcaggccuugccuguggaucuagagggggcccua

SEQ ID NO: 4115490 - RNA, 95 nt, Human
ugggagcugggggaugccaggugggaggaaagcagagauggaacaagaugcaaaaccaauaauucuccccguuccucucccugccccugcuguua

SEQ ID NO: 4115491 - RNA, 85 nt, Human
ugggaggagguguagaaauagugauuuguggcuaacaguuaagaggacauguuagaaguuaaucacuaauuuguuaccuuuccua

SEQ ID NO: 4115492 - RNA, 80 nt, Human
ugggaccccuaaaaaguggagggugauugccggcugucgugcacacggcuucucaauucucacccuccaaggaaagcccg

SEQ ID NO: 4115493 - RNA, 69 nt, Human
ugggacucucaggcuuugaauccagccaugaugcucugaggaagucaaguagccacauggagagaccca

SEQ ID NO: 4115494 - RNA, 68 nt, Human
ugggacugaaguuucuuaacaagggucuacuuuaucagucucccuccuuucuaggcuuccagcuccua

SEQ ID NO: 4115495 - RNA, 60 nt, Human
ugggacugcuuuagagagcucagagggucuucagauuucugggcccacuguagcauccca

SEQ ID NO: 4115496 - RNA, 76 nt, Human
ugggacuuuugguuagaauuguauuacauuuccaaauaccggaagaauuauugcaauacuagauauccucagccca

SEQ ID NO: 4115497 - RNA, 78 nt, Human
ugggagaacaagauugacggcuuugagugcuuuaccaagaagauagacaacagggcacucagcucaauuucucagcca

SEQ ID NO: 4115498 - RNA, 62 nt, Human
ugggagagaagggggcucgaguguccugggugccuucuauggaccaagcacuuucucgacca

SEQ ID NO: 4115499 - RNA, 61 nt, Human
ugggagagagaaaacguggcgcagcaccaauugacgucugucugucccuccaccucuccca

SEQ ID NO: 4115500 - RNA, 57 nt, Human
ugggagagcugauagaugagcuacuuuggacagagugguucacacugcauucugccg

SEQ ID NO: 4115501 - RNA, 88 nt, Human
ugggagaugaggguagcuggaucacggaggaacuugucaacaacauacugaggcauuuggacuugagcuagcaugccaucauuucuca

SEQ ID NO: 4115502 - RNA, 75 nt, Human
ugggagaugaucaacauguauuuaagaguuuacuaagugcuagggccugagaauacaauguugaaaacaguccua

SEQ ID NO: 4115503 - RNA, 83 nt, Human
ugggagcagcaucaacccucccgugucuacagacucagggguucugaacgcacagacgcagggagguggaagguggugcccca

SEQ ID NO: 4115504 - RNA, 67 nt, Human
ugggagcucagaaagggagguccccaacucagaaccgagcuaaccccuauuuucugagcaccuccca

SEQ ID NO: 4115505 - RNA, 92 nt, Human
ugggagcucugaagccagggugacccuucagcauuguccccaaauggagggaaguaggcugggcuugguuucccugcuucagccagucacca

SEQ ID NO: 4115506 - RNA, 60 nt, Human
ugggaggaucuggcucaggccuucuagucacaaaaggccucaaauguagccuuuuuccca

SEQ ID NO: 4115507 - RNA, 66 nt, Human
ugggaggcacugcucaguaauaguccuaucugucccacaacagacaggagugcugggcugcaccua

SEQ ID NO: 4115508 - RNA, 66 nt, Human
ugggaggccuaggaaggggauguaacuuuggauaaggcagcuuuccuuauccuagggcaaagccca

SEQ ID NO: 4115509 - RNA, 56 nt, Human
ugggaggugcacacaaggucuuguuggcugccccugcaggucccugucaccucuca

SEQ ID NO: 4115510 - RNA, 86 nt, Human
ugggagucagaggcaagagaagccagcuuuccuccucccaaaggaggaagauauggaagcugugcucucaggccucuggaaaccca

SEQ ID NO: 4115511 - RNA, 72 nt, Human
ugggaguccgugccuuuaguuucuucuguagcaugagccacaggacaaaaaucuggauggcaaguguuccca

SEQ ID NO: 4115512 - RNA, 118 nt, Human
ugggagucuauuacugagcaagucuauagaucacugggcaauaaauucagagaacguuccuuagcauucaucuaauuuggccauaguuuuaauuaaguguuucagcuaaugauuucca

SEQ ID NO: 4115513 - RNA, 63 nt, Human
ugggaguguuucacucacaggauugugcuuucuucuaagagccaggucuggugaacacucuca

SEQ ID NO: 4115514 - RNA, 75 nt, Human
ugggauaaagugccucagguccuggguggucacuacucaggaggcaggggcacuuuccuucaguacuccauccca

SEQ ID NO: 4115515 - RNA, 86 nt, Human
ugggauacaaggacugacagugauuggcacugauucagccuggccgaggugcucugaagaagccacucauuaguuccugccuccca

SEQ ID NO: 4115516 - RNA, 55 nt, Human
ugggaucaaagagugccaucaggacucucaaugaugagguauucuuugccuucca

SEQ ID NO: 4115517 - RNA, 72 nt, Human
ugggaucucaaucuuggcagcucauuaaaacagccugggaugauuuuauaggguagcuaggauugagaacca

SEQ ID NO: 4115518 - RNA, 77 nt, Human
ugggaugagaagaucuugguguauuuaacacauaagcuuuguuagaaaucaccucugaagaucauuucauuuucuca

SEQ ID NO: 4115519 - RNA, 63 nt, Human
ugggaugagcugcaucugggaaggguuuucuauggaagccaaaggugcaggccucaagcccca

SEQ ID NO: 4115520 - RNA, 72 nt, Human
ugggaugcuagcuuuuagucaacuguuuaaaaaauuauuaucuuuaacagcucuugaaagauuagcuuucua

SEQ ID NO: 4115521 - RNA, 65 nt, Human
ugggaugcuugaugggagcggguaggcauuugugccuucauucuguacuuuuauuuuggcacuca

SEQ ID NO: 4115522 - RNA, 57 nt, Human
ugggauggguagggaggaacucugaggagacuccagguucuucucuaguuaucuuca

SEQ ID NO: 4115523 - RNA, 70 nt, Human
ugggaugguuguugagggagaugaaaaucuuagacucugacugcaagucauaucuucuucaaaccacuca

SEQ ID NO: 4115524 - RNA, 82 nt, Human
ugggauguccuguggcuguauuuggccagagcuggaugcuccuggugaaaugccagccaaagcaggcgugugauuugcccca

SEQ ID NO: 4115525 - RNA, 77 nt, Human
ugggauguuuguucucaauagguguacuuaucccugcaauuuucaguucaccugucaaguccagcgcaacaguccca

SEQ ID NO: 4115526 - RNA, 78 nt, Human
ugggauuuuuggagaauccaucaaaaggcugguaucuucaaucacuccuccaccuuauugcuggcaccuucaauucca

SEQ ID NO: 4115527 - RNA, 60 nt, Human
ugggcaauggcucugauguuguugugacuucugaugucaccaccagaagagcuauucuca

SEQ ID NO: 4115528 - RNA, 58 nt, Human
ugggcacauguaaagcuggagaaaguguguaaauuuuuaacauuugaacauguggcca

SEQ ID NO: 4115529 - RNA, 77 nt, Human
ugggcaccuuggguuugugccaugguccaggggcagucuggacuuuccuggccagaggacaaagcuggauuggccua

SEQ ID NO: 4115530 - RNA, 62 nt, Human
ugggcacuauggcucugugcacacagguguugcaguauggagcagggccucccgagugccca

SEQ ID NO: 4115531 - RNA, 68 nt, Human
ugggcagccauggggcucagcugcacuaacaaacucugucuaguacagaaaaccucagggucucccca

SEQ ID NO: 4115532 - RNA, 80 nt, Human
ugggcagcucauucuagaguucauuucuugcguguuagaacuccuuacauucuugaagugaaguuuauuuugacuguuua

SEQ ID NO: 4115533 - RNA, 58 nt, Human
ugggcaggauaauaucucauguuuacaacuaacaaguuagauaucccuguccugccca

SEQ ID NO: 4115534 - RNA, 58 nt, Human
ugggcaugaguggacagagaaggcuauugugucauuuuuggaaacugcacugcuacca

SEQ ID NO: 4115535 - RNA, 61 nt, Human
ugggccaggaugugguucauuuuaaaauaccaguguuuuaggaagccuggaguccugccca

SEQ ID NO: 4115536 - RNA, 74 nt, Human
ugggccagguguaguggccacaccuauaaucccagcacuuugggaggccgaggcaggcuagucgcuugagccca

SEQ ID NO: 4115537 - RNA, 85 nt, Human
ugggcccacuguaucuuccuugaauuuacaaauucugcuucuaugaaaaagcagacaaaucguggaagacaccagugggcuacca

SEQ ID NO: 4115538 - RNA, 84 nt, Human
ugggcccccagugaauaucuuuguaugguucagcagguuguacaaaacuaguuagaugccaucaagggcuugcaguggggcuca

SEQ ID NO: 4115539 - RNA, 80 nt, Human
ugggccucccuagucucucucucuguaugucuuaaucuccucuucuuauaaggacacucaucagauuagauuagggccca

SEQ ID NO: 4115540 - RNA, 73 nt, Human
ugggccugcuggaaggaggccuggcagaugaagaugggcuucccauguugcacggccuucacagagcgcaccg

SEQ ID NO: 4115541 - RNA, 69 nt, Human
ugggccuggaucagugggagaugcugguuuuguaguuuaccacagcuggaggccccauuguccagccca

SEQ ID NO: 4115542 - RNA, 84 nt, Human
ugggcgggugucaguggggacaugggauaucagauccuagggcucccaugcugaccccuguguccuuggcagauaucccgccca

SEQ ID NO: 4115543 - RNA, 83 nt, Human
ugggcuacuugacgguuagggcauucuuucaugggaaugugaaaauagcuucucagaagaguccuguauccuugaguagguua

SEQ ID NO: 4115544 - RNA, 62 nt, Human
ugggcuagagaggggaaggaugugaugugagcagaugguucucacucauucuccucugucca

SEQ ID NO: 4115545 - RNA, 58 nt, Human
ugggcuagcagggaagagagacuuguuuuucucuuuuuuccugaccaguugcugccca

SEQ ID NO: 4115546 - RNA, 77 nt, Human
ugggcuaugauaaauagugcugccaugaguaucuguacacuaguuguacuaguggacucauuuuuuuucauggccca

SEQ ID NO: 4115547 - RNA, 67 nt, Human
ugggcucagccaagcccugaaggcaacaagauaccaucccuccugcccaaguguuuggcugagucca

SEQ ID NO: 4115548 - RNA, 61 nt, Human
ugggcucagccuucauguggccaaugaaaauugacauuuuccauaucccaagguuagccua

SEQ ID NO: 4115549 - RNA, 55 nt, Human
ugggcucagggucgaggacuuugcccaaagccaggucugccugauucagagccca

SEQ ID NO: 4115550 - RNA, 73 nt, Human
ugguagucacaacugggggcauuacuggcaucuaguggaugcugcuaauauucugcagugcacaggacaacca

SEQ ID NO: 4115551 - RNA, 85 nt, Human
ugguaguguccucauucuggguuuuugucuucuguguuuacugugacaugaagucauuuuuagaugaagguuaaacauuuugcca

SEQ ID NO: 4115552 - RNA, 63 nt, Human
ugguauaaaacuuuuuauugaaacuaccugugucguaaaacagggagagaaguuuugcuaccg

SEQ ID NO: 4115553 - RNA, 63 nt, Human
ugguauccuccagcuccugcuucugcgucuucgcgucggccacgcaggugcgguagguggcca

SEQ ID NO: 4115554 - RNA, 56 nt, Human
ugguauggguagcucugaaccucaaccaugaauuauuucagaguuuacucaaacug

SEQ ID NO: 4115555 - RNA, 74 nt, Human
ugguauuaguacuaaacagagaaccaauauauuaugccguagaguuuggcacucuguuuaguaagucauuacca

SEQ ID NO: 4115556 - RNA, 79 nt, Human
ugguauuaugagguguguucauugccugcuuaauaacacauuauuaggcagggcaugguggcucacuccuguaauccca

SEQ ID NO: 4115557 - RNA, 71 nt, Human
ugguauucugucauagcagcccagaauaacauauaugauuauauacuuguaaaggcuguuauugacuucca

SEQ ID NO: 4115558 - RNA, 66 nt, Human
ugguauuuguaucuggaccugacugacuccaagguaguguuaguuagaauaauacaaguaaaacca

SEQ ID NO: 4115559 - RNA, 77 nt, Human
uggucaaaguguaagagggacuagaaaugaguuucuggaacaucuacaguaauuccucuaucuuucuucaagagcca

SEQ ID NO: 4115560 - RNA, 76 nt, Human
uggucaagauggguguugugaugguuaauuuuaugugucaacuugacugagccacacaugcccagauuuuugguua

SEQ ID NO: 4115561 - RNA, 92 nt, Human
uggucaccaucucuuacgcagagaauuacuauggcagcuuuggcuuaugauccacaguuauucauuugugacaagagaaaaaccuggggcca

SEQ ID NO: 4115562 - RNA, 69 nt, Human
uggucagaaugugcuucuggcuguggucauagacgggugugagucagccccaggagacauacuuugcca

SEQ ID NO: 4115563 - RNA, 59 nt, Human
uggucagagcugugcaaggcugagggugugauuaaacuuucagcagagaggccuggcca

SEQ ID NO: 4115564 - RNA, 129 nt, Human
uggucagcuacaguccaucuguuaucaagaggccuggcugugugucuucauucaguuuauuaggcauuuacugagcacagccuacaugccagguucuucauuuuuugacacagggucuuguguugccca

SEQ ID NO: 4115565 - RNA, 65 nt, Human
uggucagcuguaucagaaauacaauguucauuucuacuguuguuuuuguucucuauagcuuccca

SEQ ID NO: 4115566 - RNA, 79 nt, Human
uggucaggcauggugcauguuuugcugggaauguuuaugcaaagaagccauuguuucagcaucaguacuaaucuggcca

SEQ ID NO: 4115567 - RNA, 71 nt, Human
uggucaguaggcaguuugaggacagggacagugucuccaucuugguauccucagugcuagccaacugccca

SEQ ID NO: 4115568 - RNA, 58 nt, Human
uggucaucuugaauuuccauucuauggagcugacaauaggauaggaaagagaagauca

SEQ ID NO: 4115569 - RNA, 70 nt, Human
ugguccaaauuugagagaaaggugauuuuuaagccuaaccccagcuuggauuuuccucguguuuguucua

SEQ ID NO: 4115570 - RNA, 75 nt, Human
ugguccagacacaauggcccagucagcaggagagggugauuuugacaucuucccuuaggugggccucugaggcca

SEQ ID NO: 4115571 - RNA, 95 nt, Human
ugguccaggccugguuacaaagugacaagcucugcugacagaguuugaacugguuagcagaaccagcagucaauuugcuaccaugcccacagcca

SEQ ID NO: 4115572 - RNA, 61 nt, Human
ugguccauggcauuuccgucacaucuuaauuggauguggacuuugaaauugucauggagca

SEQ ID NO: 4115573 - RNA, 82 nt, Human
uggucuaagcacuucgccaaugaaggcauucaaaagucuauagcuaccuuucaaagaccuuacuuggcaaagcuguagacca

SEQ ID NO: 4115574 - RNA, 69 nt, Human
uggucuaauggcuaaaccugaacuggucuauugaauaagaaaaggguauguucagguuugcuuuaucca

SEQ ID NO: 4115575 - RNA, 60 nt, Human
uggucucuuugcccaagcugcccaagccacuauaagcccucagcucugggaaagaggcca

SEQ ID NO: 4115576 - RNA, 61 nt, Human
uggucuuacuuagcauuauauuuccagugccagccacugggccggugcagaguaguugcca

SEQ ID NO: 4115577 - RNA, 71 nt, Human
uggucuucaugaauuuauauuauuagugacugagagaucaucauuaauauuaagguggauuuauaagaaca

SEQ ID NO: 4115578 - RNA, 93 nt, Human
uggucuugacacccuggccucaaucuguccuccagccucguccucccaaagugcugggaugacagacuugagccacugagacuguugagacca

SEQ ID NO: 4115579 - RNA, 67 nt, Human
uggucuuucauggauauucaguuuaaucaacuuauuaaagaaagcagagacacuacaugaaagacca

SEQ ID NO: 4115580 - RNA, 59 nt, Human
uggucuuuucuugugauauccuugccaggcuuuaguauuaggaugucucgaggagacua

SEQ ID NO: 4115581 - RNA, 58 nt, Human
uggugaacgagauggacaaaaccugucuguuaaccacuuuguccaccuguguucacca

SEQ ID NO: 4115582 - RNA, 58 nt, Human
uggugaauaguagcuucagacucaccuguugagagucugcuuuaucaagcauucacca

SEQ ID NO: 4115583 - RNA, 66 nt, Human
ugagacaguaauuguauaguuucuagguguuccccaucucaagauuuuguauguuaccuugccuca

SEQ ID NO: 4115584 - RNA, 63 nt, Human
ugagacauugccugacauuuuaauuuauauuuuucugauuacuaagaguugggcacuguuuca

SEQ ID NO: 4115585 - RNA, 62 nt, Human
ugagacccaguaagaagcuggcaccaggaaaagaguucugaaugcuguuucuggcugacuca

SEQ ID NO: 4115586 - RNA, 117 nt, Human
ugagacgcaagggguggggcacaguaaccuccugagggggcccaacagggaccccuggccaccaggggcugaaauguugggguugccucagaggugacaguggcuccccugaguccg

SEQ ID NO: 4115587 - RNA, 101 nt, Human
ugagacggagucucacacggucaccgaggcuggagugcaguggcgcgaucucggcucacugcaagcuccaccucccggguucacgcgauucucccaccuca

SEQ ID NO: 4115588 - RNA, 106 nt, Human
ugagacggagucuggcucugucgcccaggcuggagugcaguggugcagcgcaaucugggcucacugcaagcucagccucccggguucaugccauucuccugccuca

SEQ ID NO: 4115589 - RNA, 101 nt, Human
ugagacggagucuugccuugucacccaggcuggagugcaguggcgcgaucucggcucacugcaaucuccgccucccggguucaugccacucuccugccuca

SEQ ID NO: 4115590 - RNA, 63 nt, Human
ugagacugggcagcuuaaaccacagacauuuguuuucucacaguucuggaggcugcaagucca

SEQ ID NO: 4115591 - RNA, 67 nt, Human
ugagacugucacuugggaccugucaccucuagaccuggguucuugcaauggucccagguggcuuuca

SEQ ID NO: 4115592 - RNA, 80 nt, Human
ugagacuuaagacuuuacucuuuuucccccuuuggcagaggggaugagacuagagcuaaagcagcuaucuuguaaucuua

SEQ ID NO: 4115593 - RNA, 88 nt, Human
ugagagagacaaagcuggaggcauggauuaggccagagguccacaaaccguggccaccagguuagauccagccugcugucuauuuuua

SEQ ID NO: 4115594 - RNA, 81 nt, Human
ugagagagaguaaccagagcucuucagcacaggaucagacagcugguccuuacuagggugcuuugggcugcuguuucacca

SEQ ID NO: 4115595 - RNA, 103 nt, Human
ugagaggaggaccuggcuuuaaaaugcuccuggacuuuacuucuguuuaccugaggcgagcaugauuuuccacagcuuuuaaaugucuaguuccuccgcauca

SEQ ID NO: 4115596 - RNA, 67 nt, Human
ugagaggcagcagaacauggaagagaaacagaaugagagucccuaguucuaaaucuguuguccauua

SEQ ID NO: 4115597 - RNA, 72 nt, Human
ugagaggccauggcugugcaguggugaacuacuuagccaaccaucucuccgcugguuugccguggccuuuca

SEQ ID NO: 4115598 - RNA, 102 nt, Human
ugagagggagucucgcucugucaccaggcuggagugcagugguguguuaucugggcucacugcaaacuccgccucccagguucaagcaauucuccugccuca

SEQ ID NO: 4115599 - RNA, 57 nt, Human
ugagaguauauuauaugcagaguaguaagucaaaugcuuugcaucuauauguucuca

SEQ ID NO: 4115600 - RNA, 70 nt, Human
ugagaguuuaaaacgcuuguauuuaagguuuaauucuuaaucuuuuaaauuuagguguuuugauaccuca

SEQ ID NO: 4115601 - RNA, 58 nt, Human
ugagauaaggauguuauacucgugccacauguaauggcaugucugacacugugucuca

SEQ ID NO: 4115602 - RNA, 68 nt, Human
ugagauacacagagguaaagaugagggcaaguuugugggcucuggucucugguuccuuuuguauucca

SEQ ID NO: 4115603 - RNA, 89 nt, Human
ugagauaucacuucacacccacuaucauggcugaaaucaaaagacaguaaauacauguuggugaggauguggagaaacugaaacccuca

SEQ ID NO: 4115604 - RNA, 82 nt, Human
ugagauauucaauccagaaaguucugugaguuguucagcuuuuuugagcagaagauuggaacuuacugaauauagucucuca

SEQ ID NO: 4115605 - RNA, 69 nt, Human
ugagauccacuuaauuuuuuugcucuguaaauggauacaauuuaaaaauguauugaguucaguggcuca

SEQ ID NO: 4115606 - RNA, 96 nt, Human
ugagaucugcucaaggcugggugcaggagcucccgcagugguggggacaguaauucaccaucauuagcuccugcucaggucuaaggugacuucuca

SEQ ID NO: 4115607 - RNA, 56 nt, Human
ugagaugagauuucacuguccuccaggcuggaaugcaguggggcaaucauagcuca

SEQ ID NO: 4115608 - RNA, 81 nt, Human
ugagaugcacauugugcuguuauucauucuuuuuguuaacucaaaugacuuugaaaacuuaaauaacagcauguucgcuca

SEQ ID NO: 4115609 - RNA, 102 nt, Human
ugagauggaggcucacucuguugcccuggcuggagugcaguggccgcaaccucggcucacugcaaccuccgccuccuggguucaagugauucuccugccuca

SEQ ID NO: 4115610 - RNA, 103 nt, Human
ugagauggagucaggcucugucgcccaggcuggagagugcaguggcgugaucucagcucacugcaaccuccgccucccggguucaagcaauucuccugucuca

SEQ ID NO: 4115611 - RNA, 101 nt, Human
ugagauggagucucgcucuguugccuaggcuggaaugcaguggugccaucucggcucacuguaaacuccaccucccagguucaaacgauucuccugccuca

SEQ ID NO: 4115612 - RNA, 101 nt, Human
ugagauggagucucguccuguugcccaggcuggagugcaguggcacgaucucagcucacugcaauaucugcauccuggguucaagcgauucuccugccuca

SEQ ID NO: 4115613 - RNA, 59 nt, Human
ugagauggaguucugcucuuguugcccagacuggagugcaauggcacaaucuccacuca

SEQ ID NO: 4115614 - RNA, 100 nt, Human
ugagauggaguuucacucauugccuaggcuggaguguaguggccugaacuuggcucaccacaaccuccgccucccggguuuaagcgauucuccugccuca

SEQ ID NO: 4115615 - RNA, 58 nt, Human
ugagauggggucaugcuuugucacccagacuggaguauaguggcaugauccuagcuca

SEQ ID NO: 4115616 - RNA, 60 nt, Human
ugagaugggucaucagguuugguuggcauuuaaaacuuccuuccuccaugucccauuuca

SEQ ID NO: 4115617 - RNA, 78 nt, Human
ugagauucaguuuccucaucuguaaaaugagaauagucacaucuaccucacagaauaaauugagaagacuggagauca

SEQ ID NO: 4115618 - RNA, 76 nt, Human
ugagauugcaaguccuuugcaugcagggacaggguaucaugcucucugcauccccagggcucuccuuguaguguca

SEQ ID NO: 4115619 - RNA, 58 nt, Human
ugagauuucuaaacuuagccuagguuccaagaaucuacuugguuuugauagaaaucca

SEQ ID NO: 4115620 - RNA, 92 nt, Human
ugagauuuuggaggcguggcagucuuuggcaaugacaacuuuuggguuaucaccuugcaguggaugcuauaauguauugccccagacuuuca

SEQ ID NO: 4115621 - RNA, 75 nt, Human
ugagcaaggcucugcaaaaccuccaagucacccaaccucguuuggcuugucaagguucaggcagggcccuugcca

SEQ ID NO: 4115622 - RNA, 77 nt, Human
ugagcaauagucuuucaaaacgcucuguaugcaaauaauugcuuugucacagaucguuuuugagcuacuuauuguca

SEQ ID NO: 4115623 - RNA, 76 nt, Human
uggaugaugggacugagguauuaagauggcuugaagcuuuguuuaggcaacacuugcauuuuuuagucucagucca

SEQ ID NO: 4115624 - RNA, 89 nt, Human
uggaugcuccucaaaggcaagagcugcaucuaagccaugagagagucaaaauccucaggaacccaggcagguuuucuuuaggacaucua

SEQ ID NO: 4115625 - RNA, 125 nt, Human
uggauggauuucacucauaaaguuucuuuuauggaauucuaagggauuugcuggaagagauuucuaugugaaggucaaaaggaguaaauuauuuagcuuccagaagaggcagugguuacuauuca

SEQ ID NO: 4115626 - RNA, 118 nt, Human
uggauggggucccucagucgagacuuaugacccugguuguuaacuggccuuaagaauuucugucuuaaggccaauuaacaaccagggucauaagucucgacugagggacacuuauuua

SEQ ID NO: 4115627 - RNA, 64 nt, Human
uggauguagaccuuucuuugugauuaacagcuuuucuagucacucaaugaaaagucacugucca

SEQ ID NO: 4115628 - RNA, 62 nt, Human
uggauguggaugcagaugcagacguagaugcagauacagauguagauguagacacaggucua

SEQ ID NO: 4115629 - RNA, 78 nt, Human
uggaugugugugcugggagauagagggagguggcaacaggauucuccuugcuacccaguaugucacugcucacaucca

SEQ ID NO: 4115630 - RNA, 63 nt, Human
uggauuagagcuguuagugaagugcguauuauguguuaaguacuucauaaugacagccuuaca

SEQ ID NO: 4115631 - RNA, 90 nt, Human
uggauucaaacccaacauucuuuguacuuuuucucaccaccucucaaacaggaagguaggaagauagagcaaaguuuguggugauggcca

SEQ ID NO: 4115632 - RNA, 56 nt, Human
uggauucugcuccacacugauucauuucauuggaaugaaaguuggauuaggagcua

SEQ ID NO: 4115633 - RNA, 66 nt, Human
uggauucugggagagaguugauaaagggcacuauuaaaugaccaucacacaucucuucuaguacca

SEQ ID NO: 4115634 - RNA, 69 nt, Human
uggauugaaagcuugugguccccaauuuuccugagcugagcauucuggaagcaagcuuuuaaacaucua

SEQ ID NO: 4115635 - RNA, 67 nt, Human
uggcaaagcuccaaauggguggaaguggccagaaaugggcccagcuuccuccaucuggggcuugcua

SEQ ID NO: 4115636 - RNA, 59 nt, Human
uggcaaagugacucuugagcaugggugggggaagcccccacaugucugagucagugcca

SEQ ID NO: 4115637 - RNA, 130 nt, Human
uggcaaccuuuucccugaaacaaguuauuugaugagaagaaugaaaaccuuggcucaaaugguuguggaaacgucuaucaguugaccacgguuugauuuuggaaucuuuagucggcuugggaaugguaaa

SEQ ID NO: 4115638 - RNA, 79 nt, Human
uggcaacuauagcuuggcuacugcugauguuuauucaaggcccaaggggucuuuauucagcagguggugaguucugcca

SEQ ID NO: 4115639 - RNA, 79 nt, Human
uggugacauggcacuuugugugggaucaggggucagaagaguccauggcucuugucccauuugcagagauuuguuacua

SEQ ID NO: 4115640 - RNA, 99 nt, Human
uggugagagagaggggcagggagaccuacccaggacagauuugugcaaacccacaugcuggucucauuggguuagggagagcuggccuucucuuagcca

SEQ ID NO: 4115641 - RNA, 88 nt, Human
uggugagggaguccaggcccagggugcggcccuggcugggggaaaguucccgugcagcuccugcccugaggaugggcugcccucguug

SEQ ID NO: 4115642 - RNA, 59 nt, Human
uggugaggucauagagaacugucaggagauggucaucuggugucacugugucuucauca

SEQ ID NO: 4115643 - RNA, 64 nt, Human
uggugaguguuuggggggagugacuuuuaagcaccaaagagagcauucucuccaacauuuaaca

SEQ ID NO: 4115644 - RNA, 129 nt, Human
uggugaucaaaaguacgugcugcuggggaaaauagugggaaaguuaacaaagacagguuacauaacagcuaacagucacauuguucaacuuuuuuuuccugcuccaauuucucuuuugccauugcauua

SEQ ID NO: 4115645 - RNA, 65 nt, Human
uggugauggcuguuggguuuggagccagaaacgagggggcuagaacccagcucugccacuugcca

SEQ ID NO: 4115646 - RNA, 60 nt, Human
uggugauuuaugccaaacaccugauuuccuucuggggaucuggaauuuugguaugugcca

SEQ ID NO: 4115647 - RNA, 68 nt, Human
uggugcaaaacuaauugcgguuuuuggauuuaccuuuaauggcaagaccagcaauucuuuuugcacca

SEQ ID NO: 4115648 - RNA, 60 nt, Human
uggugcagagcagugucagagcaacgugguuugcucugcucuggaguggcuugugcacca

SEQ ID NO: 4115649 - RNA, 72 nt, Human
uggugcagugccugagggaguaagaguccuguuguuguaagauagugucuuacucccucaggcacaucucca

SEQ ID NO: 4115650 - RNA, 76 nt, Human
uggugccagcauuugcuucuggugggggcuucagggagcuuccacucaugacggaaggcaaagggcagcagcauca

SEQ ID NO: 4115651 - RNA, 79 nt, Human
uggugcucaauuguuuuacaguuccaugcaaagcgucuuuccccagauguugguacaaauugugaaaugcuauucacca

SEQ ID NO: 4115652 - RNA, 77 nt, Human
uggugcugagccuagcugucuccuguuugggaaaauaccaaaggugcaggacauucagugaaugggcagacagcuca

SEQ ID NO: 4115653 - RNA, 60 nt, Human
uggugcugccaggcuccugccaggcacucgggccaggcugcaggagcacugccagcacca

SEQ ID NO: 4115654 - RNA, 74 nt, Human
ugguggaaauauaacucugguaagacugauuugggauuuuauuuaauuugaagaaaguuuucuagauuuuacua

SEQ ID NO: 4115655 - RNA, 74 nt, Human
ugguggaauguucagucucaagagugauauaugaaaugcaagaauagauaugcuauagucugaaugugucccca

SEQ ID NO: 4115656 - RNA, 70 nt, Human
ugguggacacguucccaggcccucgcggggaucuguugaacccagggagcuuggagaacgggcagcauca

SEQ ID NO: 4115657 - RNA, 81 nt, Human
ugguggagaauagaaucaagacauugucauuuuauaauuagaaguaauauguaauagaagauguauuguauguuccuacua

SEQ ID NO: 4115658 - RNA, 73 nt, Human
ugguggagacagugauagagcccauuuugugccuagaauuuguaccaguguccuuguuauuacugcuccagca

SEQ ID NO: 4115659 - RNA, 58 nt, Human
ugguggaggcagugacacaguagcuuccaugugcucugggaacugacugccuucucca

SEQ ID NO: 4115660 - RNA, 57 nt, Human
ugguggaggcgcugcuggccaggcucaggcugcugcgaggucggcucuccuccauca

SEQ ID NO: 4115661 - RNA, 59 nt, Human
ugguggcagcaggagggccccucagaaaagggaugggcuugugguccccucugcccuca

SEQ ID NO: 4115662 - RNA, 86 nt, Human
ugguggcccuaccaguggacaugggugaggaagcaugcauuuuucagaagcuucuggcagcuauccucuggccauaagggaagcca

SEQ ID NO: 4115663 - RNA, 65 nt, Human
ugguggcugccaaaagcacugaaguauuagaccacaccucaaagcuuucugugcagugaacacua

SEQ ID NO: 4115664 - RNA, 64 nt, Human
uggugggaaauacggccagcugcagagugaauguccacuaagggggaaggcuguuuuuccacca

SEQ ID NO: 4115665 - RNA, 129 nt, Human
uggugggagaguaaaaagcucgguggauugccuuuggagaguuuguuaggggagacucuccccauaugggaaacacuccaagccagcaggccaguuucacacuguccaggcugcaguuaacucccauca

SEQ ID NO: 4115666 - RNA, 77 nt, Human
uggugggaggugguaccuggagugcaagucauuuugacuuauuuauaucucugcaguuuaagaaaucauccccauua

SEQ ID NO: 4115667 - RNA, 68 nt, Human
uggugggcagagcaagggaacucaagacagccauuguccacugcaagaucuugucucugccacaucca

SEQ ID NO: 4115668 - RNA, 60 nt, Human
ugguggggauucccucccuggccugaccucaaucccgccagcugcagucuauucccaccg

SEQ ID NO: 4115669 - RNA, 63 nt, Human
ugguggggcgaucggaaucgcaucgucaaaauacuaauuauuguugcauccaaagccccacca

SEQ ID NO: 4115670 - RNA, 57 nt, Human
ugguggguagagcucacuguagugggucuaucccaggcccagcugccucucccacca

SEQ ID NO: 4115671 - RNA, 55 nt, Human
ugguggugggaguggggagggugucuuguuuuugcaucuccaaaaccaaucacua

SEQ ID NO: 4115672 - RNA, 65 nt, Human
ugguguaaagucauaugcacagagcuauucaaaacauaaaaaagcuucaguauauaauuacacca

SEQ ID NO: 4115673 - RNA, 59 nt, Human
ugguguacucuguugacuaacacaugugagugugcuuguguucucacacagaugcagua

SEQ ID NO: 4115674 - RNA, 75 nt, Human
ugguguauaggaagcacuuaaagaauuuguugacucauucaccacuuugagccuagcuuccuuaucuguaaacca

SEQ ID NO: 4115675 - RNA, 63 nt, Human
uggugucugcacucccuggcguggucugcaggagacagaagcacccugggucugcugaugcca

SEQ ID NO: 4115676 - RNA, 85 nt, Human
uggugugacuucacuggugcagagaaccauugcaagacuuugccugaagaaaauuuucagugguaucuuuguaaaagucacccca

SEQ ID NO: 4115677 - RNA, 71 nt, Human
ugguguggugggcagugugucaguaucuucuuuuuguagaauggugaagaaauaugugcuugauuacagca

SEQ ID NO: 4115678 - RNA, 88 nt, Human
uggugugguuucccagccuggguacaggacuuggcagccucauuucucaauguccucuucugccucaggcccuggggaucuaaaacca

SEQ ID NO: 4115679 - RNA, 76 nt, Human
uggugugugcuguuugcaaccaaauauuagaaauauuauuuuucuucaguuugguaaauguaagaauaauacccca

SEQ ID NO: 4115680 - RNA, 89 nt, Human
ugguguuauuuuugucauguuuuguaaugucuaacuucuccaagggcacuggcaaaggagauguacagaagacaaaaggcagcuagcca

SEQ ID NO: 4115681 - RNA, 67 nt, Human
ugguguugacgccugucuccucccaacuuauggcauugaucaucuuuugguaggagccgggcuacca

SEQ ID NO: 4115682 - RNA, 71 nt, Human
ugguguugcuguuuucaaggcauucugggagaaacaccuucacaguugauugaaacacagcugccacacca

SEQ ID NO: 4115683 - RNA, 78 nt, Human
ugguguuuucaaaagcucucagaggauucugauggccugccaagguggagacuucuacuagagaccuugcagacacca

SEQ ID NO: 4115684 - RNA, 122 nt, Human
ugguuaguaucuauucccuauauaguaaacaaaauaauaauuuaauuuucacaguggucagaggccaucuuaggaacuauaugugaagguagaauuugugaacagggaaggaguaguagcua

SEQ ID NO: 4115685 - RNA, 55 nt, Human
ugguuaucagccagcgaagcucauugugaagaugagaucgcccagcugguaggca

SEQ ID NO: 4115686 - RNA, 67 nt, Human
ugguucaggcaggguguugcuggaaaccgaaaagaaaagucucuuccauaaaaugaugccugaacca

SEQ ID NO: 4115687 - RNA, 130 nt, Human
ugguucuagaacccauccuaggagcagguuuggauguuauggagucaggcaaugcuugcuugguauuccugucucauaaagcuuguagaguuugacuuccuccagauaguuucucacucuugguucauca

SEQ ID NO: 4115688 - RNA, 57 nt, Human
ugguucuccauucagcuuccugugggcugcugucuccaccggaaggggagggaacca

SEQ ID NO: 4115689 - RNA, 106 nt, Human
ugguucucuuuugaaaugcuugauuguacuuauugagcuaaacaagucuuggugacuguuguugauuugccucaaaaguuuuaaguccuggguuuucagacuacug

SEQ ID NO: 4115690 - RNA, 69 nt, Human
ugguucugcaggcuauacaagaagcaugaugccaacaucugcuucuggugaggccucaggaagcuucca

SEQ ID NO: 4115691 - RNA, 85 nt, Human
ugguucuuucuuuccacaaguguuuagagagggccuucuggaggccagcugcuguccuaggcacuguaaugaaaagaggaaacca

SEQ ID NO: 4115692 - RNA, 62 nt, Human
ugguucuuuuuuguaguaggugguguuucacaaggcgcuuaauuuucuauagaaaaguauca

SEQ ID NO: 4115693 - RNA, 109 nt, Human
ugguugagacagaguuucacucuuguugccuaggcuggagugcagugaugccaucuuggcuuacugcaaccucugccucccagguucaagugauucucugccucagcca

SEQ ID NO: 4115694 - RNA, 81 nt, Human
ugguugauuucuuuccccaucuccuaccauugaguuaggguucugguuuaggcuucuggugggagcaugacugaaaugcca

SEQ ID NO: 4115695 - RNA, 66 nt, Human
ugguugcuguggcuaaauauuuauugcuuuaagagguucugcuuuaauuagagucacaaguaacca

SEQ ID NO: 4115696 - RNA, 79 nt, Human
ugugaaucagaggcugcauuuuuauccagggcuucuggugacaguuuuaagcuggaugaacaaagcagacccugacaug

SEQ ID NO: 4115697 - RNA, 72 nt, Human
ugugaauucuuaaagauuaaauuuuauuuuaucucuauguagagguaggaaaccaaucuuuugggaggcaca

SEQ ID NO: 4115698 - RNA, 95 nt, Human
ugugacaaagcaaauugauggcagugauaggcuagugaugucauugugaugucaguccuccugcuuauccugcacaugcuugcuaauuuggaaca

SEQ ID NO: 4115699 - RNA, 71 nt, Human
ugugacagaacuauugacauuuuuauagcuugacaaaaauuaagcauaauuaaagugaaauauuuguugca

SEQ ID NO: 4115700 - RNA, 66 nt, Human
ugugacaggugcugggggcaguguguuauuuauagacacagagcccuuccuugcaccauggaagca

SEQ ID NO: 4115701 - RNA, 68 nt, Human
ugugacauuuuuacugaugagaguucuaguaacaguuaacucaaguuuucuccuacagaagagucaca

SEQ ID NO: 4115702 - RNA, 74 nt, Human
ugugaccaaacuguucucugugggauucugauuuaauucauggcauaucugaaagagaaaaguuauuaaucaca

SEQ ID NO: 4115703 - RNA, 55 nt, Human
ugugaccccugaaaauggcugcugccauuagguaauggccauggcgggggucaca

SEQ ID NO: 4115704 - RNA, 60 nt, Human
ugugaccuuuuguuuucagggauaaggauguuccuuucuuccuggcauagagagggcaca

SEQ ID NO: 4115705 - RNA, 60 nt, Human
ugugacuaucauucuaaacaucugaugaaaucaaauuucaguguuuggaaugguaguaca

SEQ ID NO: 4115706 - RNA, 69 nt, Human
ugugacuauuaggaggugcucaaaguguuauuuccagaaaacacacuucucccaucuccuguugucuca

SEQ ID NO: 4115707 - RNA, 113 nt, Human
ugugacucucaggcacuuagcaagugagucaacccaaaugaugacuccccauguacgccaccuggaugggccacacacgauugggugacucauaagugcuucugagagcaaca

SEQ ID NO: 4115708 - RNA, 73 nt, Human
ugugacuguauuacauauuuuugaaaacuacuccguggcauauuguuaggaaguuucagaaaaugcaggaaua

SEQ ID NO: 4115709 - RNA, 56 nt, Human
ugugacuugauguuugcaccagaaugaggccagaaugguguugacaucaaguuaua

SEQ ID NO: 4115710 - RNA, 71 nt, Human
ugugagaagggugaggcuuuuacaaguaaucaauauccuuaagcuugacuugaaaagucuauucaauuaca

SEQ ID NO: 4115711 - RNA, 94 nt, Human
ugugagacaaggguggccgggugcucuggaggugcuggggugguccccucacggccccucugagcuuacucugucuuccacacuuuguugagca

SEQ ID NO: 4115712 - RNA, 62 nt, Human
ugugagacaauuccucaguagacuucgugguucuaaaauacguuguuuugaauugucuuaca

SEQ ID NO: 4115713 - RNA, 58 nt, Human
ugugagagagugugauggagcacagucaugucaggcugaguaacauuuccucuccaca

SEQ ID NO: 4115714 - RNA, 70 nt, Human
ugugagagaugaggaggccaguaagagccugaugcuauccaggacucuuccuuccuuccuccaacucacg

SEQ ID NO: 4115715 - RNA, 76 nt, Human
ugugagagaugcacucccaggggagucaucugcuuucuccaggaauuagguaccccugggaggaguagucucucca

SEQ ID NO: 4115716 - RNA, 56 nt, Human
ugugagaguauaaucucucuguuucacaaaaugacagacagaacaacugcucucca

SEQ ID NO: 4115717 - RNA, 57 nt, Human
ugugagaucagugcaucagucaaagcaacucaguggcuuccuaaacugauuuccaca

SEQ ID NO: 4115718 - RNA, 56 nt, Human
ugugagaugcuaucuucaaagugcccagcaaaauacacuaugaaguuagcccucca

SEQ ID NO: 4115719 - RNA, 108 nt, Human
ugugagcuugcauugcaguaguuuaccaccaaggcaagaacugcaugcuaucuaaguuuaauugccuuuaaguauaacugcugcaagccuuaguaauuauaguucaca

SEQ ID NO: 4115720 - RNA, 55 nt, Human
ugugaggcaaagacaaagcagcaucuagaaggggcagcuuguuccuuugcuucca

SEQ ID NO: 4115721 - RNA, 82 nt, Human
ugugcauggcaggauguuugcuagcauuccuggccucuacccacuagaugccaguaacaccucgcagacuccaauuaugaca

SEQ ID NO: 4115722 - RNA, 93 nt, Human
ugugcauucaccuacuuggacauugggauuaaauacauggaauuccaggauccaugacuaggaaaccaguuuccaaguucuggagagugugua

SEQ ID NO: 4115723 - RNA, 79 nt, Human
ugugcauuucaugcagcuugaaguaagagaaaaauugaauagacccucuugccguauuuguacugcauuaugagacaca

SEQ ID NO: 4115724 - RNA, 82 nt, Human
ugugcauuuugugauccuggcugagguaacuaugaauaacucuguaaguaucuaguuauguaccucaccaagacacugcuca

SEQ ID NO: 4115725 - RNA, 79 nt, Human
ugugccaccacaauuagcugugugucuaucuccauuguuaacauccaaucaagcaacaggaaauagcugauuagguaca

SEQ ID NO: 4115726 - RNA, 129 nt, Human
ugugccagggacugggccaggcagaggcugggguauccguuaguaagaugggcacggucccucgcugccugcucugauuuuugccccagcucugagagcagauuaaugguauuguaaguccucauugua

SEQ ID NO: 4115727 - RNA, 55 nt, Human
ugugcccuucugaugcuuuccucuugguauuagcuacaaguaacagaagagcaca

SEQ ID NO: 4115728 - RNA, 79 nt, Human
ugugccgccugcgggaggggcugugcgaggggucacgggugagcuuguccuucuugucuugcccaaaucagcggggcca

SEQ ID NO: 4115729 - RNA, 56 nt, Human
ugugccuacugauagagccaagggcugauauccuaucuggcucugucgaaggcaca

SEQ ID NO: 4115730 - RNA, 62 nt, Human
ugugccugaagcugcauuccuaguugucuguugaccacuuguucaugagugucuuuggcaca

SEQ ID NO: 4115731 - RNA, 63 nt, Human
ugugccuggcauguagaaguuacuuaagauaaaagcucuagaguaaugaagauuuguugcaca

SEQ ID NO: 4115732 - RNA, 71 nt, Human
ugugccuucuucuuugaggaagaaagaacuuccuguucugauguauagguuucuucaaagaagaaggcaca

SEQ ID NO: 4115733 - RNA, 90 nt, Human
ugugcguaguuauguuacaauccaacaaaauuaccaugagagccuugcuucacagauaauuuaguuggauuugugaauuaaguagguaua

SEQ ID NO: 4115734 - RNA, 70 nt, Human
ugugcgucuaucuccugguacccuuccuagcaucaauucuguauuugcaggaguccaaucaggagacaca

SEQ ID NO: 4115735 - RNA, 91 nt, Human
ugugcuaagggaccauagcuaaagcaugacucaagaauuacucaguuuggagucugugagguuaugcuuucucuacuguuuccuaaguacg

SEQ ID NO: 4115736 - RNA, 110 nt, Human
ugugcuaagguuauucuauuucacaugccuuuuacucugcacucuggggcuuucucuugcugguguagaguguaggccuaaagugucaggaauuauugacuuuaggaaca

SEQ ID NO: 4115737 - RNA, 130 nt, Human
ugugcuaggugcugcauugguggccuuacauaguuuuuggcuuucacaguauccauuugagagaugaggaagugaagacuuggagaaguuaaguuacucuugaagguuguuacauagcuaggaagcagca

SEQ ID NO: 4115738 - RNA, 69 nt, Human
ugugcuccacacucccaguccuccaagucugaaaauaaaggucuccacugggaaguuuggagagacgca

SEQ ID NO: 4115739 - RNA, 94 nt, Human
ugugcucgggcagauggcccugccuggagcucccugucucccauuucuccaccuagaagggaagcugcuggguccaccuucccaaaagagcaca

SEQ ID NO: 4115740 - RNA, 63 nt, Human
ugugcucugaaagcccccaguagauaccuguucucccaggacuggggacucauucagagcaua

SEQ ID NO: 4115741 - RNA, 55 nt, Human
ugugcucuucuguuacuuguagcuaauaccaagaggaaagcaucagaagggcaca

SEQ ID NO: 4115742 - RNA, 64 nt, Human
ugugcugcucucagugacagccucuauaguuugggaagccuuguguccugggagccacagcaca

SEQ ID NO: 4115743 - RNA, 63 nt, Human
ugugcugcugucagagcaaugagguucagcaguuguggugacaaauuaguuuugacaagcuua

SEQ ID NO: 4115744 - RNA, 67 nt, Human
ugugcuuauuuuuguggcucuggaggaucuuucuaaugagauuuuccuccuggauacaaagggaaca

SEQ ID NO: 4115745 - RNA, 92 nt, Human
ugugcuuuagguaaagaaauuuccagacuuuuuccaggaaaccuauuuuucauuggcuaaagaccugggaucaaauucaugcuugaaauaca

SEQ ID NO: 4115746 - RNA, 73 nt, Human
ugugcuuuucuccaggaagguaugcugaccacgcuuaugaacagcaaccuggaucauggugaaaaauagcaua

SEQ ID NO: 4115747 - RNA, 101 nt, Human
uguggaacauugacuucauauugcuuuggugacagauuauagggagcguuuaucuagaagguguuuuguggucugucuacaaugauguaaacuguucugca

SEQ ID NO: 4115748 - RNA, 66 nt, Human
uguggaaggggccccaugaccagcccacugugagcucacacgugaugacugaggcuucuucacaca

SEQ ID NO: 4115749 - RNA, 80 nt, Human
uguggacaugagagaauguacaaagaguauagcuuugaguucuuuucauuuuaaggauuacuuuguguacccauguccca

SEQ ID NO: 4115750 - RNA, 77 nt, Human
uguggacuucucuuaagcauucgggacugcagcauuuuugagagcaugcagcauugaaauagcuaggcuugucuuca

SEQ ID NO: 4115751 - RNA, 74 nt, Human
uguggacuuuugagaaacugcugcuccaacacccccaccacguucagagcagcugguucccgagggcgucugca

SEQ ID NO: 4115752 - RNA, 118 nt, Human
uguggaguauguaaagaagguagguggugacagagcugaaaggcaguggguagugugaaguugcaucccucaccaaguugcuuuuugcuucucuuaucaggcuuucucauacuucuca

SEQ ID NO: 4115753 - RNA, 62 nt, Human
uguggagucgcuggcgaugcucuuuccuuccaaaccccaguauggcuucauugugcuccgca

SEQ ID NO: 4115754 - RNA, 60 nt, Human
uguggaugguuugagauaugcaaugugaauguuggauuccagacucuaaagcccuccaca

SEQ ID NO: 4115755 - RNA, 72 nt, Human
uguggcagaaggggcccaaggaugucagaccugagacucggguaccuggcagcucugagucccuucuucaug

SEQ ID NO: 4115756 - RNA, 65 nt, Human
uguggcaucauuuuggauaaacauugaaaauaucuaaaguguaaucuauucaggaugauggcaca

SEQ ID NO: 4115757 - RNA, 80 nt, Human
uguggcaucccagggagcggcccaucugugguccccccaaaaaaggggucuccacagcccagcugccaccuaugcucaca

SEQ ID NO: 4115758 - RNA, 70 nt, Human
uguggcaucuagggugacucugguauagcccuaugcccagcagaucucagugucucccuggauugccaua

SEQ ID NO: 4115759 - RNA, 63 nt, Human
uguggccagccacaggcaugguguucggucauccggaagaaagguccuguggcucagcccaca

SEQ ID NO: 4115760 - RNA, 61 nt, Human
uguggccauucuaugaucugcaggccagaguugcuucucuacugcaggguuagaggcucca

SEQ ID NO: 4115761 - RNA, 65 nt, Human
uguggcccagguuggagugcagugaugagaucauaacucacugcaaccuccagcuccugggcuca

SEQ ID NO: 4115762 - RNA, 77 nt, Human
uguggccccaugugguaccuucuguggauccaugugggauccugcaggggcugaggaaccacggagaaggggcugca

SEQ ID NO: 4115763 - RNA, 59 nt, Human
uguggccuggaguuugauguaggccaguggugucuggcuccuugcaccucuaggccaca

SEQ ID NO: 4115764 - RNA, 59 nt, Human
uguggccuggaguuugauguaggccaguggugucugguuccuugcaccucuaggccaca

SEQ ID NO: 4115765 - RNA, 73 nt, Human
uguggcucagcggagcucugcugugcuuuuaggauuacuguggcucagcggagcucugcacaaaggguccgcg

SEQ ID NO: 4115766 - RNA, 85 nt, Human
uguggcucagugcccaguagaaaacuugcucgagccuguuguucugugacaacggguguggguuuuuaacugccugcaagucaca

SEQ ID NO: 4115767 - RNA, 58 nt, Human
uguggcugugguuuucauaaaucaauaaaacuugauuuaugaaaacaaucaguaggca

SEQ ID NO: 4115768 - RNA, 60 nt, Human
uguggcuuccacgauggucaccugagacaaucuuuauuggugacaaugguaggaaucaua

SEQ ID NO: 4115769 - RNA, 70 nt, Human
uguggcuucccuguuugcugugccugucagcaaaacuggcuugaggaccgggaagcauagggaagaaaca

SEQ ID NO: 4115770 - RNA, 66 nt, Human
uguggcuuguuuggccugcagagugcuggaaaccuuucagagcucagagcugccaggcaggguacg

SEQ ID NO: 4115771 - RNA, 60 nt, Human
uggguauuauugcauguaucuucauaauaaaugaaugaggucaucaccaauauaugccca

SEQ ID NO: 4115772 - RNA, 81 nt, Human
uggguauuuuuaggaaauccagaugagcaaucauacuuuuuaucagaguaccuuaucuugggucuuauaaaaaaauacuca

SEQ ID NO: 4115773 - RNA, 65 nt, Human
ugggucacaggguggguugggcugggccaggaucaaugucccaggcuccugacucauucuacuua

SEQ ID NO: 4115774 - RNA, 59 nt, Human
ugggucagaucuggccaaugguucaccaguuaguggccuaaaggcuaggucugaacuca

SEQ ID NO: 4115775 - RNA, 71 nt, Human
ugggucaguuugggggccagccaaagaaagcuuucccacugcuugcugccuggaagaccccccaggacuca

SEQ ID NO: 4115776 - RNA, 56 nt, Human
ugggucauggucuaagggcgauguaccuggguggugcagagcucugcugaggccca

SEQ ID NO: 4115777 - RNA, 65 nt, Human
uggguccuugccaucuuggagugaccaaacugacaccaugggggcucuugugugcaaagggccca

SEQ ID NO: 4115778 - RNA, 107 nt, Human
ugggucuagagguaaaaugggauucauggggggcaggggucaaaggugaagcagaggucaggggugaaagagggcccucaaaguuaaaggugugguuuccagaguca

SEQ ID NO: 4115779 - RNA, 72 nt, Human
ugggucuggcaugcugagauggaggagcuuuguuaggugagcuaccuuuccagagggccugccuagaaccca

SEQ ID NO: 4115780 - RNA, 83 nt, Human
ugggucuucuaugucaugcuacagaguuugaauauguuagagacuugacauaaucacguuuguguauuacaaagaucauucca

SEQ ID NO: 4115781 - RNA, 118 nt, Human
uguggguguauuuauguaagugugagagugugaagaaagcaguaaaaucuccgugcgaggcuuuaaaaugacauauguagacaggcugcuuuuccuccgcacuacagauaugucuucg

SEQ ID NO: 4115782 - RNA, 116 nt, Human
uguggguuccauuucuuuaacuuguuaguacaguauacagagugccuugaaagaucucaucuuauacaaaauuaucuuuauuagugcuuguaucacuguguucauaagugcucaca

SEQ ID NO: 4115783 - RNA, 70 nt, Human
ugugguaugacagaaaauucagagcuaagaauaaaaaccugaaucuaugcacugagucugucaugcugca

SEQ ID NO: 4115784 - RNA, 62 nt, Human
uguggucauaaaacaaaguaaagcuaacaaagccacucagaagcuaaacuuaugugaccaca

SEQ ID NO: 4115785 - RNA, 71 nt, Human
ugugguguauuuuacauugggaaaugccucuauaauuauuuuccaauagauguguuuaaugugacauugca

SEQ ID NO: 4115786 - RNA, 59 nt, Human
ugugguuaaacaucaggaaugaaaaccucuaggaggauuugcacugguguuugagcaca

SEQ ID NO: 4115787 - RNA, 66 nt, Human
ugugguuaguacugaaugugcagguuguuccaaacaaaaagugccucaaaucauguacugaccaca

SEQ ID NO: 4115788 - RNA, 79 nt, Human
ugugguuauuuaguucaguaguccuucauuguaccucaagguugugaugaaauuuuaaugaauuaaguugaauagcuca

SEQ ID NO: 4115789 - RNA, 59 nt, Human
ugugguuuguaagcaaagcaaacauuuuuggaaauguuugcaaauuggacacaaccaca

SEQ ID NO: 4115790 - RNA, 69 nt, Human
uguguacaugagaaaucaacuuuugcuguguuauaucaugaaaaaguugauguuuuucauuaaugcaua

SEQ ID NO: 4115791 - RNA, 74 nt, Human
uguguagcaagaagggagaugggguucuauacacaauguuuugaaccuucacuugcuucauuugacaauacaca

SEQ ID NO: 4115792 - RNA, 57 nt, Human
uguguauacugggugccagacaucauucuaggugcagaggaggcaccagugaacaca

SEQ ID NO: 4115793 - RNA, 94 nt, Human
uguguauauaugugauguguauaugugugugucuauguaggcaugugcagguaugugcgugggcacacacauaugcacaucacauguaaacaua

SEQ ID NO: 4115794 - RNA, 64 nt, Human
uguguaugugcacauguguuugcguggguuuuuuuuccccaaaauacacaaugacacauauaua

SEQ ID NO: 4115795 - RNA, 61 nt, Human
uguguauuaccauuuuacagcugaggaaacugaggcuuagggaaguugaaugacaugcaca

SEQ ID NO: 4115796 - RNA, 57 nt, Human
ugugucaagacauuuagucauuuaauaaauaaauaugacuacuguguacuaggcaca

SEQ ID NO: 4115797 - RNA, 85 nt, Human
ugugucaaucccagaucuaccucuaugcaugaagguauuaagcaugcaugaugacuaagguggugaugguucagcgauugacgca

SEQ ID NO: 4115798 - RNA, 92 nt, Human
ugugucaugccaaauuauauuucccuuuuuguuugugucuagggagacuagacuggugaauuagggggaagucguagaccugugugaugaca

SEQ ID NO: 4115799 - RNA, 85 nt, Human
ugugucauuuaucaucagaagucaugggaugcacaauuauaggacccaggauugaguuaaucuuugagggauaaauuguggcaca

SEQ ID NO: 4115800 - RNA, 71 nt, Human
uguguccacucaggaaugcagaccaguccaaggugagguguuccagagccugucugugcuggguggacaca

SEQ ID NO: 4115801 - RNA, 63 nt, Human
ugugucccuuggaaccucagcucugacucgccacaggucacaugcugaggggucuauggcaua

SEQ ID NO: 4115802 - RNA, 57 nt, Human
uguguccugcaggugcugccugcauuuauugcugccugcauuuauugccaggacaca

SEQ ID NO: 4115803 - RNA, 66 nt, Human
uguguccuggugccacuagagaaugucugcuucaagcaggcaggacucuucugugggccgaacaca

SEQ ID NO: 4115804 - RNA, 68 nt, Human
uguguccuuucuuaagagugagaaacucuuucucauaaguucuccucacucuccagaacugggucaua

SEQ ID NO: 4115805 - RNA, 83 nt, Human
ugugucuaaaguuuagguuuggggguuagggagauguaaaaguguucacacuccagacacagacacuaugacuucaggacaua

SEQ ID NO: 4115806 - RNA, 93 nt, Human
ugugucucuugcaucugcugugggucuauauuuuacuggacacuccagaugcuauaucuuuggauccacaacugcaugcccacuaagaucaua

SEQ ID NO: 4115807 - RNA, 70 nt, Human
ugugucugagcuggggcagacagauuggugcaggguuucuuaaaaacaauuuuuugcuccaucagacaca

SEQ ID NO: 4115808 - RNA, 116 nt, Human
ugugucugcauguuccagagugugguuuuggaguucagacugccuagauuugaauccuggcucaagccccuguuagcucugugagucuaggcaaacucaugccauugcggaccuca

SEQ ID NO: 4115809 - RNA, 61 nt, Human
ugugucuguacaggugcauguucuuuuuauuucuuaaggccaacauuuguagucaggcaca

SEQ ID NO: 4115810 - RNA, 86 nt, Human
ugugucuugggugaagcguauguuuuuuaaaauccucauuucacaaaauaggaaguuaguaaauuaugugcaaaauugaggaaaca

SEQ ID NO: 4115811 - RNA, 80 nt, Human
ugugugacugauuuucaaaauguguuaaaugaaauauacuuucaagguccauuuauucaagaugagguucaugucauaua

SEQ ID NO: 4115812 - RNA, 123 nt, Human
ugugugagacuggaucugcauggauccuggguggcagauguuugcaccagcuaccaggggugggaggugcaguguguaauccaggaacuuuauaaaagggggauauccagugauccucaugua

SEQ ID NO: 4115813 - RNA, 80 nt, Human
ugugugauaaugggcacauaugcucauuaacaugcugucauaaacagcuguguuaaauguauuauguguucugugacaua

SEQ ID NO: 4115814 - RNA, 79 nt, Human
ugugugauguccuucggacaaaauucuuuuaaguugacaugcaggacaggaauuugagugcuguaggaaaaucaccaca

SEQ ID NO: 4115815 - RNA, 58 nt, Human
ugugugcacauacacauauauguauguacguacauauacaggugguauguguaaagca

SEQ ID NO: 4115816 - RNA, 56 nt, Human
ugugugcacaugauuugaaauggagauugcauacuaaauuuaacuauguguacaca

SEQ ID NO: 4115817 - RNA, 120 nt, Human
ugugugcaugcgagcugugcagcucaugugcacguccugugugagugcaccaccugugacauuaacugggugugcagagacacagcgcacaugagggccugcacaggccaugaccacaca

SEQ ID NO: 4115818 - RNA, 60 nt, Human
ugugugcuuuuucuggauucucauuaucuuuaauuuucuuguuccugggaaaggcauaca

SEQ ID NO: 4115819 - RNA, 78 nt, Human
uguguggacauggccucaaugcagcugcugccugggugucuuggaggcgcccaucggugcagagggcacaucuauaua

SEQ ID NO: 4115820 - RNA, 81 nt, Human
uguguggagcugcagagugaagaaaacaaacauuguauucuuuauauuguuuacacuaacuucauaaaagcauuucacaca

SEQ ID NO: 4115821 - RNA, 107 nt, Human
uguguggccuggugauucaguguccugugcggugcagcaugcaaguguggcugucucucuuucucagggcacugcagcaucaccuuaugacguuaaagguacgcaca

SEQ ID NO: 4115822 - RNA, 61 nt, Human
uguguggguaacaauccacaucaaaagugagcuuuacauugacuuggauuguuagacauca

SEQ ID NO: 4115823 - RNA, 77 nt, Human
uguguguaauggacagcuugcagagccacccuccuggugugccuugaagggaggcauucucagucuccauccaugca

SEQ ID NO: 4115824 - RNA, 75 nt, Human
ugugugugaaccauugagggcugaagggugaaaugacagaaggaagucuggaaagcuaagcuggugucauaugca

SEQ ID NO: 4115825 - RNA, 88 nt, Human
ugugugugaugagcuggcaguguauuguuagcugguugaauaugugaauggcaucggcuaacaugcaacugcugucuuauugcauaua

SEQ ID NO: 4115826 - RNA, 58 nt, Human
uguguguguagauaaguauaugaugucuuucugggacuauaugcuuaaucucacuaca

SEQ ID NO: 4115827 - RNA, 85 nt, Human
ugugugugugagggagacgguggagaugcugccguggccauacucagauuuggaaaggucaguuccacuuccaucaugccacaca

SEQ ID NO: 4115828 - RNA, 67 nt, Human
uguguguguguaaaaauccagagcccaucaaaagacaucugguuugcuuugguauuucacucacaua

SEQ ID NO: 4115829 - RNA, 60 nt, Human
uguguguguguguguauguguguguguauguuuguguguguauauguguacauacacaca

SEQ ID NO: 4115830 - RNA, 80 nt, Human
ugugugugugugugugugugugugguuuuacauugugaugcugucuuaguccauuagggccaccauaacaaaaugccaca

SEQ ID NO: 4115831 - RNA, 76 nt, Human
ugugugugugugugugugugugugugugcucagugucuuucuauuguguaugcagaaacaugcaaagaacucuaca

SEQ ID NO: 4115832 - RNA, 60 nt, Human
uguguguguuuccgaaugcaagcguguguauaagaguguguguguuaggaagggcacaca

SEQ ID NO: 4115833 - RNA, 58 nt, Human
uguguguucauccccucaacauuaauaaauuaauaaauguugaguggaugaacaaaca

SEQ ID NO: 4115834 - RNA, 69 nt, Human
uguguguucuaugguucagggugggaugugggaaggggaaggccaugcaccacccuccaggaacacaua

SEQ ID NO: 4115835 - RNA, 74 nt, Human
uguguuaccaacccugaagaaacuucuaagugggagaacuccccaggaggaugauuuuaagaggccggaacaca

SEQ ID NO: 4115836 - RNA, 79 nt, Human
uguguuacugacagccucuuugccuccagaguucaacuggagacagagaaaccagcuagaggcagagggagguaacacg

SEQ ID NO: 4115837 - RNA, 118 nt, Human
uguguuauuccuuggguguucugauuucauaugacagcuuuuucuaggauucaaaccauaaacauuuccucuagagacuguaaugagagguacaauuaucaacccaggggacuguaca

SEQ ID NO: 4115838 - RNA, 62 nt, Human
uguguucauucugugacaugcauguagcaugauaugcauacagcauauacagaaugaacaca

SEQ ID NO: 4115839 - RNA, 56 nt, Human
uguguucuuaaaagcagugauauuaacaugcuuguaaucagacuuuuaggaacaua

SEQ ID NO: 4115840 - RNA, 58 nt, Human
uguguucuugcccaggaguuugguuucuucucucugagcuccuggcacaguggaacca

SEQ ID NO: 4115841 - RNA, 96 nt, Human
uguguugauaugagugccaaugacagaaaaguguauaguuugugagaagucauuaagauuugugcauuucucugagugugugucauauuuaauaca

SEQ ID NO: 4115842 - RNA, 83 nt, Human
uguguugauuaugguugcaggacagagaggccucaacuacuuuugcuuuuaggagugcuuuaguucuugcaacuggaagcaca

SEQ ID NO: 4115843 - RNA, 74 nt, Human
uguguugggugcugaguuucaggaagaauaugggcccacccaguauuuggaaucugccuuaggaccuguccaca

SEQ ID NO: 4115844 - RNA, 63 nt, Human
uguguuguuuuaagcugcugcauuuguaguacuuuguuguagcagccauagggaagcaauaca

SEQ ID NO: 4115845 - RNA, 61 nt, Human
ugggugggaagguacacgggaaagaggauuuaagaaaaacuucacccaucuuacccacuca

SEQ ID NO: 4115846 - RNA, 59 nt, Human
ugggugguuuaugaguggguuuauggguggcccuccccagccucagacugagccaccca

SEQ ID NO: 4115847 - RNA, 55 nt, Human
ugggugugacugacuguguuucuggaugagauuaacauugaacuuggcacaccca

SEQ ID NO: 4115848 - RNA, 59 nt, Human
uggguguuuuacuuuagcuaaugcugcagagauaaugcagacagagaaaugaggcccca

SEQ ID NO: 4115849 - RNA, 122 nt, Human
uggguuaaaucuuguguagaaugcaugugcuagucagguuuuauggacuuucucugcauuuguauuguuauucagagcugaaaaagcugacccgggacugcagacuacuaaguuguggccca

SEQ ID NO: 4115850 - RNA, 55 nt, Human
uggguuacuuuauuucagggguuacagaaauucuccugaaauucucacuagcuua

SEQ ID NO: 4115851 - RNA, 65 nt, Human
uggguuagaagcaaggcaaaagaguuauccccauaaaagagaugacacugcaaguauuuaaccca

SEQ ID NO: 4115852 - RNA, 68 nt, Human
uggguuccuaacugcccugggcaagguucuaccaauagacacucauguuuccaggcaguggcuaccca

SEQ ID NO: 4115853 - RNA, 68 nt, Human
uggguucuagcaccacauuaaauagcaacaaccuagugguaaugcuauaaaguagaugggugaaccca

SEQ ID NO: 4115854 - RNA, 71 nt, Human
uggguugaauguuagcugugcuuuaaguucuuugagaaaucuccaaacugcuuuccacaguggcuaaccua

SEQ ID NO: 4115855 - RNA, 78 nt, Human
uggguugggacaaaaguaauugcaguuuuugccauugaaaguaaugguaaaaaccgcaauuacauuugcaccaaccua

SEQ ID NO: 4115856 - RNA, 59 nt, Human
uggguuggggccguccugggcccugcagggugcugagcagaguccauggccuccaccca

SEQ ID NO: 4115857 - RNA, 71 nt, Human
uggguuuagcccaccacccugcuccccaucaggaaauccaugggcagcaaagacugugugcucuaaaucca

SEQ ID NO: 4115858 - RNA, 83 nt, Human
uggguuugguggaaucuggggacuccucagagcaaagcaggggccuuugcucugucagggccucagucuccuccccaucccca

SEQ ID NO: 4115859 - RNA, 56 nt, Human
uggguuuuagucauaucucuauuuaccagugccuggcacagaguggcuaaggcuca

SEQ ID NO: 4115860 - RNA, 69 nt, Human
ugguaaaagcaggucccagaaaguuaauucuuuauaauugaggaaguaacuaagggacuugcaauucca

SEQ ID NO: 4115861 - RNA, 58 nt, Human
ugguaaaagugggacuuguguuuaucauuucucaaugagcacaguccuauguuuauca

SEQ ID NO: 4115862 - RNA, 83 nt, Human
ugguaaaauauauaugaagaagucuugauuacgugaagaucacuugacucagaauacuucaauguauuuuguucacauuacca

SEQ ID NO: 4115863 - RNA, 57 nt, Human
ugguaaaaugacacuaaacauagccccucagggcagguguggaguguuauuuuagca

SEQ ID NO: 4115864 - RNA, 112 nt, Human
ugguaaaugacaguaccucuucuucauucagcaaggcaugugcaggaggcgaugucugagcagugcuccaagccccauagcuaaaguggaugaggagagguucaauuugcca

SEQ ID NO: 4115865 - RNA, 63 nt, Human
ugguaaaugcuccaagcaguacuguguuuaaggaaccuguuuugcccaaugcagcauuuccca

SEQ ID NO: 4115866 - RNA, 125 nt, Human
ugguaaccagagcuccacuaaucaaacuucuggcucugcccuuaggaaggcucaccaagugcuugugggcagucuuauugggccuguagucgauuucuuugaucagucuggacuuguaaagacca

SEQ ID NO: 4115867 - RNA, 102 nt, Human
ugguaagggacaaaacaaacccugggacucggaugcuggaaaaaucauuugcuuuuaauagaguugauccuuuucauagguuuacccauuuggucuuugcua

SEQ ID NO: 4115868 - RNA, 68 nt, Human
ugguaagucaggcauguguacucuuugaugauguugguacgaaauccagaagcauguguaauuugcca

SEQ ID NO: 4115869 - RNA, 98 nt, Human
ugguaauauauuugagagaggacuuugugguacauuagugcuacuuggggacagcuagguguaugaacuacagugcauuuucuuaagcuguaugucca

SEQ ID NO: 4115870 - RNA, 56 nt, Human
ugguaauuacaaggagucggguaauuccuuugaaauccaucuugauguaauagcca

SEQ ID NO: 4115871 - RNA, 77 nt, Human
ugguacaacugaacauaauuaaauguccugggugguuccugaucuuucagggcucaagguuaucuuuagugacauca

SEQ ID NO: 4115872 - RNA, 94 nt, Human
ugguaccacccuaccucugcugccaccagaaccacuuuuaucuguuucuuauuuggagucucuguaguggagaagaguauaggcuguggagcca

SEQ ID NO: 4115873 - RNA, 91 nt, Human
ugguaccuggcucagugugaaugcucaguaaauguuaucuccuacuaaaucuugcauaaaugaguuuuuugcuggauacgacagaguacca

SEQ ID NO: 4115874 - RNA, 61 nt, Human
ugguagagucaggacggcaauucugggauuccugaugccagacuuacuguuuugucugcca

SEQ ID NO: 4115875 - RNA, 91 nt, Human
ugguagcaaaaguaaaagaacagcauaaguauuuauuucagccaucagcacugauuugcaaugauuugugcuuuugguauucuugcuucca

SEQ ID NO: 4115876 - RNA, 65 nt, Human
ugguaggagcagggguaggaugagccagagaaagcuggagccuggcuucugccccauucucucca

SEQ ID NO: 4115877 - RNA, 109 nt, Human
ugguaggcuugauaaaguacagauuccuuggacccacucccagaauugcugauuuaguaagucuggugugggauccaauaauuuguauuauauuuuuaguaaguuucca

SEQ ID NO: 4115878 - RNA, 64 nt, Human
ugguagguaaaugagacuggaggggaacaagugacaaaucuuacaagguccugaaugccugcua

SEQ ID NO: 4115879 - RNA, 63 nt, Human
ugguaguggauguucagagauuugaacccaggugucuggcuucagagucugugcauucugcua

SEQ ID NO: 4115880 - RNA, 127 nt, Human
ugguaguucucaacagcaccgaagaugcuccauugaccugauuguuccuggaauucauuauaaaagaaagauaaggauaauuuuccugggauuauugucaagcaucugauuguguaagcaacuacca

SEQ ID NO: 4115881 - RNA, 80 nt, Human
ugguauauguuaagcaaaggaaagcugacuuuuccugauagggaugagucaguuuccuucugcaucaagauguuuauaca

SEQ ID NO: 4115882 - RNA, 84 nt, Human
ugguaucugugacaagaaacauggguacagucuaugcauuugagaaucucaguguuuauggaacccugguggucacacgugcca

SEQ ID NO: 4115883 - RNA, 79 nt, Human
ugguaugaaaagggcucuguugccauuucagguugauaaacacugagggaagggguacauggcuccuugacauguucca

SEQ ID NO: 4115884 - RNA, 82 nt, Human
uggucaaggucacccaguaagucaguggcaaagcugggaauacaacccagacuuucugacucccuugcccauccccugacca

SEQ ID NO: 4115885 - RNA, 84 nt, Human
uggucacuuucaaauagguuuacuuuggacuggcgagauuuuuaaaaaauucucagcuuucaaauagacacgugaaugaugcca

SEQ ID NO: 4115886 - RNA, 57 nt, Human
uggucagcauucuuccuauaaacgggcgauuguacgcuguacaagaaugacugagca

SEQ ID NO: 4115887 - RNA, 89 nt, Human
uggucagccuuccaggaccugucuggaaugaaaagggaggaauaaaaacuuauuuucguuuauuugacauguaaggaaaagaaugauua

SEQ ID NO: 4115888 - RNA, 65 nt, Human
uggucagguaccucuggcugucccucucaccuucuuguggguuaccaggcagaggaugcugacca

SEQ ID NO: 4115889 - RNA, 61 nt, Human
uggucagucccaucucccagguggcucuccacugaguaccugggcuuugcuggaugaucca

SEQ ID NO: 4115890 - RNA, 63 nt, Human
uggucauauuaccccacuucucgcaaucuguucuugcaucuguaaaaugggguaguguuacca

SEQ ID NO: 4115891 - RNA, 56 nt, Human
uggucauucaaauuaagauuuuguuagauuucuggcaucuuggauuuggaagacca

SEQ ID NO: 4115892 - RNA, 88 nt, Human
uggucauuugcaagagauaaauguuuccuuuaccucauuaauucacaucuuucggcauagaaaauacgcauuauccuugcaguuacca

SEQ ID NO: 4115893 - RNA, 67 nt, Human
uggucccuccuggauggauuugguggagccuccuucauggguuccuauagaauccuccagaggguca

SEQ ID NO: 4115894 - RNA, 73 nt, Human
uggucccugauagauagucaccucccuuaacuuuuuggaaaaauacaguuauagucagggcuaauguggacca

SEQ ID NO: 4115895 - RNA, 63 nt, Human
ugguccugaucaccgcugggcacagaggcaauggauccugagccuagcugagcaucagaacca

SEQ ID NO: 4115896 - RNA, 57 nt, Human
ugguccuggccuugaccccaggccuggaggcuugcaauggcacuggggccaggacca

SEQ ID NO: 4115897 - RNA, 84 nt, Human
ugguccugguggcauuggcaguugacauauauuauugguauuaauugcagcagauguagcggcagcuguuuuuccaucaggcua

SEQ ID NO: 4115898 - RNA, 94 nt, Human
ugguccugucaguuuucacuagguugggagucagaagucucaggcuuuugagcaggcacugacaauucuggacugcuggaucuugacuaggcca

SEQ ID NO: 4115899 - RNA, 60 nt, Human
ugguccuuguaggcauuugagcugacaaccccugguucaaagcacauccuaacgaggcca

SEQ ID NO: 4115900 - RNA, 89 nt, Human
uggucuaauuccagcugaggauuuaaugggacucauucugacaagauauaggauauugucccaauagaugcucauuuggaaaugggcca

SEQ ID NO: 4115901 - RNA, 56 nt, Human
uggucuacagcaguuacacacaggcagugguaucugugagcagcucuguggacuca

SEQ ID NO: 4115902 - RNA, 71 nt, Human
uggucucggacaggguuugcaaggacuucggagcuaaccaguuuggagccauaacccuuucguacuugcca

SEQ ID NO: 4115903 - RNA, 61 nt, Human
uggucucucuccugcaacaacucacuuucaaucuauuaccagucuguugccagagcgauca

SEQ ID NO: 4115904 - RNA, 60 nt, Human
uggucucugcugcagcuucucaacccuguccuugcagcauagaaguggcugcagacacua

SEQ ID NO: 4115905 - RNA, 64 nt, Human
uggucugccauuuccuacucugauaucuuauaaauauaagauauccuuuucggaagagcagcca

SEQ ID NO: 4115906 - RNA, 64 nt, Human
uggucugcuggcagaauuucuucuugcucaggguagagcgagguuuguucuauucaguacuuca

SEQ ID NO: 4115907 - RNA, 65 nt, Human
uggucuuagcuacaaucacuguccuuugcucuuuucuccaagcaugacugauuccuguagcacca

SEQ ID NO: 4115908 - RNA, 77 nt, Human
uggucuuaguccugagcugucuuaaugguuggagaagccaccucucaccagcugaacugcagcccagggaugaucca

SEQ ID NO: 4115909 - RNA, 60 nt, Human
uggucuucugacuccugccgggcucccauuggccaagcccagcuggaaguuagaggacca

SEQ ID NO: 4115910 - RNA, 59 nt, Human
uggucuuuaagguagcugucauggaaauaaacaccaucaugccugcuuuuaaaggcuca

SEQ ID NO: 4115911 - RNA, 90 nt, Human
ugauuuuguaucuugagacuuugcuguauuugcuuaucaacuuaagaagcuuuugggcugagacgauggggucuucuagauauaggauca

SEQ ID NO: 4115912 - RNA, 88 nt, Human
ugcaaaaaucugucuauggagaauaaauauagggacauuuuguuuuaaaugcucucugucguuaugcuucauuagcauauauguugua

SEQ ID NO: 4115913 - RNA, 56 nt, Human
ugcaaaaggcucuucaaaauggaagccacugugguuucuguuguauggcuucugca

SEQ ID NO: 4115914 - RNA, 60 nt, Human
ugcaaaaugacuucugaaaagagucaacaucuaugaugcuguaacagauaucauuuagca

SEQ ID NO: 4115915 - RNA, 55 nt, Human
ugcaaacaucaauggccugagcauuguguauuauuaaccucagagcauguuugca

SEQ ID NO: 4115916 - RNA, 81 nt, Human
ugcaaacggggucccucucugugucaguuucuaauggagagcgagcugacagugcauggagggacucugccaagauuugca

SEQ ID NO: 4115917 - RNA, 90 nt, Human
ugcaaacucccaacaguguguuuuguuauuaagagagaaauuuggugguuuuggcuuugaugaggaagcaacugggagggagagaaugca

SEQ ID NO: 4115918 - RNA, 89 nt, Human
ugcaaagagagcuugccuaggcccagcuucagcacacaauuggagauuagaacuaggugccuggaacuggguaggcuggcacucaggca

SEQ ID NO: 4115919 - RNA, 64 nt, Human
ugcaaagcagcacccagagccaugucugcagccgcugcagcgugggagagggggcuguugagca

SEQ ID NO: 4115920 - RNA, 62 nt, Human
uguccagcauuuaggcuugcugauauguccuugaccuucucauugauucugaauccuggaca

SEQ ID NO: 4115921 - RNA, 56 nt, Human
uguccagccggcccacgcccaucuucucgaagagcacgguggguuuggcuggcacg

SEQ ID NO: 4115922 - RNA, 57 nt, Human
uguccaggcggccuugccuguugaacauaucgcuugaccagcacugcuuccuggaua

SEQ ID NO: 4115923 - RNA, 75 nt, Human
uguccagggcaggaagagguaucaccgagcagggagagagucacccuggcccggaagccucgccugcacagggca

SEQ ID NO: 4115924 - RNA, 65 nt, Human
uguccaguccuuggggugcuguccucuggaaggcgucugcagccaagaccccaagaacuggcaca

SEQ ID NO: 4115925 - RNA, 62 nt, Human
ugcuaugcuuucuccugucugaaagauuacaccaagauuguucagaaauggggaaaggagca

SEQ ID NO: 4115926 - RNA, 59 nt, Human
ugcuauguaacacagaaaugaaauuccacaagaucuugugguucucuguguuacauuca

SEQ ID NO: 4115927 - RNA, 55 nt, Human
ugcuaugucucacucccuagucagauuauagauuucuagaggggagauacuagua

SEQ ID NO: 4115928 - RNA, 60 nt, Human
ugcuaugugacugcuucagauugccaugcgguuuuaaaucuggacacaguucucaugcca

SEQ ID NO: 4115929 - RNA, 66 nt, Human
ugcuauguugccuaguguaauaucgcuugauauaguguucauaguaguuacucuggcauuauagua

SEQ ID NO: 4115930 - RNA, 56 nt, Human
ugcuauucugauuccuuugguugggugacaguuuccaggagggaccuggauuggcg

SEQ ID NO: 4115931 - RNA, 57 nt, Human
ugcuauugacacuuuuuguguagccuugagagaagaguaugaauuguguuaguagca

SEQ ID NO: 4115932 - RNA, 57 nt, Human
ugcuauugugaacagugccacaauaaacauaugugugcaugugucuuuauaguagca

SEQ ID NO: 4115933 - RNA, 78 nt, Human
ugcuauugugaauaaugcugcaauaaacauaugugugcaugugucuuuauagcagcaugauuuauaguccuuugggua

SEQ ID NO: 4115934 - RNA, 57 nt, Human
ugcuauugugaauagugccacaauaaacacaugugugcaugugucuuuacaguagca

SEQ ID NO: 4115935 - RNA, 57 nt, Human
ugcuauugugaauagugccgcaauaagcauacgugugcaugugucuuuacaguagca

SEQ ID NO: 4115936 - RNA, 76 nt, Human
ugcuauuuuaagauucuuauuagguaauuuucuugugguaaaaaggcuuugcuugacuuaagaauccacugaagca

SEQ ID NO: 4115937 - RNA, 101 nt, Human
ugcucacguacauagcuauauauuguuuaaaauaaacagggaccuuauguuauguccauugugauuauauacaaaagcguugcugugugcucgggugagca

SEQ ID NO: 4115938 - RNA, 59 nt, Human
ugcucaggacaguggaaccuaauucccagaaccucugguuguggaggcugaccugggca

SEQ ID NO: 4115939 - RNA, 56 nt, Human
ugcucaguagaguuuuuggaauaaguauuucauauuuuggaaucauuuacagagca

SEQ ID NO: 4115940 - RNA, 58 nt, Human
ugcucaguagcagugugcugcucauggcuauuguauucagcagcauuguucuagagca

SEQ ID NO: 4115941 - RNA, 58 nt, Human
ugcucagugcagugaaagguuuacugagcuacaaauuaguaaacugucugcuugagca

SEQ ID NO: 4115942 - RNA, 78 nt, Human
ugcucaguuuccuggauaagaugagaaaaaacauugggccucuugggcaguguuccacacaucuggggaagcugagua

SEQ ID NO: 4115943 - RNA, 129 nt, Human
ugcucaguuuggggucccagaggcuagccgacauauuguaugcaggacacauggaacauagucuagcuccuaacuccaucugcauuugguuucugucugguaagcucauguguaauuacagacucagga

SEQ ID NO: 4115944 - RNA, 60 nt, Human
ugcucaugacaggugaguuuuuaggaccucuggucuuucaacuuucucuuuucaucagca

SEQ ID NO: 4115945 - RNA, 73 nt, Human
ugcuccaauauuagguuccauucuucuaucucaccucuucaauggguagguccuggagcugugguaaggagca

SEQ ID NO: 4115946 - RNA, 128 nt, Human
ugcuccacugucuaggauucuauuuuucccccucugccuuuuccuaucccagcaucccaagucagcugcuggaauuauagaaaaauagagggcaauaguagaaaguccuaaaggcauugugcagagua

SEQ ID NO: 4115947 - RNA, 103 nt, Human
ugcuccagcaaggacucagggaggagcuucugggccaaauaccucuggauuuagggagggcaaaggucgcaguggcuucucucugccgguaacccuggaagcg

SEQ ID NO: 4115948 - RNA, 55 nt, Human
ugcuccaggagcaaccuuugagaacugccauccuagaugcugugcuccaggagca

SEQ ID NO: 4115949 - RNA, 57 nt, Human
ugcuccaggcaagcugagaguugcuggggacagagacuuagcugguggccuggggua

SEQ ID NO: 4115950 - RNA, 58 nt, Human
ugcucccagcuccugcagcaacccaaguaaccgggggaagugccggagguggugagca

SEQ ID NO: 4115951 - RNA, 130 nt, Human
ugcucgcccuuucuuuguccuuuuccaaggccaggauacuuacuguaaagaccuucgacaggcuuccuugugggagaguuuguuuagagugaguuuggaggagcuuaggaugaaggagggguuggaggca

SEQ ID NO: 4115952 - RNA, 82 nt, Human
ugcucuagagcuauuggcuuccacaaaaguuugugauauaguucguaucuguuaagacgagggagcuaaguucucuauggua

SEQ ID NO: 4115953 - RNA, 60 nt, Human
ugcucucagggugauggcauacugugggugauuaauaauauaugcuagcauuuuggggca

SEQ ID NO: 4115954 - RNA, 92 nt, Human
ugcucuccagcccaaaugggaggccucugucccgccagggagcuuuagguuccccgggugcuucucggaggcugacaagggcguggagagca

SEQ ID NO: 4115955 - RNA, 77 nt, Human
ugcucuccaggcuggcccagugacccacaguggcauggugcauugucucuacuguggggcuggccaccaagagggua

SEQ ID NO: 4115956 - RNA, 56 nt, Human
ugcucuccguuucugcaacagucuuucagcuguugauucagaaaaagauggagaca

SEQ ID NO: 4115957 - RNA, 74 nt, Human
ugcucuccuggaggccacaugaacgcugcgccacuuuucuggcucacaugcagucgagugguuuccuagaagca

SEQ ID NO: 4115958 - RNA, 55 nt, Human
ugcucucuggcuuccagcuggcccaguggagguaccagcuggagauuggagggca

SEQ ID NO: 4115959 - RNA, 58 nt, Human
ugcucugcacaucccucacaaacugaauguuauuucuuugguuuguugugcagaugca

SEQ ID NO: 4115960 - RNA, 57 nt, Human
ugcucuggagggugaagcuuuuacugccaacgaaugugucugggccccucuagggca

SEQ ID NO: 4115961 - RNA, 59 nt, Human
ugcucugguaacucacuuccaucugaugccugacuagaauggaauugggaguuagagca

SEQ ID NO: 4115962 - RNA, 81 nt, Human
ugcucugugaguuuccuucuugccuaggcaucugacucaggaauuugaucagaaguuaauacgaggagaaauuacaaugua

SEQ ID NO: 4115963 - RNA, 78 nt, Human
ugcucuguggauggaagcuguguugauggcauggagcuuccucccuugaaggcacaucuucccccaaguccauuugca

SEQ ID NO: 4115964 - RNA, 59 nt, Human
ugcucuguugccuugauacaguugaaggcacuuuucaagaguggcaguaaaauagagca

SEQ ID NO: 4115965 - RNA, 57 nt, Human
ugcucuuacauuaauucagcaucuauuuacuuauuggguauugguaugugugaggca

SEQ ID NO: 4115966 - RNA, 64 nt, Human
ugcucuucaguucaccccuaagcagccaggcucaguacuaggugcucagacaagcugaacagua

SEQ ID NO: 4115967 - RNA, 68 nt, Human
ugcucuucucuccuuuccucuacugcaugaggaggcaacugguguagagugacaaggugggaagaaca

SEQ ID NO: 4115968 - RNA, 69 nt, Human
ugcucuuuguccuuuuccccaaauucacuuuccaaucuuagauuuuuaaaguaggggaaugcaagagca

SEQ ID NO: 4115969 - RNA, 72 nt, Human
ugcugaauuuguaugguuuauaguuguuagaguuugagguguuaauucuaauuaucuauuucaaauuuagca

SEQ ID NO: 4115970 - RNA, 83 nt, Human
ugcugacauaaauuuucauaaacaaauuaaggccugguccaaaaaauucaaauuucauuuuuucaggcugauuuguguuagua

SEQ ID NO: 4115971 - RNA, 60 nt, Human
ugcugacccugagaguggugcaaccaucugccugccccuggccaccaccucucaccagca

SEQ ID NO: 4115972 - RNA, 67 nt, Human
ugcugacuccgccacuuccuaaacuuuggugccacaaaacaggaagcaaaaggcagggucuaaagca

SEQ ID NO: 4115973 - RNA, 63 nt, Human
ugcugagcccagaacggccuggcucuggcagauuugcccccaggcugcaagugggcggcagca

SEQ ID NO: 4115974 - RNA, 79 nt, Human
ugcugagccugcucugagggugacuguguggccuaaaggauagagggcacagaguucccacuccagaagcgacacagca

SEQ ID NO: 4115975 - RNA, 88 nt, Human
ugcugagcuuuuaccaguaugaugaguuaaugguuuauuuuuaggcagccaguggauuuccuugcauauugguaauuagacaaaagca

SEQ ID NO: 4115976 - RNA, 60 nt, Human
ugcugaguuucuucauggugcagaggcccuucuugucuccacaccagaaggagcugagca

SEQ ID NO: 4115977 - RNA, 86 nt, Human
ugcugauagauuagucaggaaaaagaguugcugccuucaucuccccuugugggcuuuggccucuuucucccaauuguccuuuggca

SEQ ID NO: 4115978 - RNA, 89 nt, Human
ugcugauugauugauuauagacucacuaaucuccuagauucaaagauaccugaagaaaaugugaacuugugaauuccggucaaacagua

SEQ ID NO: 4115979 - RNA, 66 nt, Human
ugcugcacucaccaacagauaaaacaggaguuccaggucuuuaucugccuggucuuugaugcagca

SEQ ID NO: 4115980 - RNA, 77 nt, Human
ugcugccaugcagagcaacagacacccuccaccaauuacccaugcagaggagcccucugcugccaugcagagcagua

SEQ ID NO: 4115981 - RNA, 60 nt, Human
ugcugccuguguggccacucacucugggguguaauccccaaguuggacuggacagcagca

SEQ ID NO: 4115982 - RNA, 70 nt, Human
ugcugccuuagcagccaggcaauucagcuucugcugcuuccccaucugucuggauugcugagccccagua

SEQ ID NO: 4115983 - RNA, 62 nt, Human
ugcugccuucuaggcgugcccugugauuaguuucucauaggacggagagucagggggcagca

SEQ ID NO: 4115984 - RNA, 60 nt, Human
ugcugcgguggcuggcgaugggaguguuuccugaggcugccaccaagccccuccucagca

SEQ ID NO: 4115985 - RNA, 82 nt, Human
ugcugcuccacagguacagacaaguaguucagacaagauccucucacuacccaaacucuugccuacuugucaaccagcagua

SEQ ID NO: 4115986 - RNA, 57 nt, Human
ugcugcugacuguccagaauuccuagguggauacaguccccuugguagacagcugca

SEQ ID NO: 4115987 - RNA, 75 nt, Human
ugcugcugugugggagacaggcgcugucccagggcaggcucuccugggccuaugcuuuucuccaggccagcuuca

SEQ ID NO: 4115988 - RNA, 61 nt, Human
ugcuggaagaaaauucuuuaacauccugaaaaagaaaggguccaagaaggaucuuucagua

SEQ ID NO: 4115989 - RNA, 63 nt, Human
ugcuggaagcuccugcaugucugagaccugagcacagggauauaacacaagggguuuucggca

SEQ ID NO: 4115990 - RNA, 87 nt, Human
ugcuggaauauuuuggaccugcuugagccaguaugagauuugugcacauaucugacuuucaauccagguuugaauugauauucagca

SEQ ID NO: 4115991 - RNA, 60 nt, Human
ugcuggagaugaaagggcccugugauaaccuugaauguugcugccuccgucauuuccaca

SEQ ID NO: 4115992 - RNA, 100 nt, Human
ugcuggaugaaucugagugucuggaauuuuaaguguucgccucuugcuucucaguagguggcugccucuugaggucuggcauucacccaagucuugagca

SEQ ID NO: 4115993 - RNA, 93 nt, Human
ugcuggcacuuagaacauucugccugggaauuuccuuagccaaauucacaaguucauuagguccauguucuaucuucuauguuccugcuagua

SEQ ID NO: 4115994 - RNA, 102 nt, Human
ugcuggcucagaauugccuugauucuucucauguguuaugggagcuauaaauccaacagcgaauaguagccacaagaagugacaagugcaauucagcuucca

SEQ ID NO: 4115995 - RNA, 67 nt, Human
ugcugggcaccggagagaccccagcagcaacaugauugggccggugggggauuccgguuccccagua

SEQ ID NO: 4115996 - RNA, 68 nt, Human
ugcugggcucauguuucuuugaggacaagaauaaggagugauuuuuuuggagagucaugugcccagua

SEQ ID NO: 4115997 - RNA, 85 nt, Human
uguuuggaggcauuuuagguugucacuacuuggggaggcacauuaccagccucuacuguguauaacccaaauaugcugcuaaaca

SEQ ID NO: 4115998 - RNA, 64 nt, Human
uguuuggcucauugcauccauguggauucccacaccccugguggaagcaguuccagcacaaaua

SEQ ID NO: 4115999 - RNA, 76 nt, Human
uguuuggcuuauaauaauacuggccaaaaacaugauucuccacuaaaaaugucaguguugguugggaagccaagca

SEQ ID NO: 4116000 - RNA, 60 nt, Human
uguuugggaacauggaacccgaagacuuaaacuguagacuuucuccaggugccccaaaca

SEQ ID NO: 4116001 - RNA, 125 nt, Human
uguuugggcaggauugagagugaacaucuaucuggucagggucagauuccagagccuguguuagaagauuaaggacuggugugugaucagcauuaguagauggauacucuuucauacuacaugca

SEQ ID NO: 4116002 - RNA, 62 nt, Human
uguuuguuaaaauauuggagaaaggauauagaauuccguccucucucccuguuuggcaaaua

SEQ ID NO: 4116003 - RNA, 66 nt, Human
uguuuguucacugagcaaugauuagcuauuugucugcaucauuuauaaugucuuugugaauaaaca

SEQ ID NO: 4116004 - RNA, 76 nt, Human
uguuuguuguuuuuauuuaugacccuguguguauacugcaauaugcacauauauuacuaguaaagacagagaaaua

SEQ ID NO: 4116005 - RNA, 75 nt, Human
uguuuguuugaaaacucacgauuuguucuuuuuggcuagaguugcuuuaagcaaagcugugaauuccuacaaaca

SEQ ID NO: 4116006 - RNA, 104 nt, Human
uguuuguuuugaagcauuugcuuaaaagcggagcaagagucuuaacccaacuugccauaacacugcuuuucucgcuuuugauguaaaucuucaaaauucagaca

SEQ ID NO: 4116007 - RNA, 73 nt, Human
uguuuguuuuuguuguuguuuugcuugacauacuugccuggauuugcuuaacacugacgacgugaacuaaaca

SEQ ID NO: 4116008 - RNA, 63 nt, Human
uguuuuaaagccauugccuuucugcaccuuauaauugcuuguucuugggggaggcuuggaaca

SEQ ID NO: 4116009 - RNA, 99 nt, Human
uguuuuacaaacucacugcccuuuucuuuuccaauaucccuacuauuuguuuugcuggugguuauggugaugggaaaggauguaauugagaauggaaca

SEQ ID NO: 4116010 - RNA, 76 nt, Human
uguuuuccaaauuagaagcuguuagcaaaauaugucacuauaucauucugcugccuaguuuaugaauuggaagaca

SEQ ID NO: 4116011 - RNA, 83 nt, Human
uguuuucccuauguccaguacuucuaaauggucaauagacuaugguuggccauuuggcaaaacugacuucucaagaggaaaca

SEQ ID NO: 4116012 - RNA, 58 nt, Human
uguuuucgugcagacuucucacucaguucuuguuuugguggggaguugagcacgagca

SEQ ID NO: 4116013 - RNA, 84 nt, Human
uguuuucucugaaacccucuguucuuuaacgcugaaguccuggaugccugcuaggagcagcucgagaaggaagcagggacagca

SEQ ID NO: 4116014 - RNA, 85 nt, Human
uguuuucucuuguauguguauuuugcuguuuuuuacuuuguacauucuauaauggacacaaaucuauaugaugcaagaaaaggca

SEQ ID NO: 4116015 - RNA, 88 nt, Human
uguuuucugagauguaaaaucaguuguaugugugcauguaaauauauauguacuaugcagucaacuguuuuuacauuaucuuuuagca

SEQ ID NO: 4116016 - RNA, 66 nt, Human
uguuuucuguguggaaaggggagcguugaauauaucucugaugcuucuguuacauaccagaacaua

SEQ ID NO: 4116017 - RNA, 92 nt, Human
uguuuucuuacuagggaagaaaggcauggaacucuggggccaacuaguagugucccauggcuuuucugguggcuuccuauggugaggggaca

SEQ ID NO: 4116018 - RNA, 75 nt, Human
uguuuucuucugaggcauuaacauauaaagaaguuucuuugaugaaauuuaauuuauagauguggauagagaaca

SEQ ID NO: 4116019 - RNA, 69 nt, Human
uguuuugaggagugugaagcguucucaugagucacuagagauguuaaaugcuuuacaguuuuccaaaca

SEQ ID NO: 4116020 - RNA, 83 nt, Human
uguuuugauuuauuuuuaaucagcagggguuuguaauuucagcuuuuaguuacuccugcuauuaaguauugaauggacaaaca

SEQ ID NO: 4116021 - RNA, 103 nt, Human
uguuuugcucaaugauaagugcucagugccgggaacacaguagauaaccaauaaauuauuugcuaaaauguauugggauuggcagacauuaaaauccaaaaca

SEQ ID NO: 4116022 - RNA, 55 nt, Human
uguuuugggucacuuuccuuggggcauuuguuuccuuuuggugaauuccagaaua

SEQ ID NO: 4116023 - RNA, 108 nt, Human
uguuuuggugaauaacaguuuauggccccacuuggagagaaaggccugagucccuguagguggauuuccucuugacucuaaaggucacagcuguugccaucauaaaca

SEQ ID NO: 4116024 - RNA, 115 nt, Human
uguuuuguaauaguuuauuuuuuaaagagguauguaauauuugcauuucuuuuauauacuuuggagaaaaagaaaugacaaggacauuccuguagggaaaaaauuaugcacaaua

SEQ ID NO: 4116025 - RNA, 56 nt, Human
uguuuuguagcuaauagcuauuuguacuaauauuuguagcuaauagcuacgaaaca

SEQ ID NO: 4116026 - RNA, 59 nt, Human
uguuuuguuagcacucugggaacuguuagucuuucacuacccagaagcuuaacagagca

SEQ ID NO: 4116027 - RNA, 63 nt, Human
uguuuuuagcauaugaucacagugucuauucaauuuuuaagggcugcaucaugguuaagaaca

SEQ ID NO: 4116028 - RNA, 67 nt, Human
uguuuuuagcauaugucaaaucagacucuaaggauucuagaaagcugaaauucagaugcuaaagaua

SEQ ID NO: 4116029 - RNA, 78 nt, Human
uguuuuuagguauuaacauguguauugguuuccuauuguuggcauagcaaacuagcacauguuagguagauuaaaaca

SEQ ID NO: 4116030 - RNA, 69 nt, Human
uguuuuucuguuucuuucugucucuugguuccuuaagggcuuugaugaucagggcagaagcagaaggca

SEQ ID NO: 4116031 - RNA, 81 nt, Human
uguuuuuggcagcuguugauccaaauuauuuuuuagaggauuauauugucuacuuugugguuuggaaagaagucaaaaaua

SEQ ID NO: 4116032 - RNA, 56 nt, Human
uguuuuuguucaaugcuagguccucagcaccuaggacugugccaggcacaaaaaca

SEQ ID NO: 4116033 - RNA, 88 nt, Human
uguuuuuucacauaaacuucaaaguuguagccaaccaaguauuuacacuauaccaggaagggcucuuuaaagacugugggaaaaaaca

SEQ ID NO: 4116034 - RNA, 65 nt, Human
uguuuuuuguaugagaagugcuuuaccaaugcaguuguguaguaaugcaaauuauacaaagagca

SEQ ID NO: 4116035 - RNA, 118 nt, Human
uuaaaaaauauuauugagcugcuaugugcguuuucaugccagcaagaauagacaguaaaaaagacauucacuguuccucuucucuggagcuuauauacuagcuuggugaguccuuuaa

SEQ ID NO: 4116036 - RNA, 111 nt, Human
uuaaaaauagucugauuugagggcacagauuucagguaggaaugauuauucucaaguaguagagaguuaaugaacaucuuaaucugaaaagcagugucagaaaauuuuuaa

SEQ ID NO: 4116037 - RNA, 71 nt, Human
uuaaaaaugccuccgcaugugccuuugauucuguagaauggaagugucuacauguggaguaaugucuuuga

SEQ ID NO: 4116038 - RNA, 68 nt, Human
uuaaaacagcugcaaaagguugccuggccacagagaaugcgugcugcagcauuauguagcuguuuuag

SEQ ID NO: 4116039 - RNA, 118 nt, Human
uuaaaacuguagaucuggccaugagagaugguaugggacagcuguuuugcagugggguaaacauguaagguuuuagggcuucauuuuaucuuaucaugcaguuuuacagucccauuaa

SEQ ID NO: 4116040 - RNA, 59 nt, Human
uuaaaaggugucuguaguuucuuuuagggaccaguaaaggagcauuaggcaaauuuuga

SEQ ID NO: 4116041 - RNA, 79 nt, Human
uuaaaauaggggaccaggaaaggagccuauuuccaagagggguauggagaccuccuuucuuuauggaguucugugguag

SEQ ID NO: 4116042 - RNA, 89 nt, Human
uuaaaauauauuucucucgguacaguuuagucaugguucagagcacccacagaagaaccuuuccuggcugaccgaggagacauuuuuaa

SEQ ID NO: 4116043 - RNA, 86 nt, Human
uuaaaaugaauucagagaaguuguucaagguggugagugccaugucacauaucauaggucuuggauaauuuagggugauuuuuuaa

SEQ ID NO: 4116044 - RNA, 82 nt, Human
uuaaaauuaguugcauucaggauaugacgaucgaauauaauaguuuauagauuaugcguccauauucaugagcugaguuuaa

SEQ ID NO: 4116045 - RNA, 72 nt, Human
uuaaacuaugauucauccuucaggacgccugcuaaggcaggcugccuggcugugagugaaaacauauuuuag

SEQ ID NO: 4116046 - RNA, 118 nt, Human
uuaaagaaugagucauugaguuuacaaaacacaagaagcaggguacaguuauuccaaaacaacauugugccugugcuuuuguuugaagagaaguaaaauguuuccacucaaguuuuaa

SEQ ID NO: 4116047 - RNA, 128 nt, Human
uuaaagaaugagugaaugaguuuacaaaacacaagaggcaggguacaguuauuccaaaaugauaggaaacaacauugugccuuugcuuuuguuugaagagaaauaaacuguuuccauucaaguuuuaa

SEQ ID NO: 4116048 - RNA, 73 nt, Human
uuaaagcuauuacaaucugcuacuaugaauaaaugaguauuuuagcucucaaaggguaauguaauagucuuga

SEQ ID NO: 4116049 - RNA, 79 nt, Human
uuaaagguucuaggcaccuuaauuaagaaauugcccugaauaauggagugcuuuuggaauuugguguccauuccuuuaa

SEQ ID NO: 4116050 - RNA, 121 nt, Human
uuaaaguagacugugcaacauuuaauuccauagcaggucaaaaaguuuaagacucauucuagcucuagaaauauagguuacuaugguuuuagccuuugucccuucuggucagucucuuuga

SEQ ID NO: 4116051 - RNA, 70 nt, Human
uuaaauacuuguuuggaguuguuaugguuauauuagugaaaaauaauuauagcgagucuaucguauauga

SEQ ID NO: 4116052 - RNA, 71 nt, Human
uuacuuuuuugaagggggagauauaugugugauauauguguagguacauauguauguucuuaccuaaguaa

SEQ ID NO: 4116053 - RNA, 56 nt, Human
uuagaaaggagcuuauuucuuuguuaugaauauaaagaauggaguucucuuccuag

SEQ ID NO: 4116054 - RNA, 111 nt, Human
uuagaaauaaccacaauaaagaaccuugaaaccacaucuuagaaagucagucaggcccccuggauguuuucuagguguguuuucaaaguucuuuauuauggcuauuucuaa

SEQ ID NO: 4116055 - RNA, 85 nt, Human
uuagaaaucagcaccaaacuccugcgaugacuuagucuuugcagacugagcucuugacugggaguuaagaugaccugaguucuga

SEQ ID NO: 4116056 - RNA, 67 nt, Human
uuagaacaguguuugccucgcucucacucacucucauaaaugcuagugauggucaugcacugucuga

SEQ ID NO: 4116057 - RNA, 69 nt, Human
uuagaagcagaucucaagcacucacgauggccaucagggaugaggugguccagcuugauucucuucugg

SEQ ID NO: 4116058 - RNA, 87 nt, Human
uuagaagcucuaagucuuuaaguaaugauaggcauacuugcguaauacauagcacauugccuuuauuuuaggauuuuaaucuucuag

SEQ ID NO: 4116059 - RNA, 60 nt, Human
uuagaagguuuccagucaugcucuuucauuuuucugagcauuugcucugguuccuucugg

SEQ ID NO: 4116060 - RNA, 74 nt, Human
uuagaaguuaguuuugggcauuagaauauucuuucucaaagaaagaagggcaggaucccaggacagcuaacuaa

SEQ ID NO: 4116061 - RNA, 78 nt, Human
uuagaauguaucuucauguugcuuauucuggguuaauauccuuagguauuuagcaugaauuuucaauauauacucuga

SEQ ID NO: 4116062 - RNA, 69 nt, Human
uuagaauucuguaauucuguuaguuucaaguauggugagcuugaguauacgcagaauaacagugacuga

SEQ ID NO: 4116063 - RNA, 75 nt, Human
uuagacaaauuucacagugaacuuugaggacucuagauacgaguguuucauguuuuucugugaggcauugauuga

SEQ ID NO: 4116064 - RNA, 69 nt, Human
uuagacaucagcuugugugcagggggaagccaucaaagcugucuuuuguuugccuguugauuuguguga

SEQ ID NO: 4116065 - RNA, 61 nt, Human
uuagacucguaguaacuggaugucugcccauuuccccuuggcauuuauugcuauaagcuga

SEQ ID NO: 4116066 - RNA, 80 nt, Human
uuagagaauugcaaacaaugggcucacaagaccugaaugaauuccaaaucaucuagugggcuuauugagccauuuucuga

SEQ ID NO: 4116067 - RNA, 58 nt, Human
uuagagcaaggauggcagcagagguuauaacagauaugcugagacuccugugcuuuaa

SEQ ID NO: 4116068 - RNA, 57 nt, Human
uuaucugugguuaacccacacacgcaggcacuuugguugcugaagaaucacagaugg

SEQ ID NO: 4116069 - RNA, 91 nt, Human
uuaucuuauuaugcaaagcauguugggucccucuuucuuugaccucacacuucaaaaagagguucucccacagccuuguaucccaagauga

SEQ ID NO: 4116070 - RNA, 72 nt, Human
uuaucuuggcaauucuaagguacauuuccccucucagaucauuaaugugccuuuugaaaaaguuaagcauga

SEQ ID NO: 4116071 - RNA, 63 nt, Human
uuaucuuuaguucagaugauuaaaugaggucuuccuacaauaagacaugugaacuaaagguga

SEQ ID NO: 4116072 - RNA, 68 nt, Human
uuaucuuuugguaucagcucaaucuuaccuuacacauuucuuaagacacgggcugaucuaaagaauag

SEQ ID NO: 4116073 - RNA, 111 nt, Human
uuaugaauaauaucacaggguguacaucaccuaugacauuaaaaauaacaccccccuaggauauuaugaauaauaucauggaguguacacacccugugucauuaggaguaa

SEQ ID NO: 4116074 - RNA, 89 nt, Human
uuaugacaaacauggcagcaaguaggauucuuauuuuuaacaauaugaacaaaauuaaaagucgauaccuuguguacaguuuggaguaa

SEQ ID NO: 4116075 - RNA, 61 nt, Human
uuaugacacauucuggcaacguuuagaugcaauuucaaugagccagaauguaguacuguaa

SEQ ID NO: 4116076 - RNA, 64 nt, Human
uuaugacaguagguaaaugauagcugugauaauuuuaaaggcucuucucuaucuacuaucauga

SEQ ID NO: 4116077 - RNA, 91 nt, Human
uuaugagguuggugcaaaaguaauugcaguuuuugccauuacuuucaaugguaaaaaucacaaauacuuuagcgccaaccuaaaaacauaa

SEQ ID NO: 4116078 - RNA, 63 nt, Human
uuaugcauuuauuuucauguguaagaagaaaaacguaacuagcacgugaacaugacugcaugg

SEQ ID NO: 4116079 - RNA, 88 nt, Human
uuaugcauuuugcagugugugguugaacuauguuuuaucugaccauucuuguguacauuuagguaguuuccaacauucauuaucauaa

SEQ ID NO: 4116080 - RNA, 61 nt, Human
uuaugcuaguugaaauaacacaagugcaaaagauggcauaugugugauuguauuuguauga

SEQ ID NO: 4116081 - RNA, 63 nt, Human
uuaugcugauuugguuuuguguucucugaaacaucaagggccaggcucccaugucaggaauaa

SEQ ID NO: 4116082 - RNA, 65 nt, Human
uuaugcugcagcauauuguacuggccugcugcuggcccgcaggcuuuucaauauguuuggcaugg

SEQ ID NO: 4116083 - RNA, 95 nt, Human
uuauggguugguucccucacuuuguaauaacuccugaguuugcaugagaaagcacagccaauagcauuauacagugaaggaauuacuacucauag

SEQ ID NO: 4116084 - RNA, 88 nt, Human
uuaugguaagcagcagcucacugaauaaugacuuccauugaguaaacauuuggcucugguuaucuucagggaugcuguuggcucauga

SEQ ID NO: 4116085 - RNA, 87 nt, Human
uuaugguaccugucagaaaugcauggcuguuuuaaagcaaauguaauugcuuucagaaauccgcugcauucugagucaauugcauga

SEQ ID NO: 4116086 - RNA, 55 nt, Human
uuaugguucaggugaggguguacaagucagguaaauaggaguaucuggaucauga

SEQ ID NO: 4116087 - RNA, 82 nt, Human
uuauguacaggcaaaguuuuaguaaacauauaugaaguaagugauauuaaauguguauuuauuuggggcuuaacguacauaa

SEQ ID NO: 4116088 - RNA, 68 nt, Human
uuauguacaugagcauaaacacacauaaauacagauauauauguguguggugguguguguguauauaa

SEQ ID NO: 4116089 - RNA, 72 nt, Human
uuauguaggauaaugaauugccuuuuaaugcagguaccaaacaggcucccugggauaauucauuccauauaa

SEQ ID NO: 4116090 - RNA, 63 nt, Human
uuauguauuggcuguauguacaucuguuaccuuuuaguggcagagagagugcagucgacauaa

SEQ ID NO: 4116091 - RNA, 74 nt, Human
uuauguccuuuaacuucaucacaagcacaagaaagauuaguacauuuugcaggugaggagucugaagcacauaa

SEQ ID NO: 4116092 - RNA, 97 nt, Human
uuauguucagaacucaucuuugucccugacuuucuauauguagcacccguuuuguguccaacccagggacaaguaugacacugucucuggaacauga

SEQ ID NO: 4116093 - RNA, 65 nt, Human
uuauguucuaaucauauggguaauccaauggagggccuuggauuacccauaugauuagaacauaa

SEQ ID NO: 4116094 - RNA, 118 nt, Human
uuauuaaaaaaaguacagguaaugagggaagguaugaucuuacauguaugaguuugaaaauaucuguaaagauguuuauaccuuuacaaacaugacugaaugaaguugguuuugauga

SEQ ID NO: 4116095 - RNA, 64 nt, Human
uuauuaacauguucuguugguuuuugaggaauagucuccgaaaaagucauuggaauauuaauga

SEQ ID NO: 4116096 - RNA, 64 nt, Human
uuauuaccccugugggcucagagccuguuuugaaauaaagcaaauaagaaccacaggggaguga

SEQ ID NO: 4116097 - RNA, 102 nt, Human
uuauuacuuccaaauauaaaaagggucuuagagguucauuuuuuucagacacuaaaauugaaaaugaugggaaucuaauuuugguauggaugguuguuauaa

SEQ ID NO: 4116098 - RNA, 79 nt, Human
uuauuauauacucaagggugauuucaugaaaaaguuagaacauuucauguagugguaaaccuuuggguguuuauaauag

SEQ ID NO: 4116099 - RNA, 68 nt, Human
uuauuaucucauuuaaaaauauucuaggucgcuucaguguucucaggcagugguaaaugaguuaauga

SEQ ID NO: 4116100 - RNA, 78 nt, Human
uuauuaucuccauuuuacagauuaaacagcgaggcauacuugugccucaguguuuaaucuauaaaauggagauaguaa

SEQ ID NO: 4116101 - RNA, 127 nt, Human
uuauuauuuauuuugagacggagucucgccuuguaacccaggcuggagugcaguggcgcgaucuccgcucacugcaagcuccgccuuccggguucacgccauucuccugccucagccucccgaguag

SEQ ID NO: 4116102 - RNA, 55 nt, Human
uuauucagugccuuugaaagaaacacuauaguguguuauuuucuuaacuggauaa

SEQ ID NO: 4116103 - RNA, 76 nt, Human
uuauucaucucugucucauguuagccagcacauaucuaauuauaugugcuggcuaacuggaugggcagauggguga

SEQ ID NO: 4116104 - RNA, 67 nt, Human
uuauuccagugggugguuucucccuguguugcagaguucacaggcuguaccuagcucaguggaguag

SEQ ID NO: 4116105 - RNA, 130 nt, Human
uuauucuaguuuuuggugcucagagaugccaaguggcucaucuuggggacugucucuuguagcaggcaucucuccaggggagugucucccaaacuuugagaugguuaucuguuaaucgaaggaaaaauaa

SEQ ID NO: 4116106 - RNA, 66 nt, Human
uuauucuguagaaccuaguacagugcuuuauacauaguaggugccuaguaagugucuacugaauga

SEQ ID NO: 4116107 - RNA, 83 nt, Human
uuauucuuucucccuuggccaugagagcagugcaacucaaacaggagcugcuccuucagccaaguccuucaguaaagauauaa

SEQ ID NO: 4116108 - RNA, 59 nt, Human
uuauugagaccguaagucagguacuuuaccuauugccucugauuuaaucuucucaguga

SEQ ID NO: 4116109 - RNA, 97 nt, Human
uuauugauuucuuaggagcauuaguaauuuauaauccugagcaaacuagcagaauuaaggaaaaaaauuauuucaaugcucuuggaagaaucgauga

SEQ ID NO: 4116110 - RNA, 75 nt, Human
uuauuggcaucaugcuuggauuauguuugggaauaaaaagugugcuagacucuaaguuauggaaguagccauuaa

SEQ ID NO: 4116111 - RNA, 60 nt, Human
uuauugggcuucucagaauagaggggcauugguuuccucucuggaauuaaagcccaauaa

SEQ ID NO: 4116112 - RNA, 70 nt, Human
uuauuggggagagggcugugagggccaggaaccaggcaggucacugcauaguccaucuugaauucaguga

SEQ ID NO: 4116113 - RNA, 55 nt, Human
uuauugggucccaacaaguugccacaguaucagacaccuaguugggacccaauaa

SEQ ID NO: 4116114 - RNA, 100 nt, Human
uuauuguaauuuuaaaccauuuucaguuucagaugcuuuagaaauagaccaguuguuuuugugguauauugcaacaacgggaagauuauauuaccaauaa

SEQ ID NO: 4116115 - RNA, 59 nt, Human
uuauuguaggccuauuguagaaaugcuauugauaagcauugcuuuuauaccuauaauga

SEQ ID NO: 4116116 - RNA, 63 nt, Human
uuauuguaucaucauuaucagucugcagauuucucuauagcuagaaagugaagaucacagugg

SEQ ID NO: 4116117 - RNA, 69 nt, Human
uuauuuagagagaaucuggagugcuucgugcugucucugaagguaaccagaaucuacucauuggaauga

SEQ ID NO: 4116118 - RNA, 78 nt, Human
uuauuuaggcucucugcaacuaaguauuuucacgacugaguucuugcuucaaaaaguuguuagaggaaaguuaaauaa

SEQ ID NO: 4116119 - RNA, 58 nt, Human
uuauuuaucacuuggugaguugcagaaaacugcccaaggucacacagcugguaaauag

SEQ ID NO: 4116120 - RNA, 101 nt, Human
uuauuuauugauaaauugucaagacagaaucagcugugcuuauuuuuacugaaacuggaaaguugauuauguccaacaagcuugacaauuuauguggauaa

SEQ ID NO: 4116121 - RNA, 103 nt, Human
uuauuucauuugguucuuaaguaaucuugugauguaugcaaauuggauaauuuuauuucuauguaaaaauauacacagagcuuauggugauuguaugaaguga

SEQ ID NO: 4116122 - RNA, 56 nt, Human
uuauuuccacaaugugguagggugauggaaaaacacccuaucauaauguaaaauaa

SEQ ID NO: 4116123 - RNA, 56 nt, Human
uuauuugcagagugcagaagcaucuucaguuggagagccauugccucuugcuguga

SEQ ID NO: 4116124 - RNA, 69 nt, Human
uuauuuguccauguagauuguguaucugugaauuaaacuaguauuuaaaucuacauagagaucaaauga

SEQ ID NO: 4116125 - RNA, 85 nt, Human
uuauuuuaaaggaggacauaguggacuaggguucaucuugacaauaaguucuaguuaacaguccucuugccuaccuucggaauaa

SEQ ID NO: 4116126 - RNA, 85 nt, Human
uuauuuuuaguagugggcuuguauugcuguuuugcaucugcauuuguaaguagcuuuaaaaauccaauauccaugccaagaauga

SEQ ID NO: 4116127 - RNA, 76 nt, Human
uuauuuuuauucuuuuaugagauugccuuucaggggcacccccaagaggugacauaggagaggcucaggaaaauga

SEQ ID NO: 4116128 - RNA, 91 nt, Human
uuauuuuugcccuucuuaguauaugcauuggauaagaaccccauuggcccuuuuuuagcuaguaaugucuaaugcaggaagacaggaauaa

SEQ ID NO: 4116129 - RNA, 130 nt, Human
uucaaaaauaacugcuucccuuccauaccaggcaccauguucuuaggaccuuccuugagcaaggagucuauuuucguaccugaagacaucgggcuugguuuuaugacauggcuuggcaaugaaaugugaa

SEQ ID NO: 4116130 - RNA, 69 nt, Human
uucaaaccaaccucuucuuuuuccaaagcgcauagcuuucugggaugugaaugguuuaaaagguuugag

SEQ ID NO: 4116131 - RNA, 67 nt, Human
uucaaagagaacucagucuacacuggaagaucaagauugguaaccacuggagacuggucucugugaa

SEQ ID NO: 4116132 - RNA, 68 nt, Human
uucaaagauuagcauacgcaaugugacuauucaaauagcgagucaguuuggagucuauaaucuuugaa

SEQ ID NO: 4116133 - RNA, 64 nt, Human
uucaaagcaaaaagccaagguccucuucagaugguggaaacucugagguggcucuugcuuugaa

SEQ ID NO: 4116134 - RNA, 79 nt, Human
uucaaagcaucagagagaaguuaacuaggcccuaaucaguagccaguguggucuaguccaacuaauuuugauaguugaa

SEQ ID NO: 4116135 - RNA, 76 nt, Human
uucaaagguauuuucuaauguauacuucagaugcaaacaguguuacuuucuaguauacauagagauggcuguugaa

SEQ ID NO: 4116136 - RNA, 71 nt, Human
uucaaaucagcaaugaccuaagcaaauaacccccagugcccgggauauuuagcuggagucagugcuuugaa

SEQ ID NO: 4116137 - RNA, 67 nt, Human
uucaaaugcaugaaccaucacuccuuggccuuuuggccaagaucaaguguaguaucaaaugcaugaa

SEQ ID NO: 4116138 - RNA, 84 nt, Human
uucaaauuucaguccucucacucaggccuuuaaagcaaauacaugcagaaaaucugagaaugagagcacuagcuggaagcugaa

SEQ ID NO: 4116139 - RNA, 103 nt, Human
uucaaauuuccaaucccaccaaaauguaaaacauguuuuaacuaggagggcucauuguuucuccuuucaacauguuugcuuuggaguuugggauggguuugag

SEQ ID NO: 4116140 - RNA, 130 nt, Human
uggagacuugcacacaguugcuaguuuaucuuuaaaauuuccaccaucuuuguguuccccauggaagacaaaggauuaaugaugaugaaauguaguauaaggccagugcaacaguggccaaguuuggcca

SEQ ID NO: 4116141 - RNA, 111 nt, Human
uguucaguugauggaugugaugaagacaacacauguaugccacucuucugggccaacacccagguagauggcguuuaugcuguuggcuuuagcagccaauaccuguaaaca

SEQ ID NO: 4116142 - RNA, 65 nt, Human
uguucauauuccuguccgcugauccugaggcugaggaaaggggaaguggguguggggaaugaaca

SEQ ID NO: 4116143 - RNA, 74 nt, Human
uguucauuguugugucucagcagguagcauauaguagauacucucuaaauguuugugggauaaacaaaugaaua

SEQ ID NO: 4116144 - RNA, 68 nt, Human
uguuccaacucccagaacaugcucuucuuacuacaccacggaagaaugggguggugggaggcggaaca

SEQ ID NO: 4116145 - RNA, 76 nt, Human
uguuccaagugauuucuaaguuuauuagucagagacauuuuaagugacagaguaaaacagagaaaucacucagaca

SEQ ID NO: 4116146 - RNA, 129 nt, Human
uguuccacuaacaaacacagauuuaaaacgcuccuggaauguuugacuuauucagugacuucaucauuaaaaggacacuggggagggaggcaagaaaggaguuuuccaauauccauuaccaugugcaca

SEQ ID NO: 4116147 - RNA, 92 nt, Human
uguuccauccgugcaaguguuuuaugaaaauuuagcugaagcauuuuaaaaaaauguuuuggccagauucuuuuuagaauaaaguugggaca

SEQ ID NO: 4116148 - RNA, 60 nt, Human
uguuccauuggagcacuccacgacuccccuuuuaaaaguggagccuuuuguucugggaca

SEQ ID NO: 4116149 - RNA, 74 nt, Human
uguuccccggcagagugugugcgugcaugcgugugccugugugagcagugugcgcgggcugcuggccgggggca

SEQ ID NO: 4116150 - RNA, 129 nt, Human
uguuccccucuuugucacagcccugaaacgcacuggccugcugggugagguccugaaagggucagagcuccaaggauuacuaaguaggguagugucagucccaagccaugcuguggaucuaggguuaca

SEQ ID NO: 4116151 - RNA, 97 nt, Human
uguuccuauuuggaggaagcccaagccagcaguuuaaugacucagcaucaaccugaguuuugacuguuggucuuaccuugucccucagauccaaaca

SEQ ID NO: 4116152 - RNA, 89 nt, Human
uguuccucuugacaucucucuaaagagacauguguagaaacuuguacuacacagggaaaggucucagagcugucaguacugaaggaaca

SEQ ID NO: 4116153 - RNA, 61 nt, Human
uguuccugcaaggaacuggugcucaacuaaacauacugucacaugguuccuugaaggggca

SEQ ID NO: 4116154 - RNA, 78 nt, Human
uguuccuguuaacugucuccucaucaugccugguugcuagcccucuagugcccaggguguggugggacagguggaaua

SEQ ID NO: 4116155 - RNA, 104 nt, Human
uguuccuuuaauccauaucacuugaccaggaaagagugugacuaauaaugauauacauacaugacuuauucacuucuuggucccucagugcuauuuuggguuca

SEQ ID NO: 4116156 - RNA, 129 nt, Human
uguucgcauuuccucgagacucuuacugaauuaauaugucucuggcuagacauuacagauuuuuguaggaauaaaaugaucuggcucaggauaucauugggaaaugaguucagcaagugccagauuaca

SEQ ID NO: 4116157 - RNA, 109 nt, Human
uguucuaaaaagcgggaugcagggcccagugagcugcagagugaugaagugggggaaguuccccagugucgcugcugggacacaaugccugacucccguaaguaaagca

SEQ ID NO: 4116158 - RNA, 58 nt, Human
uguucuaugcucuuuaaggugauggccacaguuuuuccauagcuuagaguguaggaca

SEQ ID NO: 4116159 - RNA, 60 nt, Human
uguucucacuggaugcuucacaggcacguugguugccuagucauguugccuaggagagca

SEQ ID NO: 4116160 - RNA, 63 nt, Human
uguucuccacugucagcacucuacuacagauaccccaucuggugcggucugauauggauaaua

SEQ ID NO: 4116161 - RNA, 83 nt, Human
uguucucucucugcuccauagcuuccauauugacaccaguuucuuucuaguggagaaguggagucugugaagccagggaaaca

SEQ ID NO: 4116162 - RNA, 60 nt, Human
uguucucuugccaguauuuuauaugaaguuguaugacuugguuaaaugggaagagcaaca

SEQ ID NO: 4116163 - RNA, 110 nt, Human
uguucugaccaggacuacugaauaacauaacuucuggagaccuagcccuguuguugccuagguaaauaacacucccuggaguuguacaauucacagcaugguuaguuaca

SEQ ID NO: 4116164 - RNA, 129 nt, Human
uguucugugguugaauguguuuuugcuuaaauaaagcuuuugguauuuguuuaaauuacacuucuugagaaguggaaauuuuaggaucaucuuugcuuuguuucaguuuugugauuuuugaaaugaaug

SEQ ID NO: 4116165 - RNA, 63 nt, Human
uguucuucaggagcuccgggggcugagcaucacuuuaggccaggacagagcuuccagaagaca

SEQ ID NO: 4116166 - RNA, 76 nt, Human
uguucuuucugucaugguguacugcucccaaggucucacuccacccaacuggcuggugcacaugaaagagaaggca

SEQ ID NO: 4116167 - RNA, 62 nt, Human
uguucuuuuucaucugcccggggaagccagaucuuccucugccccagaugaaauuuagagca

SEQ ID NO: 4116168 - RNA, 58 nt, Human
uguugaaagacuaaaugaaugagcucacauuugagacucccuuuuuauucuuccagca

SEQ ID NO: 4116169 - RNA, 64 nt, Human
uguugaaagccgggacucaaaaagacauguguacacacauguucauagcaucgguauucacaca

SEQ ID NO: 4116170 - RNA, 60 nt, Human
uguugaacugcuucagcaaagcuauuugcaauacagcagacagaagcuaaguagacagca

SEQ ID NO: 4116171 - RNA, 88 nt, Human
uguugaaugaauguuugaaugaauaaaagaguaaggcagcuuggaagaguguuuucuucugccuguucauuuauuugcccauuggaca

SEQ ID NO: 4116172 - RNA, 62 nt, Human
uguugacagacacuugaguugauucugguuuuggacuauugugaauaaagcugcugucgaua

SEQ ID NO: 4116173 - RNA, 62 nt, Human
uguugacucaacacugugggcauguagauaaaauagcuguuggcaguacagagaguuaguca

SEQ ID NO: 4116174 - RNA, 91 nt, Human
uguugagauuuuuaaaaaucuuuaguuuaagaacaugaugagaaacgacuuccuuugugucacucuguguuugaacucaagaggcuugaca

SEQ ID NO: 4116175 - RNA, 77 nt, Human
uguugagugagaugaagaggcccuuggagucauuccaggagucuauaggugacuccagucucuucucacuucugaca

SEQ ID NO: 4116176 - RNA, 69 nt, Human
uguugauuaccucauuuaagucacuauuacacucauaguguccagaguggaggugagugugguacagca

SEQ ID NO: 4116177 - RNA, 58 nt, Human
uguugauucagaaguuucagggauuaauugaccaccaggaacuuucaugaaucuagca

SEQ ID NO: 4116178 - RNA, 114 nt, Human
uguugcaugcaucuucaugucucccuuucaugaggcaggagcucagaugacaucucaggugugacgucaugugaugucauguguguucugugagagggacaugaaaagccaaca

SEQ ID NO: 4116179 - RNA, 68 nt, Human
uguugcauuuauauucuguucggauauaugauuuuguuucuuuaucuggaugaguugaauucucaaca

SEQ ID NO: 4116180 - RNA, 68 nt, Human
uguugcccaggguggagugcaguggcauaauuucgucucacugcaaccuccgccuccggguucaagca

SEQ ID NO: 4116181 - RNA, 99 nt, Human
uguugcuguuguucaguaagcuaguuucucuccuuacucucuggauaccauuacagucucaggaugagguagaggcagauaccauuucaauaagcaaua

SEQ ID NO: 4116182 - RNA, 77 nt, Human
uguugcuugcuugacucacauucuauuuggucacucagcagauauuuacugaggaccugcuaaugugccaaguaaca

SEQ ID NO: 4116183 - RNA, 89 nt, Human
uguuggcuugaaaagcuggucagauuggucuacucaacagcagagacaucucugugcagauguagaccaguuucagaauggggcccaua

SEQ ID NO: 4116184 - RNA, 61 nt, Human
uguugggagcuuggacuuaguguggacaccugaucucccgccuccuccauagcucccugca

SEQ ID NO: 4116185 - RNA, 115 nt, Human
uguugggggagacucacacugacagugauguucucuggguguguagacugaguucaucucuuccugcccugcuucugagggaagcuguuaaaagguaugaauucucuccccagca

SEQ ID NO: 4116186 - RNA, 55 nt, Human
uguugggggcucagagucuuuaaccugugagaaaagagccugagaucuuccagca

SEQ ID NO: 4116187 - RNA, 64 nt, Human
uguugggugcuuuuggaguugugaacuguaggcaccgccuucucagagcuuccagaaaacagca

SEQ ID NO: 4116188 - RNA, 71 nt, Human
uguugguaagcagcguaaaagccagggagugucugcugcaagaaucccugggcaucacguugcuuccgaca

SEQ ID NO: 4116189 - RNA, 87 nt, Human
uguuggucauauuuauuauuuuaucugcuuacuuucaggguuucgugcaccugaaguugccagaggaaaugucauuuauaaccaaca

SEQ ID NO: 4116190 - RNA, 83 nt, Human
uguugguuagauuuaguaccaaguuguaacauuuuaauuggaagcuaagcuuauuuuacacuuggguguggauuuuaccaaca

SEQ ID NO: 4116191 - RNA, 101 nt, Human
uguuguaaguuaagacuuguuuugugugccuuucuucccaaguagauguacagccaugcaucacuuagauggggaucaucacgugaguuuuuguugcagca

SEQ ID NO: 4116192 - RNA, 57 nt, Human
uguuguccacccaugacaccugccugugucccacaggagucccaggggugggccaca

SEQ ID NO: 4116193 - RNA, 70 nt, Human
uguuguggguauuucuagaaccaaaagccauccuggagauuggguggagguucugggugauaccgaggca

SEQ ID NO: 4116194 - RNA, 65 nt, Human
uguuguguucacuauugcaacccugguucccagaacagggucugaccaccaguagggauucaaua

SEQ ID NO: 4116195 - RNA, 83 nt, Human
uguuguucuugcuuauuauggacuuugggaagaagucaauuagagaaguucuuuagccaguaucauaaugaguaaugggaaca

SEQ ID NO: 4116196 - RNA, 62 nt, Human
uucagaggguuuuagggucagaacauuaucucaacacaggacugacuagaaaaaaaucugaa

SEQ ID NO: 4116197 - RNA, 57 nt, Human
uucagagguagagaggaucuugaagauaaucuacauaauccuuucacuuuuuaagaa

SEQ ID NO: 4116198 - RNA, 76 nt, Human
uucagcacccucugaggcauccuucucccaguggggcuuguuuauuuccucgcuuuccaugucacagagggcugaa

SEQ ID NO: 4116199 - RNA, 69 nt, Human
uucagcaguuucugagaagcaaagguaacauauccuuccaaaguccccaucuuuccaggagaugcugag

SEQ ID NO: 4116200 - RNA, 79 nt, Human
uucagcucuuaaaaaggcaaguuuuaguuuucuggaaagcuaacauuuuuagaauaccucuuuccuugaugaugcugga

SEQ ID NO: 4116201 - RNA, 93 nt, Human
uucagcuuguuauuucuucauuagcaagguuuccccugcugcucagcagaauaugugaggaacuuugcaaaugucagaagcacucaaguugaa

SEQ ID NO: 4116202 - RNA, 106 nt, Human
uucagcuuugccaaaaaggguggcuugcuuuuguuggggguuaggggcaauuaaaacauugccacuauuugcuuugggcuagaguugcauucuuaaggcagcugaa

SEQ ID NO: 4116203 - RNA, 72 nt, Human
uucagcuuuggucacauugaguuugagguguccuauauuuagauguaauaaaucagggugccaaagccugag

SEQ ID NO: 4116204 - RNA, 56 nt, Human
uucaggaaauuggaguccuucugccccacggugugaagguacuuuaaguuccagag

SEQ ID NO: 4116205 - RNA, 83 nt, Human
uucaggaagcagcuguaucacuuuuaaacauuuugccugucugguggcuguaaggugauaucgcauuauugcuuuaauuugaa

SEQ ID NO: 4116206 - RNA, 57 nt, Human
uucaggaauauaggcauugacaagauuuucuugucugcaaagaaaugccuucuugaa

SEQ ID NO: 4116207 - RNA, 78 nt, Human
uucaggagauuagaaaaauguucaguaguuucugcuuuaauauagagaaugucuauuaacauuuuuuguucuuaagaa

SEQ ID NO: 4116208 - RNA, 55 nt, Human
uucaggagcuagggaugugaaaguagaaagcugaguaucuuuuuuaacuccugag

SEQ ID NO: 4116209 - RNA, 62 nt, Human
uucaggcccaucccauucugaaagauaguugaaauuuauuagaaaggcuuauggugccuuag

SEQ ID NO: 4116210 - RNA, 95 nt, Human
uucaggcuccaaaguccagcuguuuccaugaugccaggcugcuuccuaauuaguauauuuaggagauaacuguauuuuagagauaaagaccugag

SEQ ID NO: 4116211 - RNA, 57 nt, Human
uucagggagcaagggcuaggaaggaggcagcuccugggacuggcauucuucccugga

SEQ ID NO: 4116212 - RNA, 71 nt, Human
uucaggucaguagggaaaucauuagugagauaguguagcucuuuaaagauuucuuacuuauugaugcugaa

SEQ ID NO: 4116213 - RNA, 60 nt, Human
uuacacaauuuuauugaccuaaacucaggaaaucccucacuggucauggagguuguguga

SEQ ID NO: 4116214 - RNA, 64 nt, Human
uuacacuuccagugcauagguagaucauuucuauaugcuaucuagaaauacuggguuuugguaa

SEQ ID NO: 4116215 - RNA, 56 nt, Human
uuacagaaaggaaggacugacuccuaaauuccaggaugucuccuuuaagucuguaa

SEQ ID NO: 4116216 - RNA, 55 nt, Human
uuacagaggcuuccagggcccacuacagccaggggccugccugggacuucuguaa

SEQ ID NO: 4116217 - RNA, 61 nt, Human
uuacagcauuuaaugagaucuggcauuuuauaccccagaucaaagcuacagaaugcuguaa

SEQ ID NO: 4116218 - RNA, 58 nt, Human
uuacagcuucgacagaggcaguugcuugagaaggcaggugcugggugggcagcuguaa

SEQ ID NO: 4116219 - RNA, 59 nt, Human
uuacaggcaugaaugaaaucuguuuuauuagaugaacaggggauuauuuauaccuguaa

SEQ ID NO: 4116220 - RNA, 61 nt, Human
uuacaguagauuuugaauguggcuguaauaaaacggccuuuaaauuuuagaauuuguguga

SEQ ID NO: 4116221 - RNA, 60 nt, Human
uuacagugaaguaccauuaaaauuaacuccacaguucuuuagugguauacuuuucugugg

SEQ ID NO: 4116222 - RNA, 126 nt, Human
uuacauuaaaaaauaucuuaacagacugugcauggucaguguuauaaguuuagccauuuuaauggcuuauuaauauuacuuccccauuggcuagauuuauugcugagcaaucagucuuuaauguga

SEQ ID NO: 4116223 - RNA, 77 nt, Human
uuacauucacucaacuuucuauagacuucucugagggggaagugucuccagggccaagucauggaaccaaaauguaa

SEQ ID NO: 4116224 - RNA, 119 nt, Human
uuacauuucuaugauuauucauuuccccuauucuaacaguuugcagagagcuggcaauugguaggcauugcacaaaaaauuguugaauaaaugaacugagagaucguaccuauauguaa

SEQ ID NO: 4116225 - RNA, 70 nt, Human
uuacauuuuuaucaguagcaaaguuuuaaagguaaaaaccucuuaauaucuaaugcuggcaaagauguga

SEQ ID NO: 4116226 - RNA, 66 nt, Human
uuaccaauuuugcagcuucugguggccucugauaugaauuagaggcaacugauuucugccagguaa

SEQ ID NO: 4116227 - RNA, 67 nt, Human
uuaccagccucaguugugagccccccugggcuguaacaggaccugggcuggcucuguggugugguga

SEQ ID NO: 4116228 - RNA, 76 nt, Human
uuaccaguauccuuugcggaaauuucuaagauuugcucauccaauagagacccgagaaaggaagaaaucugaguaa

SEQ ID NO: 4116229 - RNA, 130 nt, Human
uuacccaugggaaagggcauaauuagcuguuuucuaaugcauuugacgugaagaugcuugaaucagcacauaauugaauguauuaauagaaguagcaaauucuaauuaugagacuuaguuguugggguag

SEQ ID NO: 4116230 - RNA, 69 nt, Human
uuaccucacugggccucaguuuucucaccaugagauggagaaaauggagacuuugcccguguaagguaa

SEQ ID NO: 4116231 - RNA, 111 nt, Human
uuaccucucuugaucuggucugauacuguugguuuaaaaugcugauuugggauuauucuuagccaaaguagccaaagcacagcauuguguugacuguauuuugggagguaa

SEQ ID NO: 4116232 - RNA, 65 nt, Human
uuaccugugucaguauaugagaaaaaugaauuuaaaaacccucagaaugucacugacgcagguaa

SEQ ID NO: 4116233 - RNA, 83 nt, Human
uuaccuuaacuuuucuaggugugauaauggucgguuaauuacuuuuuuaaaaaaaauuacucaucagaggaaguuaaugguga

SEQ ID NO: 4116234 - RNA, 63 nt, Human
uuaccuuuuaggcaagcaucuuucuuauuuccccaccuaugaaaaaguaugccuauuagguga

SEQ ID NO: 4116235 - RNA, 55 nt, Human
uuacgauuauggcuaagcauugugcugaaaggaacauagcucagcauaaucgugg

SEQ ID NO: 4116236 - RNA, 74 nt, Human
uuacgucuuuaaaguuccuauauccaaauacaguuccauucugagguacugaggauuaggacuucaagauauga

SEQ ID NO: 4116237 - RNA, 81 nt, Human
uuacuaaauaaggcacuagcagaauuagugagguagauaggcuuauuucuuuuuacuuguggcagugacuuuucuuaguaa

SEQ ID NO: 4116238 - RNA, 74 nt, Human
uuacuaaguagucaguggaccaggucaauuuuccuucaaaggaaauguauuugacaguccuugcuaaaaaguga

SEQ ID NO: 4116239 - RNA, 68 nt, Human
uuacuaccacgccacccucagccccacaugccuccuccugucccuggggcugggggugugcugaguga

SEQ ID NO: 4116240 - RNA, 70 nt, Human
uuacuagauuuuuugagacagauguaaauggagauuuuccagcuccagcagcaggcuuaaggaaaaguaa

SEQ ID NO: 4116241 - RNA, 57 nt, Human
uuacuccuguaguaugaggcagguauuacauuuucugcuuuauagacaaggaaguag

SEQ ID NO: 4116242 - RNA, 69 nt, Human
uuacucucaguucccaggaggaagggguacauaggaccacacagggccuccugggaagcacuggggugg

SEQ ID NO: 4116243 - RNA, 81 nt, Human
uuacucuuaugaagaauguugcagugagcauccuaggcaauucgccuuaugcacauguaugucaauauuucccuagaguaa

SEQ ID NO: 4116244 - RNA, 61 nt, Human
uuacugagagaugguguguuuauaaacaaucguguuuacaaaagcacauauuucugaguga

SEQ ID NO: 4116245 - RNA, 75 nt, Human
uuacugagggcauaaaaguacuguguugucacacuucauuuaccaauuugcaguauuuuuuuguguccccaguaa

SEQ ID NO: 4116246 - RNA, 74 nt, Human
uuacugaugugccuuugagucugguccucacugcuguuuucagccgucaggccugcccugaaagcacauaguaa

SEQ ID NO: 4116247 - RNA, 93 nt, Human
uuacugcugcugcuugguuuacuaggauucaaauuagaacaguauccuuuugcuguaauuugugucugguggugcucaauucaguuuagguag

SEQ ID NO: 4116248 - RNA, 83 nt, Human
uuacugcuugccaaagauaauauucauuaacuagaguucacaucucaugcucuggauuaaagaaauuauuugcaagcaaguaa

SEQ ID NO: 4116249 - RNA, 102 nt, Human
uuacuguugaaugggagcgaacuacuuguugaucaguuguuaaacuuuccuuccccagaaagaugucaauucugcagcccaacaguaguuugcuugugguga

SEQ ID NO: 4116250 - RNA, 99 nt, Human
uuacuugagcugagauuuuaaaagcuuuguuaauagguuuggaagaggguauucuaaguuaacccuguuaauagauuuggaagauagcauucuaagugg

SEQ ID NO: 4116251 - RNA, 66 nt, Human
uuacuuucuucacauuuaaaugugguggcuugggggagaaaccauacuugaaauggauaggaguaa

SEQ ID NO: 4116252 - RNA, 62 nt, Human
uuacuuugcuuucucauuacaggcggccuuccccucugcuccacuggagagagucagaguaa

SEQ ID NO: 4116253 - RNA, 57 nt, Human
uuacuuuucugucaaauaugccauagcuacugcagugguguccugagggauagguag

SEQ ID NO: 4116254 - RNA, 69 nt, Human
uuagaaaacauaagugguaaagcauuaccucuauuaauaauauuuguaugcugcuuaugcauuuucuga

SEQ ID NO: 4116255 - RNA, 111 nt, Human
uuagaaauagccauaauaaagaacuuugaaaacacaccuagaaaacauccagggggccugacugacuuucuaagaugugguuucaagguucuuuauugugguuauuucuaa

SEQ ID NO: 4116256 - RNA, 67 nt, Human
uuagaaccaaaaaguccagcucuaaauaucugacuggcuuggucagagcugagcugugagguuuuaa

SEQ ID NO: 4116257 - RNA, 111 nt, Human
uuagaaguuagugcaaguauugaauuggcagaccaucuuauuaacaaguuauaaauaguuuguaucaaauaaguggucagaugagaaguucauaauuugcaaagccucuga

SEQ ID NO: 4116258 - RNA, 75 nt, Human
uuagaauaagagugggcaauagaucaagaccaaggguuauuuaaaguugugauuucuuugcaagcuguguucuaa

SEQ ID NO: 4116259 - RNA, 86 nt, Human
uuagaauauuugaagaugagguaguacuuuccuguaucuuuacacugugaguaucaacuaucucuuuugucugcagcuuagucuga

SEQ ID NO: 4116260 - RNA, 130 nt, Human
uuagaaucaccuggagagcuuuuuagaaaugucaaugcuggggccuccccaugcccagggacucacuuucaauuggucuggaauagguccugaguauuaaaugcuuuuaauagcuucuaagugauucuaa

SEQ ID NO: 4116261 - RNA, 125 nt, Human
uuagaaugccuuuuaaaguaauguacuccaguguuaucauaaguaauugaaauaagccuacacauaguuuacucaauuauuuugauguucauugagaugaguuuuguuuccaguaaauauucuga

SEQ ID NO: 4116262 - RNA, 91 nt, Human
uuagacaacgaguaauagauguaguuucuaaaagccuugaugugucugcagugacaagugcagaggaauaaccucauugcuuuuugucuga

SEQ ID NO: 4116263 - RNA, 65 nt, Human
uuagacuagacauuuuuuaaggucaaaggcuacaucuuauuggcugcucuguguuuaguaucuga

SEQ ID NO: 4116264 - RNA, 85 nt, Human
uuagagaaacagcaggugguaggcagucagcagcucugccacuagcuuguugugugacuuccagcugguucccugcccucucuga

SEQ ID NO: 4116265 - RNA, 83 nt, Human
uuagagaucccuugguggucaggauagucaaaugcuaaguuauuaacaugcucuuccuggcuagucauuuguuuugucucuaa

SEQ ID NO: 4116266 - RNA, 77 nt, Human
uuagagaugcuaaagggguaggccuccugcaccuugucagagccaaaggcagaaggccuaccucuugcaagagcuaa

SEQ ID NO: 4116267 - RNA, 85 nt, Human
uuagagcuaaagacauggaucucaguggggugucaaccuugcuugaaguaaucagcuguugucaccucacauccaaguguuuuga

SEQ ID NO: 4116268 - RNA, 62 nt, Human
uuagagcugucagcguuuuggccauugugccaagaucaguggaaagacauugcagauuuuaa

SEQ ID NO: 4116269 - RNA, 73 nt, Human
uuagagcuuucugggaaguguuaaucuugaacugaaccuuaagguuaaauagguauuuuccagacagugcuaa

SEQ ID NO: 4116270 - RNA, 81 nt, Human
uuagaggagcacuuuaaaacaggucaaguguaaccaagacuaaauugaaaaugcauuauucuuuuuugguaggcccucuaa

SEQ ID NO: 4116271 - RNA, 84 nt, Human
uuagaggugcuaauucuugggcuccaccccagacuuacugaaucagaaauucugaggacagagucuagcaaucuguauuucuag

SEQ ID NO: 4116272 - RNA, 55 nt, Human
uuagaguuaggauuugucuuuaggucuuuccucaaagccauaagccuaauacuaa

SEQ ID NO: 4116273 - RNA, 65 nt, Human
uuagaguuagguuuugcugaacaaguugaagauauuauucaugaauucuacaaaacugauucuga

SEQ ID NO: 4116274 - RNA, 75 nt, Human
uuagauauggcaggggaaaaggggugggagggggagacugagucuaucucauaauuguuucccagcuauauuuga

SEQ ID NO: 4116275 - RNA, 75 nt, Human
uuagaucuacaggacuauacugguaaaucugacccuguuaggaagcucagagaagucuuuugaauggagaucuga

SEQ ID NO: 4116276 - RNA, 103 nt, Human
uuagaugggaauauugcucaagcccuggagguugaggcugcaguuaacugugauugcaccacugcaguccagccuaggugauagagcaagacccuuucucuaa

SEQ ID NO: 4116277 - RNA, 87 nt, Human
uuagauucacugggguuugggaauaugguagcuuauuaggaggguuggaguagguucauauucuagaaucauagccauagaauuuga

SEQ ID NO: 4116278 - RNA, 106 nt, Human
uuagauuugacugccuuuuaguuuacaggugaaugcucacauucuaaucagagaagaugauugggauauaaagcauucucagaaaccaggaaguaugcauuucuga

SEQ ID NO: 4116279 - RNA, 55 nt, Human
uggcuuggugagcagaguguaggccggauuucagcccccguuugccgcccagcca

SEQ ID NO: 4116280 - RNA, 74 nt, Human
uggcuuguucuuuggauucugguuucuucaucuguaaaaugaguugaauuagcugaccucuaaggagccuucca

SEQ ID NO: 4116281 - RNA, 70 nt, Human
uggcuuuaagaugucuauaaaaccaagaauugacccaaguucuccuggcucuaaaaggcugucugggcca

SEQ ID NO: 4116282 - RNA, 59 nt, Human
uggcuuuaggagcuauauaccucaaaacuuuggcuuuaggagguauauaccuaaaacca

SEQ ID NO: 4116283 - RNA, 87 nt, Human
uggcuuugggggcagugguuucccuccucauguuuuauuuucaacucuuggggaaggaucaccacaaucuuuugugcuacaaaguua

SEQ ID NO: 4116284 - RNA, 129 nt, Human
uggcuuuggguccuggcuguaucccuuaccagcugugccuaggagcagggcucgugguggccucuuggugcaugguuaggacuuuaguagggcucuuagugcaugguuaggaccuccacccagaagcca

SEQ ID NO: 4116285 - RNA, 79 nt, Human
uucucaugccagcaacuaggagcugaauucuagaaauuauagcaaguucaaauucaauuuucuuaguguuggucuagaa

SEQ ID NO: 4116286 - RNA, 57 nt, Human
uucucauuuaugucuuugccauccauaaacucuagugggugauuuugaaagugagaa

SEQ ID NO: 4116287 - RNA, 100 nt, Human
uucucauuuuccauaagcaucgagaacacugugacaauuccugucaaacguuagaaucuucaggaaguccaguuucauuugaggucaguaaagaugggaa

SEQ ID NO: 4116288 - RNA, 123 nt, Human
uucuccaaaaucuucagaaacucucauuuuuguaucagaaaucaacacacaguggugagugagcaccaacuaugcaaucguucuaggugcaggagaugggaaaauauucuugaagugagagaa

SEQ ID NO: 4116289 - RNA, 55 nt, Human
uucuccaacacaagcaugaugucuuggugacauccggcuuucaauguugguagaa

SEQ ID NO: 4116290 - RNA, 82 nt, Human
uucuccauaacacaguguccucagaaacacagcaaaaauuauaccugcugaauugaauuugcaggauaguugugauugagaa

SEQ ID NO: 4116291 - RNA, 95 nt, Human
uucuccaucugcuaaauggagaguauuguaauagcaccugccucaucaaauuguuaugaugauuacauguguuaauauacauuaagcauggagaa

SEQ ID NO: 4116292 - RNA, 68 nt, Human
uucuccuacuccauaagagccaagcagcaguuccucuugagcugugugcacugccuuuuguggaagaa

SEQ ID NO: 4116293 - RNA, 73 nt, Human
uucuccuaucauuuuugcuuucccaauuuauuaguauaaagacagauggcaaggaugaugagaaccaggggaa

SEQ ID NO: 4116294 - RNA, 80 nt, Human
uucuccugacaaaccugcuucuggcuucaucugacaagccccucuggggaggucggccccagccagcuggguuuagggaa

SEQ ID NO: 4116295 - RNA, 91 nt, Human
uucuccugaucucaugcccuguauacuugguacuauauuucauuuuccuauaauuuuguaaugcuuuugauacagggacauuucagaggaa

SEQ ID NO: 4116296 - RNA, 76 nt, Human
uucuccugguuuaaaauuacugguuaagguuauuuugcauucacaaauguuaaacaguauaucugagcaaggugaa

SEQ ID NO: 4116297 - RNA, 63 nt, Human
uucucuaaaauuaagugagguaagcuagaaaagucaagccaauuguuccuugauuagagagaa

SEQ ID NO: 4116298 - RNA, 87 nt, Human
uucucuaagcaaucuguagaagauacucugagauugugugacuauccuuuuucucaguguguuuucucucagaggaugcugccugaa

SEQ ID NO: 4116299 - RNA, 63 nt, Human
uucucuaagccuuaguuucuucagcuguaaauacaggauaacaaggagcuaugcuucagagga

SEQ ID NO: 4116300 - RNA, 61 nt, Human
uucucuaaggcuuggcuucccuuugcugcugcagccccguagggaggccagccucagagaa

SEQ ID NO: 4116301 - RNA, 75 nt, Human
uucucuaagucugcauauuguuaauggaaugaagacuauuuugcuccuaguuucauguauguauauuuaggugaa

SEQ ID NO: 4116302 - RNA, 76 nt, Human
uucucuagcuggaagggcauuuuaaggccuccagaagauacggccagacaaauaaaugucuucuagcucuugagaa

SEQ ID NO: 4116303 - RNA, 59 nt, Human
uucucuaucucauggaaaggcagugguccguggcauuggcuacuuuaugagguugagga

SEQ ID NO: 4116304 - RNA, 73 nt, Human
uucucuauugaccaaaaaauucccugugagacacagaucuaauguguuuauauaauuucuuggugguagagga

SEQ ID NO: 4116305 - RNA, 66 nt, Human
uucucuccuacccaguauccauuguaaguacaccauuuuuucuugcuggguccugugggagaagaa

SEQ ID NO: 4116306 - RNA, 59 nt, Human
uucucucucucugugugugugcgcugcccgugcaugcuugcaugcuuggagagagagaa

SEQ ID NO: 4116307 - RNA, 55 nt, Human
uucucucucuugaaguauuagcuagagacauuugugcagaaaaagagagagagga

SEQ ID NO: 4116308 - RNA, 114 nt, Human
uucucugaaaacaaagaauauagucaaauggcagggauauuuuggaggccauugauaccguucugaaauucucucuccauagggcugcuguuuuugcuacuuccuccaggagaa

SEQ ID NO: 4116309 - RNA, 58 nt, Human
uucucugauguucuucauugucauccacauggaguagagcaaauggacacucagggaa

SEQ ID NO: 4116310 - RNA, 64 nt, Human
uucucugccucuagcuauauucuguagaccgguuggggagggaguacagaggagagggagggaa

SEQ ID NO: 4116311 - RNA, 64 nt, Human
uucucuggagaaaauaguuucuucucuagaagguguauaaggagaagaaaacgucuucagggga

SEQ ID NO: 4116312 - RNA, 83 nt, Human
uucucuggccauagcuggcuagaauagggauagaccuugaccuaagucaagccuaucaaauucugccuccuaugaguuuagaa

SEQ ID NO: 4116313 - RNA, 119 nt, Human
uucucuggcccaggcugaggccaagccacaagcugggaggacaacuuggagcucaggcguccaaccagggcugcaaauugccccugcagggcccggccgagucugaaggagccagagga

SEQ ID NO: 4116314 - RNA, 80 nt, Human
uucucugggguucaguaucucucucugauguacauacacaaucccaauaauauuuaugagaguuaugagcgccagcagga

SEQ ID NO: 4116315 - RNA, 62 nt, Human
uucucugguuugcuguuucugaaaggaguucccucaacagaguacaacaguuaaugggggaa

SEQ ID NO: 4116316 - RNA, 106 nt, Human
uucucugucauugauaccacucugucauuugucugcucccucuggccacaaccucccugagagcagagagcagaauagaaggcagggucuuuauucuggcuaugaa

SEQ ID NO: 4116317 - RNA, 57 nt, Human
uucucuguggauugggugagaggcaggagaucagccucagagaaccuaagcggagga

SEQ ID NO: 4116318 - RNA, 81 nt, Human
uucucuguguucugcagagguaauuuacagauuucuagagagcugucuuucugccuccugaugaauaggauacuagaugaa

SEQ ID NO: 4116319 - RNA, 109 nt, Human
uucucuguugagccuuauaagcucuucuguuucaagacugcuacuuucaaaaauagguaugagcugcucugggaaacagaaguuguuuguuguuugucacuucagagaa

SEQ ID NO: 4116320 - RNA, 60 nt, Human
uucucuucagcccagcuaaguguaauuaucuucacuuucuuaggcugagguugacuagaa

SEQ ID NO: 4116321 - RNA, 77 nt, Human
uucucuucccucucaucugcuggauugaauguugaugugauggagucuuggauccagaggugaagaugggaggagag

SEQ ID NO: 4116322 - RNA, 114 nt, Human
uucucuucuuggagaccuuuggcaacacuuggacaaggcacagccuggguaaugaggaagucccugcaacacagcucagugccuccaagauuuccagauacacagagaagagga

SEQ ID NO: 4116323 - RNA, 55 nt, Human
uucucuugguuagccuggcaaaaggcuuaucacuuuuguugagcucuucaaagaa

SEQ ID NO: 4116324 - RNA, 59 nt, Human
uucucuuuauguauuuaguggguuugaaauuuacagucccaacuuggucauaaagagga

SEQ ID NO: 4116325 - RNA, 59 nt, Human
uucucuuuccacagcauguccaugcuacccuuuagugugcaauuuugugggaggcagaa

SEQ ID NO: 4116326 - RNA, 61 nt, Human
uucucuuuuguuuugaacuagcucagaauggaaauaucugauuuguucuaggcacugagga

SEQ ID NO: 4116327 - RNA, 73 nt, Human
uucugaaaaguuuggauuagcaguuagagccuaagaggcuuuugcugugaauaauucugacugauacucagaa

SEQ ID NO: 4116328 - RNA, 56 nt, Human
uucugaaagaggcaggagauggguauuugcucucaccaggcuccucuccuucagga

SEQ ID NO: 4116329 - RNA, 85 nt, Human
uucugaaucacaggugaaguccuuuagaauacugcuucauguaggggagaagaagugucuuuauagacugacaauugauuaagga

SEQ ID NO: 4116330 - RNA, 86 nt, Human
uucugacacaucauaccauucccaauuugcuaauauguuccuuuugaauaugcuuuagugucaaguuuggggugggguggacagaa

SEQ ID NO: 4116331 - RNA, 64 nt, Human
uucugacacuccaucccuucucacucugcaggggaaucuugcuggaagguggcuggaaucagga

SEQ ID NO: 4116332 - RNA, 67 nt, Human
uucugacaucauuaguaacauagcuuguuucuacacacaugggcuuggcuaugauuaaugacuagga

SEQ ID NO: 4116333 - RNA, 63 nt, Human
uucugagaaguaaaauggcguuuccuuggccugugagagggaacuagucagugauucucagaa

SEQ ID NO: 4116334 - RNA, 88 nt, Human
uucugagagauuaaauugcugaggcaaaccaagaauguauuucaauacauuaauugcuuugcuuuugucuaaaugauaguuucuagaa

SEQ ID NO: 4116335 - RNA, 74 nt, Human
uucugagcaauuaauggaaaguaaggaagguuccauuuaaccuugaccauuuacugucuaauagagucuuggag

SEQ ID NO: 4116336 - RNA, 57 nt, Human
uucugagggugcuauucuugccuugucugggaaaggucucuacagcaucuuucagaa

SEQ ID NO: 4116337 - RNA, 59 nt, Human
uucugaugaggaggucucuaagcaaaccaccgaucugcuuaaagccucccucauaagga

SEQ ID NO: 4116338 - RNA, 56 nt, Human
uucugaugcagggauuuuaagugcuuugugcccugucauauccccagcaucuagaa

SEQ ID NO: 4116339 - RNA, 78 nt, Human
uucucugacccuguaaauguccugcuacagagugcauacgaaaggauguacuuaggugagauauuuucuugcagagaa

SEQ ID NO: 4116340 - RNA, 85 nt, Human
uucucugcagaauauggagaccuucaagggcaaacgggagguucucauaguuguccuuuaauguuuaguauuuuuaugcggagaa

SEQ ID NO: 4116341 - RNA, 76 nt, Human
uucucugcagcccucagaucagcuuguuggcacaggacaauuaauguguucugggcuguccagagggugaggagaa

SEQ ID NO: 4116342 - RNA, 83 nt, Human
uucucugcauauuucauuugccugacuuugguggacaggauaauuaauauuaauauccaggcuucaugaauuaugcaccugaa

SEQ ID NO: 4116343 - RNA, 108 nt, Human
uucucugggguugcaggugacuggcaggcgguauuccugaugugauggggcagugcauggcaccagcuucacaguauaggucccugaguagucacguaccuuugagga

SEQ ID NO: 4116344 - RNA, 65 nt, Human
uucucugugagggugcuggauuugaguccuacccaccagcuucgcccagcacccucucagcugaa

SEQ ID NO: 4116345 - RNA, 66 nt, Human
uucucuuggcagauggauucaacauuauuaucuucauugagaaugauucugacacugccuagagag

SEQ ID NO: 4116346 - RNA, 55 nt, Human
uucucuugugccaaguuguugccuccucccucccagcccuuaggacauaagagag

SEQ ID NO: 4116347 - RNA, 98 nt, Human
uucugaaaaacauuuugccuauuguagcuucuauacaacuucagcacugcaauaaagccaguucucgggugaguauggcagccaguugcaaaacagga

SEQ ID NO: 4116348 - RNA, 56 nt, Human
uucugaaaccacugaccaacuaagcugcaagugaaaaguugaggugguugucaggg

SEQ ID NO: 4116349 - RNA, 70 nt, Human
uucugaaaggcaugucagguaguuagacaagguuuuaucaguaugaauugccuuucaugccuucccagag

SEQ ID NO: 4116350 - RNA, 94 nt, Human
uucugaaagguaauuguauguuccaagcagccgauauuaacaacuuccaucacgacucuaggaauaauucgcaguucugaaccauguuuuagaa

SEQ ID NO: 4116351 - RNA, 60 nt, Human
uucugaaagucuuuuuaaguuaauugaauuauuccaauugccuuagagaaauauuuagag

SEQ ID NO: 4116352 - RNA, 61 nt, Human
uucugaaguauuuacagggacaauaauauguuaggugggguuguuuuaaaauacuccagaa

SEQ ID NO: 4116353 - RNA, 65 nt, Human
uucugaagucaucagauggcaguuuccaugcccaugguuuuuuucugcccuagauggcucuggaa

SEQ ID NO: 4116354 - RNA, 80 nt, Human
uucugaauuuagcaguccuccucacaaugauuagauuaguacauuuugcauuuggggaugauuauuuaaauuuaacagaa

SEQ ID NO: 4116355 - RNA, 70 nt, Human
uucugacuuugcagugugggacacccgggggaauccucuaguucauucucaugcaugcauaagucuagaa

SEQ ID NO: 4116356 - RNA, 60 nt, Human
uucugagaaacugcuuugugaggugugcauucaucucacagaguuaaaaguuucuuugga

SEQ ID NO: 4116357 - RNA, 55 nt, Human
uucugagagagccucucauguuuccauagaaacccacacagagaaucucuaagaa

SEQ ID NO: 4116358 - RNA, 70 nt, Human
uucugagaggguggcauuugagcagaugucuagaagacaugcuaaagcaaacugugcuacuauuugagaa

SEQ ID NO: 4116359 - RNA, 63 nt, Human
uucugagagugccagaaguucucauaaaauaguuaaucugcuguaagcucuggcauacuugaa

SEQ ID NO: 4116360 - RNA, 78 nt, Human
ugggcuuccagugguggcucccggaccugccuugggggcagcaggagagguugggagaggucacccugaugaagaaca

SEQ ID NO: 4116361 - RNA, 109 nt, Human
ugggcuuuucucgcacuccaccucugaagguuucuguuacugucuuuucaagagaaucuaguuucagacuuugaguucuguggcugugggcaaaaaccaaaaagaccca

SEQ ID NO: 4116362 - RNA, 75 nt, Human
uggggaagaaaaaacuagguuuguggccaaaaguaaucauauaauaggccugauaagccuuuucuuucugcccca

SEQ ID NO: 4116363 - RNA, 74 nt, Human
uggggaagaagagcuugucaaaauuccagauuucugucucugacaccaaucuucuacuugacaguucucucaca

SEQ ID NO: 4116364 - RNA, 70 nt, Human
uggggaagauuuacuaucuaccacauaugcuucaucuuuauuguguauuuggcuauugaauuauuccuca

SEQ ID NO: 4116365 - RNA, 57 nt, Human
uggggaaggcggagcuugcagcaccugggaugcaccgguucagcccugccguuccca

SEQ ID NO: 4116366 - RNA, 85 nt, Human
uggggaauugucuggaauguuuaauaccauccagaugacaucaucauaaccugguaguauuaaaugugacucuggcacuuuccca

SEQ ID NO: 4116367 - RNA, 60 nt, Human
uggggacaggccaugugcagcaagcugggaagagauaaauugcacacacccuguccucca

SEQ ID NO: 4116368 - RNA, 129 nt, Human
uggggaccgaggaaggagccaggcagauuuuguuagccauguugaagauuuagaacucaagcaaacuuauccaaaacuuagaaauauggcagaaaggaagacugcaguuucuuuccacgucggcuuaga

SEQ ID NO: 4116369 - RNA, 55 nt, Human
uggggagauuguuaaauuuagauucugauucaguaagucuguaacaagcucccua

SEQ ID NO: 4116370 - RNA, 100 nt, Human
uggggagcgaaugaggcuucugggcuggcuuuaugcugacaagggccuucugcacugucagcccggccccagcucccagcaagucuccuuucgcucccca

SEQ ID NO: 4116371 - RNA, 60 nt, Human
uggggagguaugauagcuguguccuugaggacacuggaggagguagaagauacuucccua

SEQ ID NO: 4116372 - RNA, 82 nt, Human
uggggaggugcugcuggcauccaggaugcagaggccagggaugcugcauaacauccuacaaugcacagaauagcccucacca

SEQ ID NO: 4116373 - RNA, 84 nt, Human
uggggaguuccaucuugcccuuauguguagucuggggggauuaucccauuuacagaagccaaaggggccagauaugccuucuua

SEQ ID NO: 4116374 - RNA, 61 nt, Human
uggggaugcagucagagccccugugcggcuuuaccagcauacgaccuccuauugcccccca

SEQ ID NO: 4116375 - RNA, 101 nt, Human
uggggaugcuggucucucccucagcugccagccaucgucguugcuuuucccucggagcucugaggaugcauuggugggggagagagcaccacguguuccca

SEQ ID NO: 4116376 - RNA, 61 nt, Human
uggggauggaagagaagccacguugguuuucaggaccagaaauggaauuuuccaucacccg

SEQ ID NO: 4116377 - RNA, 62 nt, Human
uggggauguaaaugaggugauaggaggggccucaaguccuuggucuccucuuugcauuccua

SEQ ID NO: 4116378 - RNA, 70 nt, Human
uggggcaaccuagagggagcggaaccuggucauguuuacaggaaagggcucagucccuggguguguccca

SEQ ID NO: 4116379 - RNA, 62 nt, Human
uggggcaggcccggggaaaugggccaacuuccccucaagaccccaggccugggccugcucua

SEQ ID NO: 4116380 - RNA, 88 nt, Human
uggggcagugcaaaagccugaccaugcugaucuccauuggguggguccaauggaagaacgcucaggguuacgucaggaaggugcccua

SEQ ID NO: 4116381 - RNA, 130 nt, Human
uggggcaucuccccaugcccaccacacucacaaagcuccauggguacucagacauccgcagcagcaugcuggggucuggaguugcccaugagagugcaaggagucuuguggagucaugggguuccuccca

SEQ ID NO: 4116382 - RNA, 73 nt, Human
uggggccagcuucucugcugccugugauucagggaauagggacagggacugggagaggggcugcggugcccca

SEQ ID NO: 4116383 - RNA, 68 nt, Human
uggggccugcaguagagguugguagggggagcuguaguuucuauauuaaagugcuuugcagugucuca

SEQ ID NO: 4116384 - RNA, 63 nt, Human
uggggccuggagcucuccacuuggggcugccugcagcuuguguuucugcuucaguuuauccca

SEQ ID NO: 4116385 - RNA, 57 nt, Human
uggggcgaggcccagggggcugcagcaggaccuucaggcgcucuggguuucguguca

SEQ ID NO: 4116386 - RNA, 129 nt, Human
uggggcucauuggugauuauugcaccaaauuucugagccucauucaugaggccccugaauucuuuucuucucaggagcuucugaggaaggcucagccuuggguaaagucagaguauuccguaucuucca

SEQ ID NO: 4116387 - RNA, 118 nt, Human
uggggcucccaccaacaggaugaaggucaaugcccuuaaggucccuagaaauccuacugcuugauugaggaggaacugugaggcaacccuucaucucuguagagugacuagagucuca

SEQ ID NO: 4116388 - RNA, 62 nt, Human
uggggcugagagcaaaccaagaaugaugcaaguucacugcaguuugcccuuugcucacucca

SEQ ID NO: 4116389 - RNA, 62 nt, Human
uggggcugcuccuccauggggacuguguccaucuugggaaggcccaggagugagcagcuuua

SEQ ID NO: 4116390 - RNA, 58 nt, Human
uggggcuguggauucucacgaaggggcagggccugcucuugaggggcucacagucuca

SEQ ID NO: 4116391 - RNA, 110 nt, Human
ugggggaaagggacuagagaugguuggaauccuggguaaacacugaccuuuuaguauucuagaggugagauuuaauucacugcuaauuaguguugguuuuggcuccccua

SEQ ID NO: 4116392 - RNA, 55 nt, Human
ugggggagaguuuagaugauuuuggccacuugguuucccuugauuuuuuccccca

SEQ ID NO: 4116393 - RNA, 60 nt, Human
ugggggagccuucacaguagcugccaagcagagguccuggcacuggggaggguucucaca

SEQ ID NO: 4116394 - RNA, 59 nt, Human
ugggggagcucaguccagcccagcucccaauugcugcagcgugugugugggcuucucca

SEQ ID NO: 4116395 - RNA, 65 nt, Human
ugggggauauuuugcugugguacauuaggaggauaauaauccuucuauaagcaaaauguuugcca

SEQ ID NO: 4116396 - RNA, 66 nt, Human
ugggggccacagaccugagugaagucucaugcagcggcaaaaugaucuucuucaggcuuaacccca

SEQ ID NO: 4116397 - RNA, 55 nt, Human
ugggggccagcuccauugugaauaacaccaccgucuucaagauggauggcuccca

SEQ ID NO: 4116398 - RNA, 130 nt, Human
uuaucaugcucauggcaucaccugggaccugauuucuucaccagugucuuauugaccaucuuucuaaaggagggucuaagggagaacugaugaaauaagucauaaauuccaaguguguuauacaugcuaa

SEQ ID NO: 4116399 - RNA, 123 nt, Human
uuaucauuucccauccaauucagucugcuuugcuuucgugaacuguaggucaaauuguguauggaugaauuggcagaacuuuauauauucaugaacacagauugaaagucagaagaaugguga

SEQ ID NO: 4116400 - RNA, 57 nt, Human
uuauccaggaaaauagucuggaacuaugaguuuguguuuguuuuaaauccuggauga

SEQ ID NO: 4116401 - RNA, 63 nt, Human
uuaucuacguauuuaaacucuugaaggaaagacaacugacugaagaguugaauagguaaguga

SEQ ID NO: 4116402 - RNA, 60 nt, Human
uuaucuccaucuucuguuagacuccuuaaaaacagcagcccacagcagguguggggauaa

SEQ ID NO: 4116403 - RNA, 97 nt, Human
uuaucucccuccccuguauagccuggaccaggggccucagaaguugcagacucuuacccaaauaccucuucccuuuguccaggcaucacagagauga

SEQ ID NO: 4116404 - RNA, 63 nt, Human
uuaucugaaauguuuggguccagaagucuugugaauuuuggauuuuugaauauuugcacauaa

SEQ ID NO: 4116405 - RNA, 129 nt, Human
uuaucugcguauuagagcaccuggagaaauuuaaaggcuauggcugccuggguccugcuuccagauauucugaguuaauuguuccagggaguuuuuaacguuucuccagugauucuaaaguacagccaa

SEQ ID NO: 4116406 - RNA, 55 nt, Human
uuaucugucaucaggcagacagaucuucugaaccuaaugucuaagugauagauag

SEQ ID NO: 4116407 - RNA, 64 nt, Human
uuaucugucuaucaagacuagcaacuugugcaacagcauuaagaaagaguggauggauaggugg

SEQ ID NO: 4116408 - RNA, 79 nt, Human
uuaucuguugcuuaaugcgcauuaggaaaggacaauguuauuguagucugcaggaugcuauuaauaaaguuauggauaa

SEQ ID NO: 4116409 - RNA, 78 nt, Human
uuaucuuccucgccuugagacagugggguguugccggacguuuucuugcgguguggguguguuucgugggggagauaa

SEQ ID NO: 4116410 - RNA, 81 nt, Human
uuaugaagcaacauccauuugucagcucuugagucauuacuuuugacaucaagcaaagauacaaauggaaggcgaacauaa

SEQ ID NO: 4116411 - RNA, 72 nt, Human
uuaugaauccguuuuuaugaaauguccaaaauaggcaaaucuauggacagaaaguagaaagcagauucgugg

SEQ ID NO: 4116412 - RNA, 85 nt, Human
uuaugaauuucccugaaguuuguaugaauguuuuaugcuaaccaaauuuacaagagauuaucuacagaugagggucaguuuauaa

SEQ ID NO: 4116413 - RNA, 77 nt, Human
uuaugagaguuaaggaccuacucaguuauucccuaauuaaaucuugggguuccugagcaguuucuuagggcucauaa

SEQ ID NO: 4116414 - RNA, 58 nt, Human
uuaugcacuuagcuccaagcuacaauagaugaggguacaguggagcagguaggcauga

SEQ ID NO: 4116415 - RNA, 61 nt, Human
uuaugcauagcaucugcaaauguuaggauagcuguaugcccaagaugcuaugguagcauga

SEQ ID NO: 4116416 - RNA, 64 nt, Human
uuaugccuguuaggcagcaucuuacgcccaguguucucccagauauucugccuaacagguuuaa

SEQ ID NO: 4116417 - RNA, 75 nt, Human
uuaugccuuugacagcuauuuugcuuugauauuuuuguagugaaaaucauagaacugugguuguuagugcuauaa

SEQ ID NO: 4116418 - RNA, 57 nt, Human
uuaugcuuucaccuccuugacuacugagcucaagggucacaaaggugagggacauga

SEQ ID NO: 4116419 - RNA, 97 nt, Human
uuauggaauuuggaauaaggcaaggauguacugcaauaggaugucguaucuggacuuuuuuaaaaaagugucuuugauuauaagacaaauuccauag

SEQ ID NO: 4116420 - RNA, 80 nt, Human
uuauggacauuaaagcgauguagaaaauguuaauaaacccgagaaauaaagcauaaucuacauuuucuuuauguacauga

SEQ ID NO: 4116421 - RNA, 71 nt, Human
uuauggaucuuggauuauguuuauucuucaugacaaccugcugucauuuaauagauaugaugggucuuuaa

SEQ ID NO: 4116422 - RNA, 57 nt, Human
uuauggcauucauuggggcuuuuucauuuaagaggcagcauucaaaagaugccauaa

SEQ ID NO: 4116423 - RNA, 91 nt, Human
uuauggucugauaaugaugaaucagaguuguuagggcaccuaacacucauauucuuaacaacugcuaagguguguccuuauuagacuguaa

SEQ ID NO: 4116424 - RNA, 124 nt, Human
uuauguaucuuauuucuguagcuagacugaaaccuuguggaguaaggugggcauaugaaugaauuaacaaaaugugcuuucuuuguuucauaauuugcucuaucucaaaucuucagauaucuaa

SEQ ID NO: 4116425 - RNA, 63 nt, Human
uuaugucuguauuagucagcauucuccagagaaggagaagcaauaggacauauauagacauag

SEQ ID NO: 4116426 - RNA, 67 nt, Human
uuauguuacaaaguuuuucuaaaauggguucaauauugauaauauuuugagagaagcuaugacauaa

SEQ ID NO: 4116427 - RNA, 79 nt, Human
uuauguuuauuccuaaaguaauacacuagaauuuuggauugcuggccaaucuccugugauuuuggugaauaugacauag

SEQ ID NO: 4116428 - RNA, 116 nt, Human
uuauuacaaaucauuaugcacauuuucuguucaagacugaggugacacuggugucaaaugaaaucaugucacuguuggucuuauggagauuaaguuacuaaguaaagauuaaauaa

SEQ ID NO: 4116429 - RNA, 75 nt, Human
uuauuacuuccauguccuuagaguccaaaaacuucaauaagucaaacugcacauaaagggcaugggaggugcuaa

SEQ ID NO: 4116430 - RNA, 130 nt, Human
uuauuaucuugacuaccugaauugcgagggauuuuuauauauucauauguuccaaagucagcaacucuccuguugguucauuauugaaugugcuguaaaugaagucuuuugcaacuaaaaugagauuuga

SEQ ID NO: 4116431 - RNA, 56 nt, Human
uuauuauuccccaagucauuauuugaacaccuagaauggugcuuggcaaauaguag

SEQ ID NO: 4116432 - RNA, 128 nt, Human
ugucacuuugcuucucuaaacuaggaaaacugauaggacuuuugaauaagguaggauauaagauuuaaaaauauaaauaggucauccccuccaaaaaagccguuuguauguuuaacuggugagugaca

SEQ ID NO: 4116433 - RNA, 63 nt, Human
ugucagaaauucuuuccaaagaaaauacuuccacugcuuucuggggaauguucauuucugaca

SEQ ID NO: 4116434 - RNA, 72 nt, Human
ugucagaauaagccauuuggacuucugguaggcuguggggagucacugaagucuucaaguaggagaaugaca

SEQ ID NO: 4116435 - RNA, 84 nt, Human
ugucagacuuuagaaucaugugaacagccuauuucuuuuugugacagauguggaguuugcaugauaaaggauuagggucucaca

SEQ ID NO: 4116436 - RNA, 62 nt, Human
ugucagagcuggaggcaaguucugaaaccaccagagccagccuucucagcuuacaaaugaca

SEQ ID NO: 4116437 - RNA, 65 nt, Human
ugucagagggacaugaggaugaucuagaagggguauguaccacuuccacucguauucuguuggca

SEQ ID NO: 4116438 - RNA, 92 nt, Human
ugucagaugccacauaguuguugaacucaaugucugcacaaugcacaguguacaaugucuggcagauauuaggagcucaauaauguuugaua

SEQ ID NO: 4116439 - RNA, 70 nt, Human
ugucagcaaagccauuuagggauuagagcagcucccucaguaaaagcugcuuauucaaaaggugcuuuca

SEQ ID NO: 4116440 - RNA, 61 nt, Human
ugucagcagaaaucuggucugcuuucugaaaugggauguagguuuccaaauucucuagaca

SEQ ID NO: 4116441 - RNA, 59 nt, Human
ugucagcagcugaggccuuagaugagucauagucacugcaggagacacagcugcugcca

SEQ ID NO: 4116442 - RNA, 56 nt, Human
ugucagcuccuccugagugcggcuuccagaauggcugggccuagaggaagcugaca

SEQ ID NO: 4116443 - RNA, 71 nt, Human
ugucaggaggcccugaagacagcuggggugagagcuagccaucuugccucggucuaucagggugccaggca

SEQ ID NO: 4116444 - RNA, 76 nt, Human
ugucaggcaugacugaggucuuagagucacccaaauaaaacuuaucuaugugcucugaccucuccuccuucugaca

SEQ ID NO: 4116445 - RNA, 67 nt, Human
ugucagucugagucuaauugaacguaccaucugauucugagaugaacaugugacucagaccuggaua

SEQ ID NO: 4116446 - RNA, 61 nt, Human
ugucagugguccucagccucggcucauguucaaaucacauggaaggcuuggaauacuucca

SEQ ID NO: 4116447 - RNA, 57 nt, Human
ugucaguuuccugugcccugcugucccacagcugaagcaacaacaggauggcagaca

SEQ ID NO: 4116448 - RNA, 101 nt, Human
ugucauauuacagaugaagaaauugugguucaaagaguuaaguguccgcuaaguuuaaguauggacacauuuauggaucgcagaaacucgucugaaugaua

SEQ ID NO: 4116449 - RNA, 76 nt, Human
ugucaucaucagagugcagggaguagcagcaaguugggauucagccagcucuaaacuccuugcucucuuucggaca

SEQ ID NO: 4116450 - RNA, 66 nt, Human
ugucaucuugacugggauaagggauacccagauagguauuuauuauuuacccagauaggcauggua

SEQ ID NO: 4116451 - RNA, 66 nt, Human
ugucaucuuucuuacuaugaguuaugaauuuuguaaucacucaucuuucauggaagaaaugugaua

SEQ ID NO: 4116452 - RNA, 56 nt, Human
ugucauggacuggauuucugcugugagcuuccauuaggacuuguccauccaggaca

SEQ ID NO: 4116453 - RNA, 71 nt, Human
uguccaacuccagcucacacagugacccccaccaaaaugugcccaggucugugcuaagcuugagagggaca

SEQ ID NO: 4116454 - RNA, 65 nt, Human
uguccacaucugagggauuugucccuuaucugaaaaguagauagguggugaguucuucagggaca

SEQ ID NO: 4116455 - RNA, 57 nt, Human
uguccaccgguccugugaugggcccuguagggaacucuggauucacaggcuggggca

SEQ ID NO: 4116456 - RNA, 84 nt, Human
uguccaccgucuccacauagcacaggcugcugggcuccgugcuggccagcaagagcaugucggccugguguggaguggggggca

SEQ ID NO: 4116457 - RNA, 58 nt, Human
uguccagagucacagagcucaaagaaauuacagaaucuuucuccugugaauucuggca

SEQ ID NO: 4116458 - RNA, 66 nt, Human
uguccagauucuaguauagggagacaucaauacacaggugaaaaaacuaauuacagauuuuggaca

SEQ ID NO: 4116459 - RNA, 62 nt, Human
uguccaggugugucuaaagagauggcuuacagaagcaagugagcuuaaggcacacacuggca

SEQ ID NO: 4116460 - RNA, 65 nt, Human
uguccauggaaugugaacaugauggcauucugugagugaguuaugccagcgcauccaaaugaaca

SEQ ID NO: 4116461 - RNA, 65 nt, Human
ugucccaggaagcccagaauucuggaauggagacagucaaauucuaaagggguucucugcuggca

SEQ ID NO: 4116462 - RNA, 81 nt, Human
ugucccaguuuaucugggacuguccugguuuuaaaauggaaaacuccugggaacucccuuagucuggggcaaauugggaua

SEQ ID NO: 4116463 - RNA, 72 nt, Human
ugucccaugguacugccacagaagagucucagcucucuccaggauucaguucuaaggucagugccuaagaua

SEQ ID NO: 4116464 - RNA, 62 nt, Human
ugucccccacuccuggccccauccagcugcaaugccuggaagaggccagaaagugggagaca

SEQ ID NO: 4116465 - RNA, 88 nt, Human
uguccccccugcagacgucuugaugccucuucucucucaaguccaaaaauggaagcaaaggcagcaaaugucuggaacagcuuuaaca

SEQ ID NO: 4116466 - RNA, 62 nt, Human
uguccccuagaaugcucacaugcacuuaccuguugguggcugucacaagcaucuggggcaua

SEQ ID NO: 4116467 - RNA, 68 nt, Human
uguccccuuggccugcagucuccucaucccgcgaugguguggggagugacgcagggccauagggagca

SEQ ID NO: 4116468 - RNA, 70 nt, Human
ugucccgacaugauggcaagcugcagcacaucaugcagauuaaaguucagccugccucagacucaggaua

SEQ ID NO: 4116469 - RNA, 65 nt, Human
ugucccucaggcuggagugcaguggcgcgaucuccgcucacugcaagcucugccucccggguuca

SEQ ID NO: 4116470 - RNA, 79 nt, Human
ugucccuuauaacagucaacuuuuucauagcucugcauuaucuguacucaccucugaaaugguugcuuauuuaagggca

SEQ ID NO: 4116471 - RNA, 77 nt, Human
uguccgcaaagagcccuccaucagugaaggagacagauucaugaggauuacaauucagguugauaagggcugggaca

SEQ ID NO: 4116472 - RNA, 65 nt, Human
uguccgcugucuuccuugcuccaagggaacucuugcgugaacccugcaaaggagcccagcccaca

SEQ ID NO: 4116473 - RNA, 111 nt, Human
uguccgguaacauucuuuuagcauuuguaauguuuauuuuaaaauuggaaagaaauuaugaggccuuuaauguuaaauuuguagauguuuuugagaauguuaaccugggca

SEQ ID NO: 4116474 - RNA, 62 nt, Human
uguccuaacacucuucaucgcacuggauaguuaagguugauguuaagaagguaguuaggaua

SEQ ID NO: 4116475 - RNA, 59 nt, Human
uguccuacacaguucagccaggcuugugucuacacugggccuuggauuuguggaguuca

SEQ ID NO: 4116476 - RNA, 96 nt, Human
uguccucuucccuguugaguaacuaugcuugagaaucaguuuuacuaauggaagacugcuuaauuuaauaguugcaaaagauaucuuaggagagca

SEQ ID NO: 4116477 - RNA, 64 nt, Human
uguccugacgugcacaggaggccaacacuaacaggcagaaacuuuuaaccggcaugggagggca

SEQ ID NO: 4116478 - RNA, 58 nt, Human
uguccugcaagcccuaaugaauccugcccuaggcaguuuuagcaaguguuugagggca

SEQ ID NO: 4116479 - RNA, 62 nt, Human
uguccugcuguuauuggccucuguuuuugugaaaacagaugaguuauaauagcccaaugaca

SEQ ID NO: 4116480 - RNA, 55 nt, Human
uguccugucucuuuccuaauugaaugccaguuuuagcgggagaggggcagucaca

SEQ ID NO: 4116481 - RNA, 102 nt, Human
uguccuucaaauugcacucaccaagccugagccaugcuuuacugcugaaacauccuagcagagagaaguaaguggcucaggguggcccucuugugguggaca

SEQ ID NO: 4116482 - RNA, 87 nt, Human
uguccuuguuuaccccuuccuggaugaacaguagaaaaagaaagacucguuucaaucugcauucaggagauaggaggccugagggca

SEQ ID NO: 4116483 - RNA, 62 nt, Human
uguccuuuccacucauucacagugaagaguuugguuccacaguauaauguauggauggggca

SEQ ID NO: 4116484 - RNA, 60 nt, Human
uguccuuugagcugcccugugucuaugcuaaagacacauaagggucugcuggguaggaca

SEQ ID NO: 4116485 - RNA, 65 nt, Human
uguccuuuucuuuagugcagcugcuggcugauaaaccugcuccugcucucucuaaggcaaggcca

SEQ ID NO: 4116486 - RNA, 65 nt, Human
ugucgcccaggcuggagugcaguggcgccaucuuggcucacugcaagcuccgccucccggauuca

SEQ ID NO: 4116487 - RNA, 73 nt, Human
uugagagcaacaggugauggggcugugagcauugaagacuuugcuggcaggcccuggcccugcugucucucag

SEQ ID NO: 4116488 - RNA, 59 nt, Human
uugagaggucauuaggccaugaggaugcagaccucaugaauuagauuagugccuuacag

SEQ ID NO: 4116489 - RNA, 77 nt, Human
uugagauaaugguagauguccacgcaguuguaagaaauaauacagauucuguguuucauuuacccaguuucccucaa

SEQ ID NO: 4116490 - RNA, 79 nt, Human
uugagauaauuacugaagguggauagugaguacaugacaguuucauuauacuaugcugucuacuuuuguauaugcuuga

SEQ ID NO: 4116491 - RNA, 88 nt, Human
uugagauaucuucuguucaaauugauuuugguaaagcugucaaucauagaauucugaaugcaguguauagaguuggaagaugacucag

SEQ ID NO: 4116492 - RNA, 69 nt, Human
uugagauauucaguuccauugaacugggagacuuuguuucuuuuggcugucaaugacugaguugcuuag

SEQ ID NO: 4116493 - RNA, 70 nt, Human
uugagaugauaugggaagaagcaguguuauuuauuuaaguacagcauugcauuuuccuuuguccuuucaa

SEQ ID NO: 4116494 - RNA, 68 nt, Human
uugagauggaaaauagaacaggaagaguaauuucaacuaaauugagauaauguucugauccauuucag

SEQ ID NO: 4116495 - RNA, 56 nt, Human
uugagauggagccucagucuuguggcccaggcuggacugcaauggcgccgucucag

SEQ ID NO: 4116496 - RNA, 55 nt, Human
uugagauggagucucgcucuguugcccaggcuggcauguaauggcuccaucucag

SEQ ID NO: 4116497 - RNA, 103 nt, Human
uugagauggagucuugaucugucacccaggcuggagugcaguggcucagucuuggcucacugcaaccuccgccucccggguucaaccaauucuccugccucag

SEQ ID NO: 4116498 - RNA, 103 nt, Human
uugagauggaguuuugcucucuugccgaggcuggagugcaguggugcagucuuggcucacugaaaccuccaccucucggguucaagcgauucuccuaccucag

SEQ ID NO: 4116499 - RNA, 76 nt, Human
uugagcacaccgcgucuaaacgaauuggcuugaauauguuuccaaaguaccaaguuuguuugacgcuucagcuuaa

SEQ ID NO: 4116500 - RNA, 69 nt, Human
uugagccagauucagugcugggaguccagugugaucugccuggaucuugcugcauugagaacaggccag

SEQ ID NO: 4116501 - RNA, 67 nt, Human
uugagcccgggagguugaggcugcagugagcugugaucaugccacugcacuucagccugggugacaa

SEQ ID NO: 4116502 - RNA, 58 nt, Human
uugagcuugucacugccugggaaggagcagcugcauuuguccucagugacaaccucag

SEQ ID NO: 4116503 - RNA, 61 nt, Human
uugaggaauuagguuuuucaaaugugcauaagugcacuguugaaauauggauugaccuuga

SEQ ID NO: 4116504 - RNA, 69 nt, Human
uugaggcacacacagguugcauugugaugccaaccacauccuuuauguuguaacacugguguuucucga

SEQ ID NO: 4116505 - RNA, 101 nt, Human
uugaggcagaauugcuugaacccaugaggcggagguugcagugagccaagaccgcuccauugcacuccugccugggcaacaagagugaaacucugucucaa

SEQ ID NO: 4116506 - RNA, 103 nt, Human
uugaggcagagucuugcucuguuguccaggcuggagugcaguggcgcgaucucugcucacugcaagcuccgccucccggguucaugccauucuccugccucag

SEQ ID NO: 4116507 - RNA, 61 nt, Human
uugaggcccagagagguugcaugaccuucccaaggucaaugagagccacucugggguucaa

SEQ ID NO: 4116508 - RNA, 75 nt, Human
uugaggcugucaguggcuguggcauuaggugaggccccuuggaggggguggcccuaaccgcagccuccgucuuaa

SEQ ID NO: 4116509 - RNA, 104 nt, Human
uugagacagaguuucacucuuguugcccaggcuggagugcaauggcgugaucuugguucacugcaaccuccaccuccuggguucaagcgauucuccugccucag

SEQ ID NO: 4116510 - RNA, 117 nt, Human
uugagacaggagaaagggaaauaauccaagggugcauguugaauuggccaucacuauggagggcugaugcaccauguagccaggaauuucucaggaaucucauggaacaugucucag

SEQ ID NO: 4116511 - RNA, 104 nt, Human
uugagacagggucucacucugucgcucaggcuggagugcaguggugugaucucagcucacugcaaccuccaccucccgggcuuaagugauucuccuugccucag

SEQ ID NO: 4116512 - RNA, 101 nt, Human
uugagacagucucacucuguccccuaggcuggagugcaguggcaugaucucggcucagugcaaccucugccucccggguucaagcgauucgccugucucag

SEQ ID NO: 4116513 - RNA, 101 nt, Human
uugagaccgagucucgcugucacccaggcuggagugcaguagcucgaucucagcucacugcaagcuccgccucccggguucacgccauucuccugccucag

SEQ ID NO: 4116514 - RNA, 102 nt, Human
uugagacggagccuugcucugucaccaggcuggagugcaguggggugaucucagcucacugcaaccucugccucuuggguucaagcgauucuccugccucag

SEQ ID NO: 4116515 - RNA, 103 nt, Human
uugagacggagucucgcucugccgcccaggcuggagugcaguggcgcgaucucggcucacugcaagcuccgccucccggguucacgccauucuccugccucag

SEQ ID NO: 4116516 - RNA, 103 nt, Human
uugagacggagucucgcucugucgcccaggcuggagugcaguggcgggaucucggcucacugcaagcuccgccucugggguucaggccauucuccugccucag

SEQ ID NO: 4116517 - RNA, 101 nt, Human
uugagacggagucuugcccugucgcaggcuggaguacaguggcacgaucucggcucacugcaacuuccgccucccaggaucaagcgauucuccugccucag

SEQ ID NO: 4116518 - RNA, 103 nt, Human
uugagacggagucuugcucugccacccaggcuggauugcaguggcacgaucucggcucacugcaagcuccgccucccggguucacgccauucuccugacucag

SEQ ID NO: 4116519 - RNA, 58 nt, Human
uugagacugccuugucgucugcuguagcagugcccuuuauuucuggggcagaucucaa

SEQ ID NO: 4116520 - RNA, 80 nt, Human
uugagagaaccuugaacauugcuuuauuucuucuacacucuugaauguggaggaaauaaaaagaugguugguugucccaa

SEQ ID NO: 4116521 - RNA, 71 nt, Human
uugagagcacucgauacuaaacucaaaugggaugcucugugccuacaugcuuuuaguguuucacuucucaa

SEQ ID NO: 4116522 - RNA, 76 nt, Human
uugagagccacagcagggcuggacaggaucuccucgcaggggauucuacugaucagcaccacguuuagguauucaa

SEQ ID NO: 4116523 - RNA, 66 nt, Human
uugagagguaauuuuguguuaaugauuugcuacucaauucagucgccaaaauaccuuaauucucaa

SEQ ID NO: 4116524 - RNA, 60 nt, Human
uugagaguuaccagcagaggaaacgaagguauugugcuuucuuuguaaauagcuucucaa

SEQ ID NO: 4116525 - RNA, 56 nt, Human
uugagauggagcuucacucuuguugcccaagcuggagugcaauggcgccaucucgg

SEQ ID NO: 4116526 - RNA, 107 nt, Human
uugagauggagucucacucugucgcccaggcuggagagcaguggcucaaucgaucucagcucacugcaaacuccgcuucccagguucaagcgauucuccugucucag

SEQ ID NO: 4116527 - RNA, 103 nt, Human
uugagauggagucucacuuugucacccaggcuggagugcaguggcucaaucucggcucacuacaaccuccgccucccggguucaagcgauucuccugccucag

SEQ ID NO: 4116528 - RNA, 103 nt, Human
uugagauggagucucgcucugucgcccaggcuggagugcaauggugugaucucggcucacugcaaccuccgccugcuggauucaagugauucuccugccucag

SEQ ID NO: 4116529 - RNA, 104 nt, Human
uugagauggaguuucacucuugucacucaggcuggagugcaguggugcaaucucagcucacuucaaccucugaguccuggguucaagugauucuccugccucag

SEQ ID NO: 4116530 - RNA, 60 nt, Human
uugagauucauguguuucaagguccuccacagguaaggcaguugaaaauauggaucugag

SEQ ID NO: 4116531 - RNA, 100 nt, Human
uugagcagcaccgugccugcuagcccaagugcucuaggauccugagucaucucacgaugacacaggaagucagcacugauggcuggaggcgugcuuucga

SEQ ID NO: 4116532 - RNA, 60 nt, Human
uugagcccuaccucagacuuucugaauaagaaucccuagagaauguccaguggggcucaa

SEQ ID NO: 4116533 - RNA, 76 nt, Human
uugagccuaaauuagugaacuaaaaauaaauuugguuucuuagccauagaauuugguuuauuaaauuguaggccag

SEQ ID NO: 4116534 - RNA, 58 nt, Human
uugagcugauuuuugaaggaggcugaggaggaggcuuuaauucuuuaauucaguuuga

SEQ ID NO: 4116535 - RNA, 55 nt, Human
uugagcuguuuucauguuagaguguuuuaaaaagccuaguguuaaaacaguuuaa

SEQ ID NO: 4116536 - RNA, 58 nt, Human
uugaggaaaugucucuugauuuuuggaucccuggaaagggguagagaacaucacucag

SEQ ID NO: 4116537 - RNA, 91 nt, Human
uugaggaggugaguucucaguuucauagcugagcaaacuaaggugagaaacacuaaggcugcucauugcuauggcugaguuucuaucccag

SEQ ID NO: 4116538 - RNA, 56 nt, Human
uugaggaguagaagcuuugaauggguuucccauccauaagucuuuuuguuccucaa

SEQ ID NO: 4116539 - RNA, 56 nt, Human
uugaggcacagauuuuaguggcuuuguggcaauaaauagggcauggugugccuuag

SEQ ID NO: 4116540 - RNA, 110 nt, Human
uugaggcagagucucacucugucccccaggcuggagugcaguggcgugaucucaguucucagcucacugcaaucuccaucuccuggguucaagugauuauccugccucag

SEQ ID NO: 4116541 - RNA, 103 nt, Human
uugaggcagagucucgcuuuaucacccaggcuggauugcaguggugugaucucggcucacugcagccuccgccuuguggcuucaagugauuuucccgccucag

SEQ ID NO: 4116542 - RNA, 103 nt, Human
uugaggcaggaagaucccuuaaacccaguaggucgagacugcagugagccauguucaugccacuguacuccagccugggggacagagggagaaguugucucaa

SEQ ID NO: 4116543 - RNA, 59 nt, Human
uugcacagaugcacaugguugccuggagucuaucguacaaucaugugcacugcugacag

SEQ ID NO: 4116544 - RNA, 95 nt, Human
uugcacagcuccaaggggaccacugccacugugcuccaugucaaugacaaccccuagagcacagaugugaguggaggcucccuggaugugugcaa

SEQ ID NO: 4116545 - RNA, 68 nt, Human
uugcacgcuugcgguuccugccccuuccgugugcaaaguaaggaagucagcaggcggcgagcaagcaa

SEQ ID NO: 4116546 - RNA, 75 nt, Human
uugcacuaaugaagcuccuauaaauccuggccugagauuuacucuuaguuuaggaauuaugagggugguggguag

SEQ ID NO: 4116547 - RNA, 116 nt, Human
uugcacuuuccaguugaggugaugccccgccuugcuucagcucacccuccaugggcugcacccacuguccaaccagucccagugagaugaaccagguaccucaguuggaaaugcag

SEQ ID NO: 4116548 - RNA, 68 nt, Human
uugcagaacacuucccauacccucccaccuccagccccaaggaggauuaggaugcagggagucugcag

SEQ ID NO: 4116549 - RNA, 86 nt, Human
uugcagagagacaauuuaguucagaauuaugugccacccugacucuaccuggcaggugccuucugugcuagcucuucuaucugcaa

SEQ ID NO: 4116550 - RNA, 62 nt, Human
uugcagagccaugaggcuggcucagcaacacaaaagccaggggcaagccucagcucuagcag

SEQ ID NO: 4116551 - RNA, 60 nt, Human
uugcagauguccacaucacacuucaugauggaguugaagguggucuuguggaugcugcaa

SEQ ID NO: 4116552 - RNA, 76 nt, Human
uugcagccaggggaaggagccuugaaacucuccagccccgacgccccagucucauuggcucccucccccgcugcag

SEQ ID NO: 4116553 - RNA, 63 nt, Human
uugcaggauugcagauuugauuagauguucaauacuaaucucagucucauuccuuugaagcaa

SEQ ID NO: 4116554 - RNA, 58 nt, Human
uugcaggguugacacugccugccugaaaacgaaggagcgccgguucucaacccggcaa

SEQ ID NO: 4116555 - RNA, 91 nt, Human
uugcaguaguccagugguucaguuuuggucuggcuuccuuuuuucuguggugacugucuagcccacaagcugaguuauggagaugcugcag

SEQ ID NO: 4116556 - RNA, 59 nt, Human
uugcaguugcuguauuuaaggaauaaauuugaccuugaguuuccugacagcgaagguaa

SEQ ID NO: 4116557 - RNA, 86 nt, Human
uugcaguuggugcugaucuaaauuuaggacaucuugauauguggccuacaaaaaguuuagauuaaaucauuuccaauauuuugcag

SEQ ID NO: 4116558 - RNA, 77 nt, Human
uugcauagcaaugcugacagaugcuuuuagaacacauguuuuuuaaaauguucaaaaggcacagcauugucuagcag

SEQ ID NO: 4116559 - RNA, 66 nt, Human
uugcauaucuagaggagggcugcuggauuacauuagugauucuauuagcauuuuauggaaaugcaa

SEQ ID NO: 4116560 - RNA, 91 nt, Human
uugcauccucaccucacuaaugagcuaaggaaaaguuacgauuguauaauuuuaucuuuuucucauuggaugggagugacauuuuuugcaa

SEQ ID NO: 4116561 - RNA, 85 nt, Human
uugcaugauuugcauuuccuguacuguuugagcuucaaugagcucuaagcgccacguaugaggaaaccacugccaaguaaugcaa

SEQ ID NO: 4116562 - RNA, 64 nt, Human
uugcauguuauuuaaucuguauacuucaguuuuccuaucugaaaaaugcagagaauggcaguag

SEQ ID NO: 4116563 - RNA, 58 nt, Human
uugcauuagaaucagacagaacugcauuggaaucucagcucuguuauuuucuaugcag

SEQ ID NO: 4116564 - RNA, 61 nt, Human
uugcauucccagccaaguuagugcuggccagcaacaggcacuaacuuggcugggaaugcaa

SEQ ID NO: 4116565 - RNA, 58 nt, Human
uugcauuuacugcaccgugaguuacugaaauauuuagacuuauugcuaguaaaugcaa

SEQ ID NO: 4116566 - RNA, 67 nt, Human
uugcauuuucucaggugcuuaucuaagucauguuaaccaguggcauagagaaccugugaaaaagcag

SEQ ID NO: 4116567 - RNA, 63 nt, Human
uugccaaggccagagccagcgauaaguggccucgcgggcgcugccagcucugugcuaaggcag

SEQ ID NO: 4116568 - RNA, 73 nt, Human
uugccacugaggggcauguguuuacacauggcucuaagcagaugaauaaacaggugccucuucacauggauag

SEQ ID NO: 4116569 - RNA, 67 nt, Human
uugccagcugcuuuuugucacauggguugccaaggaauaacugugaugcaaaggacaguuaaggcaa

SEQ ID NO: 4116570 - RNA, 55 nt, Human
uugccaggagagccacuugcagcucaguggaucacaaguuggcuccuccuagcaa

SEQ ID NO: 4116571 - RNA, 58 nt, Human
uugccagggcuuugguggcauccugaaguucgggaugguauagucagggacuuggcag

SEQ ID NO: 4116572 - RNA, 55 nt, Human
uugccagugccagcccaggcagaguuuagagcuuguucugagguggaacuggggg

SEQ ID NO: 4116573 - RNA, 66 nt, Human
uugccaucuggcuguuucaaauguauagaguuugugcuucuauauauaaaugacagcauauggaaa

SEQ ID NO: 4116574 - RNA, 63 nt, Human
uugcccaacaggaaaucucuauacugaguagcauugaaccaucuagauuucucucuuggguag

SEQ ID NO: 4116575 - RNA, 57 nt, Human
uugcccagagucacccagcucagaagcugcagagcuggggcuuucaaaucugggcag

SEQ ID NO: 4116576 - RNA, 66 nt, Human
uugcccagaguccacagcguacauuaggguucacucugcuguugaacaugcuguggguuuggacaa

SEQ ID NO: 4116577 - RNA, 64 nt, Human
uugcccauccuaguagcagugucaagguuuacuacauauuuuccagcugcagugggauggggaa

SEQ ID NO: 4116578 - RNA, 99 nt, Human
uugcccauucaaaauuagggagugagcuggacuugucuugcagaccaucguuugaugacuucuuuucuagcuauuaccauuaaugcuuguuuuggucaa

SEQ ID NO: 4116579 - RNA, 59 nt, Human
uugcccuagggucuuauccuccacauuccaccacacugggugcuggugagaccgggcag

SEQ ID NO: 4116580 - RNA, 58 nt, Human
uugccucccccagagaggauaucuaagagaauggcugaggcucucugggugaggacaa

SEQ ID NO: 4116581 - RNA, 63 nt, Human
uugccucuagagaaucuuuuaagaaguggccuuuuguucuuugugucuguucucuaaagguaa

SEQ ID NO: 4116582 - RNA, 62 nt, Human
uugauucuuugagaccgugauacucuuuucaugucauagaaauuggaggcucagagaaucag

SEQ ID NO: 4116583 - RNA, 64 nt, Human
uugauugaguucuugucugccggucacuguucuaggcacuggggauuagggacucagugaucaa

SEQ ID NO: 4116584 - RNA, 80 nt, Human
uugauuuagcuauuuauucccacugugaaaugaggguaaugguaccuguuucauagaguugugaauuuuaaauaaauuaa

SEQ ID NO: 4116585 - RNA, 69 nt, Human
uugauuucuacagaauaaauguuuacagaucauagaaggagacuaugugaacaguauuuguggaagcaa

SEQ ID NO: 4116586 - RNA, 62 nt, Human
uugauuucuuuuggccauuugaguugacaggcugugcaaauuuacagguuaaaugaaaucag

SEQ ID NO: 4116587 - RNA, 63 nt, Human
uugauuugguaucuuacauuugaaguacaugguucucucugugcuugaaagaugcagaauuaa

SEQ ID NO: 4116588 - RNA, 71 nt, Human
uugauuuuauucccacccuaaguaguaggucuuauagaucuuauuuuauaguggagggaacugaagaucag

SEQ ID NO: 4116589 - RNA, 79 nt, Human
uugauuuucuucccacuucaccucccucugagcucuccaaaagggaaaugcagagggugugaaggggaugaaaagucaa

SEQ ID NO: 4116590 - RNA, 91 nt, Human
uugauuuugauacaugauguauauucacugagcaaggggguugauccauuauguggaccccuucugggaauauguggacugugucuaucaa

SEQ ID NO: 4116591 - RNA, 114 nt, Human
uugauuuuucucugagaagauagcauuuagaauccauguuagaagauucaugaacuaauucaguaaaucucuaauuggcauacaugguaagcuguucacuuaguggauaauugg

SEQ ID NO: 4116592 - RNA, 74 nt, Human
uugauuuuugcccucucaaguugagucagauuggaggucaccaucugaagcacagcaggaagggucagaaugga

SEQ ID NO: 4116593 - RNA, 73 nt, Human
uugcaaaagccagccagugccagucuuaucaaagcagaguuucuaagaaauauuaguugguuuuaaaaugcaa

SEQ ID NO: 4116594 - RNA, 89 nt, Human
uugcaaaggugcuugaaaugacugaggccugauaacaguuguagagauuccuagagguuaaaaaggauucaguuaauagaccagugcgg

SEQ ID NO: 4116595 - RNA, 79 nt, Human
uugcaagcaguugcuuagaaaguaaacacgaagucuccagaccucuggaauuugguccugcuucuugccugcugugcaa

SEQ ID NO: 4116596 - RNA, 130 nt, Human
uugcaauaauucagaugaggaauaauagugacuugauccagaguaauacagaaugcagugaaaagugaugcaauucagaguauauuuugacagugaagcuaguauuauaaucugccaucuuuacaugcca

SEQ ID NO: 4116597 - RNA, 110 nt, Human
uugcaaugugggccggugccacaggaaucgucacuuagcgcauugauuaaaaugauccagcgccucaccagagacauucuugaggccccagaggcacccaacaaaugcaa

SEQ ID NO: 4116598 - RNA, 83 nt, Human
uugcacagauguccagggccggguagcuuauguaauuucagguggaauagacaagcacccugguaaaauggacaucuuggcaa

SEQ ID NO: 4116599 - RNA, 58 nt, Human
uugcacagcacagcaacauguuuuggaaaauaaaaccuuuaaugcauggcugugacag

SEQ ID NO: 4116600 - RNA, 84 nt, Human
uugcacccuaaaauaacuuucuguguauagucaggcagcugaugccuagaauuugugcucaggaagauuagaggaauguagcaa

SEQ ID NO: 4116601 - RNA, 88 nt, Human
uugcacucaucuuauguuagugauuuucauauuacauuagcaaauuuaaucucugcucaugugauaggaaguuacuaacacaaugcga

SEQ ID NO: 4116602 - RNA, 71 nt, Human
uugcacuguaagcaucugugucacacuaaaauuguuuaaagaaguguuuaugcaggcuguuuaagaggcaa

SEQ ID NO: 4116603 - RNA, 74 nt, Human
uugcacugugugacccuggccuugccagugcauuccuaaaauggaagaacagcaagugaggcgucagcagucaa

SEQ ID NO: 4116604 - RNA, 89 nt, Human
uugcagagccaagagguggagagaaaccgaguccagaugguaccauuugaaccccugguucagguuucucugaacuuuuuauucuguga

SEQ ID NO: 4116605 - RNA, 82 nt, Human
uugcagaguuucauucuggaauucucaaguccuggaguccacucuaggacuccaugaauucuagaauuccaggacuuugcga

SEQ ID NO: 4116606 - RNA, 60 nt, Human
uugcaggggaaggagcagagcucagaagaaucacccuagguucaaguuccugcucuguga

SEQ ID NO: 4116607 - RNA, 56 nt, Human
uugcaggguccuguggcucuccuugcgaugggggaauccacgugggggcccuggag

SEQ ID NO: 4116608 - RNA, 58 nt, Human
uugcaggugagggaaaugacugagaaucccguuucuuaucaacucccccaaccuguga

SEQ ID NO: 4116609 - RNA, 60 nt, Human
uuccuacaugggggcugcugccagcgagcacggcuuugcugguaaagucuuuaucgggaa

SEQ ID NO: 4116610 - RNA, 70 nt, Human
uuccuaccagcuuuugagccugccuacuuucaaugaagccagcagggcccaaaugcuggcucucuaggaa

SEQ ID NO: 4116611 - RNA, 86 nt, Human
uuccuacuuaaaucagggcagguuaacuugggugacauaugcaaggacauguaaccaguacccugaccuuccuucuuaaggaggaa

SEQ ID NO: 4116612 - RNA, 57 nt, Human
uuccuagugucuucaguggccuccaacucagggccaggucacaugaagccuagagaa

SEQ ID NO: 4116613 - RNA, 56 nt, Human
uuccuauggccagagucaaagagaaagucuauuguauucauuuggccauacuggaa

SEQ ID NO: 4116614 - RNA, 74 nt, Human
uuccuauuguaaguucauuagacuacagauauccagaauuggaugcuacacuguagcaguggaguuuuggggaa

SEQ ID NO: 4116615 - RNA, 81 nt, Human
uuccuauugugguuuagcuagcaaguaugucaaggcuauuuuaguuugucauuuguacuucuagcaucaccagaauuugag

SEQ ID NO: 4116616 - RNA, 61 nt, Human
uuccucaagucagggaggcaggaugaugaccaaauuuuccccucucugcugcauagaggaa

SEQ ID NO: 4116617 - RNA, 77 nt, Human
uuccucaagugauuuuccuacuugcuaaagucuaaaaaucacuguaaggacauuucaaguagagggaucgcuaggaa

SEQ ID NO: 4116618 - RNA, 66 nt, Human
uuccucaccuauccugagguuuguaauauagucccugcccccaaggacuauacagccucugaggaa

SEQ ID NO: 4116619 - RNA, 68 nt, Human
uuccucagaagcgagcgagccucuuccacaauuuggggacacuguggaagaacuucuugcuuggggag

SEQ ID NO: 4116620 - RNA, 78 nt, Human
uuccucagaauaaaccucuuuaaaagggauauugauggaaauguacaauuaccaguaauugagguuuuaucugagggg

SEQ ID NO: 4116621 - RNA, 64 nt, Human
uuccucagugcccccauacgguaggugacauuauccuugugugauagcuuaggacacagaggag

SEQ ID NO: 4116622 - RNA, 130 nt, Human
uuccuccaauucacaaacuaguaaaugaaagaaggggagcaggugaugagagaggucauugaaaugugaguguuccacagugcuuuucugguuguuuuccuagaaauugauaguggguaauuugggggua

SEQ ID NO: 4116623 - RNA, 96 nt, Human
uuccuccugccuaccuaagagauuggucuaguuucagucugcuagugcagcuguucagcuggccagauuccuuaguuuacagaugggcauuuggaa

SEQ ID NO: 4116624 - RNA, 80 nt, Human
uuccucgcuuucaggaaagaguuagaugauuagaaggaaucacaugcuuuuauguuucauucuuuucugguauuugggaa

SEQ ID NO: 4116625 - RNA, 72 nt, Human
uuccucucccuuuuacugugaaaagaaacuggagcuucuacuccugcuacaguuuaaaggggaaguaaggaa

SEQ ID NO: 4116626 - RNA, 102 nt, Human
uuccucuggucccagacuguucaccuggagcuguagccaccacccugcccuuagguuaacugccucgagugguaguuuagcucuuugugcugugccgaggga

SEQ ID NO: 4116627 - RNA, 62 nt, Human
uuccucuguaguugcugaugaauagaggcugcuguuuguggugcucaguacugcagagagaa

SEQ ID NO: 4116628 - RNA, 83 nt, Human
uuccucuguguaaaacacuucaaggacuucugucucacuuaagguaguagccaagguucuugaagugguuugcccguagugaa

SEQ ID NO: 4116629 - RNA, 73 nt, Human
uuccucuuucucugugcuauguaagguuuaaaaauaguaaauagccaagagauagcagggagaagugggggaa

SEQ ID NO: 4116630 - RNA, 66 nt, Human
uuccucuuucuuauauucugucauuguuugcuuuggcaacagcuacuauccuagggccaggaggaa

SEQ ID NO: 4116631 - RNA, 56 nt, Human
uuccugaaccccacccaaauuaccugaaauuaaaauaguuggggugaggccaggaa

SEQ ID NO: 4116632 - RNA, 60 nt, Human
uuccugaagcugaaaacuuccagcaugucaagauauuucugggacaaacagcuuuuggag

SEQ ID NO: 4116633 - RNA, 86 nt, Human
uuccugaccuuuugaauucaguugaaguuguuuucuuucucaaccuugcaacaacccucagcuguuugaggagagcuuacuaggaa

SEQ ID NO: 4116634 - RNA, 62 nt, Human
uuccugagagcuuugaugcacuguuuccuguuguaggaugggcaggcacuggcucucaggga

SEQ ID NO: 4116635 - RNA, 84 nt, Human
uuccugaggccuugauguucuugggagauucaugcauaucugaauucuauauuauucugccaaaaaucuuaagguuuuguggaa

SEQ ID NO: 4116636 - RNA, 57 nt, Human
uuccugaucucuggaggaucagggagaaaugagacuuauucuccagggacuuaggga

SEQ ID NO: 4116637 - RNA, 68 nt, Human
uuccugcauucaugcccuggauucuuaagaacaacgaaugggagaaacacacagaaaugaaugaggaa

SEQ ID NO: 4116638 - RNA, 58 nt, Human
uuccugccccugagagcucccagaccaagacgggagagugaggcaucaggggcagggg

SEQ ID NO: 4116639 - RNA, 64 nt, Human
uuccugcuugguuuauaagucagauugcacugugcuuguggucgugcuugcugcuagguaggga

SEQ ID NO: 4116640 - RNA, 71 nt, Human
uuccuggaagaauuaucugaaagcuguguguggggccuacacacaacuggugguauuuuucccucaaggaa

SEQ ID NO: 4116641 - RNA, 77 nt, Human
uuccuggaauguagaguaucuguuuuauaguagauguuuguuacuuuuccucuguuuaggacuuuacaauuuaggaa

SEQ ID NO: 4116642 - RNA, 61 nt, Human
uuccuggcugaacugaacuccuaguuugacaugauggauccuuuugagucuagccauggaa

SEQ ID NO: 4116643 - RNA, 55 nt, Human
uuccuggcugaucuaccaaaguuggccugcccaguaaaugguagucuaccaggga

SEQ ID NO: 4116644 - RNA, 57 nt, Human
uuccugggccuuaaaucuuuuggguuuggggugcccuuuuagaucaggcccuaggga

SEQ ID NO: 4116645 - RNA, 56 nt, Human
uuccugggcucuggcuggccuaagccugcaggugccgccauccagccucccaggag

SEQ ID NO: 4116646 - RNA, 55 nt, Human
uuccuggggcgacuguaucugacuaaaauuggucauuuuguagauccuuuagggg

SEQ ID NO: 4116647 - RNA, 82 nt, Human
uuccuggucauuuuccccagcuucugagggggccuugccuauuaagacccauucucagaauugaauggaagggaccaaggaa

SEQ ID NO: 4116648 - RNA, 56 nt, Human
uuccugguccuauuauauacacuuaaagagaaguggguguuuauguaaucuaggaa

SEQ ID NO: 4116649 - RNA, 67 nt, Human
uuccugguguuacuaaauugaaaugagcccuaaacuauagaaaauuuuaagaaauaguaaccaggag

SEQ ID NO: 4116650 - RNA, 97 nt, Human
uuccuguggcgugccguuuuacaguaguaucuucauuuguugauucauucacucagucaacauuuaguaaauauuaugugacaggcagccaugggaa

SEQ ID NO: 4116651 - RNA, 78 nt, Human
uuccuguggguccucaacucuagggccccauaggcccuggacaggcagggccucugggguccugagcccaagcaggaa

SEQ ID NO: 4116652 - RNA, 67 nt, Human
uuccuguuuccagcugaaauuagauacgauagaguucaauagauaaagccacgcuggaaaucaggaa

SEQ ID NO: 4116653 - RNA, 63 nt, Human
uuccuguuucugaauaaagggguuuguuuuauugacaagaguccugagcacagagacaaggaa

SEQ ID NO: 4116654 - RNA, 62 nt, Human
uuccuucagcuguuuugaguuuaauuggggucuucuguauaaaccauggacagcuuugggaa

SEQ ID NO: 4116655 - RNA, 60 nt, Human
uuccuuccagaggugauguugguucuuaucuucauaaguugguuuucacucuggaaggga

SEQ ID NO: 4116656 - RNA, 55 nt, Human
uuccuuccgggcaccaggcacucuuccaaccuagugcucugccaucauuaaggaa

SEQ ID NO: 4116657 - RNA, 61 nt, Human
uuccuugagcucaaucuggucaguaggaaaggaaauuugaccaugaugcauccuuaaggaa

SEQ ID NO: 4116658 - RNA, 59 nt, Human
uguuggccaggcuggucucaaguuccugacuucaggugauccaccagccucggccucca

SEQ ID NO: 4116659 - RNA, 60 nt, Human
uguuggcuauuccuauaugagaugaugaaacuuauuauuauauagggaaagucccagacg

SEQ ID NO: 4116660 - RNA, 101 nt, Human
uguuggcugggauggucucgaacuccugaccuugugauccacccgccuuggccucccaaagugcugggauuacaggugugagccaccgugcccggccuaca

SEQ ID NO: 4116661 - RNA, 129 nt, Human
uguuggcuucaaguugaagauggggcugcuggcugggcaugguggcucacaccuguaaucccagcacuuugggaggcugaggcggguggaucaccugaggucagaaguucaagaccagcaugaacaaca

SEQ ID NO: 4116662 - RNA, 74 nt, Human
uguugggaacacucugugugugucuaaguaaggguguauuuucucuuggaaucuccauagagugaugcccuuca

SEQ ID NO: 4116663 - RNA, 58 nt, Human
uguugggauggagauuuuauagguucagacaaaucuucuagaucugcuucacccagca

SEQ ID NO: 4116664 - RNA, 57 nt, Human
uguugggcagaggccaggaggaugcuccaugguaucugacaaacccugugcccagca

SEQ ID NO: 4116665 - RNA, 77 nt, Human
uguugggcuccugagcaagcaugccaagucuguuugcaauuuccgcagcacauagcaugcuugucagaggcuuucca

SEQ ID NO: 4116666 - RNA, 67 nt, Human
uguugggguauuauucuaugacuuguucucaucuuaucauaacauuguaugagauuugaccucaaca

SEQ ID NO: 4116667 - RNA, 64 nt, Human
uguugggguuuauuacugcaugcaagguacacacuggccucccacagugguacagcccugaaca

SEQ ID NO: 4116668 - RNA, 58 nt, Human
uguuggguguuguuacuuucuccuuuucaaggaccuguugcugaaagugcacccaaua

SEQ ID NO: 4116669 - RNA, 57 nt, Human
uguugguaggauuugcuucagcuucuaguugcuggcuugcuuucucucugcucaaua

SEQ ID NO: 4116670 - RNA, 101 nt, Human
uguuggucaggcuggucucgaacuccugaccucguaaucugccugccuuggccucccaaagugcuaggauuacaggcgggagccacagcgccuggccaaua

SEQ ID NO: 4116671 - RNA, 102 nt, Human
uguugguccugaaccuuguuuucugaugaccacacuugaucacucugagguuccuagcuguuguaccuggagugcaguugggaggacacccgguucccaaca

SEQ ID NO: 4116672 - RNA, 69 nt, Human
uguuggucuucuuuguugcuauuauuuuggucccuggaauagugcccggcacauagggaaugcucaaua

SEQ ID NO: 4116673 - RNA, 82 nt, Human
uguugguguaaagcauuuguuucuccuggaaagugcacaacggggauuuucuaagaaauggaaaacgauugccacacucaca

SEQ ID NO: 4116674 - RNA, 67 nt, Human
uguugguuuuggcuaugucuacacugaguaaaguggauauuugcaguguuccuguagccugccaaca

SEQ ID NO: 4116675 - RNA, 80 nt, Human
uguuguauaccagaguuacaguuacugugggaaucauaauuugaaauuuugacuccuguguuucuggaaucuuuacaaca

SEQ ID NO: 4116676 - RNA, 69 nt, Human
uguuguauauauguccuauuucccagcugggugguguucuucugucuggaaaaggacauagacacggca

SEQ ID NO: 4116677 - RNA, 86 nt, Human
uguugugugugugugugcaugcaugugugaaagucuggcaguucucuguauucagggacauauauguauguaugcaucggauggca

SEQ ID NO: 4116678 - RNA, 67 nt, Human
uguuguguuggaaaugaggcuggccauauaaaauuuagcccugaauuccaagccuucaacacauuca

SEQ ID NO: 4116679 - RNA, 77 nt, Human
uguuguuuguuucaguugccaagcuaauucucaacauucuuacuuugagagauagcaugguauacugguuaaccgca

SEQ ID NO: 4116680 - RNA, 86 nt, Human
uguuuaagcagcuggagcacaaguuggccaguaaaugcauguuauauagacauuuaauaccacuuggugcuuuaucaggcuuuaca

SEQ ID NO: 4116681 - RNA, 80 nt, Human
uguuuaagccacccagucuauguuaucuuguuauggcaguccagccaacuaauauagggcaugagaaaagggaggagaca

SEQ ID NO: 4116682 - RNA, 71 nt, Human
uguuuacaaaugcacagagccuuagagauaauacauuagugaguuucagguaaauguguaugaugauaaca

SEQ ID NO: 4116683 - RNA, 74 nt, Human
uguuuacagggaaauaaauaugugccagguacugugcuaagugcuuuuuaguacugucuuauuucauuuucaca

SEQ ID NO: 4116684 - RNA, 80 nt, Human
uguuuacauggagguuuucagcagccuuagcaggcaugauguuuggauccuggaaaucaucuauuuuuuauguguaaaua

SEQ ID NO: 4116685 - RNA, 68 nt, Human
uguuuaccauuccaugacaucaggacuggaaauugcauggcaguacuauuuauggagugguuauuuca

SEQ ID NO: 4116686 - RNA, 102 nt, Human
uguuuagauagacacuaauuuuucggucugaugauuuauguaucuugggggaauuuuguuauaaaugacugcaaaaguucauagcgggucuauauaaaauca

SEQ ID NO: 4116687 - RNA, 64 nt, Human
uguuuagaucucauucuucccaggggauuauacagauggguaacagggagagugagaucaaaca

SEQ ID NO: 4116688 - RNA, 76 nt, Human
uguuuaggacucaaccucuggaaaguauggacagguagaaaccuagucccacucccaggguaacaaggccagaaca

SEQ ID NO: 4116689 - RNA, 80 nt, Human
uguuuaguaaauuccuggcaugggcagggcacugggcuucucccaaagacuguaagagugugcaggauuauuugcagaca

SEQ ID NO: 4116690 - RNA, 62 nt, Human
uguuuauagcuuuucuuggcacugguauucuaugaaacauuugcagaggaaagcuauguuua

SEQ ID NO: 4116691 - RNA, 57 nt, Human
uguuuauagggucugucacuugaaaaagccuaugucaaguaucaccaucugugaaca

SEQ ID NO: 4116692 - RNA, 113 nt, Human
uguuuauaguuguuccaucagugcccagccaauuuguuauguugaaggugcucaauauauauuuucugggcaaaugaauggaugaauaaaaauaaagaaauauaacagaaaca

SEQ ID NO: 4116693 - RNA, 57 nt, Human
uguuuaucaggguaaaguguagcaauuuagccuugucccaucuugcccucauaaaua

SEQ ID NO: 4116694 - RNA, 72 nt, Human
uguuuauuaucuggcccuaacugucuguuuuauacacaaauguauccucagcaccuaggacaguagucagca

SEQ ID NO: 4116695 - RNA, 74 nt, Human
uguuuauuccaaaaacaguuuuugaguguauguucuacaaaguucugcacuagauacuguucaggaaauagaca

SEQ ID NO: 4116696 - RNA, 68 nt, Human
uguuucagaucaguaagaggaagaaugggguauggcauuucacaggcuuuuuuggcugauguggcaca

SEQ ID NO: 4116697 - RNA, 57 nt, Human
uguuucaggcuucugggauuuuaugaucuaccugaagucaucugagaacuugaagca

SEQ ID NO: 4116698 - RNA, 71 nt, Human
uguuucagugacuucuuugcucugcguaggucucacugcugcuggguuugacagucacuucaccugaaaca

SEQ ID NO: 4116699 - RNA, 77 nt, Human
uguuuccacacaggcucuacuacucauauuuguaaucagacucaaguacacaaguggacagagcuugccuggauuca

SEQ ID NO: 4116700 - RNA, 80 nt, Human
uguuuccaguuaucuugauuugucagcuggggauaaucacgaauuaucgguaagauggaaaucagggucaugagaauaca

SEQ ID NO: 4116701 - RNA, 65 nt, Human
uguuucccaggcuggaaugcaguggugugaucuuggcucacugcagccuccaucucugggguuca

SEQ ID NO: 4116702 - RNA, 88 nt, Human
uguuuccccuuuccaaacuauaaaguggcuauaugguaguuuuaauaaacuacugugugacuguuauuacuguuugcuguuggaaaua

SEQ ID NO: 4116703 - RNA, 107 nt, Human
uguuucccugggccuagaaccccuacuaggaagcagagcugagcaacaaaaugcccgccacaccagcuugcuaacugguagggguccaguucauaaccuggcgagca

SEQ ID NO: 4116704 - RNA, 60 nt, Human
uguuuccugagccagcacacucuucacacuacacuuugaguagcauggcucuauggaaca

SEQ ID NO: 4116705 - RNA, 60 nt, Human
uguuuccuggagguuauuuuugagacuucuugcuucuggucucagccaccagaagagaua

SEQ ID NO: 4116706 - RNA, 85 nt, Human
uguuuccuugguugugcuucaacuucuaaaauauguuuuuucuaugaacauuuuaaugagggguuggacauaagacagaaaaaua

SEQ ID NO: 4116707 - RNA, 81 nt, Human
uguuucuauucauuccuaacuccacuagccuugggagcuugcguuccuguguuacuugaguuaugauugaacauggcgaca

SEQ ID NO: 4116708 - RNA, 95 nt, Human
uguuucugugucugucucuuacgaauucuuagaggacaaguauguaguauauucaguuuuguaccucaaaauuugaagauacagaaaacaaagca

SEQ ID NO: 4116709 - RNA, 56 nt, Human
uguuucuuacguuuuuagaggcuucgugacggaguuaucagagacauugagaggca

SEQ ID NO: 4116710 - RNA, 78 nt, Human
uguuucuucucuguggcuugggccugccugucaucaauauaauagaaugauggaagugcaagcuauagacaccagaca

SEQ ID NO: 4116711 - RNA, 82 nt, Human
uguuucuucugcaaagagacuuugagucugguugaccaaauguuuugaaagucaagucaugacucaaaggaaguagaaagca

SEQ ID NO: 4116712 - RNA, 78 nt, Human
uguuucuuucaggauaaaauguaauggcaauggcuuugaugucuuugucuugcuuuauccuuccuucuuuaagaagca

SEQ ID NO: 4116713 - RNA, 77 nt, Human
uguuucuuuccuuuuucuucuugguuauaggcacugcacaguguuagcauagcucagaaggagaccccgggauaaca

SEQ ID NO: 4116714 - RNA, 57 nt, Human
uguuucuuuuucuauuucuauugcaaagguaaaagugagaagugggaaaagcaagca

SEQ ID NO: 4116715 - RNA, 66 nt, Human
uguuugacuugacacugagauaaagcugcuuccugguugcuucuauucacuggucacaguucugca

SEQ ID NO: 4116716 - RNA, 85 nt, Human
uguuugacuugugagcuaagauguuguuuuucucuuggaauaccauucuguuucaaagaacaaaugauauaugguuauucagaca

SEQ ID NO: 4116717 - RNA, 56 nt, Human
uguuugcuaggguugguauuuaagccugucugaauaugccacuuucuagccaaaca

SEQ ID NO: 4116718 - RNA, 60 nt, Human
uguuuggggcuuuuugugaacuuccuguuucuaaggaagaaccuaagaaagucucaugua

SEQ ID NO: 4116719 - RNA, 89 nt, Human
uguuugugaagcacacagaggcaggcuuguugaaguaaaauagggcccaaaucuuuguauuuuuaucaaguugcuaagugcuucagaca

SEQ ID NO: 4116720 - RNA, 77 nt, Human
uguuugugcuuccugcuucugucuucuuuauauauacuguguaaacaaugaaaacagagcuggaaaaagcucagaca

SEQ ID NO: 4116721 - RNA, 62 nt, Human
uguuuguugagugucucccgggugccaggcauuucuaggcacugugaauauacuagcaaacg

SEQ ID NO: 4116722 - RNA, 108 nt, Human
uguuuguuuaaaaccuuccacauuucaguauuauuuuaugacaaaugauauauuuggcaauugcuaaauguccuguuuucauuaauacuggugaauggagaacauaua

SEQ ID NO: 4116723 - RNA, 95 nt, Human
uguuuuaauuuguauacauaauugccuaauaaucauccugguucaccucugaacaguuugcuuuaagaggcacugguguuauauaaaaauauaca

SEQ ID NO: 4116724 - RNA, 109 nt, Human
uguuuuauacagauugaugauauguuaugauucauaaacuuuggaagucucaaacauuuuguguugaauauuuuaagaguuuuguuucuaucaucaaauguaaaaaaua

SEQ ID NO: 4116725 - RNA, 92 nt, Human
uguuuuauaucuuucuccaucuuuaaaauggggguaguggccugaagguacaaagaagcaucugguuuaaaagaagaaagcaaugaaaaaca

SEQ ID NO: 4116726 - RNA, 107 nt, Human
uguuuucaaaaaagaaacauggaaagagcaagggcuuugaggcuggcugaaacuggcucaaacccuggccucagcagcuuguuaacucuaugacuuuugggaaaaca

SEQ ID NO: 4116727 - RNA, 76 nt, Human
uguuuucaaagugcagcuugugaucccuagaggguacagcaaaguucuuauaggaguuggcagcaucaaaagaaca

SEQ ID NO: 4116728 - RNA, 117 nt, Human
uguuuucaaaugauagaacgcauuaacaugagagcuaagacauuaagaauuccuucggcguggauguguggugagaccuuguuccuuauguaaaugucuuuguguaauuugaaaaua

SEQ ID NO: 4116729 - RNA, 75 nt, Human
uguuuucaguagcacaauuuugucccuaacagaacuuuccaacaauguuagacagaugugugccacuuaagguca

SEQ ID NO: 4116730 - RNA, 55 nt, Human
uguuuucagucauauagcaggugaggcacccagaucagcuugcgggcugaaaaua

SEQ ID NO: 4116731 - RNA, 56 nt, Human
uuguauuccagccaccacaggcacuccagccuguggcuuucgguugugaaugacag

SEQ ID NO: 4116732 - RNA, 70 nt, Human
uuguauuucacuguaacugcaaauacuuaaccagaauuuugaagguuugcauuguugcaaugaaguauag

SEQ ID NO: 4116733 - RNA, 71 nt, Human
uugucaaucagaaaucauguuacaaguggcucuccuaucauauccauguguaacagagcacugauugacaa

SEQ ID NO: 4116734 - RNA, 77 nt, Human
uugucaaugauucugcaacugugugccaugaauucuuaguccugcaacauggucauaaagacagaaacauuccacaa

SEQ ID NO: 4116735 - RNA, 57 nt, Human
uugucaccccuagaggaauucugcguccuuucgcggcccugccucuguggguggcag

SEQ ID NO: 4116736 - RNA, 63 nt, Human
uugucacuuuugggcuaccugaaaacacugugucuggacauucuguagguuaaaaguagacaa

SEQ ID NO: 4116737 - RNA, 103 nt, Human
uugucagaguuuaucaauuauagaacagccuccucuagaggaauauaaagcacugccaaauccucugagauuuaggcuguugcugguaguaguacucuggcaa

SEQ ID NO: 4116738 - RNA, 71 nt, Human
uugucauuagcugagauggggagggcugcagaaagacuagguuuugaaugcagaagcccuauucuggacag

SEQ ID NO: 4116739 - RNA, 79 nt, Human
uugucauucuacagucagagugccuuucuaacuucccuuaagauguacccuguuggaggcugacuacugaagaagagaa

SEQ ID NO: 4116740 - RNA, 86 nt, Human
uugucauuuuaaguaugcucugacugauacaguuuacagagcuaaucuguacuugugugucaaagucaggugucacuaagguacaa

SEQ ID NO: 4116741 - RNA, 80 nt, Human
uugucauuuuaauuugucuacaaaguuuuguucuaguuagauuuucacccugcaugcuguguggucaaguuaauuugcaa

SEQ ID NO: 4116742 - RNA, 71 nt, Human
uugucccaaagcguucaguaauguuuucuuauuuuaucucuuuaagcaauacuaagugacuuuugggauga

SEQ ID NO: 4116743 - RNA, 66 nt, Human
uuguccucaucauucaaagcagggucacuaccuucaucaaagacacugcucugacagugaggccag

SEQ ID NO: 4116744 - RNA, 78 nt, Human
uuguccugcacugaauaguagacuguacacagagccugcacauaguaggaaaacaguaaauacuuguugagaggacaa

SEQ ID NO: 4116745 - RNA, 74 nt, Human
uuguccuuccuaaaagaauacacuggaugaugaaauaauacaggcauccaagauuacuucuuuugggaagacag

SEQ ID NO: 4116746 - RNA, 55 nt, Human
uugucggcauagaaguugaaggcauugguauauugcuucaaguuaugguuggcaa

SEQ ID NO: 4116747 - RNA, 75 nt, Human
uugucuaagucacauguuguauuccauauuuagcuguaguguugaaauaauaggaaaaacacugugucuuggcag

SEQ ID NO: 4116748 - RNA, 78 nt, Human
uugucuaauucugaacacauuuaaauuuauggaaaucauggggauccacuugaauuuuagugguuuuacuggagauaa

SEQ ID NO: 4116749 - RNA, 81 nt, Human
uugucuauaaguuacagagagauaaguguaaaagucucccauaauacgcaugacuuuuguauuucucuguaguaccaucag

SEQ ID NO: 4116750 - RNA, 70 nt, Human
uugucuauuuguucagguaagggacagcauuauuauuauuagcaccucuuacccuggagcaaauguucaa

SEQ ID NO: 4116751 - RNA, 62 nt, Human
uugugagucuugcaggucgcucacccuucagaccuuuaggcugaggccugccagucucagaa

SEQ ID NO: 4116752 - RNA, 63 nt, Human
uugugauaaaacauuagacauuuaugucaaaagcaguauugucucagaaguguuuuauaacaa

SEQ ID NO: 4116753 - RNA, 56 nt, Human
uugugaucuguguugauggccuauucgaauaugcaggugauucucacuauucacag

SEQ ID NO: 4116754 - RNA, 78 nt, Human
uugugcaaaggaggaggcauuauggggaagacuuagaauuugggacuucacucccacuaaugcuuuucucauuuacaa

SEQ ID NO: 4116755 - RNA, 56 nt, Human
uugugcgagagagcaagagugaccccuccucucacuccccagucucuucuugccaa

SEQ ID NO: 4116756 - RNA, 81 nt, Human
uugugcugaaaucuguugucaggaauccacaagaaguucuucauauuuauuuuguguuucggauagcagauucuguuacga

SEQ ID NO: 4116757 - RNA, 64 nt, Human
uugugcuguggcugaacucugaagaggcaguucuguugugccuguuaauuucagcacaguguga

SEQ ID NO: 4116758 - RNA, 113 nt, Human
uuguggaauuaauucagucauuccugcguggugaaauauggaauaggggcguguauucugacccuguucaauuuguuucaguuaucggcaggggaggugagcagauuucacgg

SEQ ID NO: 4116759 - RNA, 57 nt, Human
uuguggaguaucagaacaguuuuuguuuagaaguuggugaaagcuguuauuccagaa

SEQ ID NO: 4116760 - RNA, 91 nt, Human
uuguggauauugaaguuugaagccuguuguucaucuauagaugcacuggaugggauuggaagucuucagauuucaguaggguuuuccacaa

SEQ ID NO: 4116761 - RNA, 88 nt, Human
uugugggacaauugcuauuuugaauucuuagguguccaacuuuacaaccaagguuuacaaauauuuuaaauggugauuuagucagcag

SEQ ID NO: 4116762 - RNA, 130 nt, Human
uugugguccaguagcauuagcaccacuuggcaucuuguugcaaaugcagaaucacgguucucauugagacuuauugaaucagaaugggcauuuuaauaagauucauagguguuuggcaugcacauugcag

SEQ ID NO: 4116763 - RNA, 98 nt, Human
uuguggugauauaugacauuuaauuaacgaaugcucuggaauuuucaguaaaacacuucauaagcucguaacuaaaugauucaaaggugucaugacaa

SEQ ID NO: 4116764 - RNA, 66 nt, Human
uugugguuuuggccuaucaguggaacacagccacaaaauacuacugguaaaucacuaaaauuacaa

SEQ ID NO: 4116765 - RNA, 99 nt, Human
uuguguacguguguuugugcaugugcacacagugucaugcaaccuuauguguguguguguuuguauguguguguacguauguauagagauuggauacga

SEQ ID NO: 4116766 - RNA, 75 nt, Human
uuguguauaaaacuucauugccuccugaccuccauauaaguucuuguccugucagugaggcagaugaaagcauaa

SEQ ID NO: 4116767 - RNA, 130 nt, Human
uugugucacaacuguaaagauacucuuggugaaguggcuuuucagggacuguacucaucagacaagggauuuucuuucuuaugggguaguccuuuagucacuggaacuguuuauguuacuuaaaccacaa

SEQ ID NO: 4116768 - RNA, 59 nt, Human
uuguguccaaggcuauggugaucugagaagcaaagucacauuggggcccuggcacacag

SEQ ID NO: 4116769 - RNA, 62 nt, Human
uugugucccccuuugagagccagaaacuguuaaccuauggagcuuagagguacagggaccag

SEQ ID NO: 4116770 - RNA, 76 nt, Human
uugugucuaucuucucaguauaugggaugugggguguguuuguguaucugugucugggaggaguguguuggugcgg

SEQ ID NO: 4116771 - RNA, 66 nt, Human
uugugugaauuguuaaggguguugacaguuaaaaagcugucugacugaaccaauuauuuacaacaa

SEQ ID NO: 4116772 - RNA, 67 nt, Human
uugugugcauauguaccugugaucauguauguacaugcaugcauguaugugugcauguguaucucaa

SEQ ID NO: 4116773 - RNA, 82 nt, Human
uugugugcucagagaaagcaauuaaaagggugcugguucuucaugauucagagccucuaaaauuucuaucuagaacaugcaa

SEQ ID NO: 4116774 - RNA, 75 nt, Human
uuguguggaguuuaucagagagcagaggugggcuuuaagaggcucacuagugguuucuggugguugcuauaacga

SEQ ID NO: 4116775 - RNA, 57 nt, Human
uugugugugugugugugcugguuuuuuccuuaaaguagcuuaauaugaaacacauaa

SEQ ID NO: 4116776 - RNA, 72 nt, Human
uuguguguuuguagaaaauccauuucaagucaugucaucauuagaggaauauuuucuacuguuaacacacga

SEQ ID NO: 4116777 - RNA, 56 nt, Human
uuguguucugcacacgguccucaaacaccguggugaaggaacuuuguagaauacaa

SEQ ID NO: 4116778 - RNA, 74 nt, Human
uuguguuggcgaaagcaugucacuugguccagccccuacagaggcagguaugcagacaugucuuucucacacaa

SEQ ID NO: 4116779 - RNA, 74 nt, Human
uuguguuuaaggaguagaauagaugcaccuucauucagaaaguggaaguuuaugaagucuaagccaaaacacaa

SEQ ID NO: 4116780 - RNA, 55 nt, Human
uuguguuucccagagauccgccuccagugacuccauuucucucagggaaacagaa

SEQ ID NO: 4116781 - RNA, 74 nt, Human
uuguguuuggugcuuuaaauagaauuuauugauuuuauaauacugucaagcccuauuucaaggcccagauauga

SEQ ID NO: 4116782 - RNA, 62 nt, Human
uuguguuugucuguggcaauuguggguaaguuuucuuccuuuuauuuguccaggcuuuauaa

SEQ ID NO: 4116783 - RNA, 97 nt, Human
uuguguuuugucugucuccucucacuagaaugcaagcuccacaaggguaggaguuuuugccuuguugaccgguguaucucuagugcccagaacacaa

SEQ ID NO: 4116784 - RNA, 65 nt, Human
uuguuaaaaauagauuuccaggacauccccaugggucuggacucgggauccucuauuuucagcag

SEQ ID NO: 4116785 - RNA, 66 nt, Human
uuguuaaugagcugaauaguauagcaauuggauuucuuuuugaaucuauaauuucaguauuggcaa

SEQ ID NO: 4116786 - RNA, 60 nt, Human
uuguuacaauguacuuccuugcacaguaucuuugugcacuuguaugaguacaucugucag

SEQ ID NO: 4116787 - RNA, 66 nt, Human
uuguuacaugacucaaaggcacccuacuuggaauggaagggugccauugggcagucauugaagcaa

SEQ ID NO: 4116788 - RNA, 119 nt, Human
uuguuacuagaguggaaguugcuucugccuguaguauuuggagaagcuuuaaauuuguaaaucuauuuugcagcuucuccaaauauuacaggcagaagcaacuuccacucuaguaacag

SEQ ID NO: 4116789 - RNA, 67 nt, Human
uuguuacuauuuggauguuagccucaguccauaaagggacuugcuacacaucaucaaacagcggcaa

SEQ ID NO: 4116790 - RNA, 93 nt, Human
uuguuacucuguugaacaguuccagauugcuaaaaguaucaccugcuuccugaguuuagcaauuucuaaaaguguuauaucaugaguauauaa

SEQ ID NO: 4116791 - RNA, 61 nt, Human
uuguuagcugaagugugauguuugcagaaacuucugucagaccugugauuucagcaagcaa

SEQ ID NO: 4116792 - RNA, 61 nt, Human
uuguuaguaucauuuuggcauuaguauuuggugacagauguagcuuuagugauaccugugg

SEQ ID NO: 4116793 - RNA, 68 nt, Human
uuguuaguugggaagaugcugugaggccugaguuaauuuuggacuaacaugucucuucugaaagacaa

SEQ ID NO: 4116794 - RNA, 73 nt, Human
uuguuauagugugcccuucagcuuggaaacaaacguaugugauaaguuucuugauucugaaauauuaugauaa

SEQ ID NO: 4116795 - RNA, 109 nt, Human
uuguucaauuccagguuacguguauaauggauucagaaccgucaacccguauucagaguacauguauaguuguuucugaacuguuaucagguauaccugugagaaacag

SEQ ID NO: 4116796 - RNA, 64 nt, Human
uuguucagagcuggguuuggucuuaagagucauuaaaagacucucugagcuaccaggugagcaa

SEQ ID NO: 4116797 - RNA, 67 nt, Human
uuguucauagcuaucauugugucagcaaaaucucucaccaugaaugacaccaagcaguuaugaacaa

SEQ ID NO: 4116798 - RNA, 74 nt, Human
uuguucauauuugaaacagaaguuaguuucuaagagcuucuuagaauaauaaauauuguucuaaauaugggcag

SEQ ID NO: 4116799 - RNA, 73 nt, Human
uuguuccacaaauauuucuugagcaccugguauuugcccagcacugugcuaggugcuaggaagauaggaauaa

SEQ ID NO: 4116800 - RNA, 90 nt, Human
uuguuccugucgccuuuuaaagugguccauuucagaacaggcuguugauaaacuugcucauuuuauggcuuuuuugaaagauagguuuaa

SEQ ID NO: 4116801 - RNA, 55 nt, Human
uuguucuacucuacaguggagggcuucuuaaaaguuuccacccaggguagaaggg

SEQ ID NO: 4116802 - RNA, 59 nt, Human
uuguucuauggggugaagucuauaaauaaauaaauaagauauuucacauccgagaacaa

SEQ ID NO: 4116803 - RNA, 60 nt, Human
uuguucucugguaaacacaugcguauuuagaaagauguauacagcauguaucaagaacag

SEQ ID NO: 4116804 - RNA, 74 nt, Human
uuguucucuuuucacuuggcgucaagggauugacugaaaauaacuauccuuuuguuacaaagaaagaagagcaa

SEQ ID NO: 4116805 - RNA, 73 nt, Human
uuguucugugccaucugcacucucgucuauguggcagagccaagccuugaugagagagcagaggacaggccaa

SEQ ID NO: 4116806 - RNA, 83 nt, Human
uugagucucagcacagguuagguauuauacuaugcacuuagaauguagagacuaauauaugaaccaagccucaaggagcucaa

SEQ ID NO: 4116807 - RNA, 61 nt, Human
uugagucugcaauacauaacacaccuguaucagucuguauuuguagauguugcagccucaa

SEQ ID NO: 4116808 - RNA, 82 nt, Human
uugagugauaaagcugaagauuuuugcuagccccguagagaaauggggagaaauuuggcaaggcaucuuugacguggcucag

SEQ ID NO: 4116809 - RNA, 64 nt, Human
uugagugguaguuucuagagguguuauuuccaauauguuaaaguuuuagaauacuacuauuuga

SEQ ID NO: 4116810 - RNA, 68 nt, Human
uugaguguaauuaugaaauggaguuagcuauacccaacugcacaaaacacauugcuaauuacauucaa

SEQ ID NO: 4116811 - RNA, 57 nt, Human
uugaguuccaggaugguuguuaguggaaggcuucccaacccccuucugagaacccaa

SEQ ID NO: 4116812 - RNA, 62 nt, Human
uugaguuucuuaaaagaggaguuagaaguugaagauauuucuaaugccuuaaagaaauugag

SEQ ID NO: 4116813 - RNA, 62 nt, Human
uugaguuuugcaaccuccuucuuugauagauugucucaaaggaccagguucccaaaagucaa

SEQ ID NO: 4116814 - RNA, 106 nt, Human
uugaguuuugcaacuguguuuaacaugcauauaauggccagaacaaauguguuacauuguuauuuugucuguaauuauaaggcauaaaauauaggcaaauauucaa

SEQ ID NO: 4116815 - RNA, 63 nt, Human
uugaguuuugcauagagaagugacauaaaacgugaucacuuauaaaaugcaagaucugcuuaa

SEQ ID NO: 4116816 - RNA, 62 nt, Human
uugauaaagaaucuggaugaaaguauugguagcugaugaauuuaucaaagauucuuaauuga

SEQ ID NO: 4116817 - RNA, 74 nt, Human
uugauagaauuaacuuauacccagggcagaaauaauauuugcaugauuccuguggcuggguaaaguacuauuag

SEQ ID NO: 4116818 - RNA, 76 nt, Human
uugauaugcugcugcgcuugucuacuguuugucugauauugacaauuauaaacagggcagugcaaccaguauuuga

SEQ ID NO: 4116819 - RNA, 102 nt, Human
uugaucucccugauaucugaaucauuaaauaguuuucuagugguuaagauuuacaauuauuguaaugggcuacuaggaagaguuucagauucucaagaucaa

SEQ ID NO: 4116820 - RNA, 95 nt, Human
uugaucuuccgcuggcauguacugaagggccuuucuagguucugauuugaaugugugaaaucacaggcuauuuagagugccauguuuuagaucaa

SEQ ID NO: 4116821 - RNA, 68 nt, Human
uugaugaagacacauacaagggaaugaacauggggccagcugugacauuuucugugugccuuaaugag

SEQ ID NO: 4116822 - RNA, 89 nt, Human
uugaugaauaacugugacaauuguuguugcauuuuuaaacauacacaaaaagugaggccagcaacauugagacugcaguuggauaucaa

SEQ ID NO: 4116823 - RNA, 59 nt, Human
uugaugacacauuuuagaagauugcuuagcaauagauucuucuaguuuggaguuauuaa

SEQ ID NO: 4116824 - RNA, 67 nt, Human
uugaugaucaggugucaaugccugguucucugccuaauucccaguaacuugcagacaccugucucaa

SEQ ID NO: 4116825 - RNA, 58 nt, Human
uugaugcuguuauuguccaagauguucucucuuagaauagcugguaaugauagcacaa

SEQ ID NO: 4116826 - RNA, 71 nt, Human
uugaugcuguuguaagaauuaauuaauguuuugaaaguguuuugaacaugaaaagucuuacacgcauacaa

SEQ ID NO: 4116827 - RNA, 58 nt, Human
uugauggcacuggaacucaaauccaggucuuccugguuccagagucuguguucaucag

SEQ ID NO: 4116828 - RNA, 92 nt, Human
uugauguauaaguuuauggcauuguuggugaugauauuugaugguuuuacaaguguguccuuaucuccaaacaaucaaguuuuauauauuaa

SEQ ID NO: 4116829 - RNA, 115 nt, Human
uugauguauauaaugacuuggaaguaaaaauauuguuugccgugggauauuguugucuuuuucuuaugguuaauuccuggcauaauggcuuugcuccuuuauuauaaaacauuaa

SEQ ID NO: 4116830 - RNA, 89 nt, Human
uugauuauaucagcugagcuagggauaucuccugagaaugucuccucccuauucucaggaaaaaucccuagcuugguugaugucaucag

SEQ ID NO: 4116831 - RNA, 74 nt, Human
uugauucagaaguuucacaauggguuuuauggucacaugcuugauuuugucuuucccaugaaacuucuuuucaa

SEQ ID NO: 4116832 - RNA, 61 nt, Human
uugauugcuaagugguauuuggguuuguaaucaaacaucacaauuucauuuaugcagucag

SEQ ID NO: 4116833 - RNA, 88 nt, Human
uugauugguagcgugaagcugcaauaauuguuuugaaauggauucaaauacaauuaaugcaguuuauacccauggaacuaccaaacaa

SEQ ID NO: 4116834 - RNA, 83 nt, Human
uugauuguuuccgcuccccgcguggaugacguccuccgcccuuggauguggagucaggauccuggggauggaugccaacucaa

SEQ ID NO: 4116835 - RNA, 56 nt, Human
uugauuuauugagugcuuaguaugugccagacacuuugccaagcucuuuagaucga

SEQ ID NO: 4116836 - RNA, 63 nt, Human
uugauuucuaaggauguaccuaccauuccacacaauaaauagguacauauacuuggaggucag

SEQ ID NO: 4116837 - RNA, 81 nt, Human
uugauuucugacccuaaaucuaguaccuuuuugauuauacuccauguaaaagaagggaaaucuaggaaagagagaaaucaa

SEQ ID NO: 4116838 - RNA, 57 nt, Human
uugauuuguaggaauggagaccuugcaugcaggucuuuuacaguccuaccaaaacaa

SEQ ID NO: 4116839 - RNA, 74 nt, Human
uuuauuggcuggcugucuucugggagcugugcuuagcucuucauggcuucucaugagaaagccuugccaagaaa

SEQ ID NO: 4116840 - RNA, 63 nt, Human
uuuauuguguacuacaguaugccacacuguuaaauauugggcauguagaagugacaugaugaa

SEQ ID NO: 4116841 - RNA, 64 nt, Human
uuuauuuauugcuuuggaaaacacucauuggccaggaaaaugggcguguccaguaaugauuaag

SEQ ID NO: 4116842 - RNA, 83 nt, Human
uuuauuugauagauauaucugucauacugguauuaguauauuuuacuaagaaaucaaguuggagguagaucuuaacaaauaaa

SEQ ID NO: 4116843 - RNA, 69 nt, Human
uuuauuugcuaccuuugauaaauauuucugagugcuaaguguacuaagaguuagggcuagcaauaugga

SEQ ID NO: 4116844 - RNA, 92 nt, Human
uuuauuuuuguaaacaaaaagcaguuuauagucaguugaacaacuggaaaucaguugauaaguaacuagauauagauuguuuuaaaaauaaa

SEQ ID NO: 4116845 - RNA, 77 nt, Human
uuucaaaggaaauuuuggaaucuugggaagcucagugagguggcaaauuccucagaaucagaaaaccaacuuuggaa

SEQ ID NO: 4116846 - RNA, 59 nt, Human
uuucaaaguggagagccugugguugcucccugaguccagguuuuaucuuccacgagaga

SEQ ID NO: 4116847 - RNA, 55 nt, Human
uuucaaauauccaggagccccuuaguguaagggcaagcucuaaaagauuuugaag

SEQ ID NO: 4116848 - RNA, 57 nt, Human
uuucaaccuaucccaaaaagugauuguccauuucagggcagggcaagggauaugaaa

SEQ ID NO: 4116849 - RNA, 70 nt, Human
uuucaacucuaauuugcaaugugaaauuaaagaauuaagauuugggauuuuacauuguaugguguuggaa

SEQ ID NO: 4116850 - RNA, 70 nt, Human
uuucaacuugcuuuccaaaugacucacuucaguuucagcugagagaggcagaaggaaggcaaaguuggga

SEQ ID NO: 4116851 - RNA, 66 nt, Human
uuucaagcauaacugggaagagagcaugaaaacuccacuuuccacucuugugcuccgugucugaag

SEQ ID NO: 4116852 - RNA, 59 nt, Human
uuucaaguuauaaaagucggcaguuugaaagcauucauccugcaucugugacuugcaaa

SEQ ID NO: 4116853 - RNA, 75 nt, Human
uuucaaucacuuugaaacuaaaauucauuaagcauaaccagauugcuuuuguggguuguuucaaggacauugaga

SEQ ID NO: 4116854 - RNA, 66 nt, Human
uuucacacccacuaggacuguucuaaucaaaaagagagauaauaagguguuagugaggaugugaaa

SEQ ID NO: 4116855 - RNA, 108 nt, Human
uuucacagcugggccacccagaagcucucucuggcucucuugacaguggagcuguugaaaggaauacagaggccuaggagagaguccuuggucuauugaagcuagaaa

SEQ ID NO: 4116856 - RNA, 62 nt, Human
uuucacaugugcuguugucaauaucuggauguugaaacagaugcaugcauggcacagugaaa

SEQ ID NO: 4116857 - RNA, 73 nt, Human
uuucacccaugggaugcugcuuguuugcugauaccacuaagcaaaugaacaguugcauucucugagagggaaa

SEQ ID NO: 4116858 - RNA, 76 nt, Human
uuucaccuggggguagccaaauaaaucuauuuuaagucacuuuaaauaacuuguaugguuauuccacagcaugaaa

SEQ ID NO: 4116859 - RNA, 59 nt, Human
uuucagaaagcugaacauaugacucauuucugugugcgugugugugcgucuuugugaag

SEQ ID NO: 4116860 - RNA, 68 nt, Human
uuucagaaauggcacugaaaucuguuuuccgguuuuacucguugugcaauacagugcuguuuuagaaa

SEQ ID NO: 4116861 - RNA, 57 nt, Human
uuucagaggugucauuauuuuucauauaagcagaugaaagagaagaagucuuugaaa

SEQ ID NO: 4116862 - RNA, 97 nt, Human
uuucagcuaggaccaagaugggccuugacacauggaguguaaaaaaaaccucaauguccauacuuccaaggguguuagguccuaguucuaaaugaga

SEQ ID NO: 4116863 - RNA, 60 nt, Human
uuucagcuaguagcaauguauggauuccauuuggauccugauccauacaaacuguugaaa

SEQ ID NO: 4116864 - RNA, 69 nt, Human
uuucaggaaagaugguaucucuucaauagaguugcuaagcuagugagcagucauccauuucuccuuaaa

SEQ ID NO: 4116865 - RNA, 55 nt, Human
uuucaggagauuguacugucaucacuuaauaguggagaaaaauaguuuucugaga

SEQ ID NO: 4116866 - RNA, 83 nt, Human
uuucaggcagaggaaacaugaguuguaucaggcauagaaaccuggaacaaaauauuuauguuugcucagaccucagucugaag

SEQ ID NO: 4116867 - RNA, 111 nt, Human
uuucaggccucuccuucuucaugugauaggucuagauaccaccuguguaccuggaaacuugcaauuauauuugugguuuuuggcuccuuuauaaggggacaggccuugaga

SEQ ID NO: 4116868 - RNA, 99 nt, Human
uuucagguuagaaggaauaaguacagagaagggcucugauguuuugccagucaaaucauugcuccuuucucugguaaacugaauugcuguggccugagg

SEQ ID NO: 4116869 - RNA, 64 nt, Human
uuucaguagcuugccaaaugucacacuauuacccagcuaguaaguggcucugccaggacugaaa

SEQ ID NO: 4116870 - RNA, 68 nt, Human
uuucaguauccacaaaugcucaaaacauuuucuauacuuugauguuugggaacaaugaggaucugaaa

SEQ ID NO: 4116871 - RNA, 60 nt, Human
uuucagugcccagagcuuugcaggucccaccgcuucccucaagcauccccuguacugaga

SEQ ID NO: 4116872 - RNA, 63 nt, Human
uuucaguggaugugaauuggcgcaaaaggaacacuucuuuuccuucuauacauaucacugaaa

SEQ ID NO: 4116873 - RNA, 75 nt, Human
uuucaguugauugcuuggguuacucuuuauacucugcugcaacacagaaucugagaacugaagcagggacugaaa

SEQ ID NO: 4116874 - RNA, 56 nt, Human
uuucaguuuaaguaacugcuauuacuuaagugauugcacuuuugcucaaauugaag

SEQ ID NO: 4116875 - RNA, 59 nt, Human
uuucauaaucugucaaguggggauaauuaugguaaccaccacugagcauuguuaugaag

SEQ ID NO: 4116876 - RNA, 99 nt, Human
uuucauaauugucuguaugaggagacuacuuaauauuucaugacagauauauuucuuguuguugaaugaguguuuuacucauguaaucaugauauggaa

SEQ ID NO: 4116877 - RNA, 56 nt, Human
uuucauacuguguuuccaaguuucuccuuuggggauacaaugaaguauagaugaaa

SEQ ID NO: 4116878 - RNA, 76 nt, Human
uuucaucagugccaggcuagcccagaccacaggaaguuuaugaaagccuuugugauggcuggcaggcugggugaga

SEQ ID NO: 4116879 - RNA, 77 nt, Human
uuucaucuacuggaauauuuacuuuggauaaaaugcaaguucuuuguagcagucugggggaauuacaauagaugaaa

SEQ ID NO: 4116880 - RNA, 73 nt, Human
uuucaucucuuuuucucugaguacguuucaguguuuaauugaccaggaauguauuucgaggugugauaugaga

SEQ ID NO: 4116881 - RNA, 55 nt, Human
uuucaucugaguagcgucggaugaucauguuauagagaugcucauucagguggaa

SEQ ID NO: 4116882 - RNA, 65 nt, Human
uuucugggaaguagaaucagaugaguauagcuucuaauacauuuaucugaaaaaacucuuggaga

SEQ ID NO: 4116883 - RNA, 59 nt, Human
uuucugggacuggggagauucuguuauucuguucuucagcuccucuaaaagcccaggaa

SEQ ID NO: 4116884 - RNA, 62 nt, Human
uuucugguuguucuguaagccugccauucaucccaaccaggacugcaaccuuagacuagaaa

SEQ ID NO: 4116885 - RNA, 72 nt, Human
uuucugugaauggccaugacaagguacuauguuuuuugacucuuuuguuuaaauguggcauauauacagaag

SEQ ID NO: 4116886 - RNA, 64 nt, Human
uuucuguguuaaguauuugauacacucuuuugguaguguagucacauacuuaauuugcaugaag

SEQ ID NO: 4116887 - RNA, 72 nt, Human
uuucuuaauaaaguaagcaaguaugaugaugaguaaucauuuauccauuagcuaucuguuuacauuaggaaa

SEQ ID NO: 4116888 - RNA, 66 nt, Human
uuucuuacacuuuccgaaagcuuguuuacagacuucagacuaacagggacaaggaaagguaagaga

SEQ ID NO: 4116889 - RNA, 106 nt, Human
uuucuuaccucccuuuuauucugucaaacuuauacaugugacauuccauuuccucagggucuugauguuuacugguuuauagaauaagcagguucacaccaagaag

SEQ ID NO: 4116890 - RNA, 112 nt, Human
uuucuuauucauguuacuuguugguuggaggccagcuaugacucugcuccauggucucgucucuuuggaaggagcagguggcaucugggcacggguauucaugugucagaag

SEQ ID NO: 4116891 - RNA, 73 nt, Human
uuucuuccauaagcagaucuuuaacagggucacuuagguaauugggcugcuuaaacagaugugcuggaagaaa

SEQ ID NO: 4116892 - RNA, 89 nt, Human
uuucuucccaaguguuuacagcuuuuuacuaauagauugaauccuaucccuagcugccaguuuucugugaagagcugaaaaggaggagg

SEQ ID NO: 4116893 - RNA, 71 nt, Human
uuucuuccucagguugcauguggagaaaaucgggaugaauuuccccuauuucacugcaaugcuaggagaaa

SEQ ID NO: 4116894 - RNA, 65 nt, Human
uuucuuccuuaccuuacuagaguagaaaagaggagcgcauacaaaagguggggaaaaggaagaag

SEQ ID NO: 4116895 - RNA, 77 nt, Human
uuucuuccuucugugucuucuuguucugugacuuaaaaaaaugaaagcgagagagagagagagauaggaagaaggaa

SEQ ID NO: 4116896 - RNA, 71 nt, Human
uuucuucuaaguuggcccugcugggcgccaugcaaaagacacacaagcccuagggcaggcauuggaagaga

SEQ ID NO: 4116897 - RNA, 56 nt, Human
uuucuucucacccaggacagagucacagagaccuugaagaauggaggagguagaaa

SEQ ID NO: 4116898 - RNA, 55 nt, Human
uuucuucugccucccaccugauaaauaaucuuguguagugccugggcagaaggaa

SEQ ID NO: 4116899 - RNA, 67 nt, Human
uuucuucuugugcacucucuauguacuaggcuguacuugaggugcuagggauguagcagugaagaaa

SEQ ID NO: 4116900 - RNA, 104 nt, Human
uuauuugggugugcucaauagauuuaguugaaguggaaaagaaauuauucaaauuucagaccauuugcaauuaucaauuuaucugcuguuuuccagccaaguaa

SEQ ID NO: 4116901 - RNA, 60 nt, Human
uuauuuggucuguaauuacauggacuuuauuuggaggucagugaaggaacaacuaaauag

SEQ ID NO: 4116902 - RNA, 57 nt, Human
uuauuugguugcugacuuggaagaguacagaauuuuaaguuuuaagcaaucugauaa

SEQ ID NO: 4116903 - RNA, 107 nt, Human
uuauuuguaaaaugggagugauaccugcuuuaacugccucagaggcucagggucggggggaggcucagagaggcaguggaagucaggaauauuuauuuugcacauaa

SEQ ID NO: 4116904 - RNA, 87 nt, Human
uuauuugucuucccauuguuuauuuagacuuaauccccaggagugaaaugacugaaucagauaauguggucauuuaaagacauuuga

SEQ ID NO: 4116905 - RNA, 101 nt, Human
uuauuuuaaaacagcaaguaaagaauuuaaaaugaucaguaaucugguuuaaaggacucugaugcuaaaauaauuauuuugagauuuguuguguagaauga

SEQ ID NO: 4116906 - RNA, 76 nt, Human
uuauuuuauagaugaagaaacagaccaagaggaucauuuaaauaugaucaucuuaguuuuuucaguaaagaaguaa

SEQ ID NO: 4116907 - RNA, 83 nt, Human
uuauuuuguccaguguuccauggagugauuacccacauuaugcuaauugauauaauugcuccaaggagaacuaaucgaaguag

SEQ ID NO: 4116908 - RNA, 79 nt, Human
uuauuuuugacagcauaauccuacacccaugggagcugagcuuuacagguguuaaagaggauuuguuguaagaaaauga

SEQ ID NO: 4116909 - RNA, 129 nt, Human
uuauuuuuuauacauguguauuucuugcauuuagugaacaaagaauaucuguuuuauuuagguuggugccuuaauuagaaugauguuccucuaacuggaaaguaaaaguacaauuuaaacagaaaauaa

SEQ ID NO: 4116910 - RNA, 89 nt, Human
uuauuuuuucucuuugggccaagaacagcauuuccuagaccuaaaagcagcuccaguaaaugauuauuuugccaacggaugaaggguaa

SEQ ID NO: 4116911 - RNA, 63 nt, Human
uucaaaaacuccuacauaauugcucaauuaugauauuaaggcagcuuucuguaggggugugaa

SEQ ID NO: 4116912 - RNA, 87 nt, Human
uucaaaagaauucugggcucugcaguugauguuuucaauuauucuugcaaaaaacauaugcugcuggcugcccuucgauuuguggaa

SEQ ID NO: 4116913 - RNA, 59 nt, Human
uucaaacaguugcacaacuuaugucacuucucaacauagcagaaagugcaauguuugag

SEQ ID NO: 4116914 - RNA, 89 nt, Human
uucaaagcugaguaacuucagauuacacacucaaguccuguuauuuguuaacagcauuugaaugaguaacuugcucccauugcuuugaa

SEQ ID NO: 4116915 - RNA, 91 nt, Human
uucaaaggcaaaguaucuugucacuacuguuaugcauuucucaaccaauguucaugauugguuuuggcgaaugaagauacuugucacugga

SEQ ID NO: 4116916 - RNA, 93 nt, Human
uucaaaguguaaugaauggagugcacagaauuaagggagaaauaucagauuugggacugaguuuuugccucgaauucugcguauaacuuugag

SEQ ID NO: 4116917 - RNA, 71 nt, Human
uucaaauacauauaauuuuugguuagcucaauaguauuuauauuauugauacccaaguguuauggguugaa

SEQ ID NO: 4116918 - RNA, 77 nt, Human
uucaaauauaaccaugauuaaucuaagaaggcuuaaaggccuucuaauagaagaugauuauuuaugguuuauaugaa

SEQ ID NO: 4116919 - RNA, 118 nt, Human
uucaaauauguuucugcuacaaacauuguccuuuagaugguuccuuugcugccauuaugacuauggcguaaucuguaguaaagcaccauuaagauguuaauacagauguaugugugaa

SEQ ID NO: 4116920 - RNA, 60 nt, Human
uucaaaucagaccgaaggcaaccucagaaacaagaagagccuuuaaaauucugguuugaa

SEQ ID NO: 4116921 - RNA, 76 nt, Human
uucaacuucccacagaauucaaucagugucagagcauggcugaacacagacgcuuauugaauggcuguuggaugaa

SEQ ID NO: 4116922 - RNA, 57 nt, Human
uucaagaaucgagguggcuguuccuuacccaacagggcagagccugagguucuugag

SEQ ID NO: 4116923 - RNA, 123 nt, Human
uucaagcaacagccuguguguuccccaggaguuaugcugaggggcaagguuuuaugcagcucuguguucacagcacuaacagcaccagguaaacaacaggcacucaauaaauguugacaugaa

SEQ ID NO: 4116924 - RNA, 56 nt, Human
uucaagcagggauuggugauggcaacuguucccauuaccaaaguucagguuuugaa

SEQ ID NO: 4116925 - RNA, 69 nt, Human
uucaagcugcuggauuuacugaguuuuaucauauugaacgugagaaaauccagaggcuaguuucuugag

SEQ ID NO: 4116926 - RNA, 72 nt, Human
uucaaggggacccaggacuuugggaccccccugugcucccaccuggagggaguuucauuccugccccuagaa

SEQ ID NO: 4116927 - RNA, 55 nt, Human
uucaaguagaaaguauugaugaucagugacaucaacuggacaguuucugcuugaa

SEQ ID NO: 4116928 - RNA, 90 nt, Human
uucaagucaaauuccauucucugugucugaguuauggucuuuuacuaagauaauguuaauaucauaagcgauacaaaaugguuacuugaa

SEQ ID NO: 4116929 - RNA, 82 nt, Human
uucaaguccuaguagaaucccuugcaaugucccuccucccuggaaggcaagaggagauucugcucccagaacaggccuugga

SEQ ID NO: 4116930 - RNA, 59 nt, Human
uucaagucuggagaucuggaacuucuuccugaagcuccauguuuagccagauaauugag

SEQ ID NO: 4116931 - RNA, 61 nt, Human
uucaaguucuguggagagcuguaaccaugugaccuuccauggcagagccucagagcuagaa

SEQ ID NO: 4116932 - RNA, 67 nt, Human
uucaauaauuuaagaggcugacagcuguaucauagcagcucuaucauagcauuuuuguauugcugaa

SEQ ID NO: 4116933 - RNA, 67 nt, Human
uucaauccgcuccucuaagcgcgguccugagcuuuggucccagacgcgcagaaggaagcggccugaa

SEQ ID NO: 4116934 - RNA, 70 nt, Human
uucaauccuuuaucuuguaguugauuuaucuuuaaucuaaugagaaaacaacaacggagaaaggguuggg

SEQ ID NO: 4116935 - RNA, 104 nt, Human
uucaaucuucucagcauuuugucagucucucaugaaugaacucaaacuaauguaauuuuaaaagacugauauaacugcugcaggagcaaaugcuaucuauugag

SEQ ID NO: 4116936 - RNA, 116 nt, Human
uucaaugaugaauuaauaggcuggcccucaauucccauaucucuuguaacuggucucugcugucaaauuagaaggcugagcuuacaggugaggcagcaagaauuugagugauugga

SEQ ID NO: 4116937 - RNA, 111 nt, Human
uucaauggcagaugacuugauucuuggugguaaagcaagugguugguuauaaguauggggucucauugugccuagguuaacauuucuuuuccacucauaugugccauugag

SEQ ID NO: 4116938 - RNA, 85 nt, Human
uucaaugguacuugaugauagaaugugaggagugauuacacaguguuauggacuucuugcaucuguccauuacaguggaauugaa

SEQ ID NO: 4116939 - RNA, 74 nt, Human
uucaauuuagcauauuugauaaccaauauuccuuguucauuugggagcaaauuuaucaagauguuaugguugaa

SEQ ID NO: 4116940 - RNA, 84 nt, Human
uucaauuuauuagcaaguccugucaccucuacuuucgaaaucagauuauauuuugagucuaacaggacuugcugguaaguugga

SEQ ID NO: 4116941 - RNA, 59 nt, Human
uucaauuucauaauaucuagcucagccagauaugugguguagcaagaguauggauugaa

SEQ ID NO: 4116942 - RNA, 59 nt, Human
uucacaagucuggaauaugcuaccucuagaacccaaaguggccuaccagacauugugag

SEQ ID NO: 4116943 - RNA, 127 nt, Human
uucacaaugaacuuugauucaggauaguguuuuauuugucacauugaauaugauuuauucuaaaccuuuuaauggagaaaucuugcucauugugacaaucauagccuucuuaugucuuuuccaugga

SEQ ID NO: 4116944 - RNA, 73 nt, Human
uucacacugaaugggacuuuaugguguuuugagauaaaacaagaaaggccagauucacuuuacaaugugugag

SEQ ID NO: 4116945 - RNA, 55 nt, Human
uucacaguauagguuuccagcgcagacccugccuuacgugccuccuacuugugaa

SEQ ID NO: 4116946 - RNA, 119 nt, Human
uucacagucuguuuaaagauaagucagguuaucuagauguguuaucagacauuugcaagucguuggguaaaccauuaagauauuuuggaauuucaucuuucucauauaaaacacuugaa

SEQ ID NO: 4116947 - RNA, 69 nt, Human
uucacaugcaaguccucaguucuauuauuuuaauguaaaacucuagagcuuggacugcauuuucgugag

SEQ ID NO: 4116948 - RNA, 66 nt, Human
uucacaugugacccugcaggcagcuaaccaaggcuaaggaaugugcucugggcagggcacauggaa

SEQ ID NO: 4116949 - RNA, 57 nt, Human
uucacauuaagccuccuccuacauggacaaccccuaugaaggggcagcuugugugga

SEQ ID NO: 4116950 - RNA, 71 nt, Human
uucacauucccaauggcuccauuuucaucuccuuaaucagguguuaaaauucauggcuugggaaaaguggg

SEQ ID NO: 4116951 - RNA, 74 nt, Human
uucaccaacauuuuccaaaguaccaugucccugauaccaaaaauaguggaguugguguuuggagucucugggaa

SEQ ID NO: 4116952 - RNA, 76 nt, Human
uucaccaagauaagaacggagcagcuucgugggccaagagggcuggccaggugcuuugguucugcaucugugugga

SEQ ID NO: 4116953 - RNA, 77 nt, Human
uucaccaggacuuuggagagacaggaguguucuccaaaucugcccucacuucauguacuguucaaggcccuggugga

SEQ ID NO: 4116954 - RNA, 79 nt, Human
uuucugcguuaaggcugauaagucagauauaaagguugaccaaauuguuaacacaugcucuacuuacggcuuucagaaa

SEQ ID NO: 4116955 - RNA, 79 nt, Human
uuucuucuuuugcaagggauaccauacuaagaaaugccucauuacauuuuguguuguucccauugcagccagucagaaa

SEQ ID NO: 4116956 - RNA, 100 nt, Human
uuucuugacauuauguguggugaagaaguacaagacaaauuuucuagauaugaaaugucuuugaguauuucugcaaagggcuuguuaccauggugagaaa

SEQ ID NO: 4116957 - RNA, 71 nt, Human
uuucuuggucucacuagccacauuuccaauguucaauggccacauguggcuaguggacacaguauuagaaa

SEQ ID NO: 4116958 - RNA, 77 nt, Human
uuucuuguucgcugaauguaauagucaguagaacaguaaucuggaagcacuacuuuaaugcauguguauauaagaag

SEQ ID NO: 4116959 - RNA, 112 nt, Human
uuucuuguuucccucucccgauucaggaaaugcguaguugaacuucucagguuugcuugaacuucucagguuugcuuugcacaguccuaaaucaaagauguggaccaggaaa

SEQ ID NO: 4116960 - RNA, 85 nt, Human
uuucuuuaccgcucaaggccgccccuucaugcuccugcgggggaguuagcgggaccucuggagucggccuuacgcaaagaagaga

SEQ ID NO: 4116961 - RNA, 60 nt, Human
uuucuuucaaugcuuguaagggaauucuuacaagcuuucccuuacaagcauugaaagaaa

SEQ ID NO: 4116962 - RNA, 86 nt, Human
uuucuuucugaagggugcuucugggcauagcaggauagcugcaagcaauuucuccuauacaaucaggguugaccuucagaaagaag

SEQ ID NO: 4116963 - RNA, 66 nt, Human
uuucuuuuacaguguggcuauucuucuucaauaggcugauggugcagcuacucucugugagaggaa

SEQ ID NO: 4116964 - RNA, 130 nt, Human
uuucuuuuucuguauuucuauuagagugaaggucuuuaugguaugaaaacugaauauucuccucuaacaauguuuguuaucaaugaaucaaaacucuuucaaauccugauguuuccuaagaaaaaagaaa

SEQ ID NO: 4116965 - RNA, 106 nt, Human
uuugaaacauuucaagcauuugaacguuuuaugugauuccaguggcauuuucugugaaaguugucaugccauuuaaaauguuuucaaauaugaaucauguuacaaa

SEQ ID NO: 4116966 - RNA, 70 nt, Human
uuugaaaggugucgagaugugugguaggggggauuauuuuuaaugaaacuaagcuugcauauuuuucagg

SEQ ID NO: 4116967 - RNA, 72 nt, Human
uuugaaaguccuaggagagucccacccuuaaucucuuugaggccucuaugaguuuccauagcacuuuacaaa

SEQ ID NO: 4116968 - RNA, 61 nt, Human
uuugaaagucucaaagcacaggaugcuccagggaaguguuucuggcuuuaggcuuuucaag

SEQ ID NO: 4116969 - RNA, 75 nt, Human
uuugaacuuuguucugcaugcaucuguuucaccuaucauuaguaggaccaaguggagugcaggucaauguuuaga

SEQ ID NO: 4116970 - RNA, 55 nt, Human
uuugaagugggcauuagaaccuuuucccccuuugguguuuaaagcucauuuuaaa

SEQ ID NO: 4116971 - RNA, 77 nt, Human
uuugaauaauuucagugggcucugggcuauaagacugguccccaguugucuaguaccagucccuggaguaauuuagg

SEQ ID NO: 4116972 - RNA, 92 nt, Human
uuugaauauaugugcaguugagagauuuugaagccuggcaugaaaaguuaauuuuaugugcuucauaaucuucucauuauacauauuuuaaa

SEQ ID NO: 4116973 - RNA, 77 nt, Human
uuugaauccaaaauguuugaaugcaugugcuguauauugcaauaauaccacauauguaacugcaggcauuaugcaga

SEQ ID NO: 4116974 - RNA, 64 nt, Human
uuugaaucugaaacucugacauugucugugacuauuucgaaggcaaugugagaguuuauucaaa

SEQ ID NO: 4116975 - RNA, 127 nt, Human
uuugaauuacuauguugcaaaguugguaaucuuagugagaauacaagaaaacauaagguuauucacauucagguuuauuuuguuuuguauccacugugaugauuaaaauugggauuaaauauucaag

SEQ ID NO: 4116976 - RNA, 84 nt, Human
uuugaccuguuuccuuuuuuggcuuuugcuuuauauucauaguagaguguuaguagcucucaagauaagaaagaacagguuaag

SEQ ID NO: 4116977 - RNA, 86 nt, Human
uuugaccuucuuuauagccccaugaggcauuggcauguaaugucaccauuucagaguuggggaaaagcagauaugaaaaggucaag

SEQ ID NO: 4116978 - RNA, 57 nt, Human
uuugacuucugggcauuuugguuucuccccaauuuaggagaaugcccagaaugcaga

SEQ ID NO: 4116979 - RNA, 60 nt, Human
uuugacuuuucugugagcaaacgccaaucacucccagguguccuucauuaucaagucaaa

SEQ ID NO: 4116980 - RNA, 69 nt, Human
uuugagaaguccuguuccugaagaacauaguaaaccaugggcuggaucauggaacugggcaaucuugaa

SEQ ID NO: 4116981 - RNA, 97 nt, Human
uuugagaauaauuccuuucaaaacacgaauuuccaugccuuagcuuaagguuacaucuagguuauguacugaagugaaaaggagucuaucauucaga

SEQ ID NO: 4116982 - RNA, 94 nt, Human
uuugagaccaaauaguucuuauuugucaugauacugcugagaguguguggacucugggagguguuuugagaacuuggaauuuuguggccucaga

SEQ ID NO: 4116983 - RNA, 78 nt, Human
uuugagacuugggcccuuuccucagggagcuuaugccuuacuuagcuccaggauaagacaggugcacaaguaagcaga

SEQ ID NO: 4116984 - RNA, 55 nt, Human
uuugagauagucuagaguaacuguuauaaacacagacuuuggggucuuucucaga

SEQ ID NO: 4116985 - RNA, 64 nt, Human
uuugagcaguauuuuccauuucuguagcagcaagcuagugcuuugaaagauaauacuguccaga

SEQ ID NO: 4116986 - RNA, 97 nt, Human
uuugagccauggcaccaagaggaauggguguguuuaugaaaucaaauuuaguucauaagaauauuccauccuuugauugugcugaacauggguugga

SEQ ID NO: 4116987 - RNA, 90 nt, Human
uuugagcuaucuugaauaauuuauaguagccuuuggcaaguuauccuuaacuacucacaagguucacuauaaauuggaaagaggcccagg

SEQ ID NO: 4116988 - RNA, 75 nt, Human
uuugaguaaggcugaauucaaggguaggcucucaggcaaaacuggccuauuuauggaucaccuuucugauucaaa

SEQ ID NO: 4116989 - RNA, 104 nt, Human
uuugaguuuucuuuuauuuggauacaaucauuugcuuagacacauauuuuuaaacuuuuaauguauugguagcaaugauguuuucaaguagggaaacacuuaaa

SEQ ID NO: 4116990 - RNA, 97 nt, Human
uuugauaaccaaaccauauuuuugcuaaaaggugaaaaguguaugcauauauacauauauguuacuuuuuaguaaaaaauaugguuugguuaucaaa

SEQ ID NO: 4116991 - RNA, 89 nt, Human
uuugauaauuucuucccucauuagagauaaucagugucuagaaacuagauugauagauguuucuaaaauuuuggcuagaauuguacaga

SEQ ID NO: 4116992 - RNA, 81 nt, Human
uuugaucucacuggcaagacuacaggugauguucuguuuuuucaaucaggaggcacauguuugucugucugugauguuaga

SEQ ID NO: 4116993 - RNA, 58 nt, Human
uuugaugaguuuaauaacagccacuauuuauuauucggcugaggaacuccaagucaaa

SEQ ID NO: 4116994 - RNA, 101 nt, Human
uuugaugcauaauuagaagaacaggcccauaaugcaaauauuugguugucauuagcauagagauaguguauuaguugggccagguuaauugcuucaucaaa

SEQ ID NO: 4116995 - RNA, 67 nt, Human
uuugauguucacuacuugaaagaauuacagauguaaaauauuuguauauuuaggugguggaguugga

SEQ ID NO: 4116996 - RNA, 81 nt, Human
uuugauugcgugccugcugcauguaggucagaacuccugcccuccaggaacucacaucacaugacaguaggccgcaucaga

SEQ ID NO: 4116997 - RNA, 75 nt, Human
uuugauugugaaggauggugucaagucugcaaagaaaaauguuucuaaaucaguaaggcauauucucacauuaaa

SEQ ID NO: 4116998 - RNA, 65 nt, Human
uuugcacagagcucgcauuuggcagcaguaacgauuacugcagcugaaccuagagucugugcgga

SEQ ID NO: 4116999 - RNA, 57 nt, Human
uuugcacuuuaauauaaugugaaugcaagcacagaaauauuguagguaaagugcagg

SEQ ID NO: 4117000 - RNA, 69 nt, Human
uuugcagacuuuugacauuaauacagcugaguuuaaggauccacuucagcugcugucagauauuucaaa

SEQ ID NO: 4117001 - RNA, 66 nt, Human
uuugcagcaggaacaguuuaucucuggcugaaaccaaagcagaugaaaaugcugccgugcuguaag

SEQ ID NO: 4117002 - RNA, 59 nt, Human
uuugcagccccuaggccagcaccugcucugguggugccugccccacaagggguugcaga

SEQ ID NO: 4117003 - RNA, 89 nt, Human
uuugcauagcuauaggcaucugcuuuugagaauuuacuuugaugacauaggagucaaugaugaaaagcaggcuugaagagagaugugga

SEQ ID NO: 4117004 - RNA, 63 nt, Human
uuugcauauaagccgugcuucugaacuacuuuccuuugugagcagcagcaaggcuuaaguaaa

SEQ ID NO: 4117005 - RNA, 57 nt, Human
uuugcauauuaauaucugcgcuuugcauaaucugacccgcgcuuuauugauugcaag

SEQ ID NO: 4117006 - RNA, 85 nt, Human
uuugcauccccccaaaauucuuaaguugaauccuaacccccagugugaugguauuuggagaugggaacuuugggaggugaucagg

SEQ ID NO: 4117007 - RNA, 130 nt, Human
uuugcaugaauugcaaugcuuccucuuccuuacaggccucuuacuaccuuaaaaaugcuagcaaggugccaggguaggcagauaggagugcagccuauaaagaugggaauguuugcuguucuuaugcaag

SEQ ID NO: 4117008 - RNA, 57 nt, Human
uuugcauuuauaaguugguggaauauacacauuuuugcuaacuuagaugauaguaaa

SEQ ID NO: 4117009 - RNA, 56 nt, Human
uuugccauuaugaaauguacuuggcuagugaggccuauacacuuguaaugagcaga

SEQ ID NO: 4117010 - RNA, 100 nt, Human
uuugccccuuauccuauacccuucucagucauacaccagccaucugcauucuccucaaggagaaggaaggcugagugcugauggagguagaguaggcaga

SEQ ID NO: 4117011 - RNA, 112 nt, Human
uuugccucucuucucuuuuuuguguaaacaacuucugcacuauggguucugggcacugcuuagaaguauauucuagaugcagcaguauuuacaccguuaggaucuugguaga

SEQ ID NO: 4117012 - RNA, 86 nt, Human
uuugccuucauucucccagaaguaaaacuugucuuauuuuggcaagcuuuaagauuaaguccuagcuuugguaggaaugaaacaaa

SEQ ID NO: 4117013 - RNA, 81 nt, Human
uuugcuaaggggguucuacagccacuugcuguaggccaaagucugagcgauguggguauguagaaguauugccagagcaag

SEQ ID NO: 4117014 - RNA, 78 nt, Human
uuugcuacuucuauuuaagcauuuggggcaaguuacucaauuccucuaugccucuuguuuccuuacauggaaaguaaa

SEQ ID NO: 4117015 - RNA, 60 nt, Human
uuugcucaaucaucagauagaugcuuagaaaacaucauacugucuggauguuuaagcaga

SEQ ID NO: 4117016 - RNA, 99 nt, Human
uuugcucggugaugguagaaaaaacacugggcugggagucagaaugucuagacucaaacaccaggucuuuugcuuacuucuuguaucaccuugaguaag

SEQ ID NO: 4117017 - RNA, 64 nt, Human
uuugcucugcuguugccaggugccagucuguuuucagugaggcuuuggacagcaguggggcaga

SEQ ID NO: 4117018 - RNA, 76 nt, Human
uuugcugagauagcuugucugauuucauguacauggagugacaacuugcaagacgugaaauugagacaacagcaaa

SEQ ID NO: 4117019 - RNA, 124 nt, Human
uuugcugcgugacuuuaaauaacugaugcuaccucucugagcuuaagguguuucaccuuagaaaugagaauugugauauccaguucagaggauauggugaggguuaauaaguuaacaugguaaa

SEQ ID NO: 4117020 - RNA, 122 nt, Human
uuugcugguuauuaaaaauauaugauugccucuaaaauagcagugacagccgcucugcugggcagagccaggugcugcuguuugaaggcuacugaaugauguggaaugaaugcccgggcaaa

SEQ ID NO: 4117021 - RNA, 73 nt, Human
uucagaaacagagugagugagugagugagagauuuacuauaaaaaacuggcuuacuugauuguggagucugag

SEQ ID NO: 4117022 - RNA, 66 nt, Human
uucagaaacaguauggaagccauuaggaagggugcccuugccacuuauuggcccaacucuccugaa

SEQ ID NO: 4117023 - RNA, 79 nt, Human
uucagaaagcugguagugcugcacugcaaaucaguaaggaccaauccaucugggcuugcacugcagcgagaccacugag

SEQ ID NO: 4117024 - RNA, 129 nt, Human
uucagaaucucagcuuggcugugccuucuugcuugucucaugcucugaacccaucuugugaccuuuuaugguucauauuacuuugagugcaggcuagaguuggcucuuagcuagcugucaaauugggag

SEQ ID NO: 4117025 - RNA, 75 nt, Human
uuuguuacuaagccuuuaaauagcucaucugacuucuccucugucaaucaucuauucaggaggcuugguaccaag

SEQ ID NO: 4117026 - RNA, 84 nt, Human
uuuguuauucucccagucucugauggagugagucauugguuuacuacuuaagaaaaucaacuguuuccacagggagaaaacaaa

SEQ ID NO: 4117027 - RNA, 78 nt, Human
uuuguucacccucuuacaagagucacagauuucugcuugugugcuacagauacugaugcugucaaggaggugaacaga

SEQ ID NO: 4117028 - RNA, 57 nt, Human
uuuguucuuuuucccagaauguuuggaaaaagacauuuggcaagaaagagaaacaaa

SEQ ID NO: 4117029 - RNA, 71 nt, Human
uuuguugacuguauaaaaucuggaaguggagcccuggucaguugccaguauuuuauauaaucuguagcaag

SEQ ID NO: 4117030 - RNA, 87 nt, Human
uuuguuggagauaguuuguucuuaugcccuauaucaauaauaauaauaaaaaaccuuugaggcucaagaauagacaguauugacaga

SEQ ID NO: 4117031 - RNA, 56 nt, Human
uuuguuuaucgcuugcucacauaggucuguguccugaagcuuggcagaugagcgaa

SEQ ID NO: 4117032 - RNA, 124 nt, Human
uuuguuuauuaacugauguuucugggcuaguauucuguaaagucuguguaaagucuauaaggguguauguggccacugaagucuuugcuugauuagcuuagugaucaucuaaugauuagacaga

SEQ ID NO: 4117033 - RNA, 66 nt, Human
uuuguuuauuuacuuugggccuugcucaaaacuaguagcaagcugccuggaaugcaaugugacgaa

SEQ ID NO: 4117034 - RNA, 75 nt, Human
uuuguuuauuugugaucuccucccucuagaaugcugagaguguuuugaaggagaagauucauaggaagaaacaaa

SEQ ID NO: 4117035 - RNA, 62 nt, Human
uuuguuucaugacugauguuguugaaucuaugaugaaucaauaaauacaguuaugggucaaa

SEQ ID NO: 4117036 - RNA, 71 nt, Human
uuuguuucuuugaaguuucuagagguggaauaaaacagacacauuucuguggacuacauuaaagaaggaaa

SEQ ID NO: 4117037 - RNA, 127 nt, Human
uuuguuuuaccuagagauuuuuaaaaacucuaagacacuguacaauuuaaaaaguaggcaggcaaaguaggccaaagaaaugugcaguuucuuaaaguuguuaaauuauuuucuuuuacaagacaaa

SEQ ID NO: 4117038 - RNA, 60 nt, Human
uuuucaggagagaccagaaaugaagauuuuuauuucaaaucugaaaguuuuucuugggaa

SEQ ID NO: 4117039 - RNA, 75 nt, Human
uuuucagggaagagagaucuccuaguguuauccauacccagaaauuauugagggauaucuucaauucccugaaaa

SEQ ID NO: 4117040 - RNA, 62 nt, Human
uuuucaguaugcugaaugauuuuucugaucauggauaaucagaaaaacaguaaugcugaaga

SEQ ID NO: 4117041 - RNA, 59 nt, Human
uuuucagucugaugugguuuucacaguucuuauuuaccuuagauggcuuggacugaaaa

SEQ ID NO: 4117042 - RNA, 56 nt, Human
uuuucaguuugcacugcagugccaaccagacaggacgcugcucaguaaccugacag

SEQ ID NO: 4117043 - RNA, 83 nt, Human
uuuucaucagaauuucauaguagaccaccguucuauuguucaauuaccugguagaauuaccucucuauguccuuugguggaaa

SEQ ID NO: 4117044 - RNA, 84 nt, Human
uuuucaucuugucuguuauuucuuugccauaucuuuacgaaauguucaagauuggucaaugaaauagaaagauugucuugggaa

SEQ ID NO: 4117045 - RNA, 95 nt, Human
uuuucaugcugacccaguucaaggccacagagccucagagagguuccuuacccugugaggucaucugugguaacgcuggaugggccggaugaaga

SEQ ID NO: 4117046 - RNA, 67 nt, Human
uuuucauggacuuuuucauguuuucugacuuaaaaaaugagcuauuuaacauugaaagucuagaaga

SEQ ID NO: 4117047 - RNA, 76 nt, Human
uuuucauuaggaggaaggguagcauaauguagcuugagugagcuccagcccugcccauucucucguucuguggaga

SEQ ID NO: 4117048 - RNA, 75 nt, Human
uuuucauucuuauauuuacucauucaacaaguaugccucaugugccaaguggagaggaaaaagugagaaaggaaa

SEQ ID NO: 4117049 - RNA, 59 nt, Human
uuuucauugaauaucuucuuugugccaucugcuacacuuuugggauauaucagugaaga

SEQ ID NO: 4117050 - RNA, 77 nt, Human
uuuuccagccaaagagaaaguauuuggguuuugagcaucuuuuuaacugagaacauuccucuuccuggcuaugaaaa

SEQ ID NO: 4117051 - RNA, 106 nt, Human
uuuuccagugacccaugcuauggccauaguuaauccagguugugaauguccuucagaggugccaauguaugaggauuacaacuggaauggugcuggcacuggagag

SEQ ID NO: 4117052 - RNA, 84 nt, Human
uuuuccauggauugcuggagcuugagaggacagggggugccucauaccuucugcucucuuaggauuccagaauguuaaggaaga

SEQ ID NO: 4117053 - RNA, 71 nt, Human
uuuuccauuauaaucuaguuuaauauguuuaaaaguuuaauauguuuaaacguuuagauuuugggggaaaa

SEQ ID NO: 4117054 - RNA, 69 nt, Human
uuuuccauuuagcacugucuagccaagagacaccacuauuuacaaguucuuagacagcugaaaggaaaa

SEQ ID NO: 4117055 - RNA, 88 nt, Human
uuuucccuaggauuuucuuguauuccucucagaguucuuguuugcuuagaagccuucagagauggaaggcagaaugcuuagcggaaga

SEQ ID NO: 4117056 - RNA, 56 nt, Human
uuuuccugccuuuaaacucuuucuguagauaagaugauggaggaagggcaagagaa

SEQ ID NO: 4117057 - RNA, 129 nt, Human
uuuuccuuuugguccucuuuuccuucaguggcucugcuugccuaucugguggucguuuuggaaguuccaacccagcaccaauccagaguggagcuggugaugccgaaauggaaggaguguuugggaagg

SEQ ID NO: 4117058 - RNA, 56 nt, Human
uuuucuaauggcccaauggcguaggacaaugccaaguuguuuuuggccagggaaag

SEQ ID NO: 4117059 - RNA, 64 nt, Human
uuuucuagaaaguacuagagcuggucacuaaggcugacuacgcuuucuuuauuuuccuagaaga

SEQ ID NO: 4117060 - RNA, 76 nt, Human
uuuucuauuuaaacaauauucauugcuggccuccugagaaucacuggugagacuugagugcuggcuaaauagaaaa

SEQ ID NO: 4117061 - RNA, 97 nt, Human
uuuucuauuuucugaaaugauucuauuuuuuaagaaguagucagcuuuguucuuugcuaauuaagucuucaaagguagugucauucaaaguggagaa

SEQ ID NO: 4117062 - RNA, 87 nt, Human
uuuucucucuuucucuguuucuucuucuguuauauuacaagaaaaaagaauugccuguguagcucaagaggcugggaaguuaggaaa

SEQ ID NO: 4117063 - RNA, 96 nt, Human
uuuucugauguauugaauaugagggguggguuggggagguggacaggguauagaggacugaacccuaaggcacuucaauguuuagaaaucagaaag

SEQ ID NO: 4117064 - RNA, 97 nt, Human
uuuucugcucuguguacuuuuaugacauuuuguaagcauuaaugauaugcuacagcauuuuguagaguacuauaacagagaauuauauauuagagaa

SEQ ID NO: 4117065 - RNA, 65 nt, Human
uuuucuggaauugcugugugaguuccuuucauaggguaggaaaucaugccagcaauaccaaaaaa

SEQ ID NO: 4117066 - RNA, 58 nt, Human
uuuucuggagcuaaaguccacucugccaguaugcagagcagacuggaguaccagggaa

SEQ ID NO: 4117067 - RNA, 56 nt, Human
uuuucugggcagaagcauuuaggcucaauccuugcagaaaaacuuaguccagaaag

SEQ ID NO: 4117068 - RNA, 127 nt, Human
uuuucugugcaugcccccacacacauuuaugauaggagcuugagccuccuuauucuccauccuugcucuuucucucuuccuuuuccucccucaucucacaugugugugccaaggaugugccagaaag

SEQ ID NO: 4117069 - RNA, 71 nt, Human
uuuucuguuccuuugaauguuuuauuuuaauuaccagaugaauguuuuuguacaugaaaggaaacaggaaa

SEQ ID NO: 4117070 - RNA, 78 nt, Human
uuuucuguuuccucauuuaucugcugggacgcuaaggucacaguuagcuucccaacagauaaaugaggaaacagaaaa

SEQ ID NO: 4117071 - RNA, 82 nt, Human
uuuucuuaggcucauccccacaaagcaaagccuacuagauuuaacugcuaguagauuuuugggaaggugaucuuaaugagaa

SEQ ID NO: 4117072 - RNA, 60 nt, Human
uuuucuuaggugcuccaaguagaaggcuuuuuuaaaacugcuaaaaaguagcuaggagaa

SEQ ID NO: 4117073 - RNA, 60 nt, Human
uuuucuucugggucgccucuuaaguggcuccugaaggagugagcagugagccagggaaag

SEQ ID NO: 4117074 - RNA, 91 nt, Human
uuuucuugucucccaacaaugaaauugagauccagagaaauaauuuuuucaagucauucuauaauaucguggugggacuggaauaagaaaa

SEQ ID NO: 4117075 - RNA, 72 nt, Human
uuuucuuuauucagagcuuagaauggacuacugugcuuugcagugauagccccagggcucugagaaagagaa

SEQ ID NO: 4117076 - RNA, 96 nt, Human
uuuugaaagcugguuaguucaugaguuuucauauagcuguugucuucauuucugaugcuggagcaugaagacuucagagcuagcugucuagcagga

SEQ ID NO: 4117077 - RNA, 63 nt, Human
uuuugaagcccagucuacgaaggccacauaauuccuccuagacauuaagcuuggguuuuagga

SEQ ID NO: 4117078 - RNA, 69 nt, Human
uuuugacacuggaauuuuuaacugucagugcuauuguguuuacagcauucaaguucucagaguucaaag

SEQ ID NO: 4117079 - RNA, 70 nt, Human
uuuugacaucguaaugugauuugcauugauuugaggcugccaucaggaugagcucauaacuaugucaaaa

SEQ ID NO: 4117080 - RNA, 56 nt, Human
uuuugaccaaauuauacgggguuuuaccaccucuuguguguagcuauuggucaaaa

SEQ ID NO: 4117081 - RNA, 112 nt, Human
uuuugacugaauuuacaggugaauucaaucaaugugucaguucccacugaacuuucaaguugauugacuacauugauugaauaaguugaccuauuguguugucagcuuggag

SEQ ID NO: 4117082 - RNA, 75 nt, Human
uuuugacuuugacagacacaauugauccaugaaauuauaugucuuugaggguuuguuuguuuguuugagacagga

SEQ ID NO: 4117083 - RNA, 63 nt, Human
uuuugagaaauauugcacagugaggugacugcaguuaauaaagcuucacuguauauuccaaaa

SEQ ID NO: 4117084 - RNA, 57 nt, Human
uuuugagagccaaagacucaauuauguggcagaccuuauuaggaguggcuuucagaa

SEQ ID NO: 4117085 - RNA, 65 nt, Human
uuuugaggauuuuuccaauuguccuaaaagguuauaaucuuaccuuacagggaauuuccacagaa

SEQ ID NO: 4117086 - RNA, 59 nt, Human
uuuugaggcugguaaucgcuuuguuugacaauucaaacuguuagauuucagcucugaaa

SEQ ID NO: 4117087 - RNA, 74 nt, Human
uuuugaucauguuauuuauccauuaaacauccuggugacacuuguguagugggcugaauaauggguucccaaaa

SEQ ID NO: 4117088 - RNA, 102 nt, Human
uuuugauggccucuccaauaucuagaacuccagaauguaggcacuggauaaacuguggcucaugaaaugaaagaguucuaacauugaagagaguaaucgaag

SEQ ID NO: 4117089 - RNA, 66 nt, Human
uuuugauguuugcucauuuaaugucugaaauguacauuaguguaggauguaaggcaggcaucaaaa

SEQ ID NO: 4117090 - RNA, 71 nt, Human
uuuugcaggagaauguuaugguaagguaggugcacuuugcuggagucauacauaccauucucuaagcaaaa

SEQ ID NO: 4117091 - RNA, 129 nt, Human
uuuugcauauggaauagaugggaauuauaggggccaccagagggcagacugugauaagcagaauuuuggcugucaugaucuccacccucugaugcuacuccugugguuauaguauguuacauggcaaag

SEQ ID NO: 4117092 - RNA, 55 nt, Human
uuuugccacacagaguagcauguucuacccugggaaguguuuacugugugcagaa

SEQ ID NO: 4117093 - RNA, 63 nt, Human
uuuugcccacuggauaaugcaaacuggauaauuccaaguuguucaaguuccacguggcuagaa

SEQ ID NO: 4117094 - RNA, 66 nt, Human
uuuugcccagcucccugaagccuggucuugguuaacugggagcgugucguagggagugggguuagg

SEQ ID NO: 4117095 - RNA, 111 nt, Human
uuuugccuaucggagagacgugaguuguuguggccagaggacacauuguagaaaauugucuguaaagacggccaccaacaugcauguugccuuucccaucaagagguagaa

SEQ ID NO: 4117096 - RNA, 97 nt, Human
uuuugcgauggagucucgcucuguugccuaggcuggagugcaguguggcaaucuaagcucacugccugggcaacaagagugaaauuccaucucaaaa

SEQ ID NO: 4117097 - RNA, 102 nt, Human
uuuugcuucggugacugcagaauuugaaguaauauuccaauucucauuauggugaauaguguguggauguagcucagucgauucucucuucacuaagcaaga

SEQ ID NO: 4117098 - RNA, 79 nt, Human
uuuugggauagguagguaguuacacagcaauguaucuggaacauacacaucuggugugacugccagccccuuaccgaga

SEQ ID NO: 4117099 - RNA, 102 nt, Human
uuuuggguauaagugaauaagugccuuuuucuaguaccaugagauguagaauuuuauggaauuugcaaaagguuacuugacuucccucuuguccccccaaaa

SEQ ID NO: 4117100 - RNA, 61 nt, Human
uuuuggucuuggauuuaucagugguuucuaguugaauugagagagcagauccaggcuaaga

SEQ ID NO: 4117101 - RNA, 56 nt, Human
uuuuggugaauuuaagugcugugaauacucuucccacaguucgugaguuccuaaga

SEQ ID NO: 4117102 - RNA, 60 nt, Human
uuuuggugcaccuagcuuuuucuaggaaguucuaacccuacaggagguugugcaguagaa

SEQ ID NO: 4117103 - RNA, 69 nt, Human
uuuuguaacacugucuuauacuucaauguaguacaaucuauuuggggcuagagguacauguuuacaaaa

SEQ ID NO: 4117104 - RNA, 60 nt, Human
uuuuguacuagugagguuuuguuuggauaaauuccaagaaguggaauuucuuggucaaaa

SEQ ID NO: 4117105 - RNA, 78 nt, Human
uuuuguauaaucuguucuacucuauucagagccauuuuauuuuauugugcucacucuuggaguauaauagagacaaag

SEQ ID NO: 4117106 - RNA, 76 nt, Human
uuuuguauaugucauuucaauacaguuuguaaaugggcuuacugauacauuucagacuguguuggaaaauacagaa

SEQ ID NO: 4117107 - RNA, 58 nt, Human
uuuuguauccucccuuucacugaacauucagccuuagugucaggagggaaaugcaagg

SEQ ID NO: 4117108 - RNA, 106 nt, Human
uuuugucagauuauuuuugaaagauccuucucacugcaguguaagcaauauuaacacuggaaauagggagguuuuuuagaaggcuguugaaguaaucuaggcagaa

SEQ ID NO: 4117109 - RNA, 55 nt, Human
uuuugucaguugacuuugggagcugaggucuucccagguccugggacuggcagag

SEQ ID NO: 4117110 - RNA, 62 nt, Human
uuuugucaucauucugcuccucuguacuccuaaauuugagagagacagaaucagagauaaag

SEQ ID NO: 4117111 - RNA, 86 nt, Human
uuuugucauuguacuuuugucuacccugauuccagccauuguggaacuuagauguuugggucuacguagaaagaacaaugagggaa

SEQ ID NO: 4117112 - RNA, 111 nt, Human
uuuugucccucccuuuguuuucuugucaagauugacaagcauccauguguuaccaagugacauaaaguucuugcuugaauaaucaugacuaaaauccaggguauuuuaaag

SEQ ID NO: 4117113 - RNA, 60 nt, Human
uuuuguccucaguaagagggccucuggccaaaauuuggcuagcggcccauugggauaaga

SEQ ID NO: 4117114 - RNA, 66 nt, Human
uuuugugagaugcguaugaauggggguguuuaaauauaaaacacuguucuaacacgucucacagga

SEQ ID NO: 4117115 - RNA, 97 nt, Human
uuuugugcaaaguuagugaccuuuggucucuucuaaagaaugacagaguuaccguauuaacagacuugaaagagacucaguugucaaacccacagaa

SEQ ID NO: 4117116 - RNA, 79 nt, Human
uuuuguggaccuguggaaaugauauggagcaggauauaaaaguggaaucauuuugcucagcuucagaggauccccaaga

SEQ ID NO: 4117117 - RNA, 101 nt, Human
uuuuguguguaugugugugugugcuuacuuugaauuauauaacauauucccauuuaaucauuuauauugacuuuaaagaagcaaacagcauccauauggaa

SEQ ID NO: 4117118 - RNA, 76 nt, Human
uuuuguuaauaguaauggacuccagaccaagaacauuuuuagucacugugucaacaguucauacugaguaacaaaa

SEQ ID NO: 4117119 - RNA, 77 nt, Human
uuuuguugauauacaguauguacugugguuuauaauuuuuaaggcaugugaacugggacauauuggauauuacagaa

SEQ ID NO: 4117120 - RNA, 130 nt, Human
uuuuguuguuuuguuuuugcuuuuaaaaugaaggacucugguauuucacucuugaacaguaauuucucuguagcagugguuuugagauucaggguuuuucuauuuguuagggagaaaaaagagcccugag

SEQ ID NO: 4117121 - RNA, 67 nt, Human
uuuuguuucagaagucaacuagguaaagaacuacagugguucuccugggaugacuuuugaaaugaaa

SEQ ID NO: 4117122 - RNA, 105 nt, Human
uuuuguuucugugugucauuugaaagcauuuuuaugccuuaagauuguggccaacacaaggaauguaacaggaguaaaaaucaagagaaacaacagauaacagaa

SEQ ID NO: 4117123 - RNA, 86 nt, Human
uuuuguuuucaucuuauucuguuuucuuauuuuguuuuguuguuugaucaagacagaagcuaggcuagacaagugagugaacaaga

SEQ ID NO: 4117124 - RNA, 71 nt, Human
uuuuuaagaaaugcacacaacugcuggagggaguccaacuuccccaguguggugguguuguuuuauaaaaa

SEQ ID NO: 4117125 - RNA, 65 nt, Human
uuuuuaagcuccuuugaugucaggcauuauuucuugcucuucuugccugacauugagcugagaaa

SEQ ID NO: 4117126 - RNA, 79 nt, Human
uuuuuaaggcaguuugggaggcaguguugcaaaggguccaguaaucguugcaaaaucauuucucaggaugucuuagaga

SEQ ID NO: 4117127 - RNA, 80 nt, Human
uuuuuaauauacuguauauuucacaucuuggagcaaaauucaaauugccaggaaauagacacuguaugauauguuaaaga

SEQ ID NO: 4117128 - RNA, 73 nt, Human
uuuuuacuagacaauauuugaaaguaguggugcacauuguaaacauugcucugugucaaauaauggguggaag

SEQ ID NO: 4117129 - RNA, 82 nt, Human
uuuuuaguauaauugugucccaaauauugcauggggcauaaguguguuccaaauauaggaugugauauauuuauacugaaaa

SEQ ID NO: 4117130 - RNA, 79 nt, Human
uuuuuagucaacagucugguuuauauaauagauaauuugcucauuaaauguauguauuuugcuaggcugagauuaggaa

SEQ ID NO: 4117131 - RNA, 83 nt, Human
uuuuuaguuccuucaugauccuaccacauugagagcaccucucacauuuaaacaggaggauuaaagaugaaugaagcuaagaa

SEQ ID NO: 4117132 - RNA, 60 nt, Human
uuuuuaucaucuuuacgggaaugccagggugaggucugccauuucuauugaugagaaaag

SEQ ID NO: 4117133 - RNA, 60 nt, Human
uuuuuaucucuaccuguuggccucaaccuaaggguuaaagggccacucuagagaaagaaa

SEQ ID NO: 4117134 - RNA, 118 nt, Human
uuuuuaucugcuacacuaugcugagagcugugaaaaugagguuugauucaaaggcaaccuuaguguuguuuucgguccucauucuauagcuuaauucauagcaaguagcauauaagaa

SEQ ID NO: 4117135 - RNA, 65 nt, Human
uuuuuauuccugguuuauaccuguaucaaugucuugauugaaucagaaaucaucaggggugggag

SEQ ID NO: 4117136 - RNA, 76 nt, Human
uuuuuauuggaaauuacggguuuuuuaauuuaauaguaugcuuuuaaaagggauguuaucuguaaguccaugaaaa

SEQ ID NO: 4117137 - RNA, 86 nt, Human
uuuuucacaugcauuuacauggagcuaucuaacccgccugcugggaaguugggacgcuaacaugagaaucuugcauugcugggaaa

SEQ ID NO: 4117138 - RNA, 78 nt, Human
uuuuucagaagcagcauucagugaaaugugcccauaaauuguacugccuauuucauaggaucugggccuuuugagaag

SEQ ID NO: 4117139 - RNA, 87 nt, Human
uuuuucaggaacuuggguguugugucaaggaaggcguaucugugggaaccccugguguuccuugaauauaucagacgaucugagaag

SEQ ID NO: 4117140 - RNA, 85 nt, Human
uuuuucauucauuaauuuaauauucaaagaacaccugauuuaugccagccaccguuccaaguguugagauuagagggaugaagaa

SEQ ID NO: 4117141 - RNA, 67 nt, Human
uuuuucauugcagccucucuccucuaucuggccauuaaaugauagcuucugagagcacagugauaaa

SEQ ID NO: 4117142 - RNA, 124 nt, Human
uuuuuccauucaggagguuuugggccaucuucagccacccuaccagcccugaaaaggaugugacuccuguuucugggaagugugugguguguuaggugggccuacagcccugguuguggggagg

SEQ ID NO: 4117143 - RNA, 115 nt, Human
uuuuucccaggagagcuacuguugucacuaguauugccuacuguacauuuauauacacauaugugugaaaguuccuaagacuauauacaacauagguucccaccccuuggaaaaa

SEQ ID NO: 4117144 - RNA, 75 nt, Human
uuuuuccucugugccagcaguuauggugauuuguaguuaugcuauaaaagcuuaagguuugguaguagagaaaga

SEQ ID NO: 4117145 - RNA, 60 nt, Human
uuuuucuaauggcuuaggauguugcuuaucuuggcaaauguucuaugugccauugaaaag

SEQ ID NO: 4117146 - RNA, 76 nt, Human
uuuuucuagggccaucuggacucucugaguugcugccaauaggacagcagggaaaguccagaccaguccagguuaa

SEQ ID NO: 4117147 - RNA, 109 nt, Human
uuuuucuaugauccccagucucccauaauuuuccaugguuugcuaacuguaugccucuaaacagguggaaacuagugccaugcgaggggugggagaggaggaagaaaag

SEQ ID NO: 4117148 - RNA, 63 nt, Human
uuuuucuauuuccuuucccuuggagcugccugguuuaagacuuaggaaagaggauuagggaaa

SEQ ID NO: 4117149 - RNA, 64 nt, Human
uuuuucucauggaacaucguuuagaacugugggagaugcuaggcugggguuucuaugggaaaag

SEQ ID NO: 4117150 - RNA, 84 nt, Human
uuuuucugaguuagucaaaaggaaggauaugcuggauaggccuaacauaugcaguaaagacaucguccuuuggccuuggagaaa

SEQ ID NO: 4117151 - RNA, 117 nt, Human
uuuuucugcaauacuuaguuucauuuucuuggguuuucuauugucuuuggaaagugaugugaaggagaauaagauggaaagugcauggaagucaugagauagaguuuaaagggagaa

SEQ ID NO: 4117152 - RNA, 82 nt, Human
uuuuucugguccuuaauuuuaguggagagguccaugcgaagucaauuugcugagaucugccaguagauggaggaaagaaaaa

SEQ ID NO: 4117153 - RNA, 99 nt, Human
uuuuucuugcuucuuuagacuuuccuguauuuugcgaauuuucuauaaugaggcuguaggacuuuuaggaugaggggauaaacaaaggcagcagaagag

SEQ ID NO: 4117154 - RNA, 60 nt, Human
uuuuugaaggcugaugugauuaagaaguacuuagcuuucaucacugaaugccuucaagga

SEQ ID NO: 4117155 - RNA, 83 nt, Human
uuuuugcccuuccuaaaaguauggucaugggcaacuaauuaccuuauuagaaaugcucaggucaacuuaaguugggguuuaga

SEQ ID NO: 4117156 - RNA, 57 nt, Human
uuuuuggcccuuagcucuguaugucccagcuuggacucuuagagauaaggcggagaa

SEQ ID NO: 4117157 - RNA, 65 nt, Human
uuuuuguaacccagaaacugucaacaucaguuuuuuuauguguugacagucugcaguuuuaaaaa

SEQ ID NO: 4117158 - RNA, 65 nt, Human
uuuuugugaaaugggugcaggacacaucaguuuaauucauucugcauccucauuuuucacacgag

SEQ ID NO: 4117159 - RNA, 98 nt, Human
uuuuuguuucugucaucgguauuuuuguucugauuauacugguaguaucuucuuugcacaugguugaaagggugcagaaauaccagaggaaacaugaa

SEQ ID NO: 4117160 - RNA, 75 nt, Human
uuuuuuaucagcaucuuauuuucuauggaaacagucccaccuaacugaaguuccauagcuuuaagagaaagagaa

SEQ ID NO: 4117161 - RNA, 75 nt, Human
uuuuuucauguggaaaagggcuuucagaauggcagaauaaaaaccucugaaaaucuacuccuccauacaaagaaa

SEQ ID NO: 4117162 - RNA, 77 nt, Human
uuuguuuuuguuugagauggguuauugcucuuucgcccaggcuggagugcacuggcaccaucucagcucauugcaaa

SEQ ID NO: 4117163 - RNA, 129 nt, Human
uuuuaaacacugacucucaaaucucugcauuucugugacuguggaguuguuccagugugugaauugacacugguuuguggaacacacuucaaggagaaagaguguagacucaaagaauuagguugcuag

SEQ ID NO: 4117164 - RNA, 72 nt, Human
uuuuaaaguuguagagggugaugcugcuggcggcucccucccaaucagcaccauuugcagccucuuuugaag

SEQ ID NO: 4117165 - RNA, 128 nt, Human
uuuuaaaugcagucuuuguugagaggagcuguucucccagaugcuggauaauaccuaagccuuacaugguuguaggccuauguccagcaauuggugggagcacuguuaauuuuuaacuguagguuuua

SEQ ID NO: 4117166 - RNA, 62 nt, Human
uuuuaaauggcuuuuacuuuucuaagucacugaaacaaggaagggccacaugccauuuaaaa

SEQ ID NO: 4117167 - RNA, 72 nt, Human
uuuuaacuugauuaccucugugaugacauuaguuccaaauaaggacacauucggagguaguugagguuagga

SEQ ID NO: 4117168 - RNA, 88 nt, Human
uuuuaagagcuuuacuucugacuggugcucauugcuuuggaauguuucuauuaaccgcccagugggaagcuaagguggauuuuuaaaa

SEQ ID NO: 4117169 - RNA, 78 nt, Human
uugagaaauguauucuguauguuuugaaaaaugcagacugcaaaaaaauguauagagugacaucauguuaauuuuuaa

SEQ ID NO: 4117170 - RNA, 64 nt, Human
uugagaaccacugaguuagauauuucuguuauugaucuccaacuccucucuggugguucgucag

SEQ ID NO: 4117171 - RNA, 103 nt, Human
uugagaaggagucucacuccguggcccagguuggagugcagugacacgaucucggcucacugcaaccuccaccucccggguucaagcgauuuuccugccucag

SEQ ID NO: 4117172 - RNA, 85 nt, Human
uugagaaggcugcacauuugccacugagcuccucggaaccccugggauuuagagagcagauguaacaaggcguagcauucuacaa

SEQ ID NO: 4117173 - RNA, 67 nt, Human
uugagaaguucuaauuggcucuuuucuuguaacaacacccaaaggaaaacagcaauugacuuuucga

SEQ ID NO: 4117174 - RNA, 61 nt, Human
uugagacagagucuugcucugaaaccuccaccuccggguucaagcaauucuccugccucag

SEQ ID NO: 4117175 - RNA, 103 nt, Human
uugagacagggucuugcacugucacccaggcuagagugcaguggcgugaucucggcucacugcaaccuccgccucccagguucaagcgauucuccugccucag

SEQ ID NO: 4117176 - RNA, 76 nt, Human
uugagaccucugccagacugugagcuccuugagggcagaauccuuggccuuugcauccacagcacagagauuucaa

SEQ ID NO: 4117177 - RNA, 103 nt, Human
uugagacggagucucacucuguugccuaggcuggaguguaguggcgcuauuucggcucacuauaaccucugccucccggguucaagcgauucuccugucucag

SEQ ID NO: 4117178 - RNA, 87 nt, Human
aaaauaagugagcaggacaccuauaucacugguagagaauauuuauuuucccuggacagguuugggugccuguucuuaaauuauuuu

SEQ ID NO: 4117179 - RNA, 69 nt, Human
aaaauaaguggucuagucuccucauuuagauugcaaagucucuggggaaaaggcugauacuuuuauuuu

SEQ ID NO: 4117180 - RNA, 62 nt, Human
aaaauagccucacauaauugcuucuucaaguuuaguggaagcagcuaagcuguggcuguuuu

SEQ ID NO: 4117181 - RNA, 56 nt, Human
aaaauaggaaugugguccugggaauuuaauuauuccuacaauaaaauuccuguuuu

SEQ ID NO: 4117182 - RNA, 106 nt, Human
aaaauaugugugugcauguguguguauguguaugagauauagauauagauauagauauagaucauugauacuugcaucauacuuuacauuuuauaaggcauauuuu

SEQ ID NO: 4117183 - RNA, 64 nt, Human
aaaauccaaguuccacauggaccccuuaaguggggcaaucacagugauaggacauauggauuuu

SEQ ID NO: 4117184 - RNA, 56 nt, Human
aaaauccacaacgcucauuucacugaaaggucguucagguggcggugguggauuuu

SEQ ID NO: 4117185 - RNA, 57 nt, Human
aaaaucuaaguagcgaguaaggcuaauugaccagcauuuacuccuuaaugagguuuu

SEQ ID NO: 4117186 - RNA, 130 nt, Human
aaaaucucugacucccugcuauuuuucugauucaugcauuuggaagcuugaagauuauuaauucuugugacagaaagaaauaguucaggcauaaggcaugaacaaauuaugauaggguguggaguuucau

SEQ ID NO: 4117187 - RNA, 99 nt, Human
aaaaucugaaauaauauggaguuguuuuauaauugauugcaauuugcucacucuguaagucgcuuucaaguagaauacugacauauucuuuuaaauuuu

SEQ ID NO: 4117188 - RNA, 100 nt, Human
aaaaucugaaauccaaaaugccccagugugugcuuccuuugaguguuauguuguuacccaaaaagcuuuugauuuuggagcauuuuagauuuuggauuuu

SEQ ID NO: 4117189 - RNA, 60 nt, Human
aaaaucugcacaggucaguuuuaggucuggauuacuucagcuggcuuuugugaagguuuu

SEQ ID NO: 4117190 - RNA, 58 nt, Human
aaaaugacauuccagugauauuuccauaucucuaaacaucacuuggaaugugcguuuu

SEQ ID NO: 4117191 - RNA, 79 nt, Human
aaaauggugcaaagauggcaguugcaauuugaacuugagcucuaaaaauggucuauuugugguuauauuugcccauuuu

SEQ ID NO: 4117192 - RNA, 60 nt, Human
aaaauguagcuccaugccuuccacugaguauaauuucuuagugaggccagcuggcauuuu

SEQ ID NO: 4117193 - RNA, 124 nt, Human
aaaauguucaaaaguccaggcagauguuaacaaaugauuguugguuggaggaugauugaaucguuuacuauuuucucagccuuucauuuugauggaucuuugcucauucgcuuuuguucauuuu

SEQ ID NO: 4117194 - RNA, 108 nt, Human
guuacaguguuuggauguaauagaauuuguuauucauaggauuugaucuguauuuccuaaaagucuuaggaguagaauucucacauauauugucaagcuuauuguuac

SEQ ID NO: 4117195 - RNA, 115 nt, Human
guuacauauaaauagcuuaaccucuucucuuacaugugaguuauauuugcgauauuggagaacuccaggguagguugaaugugauacacauggggugagccuuaaagauauuaau

SEQ ID NO: 4117196 - RNA, 57 nt, Human
guuacauuuggugauuuggugcacacaacugucuguggucaugcacuuugauguaac

SEQ ID NO: 4117197 - RNA, 76 nt, Human
guuaccagcagagcugggaauaaaauucaagcuccuuggcucccaauucacuguuccuucugcuuugcugugugau

SEQ ID NO: 4117198 - RNA, 82 nt, Human
guuacccagccucucacagccucuuuccacaucaggcaaauggagacgcugcuuucacaggaugggggcugggaguggggac

SEQ ID NO: 4117199 - RNA, 84 nt, Human
guuaccguggccucugguuucccaguuccuccgugguguaaugaagucccagguuuuagaagcugaagccaagccuaggguagc

SEQ ID NO: 4117200 - RNA, 81 nt, Human
guuacggguuuguggaagcugugaacaagcuacgugacuuucuaaacuuuacuuaucucuguuugcagccuuaucuguaac

SEQ ID NO: 4117201 - RNA, 62 nt, Human
guuacucugguguuagucuuugcacagauugcuguggaagagacacuuacauucagagaggc

SEQ ID NO: 4117202 - RNA, 61 nt, Human
guuacugagaucacuggcuccccuucaucuucugauuacagagcccaggcaucucauuaau

SEQ ID NO: 4117203 - RNA, 86 nt, Human
guuacugcauugugguaguguggagccacugaguggcugggggaggcuaccagcucagcgggcuucugguaagacuuugcaguggc

SEQ ID NO: 4117204 - RNA, 97 nt, Human
guuacuuaacuucucuguacuucuacaucugcggaaugggaaaaauuauagcacccauuucacuggguaguuguggggguuaaaugaguuauuauac

SEQ ID NO: 4117205 - RNA, 130 nt, Human
guuagaaagaauuauugaagaaguguccaguuaaagcugaaaugauuaugacaagccuguguuauaacuaugugguaaaugucuagucuuagcucuaauuggucuuauuuuaauguguuuauuguuuaau

SEQ ID NO: 4117206 - RNA, 77 nt, Human
guuagaaaguuauugccacagacacgugaguccuaaaugcaauugugcuuacguucaaugucagucaacuuucugac

SEQ ID NO: 4117207 - RNA, 78 nt, Human
guuagaaguaguaguauaaaauugaugauaucaacaaguugauagcuucucauaauuuaugcugcccacuaauuuggc

SEQ ID NO: 4117208 - RNA, 67 nt, Human
guuagagccccagaaaacaguggugagcauuuggucguccacugugucaucuugggaugucucuagc

SEQ ID NO: 4117209 - RNA, 68 nt, Human
guuagagguucagucgcuauaauaugucaugauugguucguugaguaguguaggcugaaaaaucugac

SEQ ID NO: 4117210 - RNA, 124 nt, Human
guuagauuauuugacucuguuuuugcccaaaucacaaugugagacugagucaccaaauacguaguugaaaacuugugugcuuccuuucucccauuuugguuauaaaaacauagauuugucuuac

SEQ ID NO: 4117211 - RNA, 73 nt, Human
guuagccuaaaaauguuguuuucaugcauaauguagcuguuaaauaguacaguguuuaaaauaauaugcuaau

SEQ ID NO: 4117212 - RNA, 81 nt, Human
guuagcuugaaccacaugaaauugccauuuuguaggucauaaauaguuaaguaucaguaauugcauguguuucaaccuaac

SEQ ID NO: 4117213 - RNA, 72 nt, Human
guuagcuuuucauccugucucacuuuuugcuucuuccuugaagucuugguuuugacagggaaagggagcaac

SEQ ID NO: 4117214 - RNA, 59 nt, Human
guuaggaacacuggagccuaaaagacuccccuagccugagggagcuccauuguuauagc

SEQ ID NO: 4117215 - RNA, 79 nt, Human
guuaggagcccagcugggccugauuugcaggggcugcuaacuguacaaguuuccuacaaaaggccaaguugcucaaggc

SEQ ID NO: 4117216 - RNA, 58 nt, Human
guuaggaggacagaaauuucucaucauguggcugcagauguuauucuguuccuccagc

SEQ ID NO: 4117217 - RNA, 102 nt, Human
guuaggaggccaagaugggaggauuguuugagcccaggaguugaucaaaacccaaauccaaauaccuacuuagcauauuuucucuucugggaaguaacuaac

SEQ ID NO: 4117218 - RNA, 62 nt, Human
guuaggaguggagcaagaugaaaauuccaguuucuuucacucuaaacaguuucacucuuaau

SEQ ID NO: 4117219 - RNA, 62 nt, Human
guuaggcucuucucgcuugcuuguacuaguaaagcaaauagcagcagugagaggugucuuac

SEQ ID NO: 4117220 - RNA, 66 nt, Human
guuaggcugcucaccucccugucugcaucauccaacacgcugccgaugcuggaggagucgcugaac

SEQ ID NO: 4117221 - RNA, 58 nt, Human
guuagggaagcgcuguguucuuggggagagggaggcacaggccgucguuuaccuugac

SEQ ID NO: 4117222 - RNA, 55 nt, Human
guuaguaaguggggaaguccggaauucaaaccaggcuccagaacucuaugcuaac

SEQ ID NO: 4117223 - RNA, 64 nt, Human
guuaguggugaaugguugugaacaucuuuaaucagacuuuuaaagaugugaguauucauauggc

SEQ ID NO: 4117224 - RNA, 94 nt, Human
guuaguguaucccagauuuauuuuacauccuucaucuccugacacgcagagcuagcucaguguuuuccugcaggcuguuugguggaucucuaau

SEQ ID NO: 4117225 - RNA, 77 nt, Human
guuauacaguuuauacuuagaauuuuuacucacucuuggguaguuaugcgaaauauucuaagaugugaucuuauaac

SEQ ID NO: 4117226 - RNA, 80 nt, Human
guuauaguuucauccgaucuggucucaaguuuauagucuuaagugaacugauauauacauggagaaagaccaucuaugac

SEQ ID NO: 4117227 - RNA, 73 nt, Human
guuaucacaagcaauucaaccuaagugcauccagcaaaauggauaccuuagguuaggauucccgcuagaaaau

SEQ ID NO: 4117228 - RNA, 83 nt, Human
guuauccacaguguuauuucugaguaauggauaauuugguuaaaauaauaugaaacuauuauuuaggaaacauuguguucaac

SEQ ID NO: 4117229 - RNA, 55 nt, Human
guuaucugagagucugaguuacaagguaacucagaaaccagcucucucaauuaau

SEQ ID NO: 4117230 - RNA, 75 nt, Human
guuaucugugugcauggcaucauugcagccaccauccuccggucuugucuuuggcuggccauucaaacagguagc

SEQ ID NO: 4117231 - RNA, 60 nt, Human
guuaugaacaccaagaggcgguucacggggagaugccaguagagccagugguguucugac

SEQ ID NO: 4117232 - RNA, 68 nt, Human
guuaugaagucauucacaaauaauuuguuacugauaaugauuaaaucuaugugugaaugaguuuuagc

SEQ ID NO: 4117233 - RNA, 84 nt, Human
guuauggggcaguccuuucucuuuguagcacuuuacugguccucaccugaggacugaugauggugcugacagacugcccucuac

SEQ ID NO: 4117234 - RNA, 71 nt, Human
guuauguauauguguguugacaacuugccaugaaguccuggcaaagauguuuucaacacaauaaauguaac

SEQ ID NO: 4117235 - RNA, 83 nt, Human
guuauuacauguucagguagucucuaucauuacuccauaggacuuuggaaaaauggcaaaaggaguuaguugaaaagaauggc

SEQ ID NO: 4117236 - RNA, 66 nt, Human
guuauuagcuaagauuuauuaaaggcccucuguuuuaggggcuucauaugauuuuaucucaauaau

SEQ ID NO: 4117237 - RNA, 75 nt, Human
guuauuaucuugaggaaucugucggugaaaguaguauuuagacuucaacaagcagaaggccucuugguuaauaac

SEQ ID NO: 4117238 - RNA, 96 nt, Human
guuauucccucggcugagugggggccaacgagggcagcgcggcaaaccucacaccuggcggcuggcugugggcuccacgcucccuuagggaauaac

SEQ ID NO: 4117239 - RNA, 81 nt, Human
guuauucucaaaugcagacuuauucaaguugguuaugauagagcaguuagaacuuagaagaugauucuguguuuggaaugc

SEQ ID NO: 4117240 - RNA, 55 nt, Human
guuauucugccaaacuuccacaagaagaagagaauugugaaagcaguagaaugac

SEQ ID NO: 4117241 - RNA, 94 nt, Human
guuauucuucuacaucuuggugugaaacagguacacaggacaaaguacuuggaacaaguaguugcugguguccuuuauauugaggugucauagc

SEQ ID NO: 4117242 - RNA, 74 nt, Human
guuauugcagauggcacagauuuagagugcaucuuuuauguauaugaaaauguucugugcauuuauagcaaaac

SEQ ID NO: 4117243 - RNA, 64 nt, Human
guuauuggagaaagugcuggggcucuguccaaaugucagcccaggucagcucuucuccaguaac

SEQ ID NO: 4117244 - RNA, 80 nt, Human
guuauuuagcaagaguacaaaauaaaaucugaauuuacauggcucuuuuaagaaauuguuuuguagauuugauaaguagc

SEQ ID NO: 4117245 - RNA, 88 nt, Human
guuauuuccauggguuuuucccacucccacugauuuugguguaguuucugaucaaucaugauggugggagaugacccaguuucauaac

SEQ ID NO: 4117246 - RNA, 115 nt, Human
guuauuugcauauauguuacaggcauuaugaacaauuucuaggaaugacuuaugaacauuauacauauugucuaggaauuguuuaaaauuccugauuuaacauucugccuauaac

SEQ ID NO: 4117247 - RNA, 62 nt, Human
guuauuugcugaguuauacggggagauuuuuacuuuggauuucaaauuacucugcagaugac

SEQ ID NO: 4117248 - RNA, 73 nt, Human
guuauuuuguucuuuuuguauauagaaacauuuaguaaguauuuacuggauuccauugugcaaagagcauagc

SEQ ID NO: 4117249 - RNA, 83 nt, Human
guucaaaagcaaguauagaauccaccuacacaagagacuuuguucagaguuauuugauuuggauuccuacugugcaaugacac

SEQ ID NO: 4117250 - RNA, 72 nt, Human
guucaaauaucaggaugguuauguagugauauagauucacacagauucacaaacacauccagaguauuugac

SEQ ID NO: 4117251 - RNA, 61 nt, Human
guucaaggcugaggugugcugugaucgcaccugugaauagcuacugcacuucaaccugggc

SEQ ID NO: 4117252 - RNA, 64 nt, Human
guucaagguuuuacagaguguaaagugaauuugaacaagauaccucuuugugaaauuuuagaac

SEQ ID NO: 4117253 - RNA, 60 nt, Human
guucaaguuucugagcuuuaauuugaaagaaugacaaaauaaggauuuggaagccugaau

SEQ ID NO: 4117254 - RNA, 77 nt, Human
guucaauaaauuauuggugaauugaauggcuaggguaaucuccuugcucuuacauucuuuuacuagcauauauuaac

SEQ ID NO: 4117255 - RNA, 74 nt, Human
guucaauuaaguuacaaauuuaucugagacuucagcucagcuucagacccaugauaugugucuuggucaugaac

SEQ ID NO: 4117256 - RNA, 61 nt, Human
guucacagaaggccagaugguaggaagucuacacuuauuccuccuuuugucuuuugugaac

SEQ ID NO: 4117257 - RNA, 86 nt, Human
guucacagccaugcugcuugcauccauguaugucagauuaccuaucuuuuugcuacauaccacgaugcaguaucauacuuguuaau

SEQ ID NO: 4117258 - RNA, 115 nt, Human
guucaccaucccgcuggauguuuucuuuuagugauuuuguccugacaaacagcaagugcaguucugccuccguguucuccagagauaaucuaaaagaagaaaggggagagugggc

SEQ ID NO: 4117259 - RNA, 127 nt, Human
guucaccugcagggcuguauccaccuaguggggaaaucauuugcucauuuguacaaaggcucuggagccauaugggcuaacgaaggccuugccaaugagagaacucccuaccccuugccucggugac

SEQ ID NO: 4117260 - RNA, 57 nt, Human
guucacuggcugcagcaaauggaccacucuguuguaaagugcugauggugagggagc

SEQ ID NO: 4117261 - RNA, 66 nt, Human
guucacuguagugagcagaauauauuuccccaucccaaugagauauuaaugaacaugacagugagc

SEQ ID NO: 4117262 - RNA, 56 nt, Human
guucagaagucaggguaaaugacaucauggguauuuuuguugcccugauuuuuaac

SEQ ID NO: 4117263 - RNA, 78 nt, Human
guucagaagucuuauuugucauguaugugaaugaugcccuaucaguaucugagaaacaacaggaaaucagaccugaac

SEQ ID NO: 4117264 - RNA, 74 nt, Human
guucagaugucaacacuaaagaauaaucuuugaggcuccuagacuuaaaguguuuucugauguguucucugaau

SEQ ID NO: 4117265 - RNA, 61 nt, Human
guucagcaaguacucaguccacagcaguagcuccaaauauuggcugaguggaugcaugaau

SEQ ID NO: 4117266 - RNA, 102 nt, Human
guucagcuguauuguguauuauugauuucugcuuacucacuguaguuuuauugcacagugggcuuagggaauuaaugaguuuuauguuaaaugcuuaaggac

SEQ ID NO: 4117267 - RNA, 68 nt, Human
guucaggaaagcuugcuagguuuccacgccggaaagcccaaggagaaggagccagcaggccucugagc

SEQ ID NO: 4117268 - RNA, 72 nt, Human
guucaggaugccccugccuggcccagaaaccacacugccaugaaugggucaggacauuuuaccauccugugc

SEQ ID NO: 4117269 - RNA, 69 nt, Human
guucaggccagaugauguuccuaauccugcaaggucugggguacuuucaucugauaagagcccaugagc

SEQ ID NO: 4117270 - RNA, 62 nt, Human
guucagguguggaccgaggucagaucuguuuugacaaggacucuggcccuguccaccugggu

SEQ ID NO: 4117271 - RNA, 59 nt, Human
guucaguacuuaguggagaauuauuaucaauugaucauuuuccacuuuagugcaauaac

SEQ ID NO: 4117272 - RNA, 65 nt, Human
guucaguaggauccacagccucuuggaagacagcaacccaggaagcauguuggauccacuugggc

SEQ ID NO: 4117273 - RNA, 86 nt, Human
guucaguccucuugugaucucuacucuugucuccagccaaugucucugugacccuuggcucugaccagguagaggagauacugagc

SEQ ID NO: 4117274 - RNA, 57 nt, Human
guucagugaaggggagcuguuuugaugacuaccucucccuuugaucacuaacagaac

SEQ ID NO: 4117275 - RNA, 65 nt, Human
guucaguggcugcagggaccgagggcuccuuccuuccaaagcccuuccuccucgccugucagaau

SEQ ID NO: 4117276 - RNA, 57 nt, Human
guucaguucugggucuggacacacagagguuaggcaggcucuggcucaggacugaac

SEQ ID NO: 4117277 - RNA, 87 nt, Human
guucaguugcccuggaacuccuaggcaagcagaaaacucuggaaacagaaaccaugaaaccuacggaguucccagaggaaacuggac

SEQ ID NO: 4117278 - RNA, 68 nt, Human
guucaguuuuacccaagcuuauuuuagguaaucaaaaccuagagcaauuagcuuagguaaaacuuaau

SEQ ID NO: 4117279 - RNA, 79 nt, Human
guucaguuuuugacacgugauuauagaagcaguuugucaaucuccacaauaaagucuaauccguuuaauaauacugaau

SEQ ID NO: 4117280 - RNA, 66 nt, Human
guucauaaagauuucuuuuucucuacuuaauaugcuaaggaguaggggaaagagagauuuuuuaac

SEQ ID NO: 4117281 - RNA, 69 nt, Human
guucauagauaaagccuaggagucugcuguuuauguaggaaccucaaauaaguuuuauuuauccugaac

SEQ ID NO: 4117282 - RNA, 56 nt, Human
guucaucacucagagaccucccucagggcugggggacauggacugugaauggggac

SEQ ID NO: 4117283 - RNA, 78 nt, Human
guucaucaggcaagaagucaugcugcacaggucugcuaaaaaccagcacccuggcuuugaccuugcuguuuuaugagc

SEQ ID NO: 4117284 - RNA, 58 nt, Human
guucaugacucuuucauaaaugcauauaaacuugagcuucagugaagagucauugaau

SEQ ID NO: 4117285 - RNA, 60 nt, Human
guucaugagcccugaggaucuguucgguaaugguccaauagaacaucagggcuccuggau

SEQ ID NO: 4117286 - RNA, 80 nt, Human
guucaugggagcgagguggggcaccaaacacucgugucucucucugaggcuggaucuaugccacacucacuucuguggac

SEQ ID NO: 4117287 - RNA, 62 nt, Human
guucauguggaaauuuaaaacauuauuugaauuuuauguguuuuaccuucuuccaccuggau

SEQ ID NO: 4117288 - RNA, 123 nt, Human
guucauguggugcuuuuaugugucuaugcguugggguuauguguguggaccacguaugugugucagaguuuguauguggacacacauguaugucagaggagaugcaugguggcuugugugugc

SEQ ID NO: 4117289 - RNA, 79 nt, Human
guucauuaauaaacacuuuauaugucauggaaacuuuugcucucugcaggaacauacuguguagacuuugauaaugaac

SEQ ID NO: 4117290 - RNA, 70 nt, Human
guucauuacucccugacaggccaugggcuucgugacauaugaauuucauuauugccagggauuagaaagc

SEQ ID NO: 4117291 - RNA, 55 nt, Human
guucauucauuuauucguucaacaaaaauuguugaaugaccaugaugcaagggac

SEQ ID NO: 4117292 - RNA, 72 nt, Human
guucauuguugugucucagcagguagcauauaguagauacucucuaaauguuugugggauaaacaaaugaau

SEQ ID NO: 4117293 - RNA, 59 nt, Human
guucauuuuuacuuugaucuacuguuauuaugagaaaguggauugaggugacagugugc

SEQ ID NO: 4117294 - RNA, 59 nt, Human
guucauuuuuagaaugcuaguaaauuauagauauugaaaaucuggcuuuagaaaugagc

SEQ ID NO: 4117295 - RNA, 111 nt, Human
guuccacuaaagaacuggugacucugggacuagaauuuguaagaucaguguagacuaggaugggauuuacaauucuggugccagcuacuaaucuucuuguucuuuugagac

SEQ ID NO: 4117296 - RNA, 69 nt, Human
guuccagauacuuaguaagcuuuuuaaacaaaugguuuuguacuuacagagcuuauaaguuaaugggau

SEQ ID NO: 4117297 - RNA, 65 nt, Human
guuccagcauagcucccagggcugggccuggauacuucuagcuuggcugugagcuuugcuguggc

SEQ ID NO: 4117298 - RNA, 55 nt, Human
guuccaguaugauuccacccauggcaaauuccauggcaccaucaaggcugagaac
